United States Patent 7,888,497 (BIOINFORMATICALLY DETECTABLE GROUP OF NOVEL REGULATORY OLIGONUCLEOTIDES AND USES THEREOF) - sequence listing, part 162

SEQ ID NO: 6821654 - DNA, 120 bp, Homo sapiens
tctttaggtttaggaggagatactaagatactggatgtttatcctatcttagtttggttggagtaataagagagaagaagagggtggactttggcttttcagtgttttttcccctaaaga

SEQ ID NO: 6821655 - DNA, 95 bp, Homo sapiens
gcttaagagataggttggtgcaaaagtaattgaggtttttgccatcactttccatggcaaaaccgcaattacttttgcaccaacccaatacttgc

SEQ ID NO: 6821656 - DNA, 123 bp, Homo sapiens
tatcaaccctgatcccctggcagcatgtcccctgcagtcctttcttggctctaggtttggtggccaggacattgccaggcacttcaggacataagacaaagccaggagccatgggggaagata

SEQ ID NO: 6821657 - DNA, 79 bp, Homo sapiens
catagcattccactatgtagacatggcgtaatttgtccaaccataccgcaatgattgctatttacataaaaatgctgtg

SEQ ID NO: 6821658 - DNA, 80 bp, Homo sapiens
ggaggtgattgaaaggactgttttttcttctagggccctttgttggtaagagaagattgaaagagtccattgtttcctcc

SEQ ID NO: 6821659 - DNA, 56 bp, Homo sapiens
gggagtgtgcagaagctggggggtaaatgcaatcttgagaaattcagcacagttcc

SEQ ID NO: 6821660 - DNA, 68 bp, Homo sapiens
tacacatgtttggcaagtatgtccaggctcaaaaccttgaaaccaagcatgctgcaaaaccatatgta

SEQ ID NO: 6821661 - DNA, 64 bp, Homo sapiens
gctctgcatcataaaatttagagttgaagacagatgctgtaacttaaaaggattgatgctgggc

SEQ ID NO: 6821662 - DNA, 67 bp, Homo sapiens
gttgcagttcttgcagacaaatgtgttccagtcctttgctacacagagtggtttgtagaatagcagc

SEQ ID NO: 6821663 - DNA, 68 bp, Homo sapiens
gcgaatcttgaggtttcatgaggcaaatatgtattactttttagccttttgaaatctataggttgtgt

SEQ ID NO: 6821664 - DNA, 68 bp, Homo sapiens
gaaaaattatccaggaggaactcattttgcattaatgttgatataaagtgtaattctccaggattttc

SEQ ID NO: 6821665 - DNA, 84 bp, Homo sapiens
tacttacatacccagctggggaagtggggcatatggttctacatatcttattttatttctccaaaacatgctaagtggtaggta

SEQ ID NO: 6821666 - DNA, 67 bp, Homo sapiens
aagatgatgtgttagcttagtggatatttcctgttaacatattcattacagttaattacaacatctt

SEQ ID NO: 6821667 - DNA, 60 bp, Homo sapiens
taggggcaggtggcaaggcctggctgggccttccttcctggcctcagccacctggctctg

SEQ ID NO: 6821668 - DNA, 82 bp, Homo sapiens
gggtaagaggaagaaattgaattcatgagcttaaggcatgagcaatgaagccaggagctgaacaatatcttacttcataccc

SEQ ID NO: 6821669 - DNA, 68 bp, Homo sapiens
cttctatgaggagagacatgcacaggaacaaaagaataactcttcagcatttttctctcctataggag

SEQ ID NO: 6821670 - DNA, 111 bp, Homo sapiens
atgcatccctacattttcatgggcagcaaggtggcggaaatgagtaatgtagcaattgaatgggcagataattttttcggccatctgttgtgcatatgtctagcggatcat

SEQ ID NO: 6821671 - DNA, 128 bp, Homo sapiens
ccaggtccaaagcgtgggaactggagaaaggccactagtcactcagcactgacaaatatagtaaactcctgctgtctttgttagagtgtgggaggctggggaagggaggaggttgatacaggatgagg

SEQ ID NO: 6821672 - DNA, 76 bp, Homo sapiens
cttcagttatgggcaactgaaaaattgtattcatatgaattgtgcaatataaccagttgtcatgcaataattaaag

SEQ ID NO: 6821673 - DNA, 68 bp, Homo sapiens
ggcaatctccggccagacaggactcctttcctggtgagggacgaggagcctgtggcctggtattgatc

SEQ ID NO: 6821674 - DNA, 66 bp, Homo sapiens
gatccccttgagccagggagctggcagacactgagggtgctgccctgcctatgggtcgagggtttt

SEQ ID NO: 6821675 - DNA, 99 bp, Homo sapiens
aggaatttttaaaacattagttacagaatgtacagaggtttatggtttatttcccagatagcttgtgtttttctaagtatctgatttttatttatttct

SEQ ID NO: 6821676 - DNA, 85 bp, Homo sapiens
caatatttaacaatgaatatcatgaagtactagtgcaaccttataacttggacagtattatagagtttattgtttatgaaaattg

SEQ ID NO: 6821677 - DNA, 75 bp, Homo sapiens
cagagatgtgatccagctgtcttctccagtaccctaagaaagaagagaaaccccgccatctggatgattctcctg

SEQ ID NO: 6821678 - DNA, 57 bp, Homo sapiens
gtggccaaggtttattttgatacattggacaaagtgcagtcttctgagccttgctat

SEQ ID NO: 6821679 - DNA, 76 bp, Homo sapiens
tcatcctcttgttcagagttgcaacaacgctgtttcacacagcgtccttgcaagatctgtacaaggaataggatgg

SEQ ID NO: 6821680 - DNA, 57 bp, Homo sapiens
actgtaaagttacgatcaagttgtaaccacaattttgcccttgaagaattttgcagt

SEQ ID NO: 6821681 - DNA, 82 bp, Homo sapiens
tgcccacagtacgttttaaacacggagccagcatttttaaagtttagatttctggctcctgtttaaccagctgctgtgagta

SEQ ID NO: 6821682 - DNA, 98 bp, Homo sapiens
gagatggagtcttgctgtgtcaccaggctggagtgcagtggcgcgatcttgactcaatgcaacctccacctcccgggttcaagcaattctcctgcctc

SEQ ID NO: 6821683 - DNA, 102 bp, Homo sapiens
aggacatgaaagatggccaggctggctggagctcaggcccagcaaggccccctgggggccatggtcatgggtgagcttgggtttggcttctgttttcgtctt

SEQ ID NO: 6821684 - DNA, 124 bp, Homo sapiens
ggagcatttggtcaggtcatgggatgccaagcatgccttgcaaagcagtcttctgtgcctaaggctccttccttgcagaaacagagttttgccatgtccttattcctcactgctcataacctcc

SEQ ID NO: 6821685 - DNA, 84 bp, Homo sapiens
tttcctccatctctgcatcatttttcagagccggccagtttctatggcaacggttagattgaaagatgagcggcgagcaggaga

SEQ ID NO: 6821686 - DNA, 104 bp, Homo sapiens
gaaatctgttttccttccctgtctgtctccatctctgctgtgtctctgtggcttctgtgtctctttcacagtggatcctctgactccctcttattctggctttc

SEQ ID NO: 6821687 - DNA, 61 bp, Homo sapiens
aaggtcagagcaggaaggagtcccgtgagcataccatcctctcttacccacctctgacttt

SEQ ID NO: 6821688 - DNA, 56 bp, Homo sapiens
gggaacttgccccagaggaatttcccctgctggaatgttcctttaatgtagttccc

SEQ ID NO: 6821689 - DNA, 61 bp, Homo sapiens
tgccaggctctggcctactggagtccatgatacttttgtgtcatgcaggcagagtttggta

SEQ ID NO: 6821690 - DNA, 102 bp, Homo sapiens
tccagatactcttttgaaggattatgtaactaagtaatagcttaaaaggtaatagttaatatcttggcatgtattagttggcagttgttgaaaaggagagga

SEQ ID NO: 6821691 - DNA, 79 bp, Homo sapiens
cgccacttaatgaacctgtttgtggagagtccacctggtgcctgcctggctttaggaacccgcagcagtccgagtggtg

SEQ ID NO: 6821692 - DNA, 59 bp, Homo sapiens
ggctctgaggttcctttgccctcgccttgctgaatggtgagccgctgcctctcggagcc

SEQ ID NO: 6821693 - DNA, 71 bp, Homo sapiens
gtggcaaagcagagggtatggccaggtttggtttctaccccaacccatttgccatccctgttgtgtcccgc

SEQ ID NO: 6821694 - DNA, 55 bp, Homo sapiens
gccagcatccctggggttggccagagtccctgccagtgagccctgggatgtgggc

SEQ ID NO: 6821695 - DNA, 130 bp, Homo sapiens
agagtttttctttgtagagtctttgcaaggcttagtgcacttttccacatccatagcagataacgattttgctctgggcttggttagggctgttgaaggctcactgtttgacgatacggtgacagacttt

SEQ ID NO: 6821696 - DNA, 74 bp, Homo sapiens
gttgcagtgagcagagatcgcgtgattgcactccagtctcagtgacaagagtgaaactctgtctcaaaaacaac

SEQ ID NO: 6821697 - DNA, 68 bp, Homo sapiens
acttttagtgaatggtacatgtcttagtcttcgtgggcttacatgacagaataccattgactaggtgt

SEQ ID NO: 6821698 - DNA, 70 bp, Homo sapiens
aggatgtgagccagcctggcctgctcaccatggtgggcctaatatctagtgttaggcgtatttaggtcct

SEQ ID NO: 6821699 - DNA, 81 bp, Homo sapiens
ctgaacgaacattgtttctgaccatgatgagctttttatggatagtcaatgctcacaatgttggagaaacagatcgttcag

SEQ ID NO: 6821700 - DNA, 81 bp, Homo sapiens
agctgctttctgcatgctgtgccttctctgtgccagtctctgcttggcacagacagcacagcaatgaacaagggagtggct

SEQ ID NO: 6821701 - DNA, 65 bp, Homo sapiens
tcagtctcactgggtacatgagaaggttggaatcaacatgcttagttgcctcagtgggcacttga

SEQ ID NO: 6821702 - DNA, 56 bp, Homo sapiens
tgcatctcacacttgtatttccaaagaataaacaggctcagcaaaggtgaggtgca

SEQ ID NO: 6821703 - DNA, 56 bp, Homo sapiens
tggaggcccccaggcaacagcactgatcagctctctgctgctcctctgggcttcca

SEQ ID NO: 6821704 - DNA, 56 bp, Homo sapiens
ctgagagcacacactctgggaatgtaatccaccaccctctggctgtgtgttcttag

SEQ ID NO: 6821705 - DNA, 57 bp, Homo sapiens
tggcccatgtatgtgtcagggtttgcttagggacccccaaacatgatcatggtgcca

SEQ ID NO: 6821706 - DNA, 68 bp, Homo sapiens
gagaagggctggtctagaaagggagaggggaaattccgtctctcatccctgtctgccactctgaaatc

SEQ ID NO: 6821707 - DNA, 81 bp, Homo sapiens
agtagctcttctacagggatgaccagagggatgtgagtactgatttaagaccacttccagggtcccctgaaggaagactct

SEQ ID NO: 6821708 - DNA, 70 bp, Homo sapiens
gttctcaggcatagttggcttttttgatgaaaacaaaagcttgattaaattagcaaactgtgaaaagggc

SEQ ID NO: 6821709 - DNA, 61 bp, Homo sapiens
ggttcctgtgcctctagctggccgggccacaagcatttctccagctgctggcccagggacc

SEQ ID NO: 6821710 - DNA, 72 bp, Homo sapiens
gctgggtgcctgaggcccaaggactctgtcccgccatacacagggtgggacggggcagggcgggcattgagc

SEQ ID NO: 6821711 - DNA, 76 bp, Homo sapiens
gtggccggtctgcgttctgtctgccttgtctctggaaagaacgagagaacacaagacagaggctgaggctggccgc

SEQ ID NO: 6821712 - DNA, 96 bp, Homo sapiens
ctccaaggatggtgcttagcatatggtcagcactcagtaaatatctgttgaatgagtgcctgaacatagagtagctaagaaaaactatttttgaag

SEQ ID NO: 6821713 - DNA, 60 bp, Homo sapiens
ggagcaagaggtggtgaaaaatgtttatttactctgcattagtggctaacctcctgttcc

SEQ ID NO: 6821714 - DNA, 77 bp, Homo sapiens
ttcatggcttcatgggagtctgcaaatgactgacaagccttaaggttgcaggctggcagatatctcatgctactgag

SEQ ID NO: 6821715 - DNA, 80 bp, Homo sapiens
ctaagctgtcaagtctgcctaaccttcatgttctgtacaagtaggaggagaaggctaaggcagagttgtaaactgtttgg

SEQ ID NO: 6821716 - DNA, 116 bp, Homo sapiens
cagcttggactatagaatatgacagaaatgatcatgtaatttcagaagctgggtcataaaagaagatgtgacttctgtcctgttggatgaatcattcatgtttgcagcccgagctg

SEQ ID NO: 6821717 - DNA, 64 bp, Homo sapiens
ttggagtagatggttatggattagcaaattgtatagcttgttaagttctatgaatctactccaa

SEQ ID NO: 6821718 - DNA, 100 bp, Homo sapiens
gttaagagtatgcatactttagagctagattgcctgagttcaaataccagctctgctaattcctgggcaatctactgaagtattttgtgtatctgtttgc

SEQ ID NO: 6821719 - DNA, 110 bp, Homo sapiens
aaagatgactcaatatggtggtagatggggtaggagggagttgaagagtatgggctctacatgcttccaactgccccatcctaagctcctaccctattccttctatcttt

SEQ ID NO: 6821720 - DNA, 80 bp, Homo sapiens
tcaaggtgtcagcagggccatattgtgtgacggctctagagaagcctcttctagttctggtatttgctgacaattcttga

SEQ ID NO: 6821721 - DNA, 67 bp, Homo sapiens
gtgcctgccatcagaaacactcaaagccctctcgtttgggttttgaaatggactctggtggagatgc

SEQ ID NO: 6821722 - DNA, 96 bp, Homo sapiens
tcaaggaaatttcaggggtaagcagggtcattacagtggtatctccagttctatttcacagtgatgaatcctctatgccttttggggattctttgg

SEQ ID NO: 6821723 - DNA, 107 bp, Homo sapiens
ctggctccccacgtttgggcttcatttttgtctccggtttgtgctactctttcttcatccaaaaaggcgttggagatcccgagaatctgctgcagcttggaagccag

SEQ ID NO: 6821724 - DNA, 59 bp, Homo sapiens
ttctttaccctctctgcaccctttctgtaagggaaatttatgcagagagaggcaaagaa

SEQ ID NO: 6821725 - DNA, 79 bp, Homo sapiens
gcattgctgtccagacgagggcctggcacacagtgtgttcttgtaaatgctgtactcgggttctcatcctcacagctgc

SEQ ID NO: 6821726 - DNA, 123 bp, Homo sapiens
gtcacttagctaattaattccagggctggaacatgggctatctgtaaatttgaggttcttgctttaatgcaaaagaattatgcatcaggtgtgcaccatgttggttgaggaaaaagaagtggc

SEQ ID NO: 6821727 - DNA, 99 bp, Homo sapiens
ggcaatgaaagcttttaaggaggacacacagaatacaaatccacaggagtgaaacttaaaaggctctgcaggtctgtgactgccccctgctttcatgcc

SEQ ID NO: 6821728 - DNA, 68 bp, Homo sapiens
cagagcctggtgtggggctgcagaggagcctggctcaccaggcctctgctttccactgccagggtttg

SEQ ID NO: 6821729 - DNA, 59 bp, Homo sapiens
tgtggcctggagtttgatgtaggccagtggtgtctggctccttgcacctctaggccaca

SEQ ID NO: 6821730 - DNA, 70 bp, Homo sapiens
gggaatagttcagggttatttcaaggtcagattcacttcatgatcagaaacgttacctagggctgttcct

SEQ ID NO: 6821731 - DNA, 78 bp, Homo sapiens
tcgtgtgggaaatgggaggtctgagccgtggggggtgttctccagcccatggctcttaccttgttataatctcactga

SEQ ID NO: 6821732 - DNA, 70 bp, Homo sapiens
acgtgaaatcttgagaaacatctaatctttgtgttgaaagacagtaatattttacatgtttcttgcatgt

SEQ ID NO: 6821733 - DNA, 60 bp, Homo sapiens
ttcatcttctgtttcccagcttttcagatgcctgatagtcataggcaaatagaagaagaa

SEQ ID NO: 6821734 - DNA, 69 bp, Homo sapiens
ctaccagttctggctttacttcccatccagcagcacactggatattgaagaaagtcagtgaaatgttag

SEQ ID NO: 6821735 - DNA, 102 bp, Homo sapiens
aggaagggagacaggtgctagagtagagagagtcttagggctaattcaagtggtagattggccaggtccatttctccatctgggcctcagtttcctcatcct

SEQ ID NO: 6821736 - DNA, 88 bp, Homo sapiens
aagacgctgacccatgaatgccacgatttcatcctgcagttttctcaatgtgagtgactgtgcgcccttcatctgggtcaggcgtctt

SEQ ID NO: 6821737 - DNA, 67 bp, Homo sapiens
ttggcttcccagtttgaccattagactttggaaaaaattttctaaactagggttaaaggaaagccag

SEQ ID NO: 6821738 - DNA, 72 bp, Homo sapiens
aggcaggggaaggccatggccataggactacagcactttccgggcgcttttggccacccctttctctgcact

SEQ ID NO: 6821739 - DNA, 60 bp, Homo sapiens
cgaggacctgtgtcaacacgtcgccagcaccagccagcccggtttgcccacatgtccttg

SEQ ID NO: 6821740 - DNA, 67 bp, Homo sapiens
gagtgtgaacgctgctgctttctggtgctgtttcctgcaagccacaatctgcatcagcattcatctc

SEQ ID NO: 6821741 - DNA, 107 bp, Homo sapiens
tgttttcaaaaaagaaacatggaaagagcaagggctttgaggctggctgaaactggctcaaaccctggcctcagcagcttgttaactctatgacttttgggaaaaca

SEQ ID NO: 6821742 - DNA, 81 bp, Homo sapiens
gttttcagacaaaggctgcctaaaagctggggcccacattgtggctctgtggcattcatgggcagtattgtttttgaaggc

SEQ ID NO: 6821743 - DNA, 76 bp, Homo sapiens
atgtgtgtgtgtgcgcgtgtatatatgtatacatctatgtgtgtgtatatgtgtatatatgtgtgtgtatatatat

SEQ ID NO: 6821744 - DNA, 65 bp, Homo sapiens
ttgatttattgcactattgattttctagacttaagcaagtgatggagaaagtgtcaatgattcag

SEQ ID NO: 6821745 - DNA, 55 bp, Homo sapiens
ccatgtgcctctgagaagtgagcttccccagccaagcccacaggaggacatatgg

SEQ ID NO: 6821746 - DNA, 86 bp, Homo sapiens
tcgaggactctgtgggtggtagccatgggcaaatgcagagctgctgctgttgctttgcagtgcctgtaggacttagagggcctgga

SEQ ID NO: 6821747 - DNA, 57 bp, Homo sapiens
gtaatggagaataaatatgcttggattattaatctggagaatgtttgtctccgtggc

SEQ ID NO: 6821748 - DNA, 104 bp, Homo sapiens
ctccagaataaataagaaaatttccattgcagtaatccaggtaagacataatagggccttaacaaagaccattacacttggattgtaaagggatcaatatggag

SEQ ID NO: 6821749 - DNA, 92 bp, Homo sapiens
cagcaaatgtttagtgagaaatgtaggcataattattttactgaaatattttacaaagaaaaatgtgctacttttgtgctatttttgtgctg

SEQ ID NO: 6821750 - DNA, 95 bp, Homo sapiens
gccaggagtcgagggacataaacgttgctatttactgcaagagcttatcctgagcttggcctgcaggcagcagcgcatgtgccgattaaacccgc

SEQ ID NO: 6821751 - DNA, 81 bp, Homo sapiens
gatttatcaggcttcttctctgtgtccagcactgagtggaacagcatgcaaggcacacagggggtaagagccacagagatc

SEQ ID NO: 6821752 - DNA, 60 bp, Homo sapiens
gacaaattaatgaatggatgaatcaatggatcgatcagtcggtccaccagtcaatctgtc

SEQ ID NO: 6821753 - DNA, 62 bp, Homo sapiens
ttcagtttgctgaactaaaattctgaaggtctggttttcaggtgtgatgtctgcgaactgga

SEQ ID NO: 6821754 - DNA, 107 bp, Homo sapiens
gctgacaaaagtacagtcagagaaggatttacctccagctaggctgggtaggaattttctgcagctaggctgtaggtaaattactgtttggtgtactttgggccagc

SEQ ID NO: 6821755 - DNA, 66 bp, Homo sapiens
ccggcgcagcttcagggccaggagggcggccccgtgcacgtccccatgaacttgtggctgctccgg

SEQ ID NO: 6821756 - DNA, 56 bp, Homo sapiens
agccagtggaattcccaggggtttctcaaacatacctttgggacttatccatggct

SEQ ID NO: 6821757 - DNA, 100 bp, Homo sapiens
tcttagccaagttttacagttgttatatgtgggagtttccaagatcttaaaaggcagagaaagcatcctatatgtaaactgtgttttaaataggtgaaga

SEQ ID NO: 6821758 - DNA, 65 bp, Homo sapiens
tccagtagttggacaaatagattcggtctcacaagaggggaataatttgtgtattcaactaggga

SEQ ID NO: 6821759 - DNA, 130 bp, Homo sapiens
tcaaaaactctaattattttatagatattaaaggtgttgcaggaagcacaagtctgagaccagaatacctacttaggacttccttcctagcctacttatttttaaaccaccatttctgaaaaagcattga

SEQ ID NO: 6821760 - DNA, 63 bp, Homo sapiens
gttgaatgactccttcgtctgggtagctgcacaaggcagacagacctggcagtcatcctcaac

SEQ ID NO: 6821761 - DNA, 99 bp, Homo sapiens
cagcaaatgcaggcctctgcaggtggttttggctgacagcaatatctagcattggtgcacaggtggtccatctgcaccctgagaccctgcagtgtgctg

SEQ ID NO: 6821762 - DNA, 67 bp, Homo sapiens
tttggagctgtggctttctgtttctgtttttggtttaatctgtattgagagccacagcgtgcacaga

SEQ ID NO: 6821763 - DNA, 68 bp, Homo sapiens
gctgcacacatgtgggatccgcagggcattagagaaaccctgacccagtggcccagcatgtggtgagc

SEQ ID NO: 6821764 - DNA, 74 bp, Homo sapiens
ccaggtgctcccgctctgtcatagcactgatcagtgacaacttacaggaatgtagcagcgatggaattacctgg

SEQ ID NO: 6821765 - DNA, 81 bp, Homo sapiens
gtggggggaggagttaagagtgtgaaaatgttagttagctatagagtttgttagcatcaagtacctcgacttcatccttac

SEQ ID NO: 6821766 - DNA, 58 bp, Homo sapiens
gggagggggatgagccagggctgagccgtggcatcaggctgggctcctctccccaccc

SEQ ID NO: 6821767 - DNA, 76 bp, Homo sapiens
tgttccgtatgagaatcagacacatattatgagtcttaacatcatttcccgaagtgtgggtcatgattccagagca

SEQ ID NO: 6821768 - DNA, 79 bp, Homo sapiens
tcccattgagccactgaaagtaccagcaaatcctttgatgttgctgattctgtatttaaggtgatgtcttcatttggga

SEQ ID NO: 6821769 - DNA, 91 bp, Homo sapiens
tccgggacatcctatgtggatccttcctttactcatcactcacctgcagtgacccagagtaacagatggattctctaagggaagttttgga

SEQ ID NO: 6821770 - DNA, 59 bp, Homo sapiens
attggcatcctagtgagagatgctagtttttggaactgagcaatgcagtgggagcgaat

SEQ ID NO: 6821771 - DNA, 96 bp, Homo sapiens
tttaatcgtggccattttcaaacacagatctgcacagtgaacaattttctgaggaattcttacaaagcagagtctgttcagaggatgctgattaaa

SEQ ID NO: 6821772 - DNA, 64 bp, Homo sapiens
gattagaggtacaaaccttcacttccccacctccacttagggaaagaggtgtttgacttcagtc

SEQ ID NO: 6821773 - DNA, 86 bp, Homo sapiens
ttaatctctagcagcttctattttcttggtttataaaacatctgagctatttaaaaggaagtggagtgagctggcatagctattga

SEQ ID NO: 6821774 - DNA, 74 bp, Homo sapiens
tcttggcttccaggggcttttacagatacccccagtctggaggggaaactgtttctggctgactggggctagga

SEQ ID NO: 6821775 - DNA, 59 bp, Homo sapiens
catcaaagcttttttctgtgttgggcatatacccaacacacacagactcagcttggatg

SEQ ID NO: 6821776 - DNA, 88 bp, Homo sapiens
ctgctgaaaaaatacagaatgcaattctcttgatatagcttgaaaatagttttttaaaaaatatggaactattctgtgtagaaggtag

SEQ ID NO: 6821777 - DNA, 90 bp, Homo sapiens
ctgtctctgttctggattcttgaaatatgctgctaaagagaagaggcaaggcccctgccttgttggagcctatgtcctaggctgagacag

SEQ ID NO: 6821778 - DNA, 64 bp, Homo sapiens
ggggctcttagaagtacatttagaacatattttaagtttcaatgtgttcatagttctaaacccc

SEQ ID NO: 6821779 - DNA, 81 bp, Homo sapiens
cttttcagttctttcactcaagaaggatctgcaacttgaattcagcaggtttggtcttcagtggggcctggaagtggaagg

SEQ ID NO: 6821780 - DNA, 60 bp, Homo sapiens
gagagttattattatccccattttccaaatgaggaagctgggtgttaaaaaataattttc

SEQ ID NO: 6821781 - DNA, 82 bp, Homo sapiens
agtgccatggcactttacacccatttggctggtgaacattacaaagctgggtaatgccaagtgttggtggggctgtgggact

SEQ ID NO: 6821782 - DNA, 58 bp, Homo sapiens
attgcaaagcattgtgagcgcagtaaaagctactgaattgtacacagtactttacaat

SEQ ID NO: 6821783 - DNA, 71 bp, Homo sapiens
gtccatcactgcttgttttctaaaacatcatttatagaccgtaagagattcagcagaagacgggtaaggac

SEQ ID NO: 6821784 - DNA, 61 bp, Homo sapiens
ctgaatagctgaataatgcgtctgcagctttttacgtcactgcgcgtgcaacagctgttag

SEQ ID NO: 6821785 - DNA, 72 bp, Homo sapiens
ctttgtcttcagttactcccacctgaaagcccactgtacaaaacgtgcaggtggagctgactgagggcagag

SEQ ID NO: 6821786 - DNA, 71 bp, Homo sapiens
aacatgagatacttggtttctgtttctgcattggtttgcttaggagagtggattccagctgtatccatgtt

SEQ ID NO: 6821787 - DNA, 75 bp, Homo sapiens
ggaggggaggcaaagacagtgctgcatagacccccaccgaacaaaatgtgattgcttgcttatttgcccttctcc

SEQ ID NO: 6821788 - DNA, 89 bp, Homo sapiens
catcaatgggcctgcttaacaatgaaatgtatctagtttctgtgtttattatctgaaatcatgaacaaggtaggtgagtagccctggtg

SEQ ID NO: 6821789 - DNA, 66 bp, Homo sapiens
actagtgtccttatataagaggccccagagatctgctttgcccccttcatcatgtgaggacacagt

SEQ ID NO: 6821790 - DNA, 59 bp, Homo sapiens
tatgatccacagttgttcatattttcccatccggatgggacaattcaaagctggtcatg

SEQ ID NO: 6821791 - DNA, 68 bp, Homo sapiens
tcctggaggggagctctcagctgtctttgtatgctgcagcatacagtgcgggtgcgggcctcttagga

SEQ ID NO: 6821792 - DNA, 75 bp, Homo sapiens
aaatagtggactttgccattctgagatgagaagaatacttctatattgtagctgatgacaaatgtgccattcttt

SEQ ID NO: 6821793 - DNA, 57 bp, Homo sapiens
gccattggccatccacctgaaactgctcctctgcagaggccacctgtggccactggc

SEQ ID NO: 6821794 - DNA, 60 bp, Homo sapiens
gctgctgtcagtggtggcagttcctactctttctctcgaatctctactgctgacatcagc

SEQ ID NO: 6821795 - DNA, 57 bp, Homo sapiens
atgaacagaggcactaggagggaataagtatgggatcatctctgtgtctctgtttat

SEQ ID NO: 6821796 - DNA, 110 bp, Homo sapiens
gtaatgtgaagccaagggtagagagactgggctaagtattaataattattgtaaaagtgacatttattagatgcttactacatgccaggactctgctgacatttacatgc

SEQ ID NO: 6821797 - DNA, 108 bp, Homo sapiens
taggggcttgctgtaatgcagtcacttggtgaacacattatgtgcttctgggagataataagctacatcgatggtcagccgaggagatctgctccacagagaccccta

SEQ ID NO: 6821798 - DNA, 94 bp, Homo sapiens
ggctgctttagatttttatgtctctaagattcttggtctggtattgggtgggatgccagggcatgtccaagacttagaaaagatcaccatagtc

SEQ ID NO: 6821799 - DNA, 119 bp, Homo sapiens
tcatttaaaccatgtactttttagaatatgcatcatttgttcacttgattccaagaagattttgtgaatcataatcaggtaattaggttagcagagaactaatgtgcatggaaaaatga

SEQ ID NO: 6821800 - DNA, 84 bp, Homo sapiens
tcctttctcctgtgtaagccgcccagcactggaaaccacagggtatctgaccatggggcttgcagacctccaggggaccaggga

SEQ ID NO: 6821801 - DNA, 108 bp, Homo sapiens
gcagccagtgacaggtttaaggtgtctcctaaggctgaatatctctgcatcaaaaacttttgcaggcagtattcctcttggggctaacatcaccatgtcagtagctgt

SEQ ID NO: 6821802 - DNA, 89 bp, Homo sapiens
catcatattcttctgacaatagccatgccattttgtgttcccagggccaaggagaagacagaaacctgtttggcttgaggaatgttatg

SEQ ID NO: 6821803 - DNA, 62 bp, Homo sapiens
gcccaggcctcgcagccctcgctttcttcctaacaaagtggctgaggcatgcaggcctgggc

SEQ ID NO: 6821804 - DNA, 111 bp, Homo sapiens
ttagattaaggttagggttgaggaaggtgaatgttattagaggttgatctcattattaggagcttctcacctttggataatctttgtgtttctgccctggctctttcctag

SEQ ID NO: 6821805 - DNA, 129 bp, Homo sapiens
gcccggcggccctcaagctgggcacccaacagctgatccctaagagcctggctgtggccagcaaggcaaagaccccagcccgccaccagagcttcggggcggctgtacttagcagggaggccgcccggc

SEQ ID NO: 6821806 - DNA, 59 bp, Homo sapiens
actgcaggctcggaagtgctggctttgcctgacgcaagagttgagcaccgggtagcagt

SEQ ID NO: 6821807 - DNA, 65 bp, Homo sapiens
acaggcgctggggccaaggctaaataattcctctgtattcacatgccttcactcccagagtttgt

SEQ ID NO: 6821808 - DNA, 79 bp, Homo sapiens
tgagaccaagcagccaaatgaagattttacttatagataatctgtcctagtagacactgtatttgatgctttaggttca

SEQ ID NO: 6821809 - DNA, 78 bp, Homo sapiens
ctgttacaagaggaagcattgacataatctccattagagctctatataggggcttgtttcattgcaatctcttagcag

SEQ ID NO: 6821810 - DNA, 66 bp, Homo sapiens
ccctgtgtagtatttgtacacatatatcagctcctcagctttatttgttgcatatgttttatgggg

SEQ ID NO: 6821811 - DNA, 58 bp, Homo sapiens
tcatgcagcaatatgcattaggtgcctgtaatgtactagatgctattttagctgctgg

SEQ ID NO: 6821812 - DNA, 63 bp, Homo sapiens
ttgatgctaaattcattattgatttatcattcttcatggataccataatgagattggcctcag

SEQ ID NO: 6821813 - DNA, 55 bp, Homo sapiens
catggctgggtgcagtgatagtaggaagtgtgcctatgtgtctctgtgtagcctg

SEQ ID NO: 6821814 - DNA, 129 bp, Homo sapiens
ccacgacagccctgtttttcctgtgctgcgtagctgagctctgggtcacggctgccgagtgcaggcaacactcgggcagtcccagggctgaccgactgcgcatctggacactggcaatcacagggaagg

SEQ ID NO: 6821815 - DNA, 72 bp, Homo sapiens
tatccattcaaccttgggcaagttggaaactgaggcttagtttcctaactgcaccatagcaattgtgagata

SEQ ID NO: 6821816 - DNA, 61 bp, Homo sapiens
ttagctcaggcagtgccctctggccgtggcaggcactgcaatgggcacctgcttgagagga

SEQ ID NO: 6821817 - DNA, 91 bp, Homo sapiens
tatggttgccagacttaggcagggccagtgggttgaaaggcagtaatactttgctaggcaataattggtttaggggtgctggttagctgta

SEQ ID NO: 6821818 - DNA, 71 bp, Homo sapiens
cctctggtagtgtatcctccaatgacataaatttttcccttacactcacaggcagagaactcagccagagg

SEQ ID NO: 6821819 - DNA, 103 bp, Homo sapiens
tactcaccccttggagacctgtttgttatttataacagtgagaacgggggacctagtgcctccctcctggtgatgatgcaaatggtcaaggagatagtgagtg

SEQ ID NO: 6821820 - DNA, 97 bp, Homo sapiens
tgccaagtctgagggatatcatttctctgagtctgataatttctagatcagtaaacagtcagggcttactcagggagtttgaacctcatgggtggca

SEQ ID NO: 6821821 - DNA, 59 bp, Homo sapiens
ttcctcacaggagtgtttaccatctgaaataaatggaaaggagatactgaagtgaggaa

SEQ ID NO: 6821822 - DNA, 56 bp, Homo sapiens
gtctgaatagctctgtgaataccagtgggctgcaggggcacagaggttatacagac

SEQ ID NO: 6821823 - DNA, 58 bp, Homo sapiens
ggagaacagagcctgctattctcttggaatatctttcatcagcaggtgctgtttcttt

SEQ ID NO: 6821824 - DNA, 57 bp, Homo sapiens
taggtctggccccatgcagccatcgggtttcttcatcagctttggggcccaggcctg

SEQ ID NO: 6821825 - DNA, 102 bp, Homo sapiens
gaggcactcctgctctgtacaagggctggcttcttccctggatctaggggttgcccctgccttttagaagacagatgcacagccccagagcctagttgcctc

SEQ ID NO: 6821826 - DNA, 86 bp, Homo sapiens
gagggactaaagaacgttgaatggttaatttgtattcagtgctatccctgcatacagtcttcatattaagtttttgttgggacttt

SEQ ID NO: 6821827 - DNA, 61 bp, Homo sapiens
ccacctgctctaatggcttctcactgccacgaatgggctgacaggccagaagagcagctgg

SEQ ID NO: 6821828 - DNA, 88 bp, Homo sapiens
gatcccatcactcaaggaggagaaggatgtttccagttttcatttctgtaggtaagttatatccttctcctccttgagtgacatgatc

SEQ ID NO: 6821829 - DNA, 75 bp, Homo sapiens
gtcagttccttgtccttgtccttgtttgtccttccatgaagggacagtcacttccaggagaggacagaattggac

SEQ ID NO: 6821830 - DNA, 67 bp, Homo sapiens
gctgattttatttgaagcagaaggcacagactctcgtctggcagaagtgctgtcagtaagaagcagc

SEQ ID NO: 6821831 - DNA, 59 bp, Homo sapiens
cagcctcccctcaaaagtgagattttcctggaatgtcactagtcgcggggggaggtatg

SEQ ID NO: 6821832 - DNA, 89 bp, Homo sapiens
tttgctatctgcaaggagttgacattgtctgacaagtgaaatataatttttgtgaggctgtttttctctatttgcagtactattgcaaa

SEQ ID NO: 6821833 - DNA, 68 bp, Homo sapiens
cacaattgttctaggtcatccttattactcccatgttagagatgagaaggctcaggcttagagaggtg

SEQ ID NO: 6821834 - DNA, 63 bp, Homo sapiens
gggagcactaaggcagtcgcttcaagtcattattagtccagcagactcctgaactgtgctttt

SEQ ID NO: 6821835 - DNA, 86 bp, Homo sapiens
tagcaggactaaatcatctgccagtgccagagtacataaatctatctcaagctgtgacttttcacaggctggtccttttcctgctg

SEQ ID NO: 6821836 - DNA, 85 bp, Homo sapiens
gctgaccgtcggggacaccggcctggactgcgaggcgctgtgcggccaggccccgcagtgcgtgctggtcttcgacgtggtcagc

SEQ ID NO: 6821837 - DNA, 78 bp, Homo sapiens
tgttcagttccccctctgttgcacgtttgcaatttgccttaatgagaactgcccatgtgcatcaagtagaatcgagca

SEQ ID NO: 6821838 - DNA, 64 bp, Homo sapiens
ccttcttaatgtcctctttctgagctcttcaattagcatttgaggccaaaggatatttagaggg

SEQ ID NO: 6821839 - DNA, 66 bp, Homo sapiens
tatgtctggaagtgtacttgtcacttctgctcacaatacatgggcaaaacaagtcacatggacata

SEQ ID NO: 6821840 - DNA, 57 bp, Homo sapiens
ggtcagatagtgaatttgtgagccatatggtctctgtcacaagtactcatctctgcc

SEQ ID NO: 6821841 - DNA, 72 bp, Homo sapiens
ggctaggcagttttctcagtggggtacagatattaatttatttacagtgagccagagaagtctgctgtagct

SEQ ID NO: 6821842 - DNA, 62 bp, Homo sapiens
ttcttcatcacagtatttggcaggcattctcgaggtgtttgactgagttctttgatgaagga

SEQ ID NO: 6821843 - DNA, 62 bp, Homo sapiens
ctctacaacattccacaggcatgttctcctgataggaggcatgtgtgtttgtgtgtgtaggg

SEQ ID NO: 6821844 - DNA, 99 bp, Homo sapiens
ctgtgttgaaattaccttaccatttagggttatataccatagcatttatagatgaaatgacatgatggttgaacttaaagggaatgggtagggatatag

SEQ ID NO: 6821845 - DNA, 89 bp, Homo sapiens
ctgaaccctcaatgagtaaaggactccatgggtaagtcatattttgggtaacatattaacactttggagtctgctcaggggctgtttag

SEQ ID NO: 6821846 - DNA, 65 bp, Homo sapiens
tggtaacttgcaaggaatagggcagctttcttctgtggctaggtagctagtcctttaagttatta

SEQ ID NO: 6821847 - DNA, 83 bp, Homo sapiens
tagcccctccctctccccaggccccccttgctggtttgctgggagcaggggctacatgtgggggccccaggagctgggggctg

SEQ ID NO: 6821848 - DNA, 125 bp, Homo sapiens
tgtttgggcaggattgagagtgaacatctatctggtcagggtcagattccagagcctgtgttagaagattaaggactggtgtgtgatcagcattagtagatggatactctttcatactacatgca

SEQ ID NO: 6821849 - DNA, 61 bp, Homo sapiens
gtaggccagtgtgaaacctggtaggagccacagaacagtgtgaggttttacattggcctac

SEQ ID NO: 6821850 - DNA, 70 bp, Homo sapiens
ctaaattaaggaatctctggctggagctgaggattgcagcctcactacagtgtagagattaggagtttag

SEQ ID NO: 6821851 - DNA, 68 bp, Homo sapiens
ataaggttaacatcatcagtgataattcatgttgatagcatgtactccctgatatgatgtgatgttat

SEQ ID NO: 6821852 - DNA, 78 bp, Homo sapiens
gtttttcagacgatgttgcatttgtcagtggtttcttcctttctattactgaatagtgctgcattgtacagatagaac

SEQ ID NO: 6821853 - DNA, 65 bp, Homo sapiens
ccgctcaaggggtgctgttggaaacccagcttctgagggtgggtgtttaaaagaccctagagtgg

SEQ ID NO: 6821854 - DNA, 65 bp, Homo sapiens
caggctggctcaggtgtgagctgaagaggcaaaactgtctgtttaggttgcattgggttcccctg

SEQ ID NO: 6821855 - DNA, 72 bp, Homo sapiens
acagctcaggccattcctaccaagggaagaaaggctggcctctgtaacccctgtaggaaaggcctgctttgt

SEQ ID NO: 6821856 - DNA, 66 bp, Homo sapiens
ttgctagatccagaatggcttttcactcttagcgcttatctgtgaattcagtttgacatctagcag

SEQ ID NO: 6821857 - DNA, 91 bp, Homo sapiens
acatatagactttttgcactgtggaagtagatttgagaaggtaaagtcatttattaactcaacaaatatttactgagtgcctattatgtgt

SEQ ID NO: 6821858 - DNA, 105 bp, Homo sapiens
ttgacagttgtttagtgagtgcttactaagtgtttggcagtatcatgatcactgtatgtggtaaagttcacacgctagtagggagaagctaacaataacaatcaa

SEQ ID NO: 6821859 - DNA, 82 bp, Homo sapiens
aaggaagttgcagaatgcatggcagatgttgttagatttgtctagcaaagcccacgtgccaagcatgattgatgacattctt

SEQ ID NO: 6821860 - DNA, 66 bp, Homo sapiens
ttcttctaggatctgggatttttgacactgaagggtcctggctgccttaaatcctttctagaagaa

SEQ ID NO: 6821861 - DNA, 104 bp, Homo sapiens
gtgctttgagatagcacattttggctgcctagtgtctgagcagaaccacttttcctcctgggttgcctcaagctctggcgcttaagtggttaagttggaagcac

SEQ ID NO: 6821862 - DNA, 84 bp, Homo sapiens
cactgccccactggacccgtcgcccccctgggaggggccgccagttcggctggccctgtgggccatgtgtctacaggggttgtg

SEQ ID NO: 6821863 - DNA, 61 bp, Homo sapiens
atggtcaagatcctctagtttagaactttttgctaaactgctaagcgggtcttacaaccat

SEQ ID NO: 6821864 - DNA, 65 bp, Homo sapiens
gattattgacaaggcatgtgtcatccatgtaaccaagtctctgctgggacacacttgcagtagtc

SEQ ID NO: 6821865 - DNA, 78 bp, Homo sapiens
ctagatatctttttagtataactatgtgtttggtatataatatgtgtacatacacaaatatactgttttgagatctag

SEQ ID NO: 6821866 - DNA, 57 bp, Homo sapiens
tagcgcatcctaatgtcttcaggtcttacttactacagtgaagttagtggtgtgcta

SEQ ID NO: 6821867 - DNA, 55 bp, Homo sapiens
ctcctagaggatggtaggaagcttgatagcatccaagctgctaaattcttaggag

SEQ ID NO: 6821868 - DNA, 59 bp, Homo sapiens
tttgtctttagttgcgttatcttacttttccaaaaggggatctgtaagttgaagacaaa

SEQ ID NO: 6821869 - DNA, 69 bp, Homo sapiens
tcttgtgaaacaagatgtttcaggttcatcttatcctttctttgcctggaatcagccttttttccaagg

SEQ ID NO: 6821870 - DNA, 64 bp, Homo sapiens
agctctttctgtgtgtctcagcaagctgtgtccccagggtccagctcagcacataggaggtact

SEQ ID NO: 6821871 - DNA, 79 bp, Homo sapiens
ctctgctctgcatcactgtggcccaaaacctcaggtagagcgtcccctacctggaaacacgctagtgatgagagcaggg

SEQ ID NO: 6821872 - DNA, 82 bp, Homo sapiens
ggggaaagagagtgtagtggcattgacttcgtaattagggaaaaaaacctaaatatgaggatgtactaacacatatttctcc

SEQ ID NO: 6821873 - DNA, 56 bp, Homo sapiens
ttcctgcaggccatagagcctgccacaaaccaggtagattccattggcccagagaa

SEQ ID NO: 6821874 - DNA, 56 bp, Homo sapiens
tgggagctgagctaaaccccagcctctggataccagatggggatgcttccctccta

SEQ ID NO: 6821875 - DNA, 88 bp, Homo sapiens
tggtgagggagtccaggcccagggtgcggccctggctgggggaaagttcccgtgcagctcctgccctgaggatgggctgccctcgttg

SEQ ID NO: 6821876 - DNA, 86 bp, Homo sapiens
atggtgcagagagtgtggggtcttctcttggcctgggctgattgcctgttctctgtgcctaggcagaaacccccacacccaaccat

SEQ ID NO: 6821877 - DNA, 56 bp, Homo sapiens
gaatacatccagagcagggctgtccaatagaagtgcccatgatgatggaggtgttt

SEQ ID NO: 6821878 - DNA, 74 bp, Homo sapiens
agaagaaatagaaaagaaaatgaggcagtgccactctagttggtgatacatgacatttctttctgttctctttt

SEQ ID NO: 6821879 - DNA, 72 bp, Homo sapiens
gctttcactggaggtcagtggagcactggggttgcaatgataggacagtgccctgggccttccaggacaagc

SEQ ID NO: 6821880 - DNA, 63 bp, Homo sapiens
gtttccagaaaacgctttatttaggtgctctttgcattttgaatccgttcgttctttgggagc

SEQ ID NO: 6821881 - DNA, 122 bp, Homo sapiens
agtatcacctgggagcttgttagcaatgctctttcctgggttccctctcattctatggaatcagaaactgtaggggatgaggcccaggaatctgggtgttgtcagcctttccaagtgaaact

SEQ ID NO: 6821882 - DNA, 71 bp, Homo sapiens
gcctggcacagaggaaggctctgggaatgtttgggccggatggatctgggagcctcttttgcatgccaagc

SEQ ID NO: 6821883 - DNA, 87 bp, Homo sapiens
gttcctgccaagatcaagatacatattctgggtttctgcagttgaaggaggaattcctgcagccatcgcagagtctgtagtaggagc

SEQ ID NO: 6821884 - DNA, 81 bp, Homo sapiens
gataagagagcacagctgagagctggaaagtgattgacacctgacgctactgtcctagatccagctgtgctgaggcttatc

SEQ ID NO: 6821885 - DNA, 78 bp, Homo sapiens
tcatttagtcagtgcttcccattagaactgtgatgttctgaggatattaataggttatttggggagcattgggggtga

SEQ ID NO: 6821886 - DNA, 83 bp, Homo sapiens
ttatggtattcttttatgtgagacatgaaaattccaaacatcctgtacttactaaggttctgtctggcaaaggattaccatga

SEQ ID NO: 6821887 - DNA, 79 bp, Homo sapiens
actgaaagcacagggactttaggaatatgttacctaacctggcaacttaatcctttccctgctgcttctaaaagtcagt

SEQ ID NO: 6821888 - DNA, 72 bp, Homo sapiens
ccaagccctggtctggctagtttaggccaggcatgtttgcctggtaccaagcatgctgacctatggccatgg

SEQ ID NO: 6821889 - DNA, 98 bp, Homo sapiens
aggtgttcggtctattctgttcactgttgagttcctgatattaatgcagtgcctggcatgtatagagaccttagtagtaattatttgaatgaatacct

SEQ ID NO: 6821890 - DNA, 74 bp, Homo sapiens
cagaaaggctgctgatttctgatttcctacgttccacctgaaggttggcagtctcagtcagatggccctcgttg

SEQ ID NO: 6821891 - DNA, 103 bp, Homo sapiens
cctgaccaaagcctgctttgccagtgtgagtggagttcttggaataaaactctatgtggctccttactcatcagcaactgaagcagagatgaagcttttcagg

SEQ ID NO: 6821892 - DNA, 106 bp, Homo sapiens
aagtatttttacctctgagtcacatactatgtaatagagttatagacaggttaatgactatttcaatctgtgtaaagtgtgcaatgatcatgcctaaaagtcactt

SEQ ID NO: 6821893 - DNA, 83 bp, Homo sapiens
cttgttgaaaatacagattcctaggcagcacctaaatttggatacagctggtctggggcctgggaatctgcattgtcagcaag

SEQ ID NO: 6821894 - DNA, 96 bp, Homo sapiens
tcctaggcagatgtccctctagttgtttaatattgattgactacccacagtgggactcttagattaagcacacaaaatgggctctgccctttagga

SEQ ID NO: 6821895 - DNA, 88 bp, Homo sapiens
gacacgagaggtatgctacagtagagtaggcctctgaccaaactctttgtcacatccttactttatatgtggttctatttcaagtgtc

SEQ ID NO: 6821896 - DNA, 80 bp, Homo sapiens
gcacctggaggctgccagctgggaaccccctttaggcgacgtcagcgccgttggttctcagcctgagccgccccctgtgc

SEQ ID NO: 6821897 - DNA, 57 bp, Homo sapiens
ctctggagaacgctatggatctgtagagagtcccatagatttgtggagtgctctgag

SEQ ID NO: 6821898 - DNA, 56 bp, Homo sapiens
caaggagcctgtgggccaagaggctgaacacttagggaaatggcttgggtttcatg

SEQ ID NO: 6821899 - DNA, 55 bp, Homo sapiens
tctgttgtctgaactccctaaggtcaacgctcaagggctccgggcaggcgatgga

SEQ ID NO: 6821900 - DNA, 84 bp, Homo sapiens
gagccttactgtcttcagtggcaaatggatctgtcaacaggctccattgcctggggttgttgctgctgagattaagggaagctc

SEQ ID NO: 6821901 - DNA, 58 bp, Homo sapiens
acccaggctggagtgcagtggggccatcttggctcactgcaagctccaccctccgggt

SEQ ID NO: 6821902 - DNA, 91 bp, Homo sapiens
tctttcagtcattcactcattcagcaagaatttactgagcttatttagtgagaccagttcccttcttggctgacggaatgtcactgaaaga

SEQ ID NO: 6821903 - DNA, 90 bp, Homo sapiens
gggtctcccttttggtatctaatttcctgtatcctgatacaataagagtctttccttttggagttaggagacaggatgatgtcatcaccc

SEQ ID NO: 6821904 - DNA, 71 bp, Homo sapiens
tccccttggcccacatggaagcatcgaggaggcccagccccctcctgcctggccatttgggcacagggtga

SEQ ID NO: 6821905 - DNA, 100 bp, Homo sapiens
accaaatcagtgtggatgaactcagtgaaggtgtgagccagctgcatctcctgggctgcacggagacacatcctcagacttcaggatgcactgattcagt

SEQ ID NO: 6821906 - DNA, 58 bp, Homo sapiens
gcttgatctctgccctcatgtagctgacacactgaggcaactgagaccacagacaagt

SEQ ID NO: 6821907 - DNA, 67 bp, Homo sapiens
acaagattgataagtctgccctcgtggaatactgatttctggaaggagatgcaggcattaatcatgt

SEQ ID NO: 6821908 - DNA, 76 bp, Homo sapiens
caagagttgaaaagccagaggaacttgatgactgtaaatgcattagaatcatcttcttttgggtttagtatccttg

SEQ ID NO: 6821909 - DNA, 59 bp, Homo sapiens
gtgaagtctcatttgatgctctgaacagggaaagtttagagtgaaggttgacacttcac

SEQ ID NO: 6821910 - DNA, 93 bp, Homo sapiens
tattctttcagtggaccacagtttgatgatatctgcagtcccaagtgtaaatctaaaatcatagcatgtgagtctattccagttgaaatagta

SEQ ID NO: 6821911 - DNA, 61 bp, Homo sapiens
gcctgggtccaccctgtgaagtagaatccactgtcatctcctccacatggtcaccccatgc

SEQ ID NO: 6821912 - DNA, 82 bp, Homo sapiens
tgacatctatgacaaaattagctgcaaaggatgttatctaccttgatgatttccagttgttgctaagattatagatttatca

SEQ ID NO: 6821913 - DNA, 72 bp, Homo sapiens
gagggttagaggatggagatgaggaaaattagaaaccctcttgtctactcacatctctgttttctaaatctc

SEQ ID NO: 6821914 - DNA, 80 bp, Homo sapiens
gctagtgctggggacatagccagtctggctgatacccatatcagtacagaaagctgtcctcacccacttcatgcactagt

SEQ ID NO: 6821915 - DNA, 71 bp, Homo sapiens
agctagtgtttatggagtgcttacctgccagacactgttctaataagcattttatgtggattcactcagct

SEQ ID NO: 6821916 - DNA, 59 bp, Homo sapiens
tctcccatgaggctgcggtcaaatcaggactggattccaaactggagcctgatggagga

SEQ ID NO: 6821917 - DNA, 56 bp, Homo sapiens
gcaggtttcttcttgtcaataaacaagatatctttgttgtataagaatgtatctgt

SEQ ID NO: 6821918 - DNA, 99 bp, Homo sapiens
gctcacatggatgcagtcagatggcctgtatttgggccagagctagaacactgatgttccactataggctatcaaaagatgaagtgtaaatggatgggc

SEQ ID NO: 6821919 - DNA, 71 bp, Homo sapiens
ggtgcggggcctccccaggggtgtcatgagggaatgaagagaccccacggagcctggggaggctgcgctcc

SEQ ID NO: 6821920 - DNA, 73 bp, Homo sapiens
cagtttctttgtaagactgcctcttgcctattccctacagtctggcagggttgtcaatcaaaagaaaacactg

SEQ ID NO: 6821921 - DNA, 84 bp, Homo sapiens
gaagagtggcaggtaagaccagaacagtggtttgtatttcataagattgggatgctcacatttctgattataccaaagcttttc

SEQ ID NO: 6821922 - DNA, 73 bp, Homo sapiens
ccctgctggctctttcaaatttactaaatttataaccaaaggaaatttgggattgaggaggaggctggcatgg

SEQ ID NO: 6821923 - DNA, 84 bp, Homo sapiens
tacccagggaatcttggtaagctgacattgctttgaagagattgattccaagagcagccttaggtattgtgattccttgatgta

SEQ ID NO: 6821924 - DNA, 55 bp, Homo sapiens
agcaccctcagccttatccagattgtctgactctggagaaaggctaaagggtgct

SEQ ID NO: 6821925 - DNA, 61 bp, Homo sapiens
cttgctgtgtgagtgactgcatctcactgctttctagcgtgaggcgaagctgcaacagaag

SEQ ID NO: 6821926 - DNA, 108 bp, Homo sapiens
agctcatgagttaatgtgtcagcaatttaggctgggttcagctgggtgattcttctggtctcctctgggcccacttaaatctggcagttatctgacttatcatcagct

SEQ ID NO: 6821927 - DNA, 87 bp, Homo sapiens
atataccccaatgtctagatgactgggaccactaggtttcatatttcccagatgagattagttgtacagttcattttgcaggtttat

SEQ ID NO: 6821928 - DNA, 59 bp, Homo sapiens
acagttagggactataatcatttggaagcttctttactcatgtttagtgcctagtctgt

SEQ ID NO: 6821929 - DNA, 72 bp, Homo sapiens
ctcttcttggtatttggggaaatattttcctccccgtccattccaggaaatggctccaagtgccaaggacag

SEQ ID NO: 6821930 - DNA, 68 bp, Homo sapiens
agagaggtgaagagggcaaaaacttcccaaagtgtgaacatttcaggattatactctcttccctttct

SEQ ID NO: 6821931 - DNA, 58 bp, Homo sapiens
gattaggcttaatcacagaaagcagaagagctttcaggtgggccttttgagcataatt

SEQ ID NO: 6821932 - DNA, 62 bp, Homo sapiens
ttactatttcttgtgggaaatgcagcatcaccccagagatctgtagccatcaggaagagtag

SEQ ID NO: 6821933 - DNA, 76 bp, Homo sapiens
gatagtgttagaatcttatttttaaatcttccatagtgcagtcattaggagatttttgatgaggttttgatgagtc

SEQ ID NO: 6821934 - DNA, 85 bp, Homo sapiens
gggcatttgtgttctaatataatgtcctatgggaataaggtaagactactcctctataggaaattagaacttggaaactgagcct

SEQ ID NO: 6821935 - DNA, 84 bp, Homo sapiens
taactagaatggcatgggaaatgcagtggcctttaagaaatctggtttatgccactgtcttttccaggctgaaatttcttgtta

SEQ ID NO: 6821936 - DNA, 61 bp, Homo sapiens
tgaatagactggggctgtgaagtcattggcagaatgacattcaaagtttcaatctgtatca

SEQ ID NO: 6821937 - DNA, 58 bp, Homo sapiens
gcaggttagatttaatccattcctaacaggagctggaatctatagtctacaagcctgc

SEQ ID NO: 6821938 - DNA, 92 bp, Homo sapiens
gaacttttgaaaaatatgtatatctgtgtcccaaaccccaaaatcccagatttaattggtgtgggtgggacatcatctttttttaaaagctc

SEQ ID NO: 6821939 - DNA, 66 bp, Homo sapiens
ggagaagctgctgtgggcagggtagctggctaggcagccagcttctctgttccagcccctttgtcc

SEQ ID NO: 6821940 - DNA, 80 bp, Homo sapiens
ctagggattgattttcaattcattgacaatttaacaagttcttgctgttgtcttagaattggaagggacattccaactgg

SEQ ID NO: 6821941 - DNA, 60 bp, Homo sapiens
gtgccacctctgccccagagggtatatttaaaatcattcctcatgtcacagatcaggtac

SEQ ID NO: 6821942 - DNA, 81 bp, Homo sapiens
aggtaatgccttcgatcagagccctgatgacagactgtggagtgcaagttttttcaggtgctctgtttgctcagtaatcct

SEQ ID NO: 6821943 - DNA, 70 bp, Homo sapiens
caggagaagatgcccagccagtttagagaaagtggtcccaactcaaggctggctcggcttttctgtcctg

SEQ ID NO: 6821944 - DNA, 56 bp, Homo sapiens
ggtgattttcgagtttcatgtttcttcctgcctcggggctctgaccggaaatcatc

SEQ ID NO: 6821945 - DNA, 79 bp, Homo sapiens
gggtctgatttatacttcataatgtctatttggctgcaatgggtcaacagaattgaaggaggtatgagttaatgggcct

SEQ ID NO: 6821946 - DNA, 57 bp, Homo sapiens
ggcaggatgaagggcaaaggcaagactcaaggaaactctctgcccccttctgtcccc

SEQ ID NO: 6821947 - DNA, 62 bp, Homo sapiens
tccttcctagtgtctactttggaggctggctgggggctcacagaaatggcactggggtagga

SEQ ID NO: 6821948 - DNA, 56 bp, Homo sapiens
agaaagcacagcgggtccattttaaggatttttccaaatataccagctggctctct

SEQ ID NO: 6821949 - DNA, 79 bp, Homo sapiens
aagagagagatggaaatagatagtatcattcagcattcagaagcttgaagagtattaggttatttgaaactctgctttt

SEQ ID NO: 6821950 - DNA, 117 bp, Homo sapiens
gggggctgagcagagcacccttctctgctgggccagccttgggatgatttatcagcagaaaactggatggatctgtttgttcaagggcccagggaagacaggctttggggagccccc

SEQ ID NO: 6821951 - DNA, 78 bp, Homo sapiens
ctggcccttctaaccatacacattgtttccgggaggctaaatataacccctcaggcagtggtatggatgggtggccag

SEQ ID NO: 6821952 - DNA, 55 bp, Homo sapiens
ccagctttcatatcatgaggtaaccctagggagaggcctacatgagtaagcttgg

SEQ ID NO: 6821953 - DNA, 123 bp, Homo sapiens
gtgtgctgggcccagcagagtagttcttctagactaggctgggctccctcatgtgtctgcagtcagctgccaagtcactggaagcctgaatagtctaagataacctcagctgggatggcacat

SEQ ID NO: 6821954 - DNA, 59 bp, Homo sapiens
gcgtgtgtgtgtgtgtgtgtgtgtgtatgtgaatgtgcacatgagacacacatatatgt

SEQ ID NO: 6821955 - DNA, 64 bp, Homo sapiens
gtgtgtgtgtgtgtgtgtgtgtgtgtgtgtgtaagccacattcagggcagaccactcatttcat

SEQ ID NO: 6821956 - DNA, 67 bp, Homo sapiens
aggaacagccaggggctggcgtgttgatggtagaaaccattacagagttcgcacctggtgggtaact

SEQ ID NO: 6821957 - DNA, 63 bp, Homo sapiens
acttcacaggttttcataaaaccccaaatacaactgatggaatatgtatgaaagctgtggagt

SEQ ID NO: 6821958 - DNA, 56 bp, Homo sapiens
agctggctatgccctgtgaacccatggttcagtcccttctccaggtcagcacggct

SEQ ID NO: 6821959 - DNA, 83 bp, Homo sapiens
tgtctgagcgtatctgtgagtagcctgggagtgaaattggaactgatactaaccctcagctctcacacttagcttctatgata

SEQ ID NO: 6821960 - DNA, 60 bp, Homo sapiens
cctggcacaagagcagcattggtttaatcatcagcagcccttctgctctctgtagtcagg

SEQ ID NO: 6821961 - DNA, 83 bp, Homo sapiens
gtcttgtgtcagaacttttacagtacagaaaataacagaatagccttctgtaatgaggcgtttgttagagttttgcatgagat

SEQ ID NO: 6821962 - DNA, 60 bp, Homo sapiens
tttcagtgtgagtgtcttattttaagcctagcatcggtgaactaaagtgctcacaggaag

SEQ ID NO: 6821963 - DNA, 61 bp, Homo sapiens
cctcctggaaaaattccctggcctcagaaagtgtaacaatggcctggcggatttctggagg

SEQ ID NO: 6821964 - DNA, 62 bp, Homo sapiens
tcagtgtgcactctgtgacccagggtcccccagcatgtaaggggtcactgggaggccactga

SEQ ID NO: 6821965 - DNA, 81 bp, Homo sapiens
tatgccagattgattttggtcttttgtaagttatctcaggatttgtaggaagttacaggtagaccacagttataaggtatg

SEQ ID NO: 6821966 - DNA, 89 bp, Homo sapiens
ggcagtcttgggtcccacagttcagaagagtctacggcttctggcggctatgggagcagctgttctgacttgtctacccatattctgcc

SEQ ID NO: 6821967 - DNA, 81 bp, Homo sapiens
gcttcatgatactaagctgaagtgttggtggtttcagtattaatgtgtgataactaatatattttagtgtgtgttttgtgc

SEQ ID NO: 6821968 - DNA, 57 bp, Homo sapiens
ctggccaggttttgaacagttgcagagaaagtgtgcttactgtaacagagtggctag

SEQ ID NO: 6821969 - DNA, 78 bp, Homo sapiens
acacaaaaattgaagtcaccaaaaattggtgggagaaagaaagccaccaagagcaaggaggctttaaaatttttctgt

SEQ ID NO: 6821970 - DNA, 128 bp, Homo sapiens
tcctgagtccatgtgactaaatttcaagagggcaggttagaaaaagcaaagttgatggggcattacctgtggtttgaacttctacctgtcatatttcaggaaatcaccatgaggagcttgacttagga

SEQ ID NO: 6821971 - DNA, 99 bp, Homo sapiens
ggttgattcataattcttggtataaaaccaagttttccttagtcttgaggaatttgaagaaaggtaaaatgttggattttaagcaaagtaggattgacc

SEQ ID NO: 6821972 - DNA, 100 bp, Homo sapiens
gcattttacagcttcatgacaaacagttttgtgcccataccttagaaaatgtggtgctgagttaaataaaggctgtttgagcactggagcagaaaaatgc

SEQ ID NO: 6821973 - DNA, 67 bp, Homo sapiens
ctctcttccctaacaggtccacagtggtcaaaactctaaacatatgaacacttattggggaaggtag

SEQ ID NO: 6821974 - DNA, 72 bp, Homo sapiens
gcctggctttaaacactgggggttaatgcagaatctggagagagctgtcaaactcccagtttgatacgtggc

SEQ ID NO: 6821975 - DNA, 98 bp, Homo sapiens
gctgtccttggagtagaattcaaggcagtaggatcttccacagtggaagcataaactgttgaaactaactgttttatattatattcacagagggcagt

SEQ ID NO: 6821976 - DNA, 60 bp, Homo sapiens
tgacagtgcgggtacatcataggacactggaggaaagtcctttgaatgtaaagcatgtca

SEQ ID NO: 6821977 - DNA, 56 bp, Homo sapiens
catgcaaaggtcaagatcaggagaaggaaggaattcctcctgatcagcctttgctg

SEQ ID NO: 6821978 - DNA, 90 bp, Homo sapiens
gaggaccagatgggggcagttggcccagggctatcagacaccactggatggaggcccacactgggtagatgcaccttcccccaggccctc

SEQ ID NO: 6821979 - DNA, 85 bp, Homo sapiens
cttgataccaaatgatggattataaatattttaaggaacttaaaaaaatctctcctaaatattatgatttttaagtggtaaaaag

SEQ ID NO: 6821980 - DNA, 64 bp, Homo sapiens
aggtgaccctgagaagagcttatgagtgacagccctgtgttatgaagtcttctcagggcaacct

SEQ ID NO: 6821981 - DNA, 59 bp, Homo sapiens
gtatgtgacacttagaacagtgtctagcacatcctaagcactcaataaatgtcatatgc

SEQ ID NO: 6821982 - DNA, 70 bp, Homo sapiens
cgatgtaatgggaagaatgaaaagtctaatatttgcatagtgtgcagtttcaggacatcccattacgttg

SEQ ID NO: 6821983 - DNA, 73 bp, Homo sapiens
cctgtgtgtctggaagctcagggagcagctgtgacctgcacgtgggattcctgagctcccatgaacaggcagg

SEQ ID NO: 6821984 - DNA, 64 bp, Homo sapiens
aggccctgaaaccctgtcatggtctttgtctccagcttccaaagccctgaaggtttcaggccct

SEQ ID NO: 6821985 - DNA, 75 bp, Homo sapiens
tctacctctcaggcaggagtctcccttagtcatcttttagataaagaggtaatgactgcttgagtaaattgtaga

SEQ ID NO: 6821986 - DNA, 73 bp, Homo sapiens
taagaacaagggctctgagctggaccacctgggtacaaatccaagtgctctcgttcacggctgtgtgatctta

SEQ ID NO: 6821987 - DNA, 96 bp, Homo sapiens
ctgctgccaggccagctgtgggaatttgctgccctcttctggccaccaacttcggacaagaaggcgtaggagattttcaaagcaggctaccagcag

SEQ ID NO: 6821988 - DNA, 71 bp, Homo sapiens
ggagggcaacagaaatgcaaaatctgaggtcccagccctatggaatcagaatctgcatttttaacgtcccc

SEQ ID NO: 6821989 - DNA, 68 bp, Homo sapiens
caggagaagcagggagtcggggctgcggatctttgcctctgagccctctgttttccctctgcttcctg

SEQ ID NO: 6821990 - DNA, 64 bp, Homo sapiens
tcagacagcttgggataactgagttaccataaaacctgcaatgttgtctcacccactgtcatga

SEQ ID NO: 6821991 - DNA, 61 bp, Homo sapiens
tgccagccataaacccagatgacttttatatgtgggagtacactggcaaatgtggtgggca

SEQ ID NO: 6821992 - DNA, 58 bp, Homo sapiens
gatataacgacttcccaggtcttttacatgtctgagctgaaactggagtccttatatc

SEQ ID NO: 6821993 - DNA, 63 bp, Homo sapiens
ccaggtgggatgtgtggatcctgagtgctgaacaggtaacagtaacgagatgtcctaacttgg

SEQ ID NO: 6821994 - DNA, 55 bp, Homo sapiens
gtgtcttagaaagactgaatgctttttgttagagttctcattctactaagtacac

SEQ ID NO: 6821995 - DNA, 55 bp, Homo sapiens
agtaatgcggtggggaaaacaaggctatcatttcttgaatctgcactgcatggct

SEQ ID NO: 6821996 - DNA, 71 bp, Homo sapiens
tggtggggataggcatgacatgcagggatttctatttttaataaactcccaagtgatttctatttacacta

SEQ ID NO: 6821997 - DNA, 109 bp, Homo sapiens
tcagtgattctgtaaggatgaaggtgatgtagagtagtagatggcagctctactctggaagtccagaatactgctctgattcacacctgcaagccttattggtcaatga

SEQ ID NO: 6821998 - DNA, 80 bp, Homo sapiens
gagacggcaagggcaaggcgggatgggccaccgcccccgctggagcggcaggagccacctgcctgacccttgtctgcttc

SEQ ID NO: 6821999 - DNA, 69 bp, Homo sapiens
ttgttgttgttgtttttcttatggtgggacctatttcttgaagcactatacagaagaggataggaacaa

SEQ ID NO: 6822000 - DNA, 71 bp, Homo sapiens
accagctggtcacctgggcactattctctcccttctgtctgtgtccctttgaaagcagttgaccacctggt

SEQ ID NO: 6822001 - DNA, 75 bp, Homo sapiens
gtttgagataagatatactattaagtaccatggtaaagtactatgcaagtttgtggtggtatttcagtttctaat

SEQ ID NO: 6822002 - DNA, 55 bp, Homo sapiens
aattctgatcagttcttttaagcttcattgaaagagaaaaggagagatcagagtt

SEQ ID NO: 6822003 - DNA, 61 bp, Homo sapiens
ttagtccccagtgtgcagctcttctccactttaaaaggaggaggcctgaaactgaggctga

SEQ ID NO: 6822004 - DNA, 85 bp, Homo sapiens
ttcttcctaggtgacagcaacactcaattctgcagaagtaaccagtcagttttgctctgggttcttgctgttactgacctaagag

SEQ ID NO: 6822005 - DNA, 69 bp, Homo sapiens
gcccttcctggcagaggccccgacagcactggtcccacacagccccctgcctggggccctgtcaagcgc

SEQ ID NO: 6822006 - DNA, 59 bp, Homo sapiens
agttacattctgagctgagtagtttaaaaccactattaagctctccaggaaatgtatct

SEQ ID NO: 6822007 - DNA, 63 bp, Homo sapiens
ttaaactgggtccctgctggcagtttttggcagctgaaccaacaataagcaggacttgtttag

SEQ ID NO: 6822008 - DNA, 74 bp, Homo sapiens
tagcaggcatggagatgactgtgtagaaccctctaaatcacactaaccagtcctgtctttatgacttcaagcta

SEQ ID NO: 6822009 - DNA, 101 bp, Homo sapiens
ttcatcacatctataaatttattctttttggggtcatgtggtagagaattttgttcaccagaagttctccaaaaagatttgaaaatttgttagagtgagaa

SEQ ID NO: 6822010 - DNA, 66 bp, Homo sapiens
atcaccaaccagtagctgagttcaaaaactacatatttcttgggcagtcctctactggtatgtgat

SEQ ID NO: 6822011 - DNA, 66 bp, Homo sapiens
tgggtaggtgtggcctgaatgttgtcagttacccacttctataaatatcccagtcacatctaccca

SEQ ID NO: 6822012 - DNA, 55 bp, Homo sapiens
gatgttattgtgatcatgatactatctgacaagggcagtgatgcatgataacatc

SEQ ID NO: 6822013 - DNA, 76 bp, Homo sapiens
tgtcagtagtgccattgccaggaagggccatgaggaaaacaagggtcctctccctggctggtacattcccctggca

SEQ ID NO: 6822014 - DNA, 86 bp, Homo sapiens
actagcagaatgtaggccttcagtgttaacatagcctttttctgttattgcatttatctgcctttgttctgaagccccagtctagt

SEQ ID NO: 6822015 - DNA, 82 bp, Homo sapiens
tcaccctcagctccctccacccagaccagacaaacttcaggttagtttgtaggagggtgctggaggtaagggagcagggaga

SEQ ID NO: 6822016 - DNA, 81 bp, Homo sapiens
tctggcaatatctggagatgctttttgttgtcacaatgggggagagagtgtgctactggcatctagtgggtagaggtcagg

SEQ ID NO: 6822017 - DNA, 77 bp, Homo sapiens
gggatcttgttaaaatgcagaaactgatcctgtatgtctggaggagaactaagactctgcatttctaataagctccc

SEQ ID NO: 6822018 - DNA, 81 bp, Homo sapiens
aggtagaatcaggaggacttgataacttactgactttgaagaaaagaagtcaaagatgaccgagttcctatcctgaagcct

SEQ ID NO: 6822019 - DNA, 92 bp, Homo sapiens
acctctgaagtgccacaagataaagtatcataaatgcagaggaatgattccattgctttgtgcatatttaaaaggatatggcgctgagaggt

SEQ ID NO: 6822020 - DNA, 65 bp, Homo sapiens
aggagctgctcttctaggtggatcttcaggagtgaaaggaagaaggaacacactgagcaactcct

SEQ ID NO: 6822021 - DNA, 67 bp, Homo sapiens
ctgctgttagagaatgacgtgcaagcctccagtgccattggaagagcatgcattttctgagagtcag

SEQ ID NO: 6822022 - DNA, 73 bp, Homo sapiens
gtttttaaaagagaagaaaataagagagtgaaaatgacatcttagattttcttgtattcactcatttgggaac

SEQ ID NO: 6822023 - DNA, 56 bp, Homo sapiens
ccaggggtctgctcggcttatgggcactgtgcttgcccaaggacactggctcctgg

SEQ ID NO: 6822024 - DNA, 96 bp, Homo sapiens
atgatgcagcaataccacatgtggatatatgtccaatggaaataaaattagtatttctaagagatatctgtacttctgtgttcattgtagcattat

SEQ ID NO: 6822025 - DNA, 56 bp, Homo sapiens
gacactccatgcaggcatgccgtttgctcttgtaccactgggcctgcatggttgtt

SEQ ID NO: 6822026 - DNA, 69 bp, Homo sapiens
cttaaggtagtcagcctctgtgtacacagtttaaattatctgtaaacatgcatggctgcttaaattaag

SEQ ID NO: 6822027 - DNA, 129 bp, Homo sapiens
gttcccatctggtagtcaggcctttcacgagtagcccaggaaggaagcaggggtttcacaaccattactgagaattcacttgtcttccattttactctcctcctgtaagggtgatgtgctggatccaac

SEQ ID NO: 6822028 - DNA, 61 bp, Homo sapiens
ttggtcctgccccctccaggtccttgaaggctccagctggaagctgctggggcagggccga

SEQ ID NO: 6822029 - DNA, 70 bp, Homo sapiens
gagtggcatctcgcattcttgtttctacagtgccttgaggcatcagccaagatgctgaggttgccttctc

SEQ ID NO: 6822030 - DNA, 58 bp, Homo sapiens
gcacatttagaggttagcatggtattttgcagataccttgagttagcactgaatttgc

SEQ ID NO: 6822031 - DNA, 74 bp, Homo sapiens
ggcccagacacataggaccacactgtggtatgtgtatgaactgtttttcacattgtggtcctatatgtctggtc

SEQ ID NO: 6822032 - DNA, 66 bp, Homo sapiens
gctttgcttttcctaaactgatttctgtacactcaatatggtgttaagtctaggagagggtaaagc

SEQ ID NO: 6822033 - DNA, 56 bp, Homo sapiens
ggatgggtgactttgggcaatggacttcacatctccaagcctcagttttctcatcc

SEQ ID NO: 6822034 - DNA, 56 bp, Homo sapiens
tccaggagtctagcctcaggcctgatcccacggggagctctggagcagacactgga

SEQ ID NO: 6822035 - DNA, 63 bp, Homo sapiens
tttttctctttttggggtggggtgggataggagccttgttcaccccaccctgaggaggaggga

SEQ ID NO: 6822036 - DNA, 92 bp, Homo sapiens
caaacctccccagtgtgacctcagcctccctcccctcctctgggcttgctctggtttcatggatggccgggaggtgatgcacctgtggtttg

SEQ ID NO: 6822037 - DNA, 106 bp, Homo sapiens
gcatttcctacttcgcaggctcatccggagtttcagtcttgcctggcctgcagcttcagccgaggtctgcaaggcagcaccagctcttggagccaggtgggaatgc

SEQ ID NO: 6822038 - DNA, 56 bp, Homo sapiens
gccacagtgggctggggccagagaggggaagttccagggtccccacctagttgtgc

SEQ ID NO: 6822039 - DNA, 76 bp, Homo sapiens
cctacttaattctagtttaacacttagtaaggcttccaggcttcaaaatttgagtgctaaaatagaataaagtagg

SEQ ID NO: 6822040 - DNA, 84 bp, Homo sapiens
ggatagatggaagcaaagtgggatgacagtgctcatatgaagtcatcatattgctgtcattgtccctccaggctgctgtcttct

SEQ ID NO: 6822041 - DNA, 81 bp, Homo sapiens
ggtgagagattgctcagtagaacttttaaccaatttcagaatgagacctgttgggttcattggctccatccatctctcacc

SEQ ID NO: 6822042 - DNA, 95 bp, Homo sapiens
aattcattccagggtgcatacccatgcatacctttagaagaaaatagcctagggtgaatttctgtatgtgtgatgtgcacccagggacttgaatt

SEQ ID NO: 6822043 - DNA, 67 bp, Homo sapiens
gttccttctcttgttcctgtatttggcaaatttgtatgttaggatgtgcatatatatgggagggagc

SEQ ID NO: 6822044 - DNA, 56 bp, Homo sapiens
ctgcttcatgtcctgggacctggcttcttgtctctgactgtcctgagatgaagcag

SEQ ID NO: 6822045 - DNA, 84 bp, Homo sapiens
tcaccaaaggtctcaaacaagaatatgtagacagtagctacgttggatttctgtgtctataagagttgtttatttctctggtga

SEQ ID NO: 6822046 - DNA, 74 bp, Homo sapiens
tcctttagctttttataaccagaaatgatccagagtatttgtaatcacatgaggttatgacaaagcaaaagaga

SEQ ID NO: 6822047 - DNA, 82 bp, Homo sapiens
cctcttgcaccccgagggcccgcacctcgaaactccgtggaattcccagcgaggaactggcggtgggcccgtagggttgagg

SEQ ID NO: 6822048 - DNA, 55 bp, Homo sapiens
ggatgagttaggggcctgagtggacccctgtccctcacctagtctttgactctct

SEQ ID NO: 6822049 - DNA, 73 bp, Homo sapiens
gcaggggcagtggtccaggctacagctactgttatggtcagaaggctgattctcactgacctctgttgcctgt

SEQ ID NO: 6822050 - DNA, 67 bp, Homo sapiens
aggtaatttctccaaacatgctacttactcaacaaaaagtagtctaggtgtcttagagaaggtgctt

SEQ ID NO: 6822051 - DNA, 98 bp, Homo sapiens
agggactccttggacaaaatttcaagtcttgaagaagtaggtttactcaagcaaaactaacctcctttccaagtctggaataggtatgagatgtcctt

SEQ ID NO: 6822052 - DNA, 90 bp, Homo sapiens
tgcttatcactattattgtgcttaaatctaaatgtcatatacttagcaaaaggagatactgctaagttagaggttaggcacttaaaagca

SEQ ID NO: 6822053 - DNA, 56 bp, Homo sapiens
gctgcagcctgttgtaccagcctgtgctgacctgcaggcttctcaataggttcggc

SEQ ID NO: 6822054 - DNA, 62 bp, Homo sapiens
ggtgccctgagcccctcactgtccttccaagacatggcaggcagagagcatggctggggccc

SEQ ID NO: 6822055 - DNA, 118 bp, Homo sapiens
gcaggggcagtgatgtgatgaggtttgctctaatggaaggcttgcagctctgtggcacctggacacatgcagatgtttttgagtagcgggctttcctgcctctcccactgcactatgt

SEQ ID NO: 6822056 - DNA, 76 bp, Homo sapiens
tcttttgttattattggtagaaataggttctggaagacaaaagcagtaagccactaaagctatcagtaacaagagg

SEQ ID NO: 6822057 - DNA, 79 bp, Homo sapiens
tggcagagttatatagtgtcagtgataaatatcatgaagaaaaataaaggtcaagagatgctgtctacagatctggcca

SEQ ID NO: 6822058 - DNA, 84 bp, Homo sapiens
ctctaaacagctttgtcctgcaaacctgaacaaaaagaaattcagtgtgactgtcaggacagatgctccagaaacagttttgag

SEQ ID NO: 6822059 - DNA, 93 bp, Homo sapiens
tccctttggcccccaactctctgccctgcagggagcagtaagacctgaaactcaattgtcctctgtagagcagctcctgggaggacggaggga

SEQ ID NO: 6822060 - DNA, 64 bp, Homo sapiens
ggtccttttctcttccccagagtacattcccccggtatgtacattgagggaggaggagaggact

SEQ ID NO: 6822061 - DNA, 92 bp, Homo sapiens
gaagctcagcaaacctcaagtgcaagatatatgccatcaggtggcgagaagactcagtggcatgttttgctcttgaaaaggtgagaagcttc

SEQ ID NO: 6822062 - DNA, 76 bp, Homo sapiens
aagctttttgagaaactgctttgtgatgtgtgtattcatctcacagagttaaaagtttcttttgattgatcagctt

SEQ ID NO: 6822063 - DNA, 55 bp, Homo sapiens
ggaggcagaacttcccgtcagtaaaactttctctgtgtgaggacatctgcctacc

SEQ ID NO: 6822064 - DNA, 78 bp, Homo sapiens
atttggttccctgcagggttcggggaagacattttggagcaggtgattttttttcctctgagctttgaataattaagt

SEQ ID NO: 6822065 - DNA, 62 bp, Homo sapiens
ttttgtcatcattctgctcctctgtactcctaaatttgagagagacagaatcagagataaag

SEQ ID NO: 6822066 - DNA, 67 bp, Homo sapiens
gttattgagattatggcatgctaaaatatttgagtttgcttaaatttcagcagcttaattttgtagc

SEQ ID NO: 6822067 - DNA, 59 bp, Homo sapiens
ggaggagattcccctctcactttccagaaaaaggacaaagggaattaggaatcttttct

SEQ ID NO: 6822068 - DNA, 85 bp, Homo sapiens
tcagagagagcaagccagtcctctactgggcaccagaagacaatgcaactgggagtccaaggagaggatgaggggctcgatttga

SEQ ID NO: 6822069 - DNA, 82 bp, Homo sapiens
atgtctccaaaaattttggctaaaacgtggagagtacacaaattcttacatagttaaatagtacagctattattggaatcat

SEQ ID NO: 6822070 - DNA, 65 bp, Homo sapiens
ggtagagtgacggctcatctctggaagctcaacctccatgtttcctcccaggacctcactctact

SEQ ID NO: 6822071 - DNA, 56 bp, Homo sapiens
ttgctttgtttaaaagtggtatttcatgtatttcgtgaccctcttgcacaaagcaa

SEQ ID NO: 6822072 - DNA, 121 bp, Homo sapiens
aaagctgccaggtggttcccagtgcctggaaaatgaagaagcagaggctccatgctgggtcatgacttctgtttcagctgttccctgcttctgattttcacgggggctgattgcctgcttt

SEQ ID NO: 6822073 - DNA, 63 bp, Homo sapiens
gctgaggtgcactgaggtgggaactagccccatagctgccactttcacccagtgctcccaagc

SEQ ID NO: 6822074 - DNA, 59 bp, Homo sapiens
tggaatttctctgtactgggatgcaaacaagagctgaaaatccttaaagagaatttcta

SEQ ID NO: 6822075 - DNA, 68 bp, Homo sapiens
cattcccacactccatataattcaggggggatatcaaatagtattcctgagcaggagtcatgggaatg

SEQ ID NO: 6822076 - DNA, 73 bp, Homo sapiens
tttcctttttcaatatagaattgcattcgggctatccatagagtgcctgcaatttcaaatatcagaaaggaaa

SEQ ID NO: 6822077 - DNA, 72 bp, Homo sapiens
ggagcaggagaacaaagcaagctgccccagaccacccggctttcgcagaacccagatgatgctcctgtctcc

SEQ ID NO: 6822078 - DNA, 128 bp, Homo sapiens
gcatgagaaggacctggagtgcttgctgaaattcagattcctaggcatcacccagaccaacagaatcaatcatcctggcagggcccaggagtttgcattttaacaagttccccaggtgatttttatgc

SEQ ID NO: 6822079 - DNA, 68 bp, Homo sapiens
acccagcacaaagcaggcaattctgagatctcctttgcctctctgaattaaaccctttgtgcctgggt

SEQ ID NO: 6822080 - DNA, 101 bp, Homo sapiens
ctactttggaagattagattgtgtgctacacgagggtaaggaatatcgctgactaatctctgtatcctcagcatctagcatgaagtctaagtaccatgtag

SEQ ID NO: 6822081 - DNA, 80 bp, Homo sapiens
tgggcagctcattctagagttcatttcttgcgtgttagaactccttacattcttgaagtgaagtttattttgactgttta

SEQ ID NO: 6822082 - DNA, 63 bp, Homo sapiens
gggtgtggagtaaatcttgttttcaataacctgttgagtgacattttatattgccattggccc

SEQ ID NO: 6822083 - DNA, 69 bp, Homo sapiens
gtgacttttagaacatttagtgggttatgtagccatcactataatcctgttttagaacatttttgtcac

SEQ ID NO: 6822084 - DNA, 84 bp, Homo sapiens
tatcatttgcaactaaaatggaagttgtctggcatgtgatgctatggcatgcaaatagtcatgcttccatagaaacatatgatg

SEQ ID NO: 6822085 - DNA, 93 bp, Homo sapiens
cacaagtgcatttgtcattgaatgtgtacacgattgtttgaggaaagtatttggtttaacgaattgtgcataattccactgtttgcacttgtg

SEQ ID NO: 6822086 - DNA, 68 bp, Homo sapiens
gtgtgtctgtgccacctctccagtgtccagaatgaagcctggatctcagtccctggcatggaatgcac

SEQ ID NO: 6822087 - DNA, 61 bp, Homo sapiens
atcacagatttgatacttttgtgccaattagcttcatgcacacaaaattctgatctgtggt

SEQ ID NO: 6822088 - DNA, 56 bp, Homo sapiens
caccctggaatagtagttctgccacaacaggttattaatgaactctatccagagtg

SEQ ID NO: 6822089 - DNA, 89 bp, Homo sapiens
tccaggctagcgtgagaggccctggtaggtcagagtgtctggttgcctaagcttttgtacatcagtggccttggacacgttttcctgga

SEQ ID NO: 6822090 - DNA, 97 bp, Homo sapiens
ccagaatattgtctatttcacatcctgaagccccactggttgaatgtaccattgtggcattaattcagttactgtgaaaagttgtggttaattctgg

SEQ ID NO: 6822091 - DNA, 127 bp, Homo sapiens
cccaagcccatttcctctacctccctccgtagtgacatctggcctcacgtccccggggttcgtccttacagaatgggatggaggttctcagatgctcattagccaggaggataattgagggcttggg

SEQ ID NO: 6822092 - DNA, 86 bp, Homo sapiens
aggaagcacctgtgttcttttctctaaactgataaactaatgtctatttttacctggaggaaaagaaaatcaacagatgctgacct

SEQ ID NO: 6822093 - DNA, 62 bp, Homo sapiens
ggtgcctcctaccacaccctcagtctgtgatattccagccaggggaaatgggggaaggggcc

SEQ ID NO: 6822094 - DNA, 93 bp, Homo sapiens
tccttgaaggacagaaaccatgccttacttcgtttgtttgtccccagagcagctggtacaggaacgaatgtacattgtttccttctctaagga

SEQ ID NO: 6822095 - DNA, 84 bp, Homo sapiens
agcacttgtcaagcttttttggagaatgttttggtcagaatgacaagataatttgtgactgaggctccaagctagagaagtgtt

SEQ ID NO: 6822096 - DNA, 78 bp, Homo sapiens
aaagaaaaagatgcttattgctcctgcagtgttctctctcaggacctttctgctctaggtcatgggtactttgtcttt

SEQ ID NO: 6822097 - DNA, 80 bp, Homo sapiens
aggccaggatccgcaaaccacactcagcgtatcgggcgtgcaggtcgacgagctgagtgtagtttacttcggtcttgcct

SEQ ID NO: 6822098 - DNA, 72 bp, Homo sapiens
ccaaagcccagtgatggtgatcagatgttacctaagtatgtagactactgcctaccacgctgtacttgttgg

SEQ ID NO: 6822099 - DNA, 62 bp, Homo sapiens
aaagagtggcatccaatttgttgccatatgaggtatggcagcaatttgtgatgttgaccttt

SEQ ID NO: 6822100 - DNA, 71 bp, Homo sapiens
tggccaggattccatggtcaggaaatagctctagtatagagactctgtgtgttggccatggaatcaggcta

SEQ ID NO: 6822101 - DNA, 55 bp, Homo sapiens
gcctggcactcactgaagaggcagggcactggagcttcctccacaggtgccaggc

SEQ ID NO: 6822102 - DNA, 60 bp, Homo sapiens
caccaggcagctgggggtgatgtggagacacaggcacaggtgtgccccacctgcctgctg

SEQ ID NO: 6822103 - DNA, 79 bp, Homo sapiens
agaggcaggctgaagtttaacttgaattctttctctgcttttctgagcacagaaaagataagttaattctccttgaact

SEQ ID NO: 6822104 - DNA, 63 bp, Homo sapiens
ttctttgtcctctccaacagcctctgtgtacactgcacagtagagagttggtgagggcctgaa

SEQ ID NO: 6822105 - DNA, 114 bp, Homo sapiens
ggaaattcattaatgtcggagacagcattagaagtagttggggattattttatcttctacatatatttttctcacttgctgtttcatatttaccactcaaacatagacctttct

SEQ ID NO: 6822106 - DNA, 86 bp, Homo sapiens
aggaaactaagactgagagactaagtgctttgcccaagctcacctggtgtgccatgcagctgccacttgctctcggctcccttcct

SEQ ID NO: 6822107 - DNA, 61 bp, Homo sapiens
gatttggtgagtgacctggagaggactggggtggaagtcccacagagtggctcacctagtt

SEQ ID NO: 6822108 - DNA, 60 bp, Homo sapiens
gagagtatcagtgctcccagcttagcattaaaatgcagcctggtggtcactggagttctc

SEQ ID NO: 6822109 - DNA, 62 bp, Homo sapiens
tctgaggaggcagcgtgctgagaagtgttcgaggtgaacattcagggcagctgctcttcaga

SEQ ID NO: 6822110 - DNA, 58 bp, Homo sapiens
caaaggccattacttgcttttagactctgtgtgttgagagataaggagatggtttgtg

SEQ ID NO: 6822111 - DNA, 72 bp, Homo sapiens
ttgggacatggactgctgaactaaggcaaagttgagcgactcctttgacttcttgcagtccagctatcccaa

SEQ ID NO: 6822112 - DNA, 105 bp, Homo sapiens
ggatagtgctccaccaatgctcaaaactggcttttagtgtgaagacttggactctcattttgatatgtggaagcccactgagtttggtaaacaggtgtatcatcc

SEQ ID NO: 6822113 - DNA, 55 bp, Homo sapiens
ggtatgactcctctgagaaagagcttcttgcgttttctcagggaggagtcaagcc

SEQ ID NO: 6822114 - DNA, 76 bp, Homo sapiens
catggttgtagttttgttattttgtcaggtgagctggttgcagaaactcatcctggagatgaccctaattgccatg

SEQ ID NO: 6822115 - DNA, 83 bp, Homo sapiens
gatgtgactttgacttgaggattgtctcctgtgatgtgctcctagtggggctacaggggtcagtcctttgctttgagcacctc

SEQ ID NO: 6822116 - DNA, 97 bp, Homo sapiens
tattttttccttgaccatgtagaaacagacatcttttcctcactaaaaacttaaaaaaggaaacattgtaattttagcatggattaaagaaaatata

SEQ ID NO: 6822117 - DNA, 60 bp, Homo sapiens
tgctttccattcagggctgtttgaaagttcacctgtctatggatctgctaatgggaagca

SEQ ID NO: 6822118 - DNA, 88 bp, Homo sapiens
gctgtgaaggtgcatatgctacacacatgtgtctctgggggtgggtgcctatgcttctgggcaaatgtgtgtgactgtgcctttgtgt

SEQ ID NO: 6822119 - DNA, 102 bp, Homo sapiens
ttttctttgcctaccatacatacatctagagtcataaaaacatttgggtggcattccatcagttgctctatgtgtgttctatgtgtgtgaacagtcagaaaa

SEQ ID NO: 6822120 - DNA, 83 bp, Homo sapiens
gagtagtaaagtctaacacactggcccccagtactgacagatttcctgttatacagcattgctagtgatgtagatttactctc

SEQ ID NO: 6822121 - DNA, 69 bp, Homo sapiens
gcagagtgggtggggcaattccaaagggacttttccattttccctcctgggctgcactccattttctgc

SEQ ID NO: 6822122 - DNA, 85 bp, Homo sapiens
tctttctaatcttcagtgtcctcatttgtgagatggggacagttccaatacatagtacagagggctactggttgattaaatgaga

SEQ ID NO: 6822123 - DNA, 61 bp, Homo sapiens
cctgtgggaaagctggtggtggtgtccttttccaccatcttagtggccagctctcaccagg

SEQ ID NO: 6822124 - DNA, 56 bp, Homo sapiens
gggcagtgattttccttagaggggagcaagaaggtcaccaggaaagtctgctgtcc

SEQ ID NO: 6822125 - DNA, 73 bp, Homo sapiens
cagccacctgagataagagagctcacaccggtcagaggtatgatgcgtctcctctttcaggtatttagggttg

SEQ ID NO: 6822126 - DNA, 68 bp, Homo sapiens
tggcctctggggtctagcaatagcaggaatggtgcccctgtctttagcagaggacctcagtgtttcca

SEQ ID NO: 6822127 - DNA, 61 bp, Homo sapiens
ggtataaacaagcttcactaagtgtaaaatgctacatgagtgttagtagttgtcttatgct

SEQ ID NO: 6822128 - DNA, 63 bp, Homo sapiens
cagtaatggaaatggtcaggccataagatgaaatataacttcattggaatgatcgttttgctg

SEQ ID NO: 6822129 - DNA, 118 bp, Homo sapiens
gtaaatggtgtttgcaggcaagtaatgatttttcctccctctctataaatgatattactttggtagagagagaaatgaaatgtgctgatgttatttgttctttgtgaaaccattttgc

SEQ ID NO: 6822130 - DNA, 61 bp, Homo sapiens
cttcagattgtacacataattgcctttggctgccaaccaaaggcttgtgtgttcagtgagg

SEQ ID NO: 6822131 - DNA, 69 bp, Homo sapiens
tctccctgagcattcatgtgagcttgctttcaataattaagttaggctagctgattgccttagaagaga

SEQ ID NO: 6822132 - DNA, 72 bp, Homo sapiens
ctgggcaccactgctgccttgttgccctgtggctgtgaggtgccatagtgccaagtcttcagcacgccccag

SEQ ID NO: 6822133 - DNA, 92 bp, Homo sapiens
gcactaggagagccaggagtgtctccacacagcaaagagacaccctgaaattacctctgatttgcttcttagatattcctctctctctgtgt

SEQ ID NO: 6822134 - DNA, 110 bp, Homo sapiens
gcccatttctcattttcctctgtgctcccatggagctgatccaatggtttttaagggagctctgagcttggacaagctctgaagggcatggggcaagacaagaaacgggc

SEQ ID NO: 6822135 - DNA, 56 bp, Homo sapiens
gctgtgaccttagcaagggaaatttggaaacggagtcttgtgttttcaggcagagc

SEQ ID NO: 6822136 - DNA, 58 bp, Homo sapiens
cctgagctggcagtgacctggaacccgatgagggcgtgggtgacacatcagcgtcagg

SEQ ID NO: 6822137 - DNA, 130 bp, Homo sapiens
cagtgatctattatcccatcattgccctccagcctgggcaacagagcgagggcctgtctttttttcctttgagatggagttgagctctgttgtccaggctggagtgcagtggtgtgatcttggctcactg

SEQ ID NO: 6822138 - DNA, 120 bp, Homo sapiens
tacatggtgataccatagcgtgtttaactgttcatgtattgaaaagcattttaattgcttccagttttggttttgtttcctaataatgattgtttccaagctgctatgaagaatcatgta

SEQ ID NO: 6822139 - DNA, 129 bp, Homo sapiens
caatacccctcattcctttacgtggttgctacaggcgagtgggtacgcttttggtctctgcaggttctgccgtgagtccagcaggatgcaagtgccatcttgtagaattcatgggaatggaggaggatg

SEQ ID NO: 6822140 - DNA, 86 bp, Homo sapiens
gagtctcgctccgtcgcccaggctggagagcagtggcatgatctcagctcactgcaaactccgcctcccgggttcaagtgattctc

SEQ ID NO: 6822141 - DNA, 70 bp, Homo sapiens
gtcccacctttacttcccctttgttttgatatcttgcaaatagaggggctccccagtaaggttgacgggc

SEQ ID NO: 6822142 - DNA, 59 bp, Homo sapiens
caggacaagctgccagcatcccggaaggggttaatccccctctggtggctcagctcctg

SEQ ID NO: 6822143 - DNA, 70 bp, Homo sapiens
actggcatttggaaattgcaagtgatttgcatggtgaaatacagtgaacatggaaatttcctatttcagt

SEQ ID NO: 6822144 - DNA, 57 bp, Homo sapiens
attggcagggccagcatctccctgcagctgagagggttagctcaggccctagtcagt

SEQ ID NO: 6822145 - DNA, 58 bp, Homo sapiens
gtgaaggcttgacgtcatcaggcagcattagcatcacctgggacttttcaagcctcac

SEQ ID NO: 6822146 - DNA, 111 bp, Homo sapiens
tgttcagttgatggatgtgatgaagacaacacatgtatgccactcttctgggccaacacccaggtagatggcgtttatgctgttggctttagcagccaatacctgtaaaca

SEQ ID NO: 6822147 - DNA, 60 bp, Homo sapiens
ttgtctgaaccatctccctggcccagcacccgggatttatcctgggaggtgttcagagaa

SEQ ID NO: 6822148 - DNA, 65 bp, Homo sapiens
ggaaagggtggggtgctacatctttacagccaggtggaagtagaggtataggcttctcgccctcc

SEQ ID NO: 6822149 - DNA, 87 bp, Homo sapiens
ccctggggaaaggctcaacagctgtactttgtctaggaacttttacgtaggataaagtctttctcattggccatgctgtccctaggg

SEQ ID NO: 6822150 - DNA, 63 bp, Homo sapiens
atcaaaaccacctggagggctcgttaaacagcgatcactgagtccattgccagaatttttgat

SEQ ID NO: 6822151 - DNA, 97 bp, Homo sapiens
atccaaaccaatctcgtgtgtatttgctggctgagatctgttttcctcatgttctgtagaagggaaggagtaacatggtctcctttagatgctggat

SEQ ID NO: 6822152 - DNA, 82 bp, Homo sapiens
actctgtcagctgtgcaaggtcactgtcctctacagagtagaacatcgacactgagaaagtgacctgccaaggccacagagt

SEQ ID NO: 6822153 - DNA, 129 bp, Homo sapiens
aaccagatgtagtccctgtaccacactgttgaggacgagatgtggcctcctgcatgctatcattctagtccttatggtctgcttcgtgttctgactatcctgcattcatcaatatccatctctaaagtt

SEQ ID NO: 6822154 - DNA, 87 bp, Homo sapiens
tagctggttttacaggtgtgagccaccatgcccaattaatttttgtatttttagtagagatggggtttcaccatgttggccagacta

SEQ ID NO: 6822155 - DNA, 69 bp, Homo sapiens
gtgcagtttaaacttggcaacttgatgccctggtgttccctgggggagttagggagtttatatttgcac

SEQ ID NO: 6822156 - DNA, 67 bp, Homo sapiens
tggcaaagctccaaatgggtggaagtggccagaaatgggcccagcttcctccatctggggcttgcta

SEQ ID NO: 6822157 - DNA, 82 bp, Homo sapiens
atgagagagatcaattctcctggagaaatgccttattctcatctctagaaagaagagcatttggtgagatttgactcctcat

SEQ ID NO: 6822158 - DNA, 58 bp, Homo sapiens
ataaagtcctctttcacaaacagcttggcaaactgtgcaagtcaaagatgggctttgt

SEQ ID NO: 6822159 - DNA, 57 bp, Homo sapiens
gaattgggctgcagtttttagttacaattgacgctactgccaaactgagttcagttc

SEQ ID NO: 6822160 - DNA, 77 bp, Homo sapiens
ggagagaggggtggacatgagagatggaaagagactcctgtctacatgttcctatggctcagttgcatttctcttcc

SEQ ID NO: 6822161 - DNA, 58 bp, Homo sapiens
cagccacttccatctgcacttggctttcttcttgagtccacagttctggcaagggctg

SEQ ID NO: 6822162 - DNA, 75 bp, Homo sapiens
gcaggctccctctgggctgagttcatggccctgccccctggtggccagagccggcttcacaggataagagcccgc

SEQ ID NO: 6822163 - DNA, 96 bp, Homo sapiens
gttaagtattaggctgatgccaaagtaactgaggcctttgccactacttttaaatggcaaaactcgcaattacttttgcaccaacctaataataac

SEQ ID NO: 6822164 - DNA, 96 bp, Homo sapiens
gtcgcaacctagaatgtgggctggagagcgctgtcccagtggtggccccgaggccacaggttctgtcccagatgttctcagcaccattttagcgac

SEQ ID NO: 6822165 - DNA, 87 bp, Homo sapiens
catctttactgcccgtccctttgctctcgcgctgctacaacgaggagagactgcagcctgagtcggggctggggatggggggagatg

SEQ ID NO: 6822166 - DNA, 81 bp, Homo sapiens
tgcctctcctcaccctccctctcttcctgcagggcctgggaagggctttgagggagcctgggagccatgtgaagaggggca

SEQ ID NO: 6822167 - DNA, 74 bp, Homo sapiens
acagtgtaaataactctccagaattattactattatttttaataaaggtaatatttgggggaaaattatatggt

SEQ ID NO: 6822168 - DNA, 62 bp, Homo sapiens
tccatccgtccatttattcactgagcatttgttatgtgccaagaagtatggttggggctgga

SEQ ID NO: 6822169 - DNA, 60 bp, Homo sapiens
cggcgctggtacagtggaagagggctgtccagccctggatgtctttcatttctagctctg

SEQ ID NO: 6822170 - DNA, 73 bp, Homo sapiens
agtgctgtctcaagaaggattctggaatcacaagagagatcagtgaagaaagggctccttgttgattagcatt

SEQ ID NO: 6822171 - DNA, 59 bp, Homo sapiens
gttatgtgtgtgtatacatacaaacacacatgacttttgtatgtacacacacacaaagc

SEQ ID NO: 6822172 - DNA, 113 bp, Homo sapiens
ctaaactatgttttcttgtttaatgcccaaggatctggttctttttacaaacttttttccatgttgaggtaaagagaagtcagagcctgcatgtgcatctgactgtagtccag

SEQ ID NO: 6822173 - DNA, 55 bp, Homo sapiens
gaataggggcagatgaggaatggggctggcttcagggagaactctgcttctgttc

SEQ ID NO: 6822174 - DNA, 59 bp, Homo sapiens
gggcatagccatgagtgaaagttagcacctcgaacttgtcactataagagggcttgccc

SEQ ID NO: 6822175 - DNA, 76 bp, Homo sapiens
gagtccagccaacaccttgatagttacctgtgaaagaccctgaagcagaggactcaatcaaggtatgcttggattc

SEQ ID NO: 6822176 - DNA, 62 bp, Homo sapiens
cagcctctctgtatctcaggatcctcgtctgtaaaaccgcagtcctagttgccatgaggctg

SEQ ID NO: 6822177 - DNA, 56 bp, Homo sapiens
ctgagctgtgtcttggtgagagtcttcagcttactccacatttgaacacagttcag

SEQ ID NO: 6822178 - DNA, 91 bp, Homo sapiens
gtgaatgcagaggactctgaggtgccacccaagagccttttaaaataaatagaagtttttaaaaatgctacttaagagtcactgcagaagc

SEQ ID NO: 6822179 - DNA, 56 bp, Homo sapiens
tttcttctcacccaggacagagtcacagagaccttgaagaatggaggaggtagaaa

SEQ ID NO: 6822180 - DNA, 57 bp, Homo sapiens
gagtgcctggaccctctttccggaggaaacagtcccctctggacctcgttcggcctc

SEQ ID NO: 6822181 - DNA, 57 bp, Homo sapiens
cacatgaggtggagatgaatgagtcttcttttgacaaaacattttatcccttatgtg

SEQ ID NO: 6822182 - DNA, 94 bp, Homo sapiens
gtcttaaatgcttcatgggataggagatgatccaatgggaactgaatgttttcaattaggatgtttccatggatactattaagcatgccaagat

SEQ ID NO: 6822183 - DNA, 81 bp, Homo sapiens
cagtgctgtcattctcttagtattgctagtttagcttattctcttacatgtgctggttcaggccactaagaagacccactg

SEQ ID NO: 6822184 - DNA, 65 bp, Homo sapiens
gggactagcttgtgtgaaggccttgcagtgaaaaactgctgaagagctccaggcaatgcggtcct

SEQ ID NO: 6822185 - DNA, 69 bp, Homo sapiens
tctgaaatggatgagagcagaggttaaattgaaagaatgagggatgagatctttagccatccaatcaga

SEQ ID NO: 6822186 - DNA, 55 bp, Homo sapiens
ggaggtgcctgtaaaaatgagcatgttttattctaggttcatttctaggcactcc

SEQ ID NO: 6822187 - DNA, 65 bp, Homo sapiens
gagagacatggagaggcaaagttacacagcaagttagtgaaccaaaaccacactccatgcctctt

SEQ ID NO: 6822188 - DNA, 82 bp, Homo sapiens
gatagtgacttgagtgagaaataaaccttaatgcattaagtgacaaaatgttaaggttatttgttatgtcagttagcctatc

SEQ ID NO: 6822189 - DNA, 64 bp, Homo sapiens
gagggatgtgcctgaaggcagggagttggatctggtgacttcttaagtcctttccacatctctc

SEQ ID NO: 6822190 - DNA, 64 bp, Homo sapiens
cgccactaggctcgctacgaggaagcgccgctgagggtccatctttttaagagatctagtgacg

SEQ ID NO: 6822191 - DNA, 63 bp, Homo sapiens
cctgctggacgtggaggaggggctgagccttgggctgcattctctgcacccacctctagtagg

SEQ ID NO: 6822192 - DNA, 67 bp, Homo sapiens
cctgcctgagtctgtacgttagccataattgcatcacaaggttatatggctcataaaacagagcagg

SEQ ID NO: 6822193 - DNA, 67 bp, Homo sapiens
ccgagtgtgaagggctcgtccaatttggatgaattctttcccccaaggatccagcccttcactctgg

SEQ ID NO: 6822194 - DNA, 92 bp, Homo sapiens
agaaaggcgttattttcatgcatgtttaaggggcatgcattaactgagccaatgcaagtcaaattagatatgtattgattaatgttaattct

SEQ ID NO: 6822195 - DNA, 61 bp, Homo sapiens
atagttagtatgtgtagtctagcttttaattaactaaaagcagggccagaatacttgctgt

SEQ ID NO: 6822196 - DNA, 58 bp, Homo sapiens
gatttttctactctccttatctctttagggagataggacaggagaagtagcagaaatt

SEQ ID NO: 6822197 - DNA, 85 bp, Homo sapiens
taaagtttgtgttctggtccagaatttatgattctaagtcaggaggatggggagtttgttttgaggccaggaggacattatttta

SEQ ID NO: 6822198 - DNA, 98 bp, Homo sapiens
aagtgcagagatgtttcttcttttggtggtgggcttggcagcctggacagcagcagtgttaagttgtcagcagcactggcaaagagactcctgggctt

SEQ ID NO: 6822199 - DNA, 67 bp, Homo sapiens
actattcagatataccagtatttgtatttagatattcccatttagatggctggtgttctgagctagt

SEQ ID NO: 6822200 - DNA, 77 bp, Homo sapiens
ggagaacctccagcttggagagaagtttcttggccagggtcacacatccaggaagcggcttccaaactggactctcc

SEQ ID NO: 6822201 - DNA, 60 bp, Homo sapiens
ccttgaaatgagaaaaagttggagcttaagtaagtgaattgaagctatttccattcaagg

SEQ ID NO: 6822202 - DNA, 80 bp, Homo sapiens
tcacttgttgatggatttttgggtcattgcagtttttgatattactaataaaactgctataaacattcatgtacaagtga

SEQ ID NO: 6822203 - DNA, 75 bp, Homo sapiens
gctggagcagagggcatggccatttaagcttttggtcaacacagtgtgatgggcctgcctgaaggctgtaccagt

SEQ ID NO: 6822204 - DNA, 65 bp, Homo sapiens
caagttcatctctagacaggaggctggtgaggtggacatcagccaggccctaagagattgacctg

SEQ ID NO: 6822205 - DNA, 66 bp, Homo sapiens
gaagggctgcatcacaatggcctgtagacttcatccttccctcactctgcctgtgttcagcctttc

SEQ ID NO: 6822206 - DNA, 79 bp, Homo sapiens
actttctttgtttctgtttaaattgtgtatacttatcataaacaattcaagcaagagagacaaatgcaaaggagaaggt

SEQ ID NO: 6822207 - DNA, 91 bp, Homo sapiens
ccagaagccccctcagcaggcttctgctgatatttcattggctataaccatgtcaattggctgtcacggaggctggagggtgggcatttgg

SEQ ID NO: 6822208 - DNA, 75 bp, Homo sapiens
tgacataggataaactgtatttgggattgtgtaataaacacacagtatgaaaagtctagttaatcctttatgtca

SEQ ID NO: 6822209 - DNA, 63 bp, Homo sapiens
atgtctttattaatatcatgccaagggatgacattatgagccttgcagaattgattaggacat

SEQ ID NO: 6822210 - DNA, 120 bp, Homo sapiens
tttttagacatttagaaatagagtcagtattcagatgctttttaggtattacctgaacagttctttctcagatgcctgaaagcatgttgttgctcactcattcttggatttttttaaaaa

SEQ ID NO: 6822211 - DNA, 71 bp, Homo sapiens
ctcattgttgggctttgctggagagagagagatgttcttcctttgtagtctgagcaatagcctcaaatggg

SEQ ID NO: 6822212 - DNA, 61 bp, Homo sapiens
attctgatatgaacacacatatatatataattgtgtacttgtgaaagtgcatgtctagaat

SEQ ID NO: 6822213 - DNA, 65 bp, Homo sapiens
gagaagacgtgatggccaagaatcagaaacaattcccaacggcttcctggtagtcaagtctcctc

SEQ ID NO: 6822214 - DNA, 84 bp, Homo sapiens
ctgtacccactaaataaaggcttggaaactagagtgtgcagcaagtcctaaagctctgggtttctagatccctagtgggtgcgg

SEQ ID NO: 6822215 - DNA, 88 bp, Homo sapiens
ggtcagtctggtaaactgcagtttttggtaaaagcaccctggctggctgacactgccgaaactgtagagttttcattacctactgact

SEQ ID NO: 6822216 - DNA, 130 bp, Homo sapiens
cagttttgaggggcaggaatctggaagtggcttagctgagtggtgctggctcagggtgtctcaagacaagctgttggccaaagccacagtcatctggagctagacaattccgtgctcactcatacggttg

SEQ ID NO: 6822217 - DNA, 60 bp, Homo sapiens
aggttcttgactctaccttccagtaaaatattcctatggaaactgaagagacaggaactt

SEQ ID NO: 6822218 - DNA, 56 bp, Homo sapiens
gtactgtctggagttgccaaaggctataacatatgcctttttgcttatggacagac

SEQ ID NO: 6822219 - DNA, 81 bp, Homo sapiens
aaacaaaacacaactgagttaaacaatgaagaaagcaagcttttgatgacaaacttttggctgagaagttgtgctttgttt

SEQ ID NO: 6822220 - DNA, 87 bp, Homo sapiens
agatgaagaagattctttaagttctagcattgactgttgaaagccacttgtataaaaggtgccaagaactacaggattctttcatct

SEQ ID NO: 6822221 - DNA, 81 bp, Homo sapiens
ctccaagttgtcctgctggcttccatgcggacatcatgaatgttcctgaaccagctggaggcgagtttggatatgacagag

SEQ ID NO: 6822222 - DNA, 59 bp, Homo sapiens
gcctgcagagagaaccattcaacctgctcaaacgtggtagattctcccacctgccaggc

SEQ ID NO: 6822223 - DNA, 55 bp, Homo sapiens
cctcctgcggcgtccgcgctctgtctctctctggctcgtggagctggcaggcagg

SEQ ID NO: 6822224 - DNA, 67 bp, Homo sapiens
gtatgtgagagacacactgtgcatgtagtttacagacagcactgggtgccacatggtttccagatac

SEQ ID NO: 6822225 - DNA, 89 bp, Homo sapiens
gtggtcctggtgctggtcattgtcggcctctgtctctggctgccctcggcctccaaggaacctgacaaccatgtgtacaccagggctgc

SEQ ID NO: 6822226 - DNA, 96 bp, Homo sapiens
ggggaaaggacatcaggggagctgcgacctcaggaggacccctcctgagggaatggaggaaaagggaatcagctcacccatacctctactttcccc

SEQ ID NO: 6822227 - DNA, 59 bp, Homo sapiens
gacactggggactctggccttttgacaggacatgtgtcaaaatgccgagtgcccaggtc

SEQ ID NO: 6822228 - DNA, 79 bp, Homo sapiens
tgtgtcccccgctttcctgggaagactgtgaggacaggagcttgtccctgttcatatccccagcacagtgcctggcaca

SEQ ID NO: 6822229 - DNA, 91 bp, Homo sapiens
gcgggcctgggggcaaaggctcagaatcggcagacccagaccccagttggtgtgtttgaaagctgagcctgctggtcctcccgggccacgc

SEQ ID NO: 6822230 - DNA, 62 bp, Homo sapiens
gaggacaagctgtgagtggggttgcagaacaagtctggagaaccctgctttatgccgtcctc

SEQ ID NO: 6822231 - DNA, 61 bp, Homo sapiens
agtcacacagggcctccaaatcagaagggtactgcctctggtttaatactctgctgtggct

SEQ ID NO: 6822232 - DNA, 57 bp, Homo sapiens
atgatcatggaagtgcacccattggggttatataagggttgtgtgcttcatgatcat

SEQ ID NO: 6822233 - DNA, 58 bp, Homo sapiens
tgtcctgcaagccctaatgaatcctgccctaggcagttttagcaagtgtttgagggca

SEQ ID NO: 6822234 - DNA, 57 bp, Homo sapiens
taaggctgattagactgatagcttttataattcaaggctaaccagctaacagtttta

SEQ ID NO: 6822235 - DNA, 108 bp, Homo sapiens
ggagagaaggccatcaggccatatacagccagctgaatgtaccatgactcatactgaatgggatcaggcattcagtgggctgactgaagccgtgtatcctatcactcc

SEQ ID NO: 6822236 - DNA, 109 bp, Homo sapiens
cattgacggcctcagcattctttcagtatataaaataatttctctgttgtggggtattttctcaccagtctttattttgttattagtcgccatagaggtaaaatcgatg

SEQ ID NO: 6822237 - DNA, 63 bp, Homo sapiens
gcttgtttgcacattgttttaggaattcagaacacatttcccatagaaacaatgcagacaagc

SEQ ID NO: 6822238 - DNA, 118 bp, Homo sapiens
gagtgagctggcagccctaggagcagcgggacatgcccctcagtgggtgtctcacctgggagacaaagctcgccacctctgagggcgggtcattcttgctgtcctgccaggtcacctc

SEQ ID NO: 6822239 - DNA, 115 bp, Homo sapiens
gcctgacttggcctgtgcccatggacatgctgactatgtgtgctttgtgaatgcaagttttctgtgtgccacgaggtcacttggatgtgaagtctgtaggtgcttgtgagcaggc

SEQ ID NO: 6822240 - DNA, 59 bp, Homo sapiens
ggctctggagatgtccgacctgcatttggatgacaggtattgaccacctccttgatgcc

SEQ ID NO: 6822241 - DNA, 93 bp, Homo sapiens
ggatgctcaatattctggggatgtacatggattcctttcctccaggagaagcactaagggagaggccacatgtacagccactaatatgcagcc

SEQ ID NO: 6822242 - DNA, 81 bp, Homo sapiens
acctcccaagccttgtccccagcaggttggttttgttttcttgaagcttgtctgaaggagataagtctgcacctgggaggt

SEQ ID NO: 6822243 - DNA, 69 bp, Homo sapiens
tgtgtgtcttgaccaggatcggatataaattctattattggaagtttccaggaccctggtagacacaca

SEQ ID NO: 6822244 - DNA, 62 bp, Homo sapiens
cacaagtgaaccatgtgtccttggctatttgtccttggggaagatacatggcttctcttgtg

SEQ ID NO: 6822245 - DNA, 69 bp, Homo sapiens
cactcctccctctctgtctattcccccacctccgttaccacacataggtaagcagtgaggtgaggagtg

SEQ ID NO: 6822246 - DNA, 74 bp, Homo sapiens
agaatgttcaaatccatcaaatcttctagaactttacacacaggtactgaaagagtggtggactctggcatttt

SEQ ID NO: 6822247 - DNA, 61 bp, Homo sapiens
tccagaagttctttcatataggctgaatataataaccatcctatatacagagctttatgga

SEQ ID NO: 6822248 - DNA, 86 bp, Homo sapiens
gagtctcgctttgtctcctaggctggagtgcagtggcacgatctcggctcactgcaacctccgcctcccgggttcaagtgattttc

SEQ ID NO: 6822249 - DNA, 91 bp, Homo sapiens
agcatccagtccagagaggaggctgtgtgcgctggggaaatggtgactgacccacagatactgagcatcctttctgtggcagcttggtgct

SEQ ID NO: 6822250 - DNA, 79 bp, Homo sapiens
gtcacatatgtttatactttgatgtactcatgcaaaacacatggcaaaaatgggtttattaatgtgaactgtataagac

SEQ ID NO: 6822251 - DNA, 56 bp, Homo sapiens
agataagtagtaagtatgtatgccttgaagccatcaggctgtgacttacactatct

SEQ ID NO: 6822252 - DNA, 55 bp, Homo sapiens
ttctgaaatgttgagagtccatttgtgagactggaaacttggaacgtcttcagaa

SEQ ID NO: 6822253 - DNA, 79 bp, Homo sapiens
tcctgggacaggaaggctggttccatccctggtgtgactgcttaccacctcagggacgggatcacttggtctcccagga

SEQ ID NO: 6822254 - DNA, 65 bp, Homo sapiens
tgaaagttctgggggagaagaacgaattgagaggattatacgttggctgctccccaaggctagca

SEQ ID NO: 6822255 - DNA, 89 bp, Homo sapiens
gctacctttagatgtttccagatgagtgaaatcctgggaggaggatgcgcctcctgtttgttacctcgtttgagtttcagaggggaagc

SEQ ID NO: 6822256 - DNA, 77 bp, Homo sapiens
ccaagtgtcctaactcccaacatcatggctctagaatgacataccaggaagaagctcgtagtgttgggataggctgg

SEQ ID NO: 6822257 - DNA, 100 bp, Homo sapiens
gctgagaaggcctgcgcttccagcccattcctgccatgccgctgccctaatggctgtgacaatggatggatggatggacggagggccaggccaaccaggc

SEQ ID NO: 6822258 - DNA, 98 bp, Homo sapiens
gcataatacatgaaaaattggagcaggtgctcagggtaataatttgtataaatagctattgccttacactagcatctaaattataatcattaactagc

SEQ ID NO: 6822259 - DNA, 59 bp, Homo sapiens
gcctcttgcaaagcggttagcctctctcctcttcgagctgtacctcttcagaaaggggt

SEQ ID NO: 6822260 - DNA, 70 bp, Homo sapiens
attcgaagcttcttagaatgcatgtgccaaacatcttatggaccagtgttgctaggaagctgctttgggt

SEQ ID NO: 6822261 - DNA, 78 bp, Homo sapiens
ggtcgcacccatccttgcagggaaactggacccagccagaccctggctccagccctgagcaagctcttgggagaggcc

SEQ ID NO: 6822262 - DNA, 57 bp, Homo sapiens
ctcttcctcttctgctgagaagtgggggaatggactttggaggtgggagggggaaag

SEQ ID NO: 6822263 - DNA, 57 bp, Homo sapiens
gtaaagagctagtttataacttgtcttcagaattttggatacaagactagcatttac

SEQ ID NO: 6822264 - DNA, 69 bp, Homo sapiens
gcacctatgagaacgggggcgtgtgggacagcccagggccccgcacgacgctttcgttctcgccggtgc

SEQ ID NO: 6822265 - DNA, 60 bp, Homo sapiens
atacatatgtatttgtgtatacgtgtggacccatatacatgtagacccatatatatgtat

SEQ ID NO: 6822266 - DNA, 129 bp, Homo sapiens
tggctaatgacctgtaaccactcccttgcttgctggagtcacttccattgtatttcagaaacaaatatcttttcaagaaaatacagagttgcttaaaagctataggggattccattactccattaacca

SEQ ID NO: 6822267 - DNA, 73 bp, Homo sapiens
gtcttttattctagacacggctgacttcattgctagctctgatgttcagcaatagatctagaggctggaagac

SEQ ID NO: 6822268 - DNA, 65 bp, Homo sapiens
acactgtgagtaactgagatccaatcccattgggatatgcttccaagttattccacccaaagtgt

SEQ ID NO: 6822269 - DNA, 57 bp, Homo sapiens
gcatgcggatctcatcactgtgattacaccgtgttagccacagtgattgttctatgc

SEQ ID NO: 6822270 - DNA, 96 bp, Homo sapiens
gtgacttgctaactgatgagaacagaacagaggccttatgtttcagaaactaatgggaattatggtcactgttcctggggggcttaagcaagtccc

SEQ ID NO: 6822271 - DNA, 128 bp, Homo sapiens
ctgagacggagaaagtggtgtggcagaagaggttgctggtggccatgggtcggggtgcagattatgagagaactctggccagtgactgctcacccggggcagcgttgagtccatcaacaccgttttgg

SEQ ID NO: 6822272 - DNA, 67 bp, Homo sapiens
aattagctttccgccatcacacaattatgcagttccatccatcaagggtgtggtgggaaagtggatt

SEQ ID NO: 6822273 - DNA, 70 bp, Homo sapiens
cagttttgggtgggcaatgttaagacggaggatgtaaacctagtgacagctgcacaccccttcaggactg

SEQ ID NO: 6822274 - DNA, 79 bp, Homo sapiens
cactatggaaaatcagtttgagaaatggcagggagagcaataggaggttgttagatatttcttagaagaagccatggtg

SEQ ID NO: 6822275 - DNA, 77 bp, Homo sapiens
tatgtcatggctgaaattcttcgcttgcaatagattgtgaccctctctaggataagcatattccagtcatgtccata

SEQ ID NO: 6822276 - DNA, 60 bp, Homo sapiens
ttcctcaccagaacatgttgtcccctttcatcaagggtgcagcttctgaaggtgtaggaa

SEQ ID NO: 6822277 - DNA, 89 bp, Homo sapiens
aattgaataaggcaacatatatgtaaagtactttgtatggtatgaactacacattgagtgctccataaatcatagcccttgttataatt

SEQ ID NO: 6822278 - DNA, 72 bp, Homo sapiens
gttaatagctagctgtggcttaaaatattatattgtgagtgttttattcgggagccactgcagttgattaat

SEQ ID NO: 6822279 - DNA, 129 bp, Homo sapiens
gtgtggtggggattggggagcaggacaaggggcaccaggggcaggagggccaggaccctgctttgtacctttgtaggcttggtacctgccctgggccttgcctcgtgccatttgtagaccccaccaggc

SEQ ID NO: 6822280 - DNA, 111 bp, Homo sapiens
gtcatgcaaacttttatgtaactttttattatctatatattttgcacttaatcacatactgtcataggttagggaaatattgtaggttagggatacaggaattaaagtgac

SEQ ID NO: 6822281 - DNA, 56 bp, Homo sapiens
gttcagtttgctacaagcaacatcttcagaagtggcagaatagtggcaggatgagc

SEQ ID NO: 6822282 - DNA, 55 bp, Homo sapiens
tcccgtgtctttttccagccctgagcgaaggctgtggggttggctggcacaggga

SEQ ID NO: 6822283 - DNA, 104 bp, Homo sapiens
actgctttatactgctttgctgccattatattttactgcatgggaggaccacaatctattttatttattagtgaagacatagtcagtttccagttataagcagt

SEQ ID NO: 6822284 - DNA, 56 bp, Homo sapiens
gcacagactgtatcttaatcatgctggaaaccccagcccttaggacagcatctggc

SEQ ID NO: 6822285 - DNA, 67 bp, Homo sapiens
tatcattcatacaagtttgtttcatttcatggtggtattgagatgaaagtagaatgtctgaatgatg

SEQ ID NO: 6822286 - DNA, 74 bp, Homo sapiens
tgaaagattttgagcataaaggacatttgtcacttctggcctgaagcaatagaaactccctatgtaatttttca

SEQ ID NO: 6822287 - DNA, 66 bp, Homo sapiens
aaatctaatgcagttctgggtatttcaacaaagcttttagttgaagtcccatgcatgtattgattt

SEQ ID NO: 6822288 - DNA, 70 bp, Homo sapiens
aagtctttgctactgtgaatagtgccacaataatcatatgtgtgcatgtgtctttatagtagcatgattt

SEQ ID NO: 6822289 - DNA, 72 bp, Homo sapiens
ggcccaggagggggctagctaagtgcctgagatgttcaaagttaccatcataacagctaagtccctttctcc

SEQ ID NO: 6822290 - DNA, 73 bp, Homo sapiens
taatgaaatgtttacgaatataccattaatgaagcaagttgacattaggttgtgctttgtggacatttaatta

SEQ ID NO: 6822291 - DNA, 65 bp, Homo sapiens
tttaggccagatttatttgacatctccactttgatattccacggagagttcaaactctgtctgaa

SEQ ID NO: 6822292 - DNA, 86 bp, Homo sapiens
tctgttccccagtccctgctttcctcagctggcctgattgggggtcttcccagaggggtcgtctgaggggagggtgtgggagcagg

SEQ ID NO: 6822293 - DNA, 74 bp, Homo sapiens
atataggctgatggcttcctgagtctttctacttgatagtgttctctatcctcaggagcttcctcagcccatat

SEQ ID NO: 6822294 - DNA, 59 bp, Homo sapiens
gggctccagaggctcaccctggcctccttctcctggcccagggcagcagcacggagcct

SEQ ID NO: 6822295 - DNA, 76 bp, Homo sapiens
cacgaccatctctccacggcagctctcgggataaattggcctccagaggcagccgggggagaacgagctggtagtg

SEQ ID NO: 6822296 - DNA, 100 bp, Homo sapiens
tctggatcagggtgcttcgcttacatctgcactccaggacagggttatgaatccttcctgtcctgtggacctgaggacgttgaaggaccctcttttcaga

SEQ ID NO: 6822297 - DNA, 82 bp, Homo sapiens
ggaaggcattctcagggtgcccggatcccaggccagggtcaaggtaatggtttggcttcctggcttcactgaggctgcatct

SEQ ID NO: 6822298 - DNA, 76 bp, Homo sapiens
aatgacagctacagggagagcattgccacttggaaacaactttgcagatgttgttcctgcctgtagacaggttatt

SEQ ID NO: 6822299 - DNA, 62 bp, Homo sapiens
ctgtgtgtgtctgcagcatactatataaaataaaggagttttcagggctgctggccatacgg

SEQ ID NO: 6822300 - DNA, 63 bp, Homo sapiens
ccatctgatatgtgtgggctcatacagaaaacatgctgtaatgtgaagacataaatcagatgg

SEQ ID NO: 6822301 - DNA, 69 bp, Homo sapiens
gcaggtctggtgagagaacagttaaagaaacctgaggacccgctctttactctgtcttgagccatctgt

SEQ ID NO: 6822302 - DNA, 77 bp, Homo sapiens
agatgtgtattgatgagcattactctctaactgctcgtgtcaaagcacttggggaggctcatcaatcttgtgcgttt

SEQ ID NO: 6822303 - DNA, 82 bp, Homo sapiens
ggcttgtagatggcttccttctcactgtgtgcttgcctggttcttgtttagttcatgcatggagatagggagactgtgagcc

SEQ ID NO: 6822304 - DNA, 61 bp, Homo sapiens
actgcatcagcccaggtcacgtaatcaagtcttccttgacagcagctctgggttgagtagt

SEQ ID NO: 6822305 - DNA, 76 bp, Homo sapiens
gtgccaacaggactgtcgtctccctgacaccttggctcacatgccacggatgtctctggctgcagcctgttctcat

SEQ ID NO: 6822306 - DNA, 110 bp, Homo sapiens
gtcaggtaagttaataaatatttattgagagtttacattgttcaagcaattgtgctttggacactggagattcgtcagtaataggcacacatggaatttaataatctgac

SEQ ID NO: 6822307 - DNA, 65 bp, Homo sapiens
ggagcactgatacgagtttgactttttcaagagcgcttgaattccaaattgtgtttgtgagctcc

SEQ ID NO: 6822308 - DNA, 102 bp, Homo sapiens
gcgatgctttcccttcttggagagattatcagaccagcaatcttttagaaaaggtccgtaggaattttgtgagctttcccagaagataggtagggtatctgc

SEQ ID NO: 6822309 - DNA, 59 bp, Homo sapiens
cctggcacagggagacagccgtggcctgagtgcccaggctggttcatccctgggtcagg

SEQ ID NO: 6822310 - DNA, 76 bp, Homo sapiens
tgtattctttctgctgttcattcttttagctctgagtatttataagagacttcaccatgaatataggaatggtaca

SEQ ID NO: 6822311 - DNA, 68 bp, Homo sapiens
gcttttagagagagagctgggcactctgtggagtttctttatatgacctgaggccttactctagtggc

SEQ ID NO: 6822312 - DNA, 59 bp, Homo sapiens
tctgcctttcacacagacggccaacctctggaaggaccgggcctctgaggacaaggaga

SEQ ID NO: 6822313 - DNA, 58 bp, Homo sapiens
gcctccagaagcgggagagaagacattcctgttgttttaaactcccctagttggtggt

SEQ ID NO: 6822314 - DNA, 58 bp, Homo sapiens
tcttaatagtgctaaaccattgactatgaaattggtttgagtggtagtattattttga

SEQ ID NO: 6822315 - DNA, 63 bp, Homo sapiens
aggacacagcaggaggttgggggaaaggaatgaggccactccctgggcctcctgctatgcact

SEQ ID NO: 6822316 - DNA, 62 bp, Homo sapiens
gggcaggggcagctcggtggctcctgtgtccctgcctcgggcctgcctgctgtcatctgcct

SEQ ID NO: 6822317 - DNA, 119 bp, Homo sapiens
ttaatgaagtaatattagggtaccttcagataatgacaggtcaggagatctgctctgttcatcttctcttggtacctgacactgtctgtgaatgggccttttgtttatatattcattaa

SEQ ID NO: 6822318 - DNA, 82 bp, Homo sapiens
ctatgagtcataaaccaatggggttggttgggaatttccaagaagttcagtatgacagacgcattggaggtgtggcttggag

SEQ ID NO: 6822319 - DNA, 79 bp, Homo sapiens
gaagaagaaattgcgtcatccttctcaggcagagatgatcttcctgacctgcggggaggagggccgccttttcggcttc

SEQ ID NO: 6822320 - DNA, 65 bp, Homo sapiens
ttcactacctttagctgtagaggttttctcattcctccacagacttcaacagcataatgtaggaa

SEQ ID NO: 6822321 - DNA, 65 bp, Homo sapiens
gggaagggctttctgggagaagagacacttaaaactgagtcctctggactgaggaggcttttgcc

SEQ ID NO: 6822322 - DNA, 67 bp, Homo sapiens
tggccatgggtgggagtgaaggggctcagccttaggggcgggaagtcttttcttccacccaaatcca

SEQ ID NO: 6822323 - DNA, 63 bp, Homo sapiens
tggtaaatgctccaagcagtactgtgtttaaggaacctgttttgcccaatgcagcatttccca

SEQ ID NO: 6822324 - DNA, 76 bp, Homo sapiens
tgtgaagaaaatatgagatgttctctttcgggtcataaggactcactgaagtagtacatgtttatggagcttcgca

SEQ ID NO: 6822325 - DNA, 57 bp, Homo sapiens
ttggaaggcagcatttgtccatggaattggagagagacgggggctgctgctttccag

SEQ ID NO: 6822326 - DNA, 98 bp, Homo sapiens
gaaggctaaggagctaatccattgcacatctgagaagagattggaccttgcaactctttctcatttgctgtagagtctagtttccttgatatgccctc

SEQ ID NO: 6822327 - DNA, 61 bp, Homo sapiens
ctccatctctgtacctcagggggctaaaagtagtaagtgcagagccctgggcacatggtag

SEQ ID NO: 6822328 - DNA, 77 bp, Homo sapiens
ttttaccttcttaggcctggaattctccagctctgaacatagcaggagttaaggataccaggccaaaaagtgtagaa

SEQ ID NO: 6822329 - DNA, 59 bp, Homo sapiens
gcttcacaacgacatctggttagagctcagcttcctctgaccaaaactgttgctgaggc

SEQ ID NO: 6822330 - DNA, 65 bp, Homo sapiens
ttcctttctctgtccctaatcaccctcttctcttggtgatgtgtgggcatgcagacaggcaggga

SEQ ID NO: 6822331 - DNA, 63 bp, Homo sapiens
tggcagtggccctaacaccgtttctcaggattcctttgaacggtaagtgccattcaagagcca

SEQ ID NO: 6822332 - DNA, 60 bp, Homo sapiens
gcctatggatgacaaatattcttctcagattctagcagtagagttactgtcatcctaggt

SEQ ID NO: 6822333 - DNA, 58 bp, Homo sapiens
atgcacattgaaccatatattagtggattatttctgtgatataaagttcagtgttcat

SEQ ID NO: 6822334 - DNA, 56 bp, Homo sapiens
ggagaggaggattctttggcaagaggggaaggactaatgaagcgtcgctcctcttc

SEQ ID NO: 6822335 - DNA, 75 bp, Homo sapiens
tgttttcttctgaggcattaacatataaagaagtttctttgatgaaatttaatttatagatgtggatagagaaca

SEQ ID NO: 6822336 - DNA, 63 bp, Homo sapiens
tcagaagttcatttagcctctctggtttctgaaaataagaggactcagctagatgaattctga

SEQ ID NO: 6822337 - DNA, 59 bp, Homo sapiens
tcacaatctgcctgccagcagtgcttcgtgctctgctgaggcccaggagcactttgtga

SEQ ID NO: 6822338 - DNA, 69 bp, Homo sapiens
ttcagtttccttgagaaaggcacaagttgttacttctggtaattttgcttttacttagagtggactgga

SEQ ID NO: 6822339 - DNA, 57 bp, Homo sapiens
agcagtggctaataacagctaaacagtccatctagattgttgctgtaagcctttgct

SEQ ID NO: 6822340 - DNA, 95 bp, Homo sapiens
gtctggtcaaaattctgtcattaaattgtggccaactcaattgatctctttgagcctcaaggtcctcaactttgacatgggagggttggaccgac

SEQ ID NO: 6822341 - DNA, 91 bp, Homo sapiens
gattctgactatatttcccttgactcgtttatatattggtattaagcccgttctggagctgtggtcaacaggaaattttattcagtttatc

SEQ ID NO: 6822342 - DNA, 69 bp, Homo sapiens
gcactgtgagcagggaagtttctgtctctggaaatacaatcaaaacatgtgcttttattgctcaggtgc

SEQ ID NO: 6822343 - DNA, 82 bp, Homo sapiens
ttataactttatttgatgtatctgacgatcagggattagttctcatccacattgactgtctgtagatttttgaaagtggtaa

SEQ ID NO: 6822344 - DNA, 79 bp, Homo sapiens
ccctgggttctgtccaggcgcccagctatggcgcccggccggtcagcagtatggttagcgtctatgcaggtgcccgggg

SEQ ID NO: 6822345 - DNA, 85 bp, Homo sapiens
gggcacgggcagggctcagccgctcccacctccccacagaagcccaggagtgtgtggacgtctgagcccagctttctgcgtgccc

SEQ ID NO: 6822346 - DNA, 129 bp, Homo sapiens
tggacatgtgttttcatttcttttggatgtattcctagcattgcagttgctgggtcatatgtaaatatgtaactttacatttaacctttgaggaactgccagagtatttccaatggctgcaccagtcta

SEQ ID NO: 6822347 - DNA, 80 bp, Homo sapiens
tgcaatgttgggttgtaagagagtgcactttaaaaccatggatagaaatagaggtaactttgcttacatcttcatgtgca

SEQ ID NO: 6822348 - DNA, 55 bp, Homo sapiens
cagaaagcttggtacaatatgctgatttctattgcttttctgtatttgctttctg

SEQ ID NO: 6822349 - DNA, 59 bp, Homo sapiens
gtacagcctgatttggagccactgttacagtgtgtgcattggctcctagtcagctgagc

SEQ ID NO: 6822350 - DNA, 60 bp, Homo sapiens
ttggaggggccactgcagagctcgcggtccttgaggacacggctggcggtgcctttccgg

SEQ ID NO: 6822351 - DNA, 72 bp, Homo sapiens
tgagctcataaatatattgggttttagtgattgctgtagtaattgctgtagctactatgtattcattgctta

SEQ ID NO: 6822352 - DNA, 106 bp, Homo sapiens
tctgttagacagctggtagagtacattttcttaaatatttgcaggacatagccatgtgttagttgttcatgttaagagtagcctgtgccactgtttcctagacaga

SEQ ID NO: 6822353 - DNA, 73 bp, Homo sapiens
ggaaaacctgtagttttcttaccactatgaaatgaagccattggatagacataagaaaaattttaggtcttcc

SEQ ID NO: 6822354 - DNA, 55 bp, Homo sapiens
ctcccttgcttctggcattttgctggcctcagccaatgggaggccccagcaggag

SEQ ID NO: 6822355 - DNA, 113 bp, Homo sapiens
tttggattttaaaattaagaaaatgactgtgtaggtgatatcagcaagatggcagtataggaatttctagccctgattccctcacagaaacattaatttgacaatgaaccaaa

SEQ ID NO: 6822356 - DNA, 72 bp, Homo sapiens
ggctttatgtgtcctcaagagcaatgattttgcaaattcagaattgctacttcctcaggaaaacttgaagtt

SEQ ID NO: 6822357 - DNA, 59 bp, Homo sapiens
ggaaagaggacagctctaactaaagtcaggactattgctatgttggacatgcctcagcc

SEQ ID NO: 6822358 - DNA, 63 bp, Homo sapiens
gcttattctcatctagaggctgtggcagcttgcccatgaaacgatgtctctgtgggaattggc

SEQ ID NO: 6822359 - DNA, 56 bp, Homo sapiens
tctatgaggaaggtgcaaggaagccacaaaatacttccagggctaattcctgtgga

SEQ ID NO: 6822360 - DNA, 81 bp, Homo sapiens
gtcatttctagagaagactgctgagagaatggaaatgagcttcgtttcttgaatctaatgcagtttctcagcaggaaaaac

SEQ ID NO: 6822361 - DNA, 72 bp, Homo sapiens
ctgagggaggcctccagccacatgccagtgaggaactgaatcctcagaaagcaactgaaggccttagttcag

SEQ ID NO: 6822362 - DNA, 55 bp, Homo sapiens
tggtctgatttctttctggagttcacttcctccatggggtgctgaagttagatca

SEQ ID NO: 6822363 - DNA, 70 bp, Homo sapiens
tggacattagtagcttgctgtgtgattgttaattccaatcagtttacattaggtcaagctgccaagttca

SEQ ID NO: 6822364 - DNA, 76 bp, Homo sapiens
cccctaggctgctgctaccaccctgaaagtgccagcctgtctgcagggaggccccgcagccctcaagccccagggg

SEQ ID NO: 6822365 - DNA, 62 bp, Homo sapiens
tttcacattttatacttaagcctattttccattttgagttaatttttgtatgaggtgtgagg

SEQ ID NO: 6822366 - DNA, 100 bp, Homo sapiens
ggaaagagtctgtgctagggcagaagagtggggtgcagtctcccagagctgaaatagcaccttaactctgctgcgtgatccttagacatttaatctttct

SEQ ID NO: 6822367 - DNA, 80 bp, Homo sapiens
ggccttcatgggagcccagggcacctgcttctccacccagcacgctggtctgctttgccctgggctttgctatgactgcc

SEQ ID NO: 6822368 - DNA, 80 bp, Homo sapiens
ttcccgcggcccttgcctcccgggagcggctcccctctgacgactgagtggactgcgcttgagggggccgccgctgggaa

SEQ ID NO: 6822369 - DNA, 90 bp, Homo sapiens
ccttccaatattttggctacttcatggtccatgtattttttagatgacagagcattgcacgacatgagaggctgtggagtacaaggaagg

SEQ ID NO: 6822370 - DNA, 64 bp, Homo sapiens
cctgagtgcaagatgacggtggcagacacgtacaaagacttccccaccaggtcttctgctcggg

SEQ ID NO: 6822371 - DNA, 68 bp, Homo sapiens
gtaaattgttggcctttaaactggactttctgaatcagaacctcctgagatggagtcctgcagtttat

SEQ ID NO: 6822372 - DNA, 122 bp, Homo sapiens
cgcttgtttgcagacgaggacgctgaggaccaaagagaagggacttgcccaatttggagcatttgggcttcaactttggccccttcctagctctcagttttctcatctgtaaaatggaagtg

SEQ ID NO: 6822373 - DNA, 80 bp, Homo sapiens
tccccactggagagctgcagaggtgcaatgaaccagcaaggggagttctgctgggtttgcctttcaccatgccaggggga

SEQ ID NO: 6822374 - DNA, 85 bp, Homo sapiens
tcctttgagatatggtttcttctttcatttaagagctgttattttgcttggtttcaaagatgataggaaatcatagtttagagga

SEQ ID NO: 6822375 - DNA, 67 bp, Homo sapiens
caagtatttgcggagttccacgtttgccagctaggatcaaatccccgtggtagctagccaatacttg

SEQ ID NO: 6822376 - DNA, 62 bp, Homo sapiens
gttctagacaccagggattcagcagcaaactgaatagataaaaattcctgctgtcatggaac

SEQ ID NO: 6822377 - DNA, 64 bp, Homo sapiens
tgccctctgcaggccgccatgggaagtgcacactgcatcccctaggcaggattgtaggcgggta

SEQ ID NO: 6822378 - DNA, 66 bp, Homo sapiens
gcagataaatgtgaaatgagcagttatgttgtaagtaagacatgctttgttccatcatttgtgggc

SEQ ID NO: 6822379 - DNA, 58 bp, Homo sapiens
tctgtccccacagagaaggctggggctggagtccgacagctggcgcctggggaccaga

SEQ ID NO: 6822380 - DNA, 73 bp, Homo sapiens
ggggatatatcgtgttcctgggttgagaggattctttcaacacaggaacatgatataaatgtcagtcctcccc

SEQ ID NO: 6822381 - DNA, 72 bp, Homo sapiens
tgaaaggctgaggctcatgccatcttggcatgctttaggattatggcaaggaggtaaaagtccattttttca

SEQ ID NO: 6822382 - DNA, 129 bp, Homo sapiens
ctaattatgtgtgaattgtgcagaattcagggaagcttataagttttcatgctcaattgtgaatagtttgttttcacagatagtatgtaaattaagcaaccaaaaatgaattccttatgcatcatctgg

SEQ ID NO: 6822383 - DNA, 81 bp, Homo sapiens
tgggtggcagagggagagaaggaggaggatttgacccatttacgttaaatctcatgagcttcttgtcccaacaattaccca

SEQ ID NO: 6822384 - DNA, 94 bp, Homo sapiens
ggttggaagctgagggaccttgccggctctgagctcagcgtcagagtttagcaaacagtgaagcgtgctcggtgcagggttcggcttgctgact

SEQ ID NO: 6822385 - DNA, 65 bp, Homo sapiens
ggtgggtggatggagagaggcccccagcctaaggacccaggctcctgccttcccaccacccgtcc

SEQ ID NO: 6822386 - DNA, 56 bp, Homo sapiens
gctcagggctgggagctgttgttgctgctggcagcccagctgctatgtacctgggc

SEQ ID NO: 6822387 - DNA, 56 bp, Homo sapiens
tcatcctcttgccccttgattttctcctgagagtctgacttggccaggagctgtga

SEQ ID NO: 6822388 - DNA, 74 bp, Homo sapiens
tagaggttatttctgtatgcataaaaggaaaaaaaagtttgttttatgtcctttgtatgtgatatggatcttta

SEQ ID NO: 6822389 - DNA, 81 bp, Homo sapiens
gagccaagacaatgagtggaatcaggccgtgcgtggggccaagataaactgtgctaatgtcctgaccgttctggatggctt

SEQ ID NO: 6822390 - DNA, 57 bp, Homo sapiens
gtgatgataagtctttagacaggttcatattgtcctgtcatctgaatttctcatcac

SEQ ID NO: 6822391 - DNA, 61 bp, Homo sapiens
atgaggcctttcttcaccctttcttggtggcttgccttgagggtgttaggagatggtccat

SEQ ID NO: 6822392 - DNA, 69 bp, Homo sapiens
acactgtgtctagcattttacaggggagcaataatgtttgttcataaaaggatagcagatggatggtgt

SEQ ID NO: 6822393 - DNA, 130 bp, Homo sapiens
ctcactgaagttccctttctgggacagtcctgtgtgttcacatttgctgggacaaaagtgagtgtaagcagtgagtagtgaacagccacaggattttaatcaatcctgtgaagagggaaactttccatag

SEQ ID NO: 6822394 - DNA, 83 bp, Homo sapiens
tatgcaaagtcctaagaaagaaatgcaagagggaaggccagaaaaatgcatatattctttattagtttagtgagctttgtgta

SEQ ID NO: 6822395 - DNA, 94 bp, Homo sapiens
gggctctggatgagtaagagccaaggcctcagtctcaaccgtaaaatgacaagctggttctggggctaaatggcactgcctaaatccagggctc

SEQ ID NO: 6822396 - DNA, 73 bp, Homo sapiens
gtgccaggagtggagacaggacagtcgatacaagaggggcccctgtcatgtcagctgctgagtcccctggggc

SEQ ID NO: 6822397 - DNA, 71 bp, Homo sapiens
ctgcttgggaaagctgcagaaattctcaggacttggaggcttgaaatgctcaggggttttccagaaagcag

SEQ ID NO: 6822398 - DNA, 77 bp, Homo sapiens
aatgcagataagaatcaggtttgataaatgagggaaaacaattttataggataaaccaatgatttaaaatctgtatt

SEQ ID NO: 6822399 - DNA, 87 bp, Homo sapiens
aatctcacatgggcacgtgctttcttggaccattcctgccaccattgcaagtgggtcttctggaaagcagactgtgaaatggagatt

SEQ ID NO: 6822400 - DNA, 60 bp, Homo sapiens
gcagggccgggcacgcagcaggcattcatggagtgctgctgatggatgcctggaccgggt

SEQ ID NO: 6822401 - DNA, 64 bp, Homo sapiens
atcactctgcatttttgacccttaaaaacaacactgacttggggtcacaggggagaagagtgat

SEQ ID NO: 6822402 - DNA, 62 bp, Homo sapiens
ccatgttagtctgctctagctgccataaaataatatcacagactgagtggattaaacaatgg

SEQ ID NO: 6822403 - DNA, 59 bp, Homo sapiens
tcgcggataagcagtgaacggtctatgaatggtgagggcaataacgagcttgtctctga

SEQ ID NO: 6822404 - DNA, 58 bp, Homo sapiens
acccaggctggagtgcagtggcgtgttctcagctcactgcaacctccgcctcccgggt

SEQ ID NO: 6822405 - DNA, 62 bp, Homo sapiens
ccctcagctgccccagtggccccagcatccactgcttgggggcggtggggtcaggtgcaggg

SEQ ID NO: 6822406 - DNA, 66 bp, Homo sapiens
gctgtaaacccaggtggacaaggctttcacactataaagtaagctcaaagtctaacctggcacagc

SEQ ID NO: 6822407 - DNA, 63 bp, Homo sapiens
gcaacagcattctcattgacatttggggccagataattctttgttgtcaggggtgtgctgtgc

SEQ ID NO: 6822408 - DNA, 71 bp, Homo sapiens
aggtaagttgccctgaagaacgtcccagattttgaaattatctgtttgcttcttcatggtatcacttgtct

SEQ ID NO: 6822409 - DNA, 75 bp, Homo sapiens
gtccttttggcctgggaggctgaggttgcagtgagctgtgatcatgccactgcacttcagcctgggtgaaagagc

SEQ ID NO: 6822410 - DNA, 62 bp, Homo sapiens
taataacactgtaaaaattgtttggcgtagttgcagataaggttaggattatagtgttatta

SEQ ID NO: 6822411 - DNA, 58 bp, Homo sapiens
cagcttgcttcacagctcagcttataggtgtccgagctgagatttgaagcaagttctg

SEQ ID NO: 6822412 - DNA, 111 bp, Homo sapiens
ttggtcttaaggttcaatcaaggatgtctgctcacttttcttgctatctctgtggttctgcaaggatatgggtagtatgatgtcatagattgaccatttgttaagacacaa

SEQ ID NO: 6822413 - DNA, 69 bp, Homo sapiens
gcttggtagatttgagcgtgagtagctgacaaatgttatcaattttatgcagtcgacatctgatcaggt

SEQ ID NO: 6822414 - DNA, 83 bp, Homo sapiens
catctctagtgcatgctgccacctgtggtagtctgtagttactgtcagtcaccaccaggtggcagtattgttgaatagaaatg

SEQ ID NO: 6822415 - DNA, 74 bp, Homo sapiens
gtaatagttttagcaaaggtgtcttgggcatattatcaagatgctattagaagccatgctgttttcattgttat

SEQ ID NO: 6822416 - DNA, 77 bp, Homo sapiens
tttctgacggctccccaaagataacggcttcttcttttttgcaagccagcaagctgttcttggagagtacaaagaga

SEQ ID NO: 6822417 - DNA, 82 bp, Homo sapiens
ggaagcaaggaatgaattctacatgcatcctagtttttcctgttgtaaatgaggagtatggtggggtcattctttggcttct

SEQ ID NO: 6822418 - DNA, 80 bp, Homo sapiens
ttgaggttgaacaagaccatagatatcgcagaagcaatcttactacagaatacttctagatttttgtaattgttccccaa

SEQ ID NO: 6822419 - DNA, 60 bp, Homo sapiens
ggaactcagtatcagactccagagggctttgggatctggagtcatgactgcctgagatcc

SEQ ID NO: 6822420 - DNA, 63 bp, Homo sapiens
ttgcagttttctggagggggttgcagtcaaggacttgccctgcccctcctgctagatatgcaa

SEQ ID NO: 6822421 - DNA, 68 bp, Homo sapiens
gcttacctctcttgaaggcccaccgcttcagccacagcttggagaaggccggccaggagtggttgagc

SEQ ID NO: 6822422 - DNA, 55 bp, Homo sapiens
tggcctcaaccgtcctaagcacacgtgtgctagaaaaagggagagttgggtgtca

SEQ ID NO: 6822423 - DNA, 83 bp, Homo sapiens
gcaggcttctgccactgggtgagttgatgaaggagatgatgtctcctctcataatgctgcaccaaacagatggaatggcaagc

SEQ ID NO: 6822424 - DNA, 77 bp, Homo sapiens
ctgttacaaaggagtagagaaggcttttcttcttcagtcttagtacagaggcttttaatcttagtctcttgtgatag

SEQ ID NO: 6822425 - DNA, 83 bp, Homo sapiens
agggagaggtggggtgagctgcagactacacccacatggctataaatggggagcctctggctgctgctcactcagcctccctt

SEQ ID NO: 6822426 - DNA, 62 bp, Homo sapiens
gatgattgatggtgatagtgctgtggttaatggacataccactgtatttcccatcacttttc

SEQ ID NO: 6822427 - DNA, 72 bp, Homo sapiens
ggcaaggggatgggctcttcagctttgatcagggcagcagcctggaggactgaggggacccagaaccttccc

SEQ ID NO: 6822428 - DNA, 81 bp, Homo sapiens
acctgttatttgtggtgctgatttgttgctgagatttagattttcatgtgtgttactcaagagatagctttaaatgcaggt

SEQ ID NO: 6822429 - DNA, 68 bp, Homo sapiens
gcagttctagcatgccttttagcacatacttactgattatgtgccagaaaatatgctgaggatacagc

SEQ ID NO: 6822430 - DNA, 68 bp, Homo sapiens
catgtagagtccattaatgcaagtttctttaactttgtgtttatgaaataggcaaatgcttctgggtg

SEQ ID NO: 6822431 - DNA, 61 bp, Homo sapiens
ggtctcagcaggggtgtcattgtagttatcccctggtagctcctgcagactcctgctcacc

SEQ ID NO: 6822432 - DNA, 55 bp, Homo sapiens
gttgattccggggccatttcaacgtgcagaggcttgggatgggtctgggaccagc

SEQ ID NO: 6822433 - DNA, 61 bp, Homo sapiens
tatttctggtcctccttagcattgggttaaattagcacctgcatgcttgaggtcaggtgtg

SEQ ID NO: 6822434 - DNA, 80 bp, Homo sapiens
tacttcttctggtgctattcttttcattctgctgtctgagttttccagcactgtcttctgagagggcattataggaagtg

SEQ ID NO: 6822435 - DNA, 104 bp, Homo sapiens
acctcagtctgaacccatataaatcttggacagactaaaattgcacagtgggatcatttcattcacatgagtttgccaatatgtgggtattaacaggcaaaggt

SEQ ID NO: 6822436 - DNA, 56 bp, Homo sapiens
gcaggtctagaagctgcctctgaaccacatcacactgtgcatgcttgtggagttgt

SEQ ID NO: 6822437 - DNA, 112 bp, Homo sapiens
aatgcatcaggcgttttaagaatgaagtgaaagtaagaaagtaggactgcccaatggaggacagtcttccaagagttatatttctctcttttttctaaatgcctatggcatt

SEQ ID NO: 6822438 - DNA, 68 bp, Homo sapiens
tagttttacttatcttttggttatcacagttaaaacaaactatgctaactgggggaaaagagatcctg

SEQ ID NO: 6822439 - DNA, 75 bp, Homo sapiens
ctttgtatttactgattttaaacttacttaagccttgtttcaaaaaaggcctaagtggttaaatggcttacaaag

SEQ ID NO: 6822440 - DNA, 56 bp, Homo sapiens
ctggggacgtcgggcagtgttctgaacagcgggagccagtgcctcaacttccccag

SEQ ID NO: 6822441 - DNA, 72 bp, Homo sapiens
aagcaagggagacagcagaaactagagcacttgagtaaaagctggatgcttaggtccctgttgttcatgttt

SEQ ID NO: 6822442 - DNA, 58 bp, Homo sapiens
taacatgttcaatgcatgtctgtatcattttcaagatttacatgcatatggacagttg

SEQ ID NO: 6822443 - DNA, 58 bp, Homo sapiens
aggcagggctgctgaggaagccttgcggagccctgcaagtgacctcagcatgttccct

SEQ ID NO: 6822444 - DNA, 68 bp, Homo sapiens
agttgaagcagggtggccagattgtcattcttttggtatcctaggtagacaatgatggtgtttcagct

SEQ ID NO: 6822445 - DNA, 74 bp, Homo sapiens
agtagtcacttaataggttcatctgaagaaggaatcatttattcattgcagaaatatttattgagtgacatact

SEQ ID NO: 6822446 - DNA, 55 bp, Homo sapiens
caaccgggtagtttctttttagagaagcagaaaactgaagaggaggagcaggttg

SEQ ID NO: 6822447 - DNA, 78 bp, Homo sapiens
tcagatgattctcatttgctggctatatgatgtcctgctctggaaaagcatgtagcttagaaatgagactgcatgtga

SEQ ID NO: 6822448 - DNA, 72 bp, Homo sapiens
agcaatagattccagtgtgcttccttgctacacataattttgggatgacaatggggcacatggaaagtagct

SEQ ID NO: 6822449 - DNA, 59 bp, Homo sapiens
agtcagttgcagtttatggatgattcggttatggtttactctgtatgcttgcactgatt

SEQ ID NO: 6822450 - DNA, 68 bp, Homo sapiens
gtgggatgggaggagagactgacctgggagccacttcagaacatccttcctccttttctcccacccac

SEQ ID NO: 6822451 - DNA, 79 bp, Homo sapiens
cactaagtaatttccactcctacgtattttgatatagagatgttgctatttttctatttacagtgctaggtacatagtg

SEQ ID NO: 6822452 - DNA, 69 bp, Homo sapiens
gtctcgcccgccctgcctctcgggctctgcccagcttcctgagtcctgacagagcacagtgggggagat

SEQ ID NO: 6822453 - DNA, 98 bp, Homo sapiens
tcaaggtttaaagggtatggctcttgaaaattggaacacagaagaaaaccagcctcatctgagtgaaatatttcaagaattgccttctcagaccatga

SEQ ID NO: 6822454 - DNA, 110 bp, Homo sapiens
taatacatcctggcatatttgcatcaatggaatgctctacagttatttttaaacaatgatagagactatagagcacttacttgggatgaaaagatgcctgcaatatattg

SEQ ID NO: 6822455 - DNA, 66 bp, Homo sapiens
gttttccttggtattattagacatgggtgttataaccaatctgtttcaacaatgcttagagaaaac

SEQ ID NO: 6822456 - DNA, 57 bp, Homo sapiens
attgttgctttattatctctaggttctcctccttccctggagtctgggggtggcagt

SEQ ID NO: 6822457 - DNA, 59 bp, Homo sapiens
cctgttatacctgagccacaaagctgcacagctttgtaccagccacatatgaaaacagg

SEQ ID NO: 6822458 - DNA, 60 bp, Homo sapiens
ctcctgaccttgtgatccgcccgccttggcctcccaaagtgctcggattacaggtatgag

SEQ ID NO: 6822459 - DNA, 67 bp, Homo sapiens
gagggtgacggtgggggtagcaatggtgtggaggacataacactgctaaatctccatcgattacatc

SEQ ID NO: 6822460 - DNA, 76 bp, Homo sapiens
ctactctttattattgtgagtataactgcatttaaatgaacaggataaatataagagcagtctccataaggggtag

SEQ ID NO: 6822461 - DNA, 58 bp, Homo sapiens
ccaagacgggctggctcggacttggccaaccgctatgtccagagccggcctgctgagg

SEQ ID NO: 6822462 - DNA, 56 bp, Homo sapiens
ctctgtgcctcagttttcttctctgtaacaaagagagtagtaccgaccgcacaggg

SEQ ID NO: 6822463 - DNA, 57 bp, Homo sapiens
gctgtgtacattgtcactcatcaagtttacgaaagagctaggggacatgtgcaaggc

SEQ ID NO: 6822464 - DNA, 114 bp, Homo sapiens
agcagaggaaattcgaggtatcggctttcagtataaaatcaaagtgatgtgtttcagaacagattttgacgttgacatgactttctagttgacttttttagtattcctcttgct

SEQ ID NO: 6822465 - DNA, 76 bp, Homo sapiens
ctttggttttattttcaatcattgcaaagtaatggaaaggttttatgcaaggcaatagattgaatttgtgccttag

SEQ ID NO: 6822466 - DNA, 55 bp, Homo sapiens
tcagtgcattgttcattgtaggcactcggtttacgaattgaataatagtagctga

SEQ ID NO: 6822467 - DNA, 78 bp, Homo sapiens
gcaacctcaggcataatctcatcttgtttctattacaatttcaaattctggaaaaaggaagttgtggtctggagttgt

SEQ ID NO: 6822468 - DNA, 77 bp, Homo sapiens
atgcatagtgcagtggactgagttaatacttgggttctatttctactctgcttttgacctagtcattgatcatgcat

SEQ ID NO: 6822469 - DNA, 81 bp, Homo sapiens
taaaatgggcatgatagtggcatttatggcacagcactgtggtgctgctcaatgagatgccatctgacgtataacattttg

SEQ ID NO: 6822470 - DNA, 55 bp, Homo sapiens
gctagagaccagaggccttgaaggaaggaagcccaagggtctctcctggctctgc

SEQ ID NO: 6822471 - DNA, 87 bp, Homo sapiens
acgtagaagtaaagataattttcttccaggtagatgctttagttggataaagaggaagattatctactttatggccaaattctatgt

SEQ ID NO: 6822472 - DNA, 70 bp, Homo sapiens
ggctgtgcagaggtgagaatccaacctcccaccctgggtctgcggtctctttggttctccttccacagtc

SEQ ID NO: 6822473 - DNA, 55 bp, Homo sapiens
ggtggagcctccagtctttctagaaccaagttctacatgattagagtctctgacc

SEQ ID NO: 6822474 - DNA, 111 bp, Homo sapiens
atgcagagttaaagttagaggagattgctgtttgtgataatgacatttccttcacttctgttgaaagctattcaacacgaacatgtgactcttttactaattgtaatgcat

SEQ ID NO: 6822475 - DNA, 67 bp, Homo sapiens
ttaccagcctcagttgtgagcccccctgggctgtaacaggacctgggctggctctgtggtgtggtga

SEQ ID NO: 6822476 - DNA, 92 bp, Homo sapiens
gcagtggggccaagagtgtttcagtcttcctagatcagccacactgccatcaaggtctggagggcacctgaggcaccaagggtcccaaatgc

SEQ ID NO: 6822477 - DNA, 82 bp, Homo sapiens
gggagtgaataaatgtataaccataggaaattttaagtataatcacccttagaatttgttagattatcattacttgatttcc

SEQ ID NO: 6822478 - DNA, 87 bp, Homo sapiens
cgcgcgggagctgggcagaggcaggataagaactgcggatgaggccgagcgcagctcttaccctccccttaccctccgctccccgcg

SEQ ID NO: 6822479 - DNA, 76 bp, Homo sapiens
cctgggcaagtcttggtccctctctgggcccctttgccgtaggtccctggtggggccagacttgctactttctagg

SEQ ID NO: 6822480 - DNA, 56 bp, Homo sapiens
gcattcaggaaccggaagggtagaaacacaaagaattccggtgcttcctgggctgt

SEQ ID NO: 6822481 - DNA, 74 bp, Homo sapiens
tgtgttaccaaccctgaagaaacttctaagtgggagaactccccaggaggatgattttaagaggccggaacaca

SEQ ID NO: 6822482 - DNA, 56 bp, Homo sapiens
ggatggcaagcacataataaatgctctctgaatagcaattattggtgctgctgttc

SEQ ID NO: 6822483 - DNA, 76 bp, Homo sapiens
atttctccacctcatttgaagaacgagcttcgtagcccacggagctgaggttagtataaatgtggaagggagaagt

SEQ ID NO: 6822484 - DNA, 59 bp, Homo sapiens
gacagcttggaaagtgtgtgtgtgtgtgtgtgtatcaacacatatatgtcgaagtcctc

SEQ ID NO: 6822485 - DNA, 97 bp, Homo sapiens
gcactgtttccagagccagtcactccagcctgcctcagtgcacacctgggcaccaggcaggtgtctggaagtgactcattctctaaagaacatttgc

SEQ ID NO: 6822486 - DNA, 82 bp, Homo sapiens
taggacacttgttcatttgcaacaaccaaatatgggccttttagtcactatagatggttgtcgcaaatgaatgattgttttg

SEQ ID NO: 6822487 - DNA, 83 bp, Homo sapiens
ggattgcttgagcacaggaggttggggctgcagtgagctgtgatcatgccactgctctccagcctggatgacagagcaagacc

SEQ ID NO: 6822488 - DNA, 70 bp, Homo sapiens
gccaggaagtccacaccagctgggacttggggacagtagacagctgatgatgggcccagggtttcttggt

SEQ ID NO: 6822489 - DNA, 74 bp, Homo sapiens
tctagagccactgttgggcactttccttactggccttgacctgtctgggatatcgcctaccagtagtctccaga

SEQ ID NO: 6822490 - DNA, 56 bp, Homo sapiens
cacatggattcgtgcatcaaacactattgagtgcatattgcatgccaggttctgtg

SEQ ID NO: 6822491 - DNA, 62 bp, Homo sapiens
tgagtctgtcaaaacaatcctcttgtccaagcttccagagccaagaaattgtggtagactca

SEQ ID NO: 6822492 - DNA, 62 bp, Homo sapiens
cttctcttcctctcctcactgagccctcaagctggaggctctatgcatgggagcaggagagg

SEQ ID NO: 6822493 - DNA, 82 bp, Homo sapiens
gaaggggcatcctgcagctcctctgtcagagggattcctgccggagcacctcctggcagagagcatgaggcccggccaattc

SEQ ID NO: 6822494 - DNA, 68 bp, Homo sapiens
ttcctcagttcagaaggcagcaaatgaaaaccacgcttgtgattcctcattctagtcttcaaggggaa

SEQ ID NO: 6822495 - DNA, 100 bp, Homo sapiens
acacatatgtgtgtgtatatgtgtatatatacacatatgtgtgtatatgtgtatatatacacatatgtgtgtatatgtgtatatatacacatatgtgtgt

SEQ ID NO: 6822496 - DNA, 94 bp, Homo sapiens
aaaggcaaaagatacgggaaaatgtagaagtgggcattatagaagaatccaaatgtgtctaatgtcttcttcatactaattccttctagccttt

SEQ ID NO: 6822497 - DNA, 67 bp, Homo sapiens
ttaaatgataatgttatgtctggggtattttcagagagcaattttcccataaaaacattgcatttga

SEQ ID NO: 6822498 - DNA, 63 bp, Homo sapiens
gctctggccatagagtgttcctggagtgcccccaccgactctgagtgagcacatggttagagc

SEQ ID NO: 6822499 - DNA, 98 bp, Homo sapiens
gtgaggcagagagtgggaaaacgcagggaatgtgggcacttatgtcggttaaggtgtcaaattttacatgtctgggttttgtttccaccaggctccac

SEQ ID NO: 6822500 - DNA, 84 bp, Homo sapiens
ctgcgagggagctgtagagcagggagcaggaagctgtgtgtgtccagccctgacctgtcctgttctgcccccagcccctcacag

SEQ ID NO: 6822501 - DNA, 76 bp, Homo sapiens
acggaggccctgacacacaccgaagactcatttacagtgagagtgaagctttcctgtggtcaggaaatacttctgt

SEQ ID NO: 6822502 - DNA, 56 bp, Homo sapiens
ctgtcccagccccgtactctaacaatgttgaagttagggtctccggcgcggcacag

SEQ ID NO: 6822503 - DNA, 67 bp, Homo sapiens
cacctttaggcctggctggatctgccaccgccctcctgggggtcacctttccagcaggtctgaggtg

SEQ ID NO: 6822504 - DNA, 78 bp, Homo sapiens
gcccggattttggcggactgagaacgcgggccacgtaggccttggcctgcgcgtctgggtctgtctctgactctgggt

SEQ ID NO: 6822505 - DNA, 79 bp, Homo sapiens
cggcggggcggagggcgacagggcgaccgcgcgccctctgccgggacgcccgccctgccctgccccgccgccgccgccg

SEQ ID NO: 6822506 - DNA, 59 bp, Homo sapiens
ctggcaggcactcatgaaataagctgaattgtgtttaattaggtttggggctttgccag

SEQ ID NO: 6822507 - DNA, 56 bp, Homo sapiens
ttctgtcatcctttctagatgtgagaatttaggttcatttaggagctatggcagaa

SEQ ID NO: 6822508 - DNA, 81 bp, Homo sapiens
ggttagtataagctgaaggacttggtgatagttgagacagttataacctcaactatctggtaagttctttggaaaataacc

SEQ ID NO: 6822509 - DNA, 71 bp, Homo sapiens
gtgagattagttgatctatatccaaagaattcagacactttttgttgtttttggatctagtcactgttcac

SEQ ID NO: 6822510 - DNA, 61 bp, Homo sapiens
gggtctgagcagggcagtgtccatggagcagtgtgctctaggggacttcactgctcagcct

SEQ ID NO: 6822511 - DNA, 61 bp, Homo sapiens
tggtcttagctggaaggagggatggggaagaaaaggcaatctctcgctctcactggtacca

SEQ ID NO: 6822512 - DNA, 56 bp, Homo sapiens
ggcatccaactcacctgggtatgagtcccagctctgccttttactagctggatgtc

SEQ ID NO: 6822513 - DNA, 115 bp, Homo sapiens
tctgctttatttattctgacatgctgacttgttagtgacagtctgatttctcaaaactagaattttcaggatttaagaggttactcgatgtcagcaagtaataaatgagcgctga

SEQ ID NO: 6822514 - DNA, 70 bp, Homo sapiens
tgcttttcataactgttaagataatttttaaaggaaaacctgagagactgtcacataacagaggaaagca

SEQ ID NO: 6822515 - DNA, 58 bp, Homo sapiens
cttgttttcttctgcagtctatccatctgaattgaaggggagggtggaagaaagcaag

SEQ ID NO: 6822516 - DNA, 55 bp, Homo sapiens
cagcctgctagggcaatgcctttgccttccatagcccctttgtcttagcaagctg

SEQ ID NO: 6822517 - DNA, 58 bp, Homo sapiens
atggaagtcacgccagaaggttgttcattttgcacagcagacattgggtgattgacat

SEQ ID NO: 6822518 - DNA, 100 bp, Homo sapiens
ggagactggacacagcaaagcaggaagctcctgacagagcactggtgccctgcctggcatccctgtcactgatgctcctgccactttgtgccaaatctcc

SEQ ID NO: 6822519 - DNA, 93 bp, Homo sapiens
aggtggaacatatatggctggcatttatatcccagtttatgatttataaagcaagaacaaaattatgaagggaatataagtgctgccccacct

SEQ ID NO: 6822520 - DNA, 57 bp, Homo sapiens
ggagatacacaggcagaaaaagacctttctgggcttctctttatattgtgtgtctct

SEQ ID NO: 6822521 - DNA, 129 bp, Homo sapiens
tattttccatttcgtgaatcataaaatcagaggtttgggctgactacctttaggttcccttacggtgttttttgggaaccgctttggagtcagctatctgctaagtttggaattgccaccacgaaagta

SEQ ID NO: 6822522 - DNA, 63 bp, Homo sapiens
gagccagctggagactggcaggggtactgacacttctccagcctcatctcctggctgtccctc

SEQ ID NO: 6822523 - DNA, 64 bp, Homo sapiens
cagcgtgattgtgactggtatggctgcatggaagcttccctgtggcattaatcataaaatgctg

SEQ ID NO: 6822524 - DNA, 65 bp, Homo sapiens
gtcagggcactgtcacctgatatggaggatgaagccccgtgttgggttagggcactgccactgac

SEQ ID NO: 6822525 - DNA, 65 bp, Homo sapiens
tgatcagtatgttgacttattcttggagcaattttggctctttataagatattaactactgccca

SEQ ID NO: 6822526 - DNA, 62 bp, Homo sapiens
aagtaacacatgttacttctgcctacatttcagtggttatagcaagtcacatggtcatgctt

SEQ ID NO: 6822527 - DNA, 83 bp, Homo sapiens
tgccttgggatatctgtcagcagcttcctgtagtctggctgtcccagtggctggagtgctttgaacaccgattcccagggaca

SEQ ID NO: 6822528 - DNA, 103 bp, Homo sapiens
cccactgggggttgtccataaaatctgacaatcggaatgttctgaccatcttcagaaagcatctccattgtaggtatggggacacaagcgagactgcagtggg

SEQ ID NO: 6822529 - DNA, 65 bp, Homo sapiens
gcatatgttacattgttgcctccctttctgcccttggcctgcaggaggcccagtgaatatattgc

SEQ ID NO: 6822530 - DNA, 68 bp, Homo sapiens
catggtccggagaggtgggggcagcatctgggcccccttgctcagtcaggctccttgcctttcccatg

SEQ ID NO: 6822531 - DNA, 91 bp, Homo sapiens
gtcaatgatagtcaagaaaaggtacgtattctgtgttatttttcactttataaaagtagaataattggattacagtttagactacattggc

SEQ ID NO: 6822532 - DNA, 56 bp, Homo sapiens
ccatcagattagcaaaatccaggattcctatttatcttgttgttaatgaatgatgg

SEQ ID NO: 6822533 - DNA, 61 bp, Homo sapiens
atgctctgggaaagcattgccttgatcaaatgccaaggctgttgcatgccacagatagcat

SEQ ID NO: 6822534 - DNA, 82 bp, Homo sapiens
tggctctaactgtggttctattctagaattcctgaacgtgttccaggagttatggcagaatcaaataagttccttttagcta

SEQ ID NO: 6822535 - DNA, 55 bp, Homo sapiens
aggttcccagttttcttaggggagaaatcctggcagaggtatattgggaggacct

SEQ ID NO: 6822536 - DNA, 58 bp, Homo sapiens
agtgtctgagctatcattaggggcactaatacatttccctagcatggtttcatatact

SEQ ID NO: 6822537 - DNA, 76 bp, Homo sapiens
cttgtgcctcccgggaccatgcactgactaaaggaggagaaggggtcctgccagggcaggtgttggaaggcagagg

SEQ ID NO: 6822538 - DNA, 58 bp, Homo sapiens
tcgtgcagctgggccggctcgggccctgtagactcggccattctggtcttgctgccga

SEQ ID NO: 6822539 - DNA, 81 bp, Homo sapiens
gggtagctgaggggatggtagaccggtgacgtgcacttcatttacgatgtaggtcacccgtttgactatccaccagcgccc

SEQ ID NO: 6822540 - DNA, 76 bp, Homo sapiens
agtatgaccacatggagatttggaaagcagctggatcacataactgtgctgctgaattaaactctatgtggcagct

SEQ ID NO: 6822541 - DNA, 57 bp, Homo sapiens
aggatcttagcacaagacgtgctcattgttactagcgtgtcattgtttctaggacct

SEQ ID NO: 6822542 - DNA, 58 bp, Homo sapiens
ggtgggtcagtagccttgcagaactgtcctgagaagttattgctggtgctggccagcc

SEQ ID NO: 6822543 - DNA, 62 bp, Homo sapiens
ggtaaatgctgagtactggagaggaggaaaggggtgcctgctgctgcctgtgggtgtttacc

SEQ ID NO: 6822544 - DNA, 68 bp, Homo sapiens
gtgtgtccacactcaaatatgtgcgtgtccacactgaccgcccacactaaatatgagcgtgtccacac

SEQ ID NO: 6822545 - DNA, 130 bp, Homo sapiens
tgcagctaagttttttgctgtgtgaagaaagttattctgtactctttgagaagaatgatgcgaaatgctgagattcaacaaggaggatggagaaagtttctaacttcatctggacttcatctggcctgca

SEQ ID NO: 6822546 - DNA, 68 bp, Homo sapiens
aatcttagcaggaatgaagttctgaggtagaaagttatctcataatgttgttatttcagctcaggatt

SEQ ID NO: 6822547 - DNA, 129 bp, Homo sapiens
gaattcctcagctttaaaaatagtggcatctggttccttttccctgaaggtatttactcaagccaaggaatgaagcacctgtgggtgaagagcagatgaaagctggaactataaaagccggagggaagc

SEQ ID NO: 6822548 - DNA, 60 bp, Homo sapiens
agccacttgtgatgctggggaagttcctctacacaagttcccctggtgccacgatctgct

SEQ ID NO: 6822549 - DNA, 93 bp, Homo sapiens
tccacaggagcagctaaagtcaatcacatgcacactgaatggaaaaagaatattaagttgtgacacgtgataaggcagagggcttatgctgga

SEQ ID NO: 6822550 - DNA, 81 bp, Homo sapiens
attgtctggtaattatgtaaagatgctccagtgaaacaccatttttggcttagggaaatatttatatacttaccagatagt

SEQ ID NO: 6822551 - DNA, 99 bp, Homo sapiens
cctggggaattgttagcaatgcagattctcaggcccacagcagacccacggactcagaagctggggtggggcctggcactgtttatcaagccctccagg

SEQ ID NO: 6822552 - DNA, 80 bp, Homo sapiens
cttggcaggcaggtttctggaaaggttttgctttcaaaatcatatataagtagctgggccaggcaacctgacctgttgag

SEQ ID NO: 6822553 - DNA, 80 bp, Homo sapiens
tcctcattgcagatttttcacattcagatatagacttgattcttaaatcagtgtgtcacaaaatatgaaagctgcaagga

SEQ ID NO: 6822554 - DNA, 76 bp, Homo sapiens
gccgggcgggccctggggggagctgcgtccagcagagctgctgggtggttgctcctcccgggctctcatctccggt

SEQ ID NO: 6822555 - DNA, 57 bp, Homo sapiens
gtcctggagcagctggaagatgctgtcattgcactccatgatccagtgttcctggat

SEQ ID NO: 6822556 - DNA, 64 bp, Homo sapiens
aggtaggaatgagcttgtcaagcagcagagctgggtgaaccaagcctgcttgagagtcctggct

SEQ ID NO: 6822557 - DNA, 75 bp, Homo sapiens
gaggtgaatgaatgcagttctctgaagcaaaaaacacaatggttaaaaacagagcaattgcgtcatttgtgcctt

SEQ ID NO: 6822558 - DNA, 75 bp, Homo sapiens
tttgcagttcccataggagataaaacaagtctcttttcaaacatgaagagatttcctatggtaattataggcaaa

SEQ ID NO: 6822559 - DNA, 59 bp, Homo sapiens
cctgtgctggcagacctggagttgttgccacagagggccgataagattgtgagtacagg

SEQ ID NO: 6822560 - DNA, 71 bp, Homo sapiens
tgcttatgtcatgcatttcagagactcaatctgagcaaaaatttctcagtgaagagtataacaaataagca

SEQ ID NO: 6822561 - DNA, 66 bp, Homo sapiens
ttgggtatctattaagaaaacagccatttcatcacggctcgtaaaaattggttcatggatgcccaa

SEQ ID NO: 6822562 - DNA, 67 bp, Homo sapiens
gtgacagcctgcagccccaggtcgctggaggacatgctcagcagactctgtggttgcagagctgtgc

SEQ ID NO: 6822563 - DNA, 69 bp, Homo sapiens
agtgagtgcaagagcgctctctttcattaccttatttccagggtttggtaacagtttttggcacttact

SEQ ID NO: 6822564 - DNA, 58 bp, Homo sapiens
gcatagtcagtaggattctcaattcttaagtttggaggttgggatttctgttgaatgc

SEQ ID NO: 6822565 - DNA, 60 bp, Homo sapiens
agagaaactgatgtcctttgaagccaaccctggccttgaattaggcaaattaatttctct

SEQ ID NO: 6822566 - DNA, 60 bp, Homo sapiens
gcgcctggacttcacttatttgacttttcttttgaaaaattaaattgctagatccagggc

SEQ ID NO: 6822567 - DNA, 78 bp, Homo sapiens
agctcacatctatttctgctaataacaatcccactgctaattatgggatgtggtagttatagtgataagagaggagct

SEQ ID NO: 6822568 - DNA, 125 bp, Homo sapiens
ctaaggatttgtgctgcctgcgacccctctctccccagactctctccatttcctccgtcagaagttggggtaccttgaggctggggttagagtagggaggggacgctggaggggcaaatccaggg

SEQ ID NO: 6822569 - DNA, 102 bp, Homo sapiens
gctcaccagagcgagacattttctgttcaactttggagatttaataatagctttaggatggtcactactggttgcgtggctgaaatgctctggcctgggagc

SEQ ID NO: 6822570 - DNA, 60 bp, Homo sapiens
ctatactttcagggatcatttctatagtgtgttactagagaagtttctttgaacgtgtag

SEQ ID NO: 6822571 - DNA, 103 bp, Homo sapiens
cacaaacccccgcagcccggcctggccagaggcgtgcctgtgcatcccggcaagtgagcgcccagggactctcggccagagaggctgtgagggtggctttgtg

SEQ ID NO: 6822572 - DNA, 79 bp, Homo sapiens
ggacagtggctatggcccaggccaggatccagctttacaccggaagctctcccgcagcctggtgggcccgccctgcttc

SEQ ID NO: 6822573 - DNA, 59 bp, Homo sapiens
agccgctcttggctttgcccagcaccgagaaggcagcctgggcagatggcagtgtggct

SEQ ID NO: 6822574 - DNA, 67 bp, Homo sapiens
gtctagctggggagctagacctcagcacaggcgatactgtcctgacactgtctctccccagctgtgc

SEQ ID NO: 6822575 - DNA, 69 bp, Homo sapiens
tattctgagccaacatgtcaattttgtattgtaaatgtataatgcacatgccacatgtggtacatggta

SEQ ID NO: 6822576 - DNA, 83 bp, Homo sapiens
ggcccaactggcagagctggagggggaagaggagggatggggactgcatccttcttcttcccccttcaggggtcataggggtc

SEQ ID NO: 6822577 - DNA, 89 bp, Homo sapiens
tactttgcagtctgagcttagtgttataactgttctaaaaatgtctcatttggaaggaagagctgtagcctgctctttattgcccagta

SEQ ID NO: 6822578 - DNA, 63 bp, Homo sapiens
aaccccatgctgtgggatgagcaaggggactgccccattgctggtcccctgcagcctgtggtt

SEQ ID NO: 6822579 - DNA, 119 bp, Homo sapiens
gtaaatggttcaagtctacaccaggaataagagctacagccagttctgtttgactctaaaattcagaattatagttgctttttaaagttacctaggacaaatgtaacaggattatttac

SEQ ID NO: 6822580 - DNA, 69 bp, Homo sapiens
tcgcgccccgccctcttgggggcccgttggaggcgagcgtgggcgggccgttaggaaggtggggcgcgg

SEQ ID NO: 6822581 - DNA, 59 bp, Homo sapiens
gcctggtccaaagacaagagttcaggtccccactaagaagctctatgacttggccaggt

SEQ ID NO: 6822582 - DNA, 63 bp, Homo sapiens
tcaaaactcattttggaagtaagcagtgtatcccagggctgaggttccaaaatcaggatttga

SEQ ID NO: 6822583 - DNA, 65 bp, Homo sapiens
ttgcagggtgtgagggacagagggatgaagaataactcctaagtctctgccttacgccactgggg

SEQ ID NO: 6822584 - DNA, 75 bp, Homo sapiens
gcttcccaaagtgctgggattacaagtgtgaggcactgcacccaggctggatccctgcatttttacagatttagc

SEQ ID NO: 6822585 - DNA, 69 bp, Homo sapiens
cctgtttgttccttctactgccctctgagtcaggacaattgaccagcagagttgaggaggacacgaggg

SEQ ID NO: 6822586 - DNA, 61 bp, Homo sapiens
tctgggcgtgtcttccagctggctgtgggctgcattgccagtccagtaagatatggccaga

SEQ ID NO: 6822587 - DNA, 55 bp, Homo sapiens
tgacagtggtgacaggatggggcaggatgcattaccattgtgtatgctatagtca

SEQ ID NO: 6822588 - DNA, 55 bp, Homo sapiens
aggaaggtttgtttctcacttcccagggtatagcccagaggaacattcacctcct

SEQ ID NO: 6822589 - DNA, 61 bp, Homo sapiens
aagtagacagtcatctactttgggaagactaataggtccttaggtaacggctcttctgctt

SEQ ID NO: 6822590 - DNA, 74 bp, Homo sapiens
gctgctcatcgtggtttgccatgcagccaggaaggaggggaccgcctgccttccctgtgggcgccctgagcagc

SEQ ID NO: 6822591 - DNA, 58 bp, Homo sapiens
attgtgctttagatcacagtctttgggaacacaccatggatatgattctggctgcaat

SEQ ID NO: 6822592 - DNA, 58 bp, Homo sapiens
ttcctgctcaatgctgtcgtcgctgtccacggagctactgtcaccatcagagcgggaa

SEQ ID NO: 6822593 - DNA, 73 bp, Homo sapiens
gagattaatcacagaaatgcccattcagccttaattataatgatggtctggcttgcatttctgagattccctc

SEQ ID NO: 6822594 - DNA, 91 bp, Homo sapiens
attagcgaagaaatttccttttctgagagggccaagattacgttttgtgtaatcttgctttccatagaagtgaccactttcaagtactaat

SEQ ID NO: 6822595 - DNA, 58 bp, Homo sapiens
ttgtttttggatgttgtatgtgcatatgtttacgtattgcaagcaattccaaaaggaa

SEQ ID NO: 6822596 - DNA, 103 bp, Homo sapiens
gacaggaatctggtgggcaggtgcacctgagccatctgaacccgttcagagtcaccttttcctcaggatgcctccgttttgctcctaggttacacctacagtc

SEQ ID NO: 6822597 - DNA, 65 bp, Homo sapiens
gggagaggctccatgaccccggcaggctctggccaaaccttgctgcgtttcatggagcccctccc

SEQ ID NO: 6822598 - DNA, 55 bp, Homo sapiens
cagacctcgtgatccgcccgctttggcctcccaaagtgctgggattacaggcatg

SEQ ID NO: 6822599 - DNA, 86 bp, Homo sapiens
atcccacagtgagtagcagagttggactatgcaatagattcctgaacctctttgtatatcacaagactgtgctaggtgctagggat

SEQ ID NO: 6822600 - DNA, 69 bp, Homo sapiens
aagtaaaagctagagaagctgctgtcaactttttacttaaatctgacagtatatctctgccttggactt

SEQ ID NO: 6822601 - DNA, 93 bp, Homo sapiens
tattttattcagccccttagtacatattttcctctttcttttctaactgctcactgtatttgagggagaaaaggaaggggctttattaaaatg

SEQ ID NO: 6822602 - DNA, 55 bp, Homo sapiens
ctggggtggggagaacatgggcacgggaggtggaaaacctaagctccagccccag

SEQ ID NO: 6822603 - DNA, 63 bp, Homo sapiens
taatatgctttgatagtttattacatgtatcaactgacatggttttactagtaaggcgtctta

SEQ ID NO: 6822604 - DNA, 57 bp, Homo sapiens
gcttggctggagaaagttacctctttttatcaaaaatgtgacttagcccagtccagc

SEQ ID NO: 6822605 - DNA, 61 bp, Homo sapiens
gtatgtttctgcccatctctggaaaaacccaggtaggcactggtgggaagagagaacatgc

SEQ ID NO: 6822606 - DNA, 67 bp, Homo sapiens
ccggctggcctgctggcgtccaggctgttcttggtcagtgcgaggggctgctccaggccaaggctgg

SEQ ID NO: 6822607 - DNA, 55 bp, Homo sapiens
agatcaagggagtgctcactctgaacttctctagatggtggcacaaatttgatct

SEQ ID NO: 6822608 - DNA, 66 bp, Homo sapiens
cagcacctgtagaaagcatgtagcctgtatccataggtgggtaccacaatatgtttactgagtctg

SEQ ID NO: 6822609 - DNA, 59 bp, Homo sapiens
ctccgatttcattgacaaacatggctcgtgaatgtgagcctggcacctgcagatcggag

SEQ ID NO: 6822610 - DNA, 98 bp, Homo sapiens
gggaggtcaggggcttctttctggggttggtacccagggcatcatggctctgggcagccgccccataggattgttgcgtgaggctcttgacacagacc

SEQ ID NO: 6822611 - DNA, 55 bp, Homo sapiens
tcttgtgagctgagataaagccttgtctttggtctattgtcttagctgcataaga

SEQ ID NO: 6822612 - DNA, 58 bp, Homo sapiens
ggccatttttgttcttatctctggttcaaggattccttggaaaataacaaagttggct

SEQ ID NO: 6822613 - DNA, 60 bp, Homo sapiens
actttatggatatgcaacattttgtttatcgattgacaaactgaagtatatttagaaggt

SEQ ID NO: 6822614 - DNA, 65 bp, Homo sapiens
ctgtgccaggctgtcaattcacccaggtacctctctgggacaagtggcttggcagcctgtcaaag

SEQ ID NO: 6822615 - DNA, 82 bp, Homo sapiens
tccacactcagacagtcatcagagcttgtctattcacccaaggggtgtgatcctgcagttctgaggctgctgtataaatgga

SEQ ID NO: 6822616 - DNA, 57 bp, Homo sapiens
agcctcacacgttccaacttggctgccttcagcggcatccaggagcagtggtgagct

SEQ ID NO: 6822617 - DNA, 60 bp, Homo sapiens
gggatggggaaagcccaaaacaccctgctggaagcgctgtctcggggctttctcctgccc

SEQ ID NO: 6822618 - DNA, 63 bp, Homo sapiens
taaaggcacaaaatccaagtagcaagcatgaaatgtggtttgcatattaaatcggtgccttta

SEQ ID NO: 6822619 - DNA, 67 bp, Homo sapiens
tttcatttatatattgcttacaagtacgtggtaatttgaacttcagtaggtgatatgtgcaaggaga

SEQ ID NO: 6822620 - DNA, 81 bp, Homo sapiens
ccctaggtgtcctctcaaggagccgagattaccatggctattggtgggctgaggggccttgatgacaggcagcaccaaggg

SEQ ID NO: 6822621 - DNA, 72 bp, Homo sapiens
ttcccagaagcgccttggcatcgccagactccggttctccgcaggtgggagcacccgtggtgcggctgggag

SEQ ID NO: 6822622 - DNA, 66 bp, Homo sapiens
aactacaaccatagacatatactaggcagtactgcaagagcctaaacagtgcatatgggtgttgtt

SEQ ID NO: 6822623 - DNA, 56 bp, Homo sapiens
tcttttctgccacagcctgagccagagtggaagctgggctgtgcagcagagcagga

SEQ ID NO: 6822624 - DNA, 69 bp, Homo sapiens
agattagaagtaacttctgtttgtggttttgctcacttaaagctgcagataggatgttatttcaattct

SEQ ID NO: 6822625 - DNA, 58 bp, Homo sapiens
gaagtcattttaccaagatttgtctttaaaatagctgacaggctttagaaaatgactc

SEQ ID NO: 6822626 - DNA, 73 bp, Homo sapiens
aaagatctccttcctctgagtcagtttggttctgagtttaagaagtcaaagctttcagaggaaagttgttttt

SEQ ID NO: 6822627 - DNA, 56 bp, Homo sapiens
tttgctttaagttccattcttcccgttcctctagaggaaccaggaactaaagcaga

SEQ ID NO: 6822628 - DNA, 118 bp, Homo sapiens
gagagtttacaaacaaacacacagtgtgcagaaagcttaggcaagttggaggagaggagtgtcccctgcaattgcctaattttcatacacaaattacgtggtttccctgtagatggtc

SEQ ID NO: 6822629 - DNA, 61 bp, Homo sapiens
gtgccactggtgtcatataaggggctctgttatctacagaggattccctagtgacctgcac

SEQ ID NO: 6822630 - DNA, 100 bp, Homo sapiens
ggaggcggtcctggtagggagtgcgtagcagggtggagtcgctgtccggtcgcgcttcacttctgctccgccctccctgctccccataacagacccctcc

SEQ ID NO: 6822631 - DNA, 59 bp, Homo sapiens
cactgaagctttcattctcttgtcttccacagactttgagagaaaaatgagcttcattg

SEQ ID NO: 6822632 - DNA, 62 bp, Homo sapiens
ggtaatggtgttccaggcttctcccttccaacagagagaaaccgattctgcatgtcattact

SEQ ID NO: 6822633 - DNA, 73 bp, Homo sapiens
tcacacatgagtaaatacagggaggtttaacataactttattatcttgctgtcttttcttctcattgatgtga

SEQ ID NO: 6822634 - DNA, 97 bp, Homo sapiens
tagcttttttacatcccctcttcatcctcctgcagagaagtacgaagtacttttttggtgctcctaggaaggtggtagaaatggagtagacaggttg

SEQ ID NO: 6822635 - DNA, 80 bp, Homo sapiens
ggaaaatggacgtgtgtctcatggtagccgcagtttaagtaaacataaactctgaaccagagatcatacccgccatttcc

SEQ ID NO: 6822636 - DNA, 65 bp, Homo sapiens
gctcagtggctgttcattttacacaatataagtattgatgttcctaagtgcacagcctatatagc

SEQ ID NO: 6822637 - DNA, 90 bp, Homo sapiens
ttgtctaatatgttgtgatccaagtttctttacacttaaggttttactgtatggagtgctgttgatcaaggtttaatatgtacttggcaa

SEQ ID NO: 6822638 - DNA, 61 bp, Homo sapiens
ctcattttatttgctcctccttatatttttcactcccctaggagggtttcaatgggatgag

SEQ ID NO: 6822639 - DNA, 84 bp, Homo sapiens
agtaaccactaatctattttctgtctctatagagttgcctattctgagcaattcatataaacggaatgatataatgtggtctct

SEQ ID NO: 6822640 - DNA, 72 bp, Homo sapiens
tggagagctttaatgtgtaatcttagatgggtctgtaacaccccagagccaatacactgaagatctaatcca

SEQ ID NO: 6822641 - DNA, 65 bp, Homo sapiens
tgtataattggcttgggaaggaagatcttgaatgtttggatatttcccagttagtcatttttaca

SEQ ID NO: 6822642 - DNA, 61 bp, Homo sapiens
tgcaagtctggagtaatgtttgtgattatgtttaatgcaaattcacatgattgcttctgca

SEQ ID NO: 6822643 - DNA, 63 bp, Homo sapiens
ttagatagtattgttggaagggtaagttgatcatattaaattgcttttcaagggtacagctaa

SEQ ID NO: 6822644 - DNA, 90 bp, Homo sapiens
ctttcttttctccccctctgcctttaagaactagttgtctgacctcttgaaatgaggtaacaattctcaaaagaggggagaaccagaagg

SEQ ID NO: 6822645 - DNA, 93 bp, Homo sapiens
ggctgagtttaaaggcttttctgtttgtcttggtagcatgtgtcatcttgtgatatttacatgactcaatagaagggcatgagtaagctggcc

SEQ ID NO: 6822646 - DNA, 59 bp, Homo sapiens
gccccttcttctggagattcaaactagttgctaaaatgaattctcccagaagaatgggt

SEQ ID NO: 6822647 - DNA, 55 bp, Homo sapiens
gtagaggacatttgacatgatgttggacaccagcatcctaagtgcctttctctac

SEQ ID NO: 6822648 - DNA, 77 bp, Homo sapiens
catgtgtttgtctcttggcctacctctcgttctgaaatgaagatgagcaagatgtgaaagcttgagagaggcaactg

SEQ ID NO: 6822649 - DNA, 116 bp, Homo sapiens
attatgttcaagatttattgttttggttttagttttcttcatcagtgaagtgacttgaattagtctcacgtaactgtcaaggaaacaaaattacaggccctaatgaccaacataat

SEQ ID NO: 6822650 - DNA, 76 bp, Homo sapiens
tgagtctcttaattgtgtgtgcatgcactgtgtgttcatgtgtttgtgtgtatgtatgcatgctacagttttctca

SEQ ID NO: 6822651 - DNA, 60 bp, Homo sapiens
tcatgcagtgaatctttcttgccagagagactaaaaaggcagagagctagaacttcatga

SEQ ID NO: 6822652 - DNA, 83 bp, Homo sapiens
gctcggcatctgctgagtaccgccatgtctgttgggcatccacagtctcccaccaggcattgtggtctccgctgacgctttgc

SEQ ID NO: 6822653 - DNA, 60 bp, Homo sapiens
tcagagagttagtgtcttagcttgttctgatagatctagagctgccaccctagcttctga

SEQ ID NO: 6822654 - DNA, 80 bp, Homo sapiens
cagtcatttcgtttccttgcctcggggtaccttgcctttcaaggttgaagagtgtccttgtaaaaataatgttgtggctg

SEQ ID NO: 6822655 - DNA, 56 bp, Homo sapiens
tcagaatcggtggggccaggaatccagatttttggcaggtgccccaatgattctga

SEQ ID NO: 6822656 - DNA, 78 bp, Homo sapiens
gggatggggtaagccctaattggtagtgtttgccaatttctctcgtgtaaatactcccaccatggctgatttcatgct

SEQ ID NO: 6822657 - DNA, 71 bp, Homo sapiens
ggtctaatgaacacatattaggtgctcatgacctgttgtggaaatgggcacatagtaggtgcgcaggagct

SEQ ID NO: 6822658 - DNA, 108 bp, Homo sapiens
agccaggaatcagacctgggagtgcaggcatgaagctccagttaggcaggccccagccttcctgcagcatgacttatgtctggtacccctgcgggttgcattcctgct

SEQ ID NO: 6822659 - DNA, 86 bp, Homo sapiens
tttgtagctccctgatgatagtgatttattgaggggaatcagttttctacttaaaggaccattagtcgtctcagaaagcttacaaa

SEQ ID NO: 6822660 - DNA, 66 bp, Homo sapiens
gcctccagctcagcttcctgggtgtgtcagagaggcgtgccaggagccagagctgaggaatgaggc

SEQ ID NO: 6822661 - DNA, 68 bp, Homo sapiens
gtgaatattgagaggccactgcggagagagtgagcacttgtcctctgggagtggccacttctcatcgc

SEQ ID NO: 6822662 - DNA, 60 bp, Homo sapiens
ccattagctatgcagatatttgcattattgaattaaattggatctgcatagtttgaatgg

SEQ ID NO: 6822663 - DNA, 97 bp, Homo sapiens
gcagggaaatgggttaggaggcaattgcagtagtcagaggtgacagtggtttgcactagtgtacaagtggtggagatggctctgtctcatgtcctgt

SEQ ID NO: 6822664 - DNA, 130 bp, Homo sapiens
agtttggggtggaaccagtatcatagatgtaaattctatgttcttgagtaagaagaacccctcttaccttctttgcctttgaatagtagaaaaaataatgatacttctctcctagctccacctccagcct

SEQ ID NO: 6822665 - DNA, 58 bp, Homo sapiens
gctcaactctgtggctgtcccacaaaagcgaccagtgaccagacagacatgagtgagc

SEQ ID NO: 6822666 - DNA, 73 bp, Homo sapiens
tgatgttcctgaagccactagaactagatggagcctacattctcctgtcaagctaagggctttagaaacacca

SEQ ID NO: 6822667 - DNA, 72 bp, Homo sapiens
aggccatattaattacacaggatgagaatgtttacaccattaagttctactccagtgttataatatgcgtct

SEQ ID NO: 6822668 - DNA, 63 bp, Homo sapiens
ctagacttgggacctaggaatggagggtatcattgatcatccccctaaagccccaggatttag

SEQ ID NO: 6822669 - DNA, 124 bp, Homo sapiens
ggttccagcagcggctgacaaagcctccatcagataggtgcaagagaaagcttgtctcagagtcttcctgttgtcacagtctgcggtgctgtcctaagccctgaaatacagttgctcggcttcc

SEQ ID NO: 6822670 - DNA, 55 bp, Homo sapiens
agctgctgccggtggccaccctggagccaggtatcgccagaggccggcaggggct

SEQ ID NO: 6822671 - DNA, 56 bp, Homo sapiens
ggcaaggccttgcccagcattctgcactacagaggtgctggctataaaggctttcc

SEQ ID NO: 6822672 - DNA, 56 bp, Homo sapiens
ttgcatgtcctacatctgtgtctgaaacacagtatgcaatcatggaggatgtgcaa

SEQ ID NO: 6822673 - DNA, 65 bp, Homo sapiens
tctgtggcctgtgtccaagtgcatttgttttcccatgcctttaacctaatgacacagtgcacaga

SEQ ID NO: 6822674 - DNA, 60 bp, Homo sapiens
gcctgccacgcatgcagagtcactggaacatatgacttggtcttcaaatgcatgataggt

SEQ ID NO: 6822675 - DNA, 88 bp, Homo sapiens
gccacagaaagcaggaatgttttgtatgcctctgagctaagaatggttttcacaggggcctgcaaaacctaaatatttactgtctggc

SEQ ID NO: 6822676 - DNA, 83 bp, Homo sapiens
attccaagcatgcttctgggttcagggaaatttccatgtgtttccagcctggagacactttcccttcccagatgctctggagt

SEQ ID NO: 6822677 - DNA, 108 bp, Homo sapiens
agatgtgatttttctctatttttcttggctagtgttttggggtttatatttggcataatctaatctgatattagccaaaaagagtactgaagagagagactttgcact

SEQ ID NO: 6822678 - DNA, 59 bp, Homo sapiens
ttacaggcaagggttgttaccatggcattcgatatgcgtgacaggcaccctggctgtga

SEQ ID NO: 6822679 - DNA, 104 bp, Homo sapiens
agtcttcattaaatattaggccactagttttgcattgctgaaatatggctgcctttataaatcatacatgtttgtttagctagtgccctacttttgatgtggct

SEQ ID NO: 6822680 - DNA, 58 bp, Homo sapiens
ttccagtgcttttttaccttccaaccctgaacatgttgagagaaagagaagcctggag

SEQ ID NO: 6822681 - DNA, 69 bp, Homo sapiens
gaccactggctggagcccctcaagagcagggcttgttctttctcatgtcatggttcccagcacctggtc

SEQ ID NO: 6822682 - DNA, 97 bp, Homo sapiens
gtaatttttctttgtgagctaattttcaatgaggttttaacttgggaaacattttgtaaacttgtttgaaggtatggcccatcaaatggatttgtgc

SEQ ID NO: 6822683 - DNA, 78 bp, Homo sapiens
tggttcatagcctcacaggatattcttagtaaatatttgttaaatgaatgagtaaatcctgttaggattatgtatcca

SEQ ID NO: 6822684 - DNA, 69 bp, Homo sapiens
ggcagcttctcggctgggagtatttgaatatgagttaaaactacaaagtaactcctcgttagaactgtt

SEQ ID NO: 6822685 - DNA, 116 bp, Homo sapiens
atacgtgtgtgctggtgctctgagcctgcctgtattcaattttgtgtgatgtgtggcccacatgcacctgctgtatatagggactctcaggctccagggaggagacatacatgtgt

SEQ ID NO: 6822686 - DNA, 70 bp, Homo sapiens
catggtgagcagggcaggactggggaggggacagtctctattcctttatctctgctttgcctctgccatg

SEQ ID NO: 6822687 - DNA, 69 bp, Homo sapiens
tttctttactgaatttggtatattccatttgcaatgatttaacaaggggaataggaccttcaggagaag

SEQ ID NO: 6822688 - DNA, 76 bp, Homo sapiens
ccacctcctgggatccaagcatggggttcagtaggaatctgcattcctaacacaagctgatgctgccaggaggagg

SEQ ID NO: 6822689 - DNA, 63 bp, Homo sapiens
gcatagtacatgggtgtcctcacacagtcctcccaagctgtgtgtgtgtgtgtgtgtgtgtgt

SEQ ID NO: 6822690 - DNA, 99 bp, Homo sapiens
ccttgttatataccttcctatacatttccttcataacatttatcacagtgttaaattattgagggattgtcaggctataggtggtacttgatgacaagg

SEQ ID NO: 6822691 - DNA, 67 bp, Homo sapiens
tgagttcattgtgtgtggtcttctttgctgcaacaagtaaaaagcccagcttcataagatgccttca

SEQ ID NO: 6822692 - DNA, 85 bp, Homo sapiens
aacatatgacatcattacaaaggacagcagaaaaataattggaattatattgttgtgaggttcttatatgtggtggtgtaatgtt

SEQ ID NO: 6822693 - DNA, 55 bp, Homo sapiens
tgtcaataacatttacttctatttggaacgtgatgatagggtggagttattggca

SEQ ID NO: 6822694 - DNA, 81 bp, Homo sapiens
taacctgttcctgccttccctgcccactgcataaaggaagatggcagttcattgcagccaggaagcccaggacacaagtta

SEQ ID NO: 6822695 - DNA, 93 bp, Homo sapiens
ttcgcttgccctggcctccaggcagtcctgcagcagcaaacacatcatcagccttaggagctggcctgtgaggttgaccactctgtaggtgga

SEQ ID NO: 6822696 - DNA, 96 bp, Homo sapiens
ccttggagcttattggagatcagatgcagaggctgggggtacccaggctgcggagactcccccagcttctgcccgtgtttgctctcctgcccctgg

SEQ ID NO: 6822697 - DNA, 61 bp, Homo sapiens
gtcctagaaactctcacgagtgaaacagcaacctgtgctgtctttgctagtttctgagggc

SEQ ID NO: 6822698 - DNA, 58 bp, Homo sapiens
ccacagtaaatggattcagacctgcataaaggcaagtcataagatattatttctgtgg

SEQ ID NO: 6822699 - DNA, 78 bp, Homo sapiens
agttatttgaagcagaaaagagcaactgtgtggccaagcatgttggttgaaggggctagctttatgccttcaaagact

SEQ ID NO: 6822700 - DNA, 116 bp, Homo sapiens
cccagcccctgaagggacgacttggctcttgactgtggaggtggatggcccggacgcccgctccaggccacgacctcctggatgagcacaggccagctcgtactgtggggtctggg

SEQ ID NO: 6822701 - DNA, 82 bp, Homo sapiens
acagttagaatgcaaacttcttgttacttgtcattttctgaaatcctagaccagttgttttggaagtttgcagaatagctgt

SEQ ID NO: 6822702 - DNA, 60 bp, Homo sapiens
tggcacgtaggagctatgtcagggctccagcatgccttgacatgcctcctacatgatcca

SEQ ID NO: 6822703 - DNA, 69 bp, Homo sapiens
atttctgttctagttattcacagtggagagaggaaatgtccgtaggctgtatttgacttgagcggaaat

SEQ ID NO: 6822704 - DNA, 57 bp, Homo sapiens
aagaaggcctggtagacgtcttgaaagtctaatatcgggagctctgtcatgcttctt

SEQ ID NO: 6822705 - DNA, 55 bp, Homo sapiens
tacatcactcaaaacctagtgcctggccttggttggtgcaggtaatgatgatata

SEQ ID NO: 6822706 - DNA, 55 bp, Homo sapiens
ccaagagcttcccatagcttcttgtggccatttccagaactaaggggagctctgg

SEQ ID NO: 6822707 - DNA, 79 bp, Homo sapiens
agagcatcccggctgaccctgcaggtctggagtgaaaagaccctgcactggactcttcagggcagtgagcgggatctct

SEQ ID NO: 6822708 - DNA, 59 bp, Homo sapiens
gtggctaaagtaatccttcataaggagataattttttcttgtaggtgatttttttccac

SEQ ID NO: 6822709 - DNA, 130 bp, Homo sapiens
gttatttgcatacattttgggcatgtaggcagaatggctcaaagacaaaaatctgaggttcagccttgtttggcctcctggtgtttgatcttgaccgggctacctgcttctctgactggcatgcaaatgc

SEQ ID NO: 6822710 - DNA, 59 bp, Homo sapiens
gttttgggctgagatgtgggccgagcctcagtggggctcccagcagcatagctcagaat

SEQ ID NO: 6822711 - DNA, 93 bp, Homo sapiens
gggggctgcacctggttctattctgataaatgcatggaaagaacaaggtctttctctgcccaagtttctcaagtgtgagccaagccaacaccc

SEQ ID NO: 6822712 - DNA, 128 bp, Homo sapiens
gtcttggctgtgtgaagtttgagaggcttaatagacatcttggtggagctttaaagcaggcagtttgatacataaggctaaagttctgggggtgtttctgggctggatgatgtttacagccaaaagat

SEQ ID NO: 6822713 - DNA, 66 bp, Homo sapiens
agagtttttcatttacccgttgttcgaagccatatgagcactttaacagggtaaataaaaagatct

SEQ ID NO: 6822714 - DNA, 90 bp, Homo sapiens
tttgagctatcttgaataatttatagtagcctttggcaagttatccttaactactcacaaggttcactataaattggaaagaggcccagg

SEQ ID NO: 6822715 - DNA, 56 bp, Homo sapiens
aagagccagacaagatggggacactaacaacacaatctccagtgcttctgcctctt

SEQ ID NO: 6822716 - DNA, 57 bp, Homo sapiens
caactcactgagccttgccagcttggtgccttaccgtcctgataactcagtgctttg

SEQ ID NO: 6822717 - DNA, 80 bp, Homo sapiens
tccgtgaaaccccatcatctttgaggtcattataaataattagttgcagacgcagagatgttgaggcttcgtcactagga

SEQ ID NO: 6822718 - DNA, 59 bp, Homo sapiens
acagcaaagaagacacaggcttcatcatcaagcagacctggacctgtccttctcgctgt

SEQ ID NO: 6822719 - DNA, 70 bp, Homo sapiens
atgagaaggcacttggaggtctctgcccatacaacacagtctgggcaaagaactccaagtgccttctcat

SEQ ID NO: 6822720 - DNA, 55 bp, Homo sapiens
gctgtcacatttggagcactggtgtgaaagcaagagggctctaggatttggcagc

SEQ ID NO: 6822721 - DNA, 82 bp, Homo sapiens
aggaacacaggccaaactttctgtctgagctgcagagtattgaaacttagattgtgagctgggcaggaattcctgtggccct

SEQ ID NO: 6822722 - DNA, 73 bp, Homo sapiens
tattccacttaaaattcagaggtagtagcagagttgagaattatctagattctgtttcctctggtttggatta

SEQ ID NO: 6822723 - DNA, 59 bp, Homo sapiens
gtgagcatgtagtaatctggagttcagaatagactggtttgagattacagcatgttggc

SEQ ID NO: 6822724 - DNA, 77 bp, Homo sapiens
tggcatagagcaagccctccgtacgtgctagcttttagtattatttttagagtggtgcacacagcagggctttgcca

SEQ ID NO: 6822725 - DNA, 94 bp, Homo sapiens
gaggctgctgtgagatgcacagatccccaggacccttgggctggccccctcagaggcttgagggcctggtgacctgggtcctctgagcagcttc

SEQ ID NO: 6822726 - DNA, 78 bp, Homo sapiens
aaaggagtcaccttgggaaggtatttagctgctgaagattatcatgatttctcagcacctttttaggacttctctttt

SEQ ID NO: 6822727 - DNA, 94 bp, Homo sapiens
ggttaactgacttgcccaaggccatattgcctgtatgtgatatagctgggattcaaatccaggtagtttggtttgagagtccacactgttaatc

SEQ ID NO: 6822728 - DNA, 85 bp, Homo sapiens
ttgagtttctaattaatttctggagggagaaagagtagaacaaagtattcccttgacttcttctagaaataagcaagagaaccaa

SEQ ID NO: 6822729 - DNA, 81 bp, Homo sapiens
ggctctccgccttcattttcttgtctctgttgtaggtaatatatttgacaccaggagagaaaacacggaggacacagaacc

SEQ ID NO: 6822730 - DNA, 81 bp, Homo sapiens
actcaggctccataggtaatgagctgagattacatgatttattgctttcagtttgtcggccttggactgttctgcctgtgt

SEQ ID NO: 6822731 - DNA, 56 bp, Homo sapiens
ctccctcaggccttagccctgccttgggtggagggagggcacctggtctgtggggg

SEQ ID NO: 6822732 - DNA, 93 bp, Homo sapiens
gcagaacagtttcctattttgagacttgacacctaattagtcatcttactatttaagctgaaaaatagtgtcgtgttttgggtaacgttctgc

SEQ ID NO: 6822733 - DNA, 73 bp, Homo sapiens
tggacagggcagccaggccccgtgggaaggtggctggagactgggcccatgggcatcctggtggccctgttta

SEQ ID NO: 6822734 - DNA, 90 bp, Homo sapiens
tggaaaggtaggaactaagcaggcagggtggagagttttctgtaagacaaaaactgtctggacactgctgcggttctgttacaaagacca

SEQ ID NO: 6822735 - DNA, 123 bp, Homo sapiens
ggcggccgggaagaggcgctcctcacttcctagatgggatggcggccgggcggagacgctcctcactttccagactaggcagccaggcagaggggctcctcacatcccagacgatgggcggcc

SEQ ID NO: 6822736 - DNA, 67 bp, Homo sapiens
ctgatgatatccctggccctgccatcagagatcaattgttgaagcagagtgaaggtgaattcatcag

SEQ ID NO: 6822737 - DNA, 69 bp, Homo sapiens
agtgtcatggtagataacaacatgggcttagaaatttaaagacctaagttcaaaatcaaccaggacact

SEQ ID NO: 6822738 - DNA, 70 bp, Homo sapiens
aaactcaaaaggctttgaaaaccaaaaggttttttggaactcgtttggaggcaaagcctgacctgagttt

SEQ ID NO: 6822739 - DNA, 86 bp, Homo sapiens
ggcccatctcaatggccacctcatggataagataaactgatggtatttcaccagttaaactttgccagatgggattcagataggcc

SEQ ID NO: 6822740 - DNA, 63 bp, Homo sapiens
tcaggaccctgcagccacccgacatgtgaggcctgggcatggtggggcagggcaggggcctgg

SEQ ID NO: 6822741 - DNA, 85 bp, Homo sapiens
ggccgtggagccagagaggctggggcagcagacctttcttgggcaaatcagggggccctgctgtcctcctgtcacctccagagcc

SEQ ID NO: 6822742 - DNA, 65 bp, Homo sapiens
ggaagaattcaatttatagtcagagcagtttcttagagatgaaactggtccaagatagattgtcc

SEQ ID NO: 6822743 - DNA, 62 bp, Homo sapiens
cagctatggttattgtcttcttcatccaaggattgattgaagtaaaataaccttcataggtg

SEQ ID NO: 6822744 - DNA, 76 bp, Homo sapiens
gcctgagatcttgccttgagatctgattggacttaactgagcatttgtgatttgatcatcttaaggtatctcaagc

SEQ ID NO: 6822745 - DNA, 79 bp, Homo sapiens
ggtgtgggtgccctcctggaattgcagccccagttgcaactcatcttcgagtgaggctggcatctaagcactacacacc

SEQ ID NO: 6822746 - DNA, 58 bp, Homo sapiens
actccctctgtgttctctagctcaataaagtcacccagcaaggcagaccagagtgagt

SEQ ID NO: 6822747 - DNA, 102 bp, Homo sapiens
actttaagaatatttgccagaagtgactctgcattttatggatctaagtaaatcttaagtgaccttggaatttagtagtcttccctagcaaagtaagaaggt

SEQ ID NO: 6822748 - DNA, 64 bp, Homo sapiens
ggactctgctggttttgttcactgctgtatccccggagcccagaacagtgcttagtagatgttc

SEQ ID NO: 6822749 - DNA, 72 bp, Homo sapiens
tagagaaatagattggtccagaacagtttccggtcaacgagcattattttggattagtcaattttgggaata

SEQ ID NO: 6822750 - DNA, 66 bp, Homo sapiens
tctctcttaacatctgtctctagttgggttcagtcagtggggagccctggcagatgacaggagaga

SEQ ID NO: 6822751 - DNA, 56 bp, Homo sapiens
gaggtagagatgtgaatcagacaagtccttaaatgcatgattcatctaactgcctc

SEQ ID NO: 6822752 - DNA, 60 bp, Homo sapiens
agtttaattggaggcgtggctcggacgtaaattcaaggagctgcggctagaaagtgaatt

SEQ ID NO: 6822753 - DNA, 67 bp, Homo sapiens
acaattcagaaagcagttgtcaatgggctggagctttcagctgataaggaggcatttctggaattgt

SEQ ID NO: 6822754 - DNA, 84 bp, Homo sapiens
ctgggtgataggacgtttgggttacagcactggacatgagaggccactctattcaccacactgaacctcagtgtcttagcctgg

SEQ ID NO: 6822755 - DNA, 99 bp, Homo sapiens
cacgcaatttattctgtgcttcactttcttcatctgtaatatggagataatggcatctacctattaaagttgtgaagattcaattagatgagttgtatg

SEQ ID NO: 6822756 - DNA, 79 bp, Homo sapiens
gaatatagatgaaatgttaggctcttttagaaaatattattttcaaggactgtaagagccatttcatatcatctcattc

SEQ ID NO: 6822757 - DNA, 56 bp, Homo sapiens
ctctctggcccatcctgttgcctggagcaaccaggggcagcctgacccccagagag

SEQ ID NO: 6822758 - DNA, 56 bp, Homo sapiens
gtgggtctggctttgagggtcagcagaattcaggttgctggcagggacaggctgat

SEQ ID NO: 6822759 - DNA, 106 bp, Homo sapiens
cctgtgtgattctggtgtgcagccaagtttgagaacactgccctaagtcattgttacaggctagtacagtggcattcaaactttggtgtacaatagaatcacctgg

SEQ ID NO: 6822760 - DNA, 67 bp, Homo sapiens
ttcaaggatgggagtggaggtttaggaaaaggttaaaagaagatattaaacctccccattttctgaa

SEQ ID NO: 6822761 - DNA, 64 bp, Homo sapiens
tcaatcacctgggaggaaccatctatggtcctgtcatgagggagttcctcctaggtctggttgg

SEQ ID NO: 6822762 - DNA, 74 bp, Homo sapiens
tcgaacacttgcactgtcgtggaaatgattttctggtatcaaaacgttttcagtgactgtgcttcggggttcgg

SEQ ID NO: 6822763 - DNA, 59 bp, Homo sapiens
tattcagtggtaagcaaaacagacagagcccctgtcattatggagcttccactgtgata

SEQ ID NO: 6822764 - DNA, 102 bp, Homo sapiens
tgaatttcagatgaataatgaataatggtttaacatatgcttgagtcaaatattacatgggacatggttatactaaaatattcgttgttcatctgaagttca

SEQ ID NO: 6822765 - DNA, 129 bp, Homo sapiens
ctcctgggctcagctgtatctctctgttctgggagcctgggtgctctgtgtaaggggaacgtatacccaagggcccccctgcaagacgcccagccttgtctgaggctgcagagaaagcgccaaagcccg

SEQ ID NO: 6822766 - DNA, 66 bp, Homo sapiens
aggaagttttctgtactcgctcttggcgaatccccagaggagccccaattgagcagtacgtttcct

SEQ ID NO: 6822767 - DNA, 63 bp, Homo sapiens
agctcttcagatctcagatggtctgctcagctgagccgtgctctctgaggtgctggcagagtt

SEQ ID NO: 6822768 - DNA, 59 bp, Homo sapiens
gtatatatttatttcacaaataggtatctttttgatggcttttgtgaagaaaatgatgc

SEQ ID NO: 6822769 - DNA, 67 bp, Homo sapiens
gcagggagtgtaaatggtgctcagcggcagtataatatcttcatgccctcttttgcttgctccctgc

SEQ ID NO: 6822770 - DNA, 89 bp, Homo sapiens
gtcctcccggttgatgggttgtttcctgcaccgtgtgggctctggtgggtaggggaggagagtaggaaggaggccatcttggcggggac

SEQ ID NO: 6822771 - DNA, 72 bp, Homo sapiens
tcttttgaatctttttggaaataaagagggctcatcatttgtcttctgtttcaattggaaggttccaataga

SEQ ID NO: 6822772 - DNA, 80 bp, Homo sapiens
actgaggaggaactcagaaagaaggtggccttagtgggtctgtgcttgtcattactggtttctcgttttattcattcagt

SEQ ID NO: 6822773 - DNA, 82 bp, Homo sapiens
tgaatttaaaacaaccaggatgtgaagcctgtgtccttatcccaagaggtgccaaaagctataatttggtgagaagaattca

SEQ ID NO: 6822774 - DNA, 70 bp, Homo sapiens
aggattcctgaggggaagcttcccaagaaagcgaattaatctatcttggaaagtaactcccttgtctcct

SEQ ID NO: 6822775 - DNA, 108 bp, Homo sapiens
tttcacagctgggccacccagaagctctctctggctctcttgacagtggagctgttgaaaggaatacagaggcctaggagagagtccttggtctattgaagctagaaa

SEQ ID NO: 6822776 - DNA, 64 bp, Homo sapiens
tcagtgattttctccagctggcaggataataattgatttctgttttctctgagagaatcaatga

SEQ ID NO: 6822777 - DNA, 83 bp, Homo sapiens
ttttttcttacattcccacgtgttctttgcttctattctcaattgaaggtgatgggtaggaaatgtggcgaaatgagaagaag

SEQ ID NO: 6822778 - DNA, 55 bp, Homo sapiens
agccaggatcacccggggctgtctgcatacagacttctcaggggagttctcagct

SEQ ID NO: 6822779 - DNA, 98 bp, Homo sapiens
ttgccttttaggtttcagagttctgtcctccccactctttatctccatattacagggctggcgttgggacagaagtcaagaaaatgacaaagtggcaa

SEQ ID NO: 6822780 - DNA, 80 bp, Homo sapiens
ctcggtagccgtgtggcgcagatttcctcctccgtggtctcccgggcaacgcggagctgcctgccaagcctgctgccggg

SEQ ID NO: 6822781 - DNA, 63 bp, Homo sapiens
ccctgtctgtggtgctcctatgctgtccattgaggactcagctggaacgtcacaggagcaggg

SEQ ID NO: 6822782 - DNA, 86 bp, Homo sapiens
gccagtcctgaccgagcccagccggattcccagttcccgccgtccggggccagggaagttttggcggggaggggtagagcgctggc

SEQ ID NO: 6822783 - DNA, 65 bp, Homo sapiens
tgaagatatgagtatgagaggagagagagatatatatatacctctcaggacacacatgtctatca

SEQ ID NO: 6822784 - DNA, 72 bp, Homo sapiens
tttacacagacctagcactctagattgccttgtacctttaacctgtagccagatctgctgtgtctggataaa

SEQ ID NO: 6822785 - DNA, 130 bp, Homo sapiens
taattaattctttacaatgtcagtaagaatgtaggaaagtgacagttatttcttctaagatgagaaagatttcatgaacaaatgatttactaaatttgcataacaagttactgaaaagatggaattgtaa

SEQ ID NO: 6822786 - DNA, 65 bp, Homo sapiens
ccagatggagttgcctggaaagcttatacacatgaaaagacagtctccaggtaacatctctctgg

SEQ ID NO: 6822787 - DNA, 61 bp, Homo sapiens
tgatttcaacattacacaggcaattcatggtttcttaagaaagcctatgatgttggaacca

SEQ ID NO: 6822788 - DNA, 66 bp, Homo sapiens
ggtggccttttatgagcagggtggccttaaacaaggcttataaactagacttcatcgaaggttacc

SEQ ID NO: 6822789 - DNA, 63 bp, Homo sapiens
ggccctggtcctaggggtggaaccatggaggaacaccctggtcacccactgggactgcgggtc

SEQ ID NO: 6822790 - DNA, 105 bp, Homo sapiens
tgaccttaggcaagcagcctccttctggggccccagtgtcctcgctggtggaaagtgctgtgagtttcaaaggaggccacagagagagctagcttgggaaggtca

SEQ ID NO: 6822791 - DNA, 63 bp, Homo sapiens
tagcacacagtactatatgctacagatgaagtacaatgctgtcaaataggggtacttgtgtta

SEQ ID NO: 6822792 - DNA, 68 bp, Homo sapiens
ccccagagcccagcacacggtgctcaggggccacctgctggcagtcaggggcatgtgtgactctgggg

SEQ ID NO: 6822793 - DNA, 70 bp, Homo sapiens
aggtctctggctgtttctcctttgtctattgcatttttcctggagttgacgagatgagaaatcctgactt

SEQ ID NO: 6822794 - DNA, 128 bp, Homo sapiens
tgtaactggtcacagcaatgttttctagactagtgagtgtgtgctcatacagcaccatgtgtgttcaacaacacacaaagttggatgacaaaatcactttagtgagaaggcagctatttccaggggca

SEQ ID NO: 6822795 - DNA, 127 bp, Homo sapiens
cttagataagaaaatgtttctcaccttagttataggttatatgcattattgatatttgactgaacgccactagttttcaagatgtgatgtaacttttggtctaacctaaccttttcttgttttaatg

SEQ ID NO: 6822796 - DNA, 67 bp, Homo sapiens
atgcgtatgtttcaagagctccagcagcctacccaggatggcttgatgttgtctcttagcaccgtat

SEQ ID NO: 6822797 - DNA, 79 bp, Homo sapiens
tgttctgcagataataacacatatttcaagagtagttgtgaggattaaatgagatcatgtgtttgatctttgcttggca

SEQ ID NO: 6822798 - DNA, 66 bp, Homo sapiens
ctgtgatttttcatctattttagactattgattaatggtatctaagaaagattaagaaatttgcag

SEQ ID NO: 6822799 - DNA, 96 bp, Homo sapiens
tgccccagtttgcacattgagtaagtagaggagccaggatttggaatgaggcgttccagcttcaaggtctaggctcttctccactctacttgggca

SEQ ID NO: 6822800 - DNA, 71 bp, Homo sapiens
tccaagagacagttacccccaaaagaattcagcagacttagtatctatttggggatgactttatcaatggg

SEQ ID NO: 6822801 - DNA, 87 bp, Homo sapiens
tctacaggccagattgcttctggaaagcagttttagaaatcacatgaaaatagttgtttggatcaataaaaacactggcatgttaga

SEQ ID NO: 6822802 - DNA, 103 bp, Homo sapiens
atgtgaagaaaaagggacaggaatcagcatatcttgagcttcatgcccagccacgggctagaaacattacatgtgttaattcaagttcctgcaatcatcatat

SEQ ID NO: 6822803 - DNA, 81 bp, Homo sapiens
cccaccagggtccatgaaggagctgcacccacggagcctgttcctccccggagtcctggacaagcccttcaccctgctggg

SEQ ID NO: 6822804 - DNA, 72 bp, Homo sapiens
ctgtcacagaacacacccttcgtcatgacctgccatgtcacacatgtacaggtcttggcaaaggggagacag

SEQ ID NO: 6822805 - DNA, 59 bp, Homo sapiens
cctgctttttccaatggagccattctggactacgagatcaagtactatgagaaagtagg

SEQ ID NO: 6822806 - DNA, 104 bp, Homo sapiens
tgttgatgcactccagttagaagactgtttgtagaggaagatcagttgagaaaaaatgagaacttcttcaacataatggacactttctgtagactaaatcaaca

SEQ ID NO: 6822807 - DNA, 60 bp, Homo sapiens
tggggcgggaactgtatcggtgaggggccttccatggtcacgctcctgttcccggtccca

SEQ ID NO: 6822808 - DNA, 59 bp, Homo sapiens
ctggatgcatcttatcaaaaattatatctgtatacagtgtatacataaggtgtaaccag

SEQ ID NO: 6822809 - DNA, 85 bp, Homo sapiens
ttttacttaactgttttgtgccttagtttccccatgtggaatatggggataactttagtacctacctcataggaatagtgtgaag

SEQ ID NO: 6822810 - DNA, 64 bp, Homo sapiens
actagtattcttggtcttgtatttattgttctctgccaagttttgcagggcttgaatattatgt

SEQ ID NO: 6822811 - DNA, 55 bp, Homo sapiens
gggcctctgtttggagccaggatgaggagtttcagccgagctctgagcagggcct

SEQ ID NO: 6822812 - DNA, 85 bp, Homo sapiens
ccctgattctacaatggatttgctctgtgaccttgggcattttattaaagctctttggcactgagcagcatctgtaaaattgggg

SEQ ID NO: 6822813 - DNA, 67 bp, Homo sapiens
acacatcaggtagacctacagaggcaccataattcattgttgatttcatgagattatctgcatgtgt

SEQ ID NO: 6822814 - DNA, 60 bp, Homo sapiens
gataagtttgatctgacaaagctggaaatacctgttttagctctatcaggccaaaatgtc

SEQ ID NO: 6822815 - DNA, 63 bp, Homo sapiens
ccattctgagatcctgtgcatagtgggctgggcaaggtcatagaatcacaggatcttgggagg

SEQ ID NO: 6822816 - DNA, 89 bp, Homo sapiens
agaaggagaagcacacaccagtttgtaacctgttttcatctaaatgatatggtagacatttctacatagcttttgtaattctctcttct

SEQ ID NO: 6822817 - DNA, 61 bp, Homo sapiens
acatctttgcccatccacttccaccatgttctatgaagattttgcaagtgtgggaagatgt

SEQ ID NO: 6822818 - DNA, 76 bp, Homo sapiens
ccaatagctaggtcatattttgcaaggtcagctatatccctgtgtagatctgtcctcagtgtagattctagagtgg

SEQ ID NO: 6822819 - DNA, 95 bp, Homo sapiens
agacaggggcagggttctcaggtggcccccatgagtgggtgacatcaggagaccccgcatcaggcaaggttacctgtgtgcctgctgacttgtct

SEQ ID NO: 6822820 - DNA, 71 bp, Homo sapiens
tggtgtggtgggcagtgtgtcagtatcttctttttgtagaatggtgaagaaatatgtgcttgattacagca

SEQ ID NO: 6822821 - DNA, 87 bp, Homo sapiens
tgaatcgaatcaaattgaattgaattgaattgaattgaattgaattgaattgaattgaattgaattgaattgaattgaattgaatca

SEQ ID NO: 6822822 - DNA, 55 bp, Homo sapiens
gatggacagaggaggacagggatttgtagccacttctgcaatcgctctgaccatt

SEQ ID NO: 6822823 - DNA, 74 bp, Homo sapiens
ttaatctctttggctcaaggatcctctctcagtttgggttcccccggaaatggaccttgagacaaggattttag

SEQ ID NO: 6822824 - DNA, 55 bp, Homo sapiens
tctggagggcactttgcagggtgtgggcaaatgagagaattgcatgctctccaga

SEQ ID NO: 6822825 - DNA, 57 bp, Homo sapiens
gctatctaccacatcagccaggtattcctcctctaggttgaggatgtggtcaatggc

SEQ ID NO: 6822826 - DNA, 55 bp, Homo sapiens
ctgccagctctctggaggctcttggggcccatcctaccctcaggggacctggcag

SEQ ID NO: 6822827 - DNA, 64 bp, Homo sapiens
ctgaagttaaagtagtttttatgtagttaaaggtttgaacagtaaaagaactcttcagcttcgg

SEQ ID NO: 6822828 - DNA, 100 bp, Homo sapiens
ctgatgtaatgagccctcccctctatccttatctgtctggtcgagtcattctgggctgactgggcaccatcatgagataggcaggaggtctcatcattgg

SEQ ID NO: 6822829 - DNA, 68 bp, Homo sapiens
agtatactgagttttaccttttatgcccagaacagtgcttggtatacaggtggacttcagttagtatt

SEQ ID NO: 6822830 - DNA, 118 bp, Homo sapiens
agccctctgggggcagtgggctgggggtgggagaggcagctcttctgaatggggtgagcaggtctggcttctcggctttgggctgcactctccctgcccagcccagccgccagcggct

SEQ ID NO: 6822831 - DNA, 68 bp, Homo sapiens
ttccaacagtttatgtgaggagaaactggcatatgctattagaatcttcagttgtaaaagtgttggga

SEQ ID NO: 6822832 - DNA, 92 bp, Homo sapiens
cctgtgttcaccatgtaagtgggcagacatgatagaaggagatctattatacttccttgtgttatgtgcctatggaatagagggaacagtgg

SEQ ID NO: 6822833 - DNA, 67 bp, Homo sapiens
aaccacggtgtacctcggaagaagcgttctcagagcaacatgcacgtgttccgtgtgtaccgtggtt

SEQ ID NO: 6822834 - DNA, 70 bp, Homo sapiens
ttacatttttatcagtagcaaagttttaaaggtaaaaacctcttaatatctaatgctggcaaagatgtga

SEQ ID NO: 6822835 - DNA, 69 bp, Homo sapiens
gatgcgacaagagaggcaagggctgcagtctgagttctaggctccagccctggctcttcacctggtgtc

SEQ ID NO: 6822836 - DNA, 61 bp, Homo sapiens
tgtccctgcatctgcaggccatgtcaaaggacgccctgaatctggcgcagatgcaggagca

SEQ ID NO: 6822837 - DNA, 72 bp, Homo sapiens
ctgcactaattgagaatgcaatctactatggcacctatttgctgatttttggagcatttttaatttatgtag

SEQ ID NO: 6822838 - DNA, 87 bp, Homo sapiens
atttacgttttaagcaaatgtcctaattgcttgggaacatttttagtaattttggtggttggaatatgtgtatgaaaagcagtaaat

SEQ ID NO: 6822839 - DNA, 72 bp, Homo sapiens
acagtgaacatctgggatcattgctgtgtattccccgcaacagagagctgcagaatggcccaggtgcgctgt

SEQ ID NO: 6822840 - DNA, 61 bp, Homo sapiens
ggttctgagaaactctcaccattagctttatagctatgtaagacttgagatttctctagcc

SEQ ID NO: 6822841 - DNA, 55 bp, Homo sapiens
gaagtagctttggagttgggccaaaaaatcctcagcaccaagctaaggttacttt

SEQ ID NO: 6822842 - DNA, 55 bp, Homo sapiens
caattgcatatatatgaggccatgtgaagttgttccatggttcatttatgctttg

SEQ ID NO: 6822843 - DNA, 85 bp, Homo sapiens
caggtcccagtgcaggggaaggaaacagagggcacctgagcccctcaggctgggtaccctgtttccccttgaactgcacgacttg

SEQ ID NO: 6822844 - DNA, 55 bp, Homo sapiens
tgagcatgaggatgctgagggcctgctcctaaccctgcaccacactcactgctca

SEQ ID NO: 6822845 - DNA, 77 bp, Homo sapiens
gataggctgagccttgatgtcccttgtcctggaggctcctccatgctgaacaagcagcatcaagagcctgccctgtc

SEQ ID NO: 6822846 - DNA, 61 bp, Homo sapiens
gctggtagctggctttgatcttcccatcttattagacaggaaacaaggctagcttgaaggc

SEQ ID NO: 6822847 - DNA, 82 bp, Homo sapiens
acccagttcccattcttacacaatattttaatattattgtgtccagtgaggttcaaattaagtgtttaatggtagctgaggt

SEQ ID NO: 6822848 - DNA, 62 bp, Homo sapiens
aaatgctgtaactgatattctgggaaaacaaacctggttccagaagtgcagctgtggtgttt

SEQ ID NO: 6822849 - DNA, 71 bp, Homo sapiens
tatgtataaagcactaggtcacacaagttatgttatttaattcacataaccgtgtgacatgggcatgcata

SEQ ID NO: 6822850 - DNA, 129 bp, Homo sapiens
tcttatggtgggtgttgtaatgcttttattttgcagactctactggggccagtgaacaatgagggaatgaagtacatcattccacatgttagctggttaaagtcatggcacttggcagcctccttgaga

SEQ ID NO: 6822851 - DNA, 88 bp, Homo sapiens
agcatatacaatgctctaaagattgctcaaaactgtgacctgaattttaggattctgttttatagtggccaatctcagttgtattgct

SEQ ID NO: 6822852 - DNA, 55 bp, Homo sapiens
gacagccaggcatagggagtatgatttactgcctgcattttgtggctggcttgtt

SEQ ID NO: 6822853 - DNA, 98 bp, Homo sapiens
ggcataaaccttgtttttacccctaactcagctgtgaggcattcctagaagccagctaagcctggcaggtgtggagtggggtgagctgaggatgtgcc

SEQ ID NO: 6822854 - DNA, 72 bp, Homo sapiens
atcgtgccttagcaaacatcttcgtgtgagctacttcgtgagcccacatgtatgtgtttgttgaggggcgat

SEQ ID NO: 6822855 - DNA, 56 bp, Homo sapiens
gtggaatgtaataaaagcatggtttataaaaacttgcttatattattacattgcat

SEQ ID NO: 6822856 - DNA, 55 bp, Homo sapiens
agccctctctatggccctcttgttcacacgttgctggagctgtaggtgggaggct

SEQ ID NO: 6822857 - DNA, 56 bp, Homo sapiens
gctttagttgtaagtttctttgggttatggacccttttgagaagctgattgaatgc

SEQ ID NO: 6822858 - DNA, 116 bp, Homo sapiens
ttcaatgatgaattaataggctggccctcaattcccatatctcttgtaactggtctctgctgtcaaattagaaggctgagcttacaggtgaggcagcaagaatttgagtgattgga

SEQ ID NO: 6822859 - DNA, 63 bp, Homo sapiens
aatgttctgtggcttgtagatgcatcactccaaaaatctctatctacaacatcacatggcatt

SEQ ID NO: 6822860 - DNA, 88 bp, Homo sapiens
taagtgtgatgtggtagatgttaacttttggaaaaccgtggttttgaaaaggtcaaatagttgacattaacttgactcagaacattta

SEQ ID NO: 6822861 - DNA, 125 bp, Homo sapiens
gtgctaacaagtggttcacatccaggatctcatttaatcccccaacaaacctgtggggaaatgtcatcctcactccacaggtggggaggctgaggttcaggatggctaacagaccatgaggacac

SEQ ID NO: 6822862 - DNA, 63 bp, Homo sapiens
ttggtgcaaattcctgtaagagattcttttagtcatatatttctcaaggactttgggcactaa

SEQ ID NO: 6822863 - DNA, 74 bp, Homo sapiens
gttaattcctctgagctctatctgtgggaatgatgaattctagccattatggagttctgtgaggttaaattaat

SEQ ID NO: 6822864 - DNA, 81 bp, Homo sapiens
tgtgtgtgtgtgtgtgtgtgtgtggtcatgactgccctcctttcactctagctcaatcccttacagcctattcaccacata

SEQ ID NO: 6822865 - DNA, 58 bp, Homo sapiens
gcatctgccggacgcctcactcagctcaagaccaggagtgcatgcgccgctgagatgc

SEQ ID NO: 6822866 - DNA, 122 bp, Homo sapiens
cacagatggtgctctgcagacctctctgctgtggcacttccctccctgaatggcttcctgcaagaggtgctaattgcaagtaagggatggagtgcggcccggaccgcagagcttatttcgtg

SEQ ID NO: 6822867 - DNA, 65 bp, Homo sapiens
ggcatatatctctatttagccaatcatcacactgatatgcaaccttggttaggtgtttatatgtc

SEQ ID NO: 6822868 - DNA, 65 bp, Homo sapiens
gagttctcaccataaatcaaaggactaaaattctggtacatatgtccttattagagtgagagctt

SEQ ID NO: 6822869 - DNA, 78 bp, Homo sapiens
tgtcaatttccccagataggaaaagctaggcatagaaccccaaagttctattttagccatgttccatttggggtgaca

SEQ ID NO: 6822870 - DNA, 84 bp, Homo sapiens
ttaaagcttaatgagcgcttgtctgtttggaatgtgcaattagatttacaatcggggatgggagagagctccaaatggctttaa

SEQ ID NO: 6822871 - DNA, 77 bp, Homo sapiens
cttttagtatagaaagtttagtataaaaggttatagaggattactttacaaaaagaaactggagttcatgctaagag

SEQ ID NO: 6822872 - DNA, 93 bp, Homo sapiens
ggaacaggatatgcattttttgggagtgggtaagaatttctggttagacaagctccaaattctttggcctactttgaaggcactgcctgttcc

SEQ ID NO: 6822873 - DNA, 58 bp, Homo sapiens
cagttgaacagatgcatttataggttctgggccctgtaacactcaatctgtttaactg

SEQ ID NO: 6822874 - DNA, 63 bp, Homo sapiens
agagcaatggcatccagctgattttatttataattaatgtctttggagaggtgccatttcttt

SEQ ID NO: 6822875 - DNA, 96 bp, Homo sapiens
tgggggtagggctgagcaaggcatagtctttaagttctgactcagtcaattttttatcgagtcattttttaatctgagttttcagctctatcaaca

SEQ ID NO: 6822876 - DNA, 80 bp, Homo sapiens
aggaatgaaagatgctcccgtgcctccgccttggcgccgtcttccctccacacgccagggcaggggagcatctgcctcct

SEQ ID NO: 6822877 - DNA, 63 bp, Homo sapiens
tctgcagggctggggctgctcctgagtttctggtaaggccttcgggagtcccagctctgcgga

SEQ ID NO: 6822878 - DNA, 89 bp, Homo sapiens
gtgtgaacagatctgaggtttattgatctaaatcaacgtgggctgaggaacagcacagtaactgatgtgatcaaacgagcttctcatac

SEQ ID NO: 6822879 - DNA, 74 bp, Homo sapiens
gtggctgtattggaataggataaaatgggaccaaagatggtctgagcattgaattttcttccacactcagctat

SEQ ID NO: 6822880 - DNA, 57 bp, Homo sapiens
ctcaggattaaggaatctaaatttaatttcattttggatgcctaagtaagtcctggg

SEQ ID NO: 6822881 - DNA, 69 bp, Homo sapiens
ggtgtgtgtgtgtgcgtgtgctcatgcatgcacaagtgaatttgcatacacaagcatacatgtaccacc

SEQ ID NO: 6822882 - DNA, 69 bp, Homo sapiens
tcagatgagaggagctgtgagtgtggcctggaaaagatgtctccggcaaaccccagcccctctatctga

SEQ ID NO: 6822883 - DNA, 65 bp, Homo sapiens
cagtgaaatagtggacatcaaataactttatgggttgtattggttcctttactatgttctagctg

SEQ ID NO: 6822884 - DNA, 96 bp, Homo sapiens
gccccctggtctgtctggagcagctgcagccgcagctgtggcctgggcctcaccttccagcgccaggagctgctgcggcctcctctgccagggggc

SEQ ID NO: 6822885 - DNA, 60 bp, Homo sapiens
gggaaggcagcttcaccacagcattgccttaggacaggctctgagtagagctgccagccc

SEQ ID NO: 6822886 - DNA, 60 bp, Homo sapiens
ggatagtttccctgccctcccactttttaaaaatagtttgatggttcaggccagctgtct

SEQ ID NO: 6822887 - DNA, 57 bp, Homo sapiens
atgtcacatgtttaatgtggacttgctggaagtcagggggtctttagcgtgtgatat

SEQ ID NO: 6822888 - DNA, 78 bp, Homo sapiens
agcaaagggctaagacaattcttcagtcacaatacatctatttcctgtgttgcctaaatcttgttttacactttggct

SEQ ID NO: 6822889 - DNA, 71 bp, Homo sapiens
gatgtaagactccaggtaggcacattgacattttctagacatgaatgttagagcccacgtggtccaatatc

SEQ ID NO: 6822890 - DNA, 89 bp, Homo sapiens
tgcatttaattaatcatggtgaattcatcggaaagtaaatagatattttagtgagtttttccgtggctacgataagttaatttaatgca

SEQ ID NO: 6822891 - DNA, 58 bp, Homo sapiens
acccaggctggagtgcagtgtcttgatctcagctcactgcaacctctgcctcccgggt

SEQ ID NO: 6822892 - DNA, 58 bp, Homo sapiens
agaactctaggattggctggatagagctttagcttttcagtcaggagccaagggttct

SEQ ID NO: 6822893 - DNA, 73 bp, Homo sapiens
acagtaatttattgaacaccttcactgtgcccagcattgtgctgtgagccattgggtgattaaaagatgctgt

SEQ ID NO: 6822894 - DNA, 95 bp, Homo sapiens
gctgtctctggaggaaccatatttagctcatttccagtgcctgaaatatgtcttgcacctgttgaacagctgagcttgccctttgaggaggtggc

SEQ ID NO: 6822895 - DNA, 69 bp, Homo sapiens
gggttggcctagaattctctggttgaaaagtggtgtcagctgtggggagcttgggccatcaatcaatcc

SEQ ID NO: 6822896 - DNA, 102 bp, Homo sapiens
ggctgagctccatggagaaggactgaggtatgatttttaaaatgaggcttataactgctgacatttttataagagtcaaactgaccccagtggagctcatcc

SEQ ID NO: 6822897 - DNA, 78 bp, Homo sapiens
ccagcaccacatgccttcctcaggcctctctgtcttaacgaacttaccagcaggggcgagggtgggtatggggactgg

SEQ ID NO: 6822898 - DNA, 91 bp, Homo sapiens
gcaattaattgagagctagaggactttgattttgtaagatctttgtaaaatggttttacaaacttggagtttggttttatacagtcagtgc

SEQ ID NO: 6822899 - DNA, 59 bp, Homo sapiens
tggaggaagggagtgtacttgccctcaaaacagcaaagggactatgcttttcttctcca

SEQ ID NO: 6822900 - DNA, 79 bp, Homo sapiens
ctttgagcaacctcatttctcagaaaaggaatcttctttatagaagatacaactcagaagtgtggttacttcctcaagg

SEQ ID NO: 6822901 - DNA, 89 bp, Homo sapiens
gcattaacaggttgtttattcctgctcttgtaaattttcccttatttctaattaaatttggaacagtgtgaaaaggttatctgtttggc

SEQ ID NO: 6822902 - DNA, 111 bp, Homo sapiens
gaactttcccacagaacataaataaaatgcacgctacccagctagattttggtgttagaaatctgtgctgcaggagtctgcatggctttttgaaatgatctgagaaagttc

SEQ ID NO: 6822903 - DNA, 62 bp, Homo sapiens
gttttccaggtaccttggtattcaaaaaagccttagaatagcagattttggttttggaggac

SEQ ID NO: 6822904 - DNA, 78 bp, Homo sapiens
cctttctcttgaccatgatagacacttgtgccgaaaaatagtctggcacacatagatctgcactggcttagagggtgg

SEQ ID NO: 6822905 - DNA, 56 bp, Homo sapiens
aggccaaatagcaggtttgctaaatgttttaatgttgtaaactgcttccttggcct

SEQ ID NO: 6822906 - DNA, 64 bp, Homo sapiens
gtccacagggatggccacacatttaacattcccaaccagaaatgtcctagtcaatcctctggac

SEQ ID NO: 6822907 - DNA, 127 bp, Homo sapiens
tttgcatattgaataccaagtactgaaggatggaagagatgtggcacagcacagtaagaggagacttctgtcattcttacattagtctgtgctttcaactagctttgtaaccatgggaaagtgcaaa

SEQ ID NO: 6822908 - DNA, 59 bp, Homo sapiens
caaacctgagaacatgtgctgtgtactactttgtggtccagacatgagtctcagctttg

SEQ ID NO: 6822909 - DNA, 87 bp, Homo sapiens
aggaagagaaggaagatgtgggtgtcttcagctggtaaactcaacattgttagctctgacaaaggccacttacactaggcttttcct

SEQ ID NO: 6822910 - DNA, 78 bp, Homo sapiens
ccaccactacaagtcaatctagagattaaaataggcaaaactgtgatctacgttaggatggggttgtttgagtggtgg

SEQ ID NO: 6822911 - DNA, 56 bp, Homo sapiens
aaaatccacaacgctcatttcactgaaaggtcgttcaggtggcggtggtggatttt

SEQ ID NO: 6822912 - DNA, 72 bp, Homo sapiens
ctaaacatacccagaccatgatggacagctctggtctcattgttccttgatatcccatggtcaggtgattag

SEQ ID NO: 6822913 - DNA, 92 bp, Homo sapiens
gccttgaagttacctggaaggtgatggtacagcaggtcgcacccagcagcctgtgctgtaccaatgccttcaatgcaggtgatgtctgaggt

SEQ ID NO: 6822914 - DNA, 55 bp, Homo sapiens
ctgacctgtgcagtgactggtggcccagcaaacagggccttgtatgcagaggcag

SEQ ID NO: 6822915 - DNA, 57 bp, Homo sapiens
cttggctgccagcactggtgtagagtgacagtttcctcatccgtcttggtagctggg

SEQ ID NO: 6822916 - DNA, 63 bp, Homo sapiens
agcatgtgaggtccttggtgtgcttagctcatgcctggcaggtggtaaggatttcataaagct

SEQ ID NO: 6822917 - DNA, 75 bp, Homo sapiens
taccatggcaatgttagcaaagcatttcctgccaaatccaaaaggagatacattgttctaagcattgcatttgta

SEQ ID NO: 6822918 - DNA, 129 bp, Homo sapiens
aggaccctcaaagctatataaggagataagctttcacagtgtaatatatttttctttcatataattacatttgtgagctgacagagaggtaagttatgaagggtttgttgctctatgcttagggggctt

SEQ ID NO: 6822919 - DNA, 79 bp, Homo sapiens
gaagaaaatttggcttagtaggaaagtgtttttgtactgggcagaaacactgtgtcaaactggggcaaacaacctcttc

SEQ ID NO: 6822920 - DNA, 129 bp, Homo sapiens
ctttatacaaaaccaggtcagcacactgtgtcttggaggctgatgctgcctcacagagatgactcctttctgtagaaaactgcagccttagcatccagggccagactcttacctcatgcaatgatagag

SEQ ID NO: 6822921 - DNA, 59 bp, Homo sapiens
aaagtggccatcctctgcatcggtaagcttagggatccatggagaggtttggctttttt

SEQ ID NO: 6822922 - DNA, 64 bp, Homo sapiens
ggaagcttgttggagcagccctgcttaaaggacatttattgcacagcaatttctataagctccc

SEQ ID NO: 6822923 - DNA, 89 bp, Homo sapiens
tggcatgacagagggctcctacagtgtttgagtccagaatcagaggggatccgctggcttccatgctgtagtggcttttatacattcca

SEQ ID NO: 6822924 - DNA, 85 bp, Homo sapiens
gcaataatgccagccgatattgtgaattttagagagtatgctgagtaatttttggcctttctacaatttttggcatgagcaatgc

SEQ ID NO: 6822925 - DNA, 88 bp, Homo sapiens
atgaagctgcttccatcagtgaaatatttaacgtccaggtccctgaggggcctatctgtcaaatttctctggcctgagaacacttcat

SEQ ID NO: 6822926 - DNA, 59 bp, Homo sapiens
acttagcagcttaagtaattagaatttattatttctttggattctgtgggttgctgggt

SEQ ID NO: 6822927 - DNA, 58 bp, Homo sapiens
ggccgcacctgcattcccctcaatgggagcccgagagaaaggcttgcaggctgtggct

SEQ ID NO: 6822928 - DNA, 96 bp, Homo sapiens
gagggagccgccttggccccgccgtcctgccatgccagcatgcccgtcgcccacgggccggcggtcggcggcgcggggttggggatggcgccgctc

SEQ ID NO: 6822929 - DNA, 66 bp, Homo sapiens
ttttccctgtgggagtaggaaagttcatctgcacatagcatgtttattttcatttccaggggagga

SEQ ID NO: 6822930 - DNA, 70 bp, Homo sapiens
gccttgaactcatgtatattgatttttgttgctatcacaaatcaggtagaaaatgtttatcagttcaggc

SEQ ID NO: 6822931 - DNA, 94 bp, Homo sapiens
gccagctggtgcagctccaggaggctctggttgacgttcttctccaggtagaaggcgcagtccatggcctggagcccgctctcccagccttggc

SEQ ID NO: 6822932 - DNA, 66 bp, Homo sapiens
tgcaggtgaggggtattgttgtcaggcgtcgttatgtttttcaacgtgtaatcttatttaaatgca

SEQ ID NO: 6822933 - DNA, 78 bp, Homo sapiens
aaacactagtacaagcattctcagaatgtcatttttatatatacttgattagaaatggcaagaggattgcctgtgttt

SEQ ID NO: 6822934 - DNA, 104 bp, Homo sapiens
tttttctgttaccaagtaagttttaaagaacagtttcagttactgatgagtatgcacttatcttattttggtcagtgtactgggctgccctttggtcagaaaaa

SEQ ID NO: 6822935 - DNA, 57 bp, Homo sapiens
ctggggccccaccttaggcttggaaattagaatctacagtttaagaaaaagctccag

SEQ ID NO: 6822936 - DNA, 64 bp, Homo sapiens
agcttgctcatctgtaaaacaggattagtcagggggctaaccctattttacagatgcggaagct

SEQ ID NO: 6822937 - DNA, 58 bp, Homo sapiens
ggcacactctgtcccagagtgaagacaacacatgggtcagcacggaacagagggtgcc

SEQ ID NO: 6822938 - DNA, 112 bp, Homo sapiens
tgacctctgagagcagctgtccaggcaggcacagctctccatgagggatgcctgtggcaagctctctaacagtggctgctgcctgtcgtggacagctagcttccagatctca

SEQ ID NO: 6822939 - DNA, 64 bp, Homo sapiens
gcgcgcgaggctgggccctgcaggcggcggggggctggcgcctgtgtccccggtgtccccgcgc

SEQ ID NO: 6822940 - DNA, 61 bp, Homo sapiens
tttggtcatgtcgtcatttgggctggacacacacctcctatttggttttctcatggctaaa

SEQ ID NO: 6822941 - DNA, 60 bp, Homo sapiens
tcagctgcctttcccatgctagcttctctgaaacaccaggccagaggaagggagagctga

SEQ ID NO: 6822942 - DNA, 86 bp, Homo sapiens
catgtggatgctacttgccagttacttgatctaggccttgactcttggttttctgttgctcggataagttagcatgatttgacatg

SEQ ID NO: 6822943 - DNA, 126 bp, Homo sapiens
gaacaaatgctaaatagagtaacagttaaatgtatgtgtacactcttcccaaatgccaagagtgcagcggtggggtgagattcagatattcatttatttctaagtctgtagttaacatttatgttc

SEQ ID NO: 6822944 - DNA, 71 bp, Homo sapiens
ggttctctcctgtgcctctctaagctttctacaactataaattaatagataaagtttggagtcaggagacc

SEQ ID NO: 6822945 - DNA, 66 bp, Homo sapiens
gaagataacatgttgcagattctgcctccatagtgatcagagtagcaatctgtgatgtgtgtgttc

SEQ ID NO: 6822946 - DNA, 58 bp, Homo sapiens
tggtggaggcagtgacacagtagcttccatgtgctctgggaactgactgccttctcca

SEQ ID NO: 6822947 - DNA, 64 bp, Homo sapiens
catagcatttaatgtattgtcaatgactaatttcatggtctaatggcagagttgagtagttatg

SEQ ID NO: 6822948 - DNA, 71 bp, Homo sapiens
ttcaggtcagtagggaaatcattagtgagatagtgtagctctttaaagatttcttacttattgatgctgaa

SEQ ID NO: 6822949 - DNA, 68 bp, Homo sapiens
agtcaggaacctcagcaagtctactcacactaagctctctaggattgtcaacttgttggggcctgtct

SEQ ID NO: 6822950 - DNA, 70 bp, Homo sapiens
ggatctgctgtgcctcttttcacgtgtctccctaaaaagtccatgtgtctccagaggcagagctaatgcc

SEQ ID NO: 6822951 - DNA, 78 bp, Homo sapiens
gagtgaatgagggagggagagagcaagcaagtgggtcttcccattgctgacctttgctctccgttccccaggctactc

SEQ ID NO: 6822952 - DNA, 97 bp, Homo sapiens
gctggagcttaatccagctcaggtcattccagggatgacctaaagatgctggagaaggagggttatccctggtctgaggggataatggagctacagt

SEQ ID NO: 6822953 - DNA, 62 bp, Homo sapiens
cgtgagctgctcattcccagcacatggccagcgaggtcatagcgagtgacgaggagcacacg

SEQ ID NO: 6822954 - DNA, 75 bp, Homo sapiens
agtttgcaaaataaggaagaagaagatgaggagatgcagtcttcatttcatttcttttcccaatattttgctgct

SEQ ID NO: 6822955 - DNA, 55 bp, Homo sapiens
tgactagagcaattggaaacaattgttaaaaattgtttttaaaatgtcctggtta

SEQ ID NO: 6822956 - DNA, 127 bp, Homo sapiens
atggggcaggttaggtgaatttgtggtccctctcctgtttctgctccactctctccaggatggtggtctgtccaggagtggggcagaggtctcaggaacaatgcagatacctctcccctagccccat

SEQ ID NO: 6822957 - DNA, 77 bp, Homo sapiens
aggacacacagctctttggcgttggcagagccaggtgtgagctctggtctgcctggatcacagcccctgtgtggcct

SEQ ID NO: 6822958 - DNA, 58 bp, Homo sapiens
agtgtctggtgagggctctctcttttggttcacagacagagcctcttcactgcatact

SEQ ID NO: 6822959 - DNA, 55 bp, Homo sapiens
gctccagcacctagagcaggtccaggacccataaatgtttttaggatgtctgagt

SEQ ID NO: 6822960 - DNA, 80 bp, Homo sapiens
actcaggtatccccagggaggcctgacctggcagctcgggaccccatttcagagcctggaccctggaggactgctggggt

SEQ ID NO: 6822961 - DNA, 83 bp, Homo sapiens
catcaagcccagtgcccagacttctgggaggatctggctgctactcagtgaaaggaagcctgggaggtttgggagggcagatg

SEQ ID NO: 6822962 - DNA, 70 bp, Homo sapiens
gtgatggtatcgctggggcaatgtctacaaccaaatttagaaagttagaacattcacaggatattatcat

SEQ ID NO: 6822963 - DNA, 119 bp, Homo sapiens
tcctagagcccacagagcaggcctgcccagaagtgactcagcactgtctgccagcctcagcacgggttgagtggacactctgcttgcaggtaacaatcttctcatggcggctgctggga

SEQ ID NO: 6822964 - DNA, 130 bp, Homo sapiens
cttttggtgtacttttcatataaggatgattttgtaatattgatttctattgagaggttaggaagataactcattcttttctcaaatggacaatattgtgggggttttttgtactaatagtataggtaag

SEQ ID NO: 6822965 - DNA, 66 bp, Homo sapiens
atgtgagcaaggccagggccgtgaattaaatgagagacccatggctgctttcccttagcaccacat

SEQ ID NO: 6822966 - DNA, 119 bp, Homo sapiens
gccatcagcagaggttgtcctcccagagcatgtggctttggcatgtgccccttgtagcagagaaggggctggggcatgtgcccaacccaccagttgggaggcacccactctgctatggc

SEQ ID NO: 6822967 - DNA, 77 bp, Homo sapiens
ttactttccacaatatagtctcccattggcctgctgtttactttcattctgccacagcagggactacgtgaaagtga

SEQ ID NO: 6822968 - DNA, 73 bp, Homo sapiens
tttttccctcaattctagagccttacattgtggttgagtttataggttatttattggctttaggaaggaagaa

SEQ ID NO: 6822969 - DNA, 67 bp, Homo sapiens
gaagtttcacgtatgctctagagctcttttcactgtttctagtgtttgttctcagagcatgagcttc

SEQ ID NO: 6822970 - DNA, 90 bp, Homo sapiens
ctggatgagaaggtgttcagtcctgctggcttcaggagattcattcctgaataccttgctgtagccacgcagtgatggagctcctgacag

SEQ ID NO: 6822971 - DNA, 81 bp, Homo sapiens
taaatatatttctactgtgagaaacatgaatgggatctacttaatctagatagtcaaactctacatagggaattgtattta

SEQ ID NO: 6822972 - DNA, 66 bp, Homo sapiens
ggcagaaggatttaaaggaaagaatgtcagtggaaggatatgcttacagcttaaaatccagctgcc

SEQ ID NO: 6822973 - DNA, 96 bp, Homo sapiens
gatgagtgtcctgctgtgggcctgatgctgccatgagtccctgctgcgcacccgctctgcctggccagccctcgggccacactgtgaccctctgtc

SEQ ID NO: 6822974 - DNA, 76 bp, Homo sapiens
aggaggtagctcttactctctccggcctgcacagagctgaggaaagcaggctggggagaggggaagcacatgtcct

SEQ ID NO: 6822975 - DNA, 58 bp, Homo sapiens
cctgctgagaagctaagcaggaaagactaaaggatgaggcatgcttggcttctttagg

SEQ ID NO: 6822976 - DNA, 60 bp, Homo sapiens
tgtcttaatttggatgatgtttttattctacaaaatagaattattatcttgttcgaggca

SEQ ID NO: 6822977 - DNA, 83 bp, Homo sapiens
ctttgtgccaagctgggaggcactgaggtttcaaatggctatgcattatcaatatctcagtgtgcttctgacagggcataaag

SEQ ID NO: 6822978 - DNA, 73 bp, Homo sapiens
gggctcccccgcaggtgccggcagatggggtagcgaatggtcctgtgcctccacctgctccgggagggagtct

SEQ ID NO: 6822979 - DNA, 55 bp, Homo sapiens
acttagcttgaaatcccagctctgctcattaatagctggttgacttcaggcaagt

SEQ ID NO: 6822980 - DNA, 62 bp, Homo sapiens
gaatttgaggtgtgtatgttggggaaggaggtatcctttctctatcgacccatcgcgaattc

SEQ ID NO: 6822981 - DNA, 73 bp, Homo sapiens
catgtctctagatattgccagatgtccccggaagaacaaaaatttctgacacaaaataatgactaaagacatg

SEQ ID NO: 6822982 - DNA, 81 bp, Homo sapiens
gggaagggggaggaatgaagtatcctaagtagcaaccatggctgcgctgctggaggcctgactgtgtttctttcccttctc

SEQ ID NO: 6822983 - DNA, 58 bp, Homo sapiens
tggcagagttatgggtatttataattttattctttgtagctttctcaattttctgcca

SEQ ID NO: 6822984 - DNA, 77 bp, Homo sapiens
actgaggcttaaagatcttaggaagattttccaaggaaacaactggagagtgctagagctgagatttgaacttcagt

SEQ ID NO: 6822985 - DNA, 56 bp, Homo sapiens
aggctcccttgccattcccaggagggcaagccgcagcctgggtggctagggagttt

SEQ ID NO: 6822986 - DNA, 88 bp, Homo sapiens
ggtcgatggggaggtgaggaggacagagcagcacgtgcttaagtgcgtgctccgagtgccctgtcgctcactcccacctccattgttc

SEQ ID NO: 6822987 - DNA, 56 bp, Homo sapiens
caaatgctattttagatgggtggctagggaaggcctctctttttaggtggtgtttg

SEQ ID NO: 6822988 - DNA, 65 bp, Homo sapiens
tggtggggatgagagcaggaaccatggccagaattgtctgtgcatctgttcattcgttcccagca

SEQ ID NO: 6822989 - DNA, 102 bp, Homo sapiens
ccactacaagcactgcatgattccatttttatgagctatcaaaaatagtcaaactcgaagaagcaaagaatagaataatggttgtcaggagcttgtgggagg

SEQ ID NO: 6822990 - DNA, 73 bp, Homo sapiens
ggggctgagacccaagtcctgagcctcccagtgcatgcctccccagaccgctctcagggcatgggacagcccc

SEQ ID NO: 6822991 - DNA, 62 bp, Homo sapiens
ggttcaagcctcccctggggcaggtggcttcaaacccacctgggtcccagccaggctttgcc

SEQ ID NO: 6822992 - DNA, 68 bp, Homo sapiens
gatttctcaactctcaagagaagctattatttcctggagagaagctattatatgagagctgagaagtt

SEQ ID NO: 6822993 - DNA, 83 bp, Homo sapiens
aagtattgtttgtgggttatgtatggagtctggtgttcaacttctggtttactgctaattctgtaggtttgcgcaaattactt

SEQ ID NO: 6822994 - DNA, 80 bp, Homo sapiens
cttggcatgggtggtgggcaggtcactctgcctcagtcctgccccagctgaagaggcgtcaccaccacccccatgcccag

SEQ ID NO: 6822995 - DNA, 94 bp, Homo sapiens
agtttaatgaaaatgggttgtatgtaaagtttgtaatagaaaacaggaaagtggtcttgtacataattattgtaaactactatttttataagct

SEQ ID NO: 6822996 - DNA, 64 bp, Homo sapiens
cagaggagatactgtttctcttctacatgaaactcatttcatgcagattcagcagatccctgtg

SEQ ID NO: 6822997 - DNA, 82 bp, Homo sapiens
gtgggttaggactccagcatatacttttagtgggacacaattcaacccataaaaggtggcagtgcttgagcactggattcat

SEQ ID NO: 6822998 - DNA, 73 bp, Homo sapiens
gatggagagcgcaaggggccaagcctgagttcagggaaaggctgagccaggctactccttgctgacagccatc

SEQ ID NO: 6822999 - DNA, 89 bp, Homo sapiens
tctctgtcctaattgagcacatgacttttagtcgagttccagaaatatgacacttgcactgagatctgtgccacaaaaaggctcagaga

SEQ ID NO: 6823000 - DNA, 79 bp, Homo sapiens
gaatgttccatgccttctgccagattaagggtgggattctaccacatatttgccatgaagagtgtttgaaaacacattc

SEQ ID NO: 6823001 - DNA, 77 bp, Homo sapiens
cagaagcaacttaccaaggggtatttaaagacatgaaaatttccagaaataccatttggtgcatccctttgtttctg

SEQ ID NO: 6823002 - DNA, 55 bp, Homo sapiens
tcatcaggtatccattgtgagaagactcgcctcttcttaacaatggctctgatga

SEQ ID NO: 6823003 - DNA, 78 bp, Homo sapiens
gggacagactgcgggtggggacgtactgagaggtccggacctcaatgcgtccgacccgtctccacaccgcccttttcc

SEQ ID NO: 6823004 - DNA, 69 bp, Homo sapiens
gcagcagggaaaaagggtagaaggaaatatcccacttctctcttcctttgcactccagtctcctgctgt

SEQ ID NO: 6823005 - DNA, 78 bp, Homo sapiens
taggttggtgcaaaagtaattgtggtttttgtcattgaaagtaattgaaaaaactgcaataacttttgcaccaagcta

SEQ ID NO: 6823006 - DNA, 58 bp, Homo sapiens
cttgttagtattgtcttatttcatggagggatacagggaatgaggtcccactgaggag

SEQ ID NO: 6823007 - DNA, 119 bp, Homo sapiens
ggactgtcttacaggcttttggagttggcctgggaagagggcatggtgggccttggttagactgccatttccacacttgctgtctgctgaggatggctcctctctatgctggatggacc

SEQ ID NO: 6823008 - DNA, 81 bp, Homo sapiens
cttcacttcaatacagcagatttccctgggctcctggctgggcacagagtggctggcagaggggagtctgtggacgtggag

SEQ ID NO: 6823009 - DNA, 77 bp, Homo sapiens
gacagtattctgggggatctttggtaacatttcttctgaaaattgcttgtcttcttccctactagaatgtagctgtt

SEQ ID NO: 6823010 - DNA, 59 bp, Homo sapiens
atacacaggcatgcttctgattcatcaataatctgaaattgtagcatgtgtttgtgtgt

SEQ ID NO: 6823011 - DNA, 66 bp, Homo sapiens
tgcttatcttttctctcactaggctggagcttaagtccacttatgaggagaaaatatataaaagca

SEQ ID NO: 6823012 - DNA, 67 bp, Homo sapiens
cctcactgctatgtgtttgctcatagcagctgctaatccagaaagaacaggcactaagcatgtgggg

SEQ ID NO: 6823013 - DNA, 63 bp, Homo sapiens
tcatcttgctgccattgctttagtttaaactggacccacaaatctgagcaatgtcagcaatga

SEQ ID NO: 6823014 - DNA, 79 bp, Homo sapiens
ttttatttggtctgtgcaaataaagagcaacattatctgaaaatgtttttaagtttatttgtgacagcatcaaagaaaa

SEQ ID NO: 6823015 - DNA, 56 bp, Homo sapiens
caggaggttgtaagagcaggccctacatttgttcgctgggctcttggaggctcttg

SEQ ID NO: 6823016 - DNA, 109 bp, Homo sapiens
ctcctttaggatggtagatttagttagagaagccacagtggacaggtcaaatcctgtgatctttggtaatctggcacattcattgattttattattttgtaaattggag

SEQ ID NO: 6823017 - DNA, 58 bp, Homo sapiens
tatctgaagggctaagggttttagaatttgtattccatagaattcttaccctttgatg

SEQ ID NO: 6823018 - DNA, 89 bp, Homo sapiens
ggataccatttggagatcactggaaaagctcaaagcaaaatttattttattgttctgttgttttattgtgagtcccattagatggttcc

SEQ ID NO: 6823019 - DNA, 62 bp, Homo sapiens
ggcaagttttagattgactccaatgtcatgtgctttgacagaaagagtattaaagatctgct

SEQ ID NO: 6823020 - DNA, 66 bp, Homo sapiens
cccacactgagaatacaatgttgcagggttttatgtagctcattaattcgtgttctccagtgaggg

SEQ ID NO: 6823021 - DNA, 79 bp, Homo sapiens
ggatcatgtcaggcacagctgggcaattgcggttccagagtaaaggtccgtcaaagttctcagttcatgtcaatgattt

SEQ ID NO: 6823022 - DNA, 65 bp, Homo sapiens
ggcaatagaattgtatttgaaccatggagccctcctccatgtttctgatgcagcttttatgagcc

SEQ ID NO: 6823023 - DNA, 109 bp, Homo sapiens
ccagcacaacatttagaacccagtgtttttgtcttgagttttgttttgtcaattaacaccaaagcaggctaaataataatacatgtttggttgtgagacagtgtgttgg

SEQ ID NO: 6823024 - DNA, 55 bp, Homo sapiens
agaagggaaatgctaacagatgggcaagctttttgttcatggtgtatttctttct

SEQ ID NO: 6823025 - DNA, 66 bp, Homo sapiens
aggcaccggcagatttggcatctggtgagggcctgtttctcatagatggcaccttctgtgtgtcct

SEQ ID NO: 6823026 - DNA, 55 bp, Homo sapiens
gtatgtgttgaattcaggggtcgtgacttacaccactctgaagtccagggcatac

SEQ ID NO: 6823027 - DNA, 89 bp, Homo sapiens
tgttcttggataaatattatgtagagtagtcagaaatgccaggagacatcttgtctttaaagcacttacatactctgcatacatgagca

SEQ ID NO: 6823028 - DNA, 59 bp, Homo sapiens
ctttcagtttggtgaaatacaagggcaaggtctctttgtgcttgaaatgagactgaagg

SEQ ID NO: 6823029 - DNA, 80 bp, Homo sapiens
ttgggtattttacaactttgtgctgatttgatatggacagatcatcccagtgttttatcagacaaagtataacactccag

SEQ ID NO: 6823030 - DNA, 63 bp, Homo sapiens
gtcatctcaaatgtttccacttctgcttcctgagacagccaggagagcaaagcaagagatcac

SEQ ID NO: 6823031 - DNA, 63 bp, Homo sapiens
tggaatctcagtggaagcaggaagtttagaaggcatcacagctaccatctactagagattgca

SEQ ID NO: 6823032 - DNA, 69 bp, Homo sapiens
tcttacttctcttatctcctgcccccggggctgagttttctctgccttggcaggctgataacatgtgga

SEQ ID NO: 6823033 - DNA, 56 bp, Homo sapiens
gacccaggaagctacttctggtaacagttgtcacataccaggcagtggactgggtc

SEQ ID NO: 6823034 - DNA, 99 bp, Homo sapiens
tgaaataaatgaagatctctacaagtattctacaaagaaattgaattggtagtttaatcttcagtttcctaggttttgtttggatgtttgtttttttca

SEQ ID NO: 6823035 - DNA, 125 bp, Homo sapiens
tgtctcctccactagatccgagccagtggctctgcccaggtggacagcagagtcgccgctgagattctaactgcttccatcggggctctcggagcagctgttggaacaggatggggagcagagca

SEQ ID NO: 6823036 - DNA, 91 bp, Homo sapiens
gtccccctccagccgcgtactgtccagcttggctcctggggcttggatgtccacctccatgctgggcagagacacgtccaggttgggggac

SEQ ID NO: 6823037 - DNA, 66 bp, Homo sapiens
tcaccaggggaatgagggtctaagtcctgtgaaagaatggtggcatggccctcattccagtggcga

SEQ ID NO: 6823038 - DNA, 56 bp, Homo sapiens
ctcaaggaacaaactgttcttcacaagtgtttcttggaatgacaagttgttcagag

SEQ ID NO: 6823039 - DNA, 74 bp, Homo sapiens
gcctgtggctcaaaatcccatgatactgaagataaatctgaaaattggcattatgcattttgccctacagcagc

SEQ ID NO: 6823040 - DNA, 81 bp, Homo sapiens
atagaataatataatcctacttcccatgatgctaatttatctctcactgtaacatgaaggttaaggatcatattgtgatat

SEQ ID NO: 6823041 - DNA, 125 bp, Homo sapiens
caggaacaactggaagcttgttaaaactgcaaatttctgggccctaaaccagctctattaaatcaatctctgtggaggtggggctcaggaatctgtattttaataagcttcatcagttgtttctg

SEQ ID NO: 6823042 - DNA, 65 bp, Homo sapiens
tgtgtgtatatgtgtatataggtgtctatacataattgtcttatttgtatgcatacatacacaca

SEQ ID NO: 6823043 - DNA, 75 bp, Homo sapiens
tgttaaggtgtaagtataaaatgctaagcttttatccctagaaattcagcaaaaagatacaggacacctttggca

SEQ ID NO: 6823044 - DNA, 72 bp, Homo sapiens
tgtaacactggtatttcatttagtgagaatatttactccataatagctaatgagtgctcggtgtttgataca

SEQ ID NO: 6823045 - DNA, 73 bp, Homo sapiens
ccagagactggaagatgggggcttaatacttctcaatgattacatgtcaaagagatggctcccaggtctctgg

SEQ ID NO: 6823046 - DNA, 72 bp, Homo sapiens
ggtcccctgttcagggcgggggctcaaccagtggatctttattctattagcaattgccctgtgcaatagacc

SEQ ID NO: 6823047 - DNA, 83 bp, Homo sapiens
ggcctggctgatggagctggaaagtgcttttctgagagggagtggtgccttctactttccattccatcttacaaagccaggcc

SEQ ID NO: 6823048 - DNA, 61 bp, Homo sapiens
tgggtctttttgctttcagctctacccaaattcctaacagaaggaagccctaaaggaccta

SEQ ID NO: 6823049 - DNA, 67 bp, Homo sapiens
gtcccagctacttgagaggctgaggcgggaggatcacttgagcccaggaggtcaagtagctatgggc

SEQ ID NO: 6823050 - DNA, 64 bp, Homo sapiens
ttaggagagacaaagctgggctgacaaaaaaatacatttgtggaactagtattgtcttaactga

SEQ ID NO: 6823051 - DNA, 73 bp, Homo sapiens
gcatgaacatgtgttggctttggtctggatgccagaggatgatatctgataaagaccaaggtaagcgttcagc

SEQ ID NO: 6823052 - DNA, 66 bp, Homo sapiens
gggcaggtagaccaccagaacctccatttcttaaagccccaatggacagctggaaattacttgccc

SEQ ID NO: 6823053 - DNA, 103 bp, Homo sapiens
ggaaataaatctctagtcttctccatgggatcttgggatctaacttctccttcaacttccaacaattttctttggagactctcagactactgcctttttttcc

SEQ ID NO: 6823054 - DNA, 59 bp, Homo sapiens
gtctactgtgaggctcctggatggtgagctattccagagaaatctagtcttacagagat

SEQ ID NO: 6823055 - DNA, 62 bp, Homo sapiens
gccatggcagggaccaagctgtcatttctcataatgattgtttataatcttgtcaatgaggc

SEQ ID NO: 6823056 - DNA, 69 bp, Homo sapiens
tccttacgtcttgtgacttgatagggtagagtagaaaatgtatttcttttaagacacacagattaagga

SEQ ID NO: 6823057 - DNA, 70 bp, Homo sapiens
gcaggcttttgaaaccgaaaatcacatctgtgaaaaatgtcatagctgtgtatggtttacaaatatttgt

SEQ ID NO: 6823058 - DNA, 96 bp, Homo sapiens
agttgaattattttccttttcaatgctttctgtatattaagtccagtataaatttatagatcatttgcattggtcgtaagggcagtgagtcacatt

SEQ ID NO: 6823059 - DNA, 76 bp, Homo sapiens
gcaagtttctaggttatggtgatgctgctggtccagggaccacagtttgagaaccactagcctagttattccttgt

SEQ ID NO: 6823060 - DNA, 71 bp, Homo sapiens
ggcgggagtgcagtggcgtgatctcggctcggtgcaagctccgcctcccgggttcatgccattctcctgcc

SEQ ID NO: 6823061 - DNA, 130 bp, Homo sapiens
gtgtgggaagcagactggagctctgttactgatcgttgaaattgggtgtggctgtcatggagatcactctggatccctggtccattatcccgctttccagaaaagacaggttccagttcaaatccttggc

SEQ ID NO: 6823062 - DNA, 55 bp, Homo sapiens
atgggaggcagacactaagttctggggtctccagttttagtgggtggccactgat

SEQ ID NO: 6823063 - DNA, 124 bp, Homo sapiens
acctcagaaacactcattggctccagaaagtttttgattctaagagagattcagggtatcctaagcatcattttttacttctctctcaaagggaatcaagactgttttaagaaatgatgatggt

SEQ ID NO: 6823064 - DNA, 85 bp, Homo sapiens
tagagtaactggagcagagaggtggctgcatatgaaaagcttttccttgtccttgcagacatctctcttcaaaccagtcactctg

SEQ ID NO: 6823065 - DNA, 70 bp, Homo sapiens
atacacagctcacaacgtgtgcatttgtgtgaccttgtctctgtgtgtgtgtgtgtgtgtgtgtgtgtgt

SEQ ID NO: 6823066 - DNA, 81 bp, Homo sapiens
acaggtgcctgtatcacatgactctgcactaggctatggtttcccttcttacaggagctgctctgtgatacttgtatttgt

SEQ ID NO: 6823067 - DNA, 64 bp, Homo sapiens
acaagcattcaactctcagtcagtctcttgggctgaggcagaacagagcctgaatctctcttgt

SEQ ID NO: 6823068 - DNA, 81 bp, Homo sapiens
tcctcacctctcctcatgggcgggttctgccccacttccattctttggcatggagaggactggccctgaggggaggcagga

SEQ ID NO: 6823069 - DNA, 63 bp, Homo sapiens
actgtgacgtgccttatggagagaatatgcgtgttagtaagctttgttcaggcaagttacagt

SEQ ID NO: 6823070 - DNA, 55 bp, Homo sapiens
tttggaatgtagtttaatcatctttaaaatgagaggattgaactagatctccaaa

SEQ ID NO: 6823071 - DNA, 61 bp, Homo sapiens
agtgaagtagctctgtttgcaagttagccaaaggcttttgacagatagatgttatgttcct

SEQ ID NO: 6823072 - DNA, 67 bp, Homo sapiens
ttgagactcctctgcccaaatttgtatatagcttagtgtgtataacaggggaggggagggatttcaa

SEQ ID NO: 6823073 - DNA, 66 bp, Homo sapiens
gagataaagttgcagtgaaataaggctcaggtcattcaaggccttagcggtcatagcaaagatttt

SEQ ID NO: 6823074 - DNA, 79 bp, Homo sapiens
ttggcctgcgggtctcgtgagctggaagaaatcaggaaagggaagctgagcatttaatcctacatagatcacaggctaa

SEQ ID NO: 6823075 - DNA, 60 bp, Homo sapiens
ctgatttgctaaatgtcacatctcctgcacagaggtaggtggggtgaatggcatagtcgg

SEQ ID NO: 6823076 - DNA, 82 bp, Homo sapiens
gaagtaatgagaacatgcatataggacacaaagaaatatccacctcatcactctttggtcacacatgtatctcaatggcttc

SEQ ID NO: 6823077 - DNA, 69 bp, Homo sapiens
gacaccaaagtacctctcagctgctggtgccaagacagaggtagcatctggcctggttacttttgtgtc

SEQ ID NO: 6823078 - DNA, 73 bp, Homo sapiens
acatgcagcagaataatgactataaaaccttataattatacagcacttggatagtcaggaactgttggtgtgt

SEQ ID NO: 6823079 - DNA, 65 bp, Homo sapiens
ccactgcaaggcattaccatggctagagtcacagaagtcattgcagtcctattgccttgttttgg

SEQ ID NO: 6823080 - DNA, 73 bp, Homo sapiens
gatggacttacttgggcacacatcttaagtgtctttgtgacacctctggtctgtgtcataggctgagttgatc

SEQ ID NO: 6823081 - DNA, 69 bp, Homo sapiens
gttaagcacagtggcttttgtgtctgcagatttgagctgaaattccagttctgcagcatagggcttaac

SEQ ID NO: 6823082 - DNA, 87 bp, Homo sapiens
gtagttctggagttggtgcaggaatctgcaattgaaaaagtattttgagtattgtaattcaagtagttcttgcattttgagaaatac

SEQ ID NO: 6823083 - DNA, 63 bp, Homo sapiens
gggcaagttgagaagaatgctaccaaccctaaaccccagttaagtcactcctctcgactgtcc

SEQ ID NO: 6823084 - DNA, 55 bp, Homo sapiens
gagccctgctgggccttgtctctgcccttgcacaggccgggtttggcagaggctc

SEQ ID NO: 6823085 - DNA, 58 bp, Homo sapiens
ggcccgggggttgggtgatatccccggctacagctgaatttcacagacttactgggcc

SEQ ID NO: 6823086 - DNA, 64 bp, Homo sapiens
ccttcctcagcaggtctgtgtaccagcttcgtacaaggctggtgcaaatccatcctgttgaagg

SEQ ID NO: 6823087 - DNA, 66 bp, Homo sapiens
gagttgactacatagatgcagaccaggccaaactagtcatgacctgccctgcactgtgggtagctc

SEQ ID NO: 6823088 - DNA, 77 bp, Homo sapiens
tttatttataaactctctgctgctgagcttggggcctggagccccaggaatgagcaggcaggggagactgagatgga

SEQ ID NO: 6823089 - DNA, 58 bp, Homo sapiens
attgtacaatgcctggaacattgtaggtgctccttaaatgtttcagtgcttgtccaat

SEQ ID NO: 6823090 - DNA, 55 bp, Homo sapiens
cagctcctctgttagccctggggacagagcctcctagggagcaaggtgggggctg

SEQ ID NO: 6823091 - DNA, 56 bp, Homo sapiens
taattgtatggagaaggctgcaagacaggcactgtggtcttcagtagatacagtta

SEQ ID NO: 6823092 - DNA, 67 bp, Homo sapiens
taagggagtatcttttacaccaggaaattaatagtacagtaaatttcactgataaagactccacttg

SEQ ID NO: 6823093 - DNA, 116 bp, Homo sapiens
gagtgcaagctttagagtaagtgggacctgtgtctgcattctgtgtaactcagtagctgtgtgacatagtagctgtgtaacatgagaatgttcctcaatctcgctgagcttcagtc

SEQ ID NO: 6823094 - DNA, 69 bp, Homo sapiens
gagtgacagggcagagaggcaggcttgggtctgtccagctccaaagcccatgctctgtccatgcatctc

SEQ ID NO: 6823095 - DNA, 62 bp, Homo sapiens
taggtctgtgttctttagaggtttttgttggtaggaacattgaaccagtagacacaaaccta

SEQ ID NO: 6823096 - DNA, 64 bp, Homo sapiens
gagtgtggatgggttcagtgattcactcctaataaaaacggacaatgcagcccctaccacattc

SEQ ID NO: 6823097 - DNA, 71 bp, Homo sapiens
cactttgcctttagataagccttctgcaaattagaatgtaatgaaagaccttgtaactagaggcccaagtg

SEQ ID NO: 6823098 - DNA, 100 bp, Homo sapiens
gtcctgggagctggggggcggctggaagccggcttccctcgagccctgagtttccttaggcttccggcaggcggcgccagcctcctccccaagtccgggc

SEQ ID NO: 6823099 - DNA, 130 bp, Homo sapiens
atggacattcattaaaatgggctctgacttgatagccacgttagcagaaaatggaaaagtccatctatcactgtctgttcccattttctgcataatcattcctggaagaaagaggcctgcaagtgtgtat

SEQ ID NO: 6823100 - DNA, 84 bp, Homo sapiens
gcctccacattcctgccctcgccactacagttacagagaaattaaaaaacctttcattgtacaactgagggtggaattgttggc

SEQ ID NO: 6823101 - DNA, 65 bp, Homo sapiens
aggactccggaagtactctctcctggatttcattaaatctaatgagttagataattttggagcct

SEQ ID NO: 6823102 - DNA, 57 bp, Homo sapiens
tgcagaattccttttgacatgtaatgtagcatattcacaagttctagggattaggca

SEQ ID NO: 6823103 - DNA, 129 bp, Homo sapiens
ccctcaccagtttaactttcttcctttcctaaaatgttgtttttctgcatgtctatttaagttagtgaacattcttggaggaaataacaggaccaggctgaatgatttctgaggtttagtctttttcag

SEQ ID NO: 6823104 - DNA, 73 bp, Homo sapiens
gttatcacaagcaattcaacctaagtgcatccagcaaaatggataccttaggttaggattcccgctagaaaat

SEQ ID NO: 6823105 - DNA, 82 bp, Homo sapiens
tttggattttattctggtggcaatgaggcgtcactgaaagaatttcagctgaggcatgatgctatcagatgagagatttaga

SEQ ID NO: 6823106 - DNA, 76 bp, Homo sapiens
tgctgggagaagagtctattggaactagacatgacatgttcatgtttgtgttataagaatcatcttcaatgcagca

SEQ ID NO: 6823107 - DNA, 71 bp, Homo sapiens
agcaaaggttgtgttctggggtgaggatcatgagagagatatttatcacatgcacatgcctttatatagct

SEQ ID NO: 6823108 - DNA, 69 bp, Homo sapiens
tttgttcctaggctgtgatctcatgatttgttccagggaacattcacgctctcaaagctgaggaagaaa

SEQ ID NO: 6823109 - DNA, 60 bp, Homo sapiens
tccttggagcaacacatgacatctagaactctacatggtccaaggtctgtctcacaagga

SEQ ID NO: 6823110 - DNA, 78 bp, Homo sapiens
ttgctgcccttgtcttggcatattttcaccaagcttgctgagcctggtgcatacttatgccaggggaagagttaacaa

SEQ ID NO: 6823111 - DNA, 80 bp, Homo sapiens
ttctgtttctgttttgggaggggtgtatgtgagagagttttccttccatgccttactcttcaccgctactgaaatacgaa

SEQ ID NO: 6823112 - DNA, 74 bp, Homo sapiens
tgctttgtcaccgaggctggagtgcagtggcacgatctcggctcactgcatcctccacctctcaggttcaagca

SEQ ID NO: 6823113 - DNA, 69 bp, Homo sapiens
cagagcccttggctggagcccagataattctcctcctaaatcttccagggcttctccctaaggactctg

SEQ ID NO: 6823114 - DNA, 60 bp, Homo sapiens
tggttacacagcatgtggacttgaacaggaatagtctgagccccgagtctgtgctaacca

SEQ ID NO: 6823115 - DNA, 77 bp, Homo sapiens
ttttttttgagaagaggtcttttgggatgcatggtgctccacatacagcttcacaaaatatttcattataagagaaa

SEQ ID NO: 6823116 - DNA, 67 bp, Homo sapiens
ggctgaagggaggcggccagtgcggggccctgggactctgcgccaccctcgcctgctcgcaccagcc

SEQ ID NO: 6823117 - DNA, 130 bp, Homo sapiens
tagcgaaaggtgacgaggctgttttcggagagccaggggtcccagcggcccgctttcctgctagaggagggggcggcgcgtagccggagacttcagcgcggcggctccaaagatctcccttcacttttca

SEQ ID NO: 6823118 - DNA, 90 bp, Homo sapiens
ggaataaaggcttcctaggtaacaaacttctgacttaagcaggttttgctgaaaacttaagcaggttttgctgaaaaggaagcagattcc

SEQ ID NO: 6823119 - DNA, 57 bp, Homo sapiens
gcagtggccacatggaggaggaggcccacccggaactctgcccacactggccactgc

SEQ ID NO: 6823120 - DNA, 77 bp, Homo sapiens
tctgaagtgataaggtcagtgtttgaacccagggttatctgattccatagctatgctcttaaacatgatccttcaga

SEQ ID NO: 6823121 - DNA, 93 bp, Homo sapiens
ccccagtggctgggacagaagctgctcacaggtctgtggctattgatggtcagagccagagacctgctgtgctcattctgggacgtggtgggg

SEQ ID NO: 6823122 - DNA, 71 bp, Homo sapiens
gttggcctgtcatgtagatgtagagtagaatgtaccaggcttcatttatgctatactgctgacatgctgac

SEQ ID NO: 6823123 - DNA, 74 bp, Homo sapiens
tcataaggcccaaaattcagagactaattgtaaattcacataatcagatttctagcgtttggccaatcttgtga

SEQ ID NO: 6823124 - DNA, 86 bp, Homo sapiens
gaagctcccagagtcctctgcccatgttttcttagccaggtttgtaaaagggatcattctggagcagagggcgtttgaggaaattc

SEQ ID NO: 6823125 - DNA, 56 bp, Homo sapiens
tttcatactgtgtttccaagtttctcctttggggatacaatgaagtatagatgaaa

SEQ ID NO: 6823126 - DNA, 92 bp, Homo sapiens
ccctcagtaactgttaaaaacgcatgccatttggtggattgagagcgaagctccagcttcatgaagtgcgtgccctgacagtcgctgatggg

SEQ ID NO: 6823127 - DNA, 63 bp, Homo sapiens
gctgggtacctcaccgctgctgctggggccactctggccagcagtccacgaggtgagaccagc

SEQ ID NO: 6823128 - DNA, 83 bp, Homo sapiens
accatattgaacactgtgtcctatttccttgacattctagtgaatgaaaaatgagagaacacagttaatgatttgattatggt

SEQ ID NO: 6823129 - DNA, 66 bp, Homo sapiens
tcatcactgcctgcccctgccccccagccaggtttgctgagggtccaggtcttcaggcagagatgg

SEQ ID NO: 6823130 - DNA, 62 bp, Homo sapiens
cgtagaggcaggatggggtcattagggcttttccagcccagtgcctcaggccagcctgcacg

SEQ ID NO: 6823131 - DNA, 57 bp, Homo sapiens
cagctggcctgatccctgtggcgccaggcgggtcctgcagggcgggcagggcagctg

SEQ ID NO: 6823132 - DNA, 72 bp, Homo sapiens
acctttttccaaagcttcttactgtggagtcagaatcctccctgacgtgataagaattttgtgagaagtggt

SEQ ID NO: 6823133 - DNA, 57 bp, Homo sapiens
gcgggcaggctgatgcctcttgggacatgtaagtgcagaaggcaaggcctgccacgc

SEQ ID NO: 6823134 - DNA, 78 bp, Homo sapiens
gacctgaggcaagttcactttcttaaatcttcaattgtcacctggaaaatggagatgataagagggttgcaatgggtc

SEQ ID NO: 6823135 - DNA, 56 bp, Homo sapiens
ggttccaagagattaagttacttgcccagggtcaagagttactaagtgctggaacc

SEQ ID NO: 6823136 - DNA, 71 bp, Homo sapiens
gtagatggaagttcaggaacatgttggaaagaaatcaagataactagattttcttgttttaacttccctac

SEQ ID NO: 6823137 - DNA, 59 bp, Homo sapiens
ttgccttgcagaatgtctgtttttaattgcactggaaagctaacccttctgttgggtaa

SEQ ID NO: 6823138 - DNA, 70 bp, Homo sapiens
cggctctggaccctggagtggctgcaggcggcatggggctgcaagccaggcgctgggcgtccgggagccg

SEQ ID NO: 6823139 - DNA, 72 bp, Homo sapiens
ctcatttgccaagtcgggttgcagacacatcctctttctggagaggctgtctcagcctgcttgcagaatgag

SEQ ID NO: 6823140 - DNA, 89 bp, Homo sapiens
gtcaatcatggataagaatccgattcgtgtacattaatttcttttacgaaagatgtgcaacttgatttgaatctgaaaacatgactgac

SEQ ID NO: 6823141 - DNA, 70 bp, Homo sapiens
aggaaaactgaggcattaaagggaatcttctttggagacagaaagtgttcctttgatccttatccttcct

SEQ ID NO: 6823142 - DNA, 109 bp, Homo sapiens
gagggaaatctgcaggtccgcttcaaagccctggtctgccacccacacccctccaaatgtggagaatgggggctacaggccacatgcagttgtggacctgcggaacctc

SEQ ID NO: 6823143 - DNA, 63 bp, Homo sapiens
ggaggcagtgtttactgccctgtggattcattagcactccaaggccggcctgctctcgcctcc

SEQ ID NO: 6823144 - DNA, 70 bp, Homo sapiens
gtagttagcactgtcagcaagcctctagcacagtctatgtgtatattagtggaatgatatgaagaattgc

SEQ ID NO: 6823145 - DNA, 62 bp, Homo sapiens
tgagaatataattttattcctagagttttaatgtgtgggctctaaaatggagttttatctca

SEQ ID NO: 6823146 - DNA, 73 bp, Homo sapiens
gtacagtatcttagggaattaactaaaaattaactaaaattaacattttctgttaggaccctggagaatgtat

SEQ ID NO: 6823147 - DNA, 61 bp, Homo sapiens
gctccctgcagctgagagttccttccctggaagcctattttattatgcatgtaaggggagt

SEQ ID NO: 6823148 - DNA, 71 bp, Homo sapiens
gtttcacagtctgcagaattttatttccacacagccttactggttccaacagaatttttggattgtgtaac

SEQ ID NO: 6823149 - DNA, 85 bp, Homo sapiens
tagtcaatttagagttcaattagttggataaataacatttgtaatggttatctgtctgacagggtatgaactaaataactgacta

SEQ ID NO: 6823150 - DNA, 57 bp, Homo sapiens
tgcttgtattcatatcacagctcgcttgagtaagtggtaacgacagaataataagca

SEQ ID NO: 6823151 - DNA, 66 bp, Homo sapiens
ttagcataagggcaagctctttagtgtccttcaaagcacatatgtaaatagctgcctgtgtactaa

SEQ ID NO: 6823152 - DNA, 93 bp, Homo sapiens
ggaactaaaagaggacagagtactgagtggaacataggatgatagatttacaaataatgtagcatacttctacttcattgtatcttaagtttc

SEQ ID NO: 6823153 - DNA, 68 bp, Homo sapiens
gaggactcagataatctttgagtcttcattggtgttaccattagaagtgttcaaaggatgtcttcctc

SEQ ID NO: 6823154 - DNA, 61 bp, Homo sapiens
gttgaccatgacatttctagtttctacaaccacaccatctgaaatgtagtgttatgtcaac

SEQ ID NO: 6823155 - DNA, 65 bp, Homo sapiens
tcaactgctattttataacagaagacatactgctaaaaatgtctctaagataggaatacagttga

SEQ ID NO: 6823156 - DNA, 68 bp, Homo sapiens
cactgaggactcccacgtaggtctctttactgcccttcggagacctttttgaaatcagtctgtcagtg

SEQ ID NO: 6823157 - DNA, 76 bp, Homo sapiens
ggatttgggggcagtgaaactactctctatgatacaataattatagacacatgttattatactttcaaccaaatcc

SEQ ID NO: 6823158 - DNA, 80 bp, Homo sapiens
gtggatgaggcagaggaaatgggaatagatggtatgggcagaatcacatgatacatcttgtttatttcaattctcaccac

SEQ ID NO: 6823159 - DNA, 75 bp, Homo sapiens
ttgtgtggagtttatcagagagcagaggtgggctttaagaggctcactagtggtttctggtggttgctataacga

SEQ ID NO: 6823160 - DNA, 58 bp, Homo sapiens
tccagggctgagactgtattgggtttggtggttaattcttcagccttatagccctggg

SEQ ID NO: 6823161 - DNA, 66 bp, Homo sapiens
ccagaatccccagccagcttgcttcccagtagcctctgccaatgggagacactggtgggagcttgg

SEQ ID NO: 6823162 - DNA, 62 bp, Homo sapiens
catgggctttggaggctggaggctgtctattcccaccccactccaccctcccctaccacatg

SEQ ID NO: 6823163 - DNA, 97 bp, Homo sapiens
tgtttagtttgctggcctgtgggtctccatgagttctgttgctttgggctgcacaaatgctgggaaccattggatcagccaccccagccactagata

SEQ ID NO: 6823164 - DNA, 117 bp, Homo sapiens
cgtctaattcactcagaattttttaaaaagaatgcttcctttgaaactgaagttctttctacttggtttcagcccaaaggtgagcatttttttgagaaggttaaatcttttcagatg

SEQ ID NO: 6823165 - DNA, 79 bp, Homo sapiens
tgtatgtagggaaatcacaaatcattttatctgtgtgcagcaaccaattatttaatgatttggggtctactggcgtaca

SEQ ID NO: 6823166 - DNA, 83 bp, Homo sapiens
caaaggtttcatgcaatgttatatctgtatgtatatgcatgtgtgtgttttcatcacagaatgtaacacatttgttatttttg

SEQ ID NO: 6823167 - DNA, 62 bp, Homo sapiens
agcccagagggtagcagaagaaagaagttgaatattttttctctctgttctcctctcttgct

SEQ ID NO: 6823168 - DNA, 66 bp, Homo sapiens
tgactgctggaccttcagctgggttttggttatttacaaaacaatgttgctgggtgcggtggctca

SEQ ID NO: 6823169 - DNA, 79 bp, Homo sapiens
gtctatgaggccctcttgccacaatgaaatgtgtaaatatttgtaaatttacttcagctgccaggatgggtaacatgat

SEQ ID NO: 6823170 - DNA, 57 bp, Homo sapiens
gcacgtgtgtgtgtatgtgtgtgggtgggtgagtgtgcacacatgtgtgttatgtgc

SEQ ID NO: 6823171 - DNA, 70 bp, Homo sapiens
ccttcacaccatctttaccagggggatactactattatctgtttttattggtggagaaatgctgagaagg

SEQ ID NO: 6823172 - DNA, 79 bp, Homo sapiens
ggctggttagttgaggaggacttagctgggatggtttgtctctgctccatgtgatctctcctcctccactaggctagcc

SEQ ID NO: 6823173 - DNA, 102 bp, Homo sapiens
gagacaggaggatcgcttgagcctacggaggtcaaggctacagtgagtcgtgactgcatcattgtactctagcctctgggcaacagaatgagatcctgtctc

SEQ ID NO: 6823174 - DNA, 65 bp, Homo sapiens
tttacagcacccattaaggactggggagttatgctccatccatttgagagtggagtatctgtaga

SEQ ID NO: 6823175 - DNA, 57 bp, Homo sapiens
gcatctctacaacgaagacagtctttgaaggctgttttcaaagagagagaatgatgc

SEQ ID NO: 6823176 - DNA, 77 bp, Homo sapiens
cagaaatcaaaagctgtatgagtattgagccagagcatcacttctgctcagtaagtaaacagtaactggatctgctg

SEQ ID NO: 6823177 - DNA, 64 bp, Homo sapiens
tatctgctgttgatgaacattggaagaaaagctacatcttttcatgtacattcggcaacagata

SEQ ID NO: 6823178 - DNA, 69 bp, Homo sapiens
aggattttgaaccagacagacttcttatgaaagccaacactcttttgtctgttcaggtttcagagaact

SEQ ID NO: 6823179 - DNA, 59 bp, Homo sapiens
cacatgtagacatcaccaagggtatcaatagacacaaccacagaggtgtctgcagtgtg

SEQ ID NO: 6823180 - DNA, 94 bp, Homo sapiens
agctcttctctacaccttcacaaaaggtttattgctatggttgtttactgagacccaaggcagagcagggccagtggagtcaaagagatgggct

SEQ ID NO: 6823181 - DNA, 64 bp, Homo sapiens
ggatggatggtgagtggattgtaatggtcgatggataatggcaaataaatgctcactgctgtct

SEQ ID NO: 6823182 - DNA, 60 bp, Homo sapiens
ctccgctgtgtgtttttgtgccctcaggaatgtgtggatgcagcaaatgacaacagtgag

SEQ ID NO: 6823183 - DNA, 90 bp, Homo sapiens
aggggtccgggggggcttgtcaggggctgagggggctctcccgaagctccccacactttcactcctggctggccctgggacctggccctt

SEQ ID NO: 6823184 - DNA, 59 bp, Homo sapiens
gaggctggcatgtggcagctggttcagtggcaaccctcagcccagcccagtgcccactc

SEQ ID NO: 6823185 - DNA, 66 bp, Homo sapiens
cactgcagggcagagggagaatctctggaaaactcactagaggtgaaagaatttggctctgaagtg

SEQ ID NO: 6823186 - DNA, 71 bp, Homo sapiens
cttataagctgtatgacctaaatcttgtgtggttaccacgaaaacacgcagatcatatatccagctgtaag

SEQ ID NO: 6823187 - DNA, 82 bp, Homo sapiens
attgatttgtagctaaaatatgtttacatgtattctatccatatgagcaaaatacagtaattgcataggcttcaaaggtaat

SEQ ID NO: 6823188 - DNA, 81 bp, Homo sapiens
cttcttttaagtgattataataagaaaaggaaacgatgtgtttgggtctttcctactttattgtgaactacttgagagaag

SEQ ID NO: 6823189 - DNA, 74 bp, Homo sapiens
gagccagccagccagggtgctggggctcagctcttgagaaaaatgttgatgtaaaagccttggtggcctggttc

SEQ ID NO: 6823190 - DNA, 85 bp, Homo sapiens
gctgacctggtgctgtagcctgattgaggggcacagccttttccccagtcttggtgtctgtagcacgtatgttcttagtctcagc

SEQ ID NO: 6823191 - DNA, 64 bp, Homo sapiens
agtgggtacagggtagggcaagggaacctgcgtgtttaacacgtgccccctctacccacccact

SEQ ID NO: 6823192 - DNA, 56 bp, Homo sapiens
gaagtacacgtgtaagcttttctcctctgaagagaaaggtaaaatcagtgtccttt

SEQ ID NO: 6823193 - DNA, 83 bp, Homo sapiens
ggtttctgctgcttccatttccagctttctaggcctgttgttgactctggacatacatgaggaggctggaaacagtggagact

SEQ ID NO: 6823194 - DNA, 62 bp, Homo sapiens
tgcaattttaatacattagaggctaacagagttatcttgagctcataatgtttgactttgca

SEQ ID NO: 6823195 - DNA, 59 bp, Homo sapiens
agctggcttgcaagagaccctacatattgttatgtgtcctgtgggttttgggagcagct

SEQ ID NO: 6823196 - DNA, 76 bp, Homo sapiens
gacctgctgggcaatatgctgggcctggacctctgaaaggacaacacccagaccgtggcccgtgcccacacaggtc

SEQ ID NO: 6823197 - DNA, 130 bp, Homo sapiens
tgggataagaaaaatttatatggagaagtagcttatgctcattctgatactgctttattaactatattagcagcatgttgggatgtgaaaataggataactgccattctattacaatatttgtttacaca

SEQ ID NO: 6823198 - DNA, 75 bp, Homo sapiens
aataagccagagccagcaactctagccctgtagagatttctttccaggaatagatctgttttgcctggtgatgtt

SEQ ID NO: 6823199 - DNA, 95 bp, Homo sapiens
tatcttttgtataaacctgtacaggtcaatgataagatagtttaaatattctctatctttcagggccatttgtatttggtttagacttagtgata

SEQ ID NO: 6823200 - DNA, 62 bp, Homo sapiens
gtgagtctttggagacagttcagtataagcaggattatctctggattgtatagaaggttcac

SEQ ID NO: 6823201 - DNA, 65 bp, Homo sapiens
tagcatttcccaaatgcatttgaccttctaggacctagtcaagtgtggggcctggggaaaagctg

SEQ ID NO: 6823202 - DNA, 55 bp, Homo sapiens
tctgacagttatataagcaccagagctaggcatggtctgacttgtagctgtgaga

SEQ ID NO: 6823203 - DNA, 91 bp, Homo sapiens
gcctggcagtgggaggagaccgtctgggcagagttgtgatgaactggggaccgagcagccccagctcgcctcggaggttcccgagccgggc

SEQ ID NO: 6823204 - DNA, 56 bp, Homo sapiens
tcctgagcacctatgccatggcacacaagtgctggggccacagttagggctcagga

SEQ ID NO: 6823205 - DNA, 129 bp, Homo sapiens
caacggcgttggggcaagcctctctgcacctgcgtgtccagcctctcctgcatgccagaagtccccaggcaggagtgtggtgggacatccggctggggtaaggacaggcaccctcccacagtgtcaggg

SEQ ID NO: 6823206 - DNA, 61 bp, Homo sapiens
acatatgagtactatacagtgcctgcataccgtgtgtatttattgtgaatactgcatatgt

SEQ ID NO: 6823207 - DNA, 72 bp, Homo sapiens
ccagagatccatgcaatacagtttatagtaattcttcatttgcaatttgacaagttgcatgtttccatctgg

SEQ ID NO: 6823208 - DNA, 80 bp, Homo sapiens
gtgattcttctgtcctggcacttttcccagttttggtgcttaaatttactatccacttgaaatgtgtcactgcctgtcac

SEQ ID NO: 6823209 - DNA, 56 bp, Homo sapiens
cattatgtctgagttccaataatggggggaaggaccagaaggaggaaggcatagtg

SEQ ID NO: 6823210 - DNA, 58 bp, Homo sapiens
ggaacatgtagagggcctgtaggttatcaccctgctttgccagttaatactgtgttcc

SEQ ID NO: 6823211 - DNA, 88 bp, Homo sapiens
ctctatacacaatcgcacagatccttcttctgcattgcttaaggaattcttaaggaattgcattctgggaatggcttggtgtatagag

SEQ ID NO: 6823212 - DNA, 100 bp, Homo sapiens
ccatctcagctgaaagatcatttccaaattagaggaagctgcgactgactgagaaggcaggaggtgccctctagtggcatggttacattagcttgggagg

SEQ ID NO: 6823213 - DNA, 70 bp, Homo sapiens
gatgctccaggtgtctcctatgagcacagcgatgccatttgccaatctcctggtgacatgcctgagcatc

SEQ ID NO: 6823214 - DNA, 64 bp, Homo sapiens
tggcagctgttcagcaactcgcagagcagtctctcttctccatctgcctcgctaacagcagcca

SEQ ID NO: 6823215 - DNA, 77 bp, Homo sapiens
tttcctgtgataagacagccttctctattggcctcatgtggtgatcctggtggtgtgggggctggctgcacaggaga

SEQ ID NO: 6823216 - DNA, 75 bp, Homo sapiens
aggactgtgtcaattaatgtttgatgtgtgtgtttccttacttgacagacattttaattattaaatctcagtttt

SEQ ID NO: 6823217 - DNA, 66 bp, Homo sapiens
agacacacacatacatatgacaactttcctgtaaaggtacagctgtgtgtgtatgatatcttgtct

SEQ ID NO: 6823218 - DNA, 65 bp, Homo sapiens
cctgagatctttagaagatagaatcagcaagacttgacaactgattggatgtgggaggtcttagg

SEQ ID NO: 6823219 - DNA, 55 bp, Homo sapiens
cagcagggttaagtgactcacctgagggcacacagtggagtctttgttactgctg

SEQ ID NO: 6823220 - DNA, 78 bp, Homo sapiens
agcaagaccagggttttgtgtttgtgaacctatctaatattgctggggtttgaaaactgaaccctgagttttattgct

SEQ ID NO: 6823221 - DNA, 66 bp, Homo sapiens
aaagcactatagccaaatagccccaggaacctctccttctttgattcaattggttgtggatgcttt

SEQ ID NO: 6823222 - DNA, 58 bp, Homo sapiens
agtcctgtgaggggtgcagctttgcaactgcaggccaaagagcaaaccaaacaggcct

SEQ ID NO: 6823223 - DNA, 60 bp, Homo sapiens
gctccactgtttattggcagaagggaggattgtgtccagggccgcagtatgcagtggggc

SEQ ID NO: 6823224 - DNA, 67 bp, Homo sapiens
gaggtggtaatattcagaacatcaagctttaggatattcctgtggacaagtgctgaataactacttt

SEQ ID NO: 6823225 - DNA, 55 bp, Homo sapiens
acagcttctatttctctgtactctatgtctttgagtttggagagaaagaagtagt

SEQ ID NO: 6823226 - DNA, 60 bp, Homo sapiens
tgtggcttccacgatggtcacctgagacaatctttattggtgacaatggtaggaatcata

SEQ ID NO: 6823227 - DNA, 82 bp, Homo sapiens
tgaaatgggttgtgcagaaggcagaaagtccaggtatcttggctagatccagaggcactgccctttgtgcacctagacctca

SEQ ID NO: 6823228 - DNA, 120 bp, Homo sapiens
taggctgactggcttttttagggtaggtgagaggagaagcactttactttggggtgcccacatccacattagaatgttttctcaatttctttctcttacttttttgagattttaggccta

SEQ ID NO: 6823229 - DNA, 83 bp, Homo sapiens
aagacaattttgtggatctgtcaaatggattttgtcagaatgagctgatggaattcattaagaaagagctaaagaactgtttt

SEQ ID NO: 6823230 - DNA, 100 bp, Homo sapiens
atggaacaagccatggatgcattcacagtctatcttggtttttggaaatgggagtttcagaaaaaaggacagggctgggatcatgaaagggcttggccat

SEQ ID NO: 6823231 - DNA, 90 bp, Homo sapiens
atgaccactttgtaacttatcatttcaatatagttccattgggtagtagtacctttattctgttttgaagataaggacactgaagggcat

SEQ ID NO: 6823232 - DNA, 76 bp, Homo sapiens
aagagtgctggactcatgaccagaaggcctggcatcaggtttggtgctgccaatttctggtcttgaacaagctttt

SEQ ID NO: 6823233 - DNA, 61 bp, Homo sapiens
aggtgccaaaatattagtgcttaagtacactgatggtgtgctaaaggcagaatattcacct

SEQ ID NO: 6823234 - DNA, 55 bp, Homo sapiens
cttggggtcttcctcctcctgagatctccttaggagggcttcatcagacccccag

SEQ ID NO: 6823235 - DNA, 58 bp, Homo sapiens
ctcagagcagactttgaaggagggggccatagttctctgggtcattttttcctctggg

SEQ ID NO: 6823236 - DNA, 69 bp, Homo sapiens
agcggtgagtagaatgtttctggatggtcaaaggagaaagggattttctcagctacgctttcaccagct

SEQ ID NO: 6823237 - DNA, 75 bp, Homo sapiens
gtgtttgacgtgaggaattgatacagagttgatgccttctatggggacagctggtactcagttcttgtcaagcac

SEQ ID NO: 6823238 - DNA, 64 bp, Homo sapiens
ggcttttgcctagggttgacccgtttccgccactgatcagctgaatgaccctgggacaagtccc

SEQ ID NO: 6823239 - DNA, 58 bp, Homo sapiens
ttctggtgagtcagctgtgaaacatggcccattgtttcaacaaatatggccaccagaa

SEQ ID NO: 6823240 - DNA, 122 bp, Homo sapiens
atgaacactgcctttcaaatgtgaaaaaacgtttaaggtataaaaagaagaagaagcaaatgtgcttctttagctagaaatactctaaagtacattttacattttttcagcagtagtttcat

SEQ ID NO: 6823241 - DNA, 80 bp, Homo sapiens
taagggtctgagaggttaagaatccttccaaatgcttatcttattgcaccactttggaacttaaccctgataggtcctta

SEQ ID NO: 6823242 - DNA, 71 bp, Homo sapiens
agaagtttgaaatatttctacaatgaaaacaccagaccatgtggtttttattggagtgataccaagctttt

SEQ ID NO: 6823243 - DNA, 110 bp, Homo sapiens
gttacctggcttgtaataggccttaagttgtctgctcctataaaggaatctccagaatattcctcacagagtggcaggcaatgttaaaacctcattagtaccagtgtaat

SEQ ID NO: 6823244 - DNA, 88 bp, Homo sapiens
ccacttggccacagcactgggttgctgatttagccatacacatgggcacatggtgtgggatagatcggtacccaatatgtggtggtgg

SEQ ID NO: 6823245 - DNA, 80 bp, Homo sapiens
gtctttctccacatcctctccaacacttattttttgaaatgttctcaggagaaacctgtaaggaaggaagtgagggaagc

SEQ ID NO: 6823246 - DNA, 56 bp, Homo sapiens
ctaggctagatagtatattggttcaattaatggtcatatattttaatttagcctgg

SEQ ID NO: 6823247 - DNA, 58 bp, Homo sapiens
ttggactgttactgtatttaatcatctaacacatctagaggaagacagtaacctccag

SEQ ID NO: 6823248 - DNA, 82 bp, Homo sapiens
gtatctttaagccatcggagtgaaaaataatcaatgtctacgttagttaaaccaccattctggtattggtagttgaaggtat

SEQ ID NO: 6823249 - DNA, 57 bp, Homo sapiens
tgactattacatgctttcaagactgtatgtcagtcaaacatgggggtatgagtggca

SEQ ID NO: 6823250 - DNA, 80 bp, Homo sapiens
ttccattcttgattttcttctggtggccgaagggctggacacagacttctcccaaccatcagagggcacagagtgtggag

SEQ ID NO: 6823251 - DNA, 78 bp, Homo sapiens
tttgtcttacattcgtgatttccttccacttctgacatgtcttacagctgaaggattcaagaaatggtgtagcacaag

SEQ ID NO: 6823252 - DNA, 88 bp, Homo sapiens
gctcactggtagctggaactgggtttgttggagggaccatcataatcactgcctctaaagcaaggcctttccaatgacagtagtgagt

SEQ ID NO: 6823253 - DNA, 77 bp, Homo sapiens
tgttgggctcctgagcaagcatgccaagtctgtttgcaatttccgcagcacatagcatgcttgtcagaggctttcca

SEQ ID NO: 6823254 - DNA, 60 bp, Homo sapiens
gaatgctgtagacagactctattaagtcccaaatctttgggcagtttttctccagcattc

SEQ ID NO: 6823255 - DNA, 76 bp, Homo sapiens
tcacgttagaagtggtaagtagaaagatgaagacttccagctccttctgttactcttcccaccacttctgttctga

SEQ ID NO: 6823256 - DNA, 122 bp, Homo sapiens
tcctaggcaaaagttttcacactgttttcagtcagttctatgtagttataatagaatgaatcttcctaatttaagtcatagaatgataaaagcagtgatgaaaagagaatgtacacctagga

SEQ ID NO: 6823257 - DNA, 85 bp, Homo sapiens
acagagtgtagctacacagttaaaggcccaatatctggataaggtcagccttagatttagaccctgcctgacagttactctctgt

SEQ ID NO: 6823258 - DNA, 63 bp, Homo sapiens
gctgccagtaattgaccgtaaagacgacaccctagccagttttcatcagttgatctggacagc

SEQ ID NO: 6823259 - DNA, 60 bp, Homo sapiens
ccatgatgcccagacgcctggcttggacagtggctccagtgagatatctgggcattatgg

SEQ ID NO: 6823260 - DNA, 56 bp, Homo sapiens
tctggaagagcatgtgtttacaaatgcagaatagcatgcaatactgcttatccagg

SEQ ID NO: 6823261 - DNA, 58 bp, Homo sapiens
cctgagctttgctttcctcatctgtgaaaatgacaagagtgaggcaagatggctctgg

SEQ ID NO: 6823262 - DNA, 71 bp, Homo sapiens
gcctagtaggaggtttgagtcagggtctgtgttcacaggctagtagctgaatgaacttctctgcctacggt

SEQ ID NO: 6823263 - DNA, 56 bp, Homo sapiens
ggtgacagttccggaggtacagatgaatacataacgtcagcttcctgcctgtcccc

SEQ ID NO: 6823264 - DNA, 57 bp, Homo sapiens
ttctctggagagtatcttcttatctgttgtgagagaattgagattttctccaaagaa

SEQ ID NO: 6823265 - DNA, 72 bp, Homo sapiens
gtatttgtgacagtatttgtcatcttgtcttttggccatagttatcatgacaggatgatagaaaacagatac

SEQ ID NO: 6823266 - DNA, 96 bp, Homo sapiens
tcaaacaggataactaaagcttattatcttatcaagcttgttcccttgcagacaagattgatcaattatcataggctttctgggtgttctttctga

SEQ ID NO: 6823267 - DNA, 80 bp, Homo sapiens
agttgttgtgccattgagaggtttcagatctcctagcataatttgattgctgtttctgccctacttaggtgatagcatct

SEQ ID NO: 6823268 - DNA, 73 bp, Homo sapiens
ggagctcagtctacaccccaggctccgggcctggctccttgcggcccctggtttccaggtgtgtacagggccc

SEQ ID NO: 6823269 - DNA, 70 bp, Homo sapiens
cacgtcgacacatatgcgtatagtttagtcgttttaactgctgttaaagtgtgcgcatgtgggagaggtg

SEQ ID NO: 6823270 - DNA, 92 bp, Homo sapiens
tgtgaaaaactgtgtgatctaggaggaagcagccctaggcatgaggaagtcttagccttgctttgcttctggacagctgcatgattgttgca

SEQ ID NO: 6823271 - DNA, 96 bp, Homo sapiens
tcttccttcctgtcatctgttccttcagcaagtcctgagcacctgacatgtgatagcatcttgctagtatttgttgagcggatgagtggatgaagg

SEQ ID NO: 6823272 - DNA, 108 bp, Homo sapiens
ctcctcgggtgatcttagacaagggttctgtgcctcctgctgctgcgccagctgccaggggcctggggctcggagctctcacacttacttctggggttgtccaatgag

SEQ ID NO: 6823273 - DNA, 81 bp, Homo sapiens
gccttcttatcctcaagttcacagtctggtcgctgctgtattccaaggcagtgaaaaaagacttgttgaacagatgaaggc

SEQ ID NO: 6823274 - DNA, 74 bp, Homo sapiens
agcctacatgtttactccaagtcagggtttctcaagcttgacaccactgacttgcgaatggataattgtttgct

SEQ ID NO: 6823275 - DNA, 67 bp, Homo sapiens
aggatcctgactattgatcatcactcaaacatgagccatgcaggagagtgagtcagtagggtgtcct

SEQ ID NO: 6823276 - DNA, 60 bp, Homo sapiens
ttgattgaattatgaggtctgtaaatcatgtagtttacagtcaggcatgaattcagtcaa

SEQ ID NO: 6823277 - DNA, 68 bp, Homo sapiens
ccttcctctgtggcttgcctttctgtccaccaagaacaaagggggagaaaagagagtcagagagtagg

SEQ ID NO: 6823278 - DNA, 62 bp, Homo sapiens
tgctggttttgaaaacgcaagctgcctgttgtaggttgcctgtgttgggaggcctataggca

SEQ ID NO: 6823279 - DNA, 70 bp, Homo sapiens
tcctcttgctatttgttttcaatgtgtcattcagtggtgggctgaaatgttaaacaagtggctctgaggg

SEQ ID NO: 6823280 - DNA, 109 bp, Homo sapiens
gaagaaatctagtgtttttttattttttaaccttatcatgcataagtagaaagcagtactcatgtccactctcttttgtgtgtgtagggtgaaacaaatctagttcttt

SEQ ID NO: 6823281 - DNA, 62 bp, Homo sapiens
tgagctcacacagctccaaatacaatggaaaccactgggttatttgtcagctgttgagttca

SEQ ID NO: 6823282 - DNA, 125 bp, Homo sapiens
cactactctctaagtccttggcttacccggctccagttcctgaatgtatatttcatttggttatttctcatgagacatgacttcaggcctttggagtctcactgggccttggtctgaagagtgtg

SEQ ID NO: 6823283 - DNA, 91 bp, Homo sapiens
ggggaatcacttggtgctgtccagggagccaggcaccttctgtgttgggctaggaggcctgcatttggctggctcccacagcagggacctc

SEQ ID NO: 6823284 - DNA, 91 bp, Homo sapiens
gaagttccagttgttttacatctcaccagattcatatgcccctcctttgcctttgtatcattctggtgggtgtgtagctgctggcaatttt

SEQ ID NO: 6823285 - DNA, 130 bp, Homo sapiens
ttgttgcttgtatcagaacttcattcctcttcatggttcagtaatctgctagaaatttgaaaaaactatttttgtcagttcagtgattacaaaatatttgaagttgaataactataattttaagcaagga

SEQ ID NO: 6823286 - DNA, 85 bp, Homo sapiens
gggacaagatgggaggatgctcgggtgctcagggatcctccagcctcccttgtccaccccttctcctaaccccaacttctttccc

SEQ ID NO: 6823287 - DNA, 59 bp, Homo sapiens
gggcagtggttacacagctgaggccctgagcctgcccagctccctgcacgaccctgccc

SEQ ID NO: 6823288 - DNA, 65 bp, Homo sapiens
ggttagttagcgaatgtgttttgcattcaaccaaggaagttcaaaatactgtctctgagagagcc

SEQ ID NO: 6823289 - DNA, 58 bp, Homo sapiens
ggagaggccacatcagagctgtccagggtcccccctcagcgtgatcttggtctcctcc

SEQ ID NO: 6823290 - DNA, 94 bp, Homo sapiens
ttctgaaaggtaattgtatgttccaagcagccgatattaacaacttccatcacgactctaggaataattcgcagttctgaaccatgttttagaa

SEQ ID NO: 6823291 - DNA, 57 bp, Homo sapiens
gggcttttccattccagggttctcatccctttgagcattcaaagaagaggaaggccc

SEQ ID NO: 6823292 - DNA, 102 bp, Homo sapiens
gaagcaaaaaagtaataggcaaagtttaaagtagatttcagctagatcataaacagcttgggatgctggtttaaatttgtagatgtttttgacttatgtttc

SEQ ID NO: 6823293 - DNA, 75 bp, Homo sapiens
gctaggtgcctgcgtccacggctgggagacgggccgtagccgagccgctccctgtttgggcggaggaaccatggc

SEQ ID NO: 6823294 - DNA, 108 bp, Homo sapiens
ggtttagatgggggagttaattagggtctgagggttgtgctggaggacatggggtacttgcccataaggtccttgtatagatgcagacacttggctccattgcctgcc

SEQ ID NO: 6823295 - DNA, 85 bp, Homo sapiens
aggcagtcatggccatggcacatagaaaaggatcaataaatattagtttagtggttatgagtgtgtctctggggacagactgctt

SEQ ID NO: 6823296 - DNA, 78 bp, Homo sapiens
tcttttattctctggcttccatgcagttattgagaaagtagtcacaattacccagggaccaagagaaaccctgagaga

SEQ ID NO: 6823297 - DNA, 56 bp, Homo sapiens
ttggaggaagctcatgggggatctgtgtatttcttaggtttctccctgttctccaa

SEQ ID NO: 6823298 - DNA, 78 bp, Homo sapiens
tcttgctgtgtctctgcaggcaacctcgtcctgcttatttttatgggacaggtactatgtgcagacacctatgctgga

SEQ ID NO: 6823299 - DNA, 84 bp, Homo sapiens
aattctctgcgtttcatcagtgctttaagaatgcctctctctctccatccttacagcaatactggtgggtcaagcagagtagtt

SEQ ID NO: 6823300 - DNA, 87 bp, Homo sapiens
tgctggaatattttggacctgcttgagccagtatgagatttgtgcacatatctgactttcaatccaggtttgaattgatattcagca

SEQ ID NO: 6823301 - DNA, 57 bp, Homo sapiens
ccttttctgtttcctgtcactgttgtggcaaaaacatggctgacctagcagagaggg

SEQ ID NO: 6823302 - DNA, 129 bp, Homo sapiens
ttctggaccagatattgttttttaattttcaatgtttattctaggaaaactccttagctcataaaagatttagtgttaagagaaaattctgctttgagagctttgaaaaatatttattattatccagaa

SEQ ID NO: 6823303 - DNA, 68 bp, Homo sapiens
gaacctctagagagtcaggacagcatagcagttaagagtagggcttctgatgtcagacttctgggttc

SEQ ID NO: 6823304 - DNA, 77 bp, Homo sapiens
tctcagattatccaggtggtcccaaatgtacttataaaggttcctctaagtaaaaggggatccaggagaatcagaga

SEQ ID NO: 6823305 - DNA, 66 bp, Homo sapiens
actgggtttaggccaggcaggcccaggcctggtttcgggcctggcgccgggctgcctgtctttggt

SEQ ID NO: 6823306 - DNA, 75 bp, Homo sapiens
ctggcagaccctcttctattggtgggaaccatgtctcatgggcactcacagttacaagggagtctgaaacaccag

SEQ ID NO: 6823307 - DNA, 107 bp, Homo sapiens
tgtgaggggtgtcagttatagccttggtccttgctccacttctgtggtgaggtgctgccaagagctgtggggaaaggagtggggctcagagctgatgcccatttgta

SEQ ID NO: 6823308 - DNA, 59 bp, Homo sapiens
cctatctagttagtaattaacatattaggtttgggtgcctaatatgttaattaggtagg

SEQ ID NO: 6823309 - DNA, 58 bp, Homo sapiens
ctgggaacaggcactgctgtcaggagctactgcctgggcctaccagcctgtatcccag

SEQ ID NO: 6823310 - DNA, 121 bp, Homo sapiens
aatatatattttagcaatttggatattcatgtcagctggagactgctcaatgagataacaactaatatttattgtgtacttcctctgtgctgggcatcatactaagtgctttatgtgtatt

SEQ ID NO: 6823311 - DNA, 67 bp, Homo sapiens
catttactgagcaacttttctgtgtgtcaggcactatatggccttgcatttcaattgctcaggaatg

SEQ ID NO: 6823312 - DNA, 64 bp, Homo sapiens
ttgaggcaacagagcatttgggtaatggcaagggtctcagattccagtggctttgctgctttaa

SEQ ID NO: 6823313 - DNA, 77 bp, Homo sapiens
ggcactggagcggccctccctccctctcttttggggacctcgagggtccaggggcgaggggagccgtgccagcagcc

SEQ ID NO: 6823314 - DNA, 129 bp, Homo sapiens
ggtgattgaatcatgggggtgggtttttttgtttgtttgttttgagatggagtcttgctctgtcgcccaggctggagtgcagtggcgcgatctccgctcactgcaagctccgcctcctgggttcacacc

SEQ ID NO: 6823315 - DNA, 65 bp, Homo sapiens
aggtcagagcaatgtattgcttctggtttgttaagcaatgtgtagcagtgcattgcttctgattt

SEQ ID NO: 6823316 - DNA, 57 bp, Homo sapiens
acaaagtgctgacattacaggcatgagccaccgtgcctggctatttttttgctttgt

SEQ ID NO: 6823317 - DNA, 101 bp, Homo sapiens
tgattttattagtgaaagatgaagttggtgctcatttctaggctaactgagtaagttctggtctaaatatggctctaaatcataaattatttcgataatca

SEQ ID NO: 6823318 - DNA, 56 bp, Homo sapiens
gcccaagtctatagccttggttgatctgaggattgaggatattaggtgatttgggt

SEQ ID NO: 6823319 - DNA, 84 bp, Homo sapiens
gtgccaataatatttttaaaattgctatacatgtggaagaaaaattctttcaagtcaatttttgaatgactgtttgttaggtac

SEQ ID NO: 6823320 - DNA, 77 bp, Homo sapiens
cagtgttgtataattccagggcgtgttgtctacaaggggtacaatgtgaagagtgctccctagagttgtgcaacctg

SEQ ID NO: 6823321 - DNA, 74 bp, Homo sapiens
tatggatctgaagatatgagctttatgattaattcctataaataagttatgaagttcctgttacagtggtcata

SEQ ID NO: 6823322 - DNA, 66 bp, Homo sapiens
atacacacaagttctaaagattgcgcataagctaatgtgcaagtccagaaagaactctgtttgtat

SEQ ID NO: 6823323 - DNA, 64 bp, Homo sapiens
atggaaaaagtcatgtgcacagagaacagtctatgaatggtgactgatttaaacgtggctctat

SEQ ID NO: 6823324 - DNA, 68 bp, Homo sapiens
gccgcgcgggctcctcactgcatccccaggctgagggggttggggatggggtcgggaccctgctcggc

SEQ ID NO: 6823325 - DNA, 129 bp, Homo sapiens
tcattgctgtggatttttgtcttggacttgacattcatgaatgttccatgtgagtaaagcactcaagtttacctgtgaccacctggagcagtatgatttggtgtccagttagctgatccagcttaaggg

SEQ ID NO: 6823326 - DNA, 68 bp, Homo sapiens
aggtcctgttatcctcagctcacctctagatgcgaaactagaggccgaatgctgagctgggagggcct

SEQ ID NO: 6823327 - DNA, 57 bp, Homo sapiens
atttgatgggcccgtgggacaaccacattgagatgttgtctttaggacctgttaaat

SEQ ID NO: 6823328 - DNA, 74 bp, Homo sapiens
agcctcccttgtctcaaggttactctatgatgccatttacatcccagagctccccatgggatcaggctgaggct

SEQ ID NO: 6823329 - DNA, 92 bp, Homo sapiens
gtttctcccctctggtgtagctgtccagtgagtccctttgaaataaaggtatgatactgtgacatgcttgcaaaaagtatacatggagaagc

SEQ ID NO: 6823330 - DNA, 65 bp, Homo sapiens
taaggagcgtcctcaaattacactcacagtttcaaagttcaagaattgtggctgagcactcctta

SEQ ID NO: 6823331 - DNA, 65 bp, Homo sapiens
agaaggagagtagttaggactggggcacgtataggtctcaatgactcctatttacatttttagct

SEQ ID NO: 6823332 - DNA, 75 bp, Homo sapiens
tgctattggtgggagtgtaaattagttcaaccattatggaaagcagtgtggcaactcctcagagagctaaaagca

SEQ ID NO: 6823333 - DNA, 112 bp, Homo sapiens
atgagtgcattttgcctccaacagaattattgcttctaacttgctgaattccatgaaggaatgggcacacttagagagtaaaattcattcagggaatttgtaaaacactcat

SEQ ID NO: 6823334 - DNA, 60 bp, Homo sapiens
gccatggggtcacatggagagagaaagcaaaccaactttcagagctctaggctctcaggc

SEQ ID NO: 6823335 - DNA, 57 bp, Homo sapiens
attaggttggtgcaaaagtaattacagtttttgcaattacttttgcaccaacctaat

SEQ ID NO: 6823336 - DNA, 77 bp, Homo sapiens
ctggccttgggtctctgtgccttctccccaccccacagatttggtggggaacatggcaggagggtaagcaaggtcag

SEQ ID NO: 6823337 - DNA, 82 bp, Homo sapiens
caagtgctcacataaactctctgtaccaatatactatatgtaatattgtgtgtacaagtagttagtatctaaggagcatatg

SEQ ID NO: 6823338 - DNA, 116 bp, Homo sapiens
gcaagtcatttaacctcttcaggcttagtcttctcatagtaaaactagagctatcatggaatgatttgcaggatgcttgtgaggactaagtgaaatgatgcagttgagtgcttagc

SEQ ID NO: 6823339 - DNA, 66 bp, Homo sapiens
tgtgcttatgcacacatatgagcatgtgtgtgcccatgcatgtgtaagtgtgtgtgtgtctgtgta

SEQ ID NO: 6823340 - DNA, 85 bp, Homo sapiens
ggcttcctccctgctgctcactaccattctcgccagcagaatggtgacaaaccagtagcaataaagaggtgggaggacttgagcc

SEQ ID NO: 6823341 - DNA, 116 bp, Homo sapiens
caagtttttcagtgatgcatgttaacagttaggtcctaaaattctgtggtgctaattctcccatacccaatggtgcttttgtggatgctaactgcacacatgctgaacaaagcttg

SEQ ID NO: 6823342 - DNA, 62 bp, Homo sapiens
gccgtcctggaaagcaccgtctgttgttcattcaattgcatccgggctacttccacaccggc

SEQ ID NO: 6823343 - DNA, 80 bp, Homo sapiens
gggaagtttagaggttggggactttgcaggttagggacgtcacataaaggcttcagaggaaacaatctttagtactttct

SEQ ID NO: 6823344 - DNA, 67 bp, Homo sapiens
tgtgtcctttccccctacttaaaaataatgataggttcttctggaacctgcttaagtaagtgacaca

SEQ ID NO: 6823345 - DNA, 87 bp, Homo sapiens
tgtgggagcctgtcctgtgcattgtcagatggctagcagcaaccctagcctctgctctataaatgccagtagcacctcctcccaaca

SEQ ID NO: 6823346 - DNA, 65 bp, Homo sapiens
gacagagccctgataccctgagaccaggcttgctctctctgggtgtcttaggagctcactatgtc

SEQ ID NO: 6823347 - DNA, 56 bp, Homo sapiens
tacttttgcagtataccaggaccacgttacacctggtccttaagtacctaagagtg

SEQ ID NO: 6823348 - DNA, 64 bp, Homo sapiens
tggcttgccatagttaccaggaaatgagtgtctatgcacattcatttcaggttgcatggtacca

SEQ ID NO: 6823349 - DNA, 68 bp, Homo sapiens
gactctgaagcatgtgctggggctttttgtatgtgctgtgtcaaaaaggtaagcacaatgagagggtt

SEQ ID NO: 6823350 - DNA, 62 bp, Homo sapiens
ggagtctgttttacatgcaggacagggatcttttcagcatgtagttcagatcatgttattcc

SEQ ID NO: 6823351 - DNA, 70 bp, Homo sapiens
gcaatattgtgttatttttctaagtatctatttttgttgtggataagaaaattgtaataactgttattgc

SEQ ID NO: 6823352 - DNA, 125 bp, Homo sapiens
ggctggctttgtacactcatttatagataggcttcagagacagtgaggaaggctaggttgaggaagccacaaaaccacggctctcactcctggagaattatttgtattgaggtccagaggcagct

SEQ ID NO: 6823353 - DNA, 55 bp, Homo sapiens
gtttgttgtggtagcttttgcactacaacagtgaagttgagtagttacaacagac

SEQ ID NO: 6823354 - DNA, 73 bp, Homo sapiens
aagcttagcctggggacagagtcaagttcctaagcatgatattggaatgggagctgcccccagggctgtgctt

SEQ ID NO: 6823355 - DNA, 95 bp, Homo sapiens
gggattcctcaggccggagatggccagccagaaagaagcctttgacccagaggctgctcagctgtctggcccactactggccctgtggtgctccc

SEQ ID NO: 6823356 - DNA, 62 bp, Homo sapiens
cagacaataggagcacattctgcagttgccgctactgctactacagatactcctgctgtttg

SEQ ID NO: 6823357 - DNA, 65 bp, Homo sapiens
acagtggaatctcaagctggaagaaaccttagaggtcacctaatctttgcatgagttccctctgt

SEQ ID NO: 6823358 - DNA, 60 bp, Homo sapiens
gcagccatagccacctcagaaggacctgagctgaggacaccacctgaggattatggttgt

SEQ ID NO: 6823359 - DNA, 90 bp, Homo sapiens
gggaggggtggctgcccgccagaaagctgcgaggtcaggggtgggagtcccctcttcccctcctgcctttgcggtggctccattcctccc

SEQ ID NO: 6823360 - DNA, 61 bp, Homo sapiens
gggagttggggcttactactgttttttataattgtctcagaaaacagctaaaccagctctc

SEQ ID NO: 6823361 - DNA, 74 bp, Homo sapiens
tgatttgatctgttttcctattgtttgttgatgcttttattgacagaattaatgaaaattacaaggttaagtca

SEQ ID NO: 6823362 - DNA, 65 bp, Homo sapiens
ctgtcagcctttagatgagctggctacccctgtggacattgccaggtctgcaggcatcctgacag

SEQ ID NO: 6823363 - DNA, 80 bp, Homo sapiens
agcctgaatgaaagagccagtggtgagacagtgagttgattacttctcactgtttcaccactggctctttggttcatgct

SEQ ID NO: 6823364 - DNA, 89 bp, Homo sapiens
tttttttctcaacggtctcatggctttcagccaactaaacactaattcaaggatttggtgccaagcatgaggactcttctagaaaaaga

SEQ ID NO: 6823365 - DNA, 64 bp, Homo sapiens
ggtttcagccctgctgttcctgggtggatccctcttacttttccaggtgcggtgggtgggagcc

SEQ ID NO: 6823366 - DNA, 65 bp, Homo sapiens
cgggtcgagtgggcacagctgggtggctcttgctctacttgctaccagctgggcttactcactcg

SEQ ID NO: 6823367 - DNA, 55 bp, Homo sapiens
tgtaatgaatgtggcaaggttttcagtcaaaaaggaaaccttgcatgtcattata

SEQ ID NO: 6823368 - DNA, 99 bp, Homo sapiens
gacctatttaagatgtgcttctgcagagactatttatttacttctatcaagtgcctgggatacaactgacatgaatcactttaaatttatttttgggtc

SEQ ID NO: 6823369 - DNA, 66 bp, Homo sapiens
gcagctgggctcatcatctgtgcatttcacaataaaattttatgatgcatccagacacccagctgc

SEQ ID NO: 6823370 - DNA, 65 bp, Homo sapiens
cagtcaaagaaacgcaccttacatgcagtcattattagtccatctgcatgtgcactcttcagctg

SEQ ID NO: 6823371 - DNA, 69 bp, Homo sapiens
acatagtagccatattcgcattcttcatttccaaaggaaccatgactgtgtgtgtgtgtgtgcgtgtgt

SEQ ID NO: 6823372 - DNA, 74 bp, Homo sapiens
ttcaccaacattttccaaagtaccatgtccctgataccaaaaatagtggagttggtgtttggagtctctgggaa

SEQ ID NO: 6823373 - DNA, 90 bp, Homo sapiens
tgtcacccttaactgagtatttcgctgtcctcaaaaggtttacagttaaacaatctttttagttgctcaggtattctcttagggttgata

SEQ ID NO: 6823374 - DNA, 59 bp, Homo sapiens
tgactcctgctccttcagatttcttcttccaatagacaatcaggcaaggaaaggagtta

SEQ ID NO: 6823375 - DNA, 60 bp, Homo sapiens
gggcggcaaacctaagtggcattttcaccagtgctgttatgctatttaatttttctgttc

SEQ ID NO: 6823376 - DNA, 87 bp, Homo sapiens
gcctccctggcctctgagtgtcctggtgggggccctgcaggagcagatgctagagcccttccttagacagcaggatccagggcaggc

SEQ ID NO: 6823377 - DNA, 66 bp, Homo sapiens
ggcagttttaaccatgggcagaatctttgcagatcaatgtttcagagaaatgcctatcaaactgcc

SEQ ID NO: 6823378 - DNA, 78 bp, Homo sapiens
gttttagagcttcaacgaatagcataacatttcaataggtactgctattgtatgctgatcaaaagcttcatctgagac

SEQ ID NO: 6823379 - DNA, 83 bp, Homo sapiens
cagagtcagcgtgcggggccagcgcaggctgataaccgcacggaacttcccaggcaccctgtgtggccgcactgctccctctg

SEQ ID NO: 6823380 - DNA, 79 bp, Homo sapiens
cagcatgttgaaacctgaagaaaatatttgctgagaacattcagttcgataattttcctcaattcagtggtttaggctg

SEQ ID NO: 6823381 - DNA, 58 bp, Homo sapiens
catctgatgctttgatttggtttctctagaagcacattctgagacagggattcaggtg

SEQ ID NO: 6823382 - DNA, 58 bp, Homo sapiens
aatgacttggcagccttttgacaaatgtttgtagtgtcttgaagaaagtcaagttatt

SEQ ID NO: 6823383 - DNA, 64 bp, Homo sapiens
gaggctgtaggttggaccctaatcccagagcctcattctgatggaggcttcaaccatacacctt

SEQ ID NO: 6823384 - DNA, 130 bp, Homo sapiens
ggtcacacccttggagcataacatgcctcctaaatacaggtttttagttactaatggtagcttaacaggcttagaactgttctccacagtacaggaaatcttgttcaaaaggtacttgaaaggtgtgact

SEQ ID NO: 6823385 - DNA, 82 bp, Homo sapiens
ctaaagtcagagtgttggcagggctgattccttctggaggctctaggacaggattccttgccttgccttttctgacttccag

SEQ ID NO: 6823386 - DNA, 76 bp, Homo sapiens
cctgtgtgtgcctcgtctactgagtgccagggttagtgccccacttgccaggtgagaggactgaggctcacacagg

SEQ ID NO: 6823387 - DNA, 75 bp, Homo sapiens
ggattaatgtaatagaacactcagcatggaaagccaccccggggctgctcctgtatatattttgttacatattcc

SEQ ID NO: 6823388 - DNA, 79 bp, Homo sapiens
caggaccaggctgtgcctctgctctcagggaactcacatcctagggtggagagaaagaaacgtgaacagatggtcactg

SEQ ID NO: 6823389 - DNA, 66 bp, Homo sapiens
cattttgagtcttttcattgtgtggatttcttaacaagttgtttttacaagaaaagcctctgtgtg

SEQ ID NO: 6823390 - DNA, 105 bp, Homo sapiens
gaagctggggaagggaattgcaggcagcagaagtagaagtacaggtaaactgcacacatgtgtttcgagactgttgagtagttcagtgacttgtccctaagattc

SEQ ID NO: 6823391 - DNA, 55 bp, Homo sapiens
gcactgggtgtgaggcagcgtcgtttccccttcgcgctcttcgaatgtcaagtgc

SEQ ID NO: 6823392 - DNA, 77 bp, Homo sapiens
aatgttccctgctctctgtatgtaactttgtacttagtcttcagtggcagggttgcagcagaggcccagtaaatatt

SEQ ID NO: 6823393 - DNA, 64 bp, Homo sapiens
agaggaaaaacagaaaaattcatggcagctcataatctgctgatatattctagttttctcctct

SEQ ID NO: 6823394 - DNA, 57 bp, Homo sapiens
ggccccctgcttgctttggggtctgagttagctcctggctccactgagcaggccgtc

SEQ ID NO: 6823395 - DNA, 69 bp, Homo sapiens
acagacacttacagaattccctccttttgctttctgcagcaggaaaatcaattctgtgtagtgtcctgt

SEQ ID NO: 6823396 - DNA, 58 bp, Homo sapiens
acctggcaggcggaggttgcagtgagccgagctcacaccagtacactccagcctgggt

SEQ ID NO: 6823397 - DNA, 103 bp, Homo sapiens
tgtgaaggcaatattttgttaactatgagtggcgtagaggtagggggttatagattaccctcatactttaacctattttcctacaatgtattttctttcctca

SEQ ID NO: 6823398 - DNA, 69 bp, Homo sapiens
ttagatgttaattctgaaatgagatataaggtagcatagctgttttatttacatttcagatatttctaa

SEQ ID NO: 6823399 - DNA, 66 bp, Homo sapiens
cactagagccttcctagcatttgcattagacacgtttgtgccttgcagccactcaggagctcagtg

SEQ ID NO: 6823400 - DNA, 56 bp, Homo sapiens
cctgtgccttccttaggcacctgttgtggactcaggtggcctcggtggtgcacagg

SEQ ID NO: 6823401 - DNA, 73 bp, Homo sapiens
ggtagtagtttagtgggacagtttaaagttgggatttgaagttcaaatctgtcccttaactagtcatattacc

SEQ ID NO: 6823402 - DNA, 69 bp, Homo sapiens
ttcttccatctacactatcattgattaggaaagcaatgtggttcaaaatgacagtgtgtgattgaagaa

SEQ ID NO: 6823403 - DNA, 82 bp, Homo sapiens
gaagccttgttttcatgtctgagtcttggccttataacatttctttgggacttgaaagaagacatggcaggaatacagcttc

SEQ ID NO: 6823404 - DNA, 58 bp, Homo sapiens
tcaggcatgttgggggagggtgcagtggcaagctctgaatggacactccagtgtttga

SEQ ID NO: 6823405 - DNA, 69 bp, Homo sapiens
gggaatttctgaaaaataattgctgaattttacaaaagtgattcagcacttggatttcagagattagtc

SEQ ID NO: 6823406 - DNA, 55 bp, Homo sapiens
ttaacagatgtcatttcggcggcggctggcccactgctgctgggccatttgttgg

SEQ ID NO: 6823407 - DNA, 72 bp, Homo sapiens
tgtgtttgatagatgcagatctcagtgtgctgttgtttcatataattaagcacctgttgcacttcataatca

SEQ ID NO: 6823408 - DNA, 59 bp, Homo sapiens
caagactttggaggaatttggactaagtttaaaattactccctttctcaaaagatcttg

SEQ ID NO: 6823409 - DNA, 89 bp, Homo sapiens
gttgaagtctcatagttaaaattctttcccaaattatctaacacctgttgggaagattatctcagaagtttacatagtgagacttgaac

SEQ ID NO: 6823410 - DNA, 56 bp, Homo sapiens
aggctccaggcccttcaccagctgcagccactcttgctgatggtagtctggggtct

SEQ ID NO: 6823411 - DNA, 63 bp, Homo sapiens
aaagctctctgaacaccagaccactcttaactatatttaagtggctgggttcatcagagtttt

SEQ ID NO: 6823412 - DNA, 75 bp, Homo sapiens
tagtgcttctgcttatggaattgtatactgagtattgctctgtaaactcttaccaaaagtgacaaattagcactg

SEQ ID NO: 6823413 - DNA, 124 bp, Homo sapiens
tgtgcagagacgctgggagcccgaagaggtcgtggctgtggcttccgctgcaggttagggctattgacttgcatggaggaacatggcccacggactgtgttgcaaaccctcagtctgttgcaca

SEQ ID NO: 6823414 - DNA, 64 bp, Homo sapiens
agaactctccaggggctgtcttggaatcttgggataaagacccccaccggcccctgagtggtct

SEQ ID NO: 6823415 - DNA, 55 bp, Homo sapiens
cccaggagatgcactccattggctgaatctagccaattagattcactttcctggg

SEQ ID NO: 6823416 - DNA, 69 bp, Homo sapiens
agagtctttattctctagagtgtgaaaatgtctacaatactgtgaggcactggaaaaatgaagattact

SEQ ID NO: 6823417 - DNA, 77 bp, Homo sapiens
gagcttttctttatacacctgctgagcctgtcctcagccaggggttaagaggataaaaggctcaaagcagcaggctc

SEQ ID NO: 6823418 - DNA, 69 bp, Homo sapiens
tcaaaggatcgtagaagctacaaggagacaggttgcaaaagataagtgtccttctctatgattgtctga

SEQ ID NO: 6823419 - DNA, 130 bp, Homo sapiens
aaaatctctgactccctgctatttttctgattcatgcatttggaagcttgaagattattaattcttgtgacagaaagaaatagttcaggcataaggcatgaacaaattatgatagggtgtggagtttcat

SEQ ID NO: 6823420 - DNA, 67 bp, Homo sapiens
tcacacattccaaaatcaagggtataagcaattacagccaactcttgattatccttggcaatgtgga

SEQ ID NO: 6823421 - DNA, 57 bp, Homo sapiens
gtttctgaatgctgattagtatgagaaattatgctacgaatgagagcatatagaaac

SEQ ID NO: 6823422 - DNA, 60 bp, Homo sapiens
atggtgggatattcatgcaatgatgtggtctgcatcagtgaaagtgaatgttctagccat

SEQ ID NO: 6823423 - DNA, 67 bp, Homo sapiens
ttgtaggaggtcaaaattgtatcaggctccatctatgggtctgagaacataaattgacttcttatag

SEQ ID NO: 6823424 - DNA, 57 bp, Homo sapiens
gagaaagagacgtaactttagggcttgccaagccctgagaggcaatgactcttactc

SEQ ID NO: 6823425 - DNA, 65 bp, Homo sapiens
ggtcagtgagcaaacaaccacgatttataatcatgtttgaatagtggctggtgcactcactgact

SEQ ID NO: 6823426 - DNA, 62 bp, Homo sapiens
gtgttggctttggtttttattgccaggaatggtcatggccacattggaccgaagcttaaggc

SEQ ID NO: 6823427 - DNA, 59 bp, Homo sapiens
aagtttaggccaaattagatttataattaggaaacaaatgctggtttggtactaaattt

SEQ ID NO: 6823428 - DNA, 67 bp, Homo sapiens
cagcttcagctgcctgtctgctgacccaggtctctgagggcctgggtgtcatgggcagctgggggtg

SEQ ID NO: 6823429 - DNA, 62 bp, Homo sapiens
tctttatcacagttttgtgccttgtggacggatagtgggtccatcccatgggagctgtagga

SEQ ID NO: 6823430 - DNA, 62 bp, Homo sapiens
tagatttgtccagacttgattacagcattattatgtttattgataaaagctggacacttctg

SEQ ID NO: 6823431 - DNA, 77 bp, Homo sapiens
tagttatgcctggctatctatttatttctatctctaagctatctttcagatgaaatgtgtatattatggcagaatta

SEQ ID NO: 6823432 - DNA, 90 bp, Homo sapiens
gagaatagacagatcagcaggcatgttaatcatcttaaaaagctcccttttaaggatgatgtgatatataaccgttagacatatcttctc

SEQ ID NO: 6823433 - DNA, 62 bp, Homo sapiens
ggaagaggccactatttttagggattggtagcacagaacttccttgaattgtgccacttacc

SEQ ID NO: 6823434 - DNA, 80 bp, Homo sapiens
caaatcctatcagtcatcttgggagtctgggaacatgtaaataaatcatgtttctcccccatgataatttctgtgagctg

SEQ ID NO: 6823435 - DNA, 64 bp, Homo sapiens
ttgtaagtgtctgtaagcttattgtgttgtaaaccaagcctgacagcacaatagacaccgataa

SEQ ID NO: 6823436 - DNA, 117 bp, Homo sapiens
cctcagatgttcgtgggaatgtcacataaggggtggcatgtatgcagctggcttatgcatagggaatcactagctacatacttggccattctccttcatttctgcctttgtctgggg

SEQ ID NO: 6823437 - DNA, 61 bp, Homo sapiens
tgaggtgtgtctgatgttgtccacagttccctcccacatctgacagcacagaaatatttca

SEQ ID NO: 6823438 - DNA, 60 bp, Homo sapiens
gtcaggcagtggaaattaaaaattactggagattgtgatgttattgaaaccattcctggc

SEQ ID NO: 6823439 - DNA, 55 bp, Homo sapiens
gactgtcggttctggtttcacatgcactgtgtgaacacgcttcatacagagggtc

SEQ ID NO: 6823440 - DNA, 66 bp, Homo sapiens
tggtatttgtatctggacctgactgactccaaggtagtgttagttagaataatacaagtaaaacca

SEQ ID NO: 6823441 - DNA, 59 bp, Homo sapiens
ctgctggccttacttttttagcatacagggattggaagtgaaagaaaagagaccagcag

SEQ ID NO: 6823442 - DNA, 72 bp, Homo sapiens
ggaagcaggagtccctctggccagcatgttctctcttcctgacacctggcccttgggacccctgggcattcc

SEQ ID NO: 6823443 - DNA, 65 bp, Homo sapiens
ccggccccggctccgctccggctcccgcactggcccggcaatggaggcgagagcgcgcgggctgg

SEQ ID NO: 6823444 - DNA, 106 bp, Homo sapiens
tttctctcaaactgacttcaaatgaattttgtctaaaattctactgatgtaaatgatgagtaagtggaggagctcagccattcatttgaaggtggtctgggagaag

SEQ ID NO: 6823445 - DNA, 127 bp, Homo sapiens
ctgggaccggattctgaggggcagaggtcagcgggctggagccgctggcccccaggggttccatgcctcatcctgtgtctggcccagcccctgatcccaccagcccacgggagtccaagtgccccag

SEQ ID NO: 6823446 - DNA, 58 bp, Homo sapiens
aggaagggagcagtttgttgtttgagtgctcttaaagcaaataatctgcttgcttttt

SEQ ID NO: 6823447 - DNA, 117 bp, Homo sapiens
tgacctaaattcttcctgctctgcactcggtgagtcttccccatgtgcagccctcccatggatctcacacatggaagagatacagtgaggtcctggggagcatgagaatctaggtca

SEQ ID NO: 6823448 - DNA, 94 bp, Homo sapiens
ggaggtatttaataaacaggtgcagctgaatgtgtgtggttaaagtgcaatccagtagttatttatttgtccagattgtttataacctgcttcc

SEQ ID NO: 6823449 - DNA, 57 bp, Homo sapiens
tggcagaggaggctcagattgaggaaacaatccctcatggaatgaattcttctgtta

SEQ ID NO: 6823450 - DNA, 65 bp, Homo sapiens
gggtagaagagatttatactgcaccagaataattttctgtgctttgtgttgattttatcatgtcc

SEQ ID NO: 6823451 - DNA, 88 bp, Homo sapiens
gtccccctattgaatattgccaggagaaagaccctgtcctggcctgggacagctgtacactcctggttaatcagttctgatgggaggc

SEQ ID NO: 6823452 - DNA, 66 bp, Homo sapiens
ccttccctgataagagcctcagaatgttttctgtccaagctgtttgggttcaagtacagggcaagg

SEQ ID NO: 6823453 - DNA, 68 bp, Homo sapiens
gcaggatccgctgctgtttggcctgtagctccctcagcaggagctgccgatgcccagctgcatcctgc

SEQ ID NO: 6823454 - DNA, 65 bp, Homo sapiens
gtatattcatgccatttttctagattgagatcatagaatgtaacgatttcatggcagtaatatgc

SEQ ID NO: 6823455 - DNA, 79 bp, Homo sapiens
taccatttatggtttctcattccattacatgtgctccatcactgtgcaggggaagagagaaaaacatggagaattggta

SEQ ID NO: 6823456 - DNA, 104 bp, Homo sapiens
tgttagccaggagggtctcgatctcctgacctcgtgatctgccagccttggcctcccaaagtgctgggattacaggcgtgagtgaccgtgcccggctggcaaca

SEQ ID NO: 6823457 - DNA, 63 bp, Homo sapiens
atggaggtgtttgataatttggttgctatgcaaccactttacaattatgtaagctcctaccat

SEQ ID NO: 6823458 - DNA, 82 bp, Homo sapiens
cctatttcagctacagcatctctgcttttatctattttatttgttagatcactgaaagaaagaatgttgtggcttaaagggg

SEQ ID NO: 6823459 - DNA, 59 bp, Homo sapiens
gggcagagcagtttctggccattagatgaacatctgtgtgccctaaagcctgctctcct

SEQ ID NO: 6823460 - DNA, 65 bp, Homo sapiens
gcacatttcttccacatgctgctgtccaccatacaggcggcttttatgaaatgggggaaaaaagc

SEQ ID NO: 6823461 - DNA, 92 bp, Homo sapiens
aaccagtaggaaggtgcccagctattcctttcttagttaagtctatcctcctgcttctcctgagggtggagtactgggtgccgctgctggtt

SEQ ID NO: 6823462 - DNA, 77 bp, Homo sapiens
ctcaactctctctggctcccagcaagtacaactatttataaaagatgaggtttgccagggaacagggagaggctgag

SEQ ID NO: 6823463 - DNA, 80 bp, Homo sapiens
ctgaggcctgtcattgtcttgttcacataccagggcgagttgaagatgaaggatgggaccaagacaaatggagtcctgag

SEQ ID NO: 6823464 - DNA, 80 bp, Homo sapiens
ggacaaggtcagcccaggtcggggagcactgggtgggatgcacggtggcctcagccagctcttggactctgacctggtcc

SEQ ID NO: 6823465 - DNA, 91 bp, Homo sapiens
gatgggagcacacttagattggaatcttgaccctagctgtgctggtggccacactgactggaatcaaggatgttcagaggtggctcctttc

SEQ ID NO: 6823466 - DNA, 127 bp, Homo sapiens
ctttaaaatggtaattgtaaaccctgccttgcggatgtttctgaagtttacagataatgtaaaacacattgcttagctcataggaaacactgaatgaaaggtaactattagtattgccaatttgaag

SEQ ID NO: 6823467 - DNA, 55 bp, Homo sapiens
aagagccctctgtgtttctgagatagggcttttcttgcataaaccagaggctctt

SEQ ID NO: 6823468 - DNA, 68 bp, Homo sapiens
actattctgttgtcttttctccaatagaattgcagtgagttctgccaggaagaaagcacaataatagt

SEQ ID NO: 6823469 - DNA, 79 bp, Homo sapiens
ttaggttgacgcaaaagcaattgtggtttttgtcattactttcaatgcaaaaactgcaattgcttttgcaccaacttaa

SEQ ID NO: 6823470 - DNA, 63 bp, Homo sapiens
tgagagactgaactagcacatttttataaaactggatcaaaatgtgcttgtgatcagctgtca

SEQ ID NO: 6823471 - DNA, 70 bp, Homo sapiens
attcctggaccccaagtatagttgtctaactctaaacgccaaatgagaagcttgcttggagtttaggagt

SEQ ID NO: 6823472 - DNA, 67 bp, Homo sapiens
actgggagagtttggatgaaactattgaatgaaattattttgggggtttctttctggctctcacagt

SEQ ID NO: 6823473 - DNA, 77 bp, Homo sapiens
ggtcaccgagagagttgaggaagcaacactcgaggtcccagcctttgcaggagctagacttagatcttccggtggcc

SEQ ID NO: 6823474 - DNA, 83 bp, Homo sapiens
ctgtgctggagagggagctgttggaagtgctgggtgcactgataaagaagcatgtgttcctctgcttcctccccattgcccag

SEQ ID NO: 6823475 - DNA, 57 bp, Homo sapiens
tccaaaggcaatgttcttgtcatcatactttgatgcacaaagtcagcatcctctggg

SEQ ID NO: 6823476 - DNA, 64 bp, Homo sapiens
gcaaggaggttgatgccagggagttggggccgatgatctccagtcccaggcagaaatccagtgt

SEQ ID NO: 6823477 - DNA, 92 bp, Homo sapiens
ttctgattcacagtagcagagctagatataaaggaggctgattacatgtcatctcctcatgtatctgggaattcttttactgtgcactagga

SEQ ID NO: 6823478 - DNA, 56 bp, Homo sapiens
tgggggctaaaacaagtttgcttagctatagctacagcttgccaattagccttccg

SEQ ID NO: 6823479 - DNA, 55 bp, Homo sapiens
gctgctggggtggagaaacgctgtgacccagtcagtgtttcttttaatgagcggc

SEQ ID NO: 6823480 - DNA, 76 bp, Homo sapiens
ctttccttccttcttccatggtaggtttcttaaagaacatttctattgattggcttcctggattagggttggacag

SEQ ID NO: 6823481 - DNA, 79 bp, Homo sapiens
gaaggcagaaaaggctaatccagagcaactcttgaaagcagccccaaggagtcttccagaaaagccttggtctgccttc

SEQ ID NO: 6823482 - DNA, 74 bp, Homo sapiens
cctggggctctgcacagagcagcagagctagagccatgaaacccacagacttggtgcctgagcgcagctccagg

SEQ ID NO: 6823483 - DNA, 68 bp, Homo sapiens
tcagatgtcaacaggcctttaaacatgctctttaccactgagcaataaataccctggttgagtcctga

SEQ ID NO: 6823484 - DNA, 74 bp, Homo sapiens
tggcagtttcttaagtcactggacttgcctagattggatttagcgtaacacatgagcttatttggaaaatgcca

SEQ ID NO: 6823485 - DNA, 60 bp, Homo sapiens
ggacatgtccccctggagttagtcagaagtgtaatttacctctagggatggcatatgtct

SEQ ID NO: 6823486 - DNA, 59 bp, Homo sapiens
gttacagcttgatgagagcgcgaggaatcctttttcctgtacctaaactcagctgtaac

SEQ ID NO: 6823487 - DNA, 62 bp, Homo sapiens
gacactttatctcatctcagacagggctctatggaggaatgggctggaaaagaatgaaggtc

SEQ ID NO: 6823488 - DNA, 66 bp, Homo sapiens
atgggtttggacatgttgagtctgatatgccattgtgacattcaggtagcagtgtccgatagacat

SEQ ID NO: 6823489 - DNA, 114 bp, Homo sapiens
ggctgctcggcacctggcctcagcaggtgaacatcatgccagattccttgtcagattcaaggccaagtgggtgaatgtcatgtgcagtgttgtgccaggtatgtgccgggagcc

SEQ ID NO: 6823490 - DNA, 84 bp, Homo sapiens
gtgtgaagagctctgacagtaaatcaacagaatatctgtagtgagaggcattgggtgttccatgacttactgtgctttgcacac

SEQ ID NO: 6823491 - DNA, 61 bp, Homo sapiens
tttcagcatttttgctgctgcccactattcatatgggtggtatgagctgaaattgctgaag

SEQ ID NO: 6823492 - DNA, 73 bp, Homo sapiens
ctcccaacagggcagttagagcctaccaaagtccccagctctgtgttcctctggattgctggattgttgggag

SEQ ID NO: 6823493 - DNA, 127 bp, Homo sapiens
tctatggaggaggcggggctgctgtgacctgtttctcgggcctcccagcagcctgggatggaccagcaagctgcttctttcctagaggctgatgagtcgagaaccagggcaccttctcgtctataga

SEQ ID NO: 6823494 - DNA, 78 bp, Homo sapiens
cctgggcctgtgtcctgtgcaaggggatgatttcctttgggcccctcgaccactctgcaaggcacacaaggctcatgg

SEQ ID NO: 6823495 - DNA, 65 bp, Homo sapiens
ccaaagctgtcctctcattgtttgtagctactcccattatcaacatgaaggtaggatggttttgg

SEQ ID NO: 6823496 - DNA, 68 bp, Homo sapiens
agagatctagcacctgctggtcctctatgtgggcgggaactgtgaggtccagcctggtgtatgtctct

SEQ ID NO: 6823497 - DNA, 56 bp, Homo sapiens
gtaaaataagaggggacttgatttagattggctttcacagtccttcttggttttac

SEQ ID NO: 6823498 - DNA, 112 bp, Homo sapiens
actttcgaaagcattttaaggctattgtctcttcatgtgtttaatttttacataaaataatgataataaaaaatgaatatgatggaggattctctgtaaagtgcaagacagt

SEQ ID NO: 6823499 - DNA, 55 bp, Homo sapiens
gtgaagggaaacgctcagctggtatatcatgtcccagccacgaagctcccttcat

SEQ ID NO: 6823500 - DNA, 88 bp, Homo sapiens
acaaggctcaacccagtttaggcaggggctatttcttttaaaaatagaggagacagacaaaattcctgcctgaatctgttagtcctgt

SEQ ID NO: 6823501 - DNA, 68 bp, Homo sapiens
ctgggaagaggcgctcctcacttcctagatgggatggcggctgggaagaggcgctcctcacttcctag

SEQ ID NO: 6823502 - DNA, 90 bp, Homo sapiens
cttgctataaacaaatggttaatgtcttcctattctacagagcatttgtgctatgtagggaggtttattattttgttgtaattatagagg

SEQ ID NO: 6823503 - DNA, 81 bp, Homo sapiens
atgcttgtgtctccattgaacatcctctcagaacctttagcatgctaatgtgtttgtgaatgtccaagggagtcataacat

SEQ ID NO: 6823504 - DNA, 105 bp, Homo sapiens
gaacattgtattaagaaatttactgggaattccaaggctaaatagtctctgcccagagatccttagggatttttccagtcagttccactcattaaatatatactc

SEQ ID NO: 6823505 - DNA, 93 bp, Homo sapiens
tgtcctcacatctggaaacttgagttttctgtgtgtgacccaggagactggctcatattaacaatgaaactcagaagagagaggtgtgggtca

SEQ ID NO: 6823506 - DNA, 62 bp, Homo sapiens
gtccttctgagtgcccaggcaggccgggccctgtgctgagcactgggcacatagctgagagc

SEQ ID NO: 6823507 - DNA, 93 bp, Homo sapiens
caggaattaggttttccttttcagattcaaattttatgtgagtatttgccttttgtaactttagctatttaatctgatggagaatttttcctg

SEQ ID NO: 6823508 - DNA, 78 bp, Homo sapiens
gtctgtctgggtggctgtccagccagccatcaggctgtcatttttctgctgtctggctgtccagcttatctatctggc

SEQ ID NO: 6823509 - DNA, 103 bp, Homo sapiens
atgttgtatcaaaatgtagatatagtatatagtggcgctgtatgctgtattcagcatatggtattagtggtgctatgtgctatttgcagtatgtatacaatat

SEQ ID NO: 6823510 - DNA, 74 bp, Homo sapiens
taagattttcagtccagcacatacagtcccagtgcccagcacaccggaagtttgtatactggcctcttatcttg

SEQ ID NO: 6823511 - DNA, 55 bp, Homo sapiens
ctatgggatgtggtctaaatgctttgcctgggcatcagaggttgccactccctgg

SEQ ID NO: 6823512 - DNA, 70 bp, Homo sapiens
tgaaggcttggtggcagcctctgaggttgatgggatctttaggcagaaggtggctgccacctagctatca

SEQ ID NO: 6823513 - DNA, 72 bp, Homo sapiens
ttgtcctccagttgcgaacttggtcccgtcagggtgaatatcaactgaaaaaatcggcttgcctggaaacaa

SEQ ID NO: 6823514 - DNA, 79 bp, Homo sapiens
ctgctggcctctgccagctctaaacggctctgtggtctggcaaggccaaggcaatgtgcagctggtgggaggtcggtgg

SEQ ID NO: 6823515 - DNA, 61 bp, Homo sapiens
agtgaaatgtgcagagaattaggaattggatatttcatctttgaactctgtataaaccact

SEQ ID NO: 6823516 - DNA, 62 bp, Homo sapiens
tggggctggctattgtctccctcctctctcctgtcagagggcaaagcaagctgtcagcctca

SEQ ID NO: 6823517 - DNA, 86 bp, Homo sapiens
gcttaaaaatttccacggtggcaaaggctggaatatcagttacggattcattcagcactaattgctacctagagccaattttcagc

SEQ ID NO: 6823518 - DNA, 68 bp, Homo sapiens
acctggggcagagtaggattttggcctctactgatcttgtttataatccaactctgctcccttttggt

SEQ ID NO: 6823519 - DNA, 66 bp, Homo sapiens
ggagctcgttctaccagaccccagacttgtaggatgatagaagtatgtgctggctagaagagcttt

SEQ ID NO: 6823520 - DNA, 77 bp, Homo sapiens
tgtaaacttgccaggcaccaaagtatgctttaggatatcaccatgactagtgccctttgctgcctgccatggttaca

SEQ ID NO: 6823521 - DNA, 72 bp, Homo sapiens
atattttaacatgtgtataatttttgtttgttggctaagacaaggccaagtatcaatacattgttaaagtat

SEQ ID NO: 6823522 - DNA, 65 bp, Homo sapiens
cccagctggagggcgccaggccagcagccatggggcagagcctggacaccgcccttgcagagggg

SEQ ID NO: 6823523 - DNA, 57 bp, Homo sapiens
agctctgactgaagagatgcaagattttctcagatgatttgtgtgtcagtcagagtt

SEQ ID NO: 6823524 - DNA, 63 bp, Homo sapiens
gtcatcacatgcctatcatgagctggctctgtgattcagtcagtgttgatttgtatctgagat

SEQ ID NO: 6823525 - DNA, 103 bp, Homo sapiens
gtacaggcttctgggttcacttctctgtattagctgccttggagctaagaagttttcctcttaataataaacagttgaagatggttgaacacagaagccttgc

SEQ ID NO: 6823526 - DNA, 71 bp, Homo sapiens
ttttctggggaaggatatgattagactaatgaaataatggaattaggcttatttgtctttcctacagtgaa

SEQ ID NO: 6823527 - DNA, 59 bp, Homo sapiens
gagatatgttggcagctggtatgcacttcatcagagggcaaattactgccacacatttc

SEQ ID NO: 6823528 - DNA, 61 bp, Homo sapiens
atgaggtgcaccattattcagttgctttaacaataaagagcaaagttgttgctaacctcat

SEQ ID NO: 6823529 - DNA, 90 bp, Homo sapiens
ggtatgaagagattcagtgctcttaaataacatcattgctttgtaaggactgaacattatacaagagtttcctgcaatctgattcttacc

SEQ ID NO: 6823530 - DNA, 113 bp, Homo sapiens
ggagggggcggctccgacctgtcccttctcatcacatcagttactttccattagcgggaggggaaatcagcagatgctggtgaggggggtcccggcgggaagcagaccccttc

SEQ ID NO: 6823531 - DNA, 65 bp, Homo sapiens
tgtctattgcttgttcttgataaggaatgaatctagaacatttctatgtgttgacaagcctgaca

SEQ ID NO: 6823532 - DNA, 91 bp, Homo sapiens
ctggatggcaacctgaaacccaaggccatgagcagcgagtgtgtgtgagcccagcatggattagtgcggtggccttgggaggcccttccag

SEQ ID NO: 6823533 - DNA, 70 bp, Homo sapiens
gaagatataaacggagtcatcccttccctcaacaaatttacaccaggtggggcagctctgttttattttc

SEQ ID NO: 6823534 - DNA, 68 bp, Homo sapiens
gggaaattcaggacaaagactcttgtgttttaaaacatgctcaagtctcttttcttcctgtattaccc

SEQ ID NO: 6823535 - DNA, 64 bp, Homo sapiens
gcgggtttcatttcattatgaaggctttccttgtgccagtttctaggatgctgatgagacccgt

SEQ ID NO: 6823536 - DNA, 57 bp, Homo sapiens
gctattagacacaattagtgattcagattccaaggagttgcttttcgtgtcaatggc

SEQ ID NO: 6823537 - DNA, 62 bp, Homo sapiens
gagaagggaaatgggaactcaaggcaagaatgcctccctggcagctggtccccaagcctctc

SEQ ID NO: 6823538 - DNA, 57 bp, Homo sapiens
gcaaagtccattcttccagccagctcttgctccagccctgctgtgatgagactctgc

SEQ ID NO: 6823539 - DNA, 68 bp, Homo sapiens
ctgtaaagtccaagatcaaagagccagcatttcgattcctagtgagggcctcttcctggagtttgcag

SEQ ID NO: 6823540 - DNA, 55 bp, Homo sapiens
tcttattcacctctattagactcagtcagctgagagtttttaattggtgaaggga

SEQ ID NO: 6823541 - DNA, 59 bp, Homo sapiens
ggtgagggtggaagcagaggtggttcaatgactttccacaaaggttccattctctcacc

SEQ ID NO: 6823542 - DNA, 67 bp, Homo sapiens
atcagagtttttagttctgcctctcacagtctacggaatcacaggcaggttacaaaaactttatgat

SEQ ID NO: 6823543 - DNA, 78 bp, Homo sapiens
tgaattgaagtacattcaaacgatttattgattgaattatctttaatcattcaaatgatttggaggtactgcagttta

SEQ ID NO: 6823544 - DNA, 76 bp, Homo sapiens
gacccattacaataaggtttatttgtagcatacatagttgcaaagtatgtatttaaatgttgctgtgtccagggtc

SEQ ID NO: 6823545 - DNA, 68 bp, Homo sapiens
ctttcattcattcatctgctgacttgacaagtaccagagtggtaattgtgggcttagtagagtgaaag

SEQ ID NO: 6823546 - DNA, 59 bp, Homo sapiens
tgtcctggaattcaaagtttggctggagtaaagctcttaagctgatgtgggtactgaca

SEQ ID NO: 6823547 - DNA, 108 bp, Homo sapiens
tgtggctcccatgttgggacttgggatgggggaagtttggtgtaatgttgaagagcactggcatttgaacattcaacagacccagattctgagccctcggctgccata

SEQ ID NO: 6823548 - DNA, 130 bp, Homo sapiens
actaccaaatattttactatagttaccctgaataaattacgttttgtcttaatttggattctactgaaagcagagcctgaggcaaggacttggtggcagggagtacatttgggtgggtatataaggaagt

SEQ ID NO: 6823549 - DNA, 73 bp, Homo sapiens
tggtagtcacaactgggggcattactggcatctagtggatgctgctaatattctgcagtgcacaggacaacca

SEQ ID NO: 6823550 - DNA, 85 bp, Homo sapiens
aatttttcactttaaacaagttactctggctgtaatgaggaaaacagttttgaaatggccaagagtcgatttggggagaaaaatt

SEQ ID NO: 6823551 - DNA, 71 bp, Homo sapiens
aggatagggctggcaaacacttttaaatgtcactaagtaatttcaggaaggagctggcctgccactgtcct

SEQ ID NO: 6823552 - DNA, 55 bp, Homo sapiens
tgcaccttgttgcttttacgaagtctggtaagaatgcggtgaagttagggtggca

SEQ ID NO: 6823553 - DNA, 73 bp, Homo sapiens
gaagctgccataacttcatgggttcaaagctgggttctcttgggacctgcttccatgcaatggcagtcagttc

SEQ ID NO: 6823554 - DNA, 77 bp, Homo sapiens
tggtacaactgaacataattaaatgtcctgggtggttcctgatctttcagggctcaaggttatctttagtgacatca

SEQ ID NO: 6823555 - DNA, 78 bp, Homo sapiens
gagtcatctgcaattgatttcataagggtttctagactttgcaacaaggctaaaagacatctttatgggtagagactt

SEQ ID NO: 6823556 - DNA, 64 bp, Homo sapiens
agatctaggggaagaaatttgaagcttaaaagtatgggctgaagacctccctctccatggatct

SEQ ID NO: 6823557 - DNA, 85 bp, Homo sapiens
atttaagcatttggtaattgagatgtcttttctgacagtttggggaaactataagaatgagataatctcagcctacatgttagat

SEQ ID NO: 6823558 - DNA, 55 bp, Homo sapiens
ttgtgtttcccagagatccgcctccagtgactccatttctctcagggaaacagaa

SEQ ID NO: 6823559 - DNA, 57 bp, Homo sapiens
atgacactgagaataacaggtatgctgagtggcagctttatctggggatagtgtcat

SEQ ID NO: 6823560 - DNA, 57 bp, Homo sapiens
ttacaactctagagaaaagaaaaggaattcagctacttatcttcctctggattgtga

SEQ ID NO: 6823561 - DNA, 129 bp, Homo sapiens
aagatttataagaagagtctaaggttagagcaattctaagttcactaagaccatagaatcagacaaaatgaactagattcaggtgtgtagtaagctgaaaattatttaacccactacagttgatttctt

SEQ ID NO: 6823562 - DNA, 100 bp, Homo sapiens
tttcatgtttctgatttcttgactgatttttctaaaatttggaacttagaaaaacatataaatttcttgagaaatgtcaggaaagaagtcccgcatggaa

SEQ ID NO: 6823563 - DNA, 56 bp, Homo sapiens
agtcaatttagtttccacagggggactctaacctgcctaggaggcttaattaggct

SEQ ID NO: 6823564 - DNA, 129 bp, Homo sapiens
tcatctggagatcttgttaaaggcagcttctgattagcagcgcctgcatttctaacaagctctcaggcggggctgatgctgctgatccaaggactgtacacactttgagaatctctgttctaagctgca

SEQ ID NO: 6823565 - DNA, 69 bp, Homo sapiens
tcttccttctccccatttgccacaagctttttcacgggttccatggcagcagtggaggtagaaagagga

SEQ ID NO: 6823566 - DNA, 71 bp, Homo sapiens
gggcttgtattaagcttagagaggcaggttgctcaccaaatttagcaggtttactgagtttgaatagggcc

SEQ ID NO: 6823567 - DNA, 55 bp, Homo sapiens
ttgagacggagtcttgctcttttgcccaggctggagtgcaatggctcagtctcag

SEQ ID NO: 6823568 - DNA, 55 bp, Homo sapiens
agagacggaaatgtgtagcctgaggtcaaaacctcacctagtacaatctgtttct

SEQ ID NO: 6823569 - DNA, 80 bp, Homo sapiens
caacattatgtttctgaggactttccatgttaatgtgaccccaatttattcattttaacagtcagagttttccattgttg

SEQ ID NO: 6823570 - DNA, 61 bp, Homo sapiens
gttacaaatgtaaattctggggcctcacttaggcctattgaattagagtctgcattttaac

SEQ ID NO: 6823571 - DNA, 78 bp, Homo sapiens
acggttccaataattgttctgaattggattctgttgaaaacctccttaacagaattgaaagtataatctgggcactgt

SEQ ID NO: 6823572 - DNA, 57 bp, Homo sapiens
attccttggaacagatgcgaaggattcatagtgcctttcagctctgcttcagggaat

SEQ ID NO: 6823573 - DNA, 82 bp, Homo sapiens
taagtagggtgagtaaaggtagagaataaggtggtggtatttgaggtactttgataaggttcttctattcttacctaactta

SEQ ID NO: 6823574 - DNA, 94 bp, Homo sapiens
tcagcactcttttcatttgttagcttttacttgaacacttttataattataaaagtttgattaggcaagaaaagactgagaagatagggactga

SEQ ID NO: 6823575 - DNA, 59 bp, Homo sapiens
ttacttacaaaggcaaaggaagtcgtgctgtgttttgcttctttagcttttgtggctaa

SEQ ID NO: 6823576 - DNA, 66 bp, Homo sapiens
agttggaatttcatgtaagtgactcattagaatgactcaactacttgagactcctttcccatgact

SEQ ID NO: 6823577 - DNA, 63 bp, Homo sapiens
agatggctctcaagtctgattagggaggacatttactctatggcagtactaagagggctattt

SEQ ID NO: 6823578 - DNA, 57 bp, Homo sapiens
cctggagattgccacttggaaggtcattgtgacctttgacagcgtggtttctgtggg

SEQ ID NO: 6823579 - DNA, 78 bp, Homo sapiens
ggcagcacattttaactaatgtttttctgaatgttctaattccagataaattcaaagcatttaggactcatgtctgcc

SEQ ID NO: 6823580 - DNA, 82 bp, Homo sapiens
gggagggccctgggagcccgcgtcctggtggcggcaccccctgtgctcccacccagcgggggctcaccaccggccccttctc

SEQ ID NO: 6823581 - DNA, 90 bp, Homo sapiens
gaggacttgaggacctgtctggacaaaggactcacaggatgttagatttagattcgtatattaggattttgtccaagtagctcatgcctc

SEQ ID NO: 6823582 - DNA, 57 bp, Homo sapiens
gtggtagagtctggaacccactctggaacccaggcagtctgactagactctgctcac

SEQ ID NO: 6823583 - DNA, 110 bp, Homo sapiens
actttaatttcatctgtttttggtttcagaaggggagaaaggtcaaagcttctttgttttaagtgagctggtcactccttctgaagtgtaaaatgataggggtcaggagt

SEQ ID NO: 6823584 - DNA, 57 bp, Homo sapiens
acagtggtatggactgaaattgtttctataataagcccaccagctttatgctactgt

SEQ ID NO: 6823585 - DNA, 71 bp, Homo sapiens
ggacactttgggactcagccctagtgttatctgtgtggaccctagaggaacaaatgagtcctaaagaatct

SEQ ID NO: 6823586 - DNA, 90 bp, Homo sapiens
aaacttgaggagaaagttatcacaaaattgagacttgccaagaatgtaccttatttgttgtaatttttgaaagatttttgcttcaggttt

SEQ ID NO: 6823587 - DNA, 62 bp, Homo sapiens
attggagttcttctctcttagtaaatggctttgtgccatacaagtatggaatgattctcagt

SEQ ID NO: 6823588 - DNA, 88 bp, Homo sapiens
gtcccatggggacactgagagaacgggctgctccctaaggaaactcgagttttgggtcagtctgatcctaccagacatcacatgagac

SEQ ID NO: 6823589 - DNA, 69 bp, Homo sapiens
agcagccctcatggagttctttaaattcacagagctctgtgccacctgagggactctagacttgctgct

SEQ ID NO: 6823590 - DNA, 73 bp, Homo sapiens
ccatagtttaacagatgaggaggtgagggaacagaaagcctcagcacatctctctgttgcacagttactgtgg

SEQ ID NO: 6823591 - DNA, 55 bp, Homo sapiens
tgacatgtatgtatttgtttatggattaaaaaatagatgaatgacttatatgtca

SEQ ID NO: 6823592 - DNA, 66 bp, Homo sapiens
gcctggccaacgtggtgaaaccttgtctctactaaaaatacaaaaattcgctgggagtggccaggc

SEQ ID NO: 6823593 - DNA, 66 bp, Homo sapiens
gcttcaccactttttcagtgtgcatgcatgcacgtgcatgtgtgtgtgtgagaaagagtgtggggt

SEQ ID NO: 6823594 - DNA, 66 bp, Homo sapiens
gactgtcatcgtaatatacctcagtgaaatgaaggttaattctgatgtacaacctgcatgacagtc

SEQ ID NO: 6823595 - DNA, 76 bp, Homo sapiens
gggggctgtcctgtgcattgtaggatttttaatagcatccatggcctttacccactatatgccagtagcagccccc

SEQ ID NO: 6823596 - DNA, 109 bp, Homo sapiens
ttcaatcccagaccaattaaaccagaattgctgaaggtaggctaaggaattgttatattttaaaagcttccctagcagttctaaacttttagttgcacttggttttgaa

SEQ ID NO: 6823597 - DNA, 91 bp, Homo sapiens
tgttctactttttctcaggaagaatttaaatgccttgcctatgtgcatgtactataacaatgcaaaatgaatttaggatgaaaaaagagca

SEQ ID NO: 6823598 - DNA, 96 bp, Homo sapiens
tctgctatgatgcaagacccaccacctcccctggggtcagggactctggctcagagagggagtgtggattgaactctgagctaaagtcatggcaga

SEQ ID NO: 6823599 - DNA, 72 bp, Homo sapiens
ggggtaggatgccttgtcccatctgtggcctcagcccactgggttccagacacaccaggcccattctgcttc

SEQ ID NO: 6823600 - DNA, 84 bp, Homo sapiens
gctcttctttcataaaagcacttgtattctatttaactcctgccattgagaaaaggtagctaaaacaggcttttgaaaggtagc

SEQ ID NO: 6823601 - DNA, 106 bp, Homo sapiens
cataacatatatagaaaatggaagtacctctgcatttgcttaggaaaaaaggttaagatccttgtttttaagagatgtttactccaggtcaatgatccctgttatg

SEQ ID NO: 6823602 - DNA, 70 bp, Homo sapiens
aaagtctcagtttgaagtgatgccagacctgggtttgaatccagcttggctacttccagctgggtgattt

SEQ ID NO: 6823603 - DNA, 59 bp, Homo sapiens
acatccctcagtcagactgtaaactgcatgaggcaggctgcatctgccttggggactgt

SEQ ID NO: 6823604 - DNA, 81 bp, Homo sapiens
gcctgttaagcccatcttgccttctctcctctggacaagaagtaaatgggagtgaaaggtaagttgagcttagcctttggc

SEQ ID NO: 6823605 - DNA, 60 bp, Homo sapiens
aaaggtttattgattctgctcttaatttctgtaaggcaaagagctgagttattggccttt

SEQ ID NO: 6823606 - DNA, 61 bp, Homo sapiens
ggtttcagaagaaaagacttttagagttgcaacagcctgggtgtctttcttttcaaaagcc

SEQ ID NO: 6823607 - DNA, 61 bp, Homo sapiens
cactgttcagcttgaatctggctttgacaaaagttatgccaatcccaggctggacacagtg

SEQ ID NO: 6823608 - DNA, 94 bp, Homo sapiens
agatgactggaaattgtgcaaaggagggtcttgttgattgtatctctgttatgctatctaactgggctattttattgggcaatgcttcatatct

SEQ ID NO: 6823609 - DNA, 88 bp, Homo sapiens
tattaatttctgaatactcagtttatatttttagattgttttgtgaattgggatctctgagtataaagtggttttcagcacattggtg

SEQ ID NO: 6823610 - DNA, 71 bp, Homo sapiens
cttgtgctgacaattcacagagaagtactgtaattagatgccaactgtcttctgtgaagtgacaacacgag

SEQ ID NO: 6823611 - DNA, 65 bp, Homo sapiens
tctcagaacagagccaggactcaagctaggtctgagcaacagacctgggtccctggcctgtggga

SEQ ID NO: 6823612 - DNA, 85 bp, Homo sapiens
agtagaccgaagttaggttggaatggagaggacgttgtttaaccattaacaatgtctttgtctccttcagtctatatagtgtatt

SEQ ID NO: 6823613 - DNA, 60 bp, Homo sapiens
tcaggcttccaggctctgctgaccacaagttctgctgccagcaaggctggcaggcctaga

SEQ ID NO: 6823614 - DNA, 66 bp, Homo sapiens
ctcctgctctcatggcacaacgtgctcaccatttgttcagtcgggcaccaggccatggagcgggag

SEQ ID NO: 6823615 - DNA, 57 bp, Homo sapiens
agtagtattctacagagggtgccagtgacatcctcttatgcaaaggatacacatact

SEQ ID NO: 6823616 - DNA, 78 bp, Homo sapiens
actctataccaggcatgaagaaacggtggcctatagaccagatcaggcccattgcctcggagcctgttatgtgtaagt

SEQ ID NO: 6823617 - DNA, 57 bp, Homo sapiens
ggcctctgtcaggtgaacgcgctcctgcgggagcagctggaacatatgaagaaggcc

SEQ ID NO: 6823618 - DNA, 59 bp, Homo sapiens
ggtggctttctaaaccaaatgtctgtcctgacccctgttttggtgctggaaatgccatt

SEQ ID NO: 6823619 - DNA, 58 bp, Homo sapiens
gggggtttctgggctgagcagaaatttgtttcttaattatctttttccagcaaccccc

SEQ ID NO: 6823620 - DNA, 73 bp, Homo sapiens
gttcaatgattaactagaggaggccatctctggaggacagaaagagtcttctgatctggttagccatgcagac

SEQ ID NO: 6823621 - DNA, 68 bp, Homo sapiens
cgtcagttagacagactgcctgtaccacgcactggccccaccagtgtagacagactgcctgacccacg

SEQ ID NO: 6823622 - DNA, 77 bp, Homo sapiens
tcggaccccgggagtttcctcttccgagggggaggcgaggccgcgccagctagcggggaggaaatgccggagtctgg

SEQ ID NO: 6823623 - DNA, 55 bp, Homo sapiens
tcccactgttgtttgtctctctggagaaggttattttcaggcaggcagagcggga

SEQ ID NO: 6823624 - DNA, 68 bp, Homo sapiens
tgacctcatttgatccttgctatgagaggcatattgtcattatgcttttacaagagccagagaggtca

SEQ ID NO: 6823625 - DNA, 69 bp, Homo sapiens
tttctcattctgtttgtgaactggctgagaggcaaaccttcttgatctaatttagaaatagaagagagg

SEQ ID NO: 6823626 - DNA, 95 bp, Homo sapiens
ccaagctacatgcaccccatctggtgccatcccaacactgggcttgacatttgctccagctgtctcagggaggtgatccagggccataggcttgg

SEQ ID NO: 6823627 - DNA, 64 bp, Homo sapiens
caggggcgcttggaaagcagcgtgggccgtcgtcagtcctgggctgtgcagccaagtgcctctg

SEQ ID NO: 6823628 - DNA, 80 bp, Homo sapiens
aaggtgttatagctgaggaataaaactgacattgaataatagtcatgtttacccatatctccttatttgcttaaagcctt

SEQ ID NO: 6823629 - DNA, 63 bp, Homo sapiens
gctgtgagtgaatgggtctgaagtgtgtggcatccgtgtacttgggatgtagttacccagagc

SEQ ID NO: 6823630 - DNA, 60 bp, Homo sapiens
cttggcttaatggttagaattcagggaaaaagagatcctgaattcctaatctaaactaag

SEQ ID NO: 6823631 - DNA, 77 bp, Homo sapiens
tgccttagggaaggacagtgaagaaagatggcttatagcaaggcctcaccctttcttctactgttctaacctgtgca

SEQ ID NO: 6823632 - DNA, 93 bp, Homo sapiens
tgggtacatcaaatcagcttgcaaataggggacaactctttgctgcttatccctcttcctcagcacagacctatggcagctgccatgaaccta

SEQ ID NO: 6823633 - DNA, 68 bp, Homo sapiens
ttaaaccaccagaagccattattgctcatgaccctgtgagttgcatggggacttcctggctggtttaa

SEQ ID NO: 6823634 - DNA, 61 bp, Homo sapiens
cagtttacagatgctacaggagcactaactcatgggtgtgatcatcatggctctggagctg

SEQ ID NO: 6823635 - DNA, 76 bp, Homo sapiens
ggctagcaaggtagcagaatgccatgcatttgaagattaataatgcaaacaaccatgatgttaactttgttatgct

SEQ ID NO: 6823636 - DNA, 78 bp, Homo sapiens
catcacagacctgaactgctgaatgctattcctcatggaaactgaggcatggacatttcggcagctcccccttggatg

SEQ ID NO: 6823637 - DNA, 69 bp, Homo sapiens
cagatagttctagcaatagataatgtgcaataaataaaagttgtataactcttgttggagttttgtctg

SEQ ID NO: 6823638 - DNA, 60 bp, Homo sapiens
gggtggtgaaaattagtggctaaacatttctaattgtttccatctacggctataccaccc

SEQ ID NO: 6823639 - DNA, 57 bp, Homo sapiens
tatgagtgtgtgtgatgtgtgtgaaattctctccttacccagttccacacactgatg

SEQ ID NO: 6823640 - DNA, 60 bp, Homo sapiens
ctgagcacctgctgtgtgccaggcactttgctctgagacacagaaaagagttaggctcag

SEQ ID NO: 6823641 - DNA, 58 bp, Homo sapiens
gaagtctgcctgccttctctgtgaacccagggggtgtagaaaagaaaggggagccttc

SEQ ID NO: 6823642 - DNA, 60 bp, Homo sapiens
gagtgactgccctacccccgggatgcctatccatgcccgtggcctggggcagcttctctc

SEQ ID NO: 6823643 - DNA, 80 bp, Homo sapiens
agggaagctctgacttggtgctaccagccagagtttcaaacatttttctttactttgttgggcccaattagactttccct

SEQ ID NO: 6823644 - DNA, 59 bp, Homo sapiens
ctggcaatctggccctttgtcagagtattgaaggagacagcaagaggaccagatgtgag

SEQ ID NO: 6823645 - DNA, 60 bp, Homo sapiens
tgtttttttaagtgaaagaaaaggacccttctgggttttggtaatgaacttaggaagaca

SEQ ID NO: 6823646 - DNA, 130 bp, Homo sapiens
aatggtagtatttttttagattttttaaagcaattgtgtaaggctgattaggaaggaggctctctacagcacagctttccaattcaagcttttacgttttttaatgtttcatttttattgactttttttt

SEQ ID NO: 6823647 - DNA, 118 bp, Homo sapiens
cagtatccttcttagagaaacaatgtctcagtagaatatcacattttttactggacttaaggaaatagctttaatttagagggggatgtggaggaagagtttctcagaaggaaggctg

SEQ ID NO: 6823648 - DNA, 86 bp, Homo sapiens
agggggttctggctttaatttagtaaggcagtgcagaattttgaattgagaacttatttaatgagggttagaataaaaaaccttct

SEQ ID NO: 6823649 - DNA, 61 bp, Homo sapiens
acctcctggtgcccaagtgtttgaggtgagaaaaactgaaacatgaaaagcccagagaggt

SEQ ID NO: 6823650 - DNA, 66 bp, Homo sapiens
gaccgcagggtggaagctgtagagtggtcagcatttggatgccacatactgcaatcacccctggtt

SEQ ID NO: 6823651 - DNA, 64 bp, Homo sapiens
ggttatgggtggttgaatatcctcatatccagctgattggagtatgaatggaaactacctatcc

SEQ ID NO: 6823652 - DNA, 82 bp, Homo sapiens
gaaagggtaatcggctggcatgaactttggcagggaagatgtcatgcaaaatccagttggtttctgtagctgttagcttttc

SEQ ID NO: 6823653 - DNA, 74 bp, Homo sapiens
ttctcaaattgtcttctgtgcattcctaggggttcattggaggcacttctggggctaatacagaggtcagagaa

SEQ ID NO: 6823654 - DNA, 111 bp, Homo sapiens
gtcataaagatctgctagcttcagaaataggctctcaaatgtgaccttcatttaaatgtgtaaggcaatttcagggctctctaacatttctgagtttaaggtactattgac

SEQ ID NO: 6823655 - DNA, 66 bp, Homo sapiens
gctctggcaggggcaggccctgctcactatgagagatcagagaagtcaccctgttgctgtgagagc

SEQ ID NO: 6823656 - DNA, 88 bp, Homo sapiens
agtagtacctttggcttattatggcaaataagtaaataattaattttgtaaatgtgttagtcatggttttaagaaaaatggtaatact

SEQ ID NO: 6823657 - DNA, 72 bp, Homo sapiens
cccaccagccaagggctgtttttggcacctgggacagagtctgtgcctttaagaagctcatggtctggtggg

SEQ ID NO: 6823658 - DNA, 58 bp, Homo sapiens
cataagtggagattagaacttggctgtttggccccagggcttttctcactagactatg

SEQ ID NO: 6823659 - DNA, 64 bp, Homo sapiens
actgcaaaagttgagggggattcttacatcttcagaagccaactaattaaacaacttttgctgt

SEQ ID NO: 6823660 - DNA, 58 bp, Homo sapiens
gctttgggattccttatttttggatgagtggctttgaaagtgaatgtatcccgtaagt

SEQ ID NO: 6823661 - DNA, 73 bp, Homo sapiens
cagtggaagttcctgctatctgactctagctttgtaagtcttagttcaaaatgtcagagaaggagctttcctg

SEQ ID NO: 6823662 - DNA, 64 bp, Homo sapiens
gtagtgattgttcctcaggggttatgctttacacagctcggatttcctaaaagataatcattac

SEQ ID NO: 6823663 - DNA, 57 bp, Homo sapiens
ggcacagccactttggagaactgtggggcagcttttactaggaagtggccatgtgct

SEQ ID NO: 6823664 - DNA, 57 bp, Homo sapiens
cacttacatactgagaaaatatcctgccttgtcagggtgtgtgtgtgtgtgtgtgtg

SEQ ID NO: 6823665 - DNA, 65 bp, Homo sapiens
ggagaagttggacagtttgggaagggagagtggtctgctctgccacctcaatctttcctttctct

SEQ ID NO: 6823666 - DNA, 69 bp, Homo sapiens
ctccagcagctttgccaagtcagcctccgggccatctggctgtccttggccaaggcactgttaacggag

SEQ ID NO: 6823667 - DNA, 57 bp, Homo sapiens
gggtgaggctcattttcctgagttcaggtttccttcagcagcagggaagcctcatcc

SEQ ID NO: 6823668 - DNA, 55 bp, Homo sapiens
gggccgggtgcgcgtgtccgcgcctcttcccgccggccgggcgggcgcctggccc

SEQ ID NO: 6823669 - DNA, 62 bp, Homo sapiens
ccagctggcactgtggctgccctcccagtggggaggcctcctgcagcctgggccacatctgg

SEQ ID NO: 6823670 - DNA, 69 bp, Homo sapiens
gtttctactttctaagacatacaactttgctttccaacaaggtatctgcattcttggaaagaaggaaac

SEQ ID NO: 6823671 - DNA, 57 bp, Homo sapiens
cgaagacagaccatctgagtaggtttgctggcaagtgaatagatgggctgttgtttg

SEQ ID NO: 6823672 - DNA, 96 bp, Homo sapiens
agtgggggttgcaggagagaactggctccttctagacaggggaatatcgtggttagggttctggagtcagattcaatctgggctctgtcacctact

SEQ ID NO: 6823673 - DNA, 120 bp, Homo sapiens
aggtcacacagccagtatgtggcagaaccagaattcaaacccaggtctctcaagcctgtatttggactcaatggtttgctgcctccatccacattgacagttttcctagttgtgttccct

SEQ ID NO: 6823674 - DNA, 78 bp, Homo sapiens
ttggggtaggcactactatattaattgtgtaataggcattatgcattgctgtagttcaatatgtggtgtattccttga

SEQ ID NO: 6823675 - DNA, 58 bp, Homo sapiens
tggggttccaaagcaaaggaggtgagcccatctcagctcagagactttggaacatcca

SEQ ID NO: 6823676 - DNA, 61 bp, Homo sapiens
tgcagtctttcctcgagtttgtttggagaaagcagcaaacgtatgaaaaggaaaaactgta

SEQ ID NO: 6823677 - DNA, 80 bp, Homo sapiens
gggtctgcccacccagagtgacaggaccacctcaaaacatgcaaagagggtcctggcagctctgtgtccatgggcaactc

SEQ ID NO: 6823678 - DNA, 79 bp, Homo sapiens
agggagaggagggtcttgttgaacttgaaaaaactaaataagcaaagttgatacataaggacacccttctctttaccct

SEQ ID NO: 6823679 - DNA, 58 bp, Homo sapiens
cagcaagtcatccaggatgatgtcggatatggtgctgatcttcttggccagcttgctg

SEQ ID NO: 6823680 - DNA, 80 bp, Homo sapiens
cctttgccctgccagctgacccgtgggaggcgggactggcctaacagttctctaatccaaggtcagctcgggtgcggagg

SEQ ID NO: 6823681 - DNA, 72 bp, Homo sapiens
tcgacccatgcatgaactccagtccaagagaggttagattaccacctgggctgtttgtttagaatggcttgg

SEQ ID NO: 6823682 - DNA, 65 bp, Homo sapiens
ggaggcaggaaagacaggttcagtgatgtgacatgagaagtatttaacctgtcatttctgtcttt

SEQ ID NO: 6823683 - DNA, 106 bp, Homo sapiens
cctagtcgaacagcctgatttgtatgctgaaatcttagccattctgccttggaaaaagtcagaggcagatgagatgggaagaagcatagtcaggggatgatggagg

SEQ ID NO: 6823684 - DNA, 71 bp, Homo sapiens
tccttgggctgctgtaagcattcattacgcatgtgaatgaccattgtaaactgctgcaggagtgccaagga

SEQ ID NO: 6823685 - DNA, 67 bp, Homo sapiens
agcagaggtagaaggcatgcagtgagacatggtgatggtgtactattgtctccttcaacttcttgtt

SEQ ID NO: 6823686 - DNA, 57 bp, Homo sapiens
ggcctgggaacttgtccccggagagaatgcccaagtccaggaaggttatgccaggtc

SEQ ID NO: 6823687 - DNA, 71 bp, Homo sapiens
gctccctcatctgtgctgttttcatcacacagggaaaaccaaaggctgggagagcagcactgggagtgagc

SEQ ID NO: 6823688 - DNA, 56 bp, Homo sapiens
aaagagcaagctgagatttgaattcagctctgtctaattctaaagctctgctcttt

SEQ ID NO: 6823689 - DNA, 57 bp, Homo sapiens
ctctggcctggggcctgctccctatctgtggaactgggagtagggcccaggctaggg

SEQ ID NO: 6823690 - DNA, 60 bp, Homo sapiens
gtgacaaggaaaataaattctaaggtttatatcaagtagaattccagtttcttatgtcac

SEQ ID NO: 6823691 - DNA, 126 bp, Homo sapiens
ggggacaggcttcgaaattcctaaatgacattagagtgacagggcagggccacagtgaggctaagcttggcacagattgggtctgcctctgggctctgcccctggcttgctgtgtggcttgtttcc

SEQ ID NO: 6823692 - DNA, 63 bp, Homo sapiens
ctgctttggacaactattcttggaaactaatttcaattaagcaggaacagggtgtcctggcag

SEQ ID NO: 6823693 - DNA, 130 bp, Homo sapiens
ttcaaaaataactgcttcccttccataccaggcaccatgttcttaggaccttccttgagcaaggagtctattttcgtacctgaagacatcgggcttggttttatgacatggcttggcaatgaaatgtgaa

SEQ ID NO: 6823694 - DNA, 60 bp, Homo sapiens
tgccacatgtcatgtgctcagtagccacatgcgccagtggctgctgcatgggacaaggca

SEQ ID NO: 6823695 - DNA, 79 bp, Homo sapiens
gcattgtatagatagaccacagtttgttgtccatcagcattcacctattgatggacagtgtgtctgtttccacttttgc

SEQ ID NO: 6823696 - DNA, 79 bp, Homo sapiens
caacagtttactgacccatcttctcttgaacctcctttgccccaaaggtgaagggtggaggcaagagagggaactgttg

SEQ ID NO: 6823697 - DNA, 88 bp, Homo sapiens
ctccgcttacctggctggctcccattggtccttcctcaacctgctctccttggggaggcaattctggaccacccaagacaagctggag

SEQ ID NO: 6823698 - DNA, 75 bp, Homo sapiens
gtatctggaatgtacagccacttcacagttaaaatagttttatattttttaactagctatggattccttggatat

SEQ ID NO: 6823699 - DNA, 94 bp, Homo sapiens
tacattaaatgtactattacaatggagttttttaagcaaaatctagtataatgcctggccctttgtagactaccagtaattgttatttgaagta

SEQ ID NO: 6823700 - DNA, 56 bp, Homo sapiens
ttgcctgaggctttgtaatatcctcactgtagtagagttgttgaaacttcaggtaa

SEQ ID NO: 6823701 - DNA, 57 bp, Homo sapiens
tccatgcttagccacctctatggacataaaatatagcaaggtgttttataggcagga

SEQ ID NO: 6823702 - DNA, 59 bp, Homo sapiens
tttaaaagatcactggctgctttactggggtaagagtggaagccaaagatctgtttgga

SEQ ID NO: 6823703 - DNA, 82 bp, Homo sapiens
gaaatcagtacatcagtttgaaatgttggcaatattcagacagaggagtgtacttccatttcaactgacaaatttgagtttc

SEQ ID NO: 6823704 - DNA, 65 bp, Homo sapiens
acttaaaaatggagactatagcttaattgattgaatactctgacctagcagtcccatgtttgagt

SEQ ID NO: 6823705 - DNA, 80 bp, Homo sapiens
gcccatttattttctccttcccattaccttctgctctctagatgagcaaggcatgcacaagaagggggaggtgggtgagc

SEQ ID NO: 6823706 - DNA, 73 bp, Homo sapiens
cctgtggcttccacgacctaatcctaactcctgcgagtccctggagttaggattaggtcgtggaagccacagg

SEQ ID NO: 6823707 - DNA, 78 bp, Homo sapiens
agcctatgatgaaaactgtattccatcctcatcaacatagttatgggttcagatatggaaacaggactcacgtaggtt

SEQ ID NO: 6823708 - DNA, 58 bp, Homo sapiens
cagtcttagaggtgactgtggagagggcccccacagcagaacttaatttcaaaggctg

SEQ ID NO: 6823709 - DNA, 72 bp, Homo sapiens
cccaacggactgagcgatgggaggaagtgataagtgcagctgtctcttcagcccatggcttcttcctctggg

SEQ ID NO: 6823710 - DNA, 79 bp, Homo sapiens
tatggctgagagcaggtataggaggtatcctggtactcatacttggaaacccttaatttggcatcatcctcagcacatg

SEQ ID NO: 6823711 - DNA, 79 bp, Homo sapiens
cacacgcattctgtcttcgaggctaatagtggctccatgtgtgcagctgcctgtgccctggaaggagagagtgtctgtg

SEQ ID NO: 6823712 - DNA, 73 bp, Homo sapiens
taccaatggagaagaggggattcagacacttctttaggatctttaagttcttttccatttcttaactttggtg

SEQ ID NO: 6823713 - DNA, 85 bp, Homo sapiens
tatgttgatgatcatgttgacttcagtgccatgaataataaaatatttctctcttagcctgaagtttcatgcctctatcagcata

SEQ ID NO: 6823714 - DNA, 74 bp, Homo sapiens
gttttgcagctcttcagtgactgctctgggacaggtaggctgttagagggaggtctttgaggggcttagggagc

SEQ ID NO: 6823715 - DNA, 60 bp, Homo sapiens
caggtccctggctagcactggaacacttcaaagcttctagccccaaagcctggagacctg

SEQ ID NO: 6823716 - DNA, 60 bp, Homo sapiens
ctgggctcatgctggagatgagacaaaaacagacatggtcttcctccctacagagctcag

SEQ ID NO: 6823717 - DNA, 72 bp, Homo sapiens
cttccactggcaagttaaaatgtggtcttcaaagtaatttttaagtacgtttgattaggttgcccctggaag

SEQ ID NO: 6823718 - DNA, 57 bp, Homo sapiens
agcaaagactgggactgcagcaggcaatgcctttgccctcgcaacctattctttcct

SEQ ID NO: 6823719 - DNA, 114 bp, Homo sapiens
agggatgtggtttgagattctgcgtttctatctggctttcagaaaatgtgaggctgctggttagagacccacactttgagtagcaagattcaaatgtggctttaacccatccct

SEQ ID NO: 6823720 - DNA, 63 bp, Homo sapiens
gtcacccactccctgctgctgttgtttctgcttatccccacagcttacagggaggggagtgac

SEQ ID NO: 6823721 - DNA, 78 bp, Homo sapiens
gcccagacatgcattgcaatatccataagaactaaaactaaactctaatggaatttgctcaaatgtagtgatctaagc

SEQ ID NO: 6823722 - DNA, 71 bp, Homo sapiens
gtataagcccattctcagagacacacctcacatctgatgtttggggaccatcaactctgagagttttatat

SEQ ID NO: 6823723 - DNA, 76 bp, Homo sapiens
gcggagttttcttagcttcagaatccatagagtgaaataatgtcctctagttactctggatttgtggaaaatctgc

SEQ ID NO: 6823724 - DNA, 57 bp, Homo sapiens
cagactgggtggcttaagcaacaaatatttctcactgttctggaggctacaagtctg

SEQ ID NO: 6823725 - DNA, 66 bp, Homo sapiens
ttctctcctacccagtatccattgtaagtacaccattttttcttgctgggtcctgtgggagaagaa

SEQ ID NO: 6823726 - DNA, 57 bp, Homo sapiens
ccacatctggtggccagtgctagttagtgggttcttggctagggcacccatgtgtgg

SEQ ID NO: 6823727 - DNA, 107 bp, Homo sapiens
tctccatccatgaggtcattccaaatgaagatttggattccatgtcacagtccaagggctcagtgagcatgccgtccaagtcacttggaagcctctcctggtggaga

SEQ ID NO: 6823728 - DNA, 99 bp, Homo sapiens
gacctttagtcagtgaaagtagcaggtggtctgttgctgctgccatccccaggcggaatacccttcctgcagtagacaacagccgatgtcaccaaggtc

SEQ ID NO: 6823729 - DNA, 85 bp, Homo sapiens
caaagaaagtctaaaagtattttgtcaatgggaatttgttttagcacttccaagatgttattccattgtcttttgactttcattg

SEQ ID NO: 6823730 - DNA, 82 bp, Homo sapiens
gtgatatttcagccaagggaactgagccggagggaatgcattgtctcccacagtctcccatggctcaagaagatttaatcac

SEQ ID NO: 6823731 - DNA, 65 bp, Homo sapiens
gcacgaaggcagatgagaggagcaggcaggggcgagcccgcctgggaactctgatctcctgctgc

SEQ ID NO: 6823732 - DNA, 105 bp, Homo sapiens
ggccgcgggctctgggcgtaggtgcagcttctccggcctggtgcggggccagacggccgccgccggcttagcgggggaacttcgcctagtcctcgggctgcggtc

SEQ ID NO: 6823733 - DNA, 130 bp, Homo sapiens
agtgttccgtggagaaatggaggttgttcacaggaaagcctttcccttgaagaggggcaaaggttgcttcttctcaaggggcaggtggaatttaggttttaactttctttgcaagatccaccccaacatt

SEQ ID NO: 6823734 - DNA, 65 bp, Homo sapiens
tgttcatattcctgtccgctgatcctgaggctgaggaaaggggaagtgggtgtggggaatgaaca

SEQ ID NO: 6823735 - DNA, 83 bp, Homo sapiens
ctgggtaagaatgaagtagatatgaatcttacagcctctccgttctgggatgtgattctgtctccttcactccgggtatccag

SEQ ID NO: 6823736 - DNA, 93 bp, Homo sapiens
gtgtcaaggtgattggagtttctgcattaaatttcaatttaagcataggctttggaattggacatgttgaaggaccagtccagcctttgccac

SEQ ID NO: 6823737 - DNA, 69 bp, Homo sapiens
catattaaatggaaaggattgtggcccaacttttttagcccttggtcacaactctttccatttaatatg

SEQ ID NO: 6823738 - DNA, 78 bp, Homo sapiens
cttgcgatagttcttaagccatgttgctggaaccttcctttcttccctaagcaacagccctgaggttcatgtcgtgag

SEQ ID NO: 6823739 - DNA, 63 bp, Homo sapiens
tctaggttagaacccagaaaagtgctaagttagagggtagctagctctaggttagaacctaga

SEQ ID NO: 6823740 - DNA, 78 bp, Homo sapiens
ggcagaaagagtaaacagccttctcccagctttcttactttccacagctgagagtgtaggatgtttacagtatctgtc

SEQ ID NO: 6823741 - DNA, 57 bp, Homo sapiens
gagtccattgagattggaattttaatcaattcaagagatactgattctcaatggctc

SEQ ID NO: 6823742 - DNA, 68 bp, Homo sapiens
gttgcttctacagtttgtgtggagctggagcccagtctggggcatctactattcaaatgttaagcaac

SEQ ID NO: 6823743 - DNA, 79 bp, Homo sapiens
tatgccagaaggcagaatttatcttccatggactaacattttgtcagaaaaagaaattgataatctggtttctggcata

SEQ ID NO: 6823744 - DNA, 107 bp, Homo sapiens
tcaatttttgtttggagttccgttagatattcctgtatcctttcataaatgactaataggaaagatacaagactaataggaaacacaactttatgcaacttcattga

SEQ ID NO: 6823745 - DNA, 58 bp, Homo sapiens
ctgcatcactggccaagggtgtaaccaaatcctcatccaatgtggtcatgtgtgtcag

SEQ ID NO: 6823746 - DNA, 93 bp, Homo sapiens
gtatctagacctcagtttcctggtttgaagcagcagcactgagatgtgtgccagtgaactgactgggatagcccagggctctgtgtctgatgc

SEQ ID NO: 6823747 - DNA, 57 bp, Homo sapiens
ctgacctgcaccttctctgggttctcactcagcacttctggaatgggtgtgggttag

SEQ ID NO: 6823748 - DNA, 80 bp, Homo sapiens
agttgattgtaaatgaccttttctaattagggagtaattatgactgtgtgatttgaaaaggtaattttgaacttgtaact

SEQ ID NO: 6823749 - DNA, 61 bp, Homo sapiens
aggacatatgcaggagctgcattttaggaagctaagtccagcagtttatgtaatatgcact

SEQ ID NO: 6823750 - DNA, 61 bp, Homo sapiens
tcagagctaaggggagagcaaaagggccggggtccactgtgtaatccttcccttgttctga

SEQ ID NO: 6823751 - DNA, 82 bp, Homo sapiens
ccaagtgtcggtggagagtgttgacctggaagtcctgtgattggcaggggacaaccaacttagcattacaaactgattgtgg

SEQ ID NO: 6823752 - DNA, 85 bp, Homo sapiens
acatgtgttttcctacttatgacggtcacaacttaattaaataaactggaagcttaggtatagcatgaatagggcatatatatgt

SEQ ID NO: 6823753 - DNA, 96 bp, Homo sapiens
tgagtcaggctaacagattatggatatatgtggactggattcaagccgatgagcaagcacttcattagttcattgatctaagttagcaagaaatca

SEQ ID NO: 6823754 - DNA, 62 bp, Homo sapiens
atgtcaggctaacggcatattgcctttttcagtgagggcatggctgtttatagcactttcat

SEQ ID NO: 6823755 - DNA, 59 bp, Homo sapiens
gagttattgagtatagaatgtaaggtctttacatgcctacttctggatattcagaactt

SEQ ID NO: 6823756 - DNA, 98 bp, Homo sapiens
tagattatttcattgtcattaaatgaagggaaagtaggaggatctaattctatccctagattccttaataagtacttcattgtcagtgaaataatttg

SEQ ID NO: 6823757 - DNA, 63 bp, Homo sapiens
ttgctttctgtttttcatataatttggtcatgtttatctagattgttagcttttggaaagcag

SEQ ID NO: 6823758 - DNA, 83 bp, Homo sapiens
gtcttggtgcagtgatgaagtcagttagtgggaaaacgggatttggtttcgcaacttttccagagctgtctcttgcataagat

SEQ ID NO: 6823759 - DNA, 57 bp, Homo sapiens
gtgggccttgtagatcgagtgtttatgattttagacattcttgattcaggccttagc

SEQ ID NO: 6823760 - DNA, 81 bp, Homo sapiens
agggctctgagtgaccagatagaaccactgaatcagctagagtgagtagtgagtacagaggtgatatttgagctagacttt

SEQ ID NO: 6823761 - DNA, 59 bp, Homo sapiens
ccttgaggaaacgggccttagcttgcatgctcgttgcactgagaactgttttctagagg

SEQ ID NO: 6823762 - DNA, 57 bp, Homo sapiens
tcttgcgtaatttgagattgtaaaacctagaaggtttcttgtctttgttatgtagga

SEQ ID NO: 6823763 - DNA, 71 bp, Homo sapiens
gggtcaggctcagcagggcagccctgtcagttcttcaaaagcagggacctcagccctcctgggctttgccc

SEQ ID NO: 6823764 - DNA, 75 bp, Homo sapiens
atctcctctggacgctggggtgggaggcactccttcagggtgaggccgcacgccccggagtgcatgtggggaggt

SEQ ID NO: 6823765 - DNA, 77 bp, Homo sapiens
tgtggctttgcaggcattagcccccatggctgccttcgtcggctgggctggtgttgagtgcctgtggcttttccata

SEQ ID NO: 6823766 - DNA, 55 bp, Homo sapiens
gagatttcactggctttaagcacaggactgtctgtgccaaattccaagagagctc

SEQ ID NO: 6823767 - DNA, 75 bp, Homo sapiens
gaggccctgctggacttggagagatacaagccctaaacagggggctttcttcatactcaagcatccagctgcctt

SEQ ID NO: 6823768 - DNA, 70 bp, Homo sapiens
ccgacttacttggctattttcattcatcattaagtgattgatggatcatagttgctaagagaagacacgg

SEQ ID NO: 6823769 - DNA, 129 bp, Homo sapiens
tgaggttgtctgagaagggtctccgctcctgggtcagcattagaagcctggagtgaaggaggaacaggctacactggctatgctggctcagtactaagcagaaaacgatatcatcaagagcaaaaccca

SEQ ID NO: 6823770 - DNA, 124 bp, Homo sapiens
tgtaagatggtgacagtaaggattaggacagatttgaaggtttgatccttatttataagcttcttgcttgtgaatagaagtcagacctacaatttattaacttaccttcttcactatttctaca

SEQ ID NO: 6823771 - DNA, 56 bp, Homo sapiens
cgacactgtagatatagagttagtgtagtattggtctctagagtctattgtgcttg

SEQ ID NO: 6823772 - DNA, 77 bp, Homo sapiens
gcaaacaagttcaaggcaggtcctgaggttagagctttattagcttcatggtaaatctgcctttaccgggcatttgc

SEQ ID NO: 6823773 - DNA, 81 bp, Homo sapiens
ttctacctgtgcttctcacatcactgttgtctccattgcccacgggagcaacatctttgtgtatgtgagacccaatcagaa

SEQ ID NO: 6823774 - DNA, 73 bp, Homo sapiens
tccttgttctcttggaacacttgctcttagaacccagccactctaatgcaaggaattccaagtagcccgtgga

SEQ ID NO: 6823775 - DNA, 114 bp, Homo sapiens
ataatcaaactgaaggtgaggtcagtggtgggttttgtgtatatgcttatgcatagttttaacaaaaaactacagcatctatacaaataatgtcggcctcatttttgtgattat

SEQ ID NO: 6823776 - DNA, 97 bp, Homo sapiens
gtgcatgtgtatgtttagaaacaggaggccttccagtccagattctggtcttggtatttggaaggaccaggccttgattttgagcagaaataaccac

SEQ ID NO: 6823777 - DNA, 61 bp, Homo sapiens
tctgggtggttctaactgttgatgcgacaacggatcagagaaaagagagatcactgccaga

SEQ ID NO: 6823778 - DNA, 77 bp, Homo sapiens
atgaaaaccttctgtgttatgttcactgccctctccctaacacctagcacagtgctgaacatagaatggacattcat

SEQ ID NO: 6823779 - DNA, 69 bp, Homo sapiens
catattcagctcttggatgtgaactcttagccaagaaactattcaaatattattcaggggctgaatgtg

SEQ ID NO: 6823780 - DNA, 78 bp, Homo sapiens
gatacctatctttagaggaagagaatcttcaaggctattcgatttacttcagagatttctccctctaacagatgtgtc

SEQ ID NO: 6823781 - DNA, 70 bp, Homo sapiens
cccccaagaggcttatagtcttcctgtcactctccttgtgagcatgtaaattggaaagccttcctggggg

SEQ ID NO: 6823782 - DNA, 100 bp, Homo sapiens
cccatccccaggtaggccagtggcaggttgtgtgtggtcagcttcttcttgtttccctcttcccctactcaatagctactgttgctgacctggggctggg

SEQ ID NO: 6823783 - DNA, 74 bp, Homo sapiens
ggtagaagagcagagagtaagaggccatatgaagtcctttaggttaaatggtattctctaactcagctttgacc

SEQ ID NO: 6823784 - DNA, 59 bp, Homo sapiens
gagtaacagcataaatttgtgacttgttgtactggataattcaggagttagttgtgctc

SEQ ID NO: 6823785 - DNA, 62 bp, Homo sapiens
gcatttgcctttcacctgctgcttttcacttcccaaaatacacaggtgctaggtcaataagc

SEQ ID NO: 6823786 - DNA, 67 bp, Homo sapiens
gccctctggaggcctaaggaagtggcagctctttaaatccccagtggccactccgcccccagagggc

SEQ ID NO: 6823787 - DNA, 59 bp, Homo sapiens
tgctgagtggcggcctcacttttatgcattataccagatatgtgagggttcactcagca

SEQ ID NO: 6823788 - DNA, 61 bp, Homo sapiens
tgttgctaggcagcagtataatcagcagccatatagctaattacacactgcttctagaatg

SEQ ID NO: 6823789 - DNA, 69 bp, Homo sapiens
ggtattgtgccagtaatttcttaaaaagtaaaatgaaaattggctgcttaaaattgctgcaacaagacc

SEQ ID NO: 6823790 - DNA, 56 bp, Homo sapiens
tcatagtcagtgggataatgtcagtaaagtgtcttgatttcttccaaagactatgg

SEQ ID NO: 6823791 - DNA, 55 bp, Homo sapiens
gctgcagctttaggatccagtgaactttgcgccactagtaatcctgtgagccagc

SEQ ID NO: 6823792 - DNA, 77 bp, Homo sapiens
tctatcttattgtttctgaattttccacagatttggatgtccatttctacattctgggaaatcagatggtaggtaga

SEQ ID NO: 6823793 - DNA, 74 bp, Homo sapiens
gcttcatcaactgcaaaatgggtataataacacttgtctcaaaaagacaattgcctattcagcagagtgatagc

SEQ ID NO: 6823794 - DNA, 55 bp, Homo sapiens
atactgtagttgtccaactatccagactttccaggtgttggtacaaggacagtgt

SEQ ID NO: 6823795 - DNA, 88 bp, Homo sapiens
tttcagtgttactgataagtttagttaagtaaactctttacacagtttaaggaaatttatatgacagataaaacagtcaatgttgaaa

SEQ ID NO: 6823796 - DNA, 57 bp, Homo sapiens
gctcaggcctcactccatttggagacaaaaattgatagaggaagtgattggtctggc

SEQ ID NO: 6823797 - DNA, 56 bp, Homo sapiens
ctcctgagctgcagccttgtgtcaccaaggataaagcagggacaaagcttcaggag

SEQ ID NO: 6823798 - DNA, 59 bp, Homo sapiens
cagtttatatgtcagagctgtagtgccaaatgctttacaagccttttacatgtgttctg

SEQ ID NO: 6823799 - DNA, 76 bp, Homo sapiens
tcttttttacctcctgatgagagtaaaggaccagcctccctacgtggcctccattgacacaacaggaggaaagaga

SEQ ID NO: 6823800 - DNA, 104 bp, Homo sapiens
cacttagacaaggaggccaagcttttgaacctctccacatcagtcactgatggaggtctgctccaaggcatggtgggagagagcttagcttccaggatgaagtg

SEQ ID NO: 6823801 - DNA, 61 bp, Homo sapiens
ctctttcatcccgggatgcaatattgtttctgatttattatgttgacctgggttggaaggg

SEQ ID NO: 6823802 - DNA, 79 bp, Homo sapiens
ggatcttatatccactataccaccaaaaagtgtgtgtttagtaaatatttattggatggatggatggatggatgaattc

SEQ ID NO: 6823803 - DNA, 72 bp, Homo sapiens
ttggaatggctgatgtaggtgctgtatgtatagttgaggctgtttgtgccctgcctacatcacctttaccag

SEQ ID NO: 6823804 - DNA, 130 bp, Homo sapiens
ataaagtgaaatgtcccatgtgaaatgtagactagctagagaatggcaaagattagatttgggtctgtttctaatacctgttcttaagaacctagctgtatttctctccataattgtttttcatttatat

SEQ ID NO: 6823805 - DNA, 55 bp, Homo sapiens
ggagagctctgggtctccgacacttaggaatgggaaaggaagaaccgagctgtcc

SEQ ID NO: 6823806 - DNA, 77 bp, Homo sapiens
ctcctgaacatggtgctttcaaatttcctgtttcacaacgactgagaggtaatttgaagtgcaaaaatgtgagtgag

SEQ ID NO: 6823807 - DNA, 60 bp, Homo sapiens
tgatttagcgggagcttaatggtgtcacatgtaagaaacactgcagtcccctctgaatca

SEQ ID NO: 6823808 - DNA, 67 bp, Homo sapiens
ggcacagtgagtatttagtacctaaggtatgtttcttggtgctgtatctatacttttccactttgct

SEQ ID NO: 6823809 - DNA, 72 bp, Homo sapiens
cttcctgtcatatgtgcaacccctaccttcatccatgtcattgactgaaatgtatattgccagtgtaggaag

SEQ ID NO: 6823810 - DNA, 58 bp, Homo sapiens
tccttcctgcattgtgccagagttggtcaatgtgaccaacaggatatagtagaaggga

SEQ ID NO: 6823811 - DNA, 68 bp, Homo sapiens
cagagcccaatatagtcagtgtctatatcgttgttaagttctcaatagatatttgctgactgcctctg

SEQ ID NO: 6823812 - DNA, 58 bp, Homo sapiens
tgttatttgtctggtctaaggagggacttccaggccctctgcatacaggcgaggagca

SEQ ID NO: 6823813 - DNA, 68 bp, Homo sapiens
gtgagggagggaaagtttaacactccccaaccccaaggatatcagagtgatagtttccctccagtcac

SEQ ID NO: 6823814 - DNA, 69 bp, Homo sapiens
gagtatggagcaggagcccaggagcccacaaccaaacccacagggattctggctccgagctccatcttc

SEQ ID NO: 6823815 - DNA, 76 bp, Homo sapiens
ctgagaagattgagctaatcttcctaaaccttggtttttctgcttaaaaactaaagataatagttggatcttccag

SEQ ID NO: 6823816 - DNA, 59 bp, Homo sapiens
ttaaaaggtgtctgtagtttcttttagggaccagtaaaggagcattaggcaaattttga

SEQ ID NO: 6823817 - DNA, 78 bp, Homo sapiens
gagactgagccagatgttcccctggaggcctcttgggagccagcaagatggcctttctggcacatttcctctcttctc

SEQ ID NO: 6823818 - DNA, 80 bp, Homo sapiens
acatgaattaaggataactggtctatccaagagatttagttttgggtgatacaatgcagattgttattcccagttcatgt

SEQ ID NO: 6823819 - DNA, 68 bp, Homo sapiens
tgaaatttggaaaatctggttatagagacaaaacaattcaggtttttttggtcagattccaggtttta

SEQ ID NO: 6823820 - DNA, 127 bp, Homo sapiens
gcttctgtttttgactgctctcatattttctaaagtacatcctagtctctttcaactcatggggaaaattgcagagagttagggcccgtatagtatgtgacaccaatcaagacataaataatgaagc

SEQ ID NO: 6823821 - DNA, 62 bp, Homo sapiens
gcccctggcttgggcttaactgtaggttcagagaacagaacggaaagcccacgccctctggc

SEQ ID NO: 6823822 - DNA, 69 bp, Homo sapiens
gaaaccatttgtttctaaaattctgtgaaaaactttttaaaaagaaggctaaagaaacagattggtttc

SEQ ID NO: 6823823 - DNA, 92 bp, Homo sapiens
ggcgtaggtttctgcaggatctgggattttggctgctacttcagggatgggagagaggtagccaggcatcccagatgcttcgagaccttgct

SEQ ID NO: 6823824 - DNA, 60 bp, Homo sapiens
aggtttttggttttgtcttctaatgagaattatcaatgcaagggcaaaatccaaaagtct

SEQ ID NO: 6823825 - DNA, 99 bp, Homo sapiens
tcaggttccagctcctagtcctaacattgtgatgatgtggctattactggacatgtgcataaacatattgttggaggtgctgggaatattggaattaga

SEQ ID NO: 6823826 - DNA, 124 bp, Homo sapiens
cagttcttctgccctaaaatggccacgttttgcctttcttccctcccctacacccaggtttgggccccaggggtagagctgggggttggataagggtaagactgcacaggggccagatgggctg

SEQ ID NO: 6823827 - DNA, 79 bp, Homo sapiens
gctactgcaaatcaccattcttaccccatctcctagattctgggactgggtgtattagtggtgtttctttctcagtggc

SEQ ID NO: 6823828 - DNA, 76 bp, Homo sapiens
cggggcgtgactgcagagtggagcctcggctgggtcccaagcaccccctgccccgccaccgcgcacctgtgccccg

SEQ ID NO: 6823829 - DNA, 72 bp, Homo sapiens
atatgaatacgcggtcatacacatcacaattaaacttttaaaatacctatgtagatgattgtgtgtaaatgt

SEQ ID NO: 6823830 - DNA, 58 bp, Homo sapiens
gcctaatagttaagcaactttttccagataatggaatccttgtttagaattatagggt

SEQ ID NO: 6823831 - DNA, 74 bp, Homo sapiens
acatttgggtgtgaaaaagttctgtgtcacaaatttttgtggagggcaggaagagccttttcacacttcaatgt

SEQ ID NO: 6823832 - DNA, 61 bp, Homo sapiens
gctaagtttcaggggatgccaactgagtactttatgctgtcttgtgtcttctgaagagagc

SEQ ID NO: 6823833 - DNA, 59 bp, Homo sapiens
tttatttctctgtgcttgactttcccatttataaaatggggatggtgataggaaataga

SEQ ID NO: 6823834 - DNA, 55 bp, Homo sapiens
gctggccttctcactgatctctgggtgtgtaaactgggcttatgaggaggcttgt

SEQ ID NO: 6823835 - DNA, 81 bp, Homo sapiens
cgtctgcaagctgccctgtgccagacttcctggaactcttaggatggaggcccagggtggggatgggggaggatgcagccg

SEQ ID NO: 6823836 - DNA, 62 bp, Homo sapiens
ctccagggttccccgatccacttactgatctcagtcctgggtttacaggggatactctgcag

SEQ ID NO: 6823837 - DNA, 65 bp, Homo sapiens
ggacaagaaccactagccacagttcatcactgagggcaccagacactgaggttagatgccttgcc

SEQ ID NO: 6823838 - DNA, 63 bp, Homo sapiens
tcatgacatgtgaattgaatattatttgctgctcactgcaaacattttcagcatatggtatga

SEQ ID NO: 6823839 - DNA, 63 bp, Homo sapiens
gaatctgaactccttgcggtgagggtcttatctcctggcttcactgtaaacaattcaggattc

SEQ ID NO: 6823840 - DNA, 66 bp, Homo sapiens
gaggagcaagttgcctaagtggacgtggatatatgatgatgtcttaacaaggcaactagttccctc

SEQ ID NO: 6823841 - DNA, 78 bp, Homo sapiens
gtatattctgtattggttagtaaataaacataattttatgtcttgtgtttgctaatcttatggtgaagcagaaaatac

SEQ ID NO: 6823842 - DNA, 66 bp, Homo sapiens
gagtatggtgagtctttctcctgccctggggatttcctccagactacaggagaaactcactcactc

SEQ ID NO: 6823843 - DNA, 68 bp, Homo sapiens
ggggagtgattaaagtgaaaaaaatagatgggtgcccacaaagcatctactttacaaatcatctccct

SEQ ID NO: 6823844 - DNA, 109 bp, Homo sapiens
ttgtgagaattcagttgaattggataacttatgtaaagtacaagcctcattacaaacaaactgtaaaaggttgttctttcgttgtcccctttctctagtttcttcacaa

SEQ ID NO: 6823845 - DNA, 77 bp, Homo sapiens
tcatgttggctgctaggtggcagcactccgaggtatctaaagggtagacctggacctgccacctatgagttgtgtga

SEQ ID NO: 6823846 - DNA, 58 bp, Homo sapiens
gtgaaaaagttctagagttgcaagagacctcaaggggtccttcaaatagggctattac

SEQ ID NO: 6823847 - DNA, 75 bp, Homo sapiens
tgtatctcctgattgtttaatgctgtgtaaaaagcacccagaagaaaggcacagtacagtgcagaggaagatata

SEQ ID NO: 6823848 - DNA, 91 bp, Homo sapiens
agagaagaaagactagaatattgaaagttcttgacattgcattaaatgagcaatagttgaaggaactaatgttttaaagtctccattgttt

SEQ ID NO: 6823849 - DNA, 106 bp, Homo sapiens
gaaatgtgtgcagataaagaaagtaagcacccttcagcccagcctggaggaatagtcttcaggcaaggtgaagggtgcaacttccatttcccaaaccccgtatttc

SEQ ID NO: 6823850 - DNA, 76 bp, Homo sapiens
ggtggagctggggatcctgagctgcactggttccaatttggggctgtgcagagcacagggtccctgcagcaccccc

SEQ ID NO: 6823851 - DNA, 66 bp, Homo sapiens
aaagaagtttctgctttcggggttaaacatcaggcttgctgcaactctgccaggcagaacggcttt

SEQ ID NO: 6823852 - DNA, 73 bp, Homo sapiens
ggtgagtgcctggcctggccactccccagaaccccttgaccagtggccagctgtcagcacccttgtacccacc

SEQ ID NO: 6823853 - DNA, 70 bp, Homo sapiens
cttaatcaagagtggggactgtgcctttgcagaaaaataagtcacagaacatccttagctcatgattcag

SEQ ID NO: 6823854 - DNA, 76 bp, Homo sapiens
ggtggcttgctctgtggctcccgtgcctggcctctgctgtcatgtcaggaggcctgggagctgtggaaaggctgtc

SEQ ID NO: 6823855 - DNA, 56 bp, Homo sapiens
tcccagggcttttctcatgctttattctttctggagcctaagattagccctgtggg

SEQ ID NO: 6823856 - DNA, 76 bp, Homo sapiens
tgggaggtggggcctgtcagagatggggagtcagaggtgactcttccgggtcttcttgatgatccagggcctccca

SEQ ID NO: 6823857 - DNA, 57 bp, Homo sapiens
aaaaatcttggagatttatgtgggaaataacatctactgaacatccataagattttt

SEQ ID NO: 6823858 - DNA, 58 bp, Homo sapiens
gaatcgcgcgctcgcggaggctgggccacggcctcggggccttggcgggggccgaatt

SEQ ID NO: 6823859 - DNA, 58 bp, Homo sapiens
ctcccgagttcaagctattttcctgcctcagcctcccaggaagctggaattacgggag

SEQ ID NO: 6823860 - DNA, 68 bp, Homo sapiens
gagagatgctccactgtgcgtggccatatgtctgctgcaatctgtggccttatggatggagaactctc

SEQ ID NO: 6823861 - DNA, 59 bp, Homo sapiens
tcctgtgctgaggatgcagtttctggacagttcagggctctgttggggtcagcactggg

SEQ ID NO: 6823862 - DNA, 81 bp, Homo sapiens
gttctaagatcagcagttatattgaaataaaaatgattactcttttattatagcaagtgtaactgattggttgccaaagac

SEQ ID NO: 6823863 - DNA, 57 bp, Homo sapiens
ttagttgagatttgccatgaattttctggaccagacagtggtggcaatgtcagctaa

SEQ ID NO: 6823864 - DNA, 76 bp, Homo sapiens
gatgcaaagcccctgtgtgtgcgccctccctggtggccctttcatctcattgcacaatgcagagtggagttgcatc

SEQ ID NO: 6823865 - DNA, 79 bp, Homo sapiens
ggagtgacccatcccccaccagaccactgtgtcctgcggagcccgggcaaggaggctggtggaggaagggctgagctct

SEQ ID NO: 6823866 - DNA, 101 bp, Homo sapiens
caatgtctcttttttaaccttttgactttgctgtgaaaccatgggaagttattgactttacaggcacttcaagtatacaatcaggcagaaaaagggcattg

SEQ ID NO: 6823867 - DNA, 87 bp, Homo sapiens
caatggagggaaattcccaggactctgggtgtcttggaagtttccaaggcctgcaactgatcacagatcctggttttcctcccattg

SEQ ID NO: 6823868 - DNA, 62 bp, Homo sapiens
ctgttcaggtgtactcccttggccacttaaagggccccgtggtcacaggggaccaggagcag

SEQ ID NO: 6823869 - DNA, 67 bp, Homo sapiens
ggcagattctgttacaaagcattacagtaacaccccactggatgcaaagcacacacagaatcctgcc

SEQ ID NO: 6823870 - DNA, 58 bp, Homo sapiens
ctgatgctttacgacaaaaaactcagcaagctcagttctttggtcgtaaagctactag

SEQ ID NO: 6823871 - DNA, 65 bp, Homo sapiens
gcatgtacacataggttactgattaataataatagtgtttattgggtacttactgtgtgccatgt

SEQ ID NO: 6823872 - DNA, 61 bp, Homo sapiens
agctgcatgaattgccaattataaacatctgagtttagatttgaaagtaaattcagcagct

SEQ ID NO: 6823873 - DNA, 56 bp, Homo sapiens
tggtatgggtagctctgaacctcaaccatgaattatttcagagtttactcaaactg

SEQ ID NO: 6823874 - DNA, 87 bp, Homo sapiens
agagaaacgtcatttagagcaggatttaaggaagcttgaagataatttcttcatctgtttctctgtagttctgtgagttgtttctct

SEQ ID NO: 6823875 - DNA, 55 bp, Homo sapiens
gatgtgtgcttttcgcagtgtcaattttatgatgctctaagattgagcagacatc

SEQ ID NO: 6823876 - DNA, 62 bp, Homo sapiens
tttctgctcgctctcaatcaggcagacaacatccctctgactgattaagacacggggggaaa

SEQ ID NO: 6823877 - DNA, 55 bp, Homo sapiens
catcagcagtcacatgatgctgtctgtccagatagtcatgatgttaactctgatg

SEQ ID NO: 6823878 - DNA, 80 bp, Homo sapiens
gcacattttttggcatgaattctgtaaacatcaagtgcctgctctgtgccaggcagtattgcagatgctgaagatgtagc

SEQ ID NO: 6823879 - DNA, 87 bp, Homo sapiens
ggctttgtgtttgtgcccattttatacataggtatcaaatgaaccagaaatggttcagttacttgcttgtttgaaatacagaaagcc

SEQ ID NO: 6823880 - DNA, 68 bp, Homo sapiens
tcttcagcacactgcaactattatcagtaattttctgtatgtattgcatagtcgctctgtgcttcaga

SEQ ID NO: 6823881 - DNA, 81 bp, Homo sapiens
gtgaaggctattgcaagtagtccagcctttgggaatttgactgtaagtggacccactgcatggaagcttgcaagcttgcac

SEQ ID NO: 6823882 - DNA, 77 bp, Homo sapiens
ggaatataacagtaggcatcacataatgactcgattgcttttctaatctcagttgaatgctttattgggatattacc

SEQ ID NO: 6823883 - DNA, 77 bp, Homo sapiens
cagtagagccaaggccggggttgcagccaccagtttgctttctgtactgctgaggctccctcgggtctgctctgctg

SEQ ID NO: 6823884 - DNA, 104 bp, Homo sapiens
tggaaagaggtgaactggaaatatttgataaacagcatagtgactaccagcggccactattctgattaccagatattggttcaattggttcacactctgttcca

SEQ ID NO: 6823885 - DNA, 98 bp, Homo sapiens
gctggcagatatctggaggattctgggacttgatattgttctgttattttaaggtattgtagtaagccaggaaacttccccaggcaatccaagtcagc

SEQ ID NO: 6823886 - DNA, 56 bp, Homo sapiens
ctgattctttcttcttgccaggggcacccctctgatgcagggagtgaatggatcag

SEQ ID NO: 6823887 - DNA, 82 bp, Homo sapiens
gcctcctgctagactagcccactgcttgttttaaacacactagaaacattgctctaatgtgggcagtttccaggctcgatgc

SEQ ID NO: 6823888 - DNA, 61 bp, Homo sapiens
acacaggaagtgaatgagagaggattgaataaagtcttggacatattctacttcaatgtgt

SEQ ID NO: 6823889 - DNA, 66 bp, Homo sapiens
aggcatggcttctggggactgctgatttccttgacgataatgccagtcaggcccatagcagtgcct

SEQ ID NO: 6823890 - DNA, 91 bp, Homo sapiens
atatggtggtaacaaacacaatgcctactagtactattttgtggcactgcttcaatttgtgctaaggcaccggtagtcttatccactgtat

SEQ ID NO: 6823891 - DNA, 56 bp, Homo sapiens
tttccttccctcctgggccttcagccaggcctgctgaggaactggaagggaggaaa

SEQ ID NO: 6823892 - DNA, 61 bp, Homo sapiens
ggtgtcaacatcagaaaatgctccatcacacagctcgtagaagcacagcctgatggacacc

SEQ ID NO: 6823893 - DNA, 72 bp, Homo sapiens
tcctgagtcactgggattacaggcacgtgctaccacacccagctaatttttgtatttttagtagagacaggg

SEQ ID NO: 6823894 - DNA, 70 bp, Homo sapiens
aagctgacatctggagtctgggctgttgctaagtagttcagcacagcatgcccactttcagagttaggtt

SEQ ID NO: 6823895 - DNA, 79 bp, Homo sapiens
ctgactctgggagggagggactagcattctctttagtttacagagaggtgaagtcaccttcctatggtcacacagttag

SEQ ID NO: 6823896 - DNA, 67 bp, Homo sapiens
gccatgtaaaggagacctggagagattggaattgagatgcaattaggactccaggactctgcgtggc

SEQ ID NO: 6823897 - DNA, 85 bp, Homo sapiens
gaaatgccaagtggaaccaaagccgaccttgcactagcacgtgatactagtcaaggaggtgcttggcttcactctgctgcatttt

SEQ ID NO: 6823898 - DNA, 81 bp, Homo sapiens
tcaaagatcagatagttgtagatatgtggcattatttctgagggctctgttctgttccattggtctatatctctgttttgg

SEQ ID NO: 6823899 - DNA, 67 bp, Homo sapiens
ggtgagggtaaactaaaacatcttcagacaaacagaaagagaaggtagttatcagcagatcctcact

SEQ ID NO: 6823900 - DNA, 62 bp, Homo sapiens
ctgcagggattgcttctgtatatgcaggccttcttgcatctataggattaggtttactgcag

SEQ ID NO: 6823901 - DNA, 57 bp, Homo sapiens
aggaatagctgagagttctctgctatcgaattccagtagagaaaagaagctgttcct

SEQ ID NO: 6823902 - DNA, 75 bp, Homo sapiens
ggatggcttttccaaggagaacactctgtagtgctaaattagaaggaaattgttcctccttggctaaaactatct

SEQ ID NO: 6823903 - DNA, 79 bp, Homo sapiens
tccaccattgttgaaaatctcttggttcagaagcctcggtttctatcaggggctgaatctccagagattatttggtgga

SEQ ID NO: 6823904 - DNA, 121 bp, Homo sapiens
ggtctctcagcccggcgggccgcggccggagagggggctccctgcttggcggtccagggccgccagcgcgcccaggagcctggccatttccgcagagaaagctccgtgcctctgagagacc

SEQ ID NO: 6823905 - DNA, 79 bp, Homo sapiens
agttaggttcagtttgctcagaaatttgaaatgaaaaaggagcacttatatcaagttactagtaagagaaacctcaact

SEQ ID NO: 6823906 - DNA, 86 bp, Homo sapiens
gaaggtctgttgctgtcttttactatcatttactgtctccctgcttggaaagtatgaattactgataggactagcaatctaccttc

SEQ ID NO: 6823907 - DNA, 61 bp, Homo sapiens
aagacccgtctcctcagggctgggggaaggtcaccagcacaggaacatggagatgggtctt

SEQ ID NO: 6823908 - DNA, 56 bp, Homo sapiens
gcatctgggcccagcaagagttcagaggtttggtagtctctgcttggtccatatgc

SEQ ID NO: 6823909 - DNA, 89 bp, Homo sapiens
ggagaatcacttgaacccaggaggcagaagttgcagtgagccgagtttgcgccattgcactcctgcctgggcaacaagaggaaaactcc

SEQ ID NO: 6823910 - DNA, 65 bp, Homo sapiens
ggttctgctggccttagcaggtctaggcttatcctagaccaattggttctaggccagtagcttcc

SEQ ID NO: 6823911 - DNA, 77 bp, Homo sapiens
agccttttcatacatgagttcatctgcttctcttcattattccatgagctgggctgatgactcatgttttatagact

SEQ ID NO: 6823912 - DNA, 96 bp, Homo sapiens
ggggacactggcttgggtagcagcagggctcgatatggttcttgggattcggctgaattcatcgcgttcctgcatgctgtccccagcagggtctcc

SEQ ID NO: 6823913 - DNA, 83 bp, Homo sapiens
agtgcctggcacatggtaagtctctatagctggtgcaataacacaagcaaatgcttctccaggacttctaagtgccagacact

SEQ ID NO: 6823914 - DNA, 79 bp, Homo sapiens
actttcaacactgagctattacggtggaattaaaatttccatgtagaagtattagtgcagaattacaaaattgaaaagt

SEQ ID NO: 6823915 - DNA, 58 bp, Homo sapiens
gcgagcacccttgagagactctcgaggcgccttgagaagtcgcacacgaggctgctgc

SEQ ID NO: 6823916 - DNA, 89 bp, Homo sapiens
aagttcagtttcttcactgggatttcttcactggaataaaaatagaataagaagtaacttggacaatcccacaagaaacactggcactt

SEQ ID NO: 6823917 - DNA, 90 bp, Homo sapiens
attttgcatattttgcatctttcttagaactttcagtgcatccaggttttattgcattgatcctaaagagaggaaagaagtatgcagggt

SEQ ID NO: 6823918 - DNA, 71 bp, Homo sapiens
ctgtgtagacataacctatacctgtaatgagatcctttttattagctatcaaaggttaatgatctaagcag

SEQ ID NO: 6823919 - DNA, 81 bp, Homo sapiens
aagaggtaaggaagaacgaactttgctaattgttcttggtcaaagacattacctggcatttgatcttcagacaggcctctt

SEQ ID NO: 6823920 - DNA, 55 bp, Homo sapiens
ggggtctggggtgtgtggttctgcccaggtctgcagacagcagtctccaaacccc

SEQ ID NO: 6823921 - DNA, 79 bp, Homo sapiens
gatcctataagctaaacattatggtaggagctgtcagtttgaaacagacatggatttcttacataaaggggcttagatt

SEQ ID NO: 6823922 - DNA, 73 bp, Homo sapiens
acagacctggcgcagtgtgcagaggagtgaaggcaccctgctttggtctcctttgtaccctgggcagatctgt

SEQ ID NO: 6823923 - DNA, 56 bp, Homo sapiens
gtggcccaggcttggcgctggcagtgatgctaggcctgggatggccttgggatcac

SEQ ID NO: 6823924 - DNA, 93 bp, Homo sapiens
aacaggcacctctgaagttatatatgttgaaaatttatgagcagggacagtagaacctacactattttggaatatgtgactttcctccctgtt

SEQ ID NO: 6823925 - DNA, 90 bp, Homo sapiens
agttgaagtgtggagggggaagagaacaatgaacagactttaaaatataaaatgatctctcatgttcttatcacttcgacacattcctct

SEQ ID NO: 6823926 - DNA, 61 bp, Homo sapiens
gggcctgcatgtgcccactctggcttagagaactctaagtagttgaattacatgatggccc

SEQ ID NO: 6823927 - DNA, 71 bp, Homo sapiens
tcacagcagttactagcaatttgtgaagtaccaggcaaactttttgtaattgtaagtgattgcaactgtga

SEQ ID NO: 6823928 - DNA, 129 bp, Homo sapiens
tgccaatatgaatttgtcaatattaattctggaatgctcatataagtttaaaactatctgtcattcttatttgttgacttctgggataggtgttatggaggcattccaagaagaatcagatacatatca

SEQ ID NO: 6823929 - DNA, 100 bp, Homo sapiens
tcagggtcatcatgaagttgctgtgtttctaagtaaaggagctcccttgagaagagatagggaagtttgtgagaaatatgtcagctttcgtggcctctga

SEQ ID NO: 6823930 - DNA, 57 bp, Homo sapiens
tcagtcttcaaatctgagtcgtgcctactccaggctgatgcagccctgagcggctga

SEQ ID NO: 6823931 - DNA, 87 bp, Homo sapiens
gaacatcctcaggaaggggtggggcaggctgtgctgggcaggttgctttccacagtgacacccagtctggcccagcctgaggtgtac

SEQ ID NO: 6823932 - DNA, 79 bp, Homo sapiens
ttccctgacagttctgggaggtgcacgtccaagatcagggtgtcctcagagttggtgccttccgagagctgtgagggag

SEQ ID NO: 6823933 - DNA, 67 bp, Homo sapiens
ctgcctgccaggcctggggtgctgtcagggtgggccccccaggagagccccccaggtgaggtagcag

SEQ ID NO: 6823934 - DNA, 64 bp, Homo sapiens
tcctgtggctgtgtgagggatggattgtgttataaaagacggcagtcagggacaccagctagga

SEQ ID NO: 6823935 - DNA, 97 bp, Homo sapiens
gatggtgtcagagatcaactgaattactggacacctagctggtgttcagagaattggataattcgttgatgtgaaaagaaacctctgatttggtgtc

SEQ ID NO: 6823936 - DNA, 70 bp, Homo sapiens
gatctggtcaacatttactgccctggccctgggaggcctgggggtcggaggtgaaaagtattgccccatc

SEQ ID NO: 6823937 - DNA, 87 bp, Homo sapiens
ggtgaatagtaagagaatatttgcttgagcaatgatatccaataaactttctgtgatgatgcaaatgttctatatttgctgtgtccc

SEQ ID NO: 6823938 - DNA, 115 bp, Homo sapiens
gagctccctaggggcaagtataggtggctaagagttgaagaaatagttttgattggttcttctcaatagaaatgtattttggactagtcactattgccagcctttgggttgagtc

SEQ ID NO: 6823939 - DNA, 102 bp, Homo sapiens
ccacccaagaaatggtttaagccagactgtagagtttgagaagtcactaaaacttgatctccttgctctgcatctgtcttttcttctcatactctcccgtgg

SEQ ID NO: 6823940 - DNA, 60 bp, Homo sapiens
ttttcaggagagaccagaaatgaagatttttatttcaaatctgaaagtttttcttgggaa

SEQ ID NO: 6823941 - DNA, 79 bp, Homo sapiens
gaagtaacagctatttatctttcatgataagggccaactctagagattcatgtcatggtatttaagtaatcattacttc

SEQ ID NO: 6823942 - DNA, 72 bp, Homo sapiens
cccactgattcatctagtgcctctatgttgttgaccttcaatatcattagggtctctcagctgaatattggg

SEQ ID NO: 6823943 - DNA, 69 bp, Homo sapiens
cacttactgagagcctcctgttggctaggcatagttctaggcactagcgacaccaaggcaggggaagtg

SEQ ID NO: 6823944 - DNA, 58 bp, Homo sapiens
ctgatagccttctctgattctcctagtgaaaaatcacaggcatttggaaggtaatcag

SEQ ID NO: 6823945 - DNA, 61 bp, Homo sapiens
ggtggacgtcaatcagtgtcagtccaagcaaactggaggtctgcccatttgtgatgtcccc

SEQ ID NO: 6823946 - DNA, 60 bp, Homo sapiens
tagcaatgtgttgacttggtcatctattgtagtaaaatttgaccaagtgtcaggttgtta

SEQ ID NO: 6823947 - DNA, 63 bp, Homo sapiens
gaagtctgaaccagatggcaaggttctactaagggcaaagaaccttctgacctctcggacttc

SEQ ID NO: 6823948 - DNA, 79 bp, Homo sapiens
tgtataattttcaaactctgtcaataacttgctgggtccaacctgcagaccctggctgcgtgatggatgaagaaatgca

SEQ ID NO: 6823949 - DNA, 66 bp, Homo sapiens
ctggcttgcaggagatgctgatgctgctgaccaaacattgagtatcaaggatctccagcaccctag

SEQ ID NO: 6823950 - DNA, 62 bp, Homo sapiens
ctttatttccagcataggcttattgaaacctaccaggtgtcagtactctgctgggtatagag

SEQ ID NO: 6823951 - DNA, 83 bp, Homo sapiens
agggaattgtggaaggcactagcaagctgcctggcccagagtgggcatctggtaatcagcggctgctgctgctactgttctct

SEQ ID NO: 6823952 - DNA, 88 bp, Homo sapiens
acttggtttatgagcatcagaaaaacataatgttattatggcagaagcaaagtgataaatgtttttcattgccaacatggacttcagt

SEQ ID NO: 6823953 - DNA, 61 bp, Homo sapiens
ctgtgtcctgtctcctaaggtggattttttttcagctccagagaaggcgagaggaacatag

SEQ ID NO: 6823954 - DNA, 55 bp, Homo sapiens
tttgtcatcagttattaatatgaggtcttttgcctcctgtcagtaaagtgacaga

SEQ ID NO: 6823955 - DNA, 67 bp, Homo sapiens
caggtctttgatggtgatccagtggcaggaggagctcagctggaatgggaatcaggaaagagacctg

SEQ ID NO: 6823956 - DNA, 73 bp, Homo sapiens
ggttgaaccatatgaaattgacaatttgtgggtcaaaaatacttgaacattggcaatttcatatttttcaacc

SEQ ID NO: 6823957 - DNA, 61 bp, Homo sapiens
gtctggcgttcagcaagtggttttcaaattatttaatgaacacttgcatgaacagctacac

SEQ ID NO: 6823958 - DNA, 82 bp, Homo sapiens
cccaggggctgcatttccatgttatcttgcagacttgtacagttcccaagcagtggcatggaatgagaatgtggtcttaggg

SEQ ID NO: 6823959 - DNA, 77 bp, Homo sapiens
gtcatgtaactaggaagtggcaaaactggaatttgagaccaaatctctccgaaagagcctggcttctagctactgac

SEQ ID NO: 6823960 - DNA, 104 bp, Homo sapiens
tgggcagctgcaagagaagtggaagaacgctgctatagtgaagagagctcaggaccaccaagatctgggttctcctcttagctgtgccacttcctagctgtgca

SEQ ID NO: 6823961 - DNA, 64 bp, Homo sapiens
tggtgatgaggaaatgcctgctgagttgtgtaaagattctaaaatggtgtttcttcattttcca

SEQ ID NO: 6823962 - DNA, 112 bp, Homo sapiens
ggctccctggggaaaatgcagagggccacagccattccagggaggctgaggctaagtgtgggcagccttgaatgcgctgcattggtcctaggcactcagtgtccggggcgcc

SEQ ID NO: 6823963 - DNA, 60 bp, Homo sapiens
ctggcagggctaaaggccacgttctcacactgctcctggaggttggccaggccccgccag

SEQ ID NO: 6823964 - DNA, 76 bp, Homo sapiens
gctccccttggtcctcctgggaaccagggtgccccttagtggtggtggcccaggagaacccgaccaaggcaggagc

SEQ ID NO: 6823965 - DNA, 69 bp, Homo sapiens
cctcaagattaaatgctttgtttgtgtttctaggtctccaagcagctttgaagtatttggtctccgggg

SEQ ID NO: 6823966 - DNA, 58 bp, Homo sapiens
gtctgggacatagatcagcctttttcaatgaaggagaagtcttgccctattcccagac

SEQ ID NO: 6823967 - DNA, 79 bp, Homo sapiens
cctgctctggggcaggaggcagaggatgcccagtgagcattcagcggaccccgggttgccctgcctcaggccagcacgg

SEQ ID NO: 6823968 - DNA, 56 bp, Homo sapiens
tcctttcttcttctgcccatggcctccttcctgctatgctgggcttggagaaaaga

SEQ ID NO: 6823969 - DNA, 55 bp, Homo sapiens
gggcaagcagtggctaccagtaggagatagctccacatgggcctgaggcttacct

SEQ ID NO: 6823970 - DNA, 63 bp, Homo sapiens
gagaggccttcttgatctaaacactgcctccataggcagtaactaggacaaggaggaagactc

SEQ ID NO: 6823971 - DNA, 76 bp, Homo sapiens
tagttatgtctgcatgcatattttagcctcaaagagtgtgtctaattaggtacttttgatgtgtgagacataatta

SEQ ID NO: 6823972 - DNA, 77 bp, Homo sapiens
atgtaactgctattgatgtcacactttgtgaagtagtctttgttgcttaaaaagggtgacatctagtggctaaacat

SEQ ID NO: 6823973 - DNA, 72 bp, Homo sapiens
ggtcaacttagataagatggagctacatttctcagacccccttccctgcatagttccatattagctttggcc

SEQ ID NO: 6823974 - DNA, 56 bp, Homo sapiens
tagaaagcagtatctccattttttgctaatatagggctgaaaaatactgctttcta

SEQ ID NO: 6823975 - DNA, 79 bp, Homo sapiens
cagtggtctgttctcattgttttcatccagaaagacactgataataagatttcctgagtgccatgagagcacccctctg

SEQ ID NO: 6823976 - DNA, 72 bp, Homo sapiens
gaactttgcttgttatttttgcccaaggtaggcttttaatatcctctgccaagatgacaggtaagaaagttt

SEQ ID NO: 6823977 - DNA, 60 bp, Homo sapiens
cagtcagtgccaccagccactgccttttgctaacctcagaggctggaaggggcactgctg

SEQ ID NO: 6823978 - DNA, 69 bp, Homo sapiens
cttctccttttctgtgtctcggcctctctccagagggataaggctgctggggacgtgggagaggagaag

SEQ ID NO: 6823979 - DNA, 70 bp, Homo sapiens
ggcgggtggctaggcccaacggcaggaagccgacgctatcctccgttccgcggcgccgggtccgccttcc

SEQ ID NO: 6823980 - DNA, 75 bp, Homo sapiens
atatgcagctgctgaggaaggggttggattatccaataatatagccagtcctagttctaccttacatgttgctat

SEQ ID NO: 6823981 - DNA, 67 bp, Homo sapiens
gacgtggcaggcagtttcccaaggactaggaaagacattcacagtggcacaactgtttagctacctc

SEQ ID NO: 6823982 - DNA, 69 bp, Homo sapiens
gcctctattggaaaatatccccccaaacagtgctagttagtgtttctgtctgttttctacatagagtgc

SEQ ID NO: 6823983 - DNA, 66 bp, Homo sapiens
atcactgaacagtacttaagggctaattggcttaatacatgtaaagctcttagtactgttcctggt

SEQ ID NO: 6823984 - DNA, 73 bp, Homo sapiens
ctatcctattattgaccctttcattattctcattgccatggtgtagaaaagggaagggtttctgcaggagtgg

SEQ ID NO: 6823985 - DNA, 71 bp, Homo sapiens
aagctcagcagccaggccctgtcaatagctgtgaataactgacttctgggcattcagctgcacatgagctt

SEQ ID NO: 6823986 - DNA, 59 bp, Homo sapiens
ccttggagaagacagtgccaggaagaggagttgcttggcacatgacattctccataagg

SEQ ID NO: 6823987 - DNA, 70 bp, Homo sapiens
tctggagttgcatgttttggctaactcatgccggcatgtatactgcaaacaaaacctgcttaacttcgga

SEQ ID NO: 6823988 - DNA, 65 bp, Homo sapiens
atggggctggcaaacttttaatgtaaagggccagatgatcagtatgttaggtttgcaagccagat

SEQ ID NO: 6823989 - DNA, 79 bp, Homo sapiens
tcttgcatgtggtaggtcgttctataaatacttgtcggatgaatttatggattgaattaacacctcccatttgccagga

SEQ ID NO: 6823990 - DNA, 71 bp, Homo sapiens
tgggcggacccaggcagtgctgatccctcagcttagatacctgctggggctcatgcctgctggaaccctca

SEQ ID NO: 6823991 - DNA, 55 bp, Homo sapiens
cccacctttttcctcaggtccagctcccctgactggaggattcctggaaggcggg

SEQ ID NO: 6823992 - DNA, 90 bp, Homo sapiens
gggagcttgttaaagatgcagattccatcaccaatccagagattcttattcagtagatgggctatgagagctgcattttaacaaggaccc

SEQ ID NO: 6823993 - DNA, 67 bp, Homo sapiens
ctattatcagctagataagtcaagcaagccctcttggttgaagtgatatttgagctgagaattatag

SEQ ID NO: 6823994 - DNA, 71 bp, Homo sapiens
gtattctggtggtgtgaaaagtgatatggttgagatacccagcacataatacatgttccacttatgaatac

SEQ ID NO: 6823995 - DNA, 84 bp, Homo sapiens
agattgttaaggaagtctaggatctatgtgtaattttactacttaaattttatacatgtgttttgagatgagttttaataaact

SEQ ID NO: 6823996 - DNA, 69 bp, Homo sapiens
ggccttgggtataggtgggtatgtaacaaggaaaatacataaataaacaatcacctgcattctagggtt

SEQ ID NO: 6823997 - DNA, 107 bp, Homo sapiens
aagaaaaccaacagataacaagcatactaaagtatagaacttagtttttttagtgagacacttagtttacttaagtggaatgtttttgtaaatgcagtggttttttt

SEQ ID NO: 6823998 - DNA, 58 bp, Homo sapiens
ttcctcagagggcgctggggaaagagaggggacctgatttcttcgaccctcggaggaa

SEQ ID NO: 6823999 - DNA, 60 bp, Homo sapiens
ggtctggaacccctcaagtgacatgggaacactttcccagcattatcatggggtcaggcc

SEQ ID NO: 6824000 - DNA, 56 bp, Homo sapiens
gggtgaggtaattagcatggatttgcaattctgcagctcgcttttgttccctccct

SEQ ID NO: 6824001 - DNA, 62 bp, Homo sapiens
catgtacttatcccatgagaagaagaaaataaaatctttttcattcaaaaggaaaagtcatg

SEQ ID NO: 6824002 - DNA, 61 bp, Homo sapiens
tcccagccttccttgtggtgaatcacctgagaatgcaggatgtgactcagggagtttgggg

SEQ ID NO: 6824003 - DNA, 84 bp, Homo sapiens
tcagtatttctggatgctctgaagccccaaatagtccggaaatcctctgagattgtgtgcttcagaaattcagcaggctgctga

SEQ ID NO: 6824004 - DNA, 108 bp, Homo sapiens
ggggtggggaggctgagagtggctcccaaaatccctccccaggcaagtcctggatacaagccaggccagcctcaggcagggaccgcacactcaggcctctctcacccc

SEQ ID NO: 6824005 - DNA, 71 bp, Homo sapiens
aagcactctactatcagatcaatcaaagattctgtgagtgaatttattggtttgcatggtgaagcaagctt

SEQ ID NO: 6824006 - DNA, 101 bp, Homo sapiens
ctgtggtccccttggctgaatagcacaggcgacccctaggagcaacaggccaaggtgtgtgagcctgctggtcggcgatagtgcttcagcgggggccaggg

SEQ ID NO: 6824007 - DNA, 129 bp, Homo sapiens
gcatcatatttcttaatttgtcacagcctgagaagtgacattattgaatgacagtaggagcttgaatattgtgctttgaaatgccattgaggataccattattcatgtgacagccctgagaagattagc

SEQ ID NO: 6824008 - DNA, 69 bp, Homo sapiens
tctcagagtttctgtggccaggagtctgggcatggcttagctgagttctccactgcagagtctctcagg

SEQ ID NO: 6824009 - DNA, 60 bp, Homo sapiens
gagccctcagggctggaaagccaggaagactcttccttgggagcccagccttaagggttt

SEQ ID NO: 6824010 - DNA, 55 bp, Homo sapiens
aatggctgaatgagtgaactagcctccccagggtagctcatctctgctagttatt

SEQ ID NO: 6824011 - DNA, 60 bp, Homo sapiens
gctttttgaaattagggaactgacttgatgaacagccccagttaactgattttataaagt

SEQ ID NO: 6824012 - DNA, 84 bp, Homo sapiens
ggtgtcataaatttagcagccagagtctgaacattagggtggcataatatatcctatgtctccatgtgttgttagtttatcact

SEQ ID NO: 6824013 - DNA, 56 bp, Homo sapiens
gctggggtcttcctgtaaaacaactcaggtcccaaacctacccaggaagactcagc

SEQ ID NO: 6824014 - DNA, 65 bp, Homo sapiens
aggccaagtgaacaatgctagtagaatacattaagttatcttccttcagtgttgttcattggttt

SEQ ID NO: 6824015 - DNA, 102 bp, Homo sapiens
tctcattggatgaagtactgctgattgtataggggttattaatacttaataatattgttttgactcctacataaaacaactatgtattttaggccagtgtgg

SEQ ID NO: 6824016 - DNA, 69 bp, Homo sapiens
gttctcccacaactgatctgcttagggacagtgtccctggtgccctgggtcagcctttgtaaacagaac

SEQ ID NO: 6824017 - DNA, 76 bp, Homo sapiens
cttgtttttcttcaggctacatttgctctgagaagccatgagctggagctttctggagcacaagtcagatgacaag

SEQ ID NO: 6824018 - DNA, 66 bp, Homo sapiens
gtgaagcctcaagaagagggagacctacagcctcaggaattgtaggcccttttccttgtcctttgc

SEQ ID NO: 6824019 - DNA, 103 bp, Homo sapiens
tgttttgctcaatgataagtgctcagtgccgggaacacagtagataaccaataaattatttgctaaaatgtattgggattggcagacattaaaatccaaaaca

SEQ ID NO: 6824020 - DNA, 68 bp, Homo sapiens
gaagtaggttacttgtccaaggccacccagctaataaggggtaggaccagcaatcaagaacctacctc

SEQ ID NO: 6824021 - DNA, 55 bp, Homo sapiens
ctgacaccacaactagccattgaatgagcctctcaggtgctgtgtgtggtatcag

SEQ ID NO: 6824022 - DNA, 76 bp, Homo sapiens
gaggcctataattttccagtaattagactttcaggcacatatgtcttgtggctcgaatatgattctgttatacctc

SEQ ID NO: 6824023 - DNA, 114 bp, Homo sapiens
tcctataacttttcttcatgtgggtttctaccgaatataaatactgagtttggaatttggcttcaagtcgtatatttgggagggaacagcaggtcacatagtgaaggcatgggg

SEQ ID NO: 6824024 - DNA, 60 bp, Homo sapiens
ggtgggggagagaggcattctttctgttcctaggcagggatcaagtgcccttcccctgcc

SEQ ID NO: 6824025 - DNA, 62 bp, Homo sapiens
ggggcagatagcagaggccttattacgtatttctctcttgtgataaaactctaatctggcct

SEQ ID NO: 6824026 - DNA, 56 bp, Homo sapiens
cctcggccctttctcgggtgggagagccctgcctacccaggcttagagggctgggg

SEQ ID NO: 6824027 - DNA, 60 bp, Homo sapiens
atgctgaggacaaagagatcaagcagggtatagagctgctgatcctaaagtctgcagtgt

SEQ ID NO: 6824028 - DNA, 69 bp, Homo sapiens
atggagactctgctaagaatataattcaatcttaaggacagagttaatccttttttgacagagttgcat

SEQ ID NO: 6824029 - DNA, 89 bp, Homo sapiens
tactatctgatatgacacagtgtagttaatgtgacatttataaaaacaaatgtcctgttaaatagattgtattagtcatccagatagtg

SEQ ID NO: 6824030 - DNA, 85 bp, Homo sapiens
ttctgcagattgacaaagcccatctttctgctaatgactttagagtcaaatatgagacagaactggcctttcatcagtctgtgaa

SEQ ID NO: 6824031 - DNA, 65 bp, Homo sapiens
atccccaacctctctcccctgtgaagagcgtacgtaagcatctacatctcagtgggttggtggat

SEQ ID NO: 6824032 - DNA, 111 bp, Homo sapiens
tctgtctgtaacatcctgctcccccaggctcagctgtcatgtgacaagatgctgtccttggagatggacagattttaaatgacactccctaagcaggcttgcggaaacaga

SEQ ID NO: 6824033 - DNA, 128 bp, Homo sapiens
acaactaaattccccagttagaaactagttcttttccctccttcatctcgtgggaatgtataactatatgtgcaggtgcaggaagggggctgagagttccttctctaaaagactcctggggtagttgt

SEQ ID NO: 6824034 - DNA, 60 bp, Homo sapiens
gggctctggacccaggcaagagcctgatggttattctgccactgggtctgcaatgagccc

SEQ ID NO: 6824035 - DNA, 88 bp, Homo sapiens
tttggtctgagctcaaatgattggctcctgattgtcctgtggtctagggaattcctggggaagtcggagcctgagcaccagcactgag

SEQ ID NO: 6824036 - DNA, 110 bp, Homo sapiens
acgcaaggaaatgattcgatatagggtgggaggctggcagggtggggtcctgctgaatcctagaaggctcctatcgctttcagcaatcaacttttctcatttgtttgtgt

SEQ ID NO: 6824037 - DNA, 74 bp, Homo sapiens
agaataaaggataatccattagactggatgcatttagtttcatgaacaacttatggcattgtccttattgttct

SEQ ID NO: 6824038 - DNA, 64 bp, Homo sapiens
tgctgggtcagtgagagcagggagtatgccagacaagagagcttcctgcggccacaagcctgca

SEQ ID NO: 6824039 - DNA, 78 bp, Homo sapiens
gcacacatttaaatgaagactgactaaataaaaggtaccacacacttcttggttggtttcattccattgcatgtgtgt

SEQ ID NO: 6824040 - DNA, 58 bp, Homo sapiens
tcatttgcctgtctctatttcagcaaaagttaaggctgaaaattaagcagatgaatga

SEQ ID NO: 6824041 - DNA, 71 bp, Homo sapiens
gtgctccataactgttagctattatttttcctataacattttataggaatgataatagtaaagagtagcat

SEQ ID NO: 6824042 - DNA, 61 bp, Homo sapiens
tcacataacccagaacagaatttttcagaggaagaaactgaggcttggataggttatgtga

SEQ ID NO: 6824043 - DNA, 91 bp, Homo sapiens
gctctgagttattttgacctttgagtgctctcaggcaatattaattatcaactagtgtgagtgactctgtgaaaggcagaattatgtgagt

SEQ ID NO: 6824044 - DNA, 73 bp, Homo sapiens
gagcagatgggttgggggtgggagtggtgagaaagtggagcccatcaaatccaggccccagaccgtactgctc

SEQ ID NO: 6824045 - DNA, 76 bp, Homo sapiens
tctttcatgggggcctctcatcattatcgctttgtccaccaggatggtttccagagagatgccacctcttggaaga

SEQ ID NO: 6824046 - DNA, 62 bp, Homo sapiens
gaagagccaggtgtcgctgtggtcctctgcatctgggccgccgccgcgactctttggccttc

SEQ ID NO: 6824047 - DNA, 57 bp, Homo sapiens
cagaaatttgatctgggacttctcagccttcagaactgtgagtccaataaatttctg

SEQ ID NO: 6824048 - DNA, 73 bp, Homo sapiens
aatggcctgttagagttgtctcaggttagggttagatgatcctgccttcatactgctgtatcaactggccatt

SEQ ID NO: 6824049 - DNA, 89 bp, Homo sapiens
cagacataccacagagatatagcacagtgcacgtgttctgtgcattattatgctaggagcacctttgtctatttctctaggtttagctg

SEQ ID NO: 6824050 - DNA, 111 bp, Homo sapiens
aatgtagtaattgcacaaaaattcaaaatcagagtctgattttaaggtttctgtgaacctgagccattgggtttggtttttctgtttttgagcccgttaagtcactgcatt

SEQ ID NO: 6824051 - DNA, 107 bp, Homo sapiens
atgagggaaattacagcaaatctgagactgagtttggattttagtgcttaagaaatacccaaagggaatgaaataaatgcctagttacagattttgtgtttttgcat

SEQ ID NO: 6824052 - DNA, 57 bp, Homo sapiens
ggaaaaggggtggactgtgatggctgacttcagccttccacccagatccccttgacc

SEQ ID NO: 6824053 - DNA, 95 bp, Homo sapiens
aagtaaataggaagcaaaaatggagtaatattaacatgttaggtctatgtggcaagtaacttgtgttacattactctttgtattttaaaatactt

SEQ ID NO: 6824054 - DNA, 61 bp, Homo sapiens
ccctgatctccaggaaatgtctaatttacttgaagtaagacccagtcacttgagaaaaggg

SEQ ID NO: 6824055 - DNA, 129 bp, Homo sapiens
attgctctcatttttaatatgacaaggatagattagttttgtggttgtattgtttttaaaggaaatagatacttataacaattgtgatatccttgctgaaacgtttttcataaaaaaaagacaagtaat

SEQ ID NO: 6824056 - DNA, 71 bp, Homo sapiens
ggaaattagatgaccaagctcggaacggagcatcagggccctcgtttgtaagcttagttttcttttattcc

SEQ ID NO: 6824057 - DNA, 70 bp, Homo sapiens
tgacctgggagggactgagtgacctgttagagctagtgcaggctcagaaactcagtaattccttggtgca

SEQ ID NO: 6824058 - DNA, 77 bp, Homo sapiens
ctaccagtcttgtctgagggagtcatgattaaggaagcctccttaggctttgttcagcttcctgggtgagaaggaag

SEQ ID NO: 6824059 - DNA, 89 bp, Homo sapiens
gaggtggttaggcatctcataaggtagattacttgtttggattctaaggggtgcataagtattccaccttgcttgagatgatatccctt

SEQ ID NO: 6824060 - DNA, 66 bp, Homo sapiens
cagagggaatttgcaggttgttttgagaaagatttcttaaagcaatttgagcaagttctatctttg

SEQ ID NO: 6824061 - DNA, 69 bp, Homo sapiens
cacattaaaatgatggagaacaaagaaaatctggcccagtttttctagaaatctcctccttaaggtgtg

SEQ ID NO: 6824062 - DNA, 75 bp, Homo sapiens
ggaagtttataattttttgcttttgtgaatagtttgctaaataatttatgatgcaaagaaaaggtggtgacttcc

SEQ ID NO: 6824063 - DNA, 70 bp, Homo sapiens
ttggaggtcaaatggagggctgggtggggccagctcaaaccttctatccccagctcttttgaaattccag

SEQ ID NO: 6824064 - DNA, 78 bp, Homo sapiens
ggaaagcggcaggtgattcagcaatttttgtagcacgacaggttgtgcacaaagtgttttctgaaggcctgcacttct

SEQ ID NO: 6824065 - DNA, 84 bp, Homo sapiens
gacagtgaagttttgtgtgtggtgatacaaagcgatagaagcttttcagagcacaacatgctttaacctagaaatttcactgtt

SEQ ID NO: 6824066 - DNA, 63 bp, Homo sapiens
gcaccactagagtagagatggttttttggcttactattccatttccagtgtctaggatggtgt

SEQ ID NO: 6824067 - DNA, 75 bp, Homo sapiens
tgggaataaagatatggtttgaattttgtgaatccttacctgtttcacaagctcagatccctgtctctattttca

SEQ ID NO: 6824068 - DNA, 60 bp, Homo sapiens
atgttcagcttgcagtgggggaagatagaaaatcgaaattcacatgacagggtgaagcat

SEQ ID NO: 6824069 - DNA, 85 bp, Homo sapiens
cacccatatgtccctccagtgtcccagtggggagttagaggaatggttctcatctccaggaaagacactggactgataccaggtg

SEQ ID NO: 6824070 - DNA, 60 bp, Homo sapiens
gcagacctgaccttgggcagcaactaggaggaagacctgctgagctggggtgaaggttgc

SEQ ID NO: 6824071 - DNA, 84 bp, Homo sapiens
tattttgaaacctatttataacttctagataagggtacagccatccctccctaggacatggttttaagtagagttgaatgaata

SEQ ID NO: 6824072 - DNA, 68 bp, Homo sapiens
cagagaacggggaggaaggaggctcactacccaaggaggtgagctgatggcatccctgtttcttcctg

SEQ ID NO: 6824073 - DNA, 66 bp, Homo sapiens
ggaagccagcagtggagaaaggagctttttggaaaggaacattctggaactatactgttggtgact

SEQ ID NO: 6824074 - DNA, 95 bp, Homo sapiens
cagaaatctagagtgggcatatgaagtctcaagaagtgcttgccaaattgggtttaggacccctgaggcctcactgtagtccctcctggactctg

SEQ ID NO: 6824075 - DNA, 84 bp, Homo sapiens
gtgacaagtcccatgactttgttttcctcgtttggaaaaacctccagttggtggttccagagctgagcagtcattctacttcac

SEQ ID NO: 6824076 - DNA, 104 bp, Homo sapiens
gccatggagagtcctagggagtaaatgatgctacagttttcccatctggaagaaggtggggtgagctttaggtaaacataagacacttattggctctaagtggc

SEQ ID NO: 6824077 - DNA, 56 bp, Homo sapiens
ctctgcaatctgagcacttgtaagaaaactggaaagggcacagtcaggttgcaggg

SEQ ID NO: 6824078 - DNA, 69 bp, Homo sapiens
ctggagcatccatgcccagggtcacctagcccagggacaccttagctacaacccagggttgatgtccag

SEQ ID NO: 6824079 - DNA, 70 bp, Homo sapiens
aagataacatcaaactgcattttctaatatacttaaaaatagtaggttgtgtgtttttgatgtttatttt

SEQ ID NO: 6824080 - DNA, 63 bp, Homo sapiens
gcgccagggccagcccactagcgaggaggaggaagccgcctcggtgggagttggctgaggggt

SEQ ID NO: 6824081 - DNA, 129 bp, Homo sapiens
tctcagatataagccagatgctctcctgtggattgcatattaatattcacagatagaaggttctgtttagacagaagcgttccatttgatgggttatatatgcagtaagcagagaaactggcttagggg

SEQ ID NO: 6824082 - DNA, 66 bp, Homo sapiens
ctcatttctaactactgctgcagcattttggtaaaaacctgtagcagtttgttacactggggtgag

SEQ ID NO: 6824083 - DNA, 75 bp, Homo sapiens
tgctacttctaagtattcagatagttgtgagtcaaactgagtcagtaatgctgtctggatatcttggaattagta

SEQ ID NO: 6824084 - DNA, 67 bp, Homo sapiens
ttcacaccatgctttgtggaacccggggtctagagaggtgctttgggggctgcagtgcgtgtgtggg

SEQ ID NO: 6824085 - DNA, 76 bp, Homo sapiens
tagctatatcagtatttggcttgattcatgttcaatattgacaacagcatgtctagttaaatactgctcgcagctg

SEQ ID NO: 6824086 - DNA, 56 bp, Homo sapiens
taatgatgctagatttatctgggtatttttgccttttacatcacatggcattatta

SEQ ID NO: 6824087 - DNA, 77 bp, Homo sapiens
tttggagatgaagctgtttattttagcagcccctaaacaggcttatgctgctgcgaattgcagtctgttctaccgaa

SEQ ID NO: 6824088 - DNA, 76 bp, Homo sapiens
tcactctgttgcctaggctggaatgcagtggcatgatctcggctcactgcaacctccgcctcccaggttcaagtga

SEQ ID NO: 6824089 - DNA, 58 bp, Homo sapiens
ggactagaagtatgtttctgacatattccaaatggaatacattcatcacttttggtcc

SEQ ID NO: 6824090 - DNA, 80 bp, Homo sapiens
gtagatgggcctgttcctatgctggttgagttcttacggtgagcttctattggctgtagtagagaagagacggccactac

SEQ ID NO: 6824091 - DNA, 118 bp, Homo sapiens
cagcctagtgggtgagttcaaagtggggaaaaatgagaaactcttggctccattttctctctggagccaccttcttatttgtccttatttaatgacacatgtggtttcgccccggctg

SEQ ID NO: 6824092 - DNA, 95 bp, Homo sapiens
tagtcactgtttctcacttgcacttttccatctctcacagggaaagcctctagatctggggttgcagaggtggatgcaattggggaaagtgagta

SEQ ID NO: 6824093 - DNA, 67 bp, Homo sapiens
ccacatgatgaggaagctgaacagtaaattcaaccttgctgcatttacagcgtctacagctatgtgg

SEQ ID NO: 6824094 - DNA, 78 bp, Homo sapiens
cgtctttagaggttacattggtagcctgaaacttcagatttttcttgatttttcatgtggcgatgtctctggaagatg

SEQ ID NO: 6824095 - DNA, 75 bp, Homo sapiens
tgaattaggtatgattctcatttcaccaatgatgagactatcaagtaacttgtaagtgaaagtctgcctgactca

SEQ ID NO: 6824096 - DNA, 60 bp, Homo sapiens
ccccgctctgcgcgggaggtcgaggcaccccgctcacgccctcctgcccgcaagctaggg

SEQ ID NO: 6824097 - DNA, 72 bp, Homo sapiens
ctgggagagcccccgccttgctgggccaggggtaaaataaggctcctgtctgaaggcagggggatggttgag

SEQ ID NO: 6824098 - DNA, 57 bp, Homo sapiens
cagacagggtgggtttctgggcctcgggctgataagaagacccatcctgatcctctg

SEQ ID NO: 6824099 - DNA, 58 bp, Homo sapiens
gcccaggctggagtgcagtggtgcgatgtccgctcactgcaagctccaccctccgggt

SEQ ID NO: 6824100 - DNA, 76 bp, Homo sapiens
atttgaaggtttatgaaggatagggcaaaattttctaaggaaagttgcatcctatgacctcaggctgacttcaagt

SEQ ID NO: 6824101 - DNA, 59 bp, Homo sapiens
actagggagtttatgttgtattccaaaagcatgtggagctacaagggagacttttttgt

SEQ ID NO: 6824102 - DNA, 66 bp, Homo sapiens
aacaacacccatatgcactgtttaggctcttgcagtactgcctagtatatgtctatggttgtagtt

SEQ ID NO: 6824103 - DNA, 91 bp, Homo sapiens
cctgctgtgtaccaggcaccaggctgggctccggagataaagtgatggattttataccgactctgcctgtgagtgctttcatttagcatgg

SEQ ID NO: 6824104 - DNA, 60 bp, Homo sapiens
gggtggatggggagatgtggagagaacagatgtggagctccccagtgtcctcatgcatct

SEQ ID NO: 6824105 - DNA, 59 bp, Homo sapiens
gaaaatgcctctggcattaaacaaagcctttttatatttaatgccagcccgggattttc

SEQ ID NO: 6824106 - DNA, 67 bp, Homo sapiens
ctctgtgtgggatcttgttttgtctgtcagccttggcttcagagccacttcaagtctaacagcagag

SEQ ID NO: 6824107 - DNA, 81 bp, Homo sapiens
taacaatgatactccttgcagctctctgaaggttgcagctgcaggctgagcctggcggaagcagcgtggaatatcaagttg

SEQ ID NO: 6824108 - DNA, 60 bp, Homo sapiens
gcctggccacatgtgtgctgagcatggggacaccctgcctggctgtgtgtgtgctgaggc

SEQ ID NO: 6824109 - DNA, 103 bp, Homo sapiens
tttagccttcttcatacatacttttaacctgtgaacctgtttaacaattaagcacatgtgggaactgtaaattttggttgcaggtaaaagagagaaggttaaa

SEQ ID NO: 6824110 - DNA, 130 bp, Homo sapiens
cacattggaatgacctcaggagctttaaaaactacgaatgcttgggtttcagccccagagatttgcgtttaatcggtctgaggtgtagctgggcttcaagcttttaaaagctcctcaggtgatgtcactg

SEQ ID NO: 6824111 - DNA, 130 bp, Homo sapiens
gtgtatatgtgtgcatacatatacgcacttatatagtgtctgcatattcaaacttgtgtaatataaaacatacattcaggtacaatgtatgcagatttttgtgagtgtgtatgtgtgtataaatatgcat

SEQ ID NO: 6824112 - DNA, 84 bp, Homo sapiens
gcaattccaggccattaatgagatcaagaatcccaactctgaaataaagcagtgattttatgtcattggtagctagatttttgc

SEQ ID NO: 6824113 - DNA, 82 bp, Homo sapiens
tgatagaaacaaagtgagccattctgctcagtggacttttggctttaaggtggcaaagatggttctcaccatgttttcttca

SEQ ID NO: 6824114 - DNA, 103 bp, Homo sapiens
aggtacctggggccttactgaaatgcttgtatatttcttggtccttgtgaggatgaaagagcaggacaatgcatagactttgggggcgtccaggtcaggacct

SEQ ID NO: 6824115 - DNA, 72 bp, Homo sapiens
cctttggggtccacaacacccggctgtccccagacttgtgtccagggaagatagtgttgagggccctcaagg

SEQ ID NO: 6824116 - DNA, 77 bp, Homo sapiens
gatatttaattctcctctaaaatgtctcaacaattggtcacccaggttctgttggcattagagggttattgtttgtc

SEQ ID NO: 6824117 - DNA, 90 bp, Homo sapiens
cttgttaaacatgtaaatgctcagaccttattccagacatattaaatcagaaccttttggggtgggcctgagaatttgtgttttaccaag

SEQ ID NO: 6824118 - DNA, 77 bp, Homo sapiens
atgtagcatagtaagtgatagcatagactttagagccaaactgcttgagttccaatcctggcatttattagctgtgt

SEQ ID NO: 6824119 - DNA, 70 bp, Homo sapiens
cacagctgctggataaccatgtgatccatctatttcgcggaggatgccgcatttttattcaacagccatg

SEQ ID NO: 6824120 - DNA, 110 bp, Homo sapiens
aaagaggatgggctttgcaaacagaaggggtttgcacacagccagtgagtggcaaattctacttttgccgctcactagctgtgtggcttggagcaagttacagtctcttt

SEQ ID NO: 6824121 - DNA, 129 bp, Homo sapiens
atggaagtcagtgataccaggcctttttacctttttcttcacctttattccttatcaagaagaatgcaaaataaatcggttggttcaaggtaataaggtttgcccttatagttcattgtttcattccat

SEQ ID NO: 6824122 - DNA, 60 bp, Homo sapiens
tgctctcagggtgatggcatactgtgggtgattaataatatatgctagcattttggggca

SEQ ID NO: 6824123 - DNA, 55 bp, Homo sapiens
aagtcttttaccatgtttctataggaagtatttagaagcacaggtaaagtgattt

SEQ ID NO: 6824124 - DNA, 91 bp, Homo sapiens
agttggtggtttctgattggtgaagcctctagttacattttactgtttacattgatttggattttggtttgcttatgtagaagctctggtt

SEQ ID NO: 6824125 - DNA, 93 bp, Homo sapiens
tgattcaataaatttaacaattttgtcattgttcatgccaaagaatcattttaataggcattttaggtgacagtggttaaaatttgttaatta

SEQ ID NO: 6824126 - DNA, 78 bp, Homo sapiens
gccctccctcaactgggcagcacagggggattctgtaagcagagctgccctggcggagctgctcgggaggggtggggc

SEQ ID NO: 6824127 - DNA, 71 bp, Homo sapiens
caccttcaaatgggcagacagggagctcacggcacctgctgtatgctttggttgtttctctgatgtgggtg

SEQ ID NO: 6824128 - DNA, 82 bp, Homo sapiens
gctgtgcccagccctggctcacggctgtcgccccacaggtccctgggcgtgaccatctgggagctctttgagctgggcacgc

SEQ ID NO: 6824129 - DNA, 93 bp, Homo sapiens
aggtccaagcagtctgaggggttcaggggcccaaggtcaccagaaagaaagagaacccagggttcctgggtcccagtgtgctgttctgcacct

SEQ ID NO: 6824130 - DNA, 122 bp, Homo sapiens
tctgcccctatattttgcttgaactatttcaaactgtgtaatttataaaatgtaaggagctatcatgcctagtttgtaagtcagctagttacagagtggacaaacaatcatccaggtccaga

SEQ ID NO: 6824131 - DNA, 65 bp, Homo sapiens
ctttctggttgctgttgctgtgatgagattggatttatggggcaggtggcagcagaatcagggag

SEQ ID NO: 6824132 - DNA, 57 bp, Homo sapiens
gaggcaaatgatcctgctccttgatgtgaggaaatgtcaagggtttgcattggcttt

SEQ ID NO: 6824133 - DNA, 94 bp, Homo sapiens
tggcagccttcttcggggcagctgagcagggcaggaccggaggggggccactggtgcctgctttctgggctgccattgtgggtgggcatagcca

SEQ ID NO: 6824134 - DNA, 91 bp, Homo sapiens
ctgtgagatcccaggccccaccaggaacaagccatggaggaacagccaacctgctcatttcagtttgttgcctcagcctgcatctccacag

SEQ ID NO: 6824135 - DNA, 89 bp, Homo sapiens
ttttcctcccattaaatagatggcttaagagtaaaaggcaaaacagattttgtctagtacttggtagctctcaattccatggaggaaag

SEQ ID NO: 6824136 - DNA, 75 bp, Homo sapiens
tttctatgtactgtaattcattcaactgaagaaatactctttctacaggtactgaagtacatgcaagtttagaga

SEQ ID NO: 6824137 - DNA, 60 bp, Homo sapiens
tgtacaagtgtggctcctctgtctcccaaaggcaggcagcttggggccgcactgctgtca

SEQ ID NO: 6824138 - DNA, 68 bp, Homo sapiens
gaggcaggtggatcacctgaggtcaggagttcaagaccagcctagccaacatggtgaaaccccgtctc

SEQ ID NO: 6824139 - DNA, 96 bp, Homo sapiens
gtcagttgttaaaaatcaattcctagatgtagagactagatttttaaaaatattttaagttcctagcctttacataggtgattgatagtgattgat

SEQ ID NO: 6824140 - DNA, 67 bp, Homo sapiens
gggaaggctttagagagatataaatttatctcctttatttagtttatctcctttacttagccttttc

SEQ ID NO: 6824141 - DNA, 86 bp, Homo sapiens
ctgcccagcccctggtcccagtccctttccaccgttggcttcatcaagctccttgcggggttggggctgcatggccagggtggcag

SEQ ID NO: 6824142 - DNA, 62 bp, Homo sapiens
tgtcttctcttgcagtcccatctgggagctcattactgtactgctgggctgcaggggatgca

SEQ ID NO: 6824143 - DNA, 61 bp, Homo sapiens
acctaggaactcaatggcagatattctgagaatggggatgtctgtcatggaatttcaaggt

SEQ ID NO: 6824144 - DNA, 73 bp, Homo sapiens
gagcttcttgccgatggccgggattttaaaactgcctctttagtcccagcccagtcctgtaagcaacagtctc

SEQ ID NO: 6824145 - DNA, 62 bp, Homo sapiens
ttgaatttacttcatactgaggcttgtgtttaattattttggccttgtgtaagtaactttgg

SEQ ID NO: 6824146 - DNA, 60 bp, Homo sapiens
tttgactttctgaatctctgcacagtcagaaatctggcagaataatcactgaagttcaaa

SEQ ID NO: 6824147 - DNA, 77 bp, Homo sapiens
gaatgtccctatccctgccctccagaagctcccagtgttgtgggactctgatggatggacaggggtagtgaagactc

SEQ ID NO: 6824148 - DNA, 85 bp, Homo sapiens
ttgggaacagaggtcacctttgtatcttccacaaagctttgctcggtaagaatgcataaaggtactcaatttatactgttcctag

SEQ ID NO: 6824149 - DNA, 70 bp, Homo sapiens
ggaccttggtatagcattagccctcaggaaatggatcctctgaggtgttgatgacctatgcaaaaaggcc

SEQ ID NO: 6824150 - DNA, 96 bp, Homo sapiens
gccaggaacctcggtgtcctgccttccagccttgggctctgcctccttcagagcccccagggaaggcaggcagtgagaaagtgggtcaatcctggc

SEQ ID NO: 6824151 - DNA, 59 bp, Homo sapiens
ttctggccatggcttctttcacagtagacaatgcctcttaagaagtgcatggtctagag

SEQ ID NO: 6824152 - DNA, 62 bp, Homo sapiens
tggcagtgccagaggtactagtggagggcctaacatcccacatccactggattggcaagcca

SEQ ID NO: 6824153 - DNA, 126 bp, Homo sapiens
agctgcaggatgctaagaccacccggtggactccagggttttgcacctggaccaagatgccaaggggaggggcaggtctagcagaattcggcgtttgctgtcatctggggctctttagttgcagct

SEQ ID NO: 6824154 - DNA, 72 bp, Homo sapiens
ccacgagcccagccttgactcagtcagttctggagctatttactgagcatcagggctgggaacaattagtgg

SEQ ID NO: 6824155 - DNA, 83 bp, Homo sapiens
ccattagcttatgaaaagggctgtcaacacaatcataatctatttacctgtgtttcgctgacagattttttctgagctaatgg

SEQ ID NO: 6824156 - DNA, 64 bp, Homo sapiens
caagagcaggtgctgcttccatgaatctggcgaagaattttgagatatagtggcctagtttttg

SEQ ID NO: 6824157 - DNA, 56 bp, Homo sapiens
agagttggggcagcaactccaggaggggaggcacccctagggagctcctcgacttt

SEQ ID NO: 6824158 - DNA, 75 bp, Homo sapiens
actaaaagcagaaattcagctgagttctagagcactcgagagcctcgcgtctcactcatctgagcctgctgaggt

SEQ ID NO: 6824159 - DNA, 77 bp, Homo sapiens
gctctaagcctagaccagtcattactcatgccctgggacaattcaggctgtgtggataatattggggtttagttagc

SEQ ID NO: 6824160 - DNA, 72 bp, Homo sapiens
gactccagagtgcattcgtatgaactgtatgttcggggctgatgttacagtattatgagtgattgaaaagtc

SEQ ID NO: 6824161 - DNA, 63 bp, Homo sapiens
caagatgaaattgtgatattttaccttttttcctcctaggttaagtagatcactgttctcttg

SEQ ID NO: 6824162 - DNA, 56 bp, Homo sapiens
agatggccccaggtgcccagggccacgcctcctccctctgctcctgctgcccatct

SEQ ID NO: 6824163 - DNA, 81 bp, Homo sapiens
tatctgtgcctcaggattgtgtctcactgtgatgctctctataaagctacttaaggatacaattccaggaagctaaagata

SEQ ID NO: 6824164 - DNA, 64 bp, Homo sapiens
gagcagcacccctcctggctatgaagatgccctccctcttctctagggcactggggtgctattc

SEQ ID NO: 6824165 - DNA, 55 bp, Homo sapiens
tttcctttgagggtcctacactaggcaaactgagggtgtgatcgtcaaagagaaa

SEQ ID NO: 6824166 - DNA, 81 bp, Homo sapiens
gtcatttctttatttcttcattccgtagatatttattgagcaacttagatgaatcagaagagtgtgagaaggaggagagac

SEQ ID NO: 6824167 - DNA, 96 bp, Homo sapiens
ttacagtgatcgttgttgagtagtgattctgatgtaagacaagctcacagcttgtgaccacaaggatcattatatgaactgcaaggatcattataa

SEQ ID NO: 6824168 - DNA, 83 bp, Homo sapiens
gtgaggctgtgtggggataggagggttggagaccatgtctctatctcatgcatcaactcttcatccttcaatcatctcctcat

SEQ ID NO: 6824169 - DNA, 67 bp, Homo sapiens
ggctgggcacatggatagactcactgctgtgaaaaatatgagtgaagtaaaagatgtgcatccagtc

SEQ ID NO: 6824170 - DNA, 69 bp, Homo sapiens
tggagaggaagaggaggagcctgaaaatccagacacaggcttgagagttcctcctctttccactggcca

SEQ ID NO: 6824171 - DNA, 87 bp, Homo sapiens
tgagaaactgccaagagatgactgaaatggaatagcaacaacctcctttatgtggaatcattatctggtcatctttgcttttttaca

SEQ ID NO: 6824172 - DNA, 61 bp, Homo sapiens
gagcagagtcttggcaggcccatgacagtgccttgcaaagtccggcagcctggacatgctc

SEQ ID NO: 6824173 - DNA, 75 bp, Homo sapiens
aggttgtttggattctatattttattaattgcatgcactaagaagttatatatggttaggaatctatgacaactt

SEQ ID NO: 6824174 - DNA, 55 bp, Homo sapiens
gcttggcattggtttctctaagcctgtgtttcatagaatccaagatgccattggc

SEQ ID NO: 6824175 - DNA, 57 bp, Homo sapiens
ctggggtgggtaaggaggggaggaaggagaggctcttgaactctggacccatgccag

SEQ ID NO: 6824176 - DNA, 61 bp, Homo sapiens
gaatttcccattctgagtggagactggagcaaatccggagaatctctagaatgggagattt

SEQ ID NO: 6824177 - DNA, 68 bp, Homo sapiens
ccacaatttatgtattctcctagccacgttcattcacagtcagtgctggcaggatgttgaaattgtgg

SEQ ID NO: 6824178 - DNA, 55 bp, Homo sapiens
aagtgatagagaggaaataaacctgagttcaaatctagttctcctctgtgtcctt

SEQ ID NO: 6824179 - DNA, 59 bp, Homo sapiens
tgcagtaacttttagacttgggtataaacacttgttggtgtttgttggaagttattgta

SEQ ID NO: 6824180 - DNA, 71 bp, Homo sapiens
atgaggtcacagttcagctgccaggcacattgaccacgcaaccgatccctgggctgagcagtgaagctcat

SEQ ID NO: 6824181 - DNA, 69 bp, Homo sapiens
tgaaagcttttgggcaagatttaaagaaactgtttaatttctactgatactgtatcctaaaagctttta

SEQ ID NO: 6824182 - DNA, 90 bp, Homo sapiens
ctgctgttttggtcacaaagcttcatctgttgttttgtttctgttcggggctgatttgaatgaactgatgaacttaactaaacacagcag

SEQ ID NO: 6824183 - DNA, 62 bp, Homo sapiens
gaaagtgctgagacagactgggaagcctttggctaccggcttccactgtccctggcactttt

SEQ ID NO: 6824184 - DNA, 70 bp, Homo sapiens
gaatgagctgctgctgttccaccgtttgctatgttgaaggtgctattcctatacagcattcagctcattt

SEQ ID NO: 6824185 - DNA, 81 bp, Homo sapiens
ttagagttgatgttgtatcagtgcctataaaatgaattaaatgaattcatattttagttgctgaacagcagttgtagctga

SEQ ID NO: 6824186 - DNA, 68 bp, Homo sapiens
ctgggcacaagtggccctggattctggggttccattgccactcacccccctattcacttgtggctcag

SEQ ID NO: 6824187 - DNA, 81 bp, Homo sapiens
agttacaagaggtattttaaatgtcagtgggtttattgttctataccatagaaccatgagtttgagtatctagacttgact

SEQ ID NO: 6824188 - DNA, 65 bp, Homo sapiens
gtaagggcctaataggacgcagtttcataccaattttacactagtgtctagctaagggcttttgc

SEQ ID NO: 6824189 - DNA, 64 bp, Homo sapiens
gtctggttggggctgcagtcgcagcttcaggcgcctctgctgcaggctgcagtctcaggtgggc

SEQ ID NO: 6824190 - DNA, 81 bp, Homo sapiens
ctgagagcagttgtgcctgtccagggactgagggagagaaacacacatctgtcccccaactggaagaacagctgaactcag

SEQ ID NO: 6824191 - DNA, 73 bp, Homo sapiens
cctcacctggggatctaggctgatggagcagccactgtctggcagtgctggctctaggctgagacaggtgagg

SEQ ID NO: 6824192 - DNA, 104 bp, Homo sapiens
gctcaaggaaactcaggcaagggagttactgagggcggggccccgagggggacgacctgccaacctctgtgccttctcattctctttcctggccccttaggagc

SEQ ID NO: 6824193 - DNA, 57 bp, Homo sapiens
ccagctggaagagtgcagaactaacataaatgatgtcctgctagcatctgcagctgg

SEQ ID NO: 6824194 - DNA, 64 bp, Homo sapiens
tctgcgaggaactgagaagcagctatgccatctaaatgaggcaggagctctccagtttgccaga

SEQ ID NO: 6824195 - DNA, 77 bp, Homo sapiens
gaaatggtgtaaaataaatgcctcagaatcatcccacccaaggggcaagggagctggggcatttataccccaatttc

SEQ ID NO: 6824196 - DNA, 71 bp, Homo sapiens
tacaacatgtggtcctttatgactggcttctttcacttagcgtaatgctgtcaggattcatccatgttgta

SEQ ID NO: 6824197 - DNA, 62 bp, Homo sapiens
tgaacactgccatatttaagaaggtagagaaacacataccacctcttgataggggagtgtca

SEQ ID NO: 6824198 - DNA, 59 bp, Homo sapiens
ctgccttgtcttgttttcaggggcctcttccctccctggggtgcggccagactgggcag

SEQ ID NO: 6824199 - DNA, 73 bp, Homo sapiens
tgaacccttgtagaggatggagatgctttgtgtagaatgaagccaccttcattcctctcccacagagggtaca

SEQ ID NO: 6824200 - DNA, 55 bp, Homo sapiens
agaggccgggtgcctgctcagacctttccggcaccgcgaggaggccctggcgttt

SEQ ID NO: 6824201 - DNA, 93 bp, Homo sapiens
cagcttacaagggcagagagttgctggtttgaaccacagacccctggtttaacatctgtaatctagtcaacccctcctctttcttgaaggctg

SEQ ID NO: 6824202 - DNA, 83 bp, Homo sapiens
ctgcagaactatccattctgacacctaattctgtgaggaaactgagtcccagagaaggtggtcagagtgctggttagaggcag

SEQ ID NO: 6824203 - DNA, 56 bp, Homo sapiens
gttcttcagattccatttcagtgcctttccaacactgaggagtagttctggaggac

SEQ ID NO: 6824204 - DNA, 62 bp, Homo sapiens
tgtcccctagaatgctcacatgcacttacctgttggtggctgtcacaagcatctggggcata

SEQ ID NO: 6824205 - DNA, 107 bp, Homo sapiens
gctgcgggcagctgtgggtccaggctggctggcaggggacacagagcattgggaaactaggggatgatgactcaccctgctggggcagcccctacccacgcctcagc

SEQ ID NO: 6824206 - DNA, 58 bp, Homo sapiens
tgccttcctggagctgaaggctgctgggggaagtgcctccacagctccagggcaggca

SEQ ID NO: 6824207 - DNA, 105 bp, Homo sapiens
cagagtggttaagctgtgagctttggagttaaacaaaactagatatggacccagccctgtctcttactttgattcttggttcaacatttgctttatgccatactg

SEQ ID NO: 6824208 - DNA, 62 bp, Homo sapiens
gcctggggagccgcctgagcccccgatgctgggatgcggcggtggggccggctcacccaggc

SEQ ID NO: 6824209 - DNA, 107 bp, Homo sapiens
ggcctgaaggtcttgagagcaagctcatcagtgcgggtggtggggacacctctctgttttcaccaggaccccacggtgggttgcctggttggaaaggactgcaggtc

SEQ ID NO: 6824210 - DNA, 69 bp, Homo sapiens
ggttgatgtggaagttctggtgtttgcatgttttggtgctgataatttgctgactttcagttattaacc

SEQ ID NO: 6824211 - DNA, 82 bp, Homo sapiens
ggggagaattctatagacagaaggtcaatgttgtccccatccataggggttgaattaccttgctgttaagtggtcttccccc

SEQ ID NO: 6824212 - DNA, 82 bp, Homo sapiens
gtagataaccaatcctgtgcaatgactgcatctcgctgggaaaatcaggaaggagcacttgctgtaaggatggatattggac

SEQ ID NO: 6824213 - DNA, 55 bp, Homo sapiens
gcagatttcttgaggaaatgttttgcggtgttaacaaccttctggagatatctgt

SEQ ID NO: 6824214 - DNA, 75 bp, Homo sapiens
gcctgtgaggctgacagcagagggagggatggtaccattttatgagcctcaaatctgagtctgtccagcctcggc

SEQ ID NO: 6824215 - DNA, 69 bp, Homo sapiens
caggataactctgtacaggagacatctctaggtaattgctggaagaatgctccacagggaagaagcctg

SEQ ID NO: 6824216 - DNA, 63 bp, Homo sapiens
caatgagttctgacacttcacgaggtagaataatgacctaagtgatgattgggatgctcattg

SEQ ID NO: 6824217 - DNA, 57 bp, Homo sapiens
tcatgcacatgtgtcaccatcagcatttttatgtgccagtaatgcatctgtgtatga

SEQ ID NO: 6824218 - DNA, 79 bp, Homo sapiens
gcagagcttgtggagtacacttgtcacccttaagactgttctcaaatggcctgggacagttgtcctccactctatctgc

SEQ ID NO: 6824219 - DNA, 55 bp, Homo sapiens
ccagattgaagccggcctcgaagcttcccttggagaaagccggctatgatcctgg

SEQ ID NO: 6824220 - DNA, 74 bp, Homo sapiens
cctcagagtatatagtgcagcacagaatgataatagcctcattgctctcactctgcttgggccatatctggagg

SEQ ID NO: 6824221 - DNA, 61 bp, Homo sapiens
ttcccgggtgtgtatgtgtgtatgtgatgagctcatatgcataaagaaagctatctgggaa

SEQ ID NO: 6824222 - DNA, 78 bp, Homo sapiens
atggtacccctggagcccagatacttaagtcctccaacatttaagtgtggattggctggagctatcagaggtcaccat

SEQ ID NO: 6824223 - DNA, 55 bp, Homo sapiens
tccaggggattctgatgcaatttatgtttgagaagcactgctagaaccccctgga

SEQ ID NO: 6824224 - DNA, 67 bp, Homo sapiens
gtgacaaggaaagacagactgtccacctggttggaccactgccaagtcatgtccttccctgtgtcat

SEQ ID NO: 6824225 - DNA, 112 bp, Homo sapiens
accaatccttacgcgttttaaatcctaaaatttttctttaggtttaggtaaatagttaaaaaattataacatctaagggagagaaagtgttattgtatggaacagagttggt

SEQ ID NO: 6824226 - DNA, 57 bp, Homo sapiens
tacttgttttgtgttcctaaactttgaagctcatgtttgggaagtttaaaataagta

SEQ ID NO: 6824227 - DNA, 85 bp, Homo sapiens
actgatgctgcacttatttatgcagaaaagttgctcccaaactggggaagctttgatcttctgtcgtcaaaaagccagtgtcggt

SEQ ID NO: 6824228 - DNA, 59 bp, Homo sapiens
acctgagctctgcactttttagagccagtttctaaggcctgcaaagagtttggacaggt

SEQ ID NO: 6824229 - DNA, 62 bp, Homo sapiens
acaaagtaggaagattagctgagtgatgcttaaaatctcttctagttatatctcttctttgt

SEQ ID NO: 6824230 - DNA, 76 bp, Homo sapiens
ggctatgtacattcatggttccaccagggcacaggaatattttagacatgcccatggaagaactgatgtgccagct

SEQ ID NO: 6824231 - DNA, 66 bp, Homo sapiens
tggttattagttaacattttgaaaggcaattgtgaacatgtcttttagaaaagttgaatgtagtca

SEQ ID NO: 6824232 - DNA, 73 bp, Homo sapiens
ttggcaacacatggaaaaatttccagtacccaattaaagttatgcaggctgattttcattcatatgttgccaa

SEQ ID NO: 6824233 - DNA, 68 bp, Homo sapiens
tctcaaggtaacatcatcctcgttttagggttggtcctaaatccaacgacaggtgtacttataagaga

SEQ ID NO: 6824234 - DNA, 58 bp, Homo sapiens
tcacttatgtgtgattgatgccttttttcaagcatttggcatctgtttcgatcagtga

SEQ ID NO: 6824235 - DNA, 68 bp, Homo sapiens
caacctggtgctttgctcatttgatatgcccaataagtgtttcctgagtgataaggcatcaaaaattg

SEQ ID NO: 6824236 - DNA, 76 bp, Homo sapiens
aaatggagctctctagccataccaggattaacaagacacagttgtttctcctttgtgtggactacctgctgcattt

SEQ ID NO: 6824237 - DNA, 59 bp, Homo sapiens
tggcagagttcgctgtgcctttggtatagaaatcacaggtcacaacagtactttagcca

SEQ ID NO: 6824238 - DNA, 84 bp, Homo sapiens
cctcagagcttattagaaatgcataattttaggaccccatcccaggcctactgaattagactgcattttatcaagattctcagg

SEQ ID NO: 6824239 - DNA, 84 bp, Homo sapiens
tgagatccaggctgtctgctgaggaaaggtggagggtgagcccctgtctttctgctcttcagtgacttgtgagccaggatacca

SEQ ID NO: 6824240 - DNA, 129 bp, Homo sapiens
tcaaatttgaatgtcttgcttccccttccctccttggttcctggccccatccatcttcagagccaactgtttgaagacggaaggggccaggaaccaaggaagaggggaaaagaagacattcaaatttgg

SEQ ID NO: 6824241 - DNA, 94 bp, Homo sapiens
aacagtttaaacatctgtaaggaagaggatcaaatgtatacatggaattttaaaatatattatgaacttgctttgcttgcagaatatcactgtt

SEQ ID NO: 6824242 - DNA, 93 bp, Homo sapiens
ccttaaaacaaaatttagagaaatgcaagacataaataatctttttaacaaaatgggttacagccttggatttctttttagaattttgtgtgg

SEQ ID NO: 6824243 - DNA, 76 bp, Homo sapiens
tgagtagaccctcttgcagttgcgcagtgcatgctctgcatagctgtacccggcagctctgagatagtccaattca

SEQ ID NO: 6824244 - DNA, 79 bp, Homo sapiens
aatggagggtgtccttctgtggactctgaggaacgtggccttgccaaaacttagagcgcacacaaggagccctactgtt

SEQ ID NO: 6824245 - DNA, 101 bp, Homo sapiens
tggtttccatctgcgcagccatttcaacaaccggctgctgtcaccccagctccaaaacagcagcgaggtgatgaaatagctttgtcaaggtgagaaaacta

SEQ ID NO: 6824246 - DNA, 55 bp, Homo sapiens
ggacttgcagcattaggctacacgtgctctacaatgtgctgaggatgcaagatcc

SEQ ID NO: 6824247 - DNA, 64 bp, Homo sapiens
gccactctactcttttccgttgctggcccttagaccgaggacagcaatgacggggcagctgggc

SEQ ID NO: 6824248 - DNA, 110 bp, Homo sapiens
gccctgtcttctaagcctctaccttttttctgtctttagaaaaagagaagctctttaaccttctgctctcaggtttcaagacaggaaaactgggggctggtcatcagtgc

SEQ ID NO: 6824249 - DNA, 55 bp, Homo sapiens
acttgggggcccactctctgccgcggaaaggggagaagtgtgggctcctccgagt

SEQ ID NO: 6824250 - DNA, 72 bp, Homo sapiens
cctgtggagctgtgtgaaatgcccacaatagcccatgactcaggggattggcatttctcacagtccccgagg

SEQ ID NO: 6824251 - DNA, 103 bp, Homo sapiens
gagctacctctttaccaccaatgtgcaatgcaatctttattatattctaggcagaatagatgtataatatacgtgtgtttcagcgtgtggtagggtgtatctc

SEQ ID NO: 6824252 - DNA, 74 bp, Homo sapiens
agggatggggggccatcttcaaggatgtggcatttatcccaaattaatgtcttatcatgtggttctgtattcct

SEQ ID NO: 6824253 - DNA, 98 bp, Homo sapiens
tggaataccacttgaaaataggttgatttgaggaagctaattggtttcttctaagctccttgaattaatgctgctattatttttcaactaaaattcca

SEQ ID NO: 6824254 - DNA, 114 bp, Homo sapiens
ctaaccccaccattaatagtataatcactgggcgtttggtactagggctaggcaaacatttcctagtggcatattatttctagtggtacattatttcatgggagtgagggttag

SEQ ID NO: 6824255 - DNA, 82 bp, Homo sapiens
gtcgaggataccagttgcctgaaattttcctctggatccttctctagatcattttcagaggtatgctgcttatcttcctgac

SEQ ID NO: 6824256 - DNA, 66 bp, Homo sapiens
gcctaatgtctcattccctagtatctgtctagctcaggaagtggggagccagagacattttagggc

SEQ ID NO: 6824257 - DNA, 84 bp, Homo sapiens
gccaaagggtggttcctagaattactgagtacaagaacctactactgtaactgtggtctagggactgggaagccccaacttggc

SEQ ID NO: 6824258 - DNA, 63 bp, Homo sapiens
gtgcaggaaacagatgtcaccctaggtgttttgtgcatggaagggttttgtttcttgaagcac

SEQ ID NO: 6824259 - DNA, 78 bp, Homo sapiens
cttagtggtacctctgaagagaacaccagtagtttgacctatcataattattctcttctagagcataatttagctaag

SEQ ID NO: 6824260 - DNA, 79 bp, Homo sapiens
aggaacagcatttggaggagaggctttggggctcaaaggcaatttccaaaaccacctctgttagatgtattttgtttct

SEQ ID NO: 6824261 - DNA, 76 bp, Homo sapiens
tctattggttactggactgagttggaattgaggggttggaaaatttctcagggaggccaatttatcaaccagcaga

SEQ ID NO: 6824262 - DNA, 64 bp, Homo sapiens
tttctctctatccccttcttcattctcagagataactttgggtgatattaaggatagagacaag

SEQ ID NO: 6824263 - DNA, 91 bp, Homo sapiens
ggtgggaggagaggagtgggaagcagtgcaacccatccttttctgtccttgtttgggttcagaattcctatttcatctctctgtctccacc

SEQ ID NO: 6824264 - DNA, 63 bp, Homo sapiens
atatatgttcagaagaagaatggggaaaaatcttcctcttttatttattctgaaagcatttat

SEQ ID NO: 6824265 - DNA, 55 bp, Homo sapiens
acaaatgactcaaacaccactttgcagaagtaaaggtgctaggctgagtctttgt

SEQ ID NO: 6824266 - DNA, 59 bp, Homo sapiens
cagactaaaaatcgtgtcctggaaggaaactacaggtactaccagggattttcagtctg

SEQ ID NO: 6824267 - DNA, 67 bp, Homo sapiens
gcgaaggtgtctgcaggtttagtttcttctgaggcctctccttggcctgcaaatggcacctttttgc

SEQ ID NO: 6824268 - DNA, 59 bp, Homo sapiens
gtgaagctcttgttcaaaatgaaaagaaagccagaatttcatttgctgcaatgcttcac

SEQ ID NO: 6824269 - DNA, 72 bp, Homo sapiens
gggtccaggaaatgctgatgctcctggagggaagaccctactctgagtaccaagtttccagattttgctccc

SEQ ID NO: 6824270 - DNA, 65 bp, Homo sapiens
ggaaaagagtgtaggcagttatattttgacagtctgggtgaatgtagtagttcacattctgtttt

SEQ ID NO: 6824271 - DNA, 62 bp, Homo sapiens
caacctatgggggaaggactttcaaactgtgtattgattgtgtcttatttccatggtctttg

SEQ ID NO: 6824272 - DNA, 82 bp, Homo sapiens
gttatttagcgtgaacctggagctagtagtttcatgagtttgatcccaacatggctaaattagctttactctgttctatgac

SEQ ID NO: 6824273 - DNA, 55 bp, Homo sapiens
cagagcagaaggtccaagcctgacaacctgtcctggcacttctggacctgctctg

SEQ ID NO: 6824274 - DNA, 78 bp, Homo sapiens
ccagaaagtatcttctagagccagccgcaagagctgtgagctgcttccaagttaggcgagctggtggtggtaccctgg

SEQ ID NO: 6824275 - DNA, 76 bp, Homo sapiens
ggaagatgggtggtccttacaggaggcttactcataggtgtgaagtgacctcattacggggcctgctccatctttc

SEQ ID NO: 6824276 - DNA, 72 bp, Homo sapiens
gcagcattccttctggaagcttcaggggagaatttgtttccttgtcttttatagcttccagaggctgcctgc

SEQ ID NO: 6824277 - DNA, 57 bp, Homo sapiens
ttcggcttgggtatttctcaggcacatgacctctctgagtgtgaacccaagccagaa

SEQ ID NO: 6824278 - DNA, 58 bp, Homo sapiens
cttgcagacagaagtatatagtgtggaaaatgaaccacctcttttgactctttgcaag

SEQ ID NO: 6824279 - DNA, 81 bp, Homo sapiens
ggagttcctggcatccaagcagaatcacgtgagagcaacacctgttattttcatgtggtcattgctggccctcaggattcc

SEQ ID NO: 6824280 - DNA, 71 bp, Homo sapiens
gatttgacatcactgacctgttttcccattttaaagttaaaatgtagaaatgctcatgtgtgtcaagagtc

SEQ ID NO: 6824281 - DNA, 77 bp, Homo sapiens
ctctatacaagtttcactttgacatgttaccttatcatatacttaataagaggaggctgatcatatgaggtatagag

SEQ ID NO: 6824282 - DNA, 66 bp, Homo sapiens
ctttaaatattcttgaaagatcctggtaactgatttatagttgccaattataagaatgatttaagg

SEQ ID NO: 6824283 - DNA, 58 bp, Homo sapiens
aggaggagcccactcaaaggggagacagaggcagtgctccctgtgagcagctcttcct

SEQ ID NO: 6824284 - DNA, 55 bp, Homo sapiens
ggacatgcaatattgagactttctctcttgaggaagcagtttataatgcatttcc

SEQ ID NO: 6824285 - DNA, 62 bp, Homo sapiens
taggccttttctcgtttctccaaagagtgggctggctcaagtagggcagagagagaagcctg

SEQ ID NO: 6824286 - DNA, 75 bp, Homo sapiens
ggataggtatacgtttagctttatgagacattgccagaccttttccaaagcaaatgtaacattttttatctgtcc

SEQ ID NO: 6824287 - DNA, 57 bp, Homo sapiens
gctgtcatcagctttctcaaagaagctggaagtctagatgagttgagaagttgaagc

SEQ ID NO: 6824288 - DNA, 79 bp, Homo sapiens
tctaaaaatctctactttgggtcagataagcgggtaaattagctccactttatgtccttgaagagttgtgattttagga

SEQ ID NO: 6824289 - DNA, 71 bp, Homo sapiens
aaagacaattacattagcaaacatcttggtgttcttttttcagaacactaagatggctgttgtttgttttt

SEQ ID NO: 6824290 - DNA, 61 bp, Homo sapiens
gctgatcaccagttgtaggtattttctagccattgggagactgcctttccctggtgccggc

SEQ ID NO: 6824291 - DNA, 60 bp, Homo sapiens
gaaaaattagtgttttcttactggtgtcactgaggccagctgagaaatcattgataattc

SEQ ID NO: 6824292 - DNA, 55 bp, Homo sapiens
ctgtttttgcaaagagagtttcaagagtgcattgtaacattgtttgtaaaagcag

SEQ ID NO: 6824293 - DNA, 100 bp, Homo sapiens
gcagtatttcccctctggaattcattctcataacttctgatctatgctgctgtaagagagggataagcaactatgatggagattccaaggaaaatgaggt

SEQ ID NO: 6824294 - DNA, 62 bp, Homo sapiens
gattagttatttcattgttgagggaaaattcattcagttaacattaaaagagataattgatt

SEQ ID NO: 6824295 - DNA, 70 bp, Homo sapiens
ttgtagggaatgatacataaaccatcattttgtgtaattctcacaatggctttatgtatcatctccacag

SEQ ID NO: 6824296 - DNA, 60 bp, Homo sapiens
tctggtgtgtagagaaatagcctgaaggcactttgtgcttgcctggcctctctgcccaga

SEQ ID NO: 6824297 - DNA, 60 bp, Homo sapiens
tttgtagtgttgctagtataaaaaaagatacaagttcaaaatatgctggcaacatacaaa

SEQ ID NO: 6824298 - DNA, 109 bp, Homo sapiens
gcacccattagtaaggttccttcctcacctccagctctaggctgaagcctgcagacagccttttgttctacagctggggaaagaggccagacctgagcacaatgagtgt

SEQ ID NO: 6824299 - DNA, 71 bp, Homo sapiens
ttggccttgattatgccagtagataatgggtatgtgacagttttagcttctctggcctttgatcaggttga

SEQ ID NO: 6824300 - DNA, 66 bp, Homo sapiens
gttaaggactctccagctagcaaatacattaccattattgtatttgccagaaggtgggtcattagc

SEQ ID NO: 6824301 - DNA, 82 bp, Homo sapiens
ataggaagaagggtaaacagacactaggaagcttctgattattatacctagtgattctgtgagcctttactgcacaaactgt

SEQ ID NO: 6824302 - DNA, 61 bp, Homo sapiens
ttggcacctgatatgtgaccttgagcagagctcaggctcttcacctgcataaaggagttaa

SEQ ID NO: 6824303 - DNA, 74 bp, Homo sapiens
gcaatttttgtaatgaaaaggaggaaatagatattggatgaaacatagctatttcctacttttttacttattgc

SEQ ID NO: 6824304 - DNA, 62 bp, Homo sapiens
gaaagtggctgtatagccaagtcagatataagtcttttatctgtaggcagcatgccactctc

SEQ ID NO: 6824305 - DNA, 56 bp, Homo sapiens
ctggctccttgagaggcctagcagatctctactctgtgggtccctttcggagctgg

SEQ ID NO: 6824306 - DNA, 57 bp, Homo sapiens
gggcgatgcggagcgctggccaaggcggcgagagttggcgcaggcttcgggtcgctc

SEQ ID NO: 6824307 - DNA, 66 bp, Homo sapiens
ctagaccaggggagtcaacaggtgctgcacattaagacctggtttattgttttgttgattgtctag

SEQ ID NO: 6824308 - DNA, 69 bp, Homo sapiens
accacattcatcagtgttgtactgattgatcttagaaatatataaatagaataatagtgacgaatgggt

SEQ ID NO: 6824309 - DNA, 130 bp, Homo sapiens
cccccgggagtagagcctctggcagtgagtcaccacagcctccatcgcccgtggccttggacagagaagagctcggcgggccatgtgggcagaggaggctgtactgctgggcaggccgctcccagcgggg

SEQ ID NO: 6824310 - DNA, 82 bp, Homo sapiens
ggcactcagcaaggtggagaaggatgggtgcagagagcaatcggggtgatctaaccttcctctttattcttgtctgaatgtt

SEQ ID NO: 6824311 - DNA, 76 bp, Homo sapiens
aggaagagcttaaagttgtaaattagagaaagtttggcttttgctatctctgagttatttctttgtcctctgctct

SEQ ID NO: 6824312 - DNA, 60 bp, Homo sapiens
gtctaggtagaagccaagaaacacctgctcacaaggggctttcttaggctctaaaatgac

SEQ ID NO: 6824313 - DNA, 73 bp, Homo sapiens
tttcatctctttttctctgagtacgtttcagtgtttaattgaccaggaatgtatttcgaggtgtgatatgaga

SEQ ID NO: 6824314 - DNA, 81 bp, Homo sapiens
ccgtccctgaattccatcctgttgcaacctgggcgtcacaatgttggttctgtagtggttgtcggggtggttgagggaggg

SEQ ID NO: 6824315 - DNA, 56 bp, Homo sapiens
ggagggcacaggaccagaaatcaggagccctgctttttagttacacctctgccacc

SEQ ID NO: 6824316 - DNA, 55 bp, Homo sapiens
cagttaaatgatgtgccctagatcacataatgtgtgtctcacattagcttgactg

SEQ ID NO: 6824317 - DNA, 62 bp, Homo sapiens
tgggcatctgacttgtgaatccttcccataactaagccccgagagatttccaatcatgccca

SEQ ID NO: 6824318 - DNA, 70 bp, Homo sapiens
ccagatgccaggtgacagtatggctcacgtgtgggtttgtgtccaccttggccctgtccctggagcctgg

SEQ ID NO: 6824319 - DNA, 76 bp, Homo sapiens
atctgttatctgtctatggattctgtcagagtttaaaatttagcttacatgatgatttcataaacataaatcagat

SEQ ID NO: 6824320 - DNA, 102 bp, Homo sapiens
ggactgaaaacacaccttcaatgaaaataatagtcaatggaatagggtaaatattaatatctacaggattattatgagttattaaggtgagtatggcagtct

SEQ ID NO: 6824321 - DNA, 74 bp, Homo sapiens
cccactgtagctagtcctgggtctggagaatggaatgtatgcgttgcattcctttctaggatagctgatcaggg

SEQ ID NO: 6824322 - DNA, 123 bp, Homo sapiens
ggtgtctatctgctgtccagggaggaggggcgaagagaggctgggcgtagggcttccccgcactctgcgaagtcctcccggcctccttccggagaattccttgatgacgattcagcagacatc

SEQ ID NO: 6824323 - DNA, 77 bp, Homo sapiens
cacaatttttgttaactaagttggagatgtctaaaaacacgtaagtttttgaccaaataatttagcagataaatgtg

SEQ ID NO: 6824324 - DNA, 82 bp, Homo sapiens
ttgtttgggaggaagatggggaggaagaaaaggaaataggaatgctgtgttccttcgtcttcccttcatttctcccatgtaa

SEQ ID NO: 6824325 - DNA, 83 bp, Homo sapiens
tcagaaggccagatttacagatttgccctggatcttactacacaaacaagaaggaaggaggagaagtgaatttggcattttgg

SEQ ID NO: 6824326 - DNA, 100 bp, Homo sapiens
ttgtggttgaagcaacattaagcaacaggcataatgtgttgatctaaaaattcataggtgaaattatgcattgttgtaccaaggatgagcaatactatag

SEQ ID NO: 6824327 - DNA, 77 bp, Homo sapiens
ttgtaagggttacaagaaaacatctcttcctagatcaagatcaaccctagtgagaagtgtattacttggtcttacaa

SEQ ID NO: 6824328 - DNA, 61 bp, Homo sapiens
gtacggccatgggatggggcagtcactcaactgacccagtgactcgtctctgtggccgtgc

SEQ ID NO: 6824329 - DNA, 57 bp, Homo sapiens
ctccatggaatgtgagttgtttagttcttttttgaactgtcagaaaaatccatggag

SEQ ID NO: 6824330 - DNA, 56 bp, Homo sapiens
agctccagaagcctgcaaggtacttggcccgagtaccgtggcaaactctgtgggct

SEQ ID NO: 6824331 - DNA, 77 bp, Homo sapiens
gcagtggtcactaattttcaggaccaaggccacacaaaatgtcaggcctagggagaaaattcatctgtgcccactgc

SEQ ID NO: 6824332 - DNA, 64 bp, Homo sapiens
ccaggggaaggctagagaatgatcacgtggccgggatggggctgtgttcctggcagtcccctgg

SEQ ID NO: 6824333 - DNA, 79 bp, Homo sapiens
cagagcctggcaccttaccagggctttgaagggtctgctcccagctgcacttcaggttctggcagggcgtcaagttgtg

SEQ ID NO: 6824334 - DNA, 66 bp, Homo sapiens
ctcgcgggctctggtcctgaactgaagcagaaagccttggttctggggagcagcagcagcagcgag

SEQ ID NO: 6824335 - DNA, 129 bp, Homo sapiens
cttcactttgatttttatttgtctgtttttccactttcattcttcagagctgcgcttttggcctgaattttcagtgacaaatagaaaagctgaatggatggagacaatgactctttaattcaatgtaag

SEQ ID NO: 6824336 - DNA, 62 bp, Homo sapiens
gcggatgtttgagttgcacacacacagttgactgagtggaagtgtgtgaatttcagagccgc

SEQ ID NO: 6824337 - DNA, 111 bp, Homo sapiens
cattctgtgtttttatgcttctattatgcatatgtctgaatccatacgtgattgataacattgttttatatgttttaaatatgtgtgtaaatggtatattaatgtggtttg

SEQ ID NO: 6824338 - DNA, 60 bp, Homo sapiens
tgggggagccttcacagtagctgccaagcagaggtcctggcactggggagggttctcaca

SEQ ID NO: 6824339 - DNA, 92 bp, Homo sapiens
gtggctgtggtagaactgccatcataggagttggtgaattacccttccatcttcttccagcttctctctgatgcagctctcccattttccat

SEQ ID NO: 6824340 - DNA, 55 bp, Homo sapiens
gtgacccaggacactgtgtatcccataggccctgatttttagtggactggctcat

SEQ ID NO: 6824341 - DNA, 95 bp, Homo sapiens
tcattatttattttgaaaccttaagtatgtttacacaagtctgtccagcatagatttagctgtgaacagcttggctttaaaatgctagctgatga

SEQ ID NO: 6824342 - DNA, 74 bp, Homo sapiens
ttgcaattacagatgatctcacagcagaaaataactgcgtaattgttttctgtgtagagatcacagaattgtag

SEQ ID NO: 6824343 - DNA, 60 bp, Homo sapiens
ggcccacactgacagctgagctgggcccctcaatttcccggccacggaggcagtgtggcc

SEQ ID NO: 6824344 - DNA, 91 bp, Homo sapiens
tcatttttttaaagtaattgaagcttgtggctttacaacttagtgttttttgctatccagataacaagtttcattgtttagaacccagtga

SEQ ID NO: 6824345 - DNA, 92 bp, Homo sapiens
tgcattaatataacacccccgaaatctcagtggtgtaattaactaaagtatatttcctgctcattgaattctgggggttgagattctgagca

SEQ ID NO: 6824346 - DNA, 79 bp, Homo sapiens
ttctcatgccagcaactaggagctgaattctagaaattatagcaagttcaaattcaattttcttagtgttggtctagaa

SEQ ID NO: 6824347 - DNA, 56 bp, Homo sapiens
gggctttgtgctgggaagatgcctgtggatgcttccttcccaaggcttcaaagcct

SEQ ID NO: 6824348 - DNA, 62 bp, Homo sapiens
catgtgtaactgtgctaaaaggcaagtgcctctgtggggaggcggcagacacagttgacatg

SEQ ID NO: 6824349 - DNA, 65 bp, Homo sapiens
ccatctgctggccctgggctggatgagcgagcaggaagcagcagccagctctgggcaggtcgagg

SEQ ID NO: 6824350 - DNA, 100 bp, Homo sapiens
actcctttggtcaatgatgctctttcttttgctgaaggcttgacatacatgaatatgcagcttccataagagatggagatgacgatcatatgagaggagt

SEQ ID NO: 6824351 - DNA, 57 bp, Homo sapiens
attggttagagtaacacctatttggtgatacagatcaacagggtgtctctgattaat

SEQ ID NO: 6824352 - DNA, 55 bp, Homo sapiens
ctgtggatttaggcagagctgacctgtccagagttactctcctaatagtttacag

SEQ ID NO: 6824353 - DNA, 100 bp, Homo sapiens
gtagaaccagcagacttggtgtgactttcaacctgtcccccagaggcacctgattgctggagagaagttgcagagttgagaacaagactgatggttttat

SEQ ID NO: 6824354 - DNA, 75 bp, Homo sapiens
aagggaggtggaggggaaaaatagataagaattttaagaccttgataaaaatttgtttatcttctagcttctctt

SEQ ID NO: 6824355 - DNA, 90 bp, Homo sapiens
gagatatgtagggcagtttagcacaacatctggcacctggtaagctcttggtaaatgttgattgtggctatttttgtccctggtgtgttc

SEQ ID NO: 6824356 - DNA, 69 bp, Homo sapiens
ctagagaaaaagcttaggtacgcgtctccaaatgatggtttctttttctacaccttagctttttcatag

SEQ ID NO: 6824357 - DNA, 80 bp, Homo sapiens
cccatagctgttctcacaggaaccatcagagaaatgttcattgatacttagataacaaacctgtggttcagttatatggg

SEQ ID NO: 6824358 - DNA, 69 bp, Homo sapiens
ggttgtaagagtgaggggattcaggcaaggtgccattagcaaccattaccctctctcattgtacactcc

SEQ ID NO: 6824359 - DNA, 98 bp, Homo sapiens
agtctgacacttctaagcccatttagagtataagagagagacactaattctgaatcttttctggactctgcatggagcttaagatttactagtcagct

SEQ ID NO: 6824360 - DNA, 98 bp, Homo sapiens
gcacactcacatccaggtagttctccaggggctgttcatctaccagggtgggagcctcccactgggggaagtactttctggctgggttgaggttgtgc

SEQ ID NO: 6824361 - DNA, 57 bp, Homo sapiens
tatattttgtcaggttagtaatctgaaatcatcaaattgctaatgtgcgaatgtgta

SEQ ID NO: 6824362 - DNA, 84 bp, Homo sapiens
tgttctgacccctctggctgcaggtcaattcaccatggccagccatggtctgaactaagacagtagtgtggaggaggcagaata

SEQ ID NO: 6824363 - DNA, 82 bp, Homo sapiens
gccttgttaaggtcctgctttaatgagtgaataatggtgattgatttatgatttacacatcaaagcagcaggttagcaaggt

SEQ ID NO: 6824364 - DNA, 74 bp, Homo sapiens
taacatgctattttccaataatgtaatatttacttgggcagcacaaatcctatagtattggaaaaagttcgttg

SEQ ID NO: 6824365 - DNA, 81 bp, Homo sapiens
ttcatgctggtgaaatgacatgacggatgttagagtgttttgaagatataaagcacagggtgtctgcattcagtggtagaa

SEQ ID NO: 6824366 - DNA, 89 bp, Homo sapiens
ggtgcctgttgtgcgtctgttgctgggcctttacctccagggattctacctccctgggttctggctgggctgcacgctgatggggaacc

SEQ ID NO: 6824367 - DNA, 58 bp, Homo sapiens
tagctggcttatataaaagggctgtggataaaggcccgggaagtatgggagccagtta

SEQ ID NO: 6824368 - DNA, 86 bp, Homo sapiens
tccgcgggcgggggtgtgtgtgtgtgaaagcggttgcccccgacaacgccggcagtccgctcacccgcattggcccggcccggggg

SEQ ID NO: 6824369 - DNA, 81 bp, Homo sapiens
cagtgatctacacaccaaatcactctggttactctggggaggtagattggagtaacagggtatttgtgtggggggtgtctg

SEQ ID NO: 6824370 - DNA, 64 bp, Homo sapiens
gtgtggctcagtctgggttgactgattgctttccttgtaattaaaatcttaattagagtgacac

SEQ ID NO: 6824371 - DNA, 72 bp, Homo sapiens
gcaaagtcattatgccaaagtagaaatatacaagcatcagctatcatatttataccattggtattgaattgc

SEQ ID NO: 6824372 - DNA, 101 bp, Homo sapiens
tgagacggagtcttgccttgtcacccaggctggagtgcagtggcgcgatctcggctcactgcaatctccgcctcccgggttcatgccactctcctgcctca

SEQ ID NO: 6824373 - DNA, 58 bp, Homo sapiens
gaagttaggctttcctatgcttgtttatggtactgaggcaaggcaatgccatgatttc

SEQ ID NO: 6824374 - DNA, 76 bp, Homo sapiens
agatataaactcttgaattcccttgaagagaaggaaaacgtaccaatctacatgggggatttaattgtggatgtct

SEQ ID NO: 6824375 - DNA, 99 bp, Homo sapiens
aggcgttggtggactcggtggacctcagcgggtggggaaggagcacgtccttgtccacgtcctccgacaccagctgggctaccatctgcacgacgtcct

SEQ ID NO: 6824376 - DNA, 63 bp, Homo sapiens
tgtttttagcatatgatcacagtgtctattcaatttttaagggctgcatcatggttaagaaca

SEQ ID NO: 6824377 - DNA, 71 bp, Homo sapiens
attgtcatccaagaaatgcagtgacatttcatttccagaggaaagaaacctcacagcaattctgaagcaat

SEQ ID NO: 6824378 - DNA, 57 bp, Homo sapiens
actgccaatggtagtttgatgggagtagtattgaatctttcaaatactttgggcagt

SEQ ID NO: 6824379 - DNA, 76 bp, Homo sapiens
ggcagggagagcatgctgataacgcagccccctgaaaatataaatattgcatgaatgtattagcctcatcccagcc

SEQ ID NO: 6824380 - DNA, 71 bp, Homo sapiens
tccagcaggtctggagtgggatctgagagtctaaaattaaattgctcaccagtgattcagatgctgctggg

SEQ ID NO: 6824381 - DNA, 58 bp, Homo sapiens
cagtcacatggatgatggatagcgttgggagctgttttctctatcttccaggtggctg

SEQ ID NO: 6824382 - DNA, 62 bp, Homo sapiens
ctgtgctgattccattttctcactgggaaaacagtagcgggaaagagaggagttgtgcatag

SEQ ID NO: 6824383 - DNA, 62 bp, Homo sapiens
ccccatctccaaataccatcacattggaggttagggcttcaacatgtgaatttggggtgggg

SEQ ID NO: 6824384 - DNA, 60 bp, Homo sapiens
taaagtgttagagtctagcttcccttctcttgaagcaaggctagtttgtgactttctttg

SEQ ID NO: 6824385 - DNA, 74 bp, Homo sapiens
gcacatgctatatgtatatgtttccattttataaaattctaggaaatgcaaattaacatatagtagattagtgt

SEQ ID NO: 6824386 - DNA, 105 bp, Homo sapiens
cagctatcagaaatccctgagtcaatatctgagtgtgctttggcagattaatggctaagagcagatttcaaatattggcagagggaatccttctctctgaagctg

SEQ ID NO: 6824387 - DNA, 94 bp, Homo sapiens
gttagtgtatcccagatttattttacatccttcatctcctgacacgcagagctagctcagtgttttcctgcaggctgtttggtggatctctaat

SEQ ID NO: 6824388 - DNA, 102 bp, Homo sapiens
aggcggccccaggctggccccacactggtgggagcagcaggcagctcctccttgggcagctcctcctcttcccctgtgaggcagctctggtcatggcctcct

SEQ ID NO: 6824389 - DNA, 61 bp, Homo sapiens
gccactgttgctcctcaggaaatggcttggagcctcagccttcagaagaagtaacaggggc

SEQ ID NO: 6824390 - DNA, 90 bp, Homo sapiens
gggagtcttgctctgtcacccaggctggagtgcagtggcatcatctcaactcactgcaatctccatctcctgggttcaagcaattctcct

SEQ ID NO: 6824391 - DNA, 110 bp, Homo sapiens
cttccattccaacctgagtcactgcccactccttcgtccaacgtcagtttcctcaactgtgtattgggaggttgaggtgggtgtgcgggacgtgagttggtcctttgaag

SEQ ID NO: 6824392 - DNA, 55 bp, Homo sapiens
tcattgcagtgatgttgtatgtagcacctggcatgcagtatgctcagagtaatga

SEQ ID NO: 6824393 - DNA, 60 bp, Homo sapiens
tctccataagggcaattagtcaagtgagtttctttgctgtggccatttatccttatgaga

SEQ ID NO: 6824394 - DNA, 73 bp, Homo sapiens
tttcagggcatccagaaagacacattaaccaaagactgctgaatgctttgggagagaattctggtgactgaaa

SEQ ID NO: 6824395 - DNA, 61 bp, Homo sapiens
ctcagtcacctggtcactgcaggctggtcttgttgctacttggtgaagtcaggtgattaag

SEQ ID NO: 6824396 - DNA, 55 bp, Homo sapiens
ctagttctagatccctgaggaattgccacacagacttccacagtggttgaactag

SEQ ID NO: 6824397 - DNA, 56 bp, Homo sapiens
tcttaatttcccttgggtgtgtaatctaacatagtgacaagttctggagattaggg

SEQ ID NO: 6824398 - DNA, 65 bp, Homo sapiens
gccctcggctggtaccctgagaagttcagttgttagctggaaatcaggtctatactatgagaggc

SEQ ID NO: 6824399 - DNA, 83 bp, Homo sapiens
gtggttgacctctctggagataagcagcaatgaaattccaatgaagtttcatcatctctcatcaccaaaaccatcctaaccac

SEQ ID NO: 6824400 - DNA, 57 bp, Homo sapiens
ttgagttccaggatggttgttagtggaaggcttcccaacccccttctgagaacccaa

SEQ ID NO: 6824401 - DNA, 90 bp, Homo sapiens
gagggagtcatgagcgagcaggggcctctggtgcctgaagcgcccctcaggaagagcgggtctcaccggaaggccacactcatctccttc

SEQ ID NO: 6824402 - DNA, 79 bp, Homo sapiens
ccttggcagggggagctcctcaaccccgaaccttgcacagctgagtgggagaaaccagaggggtcttttgttgtcaggg

SEQ ID NO: 6824403 - DNA, 75 bp, Homo sapiens
aggtcatgggtaaatttcttaagagggccagttaatttggttctggaacatagcaagaagttgtactcctgacct

SEQ ID NO: 6824404 - DNA, 116 bp, Homo sapiens
tttactcagcctgaagctctggtgcagatctctgtgatccaggtcctttgaaatttaaacatattcatgaggctgaaacacagaggctctttattaaagcaaagaggctgtctaaa

SEQ ID NO: 6824405 - DNA, 68 bp, Homo sapiens
cctgggatctggatcctatggaggggacacctggtccacactcagtgctttggatcctggattcctgg

SEQ ID NO: 6824406 - DNA, 71 bp, Homo sapiens
acagtttggcgtgattgatagtcttggctcaggagagtcccagaattgaactaacaaccacactaaattgt

SEQ ID NO: 6824407 - DNA, 61 bp, Homo sapiens
gatggctcagatgttggctgtgcagactcctatggccatagcctagctgtgtgaggccatc

SEQ ID NO: 6824408 - DNA, 90 bp, Homo sapiens
tggtggggctgtcaggcgtggggaacctttcctgagagaagaaaggagccgctctccaggtgggttcccgactctggctggctcccacca

SEQ ID NO: 6824409 - DNA, 69 bp, Homo sapiens
tgcattcagttggtcagcttttattgagtactatactcctcagagtgaggctaaggccaatggaatgta

SEQ ID NO: 6824410 - DNA, 109 bp, Homo sapiens
ggctgttttaactaaaatgtaagcaaacccaatgtctaactacagtaaacaaaatttattatgattcggacgtggcagtggtgtttacatctaggttgacaaaattgcc

SEQ ID NO: 6824411 - DNA, 72 bp, Homo sapiens
cctgccatgtgatttgatgctgtctttcagaatcactatcagtggcccctgaggagcgtcagccatggtagg

SEQ ID NO: 6824412 - DNA, 57 bp, Homo sapiens
cacctctcagctaggagtaagtagaaccaccaacctatgcctggtgcagaagaggtg

SEQ ID NO: 6824413 - DNA, 63 bp, Homo sapiens
gcatatttcaaaacccagtgcgtagaagacctttcttccatgtactgggttttgtatttatgt

SEQ ID NO: 6824414 - DNA, 87 bp, Homo sapiens
gcatggttaaagaaagccattcatctaatgtcctgtgaactttataagtggttaagtagttcatgtgagtagctgctttcaccatgc

SEQ ID NO: 6824415 - DNA, 87 bp, Homo sapiens
ctgcggtcttggcaaatttggtgtcttagtttccctcttagctttggctgtggggaaattcagagcttaatttacagttacatgcag

SEQ ID NO: 6824416 - DNA, 61 bp, Homo sapiens
attccccagccatttgcttctctgaaggaaagtctctccggggccagcaatgttgaggaat

SEQ ID NO: 6824417 - DNA, 78 bp, Homo sapiens
cttttagttcaaaggcaaaggtttgtgtcatccttaactgacaaacacttacattgtctcttgctgagcagctgagag

SEQ ID NO: 6824418 - DNA, 80 bp, Homo sapiens
cagcagattttagagtttacactgattctgtgttctaaaagaagaaaatgtaatatcactgtgaatgttatcatcttttg

SEQ ID NO: 6824419 - DNA, 122 bp, Homo sapiens
atgatagggacaatagaaaccaaaaccaaaacatagaaggaagagtagtaggatctcttcacagatttttattcttttgattctgttcctaaaatttggcttttcacctttgtaactatggt

SEQ ID NO: 6824420 - DNA, 68 bp, Homo sapiens
ggccccagctgcttctcctccagagctggattcaggactgaaggagggagggaggcagcaccgaggcc

SEQ ID NO: 6824421 - DNA, 121 bp, Homo sapiens
tagcttccaggaatggcaggcatacagaccccaaattttcactggaaatgcacagctgtagatgttagcatctgagtgaataaggtccatgacaggttttctggtgcccagccattttcta

SEQ ID NO: 6824422 - DNA, 84 bp, Homo sapiens
ggaggagcggggacgggcgagactggcataagcgtcttcgcgagggagcaaggcggcctgtgggtcggcctcaccccggcctcc

SEQ ID NO: 6824423 - DNA, 56 bp, Homo sapiens
gggaacttggattatttcttcctgggcaaccctgccaccaggccatcccagttccc

SEQ ID NO: 6824424 - DNA, 73 bp, Homo sapiens
gtctcagcctcagggaggcctctgtggcttctgtgcgtagaggccacagccatcacctccctgggtctctgat

SEQ ID NO: 6824425 - DNA, 89 bp, Homo sapiens
ctggaagggtagaattgttgtctagatcagcacaggaatttctggactccctgtgccaaaatctaggcagtctgaatggacttgtccag

SEQ ID NO: 6824426 - DNA, 55 bp, Homo sapiens
cttcattgttcaatacactcatcatccatccaggactgagtggagtgcaatgaag

SEQ ID NO: 6824427 - DNA, 106 bp, Homo sapiens
gaggacgaagcagagaagaaaatatggcaacacagggggttacaaattgttcatttactgaaggtttcgaattcttgtgtttgcttttactttaatgctgcccctt

SEQ ID NO: 6824428 - DNA, 81 bp, Homo sapiens
tgtgtgttgtgtatgtgtgtgtgtgtttgtcatggtactggaggacgacaaaataattactaacttgtacacagcctaaca

SEQ ID NO: 6824429 - DNA, 59 bp, Homo sapiens
ggccagcttattagctcagaggctatcttcatttgtccttgtgtactcaaaggctggcc

SEQ ID NO: 6824430 - DNA, 55 bp, Homo sapiens
aaattcagcatcctgcactggatcatacaattggtaagctgtggatgtgggattt

SEQ ID NO: 6824431 - DNA, 84 bp, Homo sapiens
acgtgtgtgtgcctgtcaacaagtggttattgggatggacgactggtcagtcatgtgactgcttttgggtggtgtgctttacgt

SEQ ID NO: 6824432 - DNA, 61 bp, Homo sapiens
ctcagggatgtttgttctaagatattcattcagaaatttacttgttccaagcatgtctgag

SEQ ID NO: 6824433 - DNA, 63 bp, Homo sapiens
aacacccttacagcctattaaggccatggagctacccagctggaaatcaggctgaagtgtgtt

SEQ ID NO: 6824434 - DNA, 95 bp, Homo sapiens
agttattaggttggtgcaaaagtcattgtagtttttgtaataattagttggtacaaaagtaattgcgtgataacttttgcaccaacctaaatact

SEQ ID NO: 6824435 - DNA, 58 bp, Homo sapiens
aggccctgatctcctggattcttctattaatataaaaggatctctgagatcatggctt

SEQ ID NO: 6824436 - DNA, 74 bp, Homo sapiens
cccccacccagggttcctccaccctgaacaatagaagctaagtatagggctggcccagcgcccagggcaggggg

SEQ ID NO: 6824437 - DNA, 82 bp, Homo sapiens
gaccacctgaattaataaccagcctgaatcatcctactctgggagagggtggaacagaactgtttattgaccaccagtggtt

SEQ ID NO: 6824438 - DNA, 78 bp, Homo sapiens
gctagcagcattcttctagttaggaaattgttgcagtttattgccacttttgcatttaaatggaagtagtttgttagc

SEQ ID NO: 6824439 - DNA, 88 bp, Homo sapiens
tgtgtgcatgccctatgccactgacatggacaattttagctaaaagctaaaagcctcccaggttatgagtaaacagggtgcttacaca

SEQ ID NO: 6824440 - DNA, 76 bp, Homo sapiens
catgcacaagggatgatgaaatcaaatcacctgtctatgacatcttatttttaatttattatccagtgttgtcatg

SEQ ID NO: 6824441 - DNA, 84 bp, Homo sapiens
ggaggctggaagtccaagattagggtgacagcatgatcagtttctggtgaaggctgtcttcctggcttgcagatggccacctcc

SEQ ID NO: 6824442 - DNA, 65 bp, Homo sapiens
tctagttaaggttcagtgtggcaggactgggatgacagtctgacctgctggatcttatatctaga

SEQ ID NO: 6824443 - DNA, 71 bp, Homo sapiens
gaaatgaatgaataccatgcaactatcagctggattaaaagagctttaggggtcattgtgctcattttttc

SEQ ID NO: 6824444 - DNA, 76 bp, Homo sapiens
tgtttaggactcaacctctggaaagtatggacaggtagaaacctagtcccactcccagggtaacaaggccagaaca

SEQ ID NO: 6824445 - DNA, 76 bp, Homo sapiens
gagtggtggggtgtggggcagagtggtgtggtatggttggtgttttaagcagatgattctgtcatcccagctactt

SEQ ID NO: 6824446 - DNA, 55 bp, Homo sapiens
tagccacaggccatgagataccagggggccgttccttggatggagcctgtggttg

SEQ ID NO: 6824447 - DNA, 58 bp, Homo sapiens
atctgggtctatgatctcacttcaaagttttggagtaagaaattctgtagatcctgat

SEQ ID NO: 6824448 - DNA, 82 bp, Homo sapiens
tcatacctgtgactccaaaggacttcccacaagctactggaatcattttgcccacgcggaagtgcctgggagtttaggttga

SEQ ID NO: 6824449 - DNA, 57 bp, Homo sapiens
ggggtaggcaggtgatctgatcagggcgaagacccagaccagcacgtaggttgcccc

SEQ ID NO: 6824450 - DNA, 56 bp, Homo sapiens
gctctgtgaaaacataaatggaaggatggcccattcatttaggagttcataagagc

SEQ ID NO: 6824451 - DNA, 75 bp, Homo sapiens
cctctgctcagcatccctctgagataggcagaaattactccattttacagatgaggatactgaggttcagtaagg

SEQ ID NO: 6824452 - DNA, 88 bp, Homo sapiens
ggagaattgcttgaaccctggaggcggaagttgcagtgagctgaaatcgtgccattgaactccagcctgggtgacagagcgagactcc

SEQ ID NO: 6824453 - DNA, 58 bp, Homo sapiens
tggaaagttctgctccaccgagcttttgtaggcgttgtcagagagcagagcggttcca

SEQ ID NO: 6824454 - DNA, 57 bp, Homo sapiens
gagagggagtgagacacaaaagaacaaagcttggagtcctgttcattacttcctttt

SEQ ID NO: 6824455 - DNA, 55 bp, Homo sapiens
ctgagggaatggaaggaggtggccgcgctaccaccatctgcttgcctgtcctcgg

SEQ ID NO: 6824456 - DNA, 61 bp, Homo sapiens
tcctacgaaggcttctcactttggttttccctaaaaccaggacattttagtcatcttagga

SEQ ID NO: 6824457 - DNA, 81 bp, Homo sapiens
gggtacggggatggatggtcgaccagttggaaagtaattgtttctaatgtacttcacctggtccactagccgtccgtatcc

SEQ ID NO: 6824458 - DNA, 58 bp, Homo sapiens
ctgggatcagggtggcaggggaataggatgaaactagccacttctatcttgctcctgg

SEQ ID NO: 6824459 - DNA, 85 bp, Homo sapiens
agatggaaccaaagcattgtgaacatttttattaaaacagcaaatgaagctatgaaagaagtgtcacattgccaagtattcatct

SEQ ID NO: 6824460 - DNA, 75 bp, Homo sapiens
gggaacacactgagtgttgatttatcctgctctttgacctacttagtcattttagtgtatatcaacatttgtccc

SEQ ID NO: 6824461 - DNA, 86 bp, Homo sapiens
cctttaatggttgcacacagttagaggtagagtccagcccacagcttcccaggtaagggctctatcctactgtttacccaccaagg

SEQ ID NO: 6824462 - DNA, 80 bp, Homo sapiens
ttactttgccttgttttgttcatgaacattgggtttagtgcctggcaacttgatgcatatggaagagcaatgccaagtga

SEQ ID NO: 6824463 - DNA, 80 bp, Homo sapiens
aaatgggaatacaattctgagagaatcaaattctgccaaattagtttagggcttctctcagattattttgtattatattt

SEQ ID NO: 6824464 - DNA, 69 bp, Homo sapiens
tttgtgtttttgtaatcttccttttgctgttgtggggtatagcaatagcaggtctacagagagagtgaa

SEQ ID NO: 6824465 - DNA, 87 bp, Homo sapiens
gtgtggtcttcgtaagtatggtttgccattgtctctacctcatttcctgaggagagtcatacagaccaatataattggaatccatgc

SEQ ID NO: 6824466 - DNA, 58 bp, Homo sapiens
tgagagagggatgcaccctcctgtctcctgtagagagtagagtgccccccatcttcca

SEQ ID NO: 6824467 - DNA, 98 bp, Homo sapiens
gagactgggtggttttggtgccaggctgagcatgattggagctagagactgctgcttcacaggcaagttaagcctcattgtacctactatgcagtttc

SEQ ID NO: 6824468 - DNA, 63 bp, Homo sapiens
tgagtccattctgttttcctggacctgaatttctccaactgccagaagacaagaatgttctta

SEQ ID NO: 6824469 - DNA, 84 bp, Homo sapiens
gctctggctgggccatttctttagggcatccctgatgtaaacatctctgtgtctcttgtcttgggggaaacccagtccatctgc

SEQ ID NO: 6824470 - DNA, 65 bp, Homo sapiens
cactgcttctttccttggtgacttcactttcactgttgcagtccttaggagaggaagtatctgtg

SEQ ID NO: 6824471 - DNA, 55 bp, Homo sapiens
ctctgcggtcagccagccctgggtttggtgctccaggaaaggccagcacgtaggg

SEQ ID NO: 6824472 - DNA, 57 bp, Homo sapiens
ctctgtttggttctccggtatggttcttggagttgtattagagaacacaaactaaag

SEQ ID NO: 6824473 - DNA, 78 bp, Homo sapiens
cagaactaccaaatctcaatctgagtattaacaactccgcaggtggttcctacgcacattgaattttggaaagtgctg

SEQ ID NO: 6824474 - DNA, 62 bp, Homo sapiens
atacagtataactaataaaccctgaaatagcattagttttgggggggagtatgtgcatgtgt

SEQ ID NO: 6824475 - DNA, 64 bp, Homo sapiens
gggttgggtcgcagtggagaccaatcatctagcatttggtcctcaggttctctgtgcgtagccc

SEQ ID NO: 6824476 - DNA, 66 bp, Homo sapiens
tcgacttcaaattgtattgtcgagtattttatacaaagaaaaccaatatgcattgtttgaagttga

SEQ ID NO: 6824477 - DNA, 122 bp, Homo sapiens
gctcttggagcaaatctggcttacatgcttctgaacgccaaatggctgaaggccacctctctctacccccttggctggcagttatctttggatgacttggaagaagccacagttcccgcagc

SEQ ID NO: 6824478 - DNA, 98 bp, Homo sapiens
attaggaaatgaagagtaggcattcatcaggcagtgtggcttcacaggcttcaccgagatcagatgttaagaatgcctgcctcatgtggcttcttgat

SEQ ID NO: 6824479 - DNA, 90 bp, Homo sapiens
ttatggaattataaaatcttaataggcattgagcacttgctaggtccaagcatagtgctgagtgattgatattttagttagtcttcataa

SEQ ID NO: 6824480 - DNA, 59 bp, Homo sapiens
cgaaagctgtgcactgggtccaggatgacttgcacaccctgttcactgcacagtttccg

SEQ ID NO: 6824481 - DNA, 79 bp, Homo sapiens
cctctgaacttcccaccccagctctcaaggctccctggggctccctgggcctctctgggggctgacttgggaagggagg

SEQ ID NO: 6824482 - DNA, 56 bp, Homo sapiens
agtccagggcttagtcagcggggcccggagtggcttccctggctggcatctggact

SEQ ID NO: 6824483 - DNA, 76 bp, Homo sapiens
tcacatgcttgataaaatgatgaaatcactgaccagcaggatccgtcagtggagtcagcattttatcacaatgtga

SEQ ID NO: 6824484 - DNA, 63 bp, Homo sapiens
atcaagcaggagtgtactgagtgcctgaatgaggagcttattcttgcttcacactcctctgat

SEQ ID NO: 6824485 - DNA, 73 bp, Homo sapiens
gtagggagtgaatgtttgatgagaaatagagtggatacagagttccactccctacaaatcatttattaactac

SEQ ID NO: 6824486 - DNA, 129 bp, Homo sapiens
gaaacactaagttcaagaaacatttgcaagtagagtgaagtaattgttaggatttacagaagattttaaagatgcaattattattcttctcatgtgtgaatttgtctgcatatgacttccagcgttttc

SEQ ID NO: 6824487 - DNA, 64 bp, Homo sapiens
tcatgatttacttggtggatgatcttagggaaattcttcaaacatctgggccacagtttcatga

SEQ ID NO: 6824488 - DNA, 60 bp, Homo sapiens
tttttcacgtgacaagaagtcctgaggttgagctgcttagggtgttaagtcagtgattga

SEQ ID NO: 6824489 - DNA, 94 bp, Homo sapiens
ctactgaattaatcctgtacttctaaatgagaaaaaggtgacaacctcaaattacccagaaagctacatttggagagtataggaattttagtag

SEQ ID NO: 6824490 - DNA, 74 bp, Homo sapiens
aggcatccagctacaatgaccaaaatgtttccagcttgcaagtgtatctgaatcatggtcattagtttatgctt

SEQ ID NO: 6824491 - DNA, 84 bp, Homo sapiens
tggaacattaagggggaagaaagaacatggcatacaaaaatatgtgtaaatgcaacgggctttccttatcctcttgagttttca

SEQ ID NO: 6824492 - DNA, 92 bp, Homo sapiens
tggcaatttctgattaacactgacagtatcagagctgttttcacattagattaaaatagtaatttagctgcttagtaaatgattgaatgcca

SEQ ID NO: 6824493 - DNA, 73 bp, Homo sapiens
gctgcagggagctggaaggctcccagcaacacagcctgccccctctgggcagccaaccagcagcctgttcagc

SEQ ID NO: 6824494 - DNA, 72 bp, Homo sapiens
gattggggtggtaatacaccgttctgccatatttaaagtataataaagcaaatgatgtgtgttgtcccattc

SEQ ID NO: 6824495 - DNA, 57 bp, Homo sapiens
caagccaggtgaacataacaagtagagaacattcttgttgttcaagaagctggtttg

SEQ ID NO: 6824496 - DNA, 88 bp, Homo sapiens
aaatatgtcatctgcttcctgctgggatactgagtatgaagtgctccaggcatcccccaggacagagcccctgtatcatgatctgttt

SEQ ID NO: 6824497 - DNA, 62 bp, Homo sapiens
ggctggttctgccctggacagccttggccaaagcagagagagggtccctgggcagaggcacc

SEQ ID NO: 6824498 - DNA, 71 bp, Homo sapiens
gtggacttcacctcatccactttggccaccatgtttttgttgtgtgtcagcaggggagggaacttacccac

SEQ ID NO: 6824499 - DNA, 84 bp, Homo sapiens
gcagtatctattgttcccatgttaattttcatgtgtgcttaatgtttagctccaacatatacatgggaatatgtggagttttgc

SEQ ID NO: 6824500 - DNA, 67 bp, Homo sapiens
ccccaagtggcatctctctaatgacgagagaatgttctcgcagatgtgcagatgtcgggctgtgggg

SEQ ID NO: 6824501 - DNA, 99 bp, Homo sapiens
gaggcatgagaatcacttgaaccagggaggtggatgttgcagtgagctgagatcatgccacttcattccagcctcgggtacagagtgagactctgtctc

SEQ ID NO: 6824502 - DNA, 72 bp, Homo sapiens
cacaggtagcttttgatattagggctggctggaatgtctgatgtcatccctggagtccggagctcacctctg

SEQ ID NO: 6824503 - DNA, 62 bp, Homo sapiens
cttttcagtgctccactcataccactgtggctttcagaagctgagctgggagttctgaaaag

SEQ ID NO: 6824504 - DNA, 84 bp, Homo sapiens
cgtgtggatttcagagccatccgcggctgccggctgttggggcggccaggagtggcctgccagcagatggcgctgcgccgcacg

SEQ ID NO: 6824505 - DNA, 59 bp, Homo sapiens
tcactcaatatcccagtggggcccaaatacttatatagccttatttgagaggggagtga

SEQ ID NO: 6824506 - DNA, 73 bp, Homo sapiens
gagggaggcaaaagatgggccatggagtcacgcgaatctgaggactggctccaactccacctttgtctccctc

SEQ ID NO: 6824507 - DNA, 95 bp, Homo sapiens
gcatgatgaggacactatactgctctgttttcgtatgttttcaatgttccacgacaaacatgtttagaaagcagctgaagcatcttcttttatgc

SEQ ID NO: 6824508 - DNA, 71 bp, Homo sapiens
tggaaaagaacaggcttgtcagaatggattagaatatggttttttagtctcccttctcaaagctctttcca

SEQ ID NO: 6824509 - DNA, 65 bp, Homo sapiens
gctggggagcctggagtttctgatgggaggaggctacctctaccctcgctcctcggttcccctgt

SEQ ID NO: 6824510 - DNA, 70 bp, Homo sapiens
attatcctggatgatccatgtcatggaacattgagctgcgtatcctttcatttccatcattcagggtgat

SEQ ID NO: 6824511 - DNA, 122 bp, Homo sapiens
tggcagcaaaccttgagcttggggaggtcttcagctgccagtctcaccctgggtcctccagccctaggatgggccagtggtgggaatggggatgtggaccagacatccttagcacagggcca

SEQ ID NO: 6824512 - DNA, 81 bp, Homo sapiens
gtcaggaaggatggcaaaggcagcaccgcctcctgaaacaatagagtcatcaggcacgttgctgcccccgtctaatttgat

SEQ ID NO: 6824513 - DNA, 85 bp, Homo sapiens
gctggcggtgctgaactcctgcaggccagaggggtgagcctgctggaaggggctccagctggggtgcaggaagagcattcccagc

SEQ ID NO: 6824514 - DNA, 60 bp, Homo sapiens
agggtgtcagccacggaatgggacagggtccccaggttccctgtctgaggttgggaccct

SEQ ID NO: 6824515 - DNA, 99 bp, Homo sapiens
gggtatgttggaaaaagagagatgaagttttctgaggcactggctctcccagaagacctggggcagcttctcgggctctcctttcttctagcctggccc

SEQ ID NO: 6824516 - DNA, 67 bp, Homo sapiens
tgctcccatcttctttctgcaaagtccccaaaacaagatgtttggtgtacaaaacaagatgggggta

SEQ ID NO: 6824517 - DNA, 104 bp, Homo sapiens
cccctgcttagtaggagctctgggtggcaggtgtctcctggtgcatagtggggctgggcgtgggaggccctgcccagagctcctcgctggtgttgcagcagggg

SEQ ID NO: 6824518 - DNA, 57 bp, Homo sapiens
gaacagaagaggctggtgccactgtaagcctaagaggccccaggcctagatttgttc

SEQ ID NO: 6824519 - DNA, 63 bp, Homo sapiens
gtttaggctttaagtggcctacagctccttcctggagcatgctaccactcaagctctttaaac

SEQ ID NO: 6824520 - DNA, 59 bp, Homo sapiens
ctctgagaaagctgtgagctaaaagttgccttacattgcagaactctcagtttccagag

SEQ ID NO: 6824521 - DNA, 78 bp, Homo sapiens
gcttatgtttatttgttgacttgcttttcacactcatctacttagcaagtcagaaaacagagcaattaagcatcaagc

SEQ ID NO: 6824522 - DNA, 68 bp, Homo sapiens
gcagacacagggaaggcaaggaagggaggcgggtatgctgctggggagctttgttttgttttgtttgc

SEQ ID NO: 6824523 - DNA, 82 bp, Homo sapiens
catggcttgctcacactagcctcacattaccttgatgttgttacattccaggttggtgcagggtagctctgagatggccatg

SEQ ID NO: 6824524 - DNA, 56 bp, Homo sapiens
gagctgtctctatatgaatgctcagtaaacatgccagtcatctgcagggatagctc

SEQ ID NO: 6824525 - DNA, 77 bp, Homo sapiens
ttgcatgttccttctttggttttcggttttcccaggaatagaccagtgggagtggagcagagaggggatctttgcaa

SEQ ID NO: 6824526 - DNA, 73 bp, Homo sapiens
tctgggatcagaggggagagaccagacccaagtgggtgcacaggtgtctaattctcaccccctgcattgcagg

SEQ ID NO: 6824527 - DNA, 71 bp, Homo sapiens
tctgtgtctgttacttcactgcaggtaggtaggcgttacaggcattggcggaaggggaaacagaccacaga

SEQ ID NO: 6824528 - DNA, 59 bp, Homo sapiens
aggggaccagaggctgtgcacaattatggcttgattgtccctaacatttctgttcctct

SEQ ID NO: 6824529 - DNA, 69 bp, Homo sapiens
gacttcagatattttttaagttgcttgcaccctattaagcaagtagtaatattgtgaaatattggagtc

SEQ ID NO: 6824530 - DNA, 76 bp, Homo sapiens
gaattactgatttttgggccctaccacaaactcactgaatcagaatcttggaggtgggagtccaggaatctgtttc

SEQ ID NO: 6824531 - DNA, 63 bp, Homo sapiens
tatgcgtgattctaggtccattatttgcatctcattggtgaagattaaataggatcctgcatg

SEQ ID NO: 6824532 - DNA, 90 bp, Homo sapiens
gtttaactattgtatagtgaagaatatagattttttgaagtctttattaaacatattagggtctctaaattctagctaacatggtaaagc

SEQ ID NO: 6824533 - DNA, 62 bp, Homo sapiens
ctttattttctttgatgggttgttcacaatagaaactgagcaatccatcagagaaaataaag

SEQ ID NO: 6824534 - DNA, 79 bp, Homo sapiens
gagaaagtgcctttgtttccaaagttgccataagcttctgggaagtttatatacacttggaagaaagttacactttttc

SEQ ID NO: 6824535 - DNA, 62 bp, Homo sapiens
atgtattatggttttccttaagtctgggctgggtttttacaaaaaggaagaccatcagatat

SEQ ID NO: 6824536 - DNA, 94 bp, Homo sapiens
ctcatttaagggtgcaggcttctttgtggcagtgagctgggtaaatggtgattacttttctttgatttgctacataagatttgcctcctgtggg

SEQ ID NO: 6824537 - DNA, 55 bp, Homo sapiens
ctcctccttgtgtctgggaaggtgtgtgcacatctttagttgaaggcaaggggag

SEQ ID NO: 6824538 - DNA, 81 bp, Homo sapiens
aggcacaatgaattggaatggtgttagaaagattttctctagggaagactacattatgacagcattttccaaagtgtgttt

SEQ ID NO: 6824539 - DNA, 122 bp, Homo sapiens
acagacagcgttagaaccaagataaactgatgcactaaatgcctaggaagaagccaagggaggtggttgtgtccagtgctatttggtatgtaattatcagttttgtgttttagcctgcctgt

SEQ ID NO: 6824540 - DNA, 64 bp, Homo sapiens
atcacctggccattgggttaacagaccaatttggagtctattgtaataatccagggcaggtgat

SEQ ID NO: 6824541 - DNA, 55 bp, Homo sapiens
accacattgctccacagggttaacagacaactgttaaatcaaagaataatgtggt

SEQ ID NO: 6824542 - DNA, 101 bp, Homo sapiens
tctccttggacttccttttgggaaactgtttaaggaactcacatacaatacatttaaacagctaatggccaggaatagaagttcaatacataaacaggaga

SEQ ID NO: 6824543 - DNA, 65 bp, Homo sapiens
ataggaacattgttcattgttcagctcagcttctcctgttgattcagtgcactgaacaatcctgt

SEQ ID NO: 6824544 - DNA, 95 bp, Homo sapiens
ggaattagcctcttcgactggggcggagtagctggggtgtgagaaaagaacaccttcatacaacttccagctttcagccccttggagagatttcc

SEQ ID NO: 6824545 - DNA, 118 bp, Homo sapiens
tgagtcagtagaataagattgcataggcggatttgtggctccaggaagtggcttgaactcaggcagtcaggtttcagagcctgcaatcccaattggcgttctattcgtctactactca

SEQ ID NO: 6824546 - DNA, 57 bp, Homo sapiens
ggagtgctccaaatttgtatgaagatcaaggtcacatattcaaaactggaccactct

SEQ ID NO: 6824547 - DNA, 71 bp, Homo sapiens
ggaagaggaaactgaggcctgggaggtccaggggcttgcccaaatcccagcaggagtccagttccctctct

SEQ ID NO: 6824548 - DNA, 59 bp, Homo sapiens
ttgcctggccagtctaacagaggtgttaagatcctaagcactagttctactgccagcaa

SEQ ID NO: 6824549 - DNA, 88 bp, Homo sapiens
gagaaggcagcagtggggcggtatgtcagcatggctaagtctgtggatgctgacttctctctgcagtggttctcactctggccttctc

SEQ ID NO: 6824550 - DNA, 64 bp, Homo sapiens
gagcctggggtctctgactcacagtccagggcacctgtgctgtctctctaggacactggggctt

SEQ ID NO: 6824551 - DNA, 96 bp, Homo sapiens
gtttgtgggaggaggactggcaaaaatatgagagtaggagtttgggctcttgagcttgggcctggccttcaaatttccactctttcactcactagc

SEQ ID NO: 6824552 - DNA, 82 bp, Homo sapiens
tcaatagtattcctttagtgttgcttaccaaccatggtttcactgtggaaaccagaagtgatctaaagaatattgaagttga

SEQ ID NO: 6824553 - DNA, 108 bp, Homo sapiens
ctgtttcctggggattcctctcttgactctatatatacttcactgcttaactcaagatctctttaaagaggtgcagtgagtgagaattattgggggcctgggaggcag

SEQ ID NO: 6824554 - DNA, 64 bp, Homo sapiens
acactgacttttaggctgtaattagcaagttggctcgtgtctctctaaggccaaaagtaagtgt

SEQ ID NO: 6824555 - DNA, 62 bp, Homo sapiens
gcctctcagcagagctctgactgttctcaggctgcagtatcagacagaggctgtatgagggc

SEQ ID NO: 6824556 - DNA, 94 bp, Homo sapiens
gagtcctgtaggtaaatgtcacagtgacagagatgttagtttggcaagactgcaagtcctgtaactgtgtgcacctgtgccaattacagttctc

SEQ ID NO: 6824557 - DNA, 56 bp, Homo sapiens
gccaagctgcctgaggcaaatttgcatgtgttaggtttaactcaggcaacttaggt

SEQ ID NO: 6824558 - DNA, 73 bp, Homo sapiens
ggtacaagtgtctgagtaaatttctcattgaactatttttcatcagtgtaaaaataatcagattactaatgct

SEQ ID NO: 6824559 - DNA, 65 bp, Homo sapiens
tttttattcctggtttatacctgtatcaatgtcttgattgaatcagaaatcatcaggggtgggag

SEQ ID NO: 6824560 - DNA, 80 bp, Homo sapiens
gctaatggtttttggctctggcgagctttagtacaggaacactcattgtattgtgggtgtcagagtgcaagaataacagc

SEQ ID NO: 6824561 - DNA, 70 bp, Homo sapiens
ctagcaggctaatgtaagcttgtactcccccaaattaaaagggatcagtggcatatattagttatgctag

SEQ ID NO: 6824562 - DNA, 86 bp, Homo sapiens
ggcccacaagattttctgcctttctcaagggcaaaagattactgtttttacatgtccttcaagagcagtggatctctgcctgggcc

SEQ ID NO: 6824563 - DNA, 73 bp, Homo sapiens
gatttttaagagcatgttaattctaggacagtctgaacatctgtgtcttaggagaggcatgttttaggagatt

SEQ ID NO: 6824564 - DNA, 55 bp, Homo sapiens
atgccatcttcattctcacactaaaattacagtgtgaacatgcaaagataggcat

SEQ ID NO: 6824565 - DNA, 58 bp, Homo sapiens
gtgtgactagtcatgcctgaattccaccaagaaagcaccaggcctgtctagctcacat

SEQ ID NO: 6824566 - DNA, 97 bp, Homo sapiens
cctgaagctggtaattttcacagaggacaggcagttttccagatcagatatgtgcttgtgtttgtctttgccctgctcgaagatggttagaaacagg

SEQ ID NO: 6824567 - DNA, 67 bp, Homo sapiens
ggaaattggcttatggtcagaccaaactgttcttatcccctgtgtaagaggccaagtcatcatttcc

SEQ ID NO: 6824568 - DNA, 55 bp, Homo sapiens
gtgggcaggagtgagcaacaggcatttctgagccgttctccttgtttcttgccac

SEQ ID NO: 6824569 - DNA, 63 bp, Homo sapiens
tgctcagcagtcaaggtcatagagcctggagtcgtcctagaaaatagacttactgctggggca

SEQ ID NO: 6824570 - DNA, 68 bp, Homo sapiens
agcgttagagagctctaggggtggaactgagcacctgctcatgacagccagagctctgacctcgtgct

SEQ ID NO: 6824571 - DNA, 56 bp, Homo sapiens
gcgatgctaagccaccatctgtgaggagagctcacagaggtccaaacagtataagc

SEQ ID NO: 6824572 - DNA, 60 bp, Homo sapiens
gtctgcttgtggtgagataggataactatccctctggttttccatctggtataagctgat

SEQ ID NO: 6824573 - DNA, 57 bp, Homo sapiens
ccatctctctcattttgtgcactgttacttagcagtttacataaaaaggcagagggg

SEQ ID NO: 6824574 - DNA, 61 bp, Homo sapiens
tttagggtttctctccagtgtgaattatctaatgattagtaacatctgagaaacacttaaa

SEQ ID NO: 6824575 - DNA, 68 bp, Homo sapiens
tggaagggagtgacagtcagaggctagttattattgtttttgcttctcttattgtgactctcagttca

SEQ ID NO: 6824576 - DNA, 75 bp, Homo sapiens
cctgctactgtgcctggcatatatagtcaaagctcaataaacggtggtggtggtaatactagtcatagtagcagg

SEQ ID NO: 6824577 - DNA, 94 bp, Homo sapiens
ccctttgccgctgccgggagggcggtgaggtgtcctgtgagccctccagctgcggcccgcatgagacctgccggccatccggtggcagcttggg

SEQ ID NO: 6824578 - DNA, 86 bp, Homo sapiens
agggctggtctgaggcgggcaatggggatcctgatgagcagaataagagcttagcagcatgatcccagttgattgcccatagccct

SEQ ID NO: 6824579 - DNA, 80 bp, Homo sapiens
gtatccattacttttaacaacgtatgatctgaaagtatttgcctaaaatgtccttgagtgcgtgttagagtatctggaac

SEQ ID NO: 6824580 - DNA, 61 bp, Homo sapiens
agtcccgtagcaggaaacctgtgttgagggaggctcttttcattcttttcttgctggggct

SEQ ID NO: 6824581 - DNA, 113 bp, Homo sapiens
gacttcacatcatacttttgtttatttctcatatcaatactgtagatgtattaatacatgctatacatgtacattctgtagatggagaaaataaggccaaggaacatgaagtt

SEQ ID NO: 6824582 - DNA, 79 bp, Homo sapiens
agtcatgagcctttcattctccagggtgactgagttcttgcttagaacctcataagaatcgaaagttatatttaagact

SEQ ID NO: 6824583 - DNA, 80 bp, Homo sapiens
tgaaaccatagtagagtcagcttgatatgctgtcatataatttatcttttagcattcaatgattggacttgcctgtttta

SEQ ID NO: 6824584 - DNA, 75 bp, Homo sapiens
tgcattcctgacccaccaagtctgtaagcataataaaatgattgctttacaaaatttgaagtggtttgttatgca

SEQ ID NO: 6824585 - DNA, 55 bp, Homo sapiens
tccagtggaggtatttgctaaaatcacacaggttgtcagaaataccagtattgga

SEQ ID NO: 6824586 - DNA, 74 bp, Homo sapiens
gcattatttggttcactgttctaggctctggggctctgccctgtggagctttcaggataatgaaaaagtctggc

SEQ ID NO: 6824587 - DNA, 83 bp, Homo sapiens
cattcatttagtgggtccttggttctgtgagcaaaagcaaacgaatgaggttccacaggtatgaggccccacctgataaaatg

SEQ ID NO: 6824588 - DNA, 123 bp, Homo sapiens
ctggggctgggtctgcgttgctcttggaatccttaatttcctgggcctcagtcacattctgctgttggggaaactgaggcacagaaaatggtagggatttcattcacgagcgcccagtctgag

SEQ ID NO: 6824589 - DNA, 59 bp, Homo sapiens
tcccttaagcacctgagtagtcaatatttacattttagacaactgatgtgcttgtggga

SEQ ID NO: 6824590 - DNA, 68 bp, Homo sapiens
tctcagcagaagtccgactccagtcattgtgatttactcacaggcaggggatgggggttttggtgaga

SEQ ID NO: 6824591 - DNA, 64 bp, Homo sapiens
agctgtaggatgaggtctagacagtagcgtgaatgctcttcgtactctaacctccccttcagtt

SEQ ID NO: 6824592 - DNA, 74 bp, Homo sapiens
ttcaccaagcatctgttaagtgccttcaatgtgttagacattgagctaggcactacaggtcatgaactggtgag

SEQ ID NO: 6824593 - DNA, 61 bp, Homo sapiens
gagaccaggggatggatctgctgaccttagagaagagtcattgcaggcattcccctgcctc

SEQ ID NO: 6824594 - DNA, 63 bp, Homo sapiens
ttggtcatatgttactccaggggtattaactctttctagcttctaggtgtgtgcatgtgccaa

SEQ ID NO: 6824595 - DNA, 57 bp, Homo sapiens
gtctttttgtgccattccttttggggcccaggacctaagcaggaacttcaaagggac

SEQ ID NO: 6824596 - DNA, 56 bp, Homo sapiens
tgacaagagacccctccgcaggcgcagttgctagtctttaaggggcctttgtgtca

SEQ ID NO: 6824597 - DNA, 84 bp, Homo sapiens
gaaaccggggttgttgttggatgttaccgttgaaaatcagtctggatgcaaatgggcatctccaagtgtgcagctttggttctc

SEQ ID NO: 6824598 - DNA, 126 bp, Homo sapiens
gttttattggaacacagccacagctatttgcttaggtagtctctgttgctgctttcatgggcagaatggagtagttgcaacagggaccatctaaaatagttactagctggctcttcacagaaaaat

SEQ ID NO: 6824599 - DNA, 59 bp, Homo sapiens
cttgattttgtctctggccctgtaccatttcttctggtttgaggcccagcagagtcggg

SEQ ID NO: 6824600 - DNA, 64 bp, Homo sapiens
attttcaggttttgccattgtattgtatgtatgtaagatgtatatatgggggaagctggatgat

SEQ ID NO: 6824601 - DNA, 70 bp, Homo sapiens
caaaagtaaggaaccagctaatattgttagtcctgactggaaaacaagaataagtggtttctggaagttg

SEQ ID NO: 6824602 - DNA, 77 bp, Homo sapiens
ggagaaggactagggtccaagccttataattactacatcagcacagtattatagaatgttggccccgtctcttttcc

SEQ ID NO: 6824603 - DNA, 79 bp, Homo sapiens
ccagccccttgctagctgtgcacccaggggccagccaatccctggctctgagctgcaaagctgcaatacagggatatgg

SEQ ID NO: 6824604 - DNA, 99 bp, Homo sapiens
aaaccgtccagttgtttaattatctctttatgtgaaaggccaggttttactttgcctgtctgtcagtataggcaggtggttattttccgggacaggttt

SEQ ID NO: 6824605 - DNA, 57 bp, Homo sapiens
gcttggtagaatgaacattcattgaccatctgttatgtgataggcattttactgagc

SEQ ID NO: 6824606 - DNA, 81 bp, Homo sapiens
gtatgttcctgccgtagttcttagagcaaaatttcaggatgtgagtctccacacactgctctgtatatgagcaggaactac

SEQ ID NO: 6824607 - DNA, 130 bp, Homo sapiens
tctcaaggttaaatgaaatctttcatgtagtcctccagtcatagtctgtcttgttctcctcggaaatgagtggatacacaagacgtgacatataaaacttgaaaatgtgaatttgcattcaatctataaa

SEQ ID NO: 6824608 - DNA, 70 bp, Homo sapiens
gctgcaaggcttattttcctccttcctgtgcaatgataacagctctggggttggaaagtgatctaacagt

SEQ ID NO: 6824609 - DNA, 58 bp, Homo sapiens
aggagttaaggttcaattaaagttacttaaatgtgactaaaataggacattaactttt

SEQ ID NO: 6824610 - DNA, 94 bp, Homo sapiens
cagtttcaatggctgcagagcatgtcctcaggacagtgtgtgtgcccccagcagccctgctcctcgggaggacctgcttaagcagtcatagctg

SEQ ID NO: 6824611 - DNA, 57 bp, Homo sapiens
tctccccaggccccacattgtctactgaagcagataggccagggtgacctggggaga

SEQ ID NO: 6824612 - DNA, 68 bp, Homo sapiens
acagggtaaagggaatctgctctggagtcatacttgagctcaattcctggcacaaccctttaccaggt

SEQ ID NO: 6824613 - DNA, 77 bp, Homo sapiens
agtggcctgactccccaggctcctgctgtgttgacaaaattctgcaagcacaaatggacctggtcagaaagagccct

SEQ ID NO: 6824614 - DNA, 71 bp, Homo sapiens
tctatcaaagatggcccatgatctcttggaggcctgactctaatcatcaggattatcccattagggataga

SEQ ID NO: 6824615 - DNA, 89 bp, Homo sapiens
gtgcagaaaatataattacaactttattggatatttacaagatacacaaggtatcttgtaataatgaaagatttctctattttctatat

SEQ ID NO: 6824616 - DNA, 60 bp, Homo sapiens
tccctttaccgagtttgctggccccttctcgaatatattcagcaagaacgttctgaggga

SEQ ID NO: 6824617 - DNA, 64 bp, Homo sapiens
ttatttttatggcatttggtgtgactaccctcccatcctggagacatcagagttgtgaaggtag

SEQ ID NO: 6824618 - DNA, 90 bp, Homo sapiens
ctaattagactcacttcttttactataaaaccttaagagaatattttgatcaagagagttttttagtgaaatctagagggacaagattag

SEQ ID NO: 6824619 - DNA, 61 bp, Homo sapiens
gtgttggggaatataatcactcataaactgaagaaaatggagtgattatgggtttttacat

SEQ ID NO: 6824620 - DNA, 61 bp, Homo sapiens
ccaatgagaggtatcagatccttatccatcatcttcttggatcttggtatagtcttattgg

SEQ ID NO: 6824621 - DNA, 72 bp, Homo sapiens
gactacctgctgtcttaggacttggggtaatttatgtagattaccaaagaatattttaaatagttggtcgtc

SEQ ID NO: 6824622 - DNA, 85 bp, Homo sapiens
atgcatgtaattttgtatgtgcatgcatgtatatggtgtgtggtgtgtgatgtatggtatgcatgtggtatatgcttatgtgtat

SEQ ID NO: 6824623 - DNA, 89 bp, Homo sapiens
gaagtttggaatgcttttttagacacactttgtatatttggaaactgtatttcataatatgacttgtttgaaatggatagctagatttc

SEQ ID NO: 6824624 - DNA, 82 bp, Homo sapiens
gtatttgtgaagatctgagccctcaggtcctgaatggtaatggccccagtctctgacttagggtctcttcttctccaggtgc

SEQ ID NO: 6824625 - DNA, 66 bp, Homo sapiens
gcatggatgaaggcgaggatgaggggctaggactaggaggtgcctcagcttccttacatctaatgc

SEQ ID NO: 6824626 - DNA, 63 bp, Homo sapiens
aaggctgtgaacttttcgggaactggaactgtttaacttgaacccaggattgtttaaagcttt

SEQ ID NO: 6824627 - DNA, 86 bp, Homo sapiens
ttctcaagactcctaaataaagcatttcccctgtgtgggcgacccctgggtcccatgtggggtcagtgtttgggtctctctgagag

SEQ ID NO: 6824628 - DNA, 76 bp, Homo sapiens
tcacttaaacccaggagatggaggttgtggtgagccaagattgcaccactgcactccagcctgggcaatagagtga

SEQ ID NO: 6824629 - DNA, 97 bp, Homo sapiens
ggcatcccatcaagaagtaaatgccacagtagcatccaaacagtagaagatgctggtgatgtggtgctgagtgacagcaattttactatgatgtgcc

SEQ ID NO: 6824630 - DNA, 71 bp, Homo sapiens
ctcagcctcagcttcctgtctgcagaatgggaatattaattctgcctcacaggcagctgggaggatttgag

SEQ ID NO: 6824631 - DNA, 81 bp, Homo sapiens
actcctgagggcttcattgaaggagggacttgcttgggggaaactggaagcaatttcctgttcagtgagacccatggatgt

SEQ ID NO: 6824632 - DNA, 57 bp, Homo sapiens
gcaagcagttgtggcttctgagaagaatgtatcttgtgggccattcagctgctctgc

SEQ ID NO: 6824633 - DNA, 63 bp, Homo sapiens
gggtgggggagggaggagtagtgaacgctgccgcactcgcctctctttttctcccagacactc

SEQ ID NO: 6824634 - DNA, 72 bp, Homo sapiens
gtgtcacaaagggagggatagctgggttttaattctgattttgcagcgtttctctttacttttgccaggcat

SEQ ID NO: 6824635 - DNA, 55 bp, Homo sapiens
gggtctctgagtgaggacctgggcccggtaaccagccctggcctgtttcatgccc

SEQ ID NO: 6824636 - DNA, 97 bp, Homo sapiens
ggtctaatttgaacctgtcagagttactgttgcctgcgctggcccaaagtgcagatttttagtcagcttgtgataggccaggtgttttgtctggacc

SEQ ID NO: 6824637 - DNA, 70 bp, Homo sapiens
tattcttgactgcttactatgtgccttacaatgtagattccaaggattctatggtaaccagacaagaatg

SEQ ID NO: 6824638 - DNA, 78 bp, Homo sapiens
aagcatcttagacctgagttccttcatgtataaaatgagaaggaggaaccatatcacctctaagatcccttccagctt

SEQ ID NO: 6824639 - DNA, 56 bp, Homo sapiens
actgtctgtgccagatgctgggctggctcatgtgcaaagttcttgcaaagactagt

SEQ ID NO: 6824640 - DNA, 81 bp, Homo sapiens
cacatgctcgaaatgctttagggtgtgctgtctgtccttctgttctgcgcggacatacttctttagcatattgaacacgtg

SEQ ID NO: 6824641 - DNA, 56 bp, Homo sapiens
gccgaggctctgcccagctgctgttaaaaatcctaggagctgtgcagacacttcgc

SEQ ID NO: 6824642 - DNA, 66 bp, Homo sapiens
gtgtgtgctgttgggctggtacaaaaaagaatcatccatgtactcagcccacttcccagcacctac

SEQ ID NO: 6824643 - DNA, 64 bp, Homo sapiens
gaacccaggaggggagccctcaggggatggggctggtcctgtctctgaagccccctcctttgtc

SEQ ID NO: 6824644 - DNA, 70 bp, Homo sapiens
ttaaatccaagttggtagctggtgttttcagtccctgcctgaaaacagcagctgtttaatttgcatttgg

SEQ ID NO: 6824645 - DNA, 129 bp, Homo sapiens
gtaatacaaggaaggtgatgacttgctccattgtctgtggctttcttatgttgtaatgggagcttatcagtgtgcaccatgatcaggttacagcatcaggaggagctctacaacctattttagattcac

SEQ ID NO: 6824646 - DNA, 72 bp, Homo sapiens
gaagtacacatccttctgaacaaccttgcttcagcgctgcaaggttttaccacttagtgatgctgtgacttc

SEQ ID NO: 6824647 - DNA, 64 bp, Homo sapiens
gggcagtgggacagagggacccaaacagtcagccgattgcaggagcttggctctgtcccagccc

SEQ ID NO: 6824648 - DNA, 64 bp, Homo sapiens
ctgtcctggtgctggggatccctgagttgtaatcacatcccaatcagattcactgtggggacag

SEQ ID NO: 6824649 - DNA, 125 bp, Homo sapiens
tgtgattgaaagttatttccccacacactgtttgcatgtttttgtaatacacctacctgttttgtcaggtgttctaccaccagatgtgaaatagaacactgtgaggatttacttggtttgttata

SEQ ID NO: 6824650 - DNA, 56 bp, Homo sapiens
gaagagccatttaaatagttgtcagtgacaactacaacttacttgaatggcttttc

SEQ ID NO: 6824651 - DNA, 55 bp, Homo sapiens
tttccataatctcttggggagtggcaggaatgaatttctcaccatggtatggaaa

SEQ ID NO: 6824652 - DNA, 58 bp, Homo sapiens
cctgaataggctctgctcaaaacaaacatgggttttgtactctgagcacctattcagg

SEQ ID NO: 6824653 - DNA, 128 bp, Homo sapiens
gcaacttgagtggatcatttcttccttctggacctcagcgtcctcatctgtaagatggggctaaaagaagcccagtgttccttgaggggctgtggtgagaggtaaagaaatgagaatttgaaggttgt

SEQ ID NO: 6824654 - DNA, 83 bp, Homo sapiens
agggtaggagaatttaagtaatttgaagagacaggcttgtgaaaattagtctacaaagaaaagttattgaattctcttttcct

SEQ ID NO: 6824655 - DNA, 108 bp, Homo sapiens
gggctgctgggtgtgtgcagtgggttctgtggtcaggagagtgccgtctggatgggagatatttggttggttttagcttggcccattcctgccactgactgatggccc

SEQ ID NO: 6824656 - DNA, 65 bp, Homo sapiens
tattcacagatgaggaagagtcagccaaggactatttggtttatgtctacctgcatctctgaatg

SEQ ID NO: 6824657 - DNA, 130 bp, Homo sapiens
tttggaaatcatcagaagcttgaaaaaaatactgatgctcagacctcacccccaggaattctgatgtaattggtctgtggtgggccctgggcttcaggatttttaaaagctcctcccagcatttctacta

SEQ ID NO: 6824658 - DNA, 65 bp, Homo sapiens
cacatctggagatcagctggtggcaggctcatcccacccttccctgcaatggctctttagaagtg

SEQ ID NO: 6824659 - DNA, 90 bp, Homo sapiens
cagtgatgcacctaatctgtgtttctgccagtatgaccttaagagggacatggcttgcaagcataggagaatctgatgggtgctttcctg

SEQ ID NO: 6824660 - DNA, 117 bp, Homo sapiens
catgtggctcctgtcctgcatgcagggcctccagtgtctgccaactgcatggtccgtctcttcctggactttagatgacaagacacaagtgaggactgatgaaaaaggagaaaaatg

SEQ ID NO: 6824661 - DNA, 65 bp, Homo sapiens
gaacttacccatgattactgctgaaaagcactctatatttcagtattttccacgggtaaaagttc

SEQ ID NO: 6824662 - DNA, 84 bp, Homo sapiens
atgttaaattcagcgatccccagaaagcctggcactaggcttccctggccagtgactggctttctggtgtgtagaagaaaatat

SEQ ID NO: 6824663 - DNA, 80 bp, Homo sapiens
cgggagagccaggccttctccctccctcaacttcatggtgcaggcaagggacatggggagcacagggtgggggtctcccg

SEQ ID NO: 6824664 - DNA, 75 bp, Homo sapiens
ctgtgctttgcattgtttaatcaggaagtcaacatattacagagtgaaatcctttacaagcatgtgcaaacacag

SEQ ID NO: 6824665 - DNA, 64 bp, Homo sapiens
atcttacattccctcaccatttcaccacgtattaatttgagtcttaggtgcagggatgaaggat

SEQ ID NO: 6824666 - DNA, 108 bp, Homo sapiens
actttttgagctactttgttttaggagtatttaaattaatgtaaaagtgtagggaaatgtcttagctcagaaaatttaaacttactagatattaagtgcttaaaaggt

SEQ ID NO: 6824667 - DNA, 72 bp, Homo sapiens
cgtgaacataaagtactgagagactcttgccagaaaccaatggggcaaagatcttatttagctttaatcatg

SEQ ID NO: 6824668 - DNA, 78 bp, Homo sapiens
gtaattctgtttcttgctttgctttcaaggaatttgcaaattctccttcagaggataaggaagaatccatggaaatac

SEQ ID NO: 6824669 - DNA, 74 bp, Homo sapiens
aaagaggacaggctttgaagttacatagtctgggttaaaattgtgactgtgctacttagaagctgtgtggcttt

SEQ ID NO: 6824670 - DNA, 77 bp, Homo sapiens
acaaacacattcaaatagaactcacagacaagagcagttatttaacagttctcttgggtgtgtgtttatatgtttgt

SEQ ID NO: 6824671 - DNA, 78 bp, Homo sapiens
ggagaagcattgagcagtttttgccactgaagtttgaagaaaccagtttcaaagaaaattgctagtcgatacttttct

SEQ ID NO: 6824672 - DNA, 67 bp, Homo sapiens
tctccctggtttatttgctagctttgccagttggtgaagagaggacatggtgaacctgtaagggaga

SEQ ID NO: 6824673 - DNA, 117 bp, Homo sapiens
ctggagttcatgcagcagcccgaggaacagatggagtctaataacagtttaggatgagatggtgattcgattcctttgtcttcaaaataagtgggcctgtctacaagtgaactccag

SEQ ID NO: 6824674 - DNA, 122 bp, Homo sapiens
ctggcgaggaccaatacctaatccccaggtcgagtgcagagccttgcgtcatgtgccatgtgccgtagtggcctcagagaaggctgtgcgggcgggctcctggggatgcagtcaccttgcag

SEQ ID NO: 6824675 - DNA, 83 bp, Homo sapiens
cccaagcttcctgcgttagtttggggatgcagttacctgctgaggaaaatgcctcccaaacagcacaagaaaaggaaggtggg

SEQ ID NO: 6824676 - DNA, 125 bp, Homo sapiens
ttctttgtttaccctgagcttaagtcaaaggatgcatatgcatctgtgtacattggtgtgcattctagtgtgtgcatatgtgtttgcatgaggaatgactttttaaggttaagcgtgaaaaagaa

SEQ ID NO: 6824677 - DNA, 65 bp, Homo sapiens
gagtgatgggtctggggtgactttgtatgctcttcatgaaggtgtttatacctcagatcctcctt

SEQ ID NO: 6824678 - DNA, 80 bp, Homo sapiens
gggaaggataaagagtgggtgacagaaggaggtaatttctttgcctgcttgtttacctactcccctcttttcttcctccc

SEQ ID NO: 6824679 - DNA, 70 bp, Homo sapiens
agtttctgtaataattagtttagaaactaccaaggtgtaattcctgatgaatttcattattgcagagatt

SEQ ID NO: 6824680 - DNA, 99 bp, Homo sapiens
ggaacctggcacccaccgtgggggttgggctgggtgggaggcggggctccgtcatcttctctcagcccaggctcctcctcgtttgctcgtgctttttcc

SEQ ID NO: 6824681 - DNA, 85 bp, Homo sapiens
ctttgaattgtgactaggagatatgttttcttcagctttggctgcatcaaggagaagatacaaatttcttagatgcggatcaaag

SEQ ID NO: 6824682 - DNA, 61 bp, Homo sapiens
gggtagcagtcatcggcagagaaaacatgatgtatttgtcacctatggctgtcctgtgccc

SEQ ID NO: 6824683 - DNA, 69 bp, Homo sapiens
cgctgcccaggatggctggaggtgctctgtcccctagagcacagcatctccctctgtcctggggcagtg

SEQ ID NO: 6824684 - DNA, 89 bp, Homo sapiens
acagtaagttatttttgggttgttgaaagctgtgtctctgttctaaatttgagcgcagaaatcatgccacttacaaaataatgctttgt

SEQ ID NO: 6824685 - DNA, 122 bp, Homo sapiens
atctcccatcttctaagctatcgttagtcttctttcatttactcagtttccagaactgaatttgtgtagatggtctggaagcagtagctcaggtggctcatagaatttgatgcaaaggagat

SEQ ID NO: 6824686 - DNA, 64 bp, Homo sapiens
gggagcttacaggaatcactgctagatgaggacaccatcatctgtttcctaatctgtagctcct

SEQ ID NO: 6824687 - DNA, 78 bp, Homo sapiens
tccttctattttgagaactttggtattttcctttttgagtgaaaaatactatggattctggattaaaatagcacagga

SEQ ID NO: 6824688 - DNA, 58 bp, Homo sapiens
cagctgtcagccggtgcaggctcagcacatctcctgggtctggcaggtgaacgagctg

SEQ ID NO: 6824689 - DNA, 94 bp, Homo sapiens
caaatgcaatgaatgtggccagtcatgtagtaaccagatagagagtcaggaagttgcatcaactgagtcattaatcagctcattcatttatttg

SEQ ID NO: 6824690 - DNA, 88 bp, Homo sapiens
tttgtggcttctttgtttggggttctttgtttcctgcctataggtacctagaggcttaagcctgaggccccagacattagatcacaga

SEQ ID NO: 6824691 - DNA, 65 bp, Homo sapiens
agtggctgagatttattgagcaactactatatgctaagggttgtatgcttattgtctcatccact

SEQ ID NO: 6824692 - DNA, 67 bp, Homo sapiens
gttttgtgaattcttggaagattggtatttaaggcctttttatccatttctgggagatttataaaat

SEQ ID NO: 6824693 - DNA, 77 bp, Homo sapiens
tgcttgtggatccagtagtgacttttacattttatatctaaatagaagctggaggctttgttgggtactcataggca

SEQ ID NO: 6824694 - DNA, 60 bp, Homo sapiens
ggagtgctcagcgccaacctggctgctttagccggcagcaggggtggctatggcaactcc

SEQ ID NO: 6824695 - DNA, 65 bp, Homo sapiens
ccactttaaagggtccagatacttggaaatagctctgtttgtgagaggcaccttttcttaagtgg

SEQ ID NO: 6824696 - DNA, 61 bp, Homo sapiens
gcagcctcatgaagcaggcacagcttcaggaaaccctgccctatgaccagcttcactctgc

SEQ ID NO: 6824697 - DNA, 55 bp, Homo sapiens
gagcaggtctttcatggtgcatgcagaagctcctgtcccaccaattaagaccctc

SEQ ID NO: 6824698 - DNA, 57 bp, Homo sapiens
ggtaagaggcctggtggggtggctgagggccaggcaacttgaccaggctttctctcc

SEQ ID NO: 6824699 - DNA, 66 bp, Homo sapiens
ggagggggtggccgagggccctggtggagagtagcaaagtgacccgagagggcctccatcccctcc

SEQ ID NO: 6824700 - DNA, 57 bp, Homo sapiens
aggtccctaacagctttttaaagtcacggatagacttcggaatatgataagggacct

SEQ ID NO: 6824701 - DNA, 65 bp, Homo sapiens
tggatgaatgtgagcaggtgctggctgctgagcccaaggccaaggaccccttcacttaccatcca

SEQ ID NO: 6824702 - DNA, 63 bp, Homo sapiens
ataagaaggtagtttccaagtcactggtctgtgaacactgcttgtgattaattacccttttat

SEQ ID NO: 6824703 - DNA, 56 bp, Homo sapiens
agaggaaatgctctcccttctctgtctcttctaaacagaagaaaggcagttcctct

SEQ ID NO: 6824704 - DNA, 58 bp, Homo sapiens
gggcttctctgctctccttcccaagtctgcgctgcaagggctggaggatgggaagccc

SEQ ID NO: 6824705 - DNA, 84 bp, Homo sapiens
tatgctgtttaaccagaaaggtactcatcccaataaaatccagtaattagggcagtacgttttcttagttataaaatcagtata

SEQ ID NO: 6824706 - DNA, 58 bp, Homo sapiens
cctcagcagaatgtggcatgtcacccaaacagggacatgcgaagtcctgctgcaaagg

SEQ ID NO: 6824707 - DNA, 57 bp, Homo sapiens
ggggacttggaggctttatctggagctgcagctaccaggagcccccttctggtcttc

SEQ ID NO: 6824708 - DNA, 88 bp, Homo sapiens
cccaggattttattgctggtaaacttggttatctaccttccggtcacgtggtccaggatggtggcatgatcagaactaggtcctgtgg

SEQ ID NO: 6824709 - DNA, 90 bp, Homo sapiens
tttgtgaatacatttacatgtaatgttatacaaaggtatgaagacaaaatgccgtttggttgtatcattctatgaattgctttcatcgaa

SEQ ID NO: 6824710 - DNA, 68 bp, Homo sapiens
gtttcacccacattccactggccaaagcaatttccatgaccaagctcagagtcagaggatggggaaat

SEQ ID NO: 6824711 - DNA, 60 bp, Homo sapiens
tctccagagaagaaaagcaccttttttggttcatgcgagaggagcaattctttctgggga

SEQ ID NO: 6824712 - DNA, 77 bp, Homo sapiens
ctccaactgcagtgcgttcttgttctcattgttctggacagagagaagcaatcagcagccacccactgcagctggag

SEQ ID NO: 6824713 - DNA, 89 bp, Homo sapiens
cctcaggagctgatgattgtctctcctctctccaagttcaaaactgcagccacagggggtgagggacaaagccatatctcttgttcagg

SEQ ID NO: 6824714 - DNA, 82 bp, Homo sapiens
tcagaggaagtgctggagcaggacgtgggaatgggaaaccagaaggtttcgagccagggtacccgcctagtgtttcctctgg

SEQ ID NO: 6824715 - DNA, 56 bp, Homo sapiens
tgtctgttgctgggagaaaaggagatgaaaggatccctgagtccctgttacagaca

SEQ ID NO: 6824716 - DNA, 64 bp, Homo sapiens
gctctcctgtgcagatgctgctggcgctgagctttgtgcctggggcagaaagggtgaggacggc

SEQ ID NO: 6824717 - DNA, 67 bp, Homo sapiens
aggcacgaagtgttgtgtgtcaagtgcaagagctgaagttctgcattatacacaacctaagtgtcct

SEQ ID NO: 6824718 - DNA, 56 bp, Homo sapiens
acattgtgactctgagcattggggtctgactcctgagtgtctctggaagcacgtgt

SEQ ID NO: 6824719 - DNA, 98 bp, Homo sapiens
atttatcagcaccagatattgtcttcaaagtgtaggattggaatttctgtctttattccaattttatactttgaagacaatatctggagctgataaat

SEQ ID NO: 6824720 - DNA, 72 bp, Homo sapiens
tgctttcatttggttcatgaacagaaagttagggtttccctggcttcacaatttcataactaaacaaaagca

SEQ ID NO: 6824721 - DNA, 86 bp, Homo sapiens
tccttgacaaatggcattggaagacatatcatgctagaaaatgtttatctggtatttttccttctttgaagttatgaggtcaagga

SEQ ID NO: 6824722 - DNA, 59 bp, Homo sapiens
tggaagccaggaagcaggggtcagcggtcaagcccggaatccaagctgcctggctgcca

SEQ ID NO: 6824723 - DNA, 63 bp, Homo sapiens
tgcaagcactcaatgcaaacagtcattgtagattaacacaacaatgcacttgagatgtttgta

SEQ ID NO: 6824724 - DNA, 57 bp, Homo sapiens
ggtcaagacgggctctgccctttgctagcagtgcaaacttgggcaagttgcttgacc

SEQ ID NO: 6824725 - DNA, 63 bp, Homo sapiens
cccactttggttgcactctgccctgtggggacccctgactgaaggagggcagctgagagttgg

SEQ ID NO: 6824726 - DNA, 58 bp, Homo sapiens
tgcctgtcttaatatctggaaagagatttctgtgtcctgtccagcagcaaggcaggca

SEQ ID NO: 6824727 - DNA, 86 bp, Homo sapiens
tctggctaaggctattgggaagaaaaatgtttgctatttgttttcgtttaactggcccatcattctcctaaatagctttagagaga

SEQ ID NO: 6824728 - DNA, 71 bp, Homo sapiens
cagtcgagattaaaccagtcaagaatcagaatgaaggaatatgtctgaggtaccagctggtttatcttctg

SEQ ID NO: 6824729 - DNA, 102 bp, Homo sapiens
ttgtcagaagataacctacagttacagccaccattttaagatcatcacaattggtggtggtcaccatgaatgtgggttatattacagtaactccaatgataa

SEQ ID NO: 6824730 - DNA, 80 bp, Homo sapiens
gcatttggtaaataacaatcacagtgtacaagtaagtgatagtttgcaaacctgaactgctgtgagcaatttccagatgt

SEQ ID NO: 6824731 - DNA, 66 bp, Homo sapiens
ttctttggtgtcgatgtcacctgtcaactgaactgcctttttgaaagtcacaatggcattaaagaa

SEQ ID NO: 6824732 - DNA, 126 bp, Homo sapiens
agtgcggcaggttttcttcagtggcatgtaatggtactttctgattttaagctctaatttatctcgcagattaaagcaatgaaaggggtcagaatctattggtgttaagaagtcagcctcagcact

SEQ ID NO: 6824733 - DNA, 59 bp, Homo sapiens
agtaagggagatgtatagatgtagccagtcaggtggtttctgtactttgcttccatgct

SEQ ID NO: 6824734 - DNA, 84 bp, Homo sapiens
ttacacgccgtctgttctgctaattgagtgtcagggtcagatgctccttctcctggcaggtcagcaggagcagcgtgcctgtga

SEQ ID NO: 6824735 - DNA, 59 bp, Homo sapiens
ggagactacctagcaggctgttctggaaattcaacctgtatgagccagcactggtctcc

SEQ ID NO: 6824736 - DNA, 61 bp, Homo sapiens
gaggaggacctgaaattcttgcttttcacagtgctatgataagcattattagatcctgttc

SEQ ID NO: 6824737 - DNA, 68 bp, Homo sapiens
tgaaagtaggtctgttagtttataaaatgatagtcatcttggggtcttaattagcagacttcctttca

SEQ ID NO: 6824738 - DNA, 111 bp, Homo sapiens
attcactcttggagtcctgagccaccatctacaatgtctggctgcactgagatcatcatgctgcacaagccacatgtaggtgctctgctcaaccaaccctcctaagtggat

SEQ ID NO: 6824739 - DNA, 123 bp, Homo sapiens
tcagccagggtttttaaggatcttaatagagtggaactaaggtagaaactattaagagcaattaatagtgatatatctatagtcctgtttctaaacaagtttttttaaaaacctcaactctga

SEQ ID NO: 6824740 - DNA, 69 bp, Homo sapiens
tgtgcataaatagcagagctgtgaattgagccaaagtccccaagttcagtgctctgtcattatatcaca

SEQ ID NO: 6824741 - DNA, 59 bp, Homo sapiens
gggagcatatcaccttttctccaaatcgcacgtcacctggtaccaaagggggtgctccc

SEQ ID NO: 6824742 - DNA, 73 bp, Homo sapiens
ggttcctttaggttttattttctcaagtgtttattacatttcacagaaagagaaactaacatctgaaggtgcc

SEQ ID NO: 6824743 - DNA, 55 bp, Homo sapiens
gcttacattcattacctcagtgtctgggcttggcacatggtggtgcttgataagc

SEQ ID NO: 6824744 - DNA, 66 bp, Homo sapiens
ctgaaagtccaagaagtaggggccagctgattcttgtctggtaagggctcctgtcctggcttgcgg

SEQ ID NO: 6824745 - DNA, 72 bp, Homo sapiens
tgggatctcaatcttggcagctcattaaaacagcctgggatgattttatagggtagctaggattgagaacca

SEQ ID NO: 6824746 - DNA, 79 bp, Homo sapiens
ctcaactatcctgcttctgttgttgttgctattgtcttgccctttaattaaatctgacagctaggcaggcacgtttgag

SEQ ID NO: 6824747 - DNA, 69 bp, Homo sapiens
accttttaatgctgttagtgaaatggtttatacctacgaagagaccacatttctgaatagcataaaggt

SEQ ID NO: 6824748 - DNA, 118 bp, Homo sapiens
aagtacaggtgtcttcgaagtagttcaacatgccatgggcaaacctttactgagtacttaaataaagcagagattatgccatggaaagcatgagaactgaaaagaatatggctgtctt

SEQ ID NO: 6824749 - DNA, 80 bp, Homo sapiens
gaaattagtgaaactgctttgtaaactgtcctctaccattatgaagacgttaatactaaaggtcagtttcgaaaaatttt

SEQ ID NO: 6824750 - DNA, 58 bp, Homo sapiens
gcttctgaatcccacccaactgctgctgtccagggacagccaggatgggagcagaagc

SEQ ID NO: 6824751 - DNA, 82 bp, Homo sapiens
agagggcacattcccttggcctcatggacagctcatccttagggaaggttgtggctggatgaggcccagagtgaagctctct

SEQ ID NO: 6824752 - DNA, 85 bp, Homo sapiens
aaagattacaggaaaatagctggtccttggcagttctcagaaggttctgtttctcacctgggccaggattgtgcctgtggttttt

SEQ ID NO: 6824753 - DNA, 73 bp, Homo sapiens
ctctgtctgtctgaatggactcattaaggccccataaaatgcagtcacagtgagccatgtcagagatgaggag

SEQ ID NO: 6824754 - DNA, 127 bp, Homo sapiens
agttctttttaaaaaacactgttcaaggcaagcacagatagactcagcccatagatacccaagctgcaacttctggcttatagtcattctgtttttaatttgtcagttagtttcaattattaggact

SEQ ID NO: 6824755 - DNA, 76 bp, Homo sapiens
tttttacggttcacataggccagaagattcaaagagctattctctttccttctttttcttctgtggaaggtggaag

SEQ ID NO: 6824756 - DNA, 80 bp, Homo sapiens
tgtcttccttcttccatccatgtcccgtttctggctttgtggctgaggcaggaatgggtgatggtggtgtgtggtgagca

SEQ ID NO: 6824757 - DNA, 71 bp, Homo sapiens
agagttatcttcttctaaagcttaaaataagaactacttaaaagcagcgaatttagaagaatgagcacttt

SEQ ID NO: 6824758 - DNA, 71 bp, Homo sapiens
ctcaggccttggcagtagaacgtgttgaatcaatgtcatacatattgaggatattttctgccagcctgtag

SEQ ID NO: 6824759 - DNA, 101 bp, Homo sapiens
agctgctaaaagctttgatttttgagaggctgtagatacaagtagttttataataatatgtgaagatctacaggattttacagagttgaagtcttacagct

SEQ ID NO: 6824760 - DNA, 70 bp, Homo sapiens
actgctttgatgtctcaaaatccctgaggaatttcaccaagtttcacagtaacagggggatatgagtagt

SEQ ID NO: 6824761 - DNA, 83 bp, Homo sapiens
tgtgatatttaaatgcaggtctgttttcaaggtcagtttccggaaacagtgaccctgagaaggcttcctcctgagtatgcata

SEQ ID NO: 6824762 - DNA, 78 bp, Homo sapiens
tcccattagccaaagcaagtcacatgatcaagtccaaatgtaaaaggctggggggcatgtgactgcttttgtgtggga

SEQ ID NO: 6824763 - DNA, 61 bp, Homo sapiens
taagggctgaacatttgtgtccttctgtgatataagaaaacatatttgatctctgcccttg

SEQ ID NO: 6824764 - DNA, 55 bp, Homo sapiens
gctgaggcctcagaaggctgaggatcacttgagcctaggactttgaggctgtagt

SEQ ID NO: 6824765 - DNA, 57 bp, Homo sapiens
tgaatatctccttacagggaaaatagctggagagttttaactctgtggaggtgttta

SEQ ID NO: 6824766 - DNA, 75 bp, Homo sapiens
tggactgccttctgttcctttgtgcagtgatgggaaccagaagttcctttatgaacccagggatagaggcagcca

SEQ ID NO: 6824767 - DNA, 64 bp, Homo sapiens
ctctccatactcaaaggtttctgtgccatattaatcatcttacaggtttctcttttatggaggg

SEQ ID NO: 6824768 - DNA, 71 bp, Homo sapiens
ttgaatgtgaggtgcctctaagtctattaagaggtgatgttaagtagacatttagatatctcgctgttcag

SEQ ID NO: 6824769 - DNA, 76 bp, Homo sapiens
aactagaaaaagactttctgagaaactgcttggtgatgagtgactttaactcagagagctaaacctttttttggtt

SEQ ID NO: 6824770 - DNA, 65 bp, Homo sapiens
gaggttcggctccaggttggagtttgctccatgaggatgggccatgcctgcctgagctgtccctc

SEQ ID NO: 6824771 - DNA, 86 bp, Homo sapiens
aattctgggctcacagtatttcctatatggacatagatgtttttgtctgcagacatcattgtttataaagggagatttccagaatt

SEQ ID NO: 6824772 - DNA, 80 bp, Homo sapiens
cttctatgagatcatcttttttagattccacatatggttagggagattctggtcaaaagatgcacaattctcattagaag

SEQ ID NO: 6824773 - DNA, 84 bp, Homo sapiens
gtggcttttctgtgagatcacagtccctgcactcggttgggggcacagacgatgacagcagctgtggctcacggagacaaccac

SEQ ID NO: 6824774 - DNA, 114 bp, Homo sapiens
gacccaatggcttttagtgtgtctcagttttaattttgcaaatctggtgctttgcttctatgagttaccagcaatgctagtcaactctgagtcagacatcctggtgtgtgggtt

SEQ ID NO: 6824775 - DNA, 77 bp, Homo sapiens
ttattgcaccatgcctcagtttctacagttgttcaaagaaaatccactgctgattgggactggcagggctgcggtgg

SEQ ID NO: 6824776 - DNA, 61 bp, Homo sapiens
tgagtagagtttggcaatgtaatatagctcaagtctataacatctccctgacttttgctca

SEQ ID NO: 6824777 - DNA, 60 bp, Homo sapiens
gtgagtacatattgagtggtgatatttcttttgaaatattcaaactagatatgtatatgc

SEQ ID NO: 6824778 - DNA, 83 bp, Homo sapiens
gtttctcagctgttgaaagtagatgctatttggtgggaaacattctaaatactcaaatgttcacttgcatggcactgaggaac

SEQ ID NO: 6824779 - DNA, 58 bp, Homo sapiens
aaggaagttgactttcttccactgatccatcctttggtcatgggcaggtcacttcttt

SEQ ID NO: 6824780 - DNA, 57 bp, Homo sapiens
gccttctgatcgctggactgactctctcgccttctcttggtgcagccctcgggaggc

SEQ ID NO: 6824781 - DNA, 66 bp, Homo sapiens
ctgagtaagatacagaagctccaacattttgcttaatttgttccatgtattctgtattctgctcag

SEQ ID NO: 6824782 - DNA, 71 bp, Homo sapiens
tagtcctgaccagctggatgtttcattacacattggaatctgtatttcagctggcatctcaggagaatcta

SEQ ID NO: 6824783 - DNA, 70 bp, Homo sapiens
acaaaatccaagaggtcaatcacttagaagggaaaaacaaatttctgggtcttagttttcttgattttgt

SEQ ID NO: 6824784 - DNA, 61 bp, Homo sapiens
gtggcggagctggcgtctgtgtggacacacggtgcccggggcgcacggctcccctggccgc

SEQ ID NO: 6824785 - DNA, 60 bp, Homo sapiens
ggtctttaactgatgaagcccacccacattatgaagggtaattggctttacttaaagtcc

SEQ ID NO: 6824786 - DNA, 55 bp, Homo sapiens
tagtcactccccatgaaccctctccgtgcagaggggatcgtcatggaaagtgcta

SEQ ID NO: 6824787 - DNA, 56 bp, Homo sapiens
ggatcaagaaagtcagatgaagagggggggcatttctgctcactgacatttttgcc

SEQ ID NO: 6824788 - DNA, 55 bp, Homo sapiens
tctttgtgatagtactagaatctaaatcagtttgattctagcatacttacaagga

SEQ ID NO: 6824789 - DNA, 82 bp, Homo sapiens
ctgtgttgtcttttcatgcctggaattgcccttacattaagcttgaagataaggagttatatagacaggaaagataatggag

SEQ ID NO: 6824790 - DNA, 70 bp, Homo sapiens
cctcccaggagtccagagaagggacacctctcttccaagtgagggtcccgtccctctgcaccctgtgagg

SEQ ID NO: 6824791 - DNA, 60 bp, Homo sapiens
tctgggcctcagtttcttcatctgtaaaatgggactttgatgaggattggaggagtcaga

SEQ ID NO: 6824792 - DNA, 55 bp, Homo sapiens
tcccttgccagggacacttattggccatgcccagtgagatgctagaaggcaggga

SEQ ID NO: 6824793 - DNA, 60 bp, Homo sapiens
gctatgtgtgttttgctgcagctctattctccatgcctgcaacagcatccgacacatagt

SEQ ID NO: 6824794 - DNA, 103 bp, Homo sapiens
ttggttgttgattgaaagacataaaatggaattctgttgctgtaagaaacacatggcatttcagtgttattctaattttatgagtttctattatacatactaa

SEQ ID NO: 6824795 - DNA, 58 bp, Homo sapiens
ggtcggcggcgtggtgcctgctgctgccgccgcggcagctgagatcatgctgttgatc

SEQ ID NO: 6824796 - DNA, 72 bp, Homo sapiens
gtaggttactgccatgggcatctgaggctcagtcttcctgggatcttttgagatactgtggaccacacctac

SEQ ID NO: 6824797 - DNA, 63 bp, Homo sapiens
agatctcttgcccatttttaaattggactgtttgtctttttactgttggttggtaagagttct

SEQ ID NO: 6824798 - DNA, 77 bp, Homo sapiens
cagtactggctcattgtgctgttgtgtgcaacaaataatagatgataaatactataatgagaccaactaagatactg

SEQ ID NO: 6824799 - DNA, 113 bp, Homo sapiens
atgtatgtgagtatgtggtcgtggattcaaacacgtaattctaaaatgtttagaaatgctgcatctactgtattatggacattacgatttttcatgaccaaagcttgttacat

SEQ ID NO: 6824800 - DNA, 66 bp, Homo sapiens
ttaaaatcactgttattgatcttaaagggggagtgcttcattaatgtacctaaatggtgattttaa

SEQ ID NO: 6824801 - DNA, 63 bp, Homo sapiens
gcagtgagcagtgagtgtgctgcagggttaggagcaggccctcagcatcctcctgctcagtgc

SEQ ID NO: 6824802 - DNA, 72 bp, Homo sapiens
ctgcatgtctctgtggttagactatggctgtgtctcctgcacaggaagtcagttaaccatagacatactcag

SEQ ID NO: 6824803 - DNA, 71 bp, Homo sapiens
cagcaggatgtatgtcttattcttctaccagatgagaagagaatgcacagagacaaataccatccatactg

SEQ ID NO: 6824804 - DNA, 87 bp, Homo sapiens
gtttgtggatgagataactgtagaagaataacacaaagattaaaatccagaataattgtgcaagtttctaaggtttttatctgctac

SEQ ID NO: 6824805 - DNA, 90 bp, Homo sapiens
agatcttttccaccctttgctgctcttcctccccctgtgccagacttcagggaaccggaggtcacaaggtgagtaaaggagaaagtgtct

SEQ ID NO: 6824806 - DNA, 125 bp, Homo sapiens
gcttgggtgccgcccccctagccaccccagctcctaggaatgattggaattccaggagtatgatccttaggtgccctgggcggctcatccctgggaggtgggcagggtgtgggggtggcctctgc

SEQ ID NO: 6824807 - DNA, 78 bp, Homo sapiens
ccactccagtaaaccaagtgtttactagaagtggtggatcaaactttacttgtggaacatattttggtttgctgctgg

SEQ ID NO: 6824808 - DNA, 74 bp, Homo sapiens
aactctggtctcttgagaaaagtacatggagaagctgctggaaagatttccctatagttttctctttcggagtt

SEQ ID NO: 6824809 - DNA, 79 bp, Homo sapiens
ctgcagtgcttagcatattatgtgatcaatatatatttaatgagtaaatgaataagtgatgtcatatataagcaggcag

SEQ ID NO: 6824810 - DNA, 55 bp, Homo sapiens
tattttctccttctcctcaagctcctgctattggggcacagagatgagcaaagta

SEQ ID NO: 6824811 - DNA, 59 bp, Homo sapiens
tctgttttgtgtctctctggtgtttggtgacataacataataagatggcaggaggcaga

SEQ ID NO: 6824812 - DNA, 93 bp, Homo sapiens
tgtcacttgcctcatccaatctgctgactttagaacccaaaaagtttctttggtatgggcttttggagctgaattacagtggagggcatgatg

SEQ ID NO: 6824813 - DNA, 78 bp, Homo sapiens
agaagaaacagcatcccacataattgcttttggcagcctattagtcagcaaaaaatttatgtgaggaaaggttctttt

SEQ ID NO: 6824814 - DNA, 81 bp, Homo sapiens
gagggcagagggagttcttaatgatgagcaaagcttttcatttggaatactgagccacagtgagagctcctgaatgtcttc

SEQ ID NO: 6824815 - DNA, 94 bp, Homo sapiens
gagaactcgtgccatcccaggtgaagcagcgctgggccgggaccagccgcacctggcccggctctgagctgtgctgggctggctccgggttctt

SEQ ID NO: 6824816 - DNA, 102 bp, Homo sapiens
tgtgtgcccacaagcttggtggccaggagacatttgtcaaaggaatgcctgattgcatgaatgaacagatgccttctcccatgaattgccttggtgcctaca

SEQ ID NO: 6824817 - DNA, 64 bp, Homo sapiens
ttgacgtctggtgtccaaacatgatgtcaatattgatattatctcaagggatagcagatttcag

SEQ ID NO: 6824818 - DNA, 61 bp, Homo sapiens
tctgttactaggaacatattaagtaatatgaattattatttgtctttggacctgtgagagg

SEQ ID NO: 6824819 - DNA, 66 bp, Homo sapiens
gctgttagaattcctagttgtacttagtgaaaagtcactgctctccaatgtggagttcctaagagc

SEQ ID NO: 6824820 - DNA, 67 bp, Homo sapiens
ctgtgtagtcaggtggtcccacttggggaataaccacaggtatggggggctggctaggggctcacag

SEQ ID NO: 6824821 - DNA, 62 bp, Homo sapiens
agagctgggacttggactcaattctgattcagaaggaaatgctgatccactctcattgctct

SEQ ID NO: 6824822 - DNA, 64 bp, Homo sapiens
ttcacactcagtgggcttgatgtcgaagattttcacatgtttccagcttattgctttaggtgaa

SEQ ID NO: 6824823 - DNA, 69 bp, Homo sapiens
atagggcttttatgaaaggctctgggcaaatagccttatctctgctctttgcaattcagaagcacctgt

SEQ ID NO: 6824824 - DNA, 60 bp, Homo sapiens
gtgtatcctggaacagattttacctatgaccaatatacagtattacctgttcaggagcac

SEQ ID NO: 6824825 - DNA, 96 bp, Homo sapiens
tgctgtaatgaagcttgtgctggaattacatgtccggctggagacatcaacatgtaatacatccagcaataaggatcatgaaacaataagatggca

SEQ ID NO: 6824826 - DNA, 63 bp, Homo sapiens
ttttgctgagctgagaatgtgggaacgggataaagaaaccaacaaatgcttagttcaccaaaa

SEQ ID NO: 6824827 - DNA, 84 bp, Homo sapiens
tatttgtatcttgctttattgacacccaacactttcagcaaggtgtgaaaatggtgtgtgagtcaagacaagttgaagaaaata

SEQ ID NO: 6824828 - DNA, 67 bp, Homo sapiens
gacaactgcaggcagttaatatgaactaaagccctacaggaaagttcagactgccttcagcattgtc

SEQ ID NO: 6824829 - DNA, 103 bp, Homo sapiens
gagcatcattttaaaagatactgctgcctgggccccacatccagtgcagctgacctaactggtctgcagtggtgtccaggtgtactgtttttgaaggatgctc

SEQ ID NO: 6824830 - DNA, 70 bp, Homo sapiens
gccaactttcacagcttgaaaagtattgataccactgatggatgaaatgttttccaagcatggaaatggc

SEQ ID NO: 6824831 - DNA, 61 bp, Homo sapiens
tctaagtttggtgattaccaattaggcagctagagaaagtcgatgggacagtaaacttgga

SEQ ID NO: 6824832 - DNA, 59 bp, Homo sapiens
cctctctgtagccacccccagtgctacagagcagagcactgggggctgctacagagagg

SEQ ID NO: 6824833 - DNA, 56 bp, Homo sapiens
tgcctgtcttcaggagtgtcacagagggccttgtggacatggctgaaaggctggca

SEQ ID NO: 6824834 - DNA, 61 bp, Homo sapiens
ccctgaggccctcctggggtctgtgccgcaccaattatacacagactgggctgccttaggg

SEQ ID NO: 6824835 - DNA, 81 bp, Homo sapiens
ggaggagttctgggagatcttgagcttctggtggcccacgggtgtctgggaaatctcagatctcccagatctcagatctcc

SEQ ID NO: 6824836 - DNA, 55 bp, Homo sapiens
tctgccggctaagtaggaacctgggcagagggagcccagcctgcaggcccgcaga

SEQ ID NO: 6824837 - DNA, 77 bp, Homo sapiens
tcgggccagcgccgggctgaggtgtccagaggcggcggcagctggcagtgccctcagcccccaagtgtccagcctgg

SEQ ID NO: 6824838 - DNA, 57 bp, Homo sapiens
tgtttattttatttagagagctgggacctaccatgctcagattctgaataataaaca

SEQ ID NO: 6824839 - DNA, 55 bp, Homo sapiens
aagttggacaggtggactttaacccattttggcttagtccaaagcctgtttactt

SEQ ID NO: 6824840 - DNA, 97 bp, Homo sapiens
tctagaacttgagatactaactctgtaaaactgtctgtcgatgctggggagacctaagtcagcctcattttggaggttagtgtattcctgtttgtga

SEQ ID NO: 6824841 - DNA, 78 bp, Homo sapiens
ggtggggagtggctggcatggccagtgctgggagtgatgtccaccctgttcctggccctgctgactcctctcctgacc

SEQ ID NO: 6824842 - DNA, 65 bp, Homo sapiens
tgccagccagtccagcattggtgtagacagctacttgcgatacttatgacgagggctggcctgca

SEQ ID NO: 6824843 - DNA, 69 bp, Homo sapiens
tggtttcctaagatagatacttcagtttatcagtgttcctctcactggtgttgcctgaactctaaacca

SEQ ID NO: 6824844 - DNA, 69 bp, Homo sapiens
gctgttgtcatcgccgaggtcctgctccaagttctccttgcagtttaggtcctctgtgctggtgaaggc

SEQ ID NO: 6824845 - DNA, 61 bp, Homo sapiens
tgtgtttgagtcctcacagtgccccaggagttcctacccacctgtgaactgcttaaagcca

SEQ ID NO: 6824846 - DNA, 55 bp, Homo sapiens
tctgaggtctgagtggggacaggggcccagaggtttctggacctggaggcccgga

SEQ ID NO: 6824847 - DNA, 58 bp, Homo sapiens
atctgacttttgcacctgtgaaaataaccacagcacctcgcaggtcattaggctaggt

SEQ ID NO: 6824848 - DNA, 57 bp, Homo sapiens
aatctggagttaatgttttcgctcaaggaagctgaagactatcaatactccatggtt

SEQ ID NO: 6824849 - DNA, 77 bp, Homo sapiens
ctctaatccccatttttcttgtctctaaattgatgctacaaatagtgtcttcttcataaggagagtgctgagtaggg

SEQ ID NO: 6824850 - DNA, 69 bp, Homo sapiens
tagactgattaaaaacagacatttattttctcacagttctggaggctggaagtctgtgatcacgtgcta

SEQ ID NO: 6824851 - DNA, 71 bp, Homo sapiens
tgtgcatggctgctgcagagctggagggggtaaagcaacagtgttttctcagttgtgcgagcagcattaca

SEQ ID NO: 6824852 - DNA, 70 bp, Homo sapiens
tcagtcaccccctccatcacccatatgtcattttaccttgtgtgtatttgatgagaggagggtcaactga

SEQ ID NO: 6824853 - DNA, 57 bp, Homo sapiens
ggccatggttggggaagacatgggttaactccacatatcaatccatccactgtggcc

SEQ ID NO: 6824854 - DNA, 70 bp, Homo sapiens
aatgaaaatttaatgagtgtttactctgtgctaggtattatactaagcaggttacatacattatctcatt

SEQ ID NO: 6824855 - DNA, 98 bp, Homo sapiens
gagatctggcttggccataagtgtgtcctgaatgtgtgtgtgagacccctgagtgcacttcactgtcactggactcactgtggccagatccccttctt

SEQ ID NO: 6824856 - DNA, 125 bp, Homo sapiens
cttactgttttaaaaatgtagtgtcacttggcacaagacttgttttatagctgtgttttaaaaaatactctcaataaagaaagtgttgtgaggaagctgatgaattgctctttaggataattgag

SEQ ID NO: 6824857 - DNA, 77 bp, Homo sapiens
ggtcctgggtactggggcctggctgtattggaggggaacagccagcccttcagtgttgccagggcctagctaggatc

SEQ ID NO: 6824858 - DNA, 77 bp, Homo sapiens
ccctcaggtacgtgcttctagacacagagtcttcatggttggtgaaattttagtaaggaagttgagtaaattgaggg

SEQ ID NO: 6824859 - DNA, 62 bp, Homo sapiens
gttatttgctgagttatacggggagatttttactttggatttcaaattactctgcagatgac

SEQ ID NO: 6824860 - DNA, 66 bp, Homo sapiens
ccgatttatgtctctgacttgatttatggaaataatactagttgttgcatcagcaggcataattgg

SEQ ID NO: 6824861 - DNA, 77 bp, Homo sapiens
cagagctattccagacgttctccaatgggccaggcttcattcctgcctcagggcctttgcagttgtttttctctctg

SEQ ID NO: 6824862 - DNA, 82 bp, Homo sapiens
cccctttgcctccatgggttgtctttgtctccacttccagcttttatgggggtggtgagatgtagctgatgggggttggggg

SEQ ID NO: 6824863 - DNA, 103 bp, Homo sapiens
tcctctttccctgggatgctctgaggtcctcagagggaaaggttcgggatcccccgtgcctctccctgcagggcccagggcagctgatcccactcatcgagga

SEQ ID NO: 6824864 - DNA, 76 bp, Homo sapiens
tttagacagtaccaggccaaaccatgagaatgtgactccaagactaatggattgtgtcaggtatctgcattctgaa

SEQ ID NO: 6824865 - DNA, 77 bp, Homo sapiens
tttgcctaactgagattattaaggccgtttttagaggtggaaagggctcccaggatcatctcggctgagatggcaaa

SEQ ID NO: 6824866 - DNA, 61 bp, Homo sapiens
ttgcctagcactgagcacacttctgagcttcttagactcacagaatgtcagagttggggag

SEQ ID NO: 6824867 - DNA, 55 bp, Homo sapiens
gcagccctagcgacaaattgatcagtgatgatggatgagtactgtaggggcttgc

SEQ ID NO: 6824868 - DNA, 69 bp, Homo sapiens
catttaggtagactttatccctggctttctctgaagagcttcactaaatgataaattgtctcttaagtg

SEQ ID NO: 6824869 - DNA, 65 bp, Homo sapiens
acttggaaattaacttggtacatatcctttccactctgggaagtgttcaagttgattatctctgt

SEQ ID NO: 6824870 - DNA, 66 bp, Homo sapiens
agcttctgagttcttgcttaataatattagtatcacctgttgctgttctacgttaactcaggagct

SEQ ID NO: 6824871 - DNA, 80 bp, Homo sapiens
cattattcaggatgaaagtgtgcaacactagatcctaccatctagttttttgtcctaacataattcatccatgagtgctg

SEQ ID NO: 6824872 - DNA, 62 bp, Homo sapiens
tttaaatagctctggtcctcacccaccagcccctgggtctgtggtggaccagtgctgggaga

SEQ ID NO: 6824873 - DNA, 58 bp, Homo sapiens
agctatcagtaggaccatgttctctctccaaccttcagaatagagtctgcctggtgct

SEQ ID NO: 6824874 - DNA, 56 bp, Homo sapiens
gcccagggctggtttctggagcacagctcagcagatgcctcaggaacctgtctggc

SEQ ID NO: 6824875 - DNA, 55 bp, Homo sapiens
ggttatgcaggatgcacgtcttcagctgcactgaatcatgccattttgcttaatc

SEQ ID NO: 6824876 - DNA, 65 bp, Homo sapiens
gtgagtcctgtgggcccaccatgagccaggctctgggctggggctcaggtggctcagggactgat

SEQ ID NO: 6824877 - DNA, 76 bp, Homo sapiens
ttgggaagaaagggtcactgaaagaggaggtggctactcacctgtcaagtctgcttagatgttgccctggttccaa

SEQ ID NO: 6824878 - DNA, 62 bp, Homo sapiens
agctgtctgttgctcttctaaatccacatattttggaccatctgggagtcaagagattagtt

SEQ ID NO: 6824879 - DNA, 111 bp, Homo sapiens
ttttaaaatgacatttttatatggtcttggtcttaaaaacatcaaatgggggataattcttcatttgaagttattaaacatggctataatcataaaaatgtcattttaaga

SEQ ID NO: 6824880 - DNA, 86 bp, Homo sapiens
catctgacatattgcttatttcttcttttgtttgtttcctcccactagaatacaaggaccatgaggcagaccctttgtgtcatttg

SEQ ID NO: 6824881 - DNA, 74 bp, Homo sapiens
gacatttatcagtaattacctatgactcgaagtttccttcagtgatgagttactgattattcttaggaagtgtc

SEQ ID NO: 6824882 - DNA, 70 bp, Homo sapiens
agaagtgattttggcctggccttttgacctgttgctgagatccagcaaagaagtccagggaatcatttct

SEQ ID NO: 6824883 - DNA, 75 bp, Homo sapiens
ctgtagtctggtgtggtgcccagtgaccacgtgcctctcgatctgcatcatcctgggaccaggcacctactgcag

SEQ ID NO: 6824884 - DNA, 81 bp, Homo sapiens
atgttcagggtcatatagtcagtgatcagtggagttgggattccaacccagatgtttttgacttcaaatgactctgatcat

SEQ ID NO: 6824885 - DNA, 106 bp, Homo sapiens
tcctagaaaaaaagaaattgaaaactgcagggaaagtgttggcagcatcccagactttcttgttttgctgctaatcactctgacagcggatttctttttcagagga

SEQ ID NO: 6824886 - DNA, 68 bp, Homo sapiens
gttcaaggtcactgtctagtttgcagaaagcggttctgcctcgtatgcaaattaggccgggactcagc

SEQ ID NO: 6824887 - DNA, 74 bp, Homo sapiens
aagctgggccatatacccactgtctccatttcccgttgtttgggaagcatgcacggggcatatgggacaggctt

SEQ ID NO: 6824888 - DNA, 87 bp, Homo sapiens
ttctgtccttaagctgtccatgtctggcctcagtcttcttatctgtaaaatgggactgggccacatagacctgctgtactggcagag

SEQ ID NO: 6824889 - DNA, 57 bp, Homo sapiens
gaggtggaaagagcatgaatcttaaaatcagacagacctgtgttcaaactccatctc

SEQ ID NO: 6824890 - DNA, 58 bp, Homo sapiens
ctcttacggtactatgagttgccaccatgtcatgcaacataacatattgctgaaagag

SEQ ID NO: 6824891 - DNA, 71 bp, Homo sapiens
tgaaaagttggtgctatgatcccaagttacagaagagaactgaagcctggagaggcgccatacactgttca

SEQ ID NO: 6824892 - DNA, 58 bp, Homo sapiens
tgcttggttgacatctgcatgctcacaggatcttggaaaggtaggtcagtaccaagca

SEQ ID NO: 6824893 - DNA, 85 bp, Homo sapiens
actgttaaaaagttgggttatataccaaagtttataatatgttaataatgtgtctaaactgtggaatgttctcttttttaatagt

SEQ ID NO: 6824894 - DNA, 92 bp, Homo sapiens
gtggccgctgggcagagctggagcaggtcaccttggggtaaacggtattactgccccaggacaggagttggcttcgctgtgcccacgtccat

SEQ ID NO: 6824895 - DNA, 55 bp, Homo sapiens
ctgtatctcacatttcctcctatcctgctagtggattccctggaaggagaagcag

SEQ ID NO: 6824896 - DNA, 57 bp, Homo sapiens
cagtcccttcccattaggtcccctcaatccagaagaggccatgaggggaggtgactg

SEQ ID NO: 6824897 - DNA, 72 bp, Homo sapiens
tcttaacaatttgcttaactggtagaatgcggtggagatgacattgcttgacttatgaggtagactgtaaga

SEQ ID NO: 6824898 - DNA, 77 bp, Homo sapiens
gctcccattccagggccagccatcctgctgggagtttgcatctcaagcagcagcaggcccttcgggaggaggggagc

SEQ ID NO: 6824899 - DNA, 55 bp, Homo sapiens
agaaccccttagccaaggtacttgtgaaataaggtgagtgctgatgagtggtttt

SEQ ID NO: 6824900 - DNA, 120 bp, Homo sapiens
gggacgcagcaccaagatcccattttagagtctgttcctaggatccttcctggcaccaactgtcacaggttgggttcccaggaaaacactcgaggacggagatttgtgtgcaggcttctc

SEQ ID NO: 6824901 - DNA, 62 bp, Homo sapiens
accatagcagaaggaaaggggccccctcccgctccagccccttcagcctcaactactatggt

SEQ ID NO: 6824902 - DNA, 71 bp, Homo sapiens
ggcccctgttattcttggtggccctgctgaaacttgttcttagtattgtcacctgggtgaagcctggggcc

SEQ ID NO: 6824903 - DNA, 81 bp, Homo sapiens
aaatatgtgcatatgagattagactacatctaatccataaattggagcagatgttttgtgtatttcatcatgtgcatgttt

SEQ ID NO: 6824904 - DNA, 61 bp, Homo sapiens
ccctgggataggaaggtttccagcaatactcctactgcctgctgcatcaatctacccaggg

SEQ ID NO: 6824905 - DNA, 67 bp, Homo sapiens
tcattctttgactgttgtagtaatgagttagctttgctccaactgccagaatcattcaaggaagtga

SEQ ID NO: 6824906 - DNA, 63 bp, Homo sapiens
ctacagggacttacaatagatgaacccaactatgagtatttatatgtaagtacctttatgtgg

SEQ ID NO: 6824907 - DNA, 75 bp, Homo sapiens
ggggacaggtgtgggcagatgccctacttaataagggtttttaaggagtgggtgaatgtgctcataacagtcgcc

SEQ ID NO: 6824908 - DNA, 62 bp, Homo sapiens
tttccaaaacttatttgaagtcatctgaatgggatatctcacttagttaagtattttggaaa

SEQ ID NO: 6824909 - DNA, 74 bp, Homo sapiens
gccaccttttcacccagcgggcgcacactcgggatctgaactctctgatagatgggccatgctggggagacagc

SEQ ID NO: 6824910 - DNA, 88 bp, Homo sapiens
gatggctcgaacctgggaggtcaaggctgcagtgagctgtcatccttgccactgcactgtagcttgggcaacagagcaagagtctgtc

SEQ ID NO: 6824911 - DNA, 70 bp, Homo sapiens
ggggtatttcctactatgagcctcttttaattagaggaaaaagtacttcctaggaggcccagaagacctc

SEQ ID NO: 6824912 - DNA, 78 bp, Homo sapiens
gataaataattgagttggtcaatatgagtaatggttagaacaatccctggcacatagtgagcactcaaggtatttgtt

SEQ ID NO: 6824913 - DNA, 84 bp, Homo sapiens
ggcccttccaaactgtgtcgtctgcatagcaacatgcagcccattcgcctgtctttatgctgacgaatatatttctgaaaggct

SEQ ID NO: 6824914 - DNA, 93 bp, Homo sapiens
gtgaatcatctcttctggagttgtgcagtggacctggcatgaccaagtttatgcatcttagggtccctcacatctgcagttgagatacctcac

SEQ ID NO: 6824915 - DNA, 69 bp, Homo sapiens
cttgccctgagagacacagttatcaggcatacaaggtgacagaccagtaccctctgttcctcaggcaag

SEQ ID NO: 6824916 - DNA, 78 bp, Homo sapiens
ttgtctaattctgaacacatttaaatttatggaaatcatggggatccacttgaattttagtggttttactggagataa

SEQ ID NO: 6824917 - DNA, 56 bp, Homo sapiens
tccactggaagttcattctcagaaggtctgtttccttttgataaagaacccaggga

SEQ ID NO: 6824918 - DNA, 130 bp, Homo sapiens
acagctctttgtatccttccttcacgtcactactctcagtttctcattataaaagtgtgtgatcattttacagttgaggaaactgagagcttgagaagcagaggtaattttcccaaagaaatgaagctgt

SEQ ID NO: 6824919 - DNA, 71 bp, Homo sapiens
attacagtaggattggaaaggaaaacttgaacgtgcactgcaagttgattctttgatttctaatctgtgat

SEQ ID NO: 6824920 - DNA, 72 bp, Homo sapiens
ttcagctttggtcacattgagtttgaggtgtcctatatttagatgtaataaatcagggtgccaaagcctgag

SEQ ID NO: 6824921 - DNA, 59 bp, Homo sapiens
gttgccctcactggccctttattgcagcccaggctggagctgaggacgtgaagggcggc

SEQ ID NO: 6824922 - DNA, 59 bp, Homo sapiens
atgcatccaaactcactgactttctttttactactctagttactttgtttggatgacat

SEQ ID NO: 6824923 - DNA, 82 bp, Homo sapiens
ccaagcagtctttgtttacaaaaataagcagtgggatatagtttactgactgtttttgtacaacaagttttctagaccttgg

SEQ ID NO: 6824924 - DNA, 65 bp, Homo sapiens
gaatattccaggcagagggaatagcaagtgcaaaggcactgaggtggggtctgcttggagtgttc

SEQ ID NO: 6824925 - DNA, 60 bp, Homo sapiens
ccaaagctctgaggaactgcatgttacttgggcaaaatatgcaagcaatctgagctttgg

SEQ ID NO: 6824926 - DNA, 61 bp, Homo sapiens
taactctagcaagaatcccagggctaagattccttgactctgattgccttagcttgggtta

SEQ ID NO: 6824927 - DNA, 71 bp, Homo sapiens
atgggtttataggtggactttttctttacagttacttttatcagtaaagcaaatcacacatataaatctgt

SEQ ID NO: 6824928 - DNA, 83 bp, Homo sapiens
gatccctggagagcagtgggggtggtgtgagtgtttgtgctgagcatggaaattggcatggccttgtgctccttctcaaagtc

SEQ ID NO: 6824929 - DNA, 112 bp, Homo sapiens
aatgacttctgtataagcaaaggtaaattaaaggtcatgttaaaggggtattattgccttcagtgcatgtttataatcacacattgtttatacgtaggaaaacagaagcatt

SEQ ID NO: 6824930 - DNA, 73 bp, Homo sapiens
taaagatatttatcaaggtaggagaataggacatgtcttgtgtaatggtttgttagcttgatttataacttta

SEQ ID NO: 6824931 - DNA, 61 bp, Homo sapiens
gggagaaacattgcacagaaggaagacctggctcccagtcccagctctgccatgctcttcc

SEQ ID NO: 6824932 - DNA, 123 bp, Homo sapiens
ctataaaaattcttctgtatatttgattgaaagtgaagaaataccttgcttgaagtagttgttctgaatattttgaagtgttatttctatcactttaaaattgaatttattgtatctttatag

SEQ ID NO: 6824933 - DNA, 57 bp, Homo sapiens
gactgaggcaggttcctcaaattgcatctgcaagtaggaacctaagagcctgcagtc

SEQ ID NO: 6824934 - DNA, 70 bp, Homo sapiens
ccatttgtatgtcggtgctgttttgagtgctaccccctgctggtggggctttcatacagcacacagatgg

SEQ ID NO: 6824935 - DNA, 73 bp, Homo sapiens
gcagataagctcactgtaagaactgatgtagtaaaatcttcacagttattgaagtgagctctaaattcactgt

SEQ ID NO: 6824936 - DNA, 70 bp, Homo sapiens
tttgtctgctgcctccaatctgtgccccggctgggggaggcggggagagggatgggaggtaggaggtgga

SEQ ID NO: 6824937 - DNA, 78 bp, Homo sapiens
gtgtggtagggtcaggcttttcttccctcagtgcctgcctggaaccagtgggggtaagagcctggtcttacaccttgc

SEQ ID NO: 6824938 - DNA, 77 bp, Homo sapiens
tgtacagcccaagtctctgaggcaaaatccggaagataagcgtgtcttctgttaccacagcgatgaggtgctgggca

SEQ ID NO: 6824939 - DNA, 79 bp, Homo sapiens
ttagctagttattatcaaatgagagtatgcatctgcccaataactaggcatataacacattgaatagaagcatggctaa

SEQ ID NO: 6824940 - DNA, 64 bp, Homo sapiens
caggggtggcaggaccagggaaaagcaaagtcgtttcatccaaggagaccttgcagagcctctg

SEQ ID NO: 6824941 - DNA, 66 bp, Homo sapiens
gtacagatctattgagttggaacaaaatgtcatgcaggtcattcttaacaactcagtaggtcctac

SEQ ID NO: 6824942 - DNA, 62 bp, Homo sapiens
gggggtgggtattgtgtcaatctctgggaatgtatctgagagattgtgctactcacccaacc

SEQ ID NO: 6824943 - DNA, 58 bp, Homo sapiens
tctctgcgagagtgtagttgtctggatacttttatgtccacctgtggttttgcagaga

SEQ ID NO: 6824944 - DNA, 55 bp, Homo sapiens
tcagaatggcccataaatagtccctatttgggagcttttggaactgctattttga

SEQ ID NO: 6824945 - DNA, 76 bp, Homo sapiens
ggcaaaagcatttcttggttttaaaaggtacttcacccctttacaacctgtgtaattgctattggaatgctttgcc

SEQ ID NO: 6824946 - DNA, 64 bp, Homo sapiens
ttgtcatcatcctctttggggtaggaatgccacgtcagcctttcctcatagaaggatatgacaa

SEQ ID NO: 6824947 - DNA, 68 bp, Homo sapiens
ctgtagggttgttttaagcattatatgagttaataaatgtgaagcattttggacagcgcctggtacag

SEQ ID NO: 6824948 - DNA, 65 bp, Homo sapiens
cagatgaagcctgccatctgttcatcaaacttgtagttggagggagcagctgcagtttctatctg

SEQ ID NO: 6824949 - DNA, 99 bp, Homo sapiens
caggaactggccattttcacttcttttgtgattcttcacttgcttcaggccatctggatgtatacgtgcaggtcacaggggatatgatggcttagcttg

SEQ ID NO: 6824950 - DNA, 55 bp, Homo sapiens
ccagtggaaatgtggtcaggatctttgtgtggttttctccatacccattcactgg

SEQ ID NO: 6824951 - DNA, 66 bp, Homo sapiens
ggcagggaaacaggtgctaaggaaacaccgctggtcagtccgacgtcctcagtctccttctctgcc

SEQ ID NO: 6824952 - DNA, 66 bp, Homo sapiens
gagttcttcactgtctttgggcttctcttcagaggtctgtttaacaaagtcagggatgaggatttc

SEQ ID NO: 6824953 - DNA, 65 bp, Homo sapiens
taaatactgcctgtgaggtaactcggcgaaatactttcacagaggcctcatgaggtgagcattta

SEQ ID NO: 6824954 - DNA, 55 bp, Homo sapiens
ttatgcagcaaagtgcttgaaacataaccaatgcttcacttgcacgtttgcatag

SEQ ID NO: 6824955 - DNA, 79 bp, Homo sapiens
gattgttatttgatcttttcaggtttctctagtcatgtagttagcacattggaagcaagaaaagataaacagtacagtc

SEQ ID NO: 6824956 - DNA, 61 bp, Homo sapiens
tgtcctctgctggtctctggctaggtccccatctccagccagtggcgtaaactagaggata

SEQ ID NO: 6824957 - DNA, 61 bp, Homo sapiens
gacctagatttgcatgcctacaccactacctagtagtggtgccctttgataaatttatttc

SEQ ID NO: 6824958 - DNA, 56 bp, Homo sapiens
cccaggaggtggaggttgcggtgagccgagatcacgctgcagcactcctgcctggg

SEQ ID NO: 6824959 - DNA, 65 bp, Homo sapiens
ggaagctcaactgtgttcacttcggcatcaaatgtaaagtgatgccatttggaagttgggggtct

SEQ ID NO: 6824960 - DNA, 101 bp, Homo sapiens
ttccgcctcccttgtgcgtgttctgtgcatctagccagtatgggcactgtcctagcctgtgcaggctgccttcacagagccccacagactggctggctgaa

SEQ ID NO: 6824961 - DNA, 73 bp, Homo sapiens
caatccattgctgcttcttgcatgaagtctgacacatatgtcttattgctcagcacaagcagcagaaggaatg

SEQ ID NO: 6824962 - DNA, 89 bp, Homo sapiens
actttttgtcataataattatatatgcatagtgatttagaacagaatacgtttatttagtgctctatgtatatatttagtgtagaaggt

SEQ ID NO: 6824963 - DNA, 60 bp, Homo sapiens
accaaatcccagttctaggatctagatcccaattctagaagttggggctagggatatggt

SEQ ID NO: 6824964 - DNA, 62 bp, Homo sapiens
gcgaggctcatcatatctcatctctgccccagaaggtggttcagtggaatgtgttgaccagc

SEQ ID NO: 6824965 - DNA, 62 bp, Homo sapiens
caccacagcatccactagaaggaatatttagggttttgtttctttttgagtatgttttggtg

SEQ ID NO: 6824966 - DNA, 59 bp, Homo sapiens
tacagtagaatgcggtgccagtggaaaaatcctactcagcatatctaaattctaatgtg

SEQ ID NO: 6824967 - DNA, 64 bp, Homo sapiens
gtttacatgaactgacttttaggggaattagctccaggttccagagtcaggagctcatgtgaat

SEQ ID NO: 6824968 - DNA, 76 bp, Homo sapiens
tcagtctcccaaagtgctgggattataggcatgagccactgtgcctagccaagtccagtatttataggagatgtga

SEQ ID NO: 6824969 - DNA, 85 bp, Homo sapiens
ttgactcttgcaccagctacattagcttcaatggctagggtaaccatggcattttgtagctgtgtatctgtttgtcaggagttaa

SEQ ID NO: 6824970 - DNA, 56 bp, Homo sapiens
gggctgtgggcagcacgccggcctcagcacagaggtttcctgtttctcagcagccc

SEQ ID NO: 6824971 - DNA, 77 bp, Homo sapiens
ccacgcccctagcccgggctccttcatgcatctgttcagactgaagctgcatcatgcggaactggctttgggggtgg

SEQ ID NO: 6824972 - DNA, 55 bp, Homo sapiens
tatttaggtgcagaaagaggggcgtgttcactgtaatctctctgtacattagata

SEQ ID NO: 6824973 - DNA, 122 bp, Homo sapiens
agccagagcaagactcactggcactgtggactgatgctccctattgaagctaatcttgctctgtttattttccatgtgttaaagcatcgctccatcagtgtctgcatgagtcatgtcttcct

SEQ ID NO: 6824974 - DNA, 99 bp, Homo sapiens
gaggcaggagaatcgcttgaacccaggaagtggaggttgcagttagctgagatcgcaccactatactccagcctgggtgacagagcgaaaccctgtctc

SEQ ID NO: 6824975 - DNA, 59 bp, Homo sapiens
cttaggggagggacagctgtgcttggcttgatggggcaagcacacttacctgttctaag

SEQ ID NO: 6824976 - DNA, 64 bp, Homo sapiens
gacatgcgagacctgaaagacccagagatacagattccttttctgggccacttgtctgcacttc

SEQ ID NO: 6824977 - DNA, 60 bp, Homo sapiens
tcacatgaagatccctcaatttatgctcaacttgggcctgaggaatttctttatgaatga

SEQ ID NO: 6824978 - DNA, 60 bp, Homo sapiens
gccttcagcggccgctcgctgcggggacaccccggtggatgagttctcgctgccaggggc

SEQ ID NO: 6824979 - DNA, 59 bp, Homo sapiens
tctccagagtgcaggtgcctgtgagcttgaagccggaggggctgagcaactttcagaga

SEQ ID NO: 6824980 - DNA, 109 bp, Homo sapiens
tggcatatagggcctcagaagggtgagtgacatgttactggagttcaagtgcactgaataaccttccagccattcattatgacacctactgggaatctattatgtgcca

SEQ ID NO: 6824981 - DNA, 130 bp, Homo sapiens
tttctttttctgtatttctattagagtgaaggtctttatggtatgaaaactgaatattctcctctaacaatgtttgttatcaatgaatcaaaactctttcaaatcctgatgtttcctaagaaaaaagaaa

SEQ ID NO: 6824982 - DNA, 98 bp, Homo sapiens
tgaccttttctttttatctttattctcttctctgttgcctctgttgttccagtgacttcagagacaacctggtagagaaatgcaaggattaggcctca

SEQ ID NO: 6824983 - DNA, 62 bp, Homo sapiens
caggtctttgttgcagcatggacaggagccaacgtcgttcaaccacagccaagagggacctg

SEQ ID NO: 6824984 - DNA, 59 bp, Homo sapiens
ggtcagagagataagagtccaggtgttgaaggtgacatctggcagtgatttctgtgatc

SEQ ID NO: 6824985 - DNA, 65 bp, Homo sapiens
acaggaatttgctggaacacagatcattcaacttccttggttgaaatcgttcagtaattttctgt

SEQ ID NO: 6824986 - DNA, 55 bp, Homo sapiens
ttacagaggcttccagggcccactacagccaggggcctgcctgggacttctgtaa

SEQ ID NO: 6824987 - DNA, 55 bp, Homo sapiens
ccattgacatcaggcttggccaagtgactcacttcagccaacaggatgttagagg

SEQ ID NO: 6824988 - DNA, 65 bp, Homo sapiens
gatttgggggtgaattaaatatagccaggtcaactttgttgacacagaatttactcccgataatc

SEQ ID NO: 6824989 - DNA, 68 bp, Homo sapiens
gcaggggcaggaagggagcagctgatgccccatgctgagcagcctgcttccctttgtgccccgtctgc

SEQ ID NO: 6824990 - DNA, 81 bp, Homo sapiens
ttgttcactattttatagcttaggattttcttcttggtcctcacaaaggacttgacttgaagctgtggaaaaaggaaatga

SEQ ID NO: 6824991 - DNA, 75 bp, Homo sapiens
aagttccattgtaattgaacccttaggcttgagagggtaaggattcctcacacagtctgatttcaacaagaattt

SEQ ID NO: 6824992 - DNA, 89 bp, Homo sapiens
cccaggctgggcagaaggaagccagcacagtgtggaaggaacaggtttttcaaggttcaaggctggcttcttccagttccagccctggg

SEQ ID NO: 6824993 - DNA, 114 bp, Homo sapiens
acaggtaagctctcaatcattgttgactacataagaagaccagggttcaagtcttggctccattctttatgagttgtgtgatctaaattttttggagccttaaattttacctgt

SEQ ID NO: 6824994 - DNA, 73 bp, Homo sapiens
gggatttagtaggatagtatacgtagctcatagaatcattgggagagctggggaattctcctgctgaagtccc

SEQ ID NO: 6824995 - DNA, 56 bp, Homo sapiens
ggggacctaggctctgtctcttctggttaagtcagtggaggggggcatagttctcc

SEQ ID NO: 6824996 - DNA, 80 bp, Homo sapiens
atccggaattcttttaatgttctgaagtttcatgcttttccctgctgagcctggaagctctctacataagaatgctggat

SEQ ID NO: 6824997 - DNA, 79 bp, Homo sapiens
aagttgtattattttctgttgttggtgtctggctccttttgggggtaggagtattttgcagcagtgtgataattaattt

SEQ ID NO: 6824998 - DNA, 68 bp, Homo sapiens
ggacagtgaatgtggggatgcattttaaaatcagtccaaatgtttttttcctcccctcacccattgcc

SEQ ID NO: 6824999 - DNA, 102 bp, Homo sapiens
gaattaatgttgtagaggaatgtcagcttctcagggaaaagtttaaataaagtcaaaatagtgtttttccttaggggttactcacctttgtactaataattc

SEQ ID NO: 6825000 - DNA, 55 bp, Homo sapiens
atctgaccttctgtttgagaacaatgttccccaaatgtgtaaggaagtgttagat

SEQ ID NO: 6825001 - DNA, 59 bp, Homo sapiens
aggctggctttggtagcatggtacagcagtcacatctctctaagttccaaagtcagttt

SEQ ID NO: 6825002 - DNA, 68 bp, Homo sapiens
ggtggggggcttgggggaatggctgtgatcagtgctgccaattcccagctgccgggctgcactccacc

SEQ ID NO: 6825003 - DNA, 71 bp, Homo sapiens
tgaggccaggcaaaggcgatctcggccagaggccacttcctgcctctactcagacctttcctaaggcttca

SEQ ID NO: 6825004 - DNA, 56 bp, Homo sapiens
tcattgctgtagtccagatgaggcatggtgagagtctgaaatggcagcgggaatga

SEQ ID NO: 6825005 - DNA, 56 bp, Homo sapiens
ggggtctcagagctcggggtgccatcttctgggggacccacggtctttgaggctct

SEQ ID NO: 6825006 - DNA, 90 bp, Homo sapiens
tcacctgggagcttgttcaaatgcagaataccagtccccactccgacctgctggatcagaatctgcatttttaacaagatccccgggtga

SEQ ID NO: 6825007 - DNA, 92 bp, Homo sapiens
ttctgcaaaccccatctctttcgtctctgggttccctgttaaatttccccacaaggggacactagatggagaagggaaggtgggaggcagga

SEQ ID NO: 6825008 - DNA, 81 bp, Homo sapiens
actgcttctcccctgaatatctactgtgtccccactctgttaaagatcacataaatagattattgggagggaacatgtagt

SEQ ID NO: 6825009 - DNA, 67 bp, Homo sapiens
gacagccctgttgtattactatttaatcacttttgctaaataaatagagcagccccgaggtgctgtc

SEQ ID NO: 6825010 - DNA, 72 bp, Homo sapiens
ggggagctctaagacctcttctatgaacgcaaaaaatacggcttcaagaagaggtgattggtaagtggcccc

SEQ ID NO: 6825011 - DNA, 60 bp, Homo sapiens
tgaacttgggttttaacttctctctcacctatgggggagtatagtctggcctcattatca

SEQ ID NO: 6825012 - DNA, 59 bp, Homo sapiens
gggcccgtttcttctccgcatgcaatccggtaagccgtggagcagctctagcgggcgcc

SEQ ID NO: 6825013 - DNA, 74 bp, Homo sapiens
aaggtggagaaactgaaatatggcttttcttcctcccccaggttcccctgtgccattctttctttcttcatctt

SEQ ID NO: 6825014 - DNA, 76 bp, Homo sapiens
taggggtacaggtttggggatcaaagagacctagattaaaatctttgctctgccatttatcagaactgtgatctta

SEQ ID NO: 6825015 - DNA, 67 bp, Homo sapiens
ggatgatttgaggatttcatgaggccagaatttccacacgctgtcacatggaatcttcagagtcacc

SEQ ID NO: 6825016 - DNA, 98 bp, Homo sapiens
atttttaaaaacatggaaacaaaccaggagactgtactgatatttggatttaagttagagatcacagttttttggccaacttctttgattttaaaaat

SEQ ID NO: 6825017 - DNA, 62 bp, Homo sapiens
aggagcctgactccacactaagggcgagaagtcccaggcccagagtgagtggggaaggccct

SEQ ID NO: 6825018 - DNA, 81 bp, Homo sapiens
gaaaacagacactagtgcagtgaataagacatgggtttggggttgctaatggttttgaatcactgcgcttcacttgttttc

SEQ ID NO: 6825019 - DNA, 56 bp, Homo sapiens
gagtatagcatactgctgagcaatttcagagatggctccagcagtatgctatactt

SEQ ID NO: 6825020 - DNA, 112 bp, Homo sapiens
ataatttacagggcatccatccatgatggaatattattcaggcattagaaaggatgatgcaggaatgaggttctcagttagagttcatggttcaggaaatctctgaaattat

SEQ ID NO: 6825021 - DNA, 84 bp, Homo sapiens
gagggcaggggaggggctcagtctttcttggcagcagctttcctcatggcggccagtacgttgctcagctcctcccgcttcctc

SEQ ID NO: 6825022 - DNA, 60 bp, Homo sapiens
cttctgggattaatttttcctgaggaaaactaatgaatgaggaaggtaagctcccagaag

SEQ ID NO: 6825023 - DNA, 65 bp, Homo sapiens
tattaggttcatgaaattttcaggaattaaagttagtcctgaggaaagttcatgaatgtctaatg

SEQ ID NO: 6825024 - DNA, 65 bp, Homo sapiens
gattttagaaggaatgctatggtgatgataataaaataacaccatctagcatttatttggaaatt

SEQ ID NO: 6825025 - DNA, 101 bp, Homo sapiens
gatgaatagttttaaacaagagtatcctttctagcctcaaagtttctattaataagcattaataagctttgctggagagacctctttgggaagtatttgtt

SEQ ID NO: 6825026 - DNA, 57 bp, Homo sapiens
tgtcccagacacagtatgcgcttgtggtcactcactcaccattcctgtgctgaggca

SEQ ID NO: 6825027 - DNA, 68 bp, Homo sapiens
tactgatttatgacagagctgactctcacatgtgcatttttgtgtagactgctccaatgtgaacagta

SEQ ID NO: 6825028 - DNA, 89 bp, Homo sapiens
tgtagtaaacaatcagcttgcgcattttgaggagtcgggatttaagcacgtttctagaagtggctgggcgttattgattgaagagtaca

SEQ ID NO: 6825029 - DNA, 61 bp, Homo sapiens
catttctaagaagatctgggtaatcaattattagcatgccaagatcttttctatagaagtg

SEQ ID NO: 6825030 - DNA, 81 bp, Homo sapiens
cacaagagcaacaacagtaatgataaccagcatttattttgcacttaacaaatgccagttattgctgtcagtgttcatgtg

SEQ ID NO: 6825031 - DNA, 70 bp, Homo sapiens
taatgcatgatagttatgtaagaggtcaccatcggtgggagatgagtgatgggtacattggcttgcatta

SEQ ID NO: 6825032 - DNA, 71 bp, Homo sapiens
aagcaccttatcccggggtataggcaggggcaggggcatcctccacacgcctggccaccccagggctgctt

SEQ ID NO: 6825033 - DNA, 62 bp, Homo sapiens
actcttgagcatctatgactgaagacatcaacaagaaatctcacagcatcattgctcatggt

SEQ ID NO: 6825034 - DNA, 57 bp, Homo sapiens
gcaggtgtggatttgcatccaggtaaccacctcaggttcacacaggtcagcacctgc

SEQ ID NO: 6825035 - DNA, 59 bp, Homo sapiens
aggatggcagcaagttcttgggaggtctatcacctggagtcttctaattgctgtttcct

SEQ ID NO: 6825036 - DNA, 72 bp, Homo sapiens
gcagctggtgatggcctaagaaggtctgtgtaaaggaaaacacatgtctccctgtttgctacgctatcttgc

SEQ ID NO: 6825037 - DNA, 56 bp, Homo sapiens
atggagcccagattctttgtttgctttaaagaaagtaatctggaatttggttttgt

SEQ ID NO: 6825038 - DNA, 60 bp, Homo sapiens
gtgtggccctgcgtcctgagtctccctgctagagcaggcttgggcaggagcagggagcac

SEQ ID NO: 6825039 - DNA, 57 bp, Homo sapiens
ccctctgagacaggtagctcacccccgaccttgtgggcagcaccagctctcagaggg

SEQ ID NO: 6825040 - DNA, 114 bp, Homo sapiens
aatcctgtttttggtttgacacattatgagcagttgtctttccttcctcaaatagtgggaaagcagacttgtcttctaatgtcatttcagtctcccttttcccagaaattgatt

SEQ ID NO: 6825041 - DNA, 60 bp, Homo sapiens
gcacacagaacatttggatcctcgcagaaaagactattagacccaacagttctgttgtgt

SEQ ID NO: 6825042 - DNA, 92 bp, Homo sapiens
gacgggcacagaaacctggccgcggctttccgggagctgtgggcacgcgagctgctcgaagccggtggcccggggatcgtcgctgcccagtc

SEQ ID NO: 6825043 - DNA, 58 bp, Homo sapiens
acagtaaatattaagcctgagtccttctaattcataccaggcttgtcattcttgctgt

SEQ ID NO: 6825044 - DNA, 81 bp, Homo sapiens
ggaggtggaggaaagcagtgtgaaatgatttaagggattaaaaggtatttccttatagaacttacctgcctttcacgcttc

SEQ ID NO: 6825045 - DNA, 74 bp, Homo sapiens
tattgaaattttagatcttccatactgctctgtggcaaggtatgtatgggagtgaatggaagctgggatcaatg

SEQ ID NO: 6825046 - DNA, 60 bp, Homo sapiens
gttggattttggttgaattgttctgatagaattcagaatagaattctcatagaatttcac

SEQ ID NO: 6825047 - DNA, 63 bp, Homo sapiens
gcggcgaggcccgagaggtctggcatccggcggcctcccagctttgctcgggtctcccgccgc

SEQ ID NO: 6825048 - DNA, 57 bp, Homo sapiens
ggaaactgagtgacactccctcagaaaaagttgtgggcctgtgtaaattgagtttcc

SEQ ID NO: 6825049 - DNA, 57 bp, Homo sapiens
gcctgcatttcacatttaaacttttatgtttaaagttgtaatggaagaaatgctggt

SEQ ID NO: 6825050 - DNA, 85 bp, Homo sapiens
cactctctcaggcatcagaagatggctctggaaataaaggttcatttatttccatgcacctgtcatttggttcctaagtgatgtg

SEQ ID NO: 6825051 - DNA, 130 bp, Homo sapiens
ctcagcttacactccatgtgtttccaacagagagggatacgcacttgatagaaacagaaaattataatcaaatagaattcttctgttggcagagcatacatatttatacattcttctgtgtttagctcag

SEQ ID NO: 6825052 - DNA, 59 bp, Homo sapiens
caggacaaagccctttgagaaacagtcaccaacctgtgttcccactgggctctgtcctg

SEQ ID NO: 6825053 - DNA, 70 bp, Homo sapiens
aaattttaaggctggaacttaatccaatgatgtatgctggaagaaattgaattcacggcctgggagattt

SEQ ID NO: 6825054 - DNA, 65 bp, Homo sapiens
ttctctaccttttactagtgccatgattgtgggcaaatcacctcatgtcatcagtaaaatgagga

SEQ ID NO: 6825055 - DNA, 58 bp, Homo sapiens
tgagccccaggaaattgaggagaggcagagatagctgctgctcctccctaagggctca

SEQ ID NO: 6825056 - DNA, 58 bp, Homo sapiens
tggagggaacaaaggagtcccagagcacaggcagcttaggcacgtccttgatccccca

SEQ ID NO: 6825057 - DNA, 70 bp, Homo sapiens
ttggtggggaagattgtaggaggttaaggatcaaggaacctgagatatcaccttctgaattacctaccaa

SEQ ID NO: 6825058 - DNA, 56 bp, Homo sapiens
gtgaccttatttggagttaggatctttacagagtaatcaagttaaaatgaggtcat

SEQ ID NO: 6825059 - DNA, 57 bp, Homo sapiens
tgaagaattccatggcttccatgtctcagcagctcaaggccaagttggatttcttca

SEQ ID NO: 6825060 - DNA, 77 bp, Homo sapiens
gatattggcttggtttacaattggttttctctaatttaataggttaggaaggtatagttgtattctgagctaacatc

SEQ ID NO: 6825061 - DNA, 91 bp, Homo sapiens
ccttcttttccactcttttcctctctttcctggctggcctctaggtcaggcctgaggaattgagggggtaagtcaggatcccagcaggagg

SEQ ID NO: 6825062 - DNA, 86 bp, Homo sapiens
tctcccttgggctcagcaagaatcagacaacctcagtgtttcatttttggctgagctggaatcttcttgactgtgcctatgggaga

SEQ ID NO: 6825063 - DNA, 62 bp, Homo sapiens
gccttggtttgtttatacaaaagatcctataggtgaggatcatgaagtataaataggaaggc

SEQ ID NO: 6825064 - DNA, 80 bp, Homo sapiens
cacaacttgtttatccatgctcccgttgatggatatccatgttactcctgtcttcaactattatgaataaaattgttgtg

SEQ ID NO: 6825065 - DNA, 71 bp, Homo sapiens
tcagaatgaccccctaaccccaggtgaggaagtgatgattattatttcaaagtagggtagggggtccttga

SEQ ID NO: 6825066 - DNA, 100 bp, Homo sapiens
tcacccagctatgggaaatgctctggatgaccttggatttctatgcagttagctggacctcatcccagggttacagccagggcatccctgagctgggtga

SEQ ID NO: 6825067 - DNA, 80 bp, Homo sapiens
aggagctgccctgggcaggtatacaaaaaatgtaatgtgtacttaagctttcatttgatatatttgtttagtgtgatcct

SEQ ID NO: 6825068 - DNA, 112 bp, Homo sapiens
tgaaaatgccctgtaaacgaaacccacacagtcccgtgcttaccatgttgttgcacctccttcatatggactttgtatgtggttgtatgtatttttatagggcagattttta

SEQ ID NO: 6825069 - DNA, 57 bp, Homo sapiens
gcagtgcatgcaatgcaaatgaataaagtcagtgcatttgcataaggatgctactgt

SEQ ID NO: 6825070 - DNA, 56 bp, Homo sapiens
atctcagctttgtggaaatggctgatggagtcttcacccagatgagcagctgagat

SEQ ID NO: 6825071 - DNA, 57 bp, Homo sapiens
gccaggcctgcaagtgctggtggagctgttcccactggcctgggcttaggggctggc

SEQ ID NO: 6825072 - DNA, 57 bp, Homo sapiens
tttgtcccatggaatgatacattcccatcttccatcatgtattgttattgggacaga

SEQ ID NO: 6825073 - DNA, 58 bp, Homo sapiens
cagtcctaccaggttctgagctagccagatgagtcctggcatagaatatggtgggctg

SEQ ID NO: 6825074 - DNA, 70 bp, Homo sapiens
aacgtagggtcatgtttctatactgagcaaaagggcttcttttgctcagtatagaaaatgatatcatgtt

SEQ ID NO: 6825075 - DNA, 84 bp, Homo sapiens
agtacattgtaatttgatcacattgtttcatacatattctgggacatcctaaaattgtacatgcagtgagtcatcttacgtgct

SEQ ID NO: 6825076 - DNA, 76 bp, Homo sapiens
ttctttcaattttacataggggatatgggctatgaagtgggcttgtcccatatctgaccctgaaggcttgagagag

SEQ ID NO: 6825077 - DNA, 56 bp, Homo sapiens
agggagcccactttagttaggccagcagggcaggcctgtctgaggaggtgctcttt

SEQ ID NO: 6825078 - DNA, 73 bp, Homo sapiens
cctgagggtaattaagaaaatgtcagatgtcattgatgaaccatttgccattatcttaaggaaatcatgcagg

SEQ ID NO: 6825079 - DNA, 130 bp, Homo sapiens
gagggaggaagacagggacgccaagggctcagggagaaggccgggaggagcaagggggctcgaggagtggccagagccccttgctgccctctagaggccccggctgagcagagggtctgttgtccacccc

SEQ ID NO: 6825080 - DNA, 88 bp, Homo sapiens
ggacaatttgtgtaacaaggagcttggggaattgacttcttattggcccagaaattgtaaatattccctcggttcctacaacttatcc

SEQ ID NO: 6825081 - DNA, 55 bp, Homo sapiens
gaaaaggctaattaagttttggatcatagtgtgtgtctcctcctttggccttttc

SEQ ID NO: 6825082 - DNA, 93 bp, Homo sapiens
atgcccccattctatctgtaaacagacatatttttaatatgcttctcccttgtgagtcttgcatcatttgaaaatgtctgtgcagagtggcat

SEQ ID NO: 6825083 - DNA, 64 bp, Homo sapiens
cagcagcattgctctggattcctaagtgagagacaaacactcagaacccagcagcagtgctctg

SEQ ID NO: 6825084 - DNA, 79 bp, Homo sapiens
taggtagaagatctcaagtcacacagccaggcataatgttgccaattataagccctgtgaacttaagattccttatctg

SEQ ID NO: 6825085 - DNA, 91 bp, Homo sapiens
gctacaaggatgtgcctccatgtctttttccctcgcagtggtgtgtaagctctgtgagggtcacagccatgcccacactgttctttgctgt

SEQ ID NO: 6825086 - DNA, 56 bp, Homo sapiens
ggcctgtggctttggcgtctaactttccttaagagttgagcccattcccactggcc

SEQ ID NO: 6825087 - DNA, 84 bp, Homo sapiens
cctgggggctgggtgaaatgcaggcttggattcagcaggactggggtagggcctgagagtctgcatttctaatcagctcccagg

SEQ ID NO: 6825088 - DNA, 58 bp, Homo sapiens
gctcttcctggcctcttccaccaccagtcaagctggtgcaggagttggcagggacagc

SEQ ID NO: 6825089 - DNA, 65 bp, Homo sapiens
gtctttcttcattctggttcctcagaggcattttagtatcatggaaactcagagatgaaaaagac

SEQ ID NO: 6825090 - DNA, 69 bp, Homo sapiens
gctactgtgcaaaaatgaatattgtaatattaaaagagaaactaattgttcagtatcattgcacatagt

SEQ ID NO: 6825091 - DNA, 71 bp, Homo sapiens
tttaaagcaactgttgaattggactagagtgatacttcttgatctgtgctggtaaacagtatgctgttaaa

SEQ ID NO: 6825092 - DNA, 85 bp, Homo sapiens
gtggcaatgcagattcctgggcctgcctctagtgattcccattcagtaggtttggggtggggcccaggaaatctatatttttcac

SEQ ID NO: 6825093 - DNA, 62 bp, Homo sapiens
gtgccaatgatatcctataatggtgccagaaaatctggaaatttgtcaggatcttaggtcac

SEQ ID NO: 6825094 - DNA, 76 bp, Homo sapiens
taattaggagccagtttagacctcagttgcttgatgaggtagcttcaactgttgtcacgaatgtggctcctttttg

SEQ ID NO: 6825095 - DNA, 67 bp, Homo sapiens
cattagcaatcataaacctttattgatctaaaccaatgggtattgaagtggtttgtaattggtaatg

SEQ ID NO: 6825096 - DNA, 72 bp, Homo sapiens
cttgcttgtatggctttctccatagggcagttcacagtgtggcagtttgcttcatcagagtaaacaagtaag

SEQ ID NO: 6825097 - DNA, 65 bp, Homo sapiens
gcggtcccaggctggggccaggtgaccggaggagtcgaggagccgcggccgcggcctggggaggc

SEQ ID NO: 6825098 - DNA, 63 bp, Homo sapiens
gtccaagctctaagtgctaaaagatactatctgtttctcagcgttcttagggctctatcagac

SEQ ID NO: 6825099 - DNA, 59 bp, Homo sapiens
agcaagggcatcacctgggagcttgttagaaatgcaggatctcaggccccctccttgct

SEQ ID NO: 6825100 - DNA, 57 bp, Homo sapiens
tcatggcttgctagtggcccaagtttacatgacaaatatgtgccaagaaagctatga

SEQ ID NO: 6825101 - DNA, 65 bp, Homo sapiens
agaaggaagccgtttctctccaggacatgcagtgtctgctggagttttggaaaaatgctttctct

SEQ ID NO: 6825102 - DNA, 76 bp, Homo sapiens
tggtgtgtgctgtttgcaaccaaatattagaaatattatttttcttcagtttggtaaatgtaagaataatacccca

SEQ ID NO: 6825103 - DNA, 58 bp, Homo sapiens
actgaagtccacacatgtaggattgatgatatttacaatcctgtggcactgtttcagt

SEQ ID NO: 6825104 - DNA, 87 bp, Homo sapiens
cttgcccaaattctgaatcctttcttccactgttttctcttgggccctgaaacccagagaggccttggcaagacagaattaaaaaag

SEQ ID NO: 6825105 - DNA, 70 bp, Homo sapiens
ggtggcagggctgaggctcagggtgcagctcagtgtgaaatgagggctgctcttctcagacctgtcagcc

SEQ ID NO: 6825106 - DNA, 79 bp, Homo sapiens
ggggcagggacaaagtgagaaaggaatatcagtggggcagatccagagttcatttctttgcttattttattctttttcc

SEQ ID NO: 6825107 - DNA, 84 bp, Homo sapiens
ggctccgggagacctggagcgattgcgggggtcagaggttagggtcaagggtcagacctctctgtcgccgcccctcctggagcc

SEQ ID NO: 6825108 - DNA, 76 bp, Homo sapiens
gaagagctgtcagaaaagctaatgcatctcttgatctaaaagagctagtttagaatgggttttctgaaaggttttc

SEQ ID NO: 6825109 - DNA, 115 bp, Homo sapiens
ggctgagagaagtgtgccttccagaagtgctcctttcattgctgcccaaatccaaacctcttctttgagaagggaagggcacaagaaaggaggtacctgaacccttctctgagtc

SEQ ID NO: 6825110 - DNA, 63 bp, Homo sapiens
gagcggaagtgcctcttcacctatgtggttgaaacagcccacagatgcgaggcgcacccgttc

SEQ ID NO: 6825111 - DNA, 56 bp, Homo sapiens
ggaagctggcatatgtaatcctagccctgggcaaccatgttgtcagctaaaaatcc

SEQ ID NO: 6825112 - DNA, 60 bp, Homo sapiens
cgagctaactgtattctgtaggcagatactagagaatttctcctgagtgcagttggcttg

SEQ ID NO: 6825113 - DNA, 57 bp, Homo sapiens
cacagaggcaaccttctggggttacagcatcctaacctaatttgaatggtctctgtg

SEQ ID NO: 6825114 - DNA, 78 bp, Homo sapiens
ccttcagctcaatggcccagggtctacagcctcaagacctccttgatgctactacctgggctgaaagctgattcaagg

SEQ ID NO: 6825115 - DNA, 84 bp, Homo sapiens
tcctccgcaccccactgcctctgcgtcccacagagtctaggctcatttcggctcggtggccagcctgaggccctggggagggga

SEQ ID NO: 6825116 - DNA, 83 bp, Homo sapiens
gatatcagtgaacgaacaaatcttaaagtaattcaaatgtatgtcaagcattgaaatagagatctgcttgtttgcttagtgtt

SEQ ID NO: 6825117 - DNA, 78 bp, Homo sapiens
aaaggctcccagctgcgggcagcctgtgggaaacagagaccctcctggcccaaagcagcccagcaggtggaggccttt

SEQ ID NO: 6825118 - DNA, 55 bp, Homo sapiens
gattctgctgtccctaagtgccggcaagggctgggggatgatcttgagtagggtc

SEQ ID NO: 6825119 - DNA, 79 bp, Homo sapiens
gcaggagaaggtgcttccaggagacaaggtgtgcaaggcttaatgttgcttacctgtttacctgcacctgtttacctgc

SEQ ID NO: 6825120 - DNA, 125 bp, Homo sapiens
agactcagctgaggaacatttgaaaatattagtgctctgggtccactccagaccaattctatcagaatctctggggtggggcccaggcatcaatgtattttttttttaattccccaggtgagtct

SEQ ID NO: 6825121 - DNA, 60 bp, Homo sapiens
tatagaagttgctcaataaatgtttgtgagggttaataatacttgtgggtaagttctgta

SEQ ID NO: 6825122 - DNA, 74 bp, Homo sapiens
ggggacaggactgatttactaactctttgtactggttaggccaggctgggtctgaaattatgtcactgctctcc

SEQ ID NO: 6825123 - DNA, 63 bp, Homo sapiens
gagcttgctgcgttctgatttaagggactgatacatccatagctcttgatgctggcaggactt

SEQ ID NO: 6825124 - DNA, 80 bp, Homo sapiens
ctcagagggcaaggagcatgcctgtctcctttgcactgtagccccagcagctaggacagtgtctgcttcaggcccatgag

SEQ ID NO: 6825125 - DNA, 77 bp, Homo sapiens
tattccgtctttcatatgctgtttgggtccagttgcctaataattaccacttaatcaacatatgtatttatgggata

SEQ ID NO: 6825126 - DNA, 55 bp, Homo sapiens
gactctgtggctgttatctttatatcttttcttgagatattaatagctcagtgtc

SEQ ID NO: 6825127 - DNA, 56 bp, Homo sapiens
tgttttggttttcaccgagtccccctggccagagtggagctatgaaaaccaaagca

SEQ ID NO: 6825128 - DNA, 56 bp, Homo sapiens
gatggcctggggagaattttctcatgaagggataagaaaatagccccaggctcatt

SEQ ID NO: 6825129 - DNA, 58 bp, Homo sapiens
tacccaggacttggcaacctcatttgctaaaagtcaatcatgaggacagtgctgggta

SEQ ID NO: 6825130 - DNA, 82 bp, Homo sapiens
tttcctgtatcagattttccacagactggaagggaaattcccttctattgggacttttgtgaagaatgcctggcaccggaga

SEQ ID NO: 6825131 - DNA, 103 bp, Homo sapiens
ttgagatggagtcttgctttgtcacccaggctggagtgcagtggtgtgatctccactcactgcaacctccacctcccagcttcaagtgattctcctgcctcaa

SEQ ID NO: 6825132 - DNA, 61 bp, Homo sapiens
atggtttgcagagacatttccatttcaggcactcctctaaaggcttgttattgcatttcat

SEQ ID NO: 6825133 - DNA, 57 bp, Homo sapiens
gcactgccactgcccagccggtggccttagataggtggccttgggcaggtggcctgc

SEQ ID NO: 6825134 - DNA, 70 bp, Homo sapiens
gcagcacgctacagttagggattcctgagtgacttagtcacatgggctctagactttagtgtggagctgc

SEQ ID NO: 6825135 - DNA, 80 bp, Homo sapiens
tgatctctagaaagatatagataaaactatgcaagctgttaaaaattcagcctgatacagaattgatatctgagagatta

SEQ ID NO: 6825136 - DNA, 113 bp, Homo sapiens
cccctccagcctctttcatttgcaaccttccattcagttctgctggttctgctctgtgtcaagagtgtcagagaattggggggaaggtgaattatgaggtggctggcaggagg

SEQ ID NO: 6825137 - DNA, 70 bp, Homo sapiens
tgccacattgcgctaaacccactcccggtaataagcaacctaagtgtgtacatttggtgcagttgtggca

SEQ ID NO: 6825138 - DNA, 130 bp, Homo sapiens
cctcagcctctcaaagtcctgggattacaggcgtgagccaccgcgcccggcctgtattcatttcttaaaaatattattggccgggcgcggtggctcatgcctgtaatcccagtattttgggaggctgggg

SEQ ID NO: 6825139 - DNA, 61 bp, Homo sapiens
accctgggacctggaggtggatcacctgcggtcaggccctggaggacctccagtcaagggt

SEQ ID NO: 6825140 - DNA, 77 bp, Homo sapiens
gcaggacatttgagataaggaagtaattaggaggtgcttttatgtgtttaatggttcctgagtctgaacagtcttgt

SEQ ID NO: 6825141 - DNA, 85 bp, Homo sapiens
actgggtaggaaattattccatcatacggtattattcaagcaattagaaatcacattgtgtggtgaatgatcagctcttcttggt

SEQ ID NO: 6825142 - DNA, 61 bp, Homo sapiens
gattctgggcctcaccctcagagtatctaatttagaaagtctgggagggagcctcagaatc

SEQ ID NO: 6825143 - DNA, 68 bp, Homo sapiens
gtatttgtgttctctcctaaattggcaacatcttccggaattgttttgtttatgagagcacagcatat

SEQ ID NO: 6825144 - DNA, 91 bp, Homo sapiens
ccctactcctcaatttcattgtcatctatcttagatatgtgtagttactacaagttcccaatagatggcaggaaagtgttttgaggaaggg

SEQ ID NO: 6825145 - DNA, 83 bp, Homo sapiens
gattgagagcaggagctgtgggaagatggtggggccagacatcagggccttcccctgagctaccccagctcctgtgctcactc

SEQ ID NO: 6825146 - DNA, 84 bp, Homo sapiens
tctcatgcagtcattctccaaaagggagcactttctgtttgaaagaaaacaaagtgcctccttttagagtgttactgtttgaga

SEQ ID NO: 6825147 - DNA, 57 bp, Homo sapiens
tgctggaaattcctaggaggtagggaccgcatcttactcatctttgaattttcagta

SEQ ID NO: 6825148 - DNA, 66 bp, Homo sapiens
tgaactgtaaggacttcacagctaatatatgcccctgggtaatgttacatagtccttatttgttta

SEQ ID NO: 6825149 - DNA, 60 bp, Homo sapiens
ggtgacctgggtcccagcccctggccccaaggatggggcatggggctctgatccttcacc

SEQ ID NO: 6825150 - DNA, 81 bp, Homo sapiens
actctatgtgtttcctgtggctgccataacaaataccacaaactgggtggctcaagtaacaaaaatatatcatctcagagt

SEQ ID NO: 6825151 - DNA, 82 bp, Homo sapiens
gagacttaagacagactttgatctggatgttgatatcacattggttcatagacatcggttcaaaactctgtatgaagctttc

SEQ ID NO: 6825152 - DNA, 119 bp, Homo sapiens
gtgtgccaagaaaataattctagcttaatgatccactcatgagatctggctgacttccatatgtacaaagtcagccctaagatactgcagagtaggttattgactaagattctggctac

SEQ ID NO: 6825153 - DNA, 59 bp, Homo sapiens
tgggcttggccaagtgggtgtgaagtgttccattgactcaggcctgcagtgccaaccca

SEQ ID NO: 6825154 - DNA, 64 bp, Homo sapiens
aggtaagtgttattattctcactttctacataaggaaagctcagaagaaataagcaacttgcct

SEQ ID NO: 6825155 - DNA, 70 bp, Homo sapiens
ggtaagctcagagtctcggagggaaaaaggagagacagcatgtctagtttcatcagagaatcttggtgcc

SEQ ID NO: 6825156 - DNA, 102 bp, Homo sapiens
ttcacaatcatttaggtagacaggactttgcatgggtctgaaggcttgcatggcagatggaggcaaagagccagcaaatctggttgtaaatgtcaatgtgaa

SEQ ID NO: 6825157 - DNA, 58 bp, Homo sapiens
cccttccaggctggaggcttgggatcaccaataaactccaggaaaaggcttgcagggg

SEQ ID NO: 6825158 - DNA, 76 bp, Homo sapiens
caatcacatcacttcttttgaaatctgctggtgattggtcaccatgcatcagttaaaaggagtaagcatgtggttg

SEQ ID NO: 6825159 - DNA, 80 bp, Homo sapiens
ttctcagacaatagatggagttcatatcatgtgccaaccctgatcaaatggtagtagcattccatatactgtcttgtgaa

SEQ ID NO: 6825160 - DNA, 130 bp, Homo sapiens
gggaagagtggcagctctagcctcagtggggtcgatgtgagggaagtgtaaggcacgaaataaggaatctctacacaggattcacatgaggggtaaaaatttgtgatgagagaggtattatactttttcc

SEQ ID NO: 6825161 - DNA, 66 bp, Homo sapiens
aggaaggcgaggaagaatatggattttacagcacattaggaaaatcgtttcgttcctggtttttct

SEQ ID NO: 6825162 - DNA, 57 bp, Homo sapiens
agcctgtggagcaatggcatcacctaatccttcctggttggctgtggctcccaggtt

SEQ ID NO: 6825163 - DNA, 57 bp, Homo sapiens
tcctggccctctgcaaacgccatcatgtggggcgcagagtagcagagtgctgaagga

SEQ ID NO: 6825164 - DNA, 82 bp, Homo sapiens
gagtggctgggatttggagagagatgggtgagaatggggtgagatgaggccattttgattgtactccaagtacctgctactc

SEQ ID NO: 6825165 - DNA, 57 bp, Homo sapiens
actgagagaatatttgcaacgttactctgctctgataactctgcttgttctctgagt

SEQ ID NO: 6825166 - DNA, 57 bp, Homo sapiens
ccagtcattcatttggagctttgagcttggtgctccagagtgacaaatgactgatgg

SEQ ID NO: 6825167 - DNA, 108 bp, Homo sapiens
ccgggcactcggagctggccgggggagccccacctcggtgcccgcagcccgggaccgacgggccatggccggggacggggttcctggggtaggcccggaagtgtctgg

SEQ ID NO: 6825168 - DNA, 58 bp, Homo sapiens
gttggggttgccacaacagtgagaagaagtcggatggcgcctcatgtgtggtcccagc

SEQ ID NO: 6825169 - DNA, 61 bp, Homo sapiens
gcacaggaagcaagcctggggccccacccctgtctggcccagaagcactgctctcctgagt

SEQ ID NO: 6825170 - DNA, 129 bp, Homo sapiens
caggccctgggtacctggtctctgatggcatggggtctgtgcaggaggtgagcagtgggcagcaggctgaagtggcttcctgcatggatcctctgatgggccagggctgagacctgcctctgtggcctg

SEQ ID NO: 6825171 - DNA, 68 bp, Homo sapiens
tgctatcagcacagggcctggcacataagagacgctcagtaaatgcctttctgtgaatgatgatggca

SEQ ID NO: 6825172 - DNA, 80 bp, Homo sapiens
gggcagcaccctccaaggaccccctgaggtagggtcccccatccacacctcagaacggcgttcttgaacccagttagctc

SEQ ID NO: 6825173 - DNA, 58 bp, Homo sapiens
aggacaagctaaaggacttccttccccaaggctatgaaggtagtaaatgtttgctcct

SEQ ID NO: 6825174 - DNA, 75 bp, Homo sapiens
tctctgggcttgaagtctgagtgtcagtgcaagtggaggggtaccactgactactttaggattagcgttcagagg

SEQ ID NO: 6825175 - DNA, 89 bp, Homo sapiens
cattaaaggacttgctattggtttactctgtaaaccaggaacctgacatagttgctggtttctgagtaaccacagcagtacaacaaatg

SEQ ID NO: 6825176 - DNA, 84 bp, Homo sapiens
tgtttaaaagcagcataattcttctgccctatataagttactgacatcttctgtagtccaggaattgtgtctgaaccttaaata

SEQ ID NO: 6825177 - DNA, 55 bp, Homo sapiens
gtctctctcccaagattggctagtgtatagttactggaccagctgtctgaggggc

SEQ ID NO: 6825178 - DNA, 68 bp, Homo sapiens
ttaggacagtaacattccctcaaagtgtaaatgcaatctattgctctgtgaggatgtctacgttttaa

SEQ ID NO: 6825179 - DNA, 60 bp, Homo sapiens
gtccgggtcacctatcaattttgtgcatgggtgcacaggacaggatttgggatctagggc

SEQ ID NO: 6825180 - DNA, 74 bp, Homo sapiens
gggggctcagcaggctctggttcatcatgatggctgtgatgctgcccattaccactggccctgctatagcctcc

SEQ ID NO: 6825181 - DNA, 62 bp, Homo sapiens
gacacatggagctcaaacatgagtgccacccacccctgggcagcaccaagatggctctagtc

SEQ ID NO: 6825182 - DNA, 72 bp, Homo sapiens
gctcagtgctagaagtagattgcctggcttcaagctctgcatttgtcacttactacctgtctggccttgggc

SEQ ID NO: 6825183 - DNA, 95 bp, Homo sapiens
gttctgtgaggaaccttcttgtgcagaactgtagacattgataaagattggcacatcataacctgacaagttttgctgcaggaagaacatgggac

SEQ ID NO: 6825184 - DNA, 76 bp, Homo sapiens
tcacttgagcctgaaaagcagaggttgcagtgagctgagatcatgccactgcacttcagcttgggggacagagtga

SEQ ID NO: 6825185 - DNA, 85 bp, Homo sapiens
cttccttgttgctgatgaatgtcatacataatgaaagattatatccatttatcctcagcagtaaatcatttatcacacaaggggg

SEQ ID NO: 6825186 - DNA, 86 bp, Homo sapiens
tgtatactaatcttgataggaatgattcaagacttggcttattatccatccatgactgggttcccctattcccaaattggtataca

SEQ ID NO: 6825187 - DNA, 100 bp, Homo sapiens
tggaaatttctaatgccctactgacatttttccctaagcatttatactccctctataaatggagagaccatgtcctgtgatgggatataggagtcagcca

SEQ ID NO: 6825188 - DNA, 96 bp, Homo sapiens
gtggtgctagtgataccgtggagcacggaggaggcccctttgctggctgacacagatggatggctcaactctctgcccggtcttcactggcactgc

SEQ ID NO: 6825189 - DNA, 84 bp, Homo sapiens
cgaattaatgttggagagccagttaagcacttacagctgtgtggtaggcatttgggggctcacaagacaaatattaatctatcg

SEQ ID NO: 6825190 - DNA, 117 bp, Homo sapiens
tatgtaggagaaattagaatgatgagggaatagttggaactgagtggaggatatataggaaggaagattttggcttagtttaggacaattttctaacatttttttctgtttaacata

SEQ ID NO: 6825191 - DNA, 102 bp, Homo sapiens
gagtgcttatccgtcagatctctgcttcatgtttggagtttgctcacttaacacatcagaagtggctttgttccgtatggcagcaagttctgcagaagcctc

SEQ ID NO: 6825192 - DNA, 67 bp, Homo sapiens
gatagcagctctggggtcagactgacaacaaggggctggaccccttttctgcctccagctgtttatc

SEQ ID NO: 6825193 - DNA, 80 bp, Homo sapiens
ttggcaagcacacacgctggagaggaagaaacgggatcagtttcaatttcactttccaggctttttgtgtttcttgctag

SEQ ID NO: 6825194 - DNA, 56 bp, Homo sapiens
gcatgggggctagaacccagggatttgcagtcctaggtcagggggtgcctccaggt

SEQ ID NO: 6825195 - DNA, 57 bp, Homo sapiens
tgtcagccacagatttctaagcctcacctcagaggttctgattctctgggtatggca

SEQ ID NO: 6825196 - DNA, 68 bp, Homo sapiens
acaactagaaagaacatatttccacatcggcctgggacaggtctggtttatgccttttgatctggtgt

SEQ ID NO: 6825197 - DNA, 79 bp, Homo sapiens
tttcttcttttgcaagggataccatactaagaaatgcctcattacattttgtgttgttcccattgcagccagtcagaaa

SEQ ID NO: 6825198 - DNA, 66 bp, Homo sapiens
ctgcacccccagggatgctttcccaggactctttcagtcttttatgtgagcatccactgaggtcag

SEQ ID NO: 6825199 - DNA, 84 bp, Homo sapiens
atagtgtgaaagacaaggcaggatattaaccggaccagggcctgggccaggtgtgagcattctgtcttctgtctgtcactttat

SEQ ID NO: 6825200 - DNA, 62 bp, Homo sapiens
gcaggcagaaaaatgtgaaaagagagactggcctagtctcccagcctacatctttcttctgt

SEQ ID NO: 6825201 - DNA, 56 bp, Homo sapiens
tcctctgccagctagctcctagttgaattggattaatgtaaggcactggcagtggg

SEQ ID NO: 6825202 - DNA, 66 bp, Homo sapiens
gaccttccaggctgaatggctgactgagtgtgatatcttctctgtcttttcatggtcaggaatgtc

SEQ ID NO: 6825203 - DNA, 79 bp, Homo sapiens
ctgtactagccacatttcaagttctgttcctaaactgggaacacacacaggaacagaacttgaaatgtggctagtacag

SEQ ID NO: 6825204 - DNA, 57 bp, Homo sapiens
agtaacttaggagatacatgggtgaaaaatccattaagctcttatctctaggttact

SEQ ID NO: 6825205 - DNA, 71 bp, Homo sapiens
tttggtaaatgtgtatgaggaagagagaaacaattagaagttctctgtcacacaatctacacactaccagg

SEQ ID NO: 6825206 - DNA, 63 bp, Homo sapiens
ctgttattatgtttccagagcctttcctaaccaaggaaggcttcatatttaggcatatgacag

SEQ ID NO: 6825207 - DNA, 116 bp, Homo sapiens
gtggacgcagcatcctttttaggttatcaatgtttcatatttctttgaaactttggacaagcaatttttgaaagggttatgagactgaataccaggtactgaattcttgtttccat

SEQ ID NO: 6825208 - DNA, 82 bp, Homo sapiens
agacacttacttcccagagctctggaggttggaagcccaacatcacgcttccagctgaggtggcctctgtggaggtctgtct

SEQ ID NO: 6825209 - DNA, 60 bp, Homo sapiens
ttttcctctgtatttgaaatgctttgaaagctacaagatttcctagatacagaagggaag

SEQ ID NO: 6825210 - DNA, 61 bp, Homo sapiens
acaaaatagagttctcccctgggaggatgatgcctccagggcaataggaacacttttttgt

SEQ ID NO: 6825211 - DNA, 84 bp, Homo sapiens
agagatttgaggcaacagagagttccgctgtgcagtcttgggaaaagtgaggctgcttctgcacagtcactcctggcttcctct

SEQ ID NO: 6825212 - DNA, 90 bp, Homo sapiens
gagtagaccatccctgcaagcaccaccctcccaacctgtccctgggactcaggactcacgagggaggtgggcgtggaggaggtgctgctt

SEQ ID NO: 6825213 - DNA, 92 bp, Homo sapiens
ttacgagtagacattacccagttaggagactgtgataggatctgtgattcataaagtacagtctctttgagtgattgtcttgtcacttgtga

SEQ ID NO: 6825214 - DNA, 79 bp, Homo sapiens
acagtaggtgctcaatacatgtgtgtggatggtgcgcccagccacctggagatttctatacatgtaagggctctgctgt

SEQ ID NO: 6825215 - DNA, 87 bp, Homo sapiens
tattttgaaaggtacagaaattaacaaggaaggagttaacacctccactctcataatcctactggtgacttctgtatagctaaaata

SEQ ID NO: 6825216 - DNA, 67 bp, Homo sapiens
tcctgtggtagtaaatttcagctccattgtaggtttctcctgctcattgctgatttacatgtcagga

SEQ ID NO: 6825217 - DNA, 76 bp, Homo sapiens
ttattcatctctgtctcatgttagccagcacatatctaattatatgtgctggctaactggatgggcagatgggtga

SEQ ID NO: 6825218 - DNA, 63 bp, Homo sapiens
acagcattgctccatctcaagacctcacagaaaatctctctctgagaggaatgtaatgtatgt

SEQ ID NO: 6825219 - DNA, 58 bp, Homo sapiens
ttaggttttgcaaagtccattgaagtaatctggctacagtgtggtgtgcacagcttag

SEQ ID NO: 6825220 - DNA, 71 bp, Homo sapiens
ctcacagtgtcaacattaactaccactgctttttatgtttaacttggttaatatgtttagacgctgctggg

SEQ ID NO: 6825221 - DNA, 91 bp, Homo sapiens
gcctgtccgggagccccagaacccggtggaggcagtgggatgctgcagtatctccagtcctggtttcctggatggggtggctggtacgggc

SEQ ID NO: 6825222 - DNA, 71 bp, Homo sapiens
cagttccttaatgctttgaaaaggtgcattaacactttggcagcactaactattaggtatttaaggagctg

SEQ ID NO: 6825223 - DNA, 80 bp, Homo sapiens
tgtgtcgaagatgtggcgctatgagatgaaagaggctgagcttctaaagcactgttttaaatagagccactcttctacca

SEQ ID NO: 6825224 - DNA, 59 bp, Homo sapiens
gtcctgatatttttcactggcctctgggatatatctgtgatgtcagtggtatcaaagac

SEQ ID NO: 6825225 - DNA, 107 bp, Homo sapiens
ggacctctaggggagtcagaatcagtataagagtgaggaagggcatggcctacatgctataatatttttgttctatgtatattactttttgatgttcctgaaaggct

SEQ ID NO: 6825226 - DNA, 65 bp, Homo sapiens
ctgctatctagagtcctgctgagaacaaagctgagtgacatgttctctttctgctttagatacag

SEQ ID NO: 6825227 - DNA, 70 bp, Homo sapiens
taatggatttcagggtaaaaagtgttcaacaatgcatccattttctgaagctcaccctgtaaattcatta

SEQ ID NO: 6825228 - DNA, 58 bp, Homo sapiens
tgtactaaggctgtgtagatgtcatctcaattgattctttcaacacagttttaaggca

SEQ ID NO: 6825229 - DNA, 87 bp, Homo sapiens
gaaggatgagtaaatgaagatgggaatgatgagtggggacagatgtcagcccctaatgggttctagtctcatcacactcataccttc

SEQ ID NO: 6825230 - DNA, 112 bp, Homo sapiens
ggacatagccgaagctcgccttagcgaagagagtctcacctcctcgggctttgcacagagttggagaagaggtcgggaatcacagggaggctggattttggctgctctgtcc

SEQ ID NO: 6825231 - DNA, 92 bp, Homo sapiens
gagaaagaaatatgtaccttctgatactgacatcatttatggagaacagaatggtgtgattcagtacatgatgtatgttacttctgatactc

SEQ ID NO: 6825232 - DNA, 73 bp, Homo sapiens
gttggtttatttttctcttctttttcctcagagctgcaaggaaccagggaaagggaaggaggttagaacccac

SEQ ID NO: 6825233 - DNA, 56 bp, Homo sapiens
aggctgctggaggatttatgccttcagtgtggcttctgtaagttcttaggcagctt

SEQ ID NO: 6825234 - DNA, 58 bp, Homo sapiens
tgagcctggttgcagtgtctggtcccagcattcctggattcagagcccggctaggtca

SEQ ID NO: 6825235 - DNA, 73 bp, Homo sapiens
ggccacatgcaaagccacaggacccgggctttggcctcaggcagaatgggtgagaatctgtgctttgcatgcc

SEQ ID NO: 6825236 - DNA, 66 bp, Homo sapiens
gagttgacattttatgaatattttagttccattataaattactcacttgttcagatatgtcagctt

SEQ ID NO: 6825237 - DNA, 82 bp, Homo sapiens
gacaatcaaaagaattctgacaatagaattggtttaatttttaaaagtttttaattctatgttagagtctgccaaggttgtt

SEQ ID NO: 6825238 - DNA, 66 bp, Homo sapiens
cgcttagctgcgggccctcctcgcgtatactccgcgtgattagtgaccgagggcgcgcggtgtgtg

SEQ ID NO: 6825239 - DNA, 55 bp, Homo sapiens
gtgtcccaggcagtcactacctatagattagagctgatgtgctggcctggggctc

SEQ ID NO: 6825240 - DNA, 82 bp, Homo sapiens
tgggatgtcctgtggctgtatttggccagagctggatgctcctggtgaaatgccagccaaagcaggcgtgtgatttgcccca

SEQ ID NO: 6825241 - DNA, 57 bp, Homo sapiens
gttgaattaccccatgcctggagcacttactaagctccaggcatggtgtaattttgc

SEQ ID NO: 6825242 - DNA, 62 bp, Homo sapiens
tgtatgtgtgtgtgtgtatatgtgtatataaatatatgtgtgtgtatatacacacatgtaca

SEQ ID NO: 6825243 - DNA, 71 bp, Homo sapiens
ggctgtttacttgtaagtaacaagtgagaaatgaaaagtaagttatctcattgcttacatagttatgagcc

SEQ ID NO: 6825244 - DNA, 61 bp, Homo sapiens
ggatctcagatttaagttgtacatcttcacctgggtagatgcaatgctgaatttgagttcc

SEQ ID NO: 6825245 - DNA, 77 bp, Homo sapiens
aggctggagtgcaatggcgtgatcttggctcacagcaacctctgcttcccggccgggttcaagccattctcctgcct

SEQ ID NO: 6825246 - DNA, 64 bp, Homo sapiens
aactgctgcatcttagaatgcatatatttcaaggtgtgcttattaaaaatgagtgctagcagtt

SEQ ID NO: 6825247 - DNA, 64 bp, Homo sapiens
gggaaaggagcatgcgtaccttcttcagtttctgcaccgctggagggcatagctgttctttcct

SEQ ID NO: 6825248 - DNA, 76 bp, Homo sapiens
gggccaggcaggcctggggtcggtgctccggaggaagtggccctcaggagcccgttgctccggcgggccggggccc

SEQ ID NO: 6825249 - DNA, 59 bp, Homo sapiens
aaagcttgacaagtaatacttaaattacttttgtaagtagcaagtacttgttaagtttt

SEQ ID NO: 6825250 - DNA, 125 bp, Homo sapiens
agttagcctaagttttaatgatatattttactagaaatgttctgcaactgttttcatcctaatgttttttgaagaggatattgtgagagccctctgcctctaaatgtatattaccctggtttgct

SEQ ID NO: 6825251 - DNA, 69 bp, Homo sapiens
gaagggtgcaagcttctctgtgtgcaagtgtcattgtctagagagtacacagttctgccggcatctttc

SEQ ID NO: 6825252 - DNA, 65 bp, Homo sapiens
cctccctcagagaccgtggtgcagtgatttcatgtttttcatatatcaattttttttgggggggg

SEQ ID NO: 6825253 - DNA, 71 bp, Homo sapiens
agcagggctggtgctgagcaggtaggatgggccctcactccctcttcagcctcatctcagcccgtgctgct

SEQ ID NO: 6825254 - DNA, 118 bp, Homo sapiens
ctcgggcgacagcatcatttatatcttccacgcacacaatcttttctgcatgtgcgtgagtctcgattacaggcagttgaggtttgtgtggtaggcattatgcatttatgagccagag

SEQ ID NO: 6825255 - DNA, 56 bp, Homo sapiens
agatatgttactgcatcatggggttaaacaatttccagaaaacagtaagaatgtct

SEQ ID NO: 6825256 - DNA, 77 bp, Homo sapiens
tctgcgctttagcaccctagagttgcctgaggactcattgggttcgtagggcttagtggggctagctagaatgcgga

SEQ ID NO: 6825257 - DNA, 69 bp, Homo sapiens
aagcttatcataaaacaaatagttaaagatggactataccattgagaattgggccttttctggtagctt

SEQ ID NO: 6825258 - DNA, 56 bp, Homo sapiens
aggcagagaacatgctgggcagaggagacaaggtcaggtcagcctgttgtctgcct

SEQ ID NO: 6825259 - DNA, 68 bp, Homo sapiens
atctgaatctctaggggtatgatgaacaggaaatacaattattttataagccctcatgatattcagat

SEQ ID NO: 6825260 - DNA, 76 bp, Homo sapiens
tggggcttattaagaaaatagcttctcaacagattgtgaaaaccagctgaaggcttgttgttttcttagtgtctca

SEQ ID NO: 6825261 - DNA, 58 bp, Homo sapiens
acatcagctgcagtttcacaagcacccgtgaggtgccaggtgctaagctgtgctctgt

SEQ ID NO: 6825262 - DNA, 61 bp, Homo sapiens
gatcacactgctcattagaattaagtataatgaagtattttcaattttgaggcagtggttc

SEQ ID NO: 6825263 - DNA, 101 bp, Homo sapiens
tcatgtgtgctttacccccatgatgttatctaaatctggtctcatcccaaggcaaccaccctctgatagcatcacattggggatagggcttcaacgtttga

SEQ ID NO: 6825264 - DNA, 58 bp, Homo sapiens
ttttccccattaacttgcagagtagaccttcttgatactgcaagatgggtggggagaa

SEQ ID NO: 6825265 - DNA, 71 bp, Homo sapiens
ttctaaacctcaggctctctggacaatgcagctcagccttcagctccaccagagaggctgcagtgtgtgaa

SEQ ID NO: 6825266 - DNA, 56 bp, Homo sapiens
ttatctgatgagtgaattgcttttttgtgtagaaaggtggtctagcatcacggtga

SEQ ID NO: 6825267 - DNA, 56 bp, Homo sapiens
tagtgctttgtgccttttttaagcccttgacaagagtttgagaacaccaagtactg

SEQ ID NO: 6825268 - DNA, 57 bp, Homo sapiens
gctaccctttcagaagtgtacgggtaaatatattcataagcacttcacagggatagt

SEQ ID NO: 6825269 - DNA, 129 bp, Homo sapiens
gatgtgtaaagaggttcgacttccaagtaaagcctcgtccacaatccttgcacacataaggtttctcccctgagtgtgtcctctgatgtgtgatcaggtttgacttccacgtaaagcctcgcccacatt

SEQ ID NO: 6825270 - DNA, 68 bp, Homo sapiens
caggtttttatgttgatgctacttggtgatattattcactaaaaaagtaacatgcaaataacagtctg

SEQ ID NO: 6825271 - DNA, 61 bp, Homo sapiens
ggctcgggcttgaggctgtttacctggttgaggtagaaataatcttcaggctgcttgagct

SEQ ID NO: 6825272 - DNA, 67 bp, Homo sapiens
gagatttagtagtgacagattctgggttcagaatcctgattttgtcacttactaactaagtgatctt

SEQ ID NO: 6825273 - DNA, 70 bp, Homo sapiens
ggtgaagactgaaaacattgtgtgctaatttctttgttttaggggaggttatcatagttgttatcaggcc

SEQ ID NO: 6825274 - DNA, 62 bp, Homo sapiens
ggcataatgaacattagctactgtactgagcccataagagcagaggttatgttttttaggct

SEQ ID NO: 6825275 - DNA, 110 bp, Homo sapiens
ctggaacgaggaccaaactttttaattatggctttgaagtaatgtaattgtggtttttaatgcctcattcatctgcttgaaggattatatgagtttgttcaaagttctgg

SEQ ID NO: 6825276 - DNA, 55 bp, Homo sapiens
ggagaaattgatccttctggttatgggatattcttagcagagagttaacttctcc

SEQ ID NO: 6825277 - DNA, 64 bp, Homo sapiens
tgttttaatatcagattatgacgtttcatggaatacccatggagctcaattggatattagcaca

SEQ ID NO: 6825278 - DNA, 71 bp, Homo sapiens
gtcctctgtcaagcttgtcttgtccatagcagtggatactgtacagtgtcttgggcacagctttggagggc

SEQ ID NO: 6825279 - DNA, 118 bp, Homo sapiens
gagcccctattcccttagggcaggaagctggtccttccctgccctgtcctgtccccagtgcagggctgggtgcatagaaggacacagagcctgcacttctgggattaggcaggaactc

SEQ ID NO: 6825280 - DNA, 64 bp, Homo sapiens
cagggatacatagatagataatctggcaaaattgtggatttaatctttccatgttgataccctg

SEQ ID NO: 6825281 - DNA, 71 bp, Homo sapiens
gggctttggtgggagaagactctggtttcctttgtccttggaggcctctgtccccccacctttagggaccc

SEQ ID NO: 6825282 - DNA, 72 bp, Homo sapiens
aattccaatctcatagtattcttgtggcttgagtggatctttaatgtttcaataatgctgtgagtaggagtt

SEQ ID NO: 6825283 - DNA, 76 bp, Homo sapiens
ttgctgaataaatgtttacttagtttaaaaattaagagtttagttttgaatttagattgataaacatggacagcag

SEQ ID NO: 6825284 - DNA, 97 bp, Homo sapiens
ttactagcaacctgacatttatttgaacaactatttttttaagagaagtaattcagacaaattgttgcttcatgaatgagtgtgagtctgttgttga

SEQ ID NO: 6825285 - DNA, 71 bp, Homo sapiens
ttctaatgaagacatcatggagaggatagatgggcaagccttttctacatcttttccaatgttgtctggaa

SEQ ID NO: 6825286 - DNA, 64 bp, Homo sapiens
tgcaatgcaatgcaatgcaatgcaatgcaatgcaatgcaatgcaatgcaatgcaatgcaatgca

SEQ ID NO: 6825287 - DNA, 62 bp, Homo sapiens
ggtcactgaccacaaagatattctgttcccaaagagcaccatattcgtggtcaagtaaggcc

SEQ ID NO: 6825288 - DNA, 60 bp, Homo sapiens
tagttcgagtattctaatctgtggaacctcaagccacagtaatattgatgctcgtcatta

SEQ ID NO: 6825289 - DNA, 60 bp, Homo sapiens
caggatgagcatgtgactcaaaccaagctaatcaggtctagctagagttaatgttccctg

SEQ ID NO: 6825290 - DNA, 81 bp, Homo sapiens
ccctccatttttagcttggtcaagtcttaaagaaaaattgagtgtaagtaatttttcggcttagacccagttgaactaggg

SEQ ID NO: 6825291 - DNA, 67 bp, Homo sapiens
ctcaagttcttagacaagcttgtggcaggtcctacctactacatgtctggtttaaggaagaagtgag

SEQ ID NO: 6825292 - DNA, 93 bp, Homo sapiens
cccagcattatgcattcatatgcttcaactaccccaggctgctttcaggacagcagtttgtaattactgcagcatggtgtatagtgtctgtgg

SEQ ID NO: 6825293 - DNA, 63 bp, Homo sapiens
gccctagactgtgtgctgtggggagaggaagtccctatcttcttggctgttcatggtcagggt

SEQ ID NO: 6825294 - DNA, 57 bp, Homo sapiens
caagtacaaaatgatatttagtcaataaatatatattgaatatctattgtgtgcttg

SEQ ID NO: 6825295 - DNA, 61 bp, Homo sapiens
gagacagtgtccatccaggggcgctggcattgtgcctccttttctctcctgggcctgtctc

SEQ ID NO: 6825296 - DNA, 97 bp, Homo sapiens
gcttgagtgaatcagggctgaagatcagaagtccccagtcaaggagctttccccactaatgagctctccgagggcctctgacagcccctccctttgc

SEQ ID NO: 6825297 - DNA, 64 bp, Homo sapiens
cttgaacagtagaccctggataaacatttcttgagaaaatgttgcctgatctgctgtagccaag

SEQ ID NO: 6825298 - DNA, 129 bp, Homo sapiens
ctgcttctgaaatttatgctcagttctctggcctcctagcaaatgtgttatgctatgcttcccagagacttgctctgtgcatgtacagcttaggcatcagctaagggccctgagagggattttatgcag

SEQ ID NO: 6825299 - DNA, 56 bp, Homo sapiens
aatgtgattgaaaatcaggtccttatttccctttaggtcctggactcttttacatt

SEQ ID NO: 6825300 - DNA, 78 bp, Homo sapiens
ttctttagttggctgtctcatggatctacagtcaggagtggctctggctgtacagataaagactgtaaatttaagggg

SEQ ID NO: 6825301 - DNA, 55 bp, Homo sapiens
tcaggacagccagggtgcagactcagggaagagcaggtcggcccggctgtgctgg

SEQ ID NO: 6825302 - DNA, 84 bp, Homo sapiens
caaccaaggtacagcacgcactaagtgtatgccaagctgacaaccatgcttggcatatacttagtgcatgctgtaccctggttg

SEQ ID NO: 6825303 - DNA, 62 bp, Homo sapiens
atctagaaaaggtgactaaaatctgtcaaagtacaaattttaggatgtgccttttgttaggt

SEQ ID NO: 6825304 - DNA, 71 bp, Homo sapiens
ggctagggttggagagtcagcttcagaggatagataattaaagccacaagaatagctgaggtcacccagcc

SEQ ID NO: 6825305 - DNA, 80 bp, Homo sapiens
ctggctgtggagggctcctgaggcccttctggtacaattgtccatgttccacggcaaactcagaagccttcccacagcag

SEQ ID NO: 6825306 - DNA, 83 bp, Homo sapiens
ttgagtagcttggtctgtagatgagtcttaagaatttgattccatatgtgaattctgaaatttctgtagatcttgttacttgg

SEQ ID NO: 6825307 - DNA, 82 bp, Homo sapiens
cctgttgagtgcctcgtgagcccctgcctgtgttcctgccgttcgggtatgagaacacagcggggcttacccggtgtgcagg

SEQ ID NO: 6825308 - DNA, 76 bp, Homo sapiens
tctacccaaaaggtaagaaggaactcaccaattcctaatttacaaaggtggtttaaagtagcttccttttggtaga

SEQ ID NO: 6825309 - DNA, 76 bp, Homo sapiens
gctttccagtgaacgactgttgactatttggggattctcttgttctcagatccatcagaagtcccacagagaaagc

SEQ ID NO: 6825310 - DNA, 64 bp, Homo sapiens
tttgtcctataatcctcttacataagagggcaaagtactcgttgtgatacatttatggggcaga

SEQ ID NO: 6825311 - DNA, 63 bp, Homo sapiens
ctaaacagctgtattgtattgtgccccgacgaatacctgtttggaagccagacagctgtgcag

SEQ ID NO: 6825312 - DNA, 75 bp, Homo sapiens
gggcgacgtagcacagcttcttgatgtcacgcacgatttcccgctcggccgtggtgtgaagctgtagccgtgctc

SEQ ID NO: 6825313 - DNA, 64 bp, Homo sapiens
gcccagctggcgtggagtgattgcaggccaggtggtgtgagggcctgcccaggccaggttgggc

SEQ ID NO: 6825314 - DNA, 69 bp, Homo sapiens
ttggaagcagctagcccactagtcagtattctttctgcctctgtgctgcaccgtgggagctgtgtccaa

SEQ ID NO: 6825315 - DNA, 76 bp, Homo sapiens
ccagggaaggagtacagggagggtccctgtgtgcagctgctcagggagttccgatctgtgcaccctcttgacctgg

SEQ ID NO: 6825316 - DNA, 68 bp, Homo sapiens
gttggaataattaaaaattctggtgcagtggtggtataccaatctttagaattcttaagtattctaat

SEQ ID NO: 6825317 - DNA, 102 bp, Homo sapiens
ggaggttacttgagtctttaggtagcagggagcatgccatttttctttatactcttggcattcattcaggctcccaggggcaagttagtgaccagcaaatcc

SEQ ID NO: 6825318 - DNA, 128 bp, Homo sapiens
ggagcctatgtaagggtgatggttatatgcaagtttacaatgtgtatgtgttggggctgggaactgaaaagctgaaacactgcagatgtaatttgagtcatgtggctagctactttttcataggatcc

SEQ ID NO: 6825319 - DNA, 62 bp, Homo sapiens
tctgtctgcgcttgccctggtgaaaaaccccaccgttcaggctgcagggtgcgagacccagg

SEQ ID NO: 6825320 - DNA, 74 bp, Homo sapiens
gtcattttacacaccacaggaaatattaggagggattaaataaagtccccctcaagtacaacctgtaaagtgac

SEQ ID NO: 6825321 - DNA, 96 bp, Homo sapiens
aaagacattttcacagtgtagaaaatttgaggttgatagatgtgttaattaattaattaaattctacaacttcaaagatgttatttgaatgtcttt

SEQ ID NO: 6825322 - DNA, 69 bp, Homo sapiens
gttgaaataaggtgccgatgatggttttatgtgtcaaactatctaaactatagtacctagtcattcaat

SEQ ID NO: 6825323 - DNA, 69 bp, Homo sapiens
actcatacatatgtaaaggctaatggagttgtaaatgtaacttttgaggactttattgtatgtatgcgt

SEQ ID NO: 6825324 - DNA, 63 bp, Homo sapiens
gaggtaagtaaccattccatggctacacagtgggtccttaatggagctggtactagctacctc

SEQ ID NO: 6825325 - DNA, 71 bp, Homo sapiens
tgtaaggtttctctgcagtgtgaattctggtatgtcttgccaggtatgaattacgcacgaaagccttgtca

SEQ ID NO: 6825326 - DNA, 123 bp, Homo sapiens
gcaggtaagaaattcccccatggttttcctgttctttatgttgggaaaagtcagattttctgtcacaggcaagaaatcttctccagacataaggggatttaaattatgacagtttttacctgc

SEQ ID NO: 6825327 - DNA, 59 bp, Homo sapiens
gcttgctctggctcaaaccaccggctcttctgaccatggtgggtctgaccatggtgggt

SEQ ID NO: 6825328 - DNA, 76 bp, Homo sapiens
gtcctcaccccttgtgaatgctgctctggaaggcaagctggtcctgctggatggcattcaccgggtgaatgcgggc

SEQ ID NO: 6825329 - DNA, 64 bp, Homo sapiens
agtgcagttttccttcaacattgtcctgggctttattctgctttgggaaggtgagagctgttct

SEQ ID NO: 6825330 - DNA, 70 bp, Homo sapiens
gagaagccgaggccacacagcaggagcttggtacatccacttctctctgctcagtggcttctgctcactc

SEQ ID NO: 6825331 - DNA, 69 bp, Homo sapiens
gcatcacactgattttctaaaagaagtcactgatcttacgatctgttatattttgtagagttgtgatgc

SEQ ID NO: 6825332 - DNA, 88 bp, Homo sapiens
ggggctcagaagacagtggctcctccccccaggctcagcctcccagtggctgagtggctacaggcagcttacatctcctctgagcctc

SEQ ID NO: 6825333 - DNA, 66 bp, Homo sapiens
ttggagaatgattctttgctcacttttagaccacgtggttcctgtaggaaagagaacattccccag

SEQ ID NO: 6825334 - DNA, 68 bp, Homo sapiens
ctgctgagctcagcctgaggcctggctcctccaggctgggggaaaaccaggcttgctgtgctcggcag

SEQ ID NO: 6825335 - DNA, 67 bp, Homo sapiens
ttaggtataaatgattggcaagtctcaaccttgctaaaactgagacttttcaattagctatgcttaa

SEQ ID NO: 6825336 - DNA, 76 bp, Homo sapiens
gcacaaacccctgcatgtctgtaattacagagcctcttgatgctggctgctgttggcagcatgctggggaacgtgt

SEQ ID NO: 6825337 - DNA, 57 bp, Homo sapiens
cctgccactgctgaataagcagttcacaacacagtttgcatcttcaaggttggcagg

SEQ ID NO: 6825338 - DNA, 78 bp, Homo sapiens
tctttctgagcttttttaggtaagacccaggcaatagcctaggctatggtggggttcctggagagtctgtaagaaaga

SEQ ID NO: 6825339 - DNA, 66 bp, Homo sapiens
tcaggactagacatgaggaaggatataaaatgtcatcactgtccctgcctcatctgtctgtcctga

SEQ ID NO: 6825340 - DNA, 84 bp, Homo sapiens
gcccttataggcagagagggcagggcggtaagtcctgaaaaaaagattctaggagcccccacgtgcctggttctctgcgagggc

SEQ ID NO: 6825341 - DNA, 65 bp, Homo sapiens
ggcacgccacccacgaagatgagcggcatggccttgccatagcggtattccacgtggttggtgcc

SEQ ID NO: 6825342 - DNA, 110 bp, Homo sapiens
tttggaaggataaaatgagattggacaggtattatgaagcctattttacagatggaaaagctactactcataaatcttcctgaaatttgttcaagttagtcttttccaaa

SEQ ID NO: 6825343 - DNA, 73 bp, Homo sapiens
caccaatcccaggctgctgcttctcccctcagggttccttgtgggccttgggacagagcaacttgggatggtg

SEQ ID NO: 6825344 - DNA, 77 bp, Homo sapiens
tcgtgatccaccagaggatggaaaatttctggcttggacgtctggtcaatatattctgtctctttgagagaaaacga

SEQ ID NO: 6825345 - DNA, 61 bp, Homo sapiens
acctgttgctgaatcacctgggcgttcgtgggggtaaaatgcagattcttagccagcaggt

SEQ ID NO: 6825346 - DNA, 77 bp, Homo sapiens
tgaccacaaacaacactaatcgattgtcttacagttctggagtcagaagtctgaaatcggtttgtttcactgggtta

SEQ ID NO: 6825347 - DNA, 59 bp, Homo sapiens
cctctccatggggctgcctgactgtcctcacaacacagcatctggcttcccctggatgg

SEQ ID NO: 6825348 - DNA, 63 bp, Homo sapiens
tctgatccaatctgtgggctgtcagtttacaatttctgctgtatagcacttcacttggttaga

SEQ ID NO: 6825349 - DNA, 101 bp, Homo sapiens
ccatttgtgacccagattgtccaactttctcctttatactgagtgtatggctcaaatgaagcaattagaaacttgaaggacaaaagctgagttgcagatgg

SEQ ID NO: 6825350 - DNA, 101 bp, Homo sapiens
ttgtgctgctctgcccccaagtcctccgctcactttcaatgttaaaaccttccaaatgtgtccttgagaagaacactgatagctgaggggactcagcacaa

SEQ ID NO: 6825351 - DNA, 57 bp, Homo sapiens
tactgagatatcatcagataattgtacatgagaatgacaagctggtgaaatccagta

SEQ ID NO: 6825352 - DNA, 75 bp, Homo sapiens
tctcaacccgcagggcctggggccgggcctcggcctcttttccccgtggcagccgcaggccctgtgtggcaggga

SEQ ID NO: 6825353 - DNA, 68 bp, Homo sapiens
tgatttatttttgacaaatgtatctgcattatgaattatattggggatggaattgttacattaaatca

SEQ ID NO: 6825354 - DNA, 55 bp, Homo sapiens
agtagtttttaagaggtataaaggagtcttgggcttcaaaccctcagaaactgct

SEQ ID NO: 6825355 - DNA, 99 bp, Homo sapiens
agagaggcttctgtctcattcctccgtggctgtggacgcagcccctccaaaccaaggtgggctggcgacctgcagcgacgtgcgacacccagcttccct

SEQ ID NO: 6825356 - DNA, 64 bp, Homo sapiens
aggggaccttttttctgatctgctgttgtaaaaccacagcagctgtggggacaagggtaactct

SEQ ID NO: 6825357 - DNA, 70 bp, Homo sapiens
caggcagaaagtattctgtgtaatgttttgttagatacacattgatagggaacaaatactgctctgcctg

SEQ ID NO: 6825358 - DNA, 61 bp, Homo sapiens
tgtttgtctcacgctgtgaccctggcttgtagcacagtgccaggcacatggtggacacgca

SEQ ID NO: 6825359 - DNA, 73 bp, Homo sapiens
tcagaggatcatctagtttgactcaggcagagctttgaatagccatgggacatttatcagatgaccattttga

SEQ ID NO: 6825360 - DNA, 61 bp, Homo sapiens
cctccttctctttttgcagagcatgtgtatagtttcaagctctgtggaagaagaaagaagg

SEQ ID NO: 6825361 - DNA, 87 bp, Homo sapiens
ggtagatggaaggatggaaggtgggagacctgtcagaaggctcacagcttaggcctctgaaactccagccccaggttttcccatacc

SEQ ID NO: 6825362 - DNA, 66 bp, Homo sapiens
gttaagaatcaagacttatctttggggtctttaaatgtatgccaagattcatcttgtatttttaat

SEQ ID NO: 6825363 - DNA, 94 bp, Homo sapiens
ccgttgtactgacagtgttctgaaagttgagggtgtgtgtttacttgcctttatatccccacaacaaaattcagagtcactatttgtatatagg

SEQ ID NO: 6825364 - DNA, 73 bp, Homo sapiens
ccagattcccttgacacaaagcctgactttctccagggaaataagggaaagccaggttgtgtgcaggaattgg

SEQ ID NO: 6825365 - DNA, 55 bp, Homo sapiens
atgtgcgaggggcgtgatgacagcggccagcctctttgcgcaacaccttcgccat

SEQ ID NO: 6825366 - DNA, 89 bp, Homo sapiens
aagaatttgaagatcttcagtacttgagtctttccaaagccgtcattaacatggatcttttggaaaattcagaaagttttctgtttctt

SEQ ID NO: 6825367 - DNA, 113 bp, Homo sapiens
gggcaggtgagaggtgtgactgggaggctggtaggaaaggaaacattaagaatcctgaaattgctgtactcattgcctacaggcctctgggtctattacagctgaccaagccc

SEQ ID NO: 6825368 - DNA, 110 bp, Homo sapiens
ggtagctcagggcgtgcactgtgagacaggacctgttgactccgtggtgagcatctatttagcttcaggtggtcttgtttctgtatagagtgacatagcattctgctgcc

SEQ ID NO: 6825369 - DNA, 62 bp, Homo sapiens
atggctgggaagagttagagacagctgcagatgcagcttttgcagacttcttgcccagctgt

SEQ ID NO: 6825370 - DNA, 73 bp, Homo sapiens
attctccatctatttaatacgtccaccttcttgatattggtttggaagtcctgaaatagaggtcgtggggaat

SEQ ID NO: 6825371 - DNA, 69 bp, Homo sapiens
tataatctgtgtgtgtgtgtgtgcaggaaggaaaatggctttgcacacattaaggatacacagaatgtg

SEQ ID NO: 6825372 - DNA, 89 bp, Homo sapiens
gttctgccaaatagactgaaaccatgctagcatcaaaatgttagtgattctgtgcattttgatcatggtctctgtatttgctgaggaac

SEQ ID NO: 6825373 - DNA, 75 bp, Homo sapiens
tagaatcaataagtgagtttagcaagtttgcagaatacaaaaaagcacacatgagaaacatcagttgtctttcta

SEQ ID NO: 6825374 - DNA, 69 bp, Homo sapiens
gtgtgtattgaatgtctggcagaaactgagtaatagctgaacagaacagtcagggattcaagtgctcac

SEQ ID NO: 6825375 - DNA, 64 bp, Homo sapiens
ggttgtggaagtgaacaaccaaggcaggtggtactgccatttcctgatagaacactttccaatc

SEQ ID NO: 6825376 - DNA, 72 bp, Homo sapiens
actcttcttaccactgtgtcagtttggttagacaaggctgctgattaagtttgtcaacaggcaaagaggagt

SEQ ID NO: 6825377 - DNA, 71 bp, Homo sapiens
ttgaggctcagagactttaagtttctatcaacatatatagtgagcctgaggcttgaggctcctgagtccaa

SEQ ID NO: 6825378 - DNA, 70 bp, Homo sapiens
catccatgtgtgaatcccagaacctgtgactgttaccttacatggcaaaagggactttacagcagaggtg

SEQ ID NO: 6825379 - DNA, 77 bp, Homo sapiens
gttatacagtttatacttagaatttttactcactcttgggtagttatgcgaaatattctaagatgtgatcttataac

SEQ ID NO: 6825380 - DNA, 88 bp, Homo sapiens
acccacagtggggcagctctgcccatcagaggctcttcttagctcagagctgggtaccacctcccggtggcagctctcccactggggt

SEQ ID NO: 6825381 - DNA, 79 bp, Homo sapiens
cttttaacagtgcccctaaacaggtacagtttccctctgggctccgctgagctcctgtacgtgcttcactgttcaagag

SEQ ID NO: 6825382 - DNA, 60 bp, Homo sapiens
gcccagggctgcctggcctgggggtgaaacactgggctctggagtcaggcagccctgggt

SEQ ID NO: 6825383 - DNA, 82 bp, Homo sapiens
cctctcatggcctagaaagtctttaggatgttgttaaacagtggtttgggagcatttagaaaagacgtatggcccggagtgg

SEQ ID NO: 6825384 - DNA, 80 bp, Homo sapiens
attcgtctaaactttggcccagatttcttgtgttgaatggagtacacattgcaaatagtaggctaggtttagagttgagt

SEQ ID NO: 6825385 - DNA, 78 bp, Homo sapiens
cataaatggaaaccaccgatgtttacccagggtggcattgagcacctttccaagtatcaggtggtgttttcaactgtg

SEQ ID NO: 6825386 - DNA, 75 bp, Homo sapiens
ttattggcatcatgcttggattatgtttgggaataaaaagtgtgctagactctaagttatggaagtagccattaa

SEQ ID NO: 6825387 - DNA, 84 bp, Homo sapiens
gtttctgctctgagaaccaggaacacaggagtgaataaagtggaccaaactccctgccctctcattttcttatgagacagagac

SEQ ID NO: 6825388 - DNA, 70 bp, Homo sapiens
tagggagaactccaaatccatatttccatccatgcccttggaaagtgggtcatctgggagaatttttcta

SEQ ID NO: 6825389 - DNA, 60 bp, Homo sapiens
caacattgctgaaagctgggacaggcctcaggcttgtgaatggcacttttcgcagtgttg

SEQ ID NO: 6825390 - DNA, 89 bp, Homo sapiens
agcagattacctaagatttccatgttagtacacagggtttctatcagaaagagttgaaaactaacagtggcactctcaggcaattagct

SEQ ID NO: 6825391 - DNA, 81 bp, Homo sapiens
tataattatatctcctacattacgtatgcaacgcagacattttctgaaacataaatacagtgtgtgggaaatgtgactgta

SEQ ID NO: 6825392 - DNA, 65 bp, Homo sapiens
ggcttctgaagaagtgtaagtctgtttcaccagaacattcggtggaggaaacacatcagaagacc

SEQ ID NO: 6825393 - DNA, 55 bp, Homo sapiens
ggcaactgaggtgtctagggtgcaaaatgtgagttgtctagacaccaaagttgtc

SEQ ID NO: 6825394 - DNA, 56 bp, Homo sapiens
cctgttcaatattcttccttgtaacaatcctctcaagtgaagaaaccaggaatagg

SEQ ID NO: 6825395 - DNA, 59 bp, Homo sapiens
gtgcatttcaagagctctgctgttagtttctctaatgagagccagggttctggatgcac

SEQ ID NO: 6825396 - DNA, 69 bp, Homo sapiens
ttctctctgttatggattttactgtttatattaatttactaacattttagtgaggttcaagagggagaa

SEQ ID NO: 6825397 - DNA, 55 bp, Homo sapiens
cttgactgacttctgaattggtttgtaaattggaagaattagggagtcggttaag

SEQ ID NO: 6825398 - DNA, 56 bp, Homo sapiens
atcctggtggtggggtctgtgggtggaggggtctccaggtgtccacgtggcagggt

SEQ ID NO: 6825399 - DNA, 57 bp, Homo sapiens
ggagtcaccaagtaggagtcttggtctcgccttgacttctgcctgctgagtgccttc

SEQ ID NO: 6825400 - DNA, 57 bp, Homo sapiens
attatagcaaccagaacagcactctagtcctctagagagcaatgtttctgctaaaat

SEQ ID NO: 6825401 - DNA, 106 bp, Homo sapiens
gatttaatttacttatattctactttcatccacaaagctgttgactatgagtaactcacagtcaacagcattatggatgaaagcagagtatcagtaaataggaatc

SEQ ID NO: 6825402 - DNA, 101 bp, Homo sapiens
ctattgctgagtttaaaattacccccaaaacttagtgacttaaaacaacaaacatgcatggttgttgtcacaggttctgtgggtcaggaattaagaagtgg

SEQ ID NO: 6825403 - DNA, 81 bp, Homo sapiens
cctccttaatatgtgggacataaatggggtctttaagtcctgtgcttgggactccaaaactgtacccaaaacatgtggagg

SEQ ID NO: 6825404 - DNA, 60 bp, Homo sapiens
ataagagctacctcatagatgagagggcataggaattccttaataaatggtagctgttat

SEQ ID NO: 6825405 - DNA, 71 bp, Homo sapiens
taagtggcagaagtcactgggtagctttgggtacattattgcccatttcttgccttctgcttctccatttg

SEQ ID NO: 6825406 - DNA, 56 bp, Homo sapiens
gcaggttggttcccaggacctgggggggacctccagccccgggaacctggccgtgc

SEQ ID NO: 6825407 - DNA, 66 bp, Homo sapiens
gtccatggttgctttcatgtaaaagcagcagagtcaagttgttgcaacagagatcagctgatgggc

SEQ ID NO: 6825408 - DNA, 87 bp, Homo sapiens
gtgagaagatactttgcatgcatgaagtgccatataatgaccttccttttgtgttcagctcattccatgtgtattttgagtcttcac

SEQ ID NO: 6825409 - DNA, 82 bp, Homo sapiens
ggtcatctctatgtgtgtctatgtcctaatctcttcttataaggataccagtccttttggattagggcccacccatatgacc

SEQ ID NO: 6825410 - DNA, 68 bp, Homo sapiens
gagatacatgcatcagccagtggcaaaggctgtatccagcttccagcaaacactggctgctttgcctc

SEQ ID NO: 6825411 - DNA, 70 bp, Homo sapiens
catcttctgggacttctcagttggatcagtaggatcagttgacctgaaaagaggagtcttgtagaaaatg

SEQ ID NO: 6825412 - DNA, 68 bp, Homo sapiens
ccagctacagactgagcatggctctactgaggaataaggaagagctttagctgctggtctggacctgg

SEQ ID NO: 6825413 - DNA, 87 bp, Homo sapiens
cttcttgtaattacatctaaaataagccttataatgattgggtgttataatgattgttactgggttaatttggacttgaaagagaag

SEQ ID NO: 6825414 - DNA, 105 bp, Homo sapiens
gcacagcaagggtgggcatggctttcctgcggcatcaccaaacctgctgccccatccccagcaggtgcagggagttcaggatgaacatgtcagctgggctgctgc

SEQ ID NO: 6825415 - DNA, 57 bp, Homo sapiens
ctagggaatgagagactggatcaaaacattctatagataaagtatgccgtttcctag

SEQ ID NO: 6825416 - DNA, 64 bp, Homo sapiens
ttctggagagaagaccagtgtgagaattccacccttgaattaatgtaactgttttctcctagag

SEQ ID NO: 6825417 - DNA, 61 bp, Homo sapiens
ggcgtgggcgaggtgctctatctgagacaaaacagcatggggctgttctctgccctgcgcc

SEQ ID NO: 6825418 - DNA, 57 bp, Homo sapiens
ggaaggggaaaacgtcagaagaaatcttcttggttttcatctgcttcttcctattcc

SEQ ID NO: 6825419 - DNA, 79 bp, Homo sapiens
tcataaatactttatgcgattcacagctgtaacctaatgagttctcatattgttcctgagagtcagtggagtggtgtga

SEQ ID NO: 6825420 - DNA, 129 bp, Homo sapiens
tattccaaccaattctcccccaaccttgaaaccctgacactctgttcctggacagtctttagccttgggaataatgaaggtgtttcaggagtgctggtttttatctttctagggagcaggggaagaatg

SEQ ID NO: 6825421 - DNA, 59 bp, Homo sapiens
cttcgatttaattcttaaccttccttcataggaacaataggtgaagatttagatcaagg

SEQ ID NO: 6825422 - DNA, 59 bp, Homo sapiens
tcttccagatgcagatgcttcttcctgagtttaggagcttactgtcccatttgagaagg

SEQ ID NO: 6825423 - DNA, 55 bp, Homo sapiens
gcccggtctctctagtttagaccgataaattggtctacattgagagagctgctgc

SEQ ID NO: 6825424 - DNA, 76 bp, Homo sapiens
tttacttgtcactgttttacatgttatttaataatttacagttatttaaaagtggtaagattccaaggcaagtagg

SEQ ID NO: 6825425 - DNA, 77 bp, Homo sapiens
tgtatttatattccacaacaaccaagcatatacatataattgtatgtgtgtgaatgtgtgtgtgtagagtattttta

SEQ ID NO: 6825426 - DNA, 129 bp, Homo sapiens
tttgtgctcaataattatttactaattagttatttgatagcagtggatcttttggcctgattaatcctgatattgctttaaacctctactctgtccatgtagctattagaatgtaagatctcccacaaa

SEQ ID NO: 6825427 - DNA, 63 bp, Homo sapiens
actctttatttgggcatagaaattaatgacgcagaccgttttatttctcccaagtgcaagggt

SEQ ID NO: 6825428 - DNA, 69 bp, Homo sapiens
tgttccttcttatctgtccctcctcacagcctctccattgatgaatttgtgttgggacaagttgggaca

SEQ ID NO: 6825429 - DNA, 86 bp, Homo sapiens
tatacagctccattatcctaagatgagcatgtcataatctgtgaatttattcagaaagatgctgccatttcaggattagctgtatg

SEQ ID NO: 6825430 - DNA, 62 bp, Homo sapiens
ctctgggttttcttttctagtaaggccttccagagagggaagaagagaaagaggatccacag

SEQ ID NO: 6825431 - DNA, 75 bp, Homo sapiens
aggccccagcaatagattgcgagtctagattcaacaaactcttgccagtttcctctgactcacagcctggggcct

SEQ ID NO: 6825432 - DNA, 101 bp, Homo sapiens
ttgagacagtctcactctgtcccctaggctggagtgcagtggcatgatctcggctcagtgcaacctctgcctcccgggttcaagcgattcgcctgtctcag

SEQ ID NO: 6825433 - DNA, 73 bp, Homo sapiens
acatataagggatcagtgacagaattaatttctgagtaatgcagaataaacatcaatattgacctttgtatgt

SEQ ID NO: 6825434 - DNA, 66 bp, Homo sapiens
gggaccattgcattggattgtacttgtaagataataggtctaagatccctgtagactctaggttcc

SEQ ID NO: 6825435 - DNA, 72 bp, Homo sapiens
agcacgctgaggccagagtgggcctcttcctatttcaggctctgaaagtggcccagtcttgccctgggtgct

SEQ ID NO: 6825436 - DNA, 57 bp, Homo sapiens
gccatcctgatgacaggccactcgttgtggccttatggcaaagtcagttgatagggc

SEQ ID NO: 6825437 - DNA, 66 bp, Homo sapiens
gtgggggctgcttttgctgtaagccagagatacaaaccttgaggtgagcacaaaggcagagaccac

SEQ ID NO: 6825438 - DNA, 58 bp, Homo sapiens
tcctctgaaattggccctcagcaggtcactatgccatgatgataggagttttagggga

SEQ ID NO: 6825439 - DNA, 55 bp, Homo sapiens
ttgacagccaccaccctcatgaaatcatagatgacatcaacagtggtgctgtgga

SEQ ID NO: 6825440 - DNA, 72 bp, Homo sapiens
tgcaaatgtattttaaagactgccagcctacctacatttcacaatataggattaggtctttaaaataatgca

SEQ ID NO: 6825441 - DNA, 122 bp, Homo sapiens
atgattctttatcattatgccaaccattaaaatattcagggccaagcgaaacatttcaactaaaaacagctagttgaatgcgttgtgtggcccgtttcctgagagcacttgaggggagtcgt

SEQ ID NO: 6825442 - DNA, 62 bp, Homo sapiens
gcacagatctttgttggacagctgtacatctgcacagtttcttaagactgagatcttactgc

SEQ ID NO: 6825443 - DNA, 57 bp, Homo sapiens
ctgtggtcatctcagagtggcccaaatagttcctaagaaggcaggggtgaaccacag

SEQ ID NO: 6825444 - DNA, 111 bp, Homo sapiens
agtgagtgagttgacaatgcttcagctgtagatgaccccagggtttgtgtcagaataagaagctaagaccctgaagttttctatgattgattctttgttcattcatttatt

SEQ ID NO: 6825445 - DNA, 76 bp, Homo sapiens
tgtgatagacttaagaatattgaagttgtggagcctaaaagttaccagcactctattgaatattctctctcttaca

SEQ ID NO: 6825446 - DNA, 56 bp, Homo sapiens
gagctaggcctgaccttggagtttgagatcacttccaagaagtagggcctggactt

SEQ ID NO: 6825447 - DNA, 91 bp, Homo sapiens
atatgcgtgcatgcatgtgtgtgaatacatgtgtgtatagaggtgtatgcctagtgttaatgtgtgttcatgtgtatgtgtgagtgcatgt

SEQ ID NO: 6825448 - DNA, 71 bp, Homo sapiens
cccaagaacatacagtggcggagtcacaacaataacccagctgtcagactccaaaactctgtgcttatggg

SEQ ID NO: 6825449 - DNA, 64 bp, Homo sapiens
gtttctctctgccatgtgctccctgcagttcaagagggccatccatgcgccagacagattaaac

SEQ ID NO: 6825450 - DNA, 57 bp, Homo sapiens
agaagtgagactcagttgatgaactgaaataaaagagaaaattgagtctcaacttct

SEQ ID NO: 6825451 - DNA, 56 bp, Homo sapiens
aaatgtttctacttgtgagcatcatgaagaaaaattgctccctggtagaaatgttt

SEQ ID NO: 6825452 - DNA, 122 bp, Homo sapiens
agagaaaaaagggaatctcaagcctctgttgcagtacttcttggaaactggattaggcacactgttgctaatctagtttccagcaagtactgtgacagaggtttgagattcctactttccct

SEQ ID NO: 6825453 - DNA, 72 bp, Homo sapiens
gcatgcgcaggtgtgcaggtggctggtggcaccctcagacctgagtggaacgcccgatttgcaccagcatgt

SEQ ID NO: 6825454 - DNA, 66 bp, Homo sapiens
ggatgtatttctggtaactgctgctatccctgtgaaaaagaatggagtggatcaagaagtatctcc

SEQ ID NO: 6825455 - DNA, 61 bp, Homo sapiens
gaaatagtttgaatagtgtctcctaggatcaatcttttggctgctcttttcatgctgtttc

SEQ ID NO: 6825456 - DNA, 97 bp, Homo sapiens
gaaaccaaagtttgaatctatgttgccccataatcagccagtgaaagcccattgagacaaatggaacaatgaagactgaaatttaaacttttgtttc

SEQ ID NO: 6825457 - DNA, 64 bp, Homo sapiens
actattttccattacttagaaaggaactgagatcaaatcagttttaaatctgtgatgaaatggt

SEQ ID NO: 6825458 - DNA, 66 bp, Homo sapiens
cttagtaaaatatctgccggatgtggttgtaagtcatcttatgaacatgctacatgtggtactgag

SEQ ID NO: 6825459 - DNA, 57 bp, Homo sapiens
ggagattggaagctaaatgaagacagagtcaaggatgtctttgttaattttatctcc

SEQ ID NO: 6825460 - DNA, 74 bp, Homo sapiens
ggtgcacagagcacagaagttatatgttacttttctaaggtaatggcgtgtttcttttgagctgaaactgtacc

SEQ ID NO: 6825461 - DNA, 71 bp, Homo sapiens
tttcctcttgttgtcacactctgtctaattttgctgagttactggcaggacattgactacagtgatggaga

SEQ ID NO: 6825462 - DNA, 95 bp, Homo sapiens
gccctgggtttgcgggaagtgggctccagccaggatggcccagggatgggcagtccacagggcctttctggtgtgggtctggtgagccgaggggc

SEQ ID NO: 6825463 - DNA, 104 bp, Homo sapiens
acagttactaacatgacaacagatttggtttcaggtgcctttgtatacactcacactcacaagaggcactccagccactggtcttctttgcaatacaagactgt

SEQ ID NO: 6825464 - DNA, 66 bp, Homo sapiens
cctgactcctccatccctgactcctcctggagtgctgtttgctccgggccagtgggtgaggagagg

SEQ ID NO: 6825465 - DNA, 67 bp, Homo sapiens
attgctgtgtctggggcagatgcacacccctgaccttgacgcgtgtctgacagctccaggcagcaat

SEQ ID NO: 6825466 - DNA, 68 bp, Homo sapiens
tggcacatctatgaacatttaagtaggtacatcatttgtcctagtaaatcattttaaagaatgtgtca

SEQ ID NO: 6825467 - DNA, 58 bp, Homo sapiens
cggaaggtggccggaagagccccgtcccagctcagatgggcttccccgccatcttccg

SEQ ID NO: 6825468 - DNA, 78 bp, Homo sapiens
ttacagtgtatattgtttatctggagttatggcctcttgaaacctatacaggcctttatataaataaatattttgtaa

SEQ ID NO: 6825469 - DNA, 98 bp, Homo sapiens
gatgtacagcttttagaatcaggttgtctgggtgtgaatgccagcttccctctttcccagctggctatcccagccaagtgatctgaccgccctgcatc

SEQ ID NO: 6825470 - DNA, 57 bp, Homo sapiens
gcagtggtggagcttacatatcatacctttgaaaatgactctgagtaccacttttgc

SEQ ID NO: 6825471 - DNA, 96 bp, Homo sapiens
cccacctccctgcctctctgtttggtgggagtgattttgatgcactaaaaaacaaggaggcctctatccagagagacagagtcggggcagtgtggg

SEQ ID NO: 6825472 - DNA, 71 bp, Homo sapiens
agagggcccacctccctatccatggaagctgctacgccctggatcctggatcagcgggggcaggcacctct

SEQ ID NO: 6825473 - DNA, 87 bp, Homo sapiens
tagaataccgctaatggtcatctgtcaaattgcaataagagagtttaattttatgttcaatcagagcagggttcctgttggtttcta

SEQ ID NO: 6825474 - DNA, 68 bp, Homo sapiens
gtgtgcctctgagtgttttccccgggtcgctggatatgcagccaggataggaatcactgcagctacat

SEQ ID NO: 6825475 - DNA, 85 bp, Homo sapiens
ggtggtttgtggaagatggcttctctctagcttggtgttacatgcttacatgaccaggtccctagggataggcccacccagcccc

SEQ ID NO: 6825476 - DNA, 74 bp, Homo sapiens
aggctcctcgctatttaaagagcttgcaaaagtctaaggaaagccagtttcttaagtaggaagaaaaggagtct

SEQ ID NO: 6825477 - DNA, 64 bp, Homo sapiens
tacaaagattcatttgcattattgcattctctctagagtcattgatgctttctgagattttgtg

SEQ ID NO: 6825478 - DNA, 66 bp, Homo sapiens
ttcaatgacccacagccaggttttaggagagacaacatataggataaggcataaaggtacattgga

SEQ ID NO: 6825479 - DNA, 55 bp, Homo sapiens
catatcctatacacatagttgtcgtttatgatatgtgtgtatgtgtgtgggagtg

SEQ ID NO: 6825480 - DNA, 83 bp, Homo sapiens
ggaggtaggagtgtgcagggctgcctgtgccgatggactttgtactttgcatcggtatggacccgtcttgttacccttccttc

SEQ ID NO: 6825481 - DNA, 55 bp, Homo sapiens
ctttaataggacagcaggccatctgtttggatgagggaagggctggcctttggag

SEQ ID NO: 6825482 - DNA, 97 bp, Homo sapiens
ctgaaattcagggaaagaaggggaggattgtcctggggtctaccagctgactctgccacaggacaatctcgtcgggtccttctgctttgagtcttgg

SEQ ID NO: 6825483 - DNA, 75 bp, Homo sapiens
aaactccacaaaaatctaggatgggaagactagagaaggagctgtgagtctgtatgtccagatttagtggatttt

SEQ ID NO: 6825484 - DNA, 80 bp, Homo sapiens
ccagaccttgttatctccgtgtccttgtgataattcagaaatggaaatgaatgaacacaggcctggggtacaagttctgg

SEQ ID NO: 6825485 - DNA, 86 bp, Homo sapiens
gtggtatatagtatttagcatagtggttagtgcttagtaagcacgtgatggatgttagctagtactgcaggtgctatggaaatcat

SEQ ID NO: 6825486 - DNA, 107 bp, Homo sapiens
cccactgcctggctgctttctgctgttggtgtctgctccaatctcagaaaagttggggcaaaacctgggcatcatgaatggcagcagaaggcagataggttcctggg

SEQ ID NO: 6825487 - DNA, 68 bp, Homo sapiens
tgctttcaggtcacataacgccaatgaagagactttagattctgcttgatgttatctggcctgatgca

SEQ ID NO: 6825488 - DNA, 72 bp, Homo sapiens
cagagatgaggcagagtggagagaaacaactctggctgagccagagtctccagccactacttcttattcctg

SEQ ID NO: 6825489 - DNA, 72 bp, Homo sapiens
gggaccaggggtttaaggaaacgcctgtctgcaaaagagggtacaagacaggcagacctgtgccctgggccc

SEQ ID NO: 6825490 - DNA, 79 bp, Homo sapiens
gtagcagaatctcaaggcttgtgaggataagaaggtggctaaattagcttattctcacaggtcttgagatcttgactac

SEQ ID NO: 6825491 - DNA, 58 bp, Homo sapiens
gacttaagtggtgtgataagtgccattattatgggaaaattcacactatttcagagtc

SEQ ID NO: 6825492 - DNA, 67 bp, Homo sapiens
tagcatgatattggccctagaaagtgagctctaatcagaaaacaagatagtgccagtgtgcatgcta

SEQ ID NO: 6825493 - DNA, 70 bp, Homo sapiens
agggatcgggtgggttctgccatcaggaccagggagcccactgagtggcctggagccccgcctggtccct

SEQ ID NO: 6825494 - DNA, 66 bp, Homo sapiens
gcagaatctccactttgccttttgaccctagttatctagaactctgggatgagaaaagggttctgc

SEQ ID NO: 6825495 - DNA, 57 bp, Homo sapiens
actagcaatgattctaccaagttgttgcaaaggggctgtggcagagacaatgctagt

SEQ ID NO: 6825496 - DNA, 119 bp, Homo sapiens
actttttaaaaattactctatataaggatattggttaattttggttggtgtatttttataatatacacagccattatgaattaggtttattttcagtagtagttattgatgtggaaagt

SEQ ID NO: 6825497 - DNA, 61 bp, Homo sapiens
gcccaaggcaaagctagcctggaggatgagcagcatccgggggtggtagatttccttgagc

SEQ ID NO: 6825498 - DNA, 126 bp, Homo sapiens
tgtgttgctgggtttcttttgttgttgttgttttacttgtcttgtgtgtttggggtgattcaggacactggatgttcatcaacacattacaaggcgtagaactttttctgcttatcctgtgacaca

SEQ ID NO: 6825499 - DNA, 70 bp, Homo sapiens
ctagaagagaggctccttgagggcaggaatctttcattcatttcttcactgatgtctctcaaatgtctag

SEQ ID NO: 6825500 - DNA, 58 bp, Homo sapiens
tactgtagatagtgctgtgtaaacttaatattaaggtacaaagtattatttaaaagtg

SEQ ID NO: 6825501 - DNA, 62 bp, Homo sapiens
ggaacagactgacttcttgaattaagctcaaaaacagcggtcaggaattttgttctgtatcc

SEQ ID NO: 6825502 - DNA, 65 bp, Homo sapiens
aaactgaggcttagagaattaagtgatttgtccaaggtcccttagttagtaagttaggtcggttt

SEQ ID NO: 6825503 - DNA, 65 bp, Homo sapiens
ggagactcgggttctagccttgtgaacttggaccacgaccttggcctctctgggactcggtctcc

SEQ ID NO: 6825504 - DNA, 77 bp, Homo sapiens
gtacagcgaacacatcctctcctcttccccaaaccgtaccaaatgtggaagctaatgaggtgtgtttctgctgatgc

SEQ ID NO: 6825505 - DNA, 58 bp, Homo sapiens
acagctgtggtttgccaatcctttagacccatctggtctagagactgccaccagctgt

SEQ ID NO: 6825506 - DNA, 85 bp, Homo sapiens
tggggtgtcgggatgggggtgctgggagacacagacctgatacagtatgtctttctgcaccacctcacaattttcctgaacccca

SEQ ID NO: 6825507 - DNA, 61 bp, Homo sapiens
agcctcagtggggcgacagggtgctcggcggactccacctcaggccctccccactgttgct

SEQ ID NO: 6825508 - DNA, 70 bp, Homo sapiens
tgggtgaatcttgtgctggaaaaggttcctgaaaggaagcccctgtcatcttgtccagccaggcaactca

SEQ ID NO: 6825509 - DNA, 76 bp, Homo sapiens
actctctctgtcctatgagtactcactagtttgtcaatgaccttcttagtgtgcagtgctcagggttagatacagt

SEQ ID NO: 6825510 - DNA, 76 bp, Homo sapiens
aactgtttttcacgtgtctcataactgtggtgatgagcaaatcagaagtcatcaaatgaaatatggaagaaaggtt

SEQ ID NO: 6825511 - DNA, 59 bp, Homo sapiens
ttcctccatccttagggagagcacctcatgtctagggttgctgtaaggattggagagga

SEQ ID NO: 6825512 - DNA, 83 bp, Homo sapiens
atgaaaagtcctaacttgagctctcagtgctatttatgatctcgggaggagggtctgaagctggggttcagaatcttttacat

SEQ ID NO: 6825513 - DNA, 65 bp, Homo sapiens
gctccagatgtttcaggggaaacatttcttatatttaagaatgaagccactgaagacaatcttgc

SEQ ID NO: 6825514 - DNA, 74 bp, Homo sapiens
ggtctatcttgttctctgagtggattttgtagcatcatgcattgcattggtcatttagaaaatactggttcact

SEQ ID NO: 6825515 - DNA, 58 bp, Homo sapiens
gaaggaattatttcagttgtagtgtgaacttgaacagtacaataagtataattctttc

SEQ ID NO: 6825516 - DNA, 76 bp, Homo sapiens
tcgctctgttgcccaggctggagtgcagtggtgcaatctcggctcactgcaatgtctacctcctgggttcaagcga

SEQ ID NO: 6825517 - DNA, 65 bp, Homo sapiens
ccatctcctaaagctgagcaaagctcctccctgcaaggtagggcactgaacagctgtagcagtgg

SEQ ID NO: 6825518 - DNA, 60 bp, Homo sapiens
tggcctccctggccctccctcttctggtaatgaaatagaggctgtgcagagggagtgcca

SEQ ID NO: 6825519 - DNA, 56 bp, Homo sapiens
agcatatggaggcagctattcagttatgctgagctatgctgcaatatcattttgct

SEQ ID NO: 6825520 - DNA, 75 bp, Homo sapiens
tactagtttctaccttacagaaagtatcatagaaaatatcaaataaatactttcatgtgagcatggaatgaggta

SEQ ID NO: 6825521 - DNA, 61 bp, Homo sapiens
ctcagccccacagcaagccccagggtcacagccagggcccagctctgcctctggggctgag

SEQ ID NO: 6825522 - DNA, 94 bp, Homo sapiens
tcctccatgaactaattagagtaatgactatttgcagacatttccacacaggtaattatttgtaagcaagttaacatttttttagaggggaggg

SEQ ID NO: 6825523 - DNA, 64 bp, Homo sapiens
tgcccataaatggaagactaggggcactttgactagttaacaggctcacagtcatttcattgca

SEQ ID NO: 6825524 - DNA, 75 bp, Homo sapiens
gacaaaaaccagtgtcaggatcagtatatttcagtatattaaatctgactatactgtgtgctgtacaaaaatgtc

SEQ ID NO: 6825525 - DNA, 72 bp, Homo sapiens
tgagtgtgtagcatttggcaggcagcctggcatgaaccaagtgcccaatgcatgtcagctgctgctcatcca

SEQ ID NO: 6825526 - DNA, 55 bp, Homo sapiens
agtgtctgtagctgcccctttccacaaaaggtggcaggaagcatctataggtcct

SEQ ID NO: 6825527 - DNA, 93 bp, Homo sapiens
cagattaagaaagtttgctaagagatgttactaaatgttgtatgtaactaaacatgtgtcttgcatttcttggtagatacaatttttaagatg

SEQ ID NO: 6825528 - DNA, 70 bp, Homo sapiens
ggcagctcccctctgtggggcagtatctggtcctgtgccccagctgccaaaggagagtgggggccatgcc

SEQ ID NO: 6825529 - DNA, 58 bp, Homo sapiens
tggctcggggcaaactactctgcttgttacatggctagcaggcatgcccctgagtcca

SEQ ID NO: 6825530 - DNA, 70 bp, Homo sapiens
cttggaatgtggtggttggtggttatttaatgagtatatatttagtaagtacctccacttgattgccaag

SEQ ID NO: 6825531 - DNA, 62 bp, Homo sapiens
aagtgatctgactcccagttagaggttctttccttgccctcttttaggtgatcagatcactt

SEQ ID NO: 6825532 - DNA, 61 bp, Homo sapiens
tgggcacctagcaacccttctccatggtgtactttgactccatcttgttgctagttgtcca

SEQ ID NO: 6825533 - DNA, 79 bp, Homo sapiens
aagcctccctggagcaggtcgttcaggtgctggcatctcagggagcacctgagggcgccgagctcccaggaggaggctt

SEQ ID NO: 6825534 - DNA, 76 bp, Homo sapiens
tatgttcacaagatgtctgtggcttcaggtggggattaaacaaaaataactgccttagtcacaggcctggaacatg

SEQ ID NO: 6825535 - DNA, 90 bp, Homo sapiens
cagttcgtctcggttattcctcatttaacactggttcagttaatggaaaagaaagcacttaagagaaggaatgacctagctagtgagctg

SEQ ID NO: 6825536 - DNA, 97 bp, Homo sapiens
gaggtaggagaatggcgtgaacccgaggcggagcgtgcagtgagccgagatcgcgccactgcactccagcctgggtgacagagcaagactccatctc

SEQ ID NO: 6825537 - DNA, 72 bp, Homo sapiens
ttggtcttgaatattcttggaaatgattgaatgctgcagctttcaatacaaagaaaggaattttgataccag

SEQ ID NO: 6825538 - DNA, 62 bp, Homo sapiens
aggactgacttttgccatgaaacttgccagtcactcctgtgagatggcaaatcgtcagtcct

SEQ ID NO: 6825539 - DNA, 66 bp, Homo sapiens
gtcatgtaaagtgcgttgcttctaagtcttcttcattgatagcttaaggttcagctttcccatgac

SEQ ID NO: 6825540 - DNA, 63 bp, Homo sapiens
gcagctctacaaagtgtgcccatgctgaggcttgagcctgcagagggtactttttgttcatgt

SEQ ID NO: 6825541 - DNA, 86 bp, Homo sapiens
ctgggcttatgtatgaaggaattgggcttatggttgcggaaataattccaaagcaaatatttctaattcctgaaataggtacttgg

SEQ ID NO: 6825542 - DNA, 100 bp, Homo sapiens
tggggtggtgtggagggttcagaaggtgcagcctgggccccccatgacattccctgctgggggcgccaggcctgctctctttacctctagcagagcctca

SEQ ID NO: 6825543 - DNA, 72 bp, Homo sapiens
gtcagtagtctgggcggcggtggtctccccgcaggtggccgctggctcctcaggactgcgggatctgctgac

SEQ ID NO: 6825544 - DNA, 78 bp, Homo sapiens
gccaggcaccctttcaccccaagcatttgctctcctcttccttctgcctgtatgtgcttccctggatgggtgtttggt

SEQ ID NO: 6825545 - DNA, 56 bp, Homo sapiens
taggcgctgtggctctgttttcagtccctgatgggagaaaccagaacgcagccctg

SEQ ID NO: 6825546 - DNA, 60 bp, Homo sapiens
ctggtttgagtaacagggccctctttgtcagctacaacaagggcctctcatttgtgccag

SEQ ID NO: 6825547 - DNA, 69 bp, Homo sapiens
aacccttccgggcagctggcttataggtttgtggtaaaagcgaaggtgtgggtcaggctgttgggggtt

SEQ ID NO: 6825548 - DNA, 64 bp, Homo sapiens
agcacgcacctgcttcgcgtcgcccccggcccctccggaaatcagagctggggcggtgtgtgtt

SEQ ID NO: 6825549 - DNA, 84 bp, Homo sapiens
gtttttctttgctttgtttctttttcttgcaggactaaacaatgtcatccaaggccataagagatacaaaacccaaggaaaaat

SEQ ID NO: 6825550 - DNA, 61 bp, Homo sapiens
acatctccaggaaccatcatggtaactaaattaattgtttaccgtattctttctggaatgt

SEQ ID NO: 6825551 - DNA, 83 bp, Homo sapiens
ttagtaactctttaagccactattaaataatgattgtatagctacagcagtttcaattttagtgtttatatcagggtcactga

SEQ ID NO: 6825552 - DNA, 103 bp, Homo sapiens
tccccaggctaacaaggagtggggggctcctcccagctgccagtgcccaggaggtaggagctgaagactgcgggtgggccccccttccctttccacctcagga

SEQ ID NO: 6825553 - DNA, 61 bp, Homo sapiens
ctctcacacttgcttccccagtccagggcacccaggagtttggggtacgcaggtctgggag

SEQ ID NO: 6825554 - DNA, 91 bp, Homo sapiens
aagcactgtgtttgctatgcaaagacatctaattttgcaaaataaatacaccaggcatacaatttttgctttgcaaaagaacatagtgctt

SEQ ID NO: 6825555 - DNA, 99 bp, Homo sapiens
aatgtaagaggtaatcctactcattgttcttggtatatagtcagcttatagctgtgctgtgtctatcaggaataataataaataattatctactatgtt

SEQ ID NO: 6825556 - DNA, 68 bp, Homo sapiens
tatgtacattttgaggttaaaacaaccatgcagttatggtggttttgtttattctgaacctgtatgta

SEQ ID NO: 6825557 - DNA, 77 bp, Homo sapiens
tggggatcagcaggccacctgccccagtcttggagctctgtagggtgaatgaggcagacgtggaagagttggcccca

SEQ ID NO: 6825558 - DNA, 63 bp, Homo sapiens
ggttttggaagtgtgtctgcagggtgttcataggcattaagataactgcacgttttcaaggcc

SEQ ID NO: 6825559 - DNA, 62 bp, Homo sapiens
caccgggccctctccggcgtctgctttccacaatgcagcccccgcccaggagggcccatgtg

SEQ ID NO: 6825560 - DNA, 94 bp, Homo sapiens
gcccatggggacaaaagttggagtccaggactaataaagggtggcagcccttctatatcaccctcggatttggcctaggactttaaaaccctgc

SEQ ID NO: 6825561 - DNA, 58 bp, Homo sapiens
ctgcaggaggatcctgagagtggtgttaactctttctggtcagcacgtcttccttcag

SEQ ID NO: 6825562 - DNA, 58 bp, Homo sapiens
tcagcagaggcagactctccttcttccttacttgataagtctgttaagctttgcctga

SEQ ID NO: 6825563 - DNA, 88 bp, Homo sapiens
tctatcattgtgttagcaggttaaaccaaaatataatatgttctaaatattttattgtgtgattggtttgatttgattgctttgtagg

SEQ ID NO: 6825564 - DNA, 101 bp, Homo sapiens
ggttaatagaaaagatttgttcctctgtttattcaatttctatatatcagagacttggtattaggagtataatagcagaggaataaaaacatgatgttgcc

SEQ ID NO: 6825565 - DNA, 77 bp, Homo sapiens
gtaacatctgaccattacaagacattttaaaatatagaaaagtctgaagagtaatgtcagatcacccctaatgttac

SEQ ID NO: 6825566 - DNA, 68 bp, Homo sapiens
cagaagccggcgccacaccatggctgctaggttcaccatcccagcgtggatgtggggcgcggctgctg

SEQ ID NO: 6825567 - DNA, 63 bp, Homo sapiens
gcggaagaaagaaaatcactcctcaaaacacagcagatctgggtgtgaggtctttccttttgt

SEQ ID NO: 6825568 - DNA, 62 bp, Homo sapiens
gttagaaacgcaggctctccgggtttgtcctggacctattgagctggagtgtgcattttaac

SEQ ID NO: 6825569 - DNA, 63 bp, Homo sapiens
tagatgaagagggtaggtagatctcacttttagatatcagtacctattttcttaacacatcta

SEQ ID NO: 6825570 - DNA, 65 bp, Homo sapiens
ctgacgggacaggtgaggctggggcagtgctcctggctcccccaaagcctcagcctgcctgcaag

SEQ ID NO: 6825571 - DNA, 84 bp, Homo sapiens
ggaaagaagatacagatagaattagtgagttaggaaaatcatctgaatccttgatttaccagttactatcttgtaatacaatcc

SEQ ID NO: 6825572 - DNA, 94 bp, Homo sapiens
caggaactagatccagtttttgccaggtgtcttggctgactgtcagagacagtcatctggttttgcatggcagcatctggttttacagtttctg

SEQ ID NO: 6825573 - DNA, 62 bp, Homo sapiens
ctgtggctgcgccatcgaaaacacctagggggaaattgtctggattttatggccacccacag

SEQ ID NO: 6825574 - DNA, 110 bp, Homo sapiens
cttgtatttttagtagtgatggggttttgctatgttggccaggctggtcttgaactcctgacctcaggtgatccacccgcctcggcctcccaaagtgctgagattacagg

SEQ ID NO: 6825575 - DNA, 75 bp, Homo sapiens
cagtccgtgagtgccttcagatttgccccagtgcccctgcctgaggtgtgaaatggtggcaacttctggcacctg

SEQ ID NO: 6825576 - DNA, 81 bp, Homo sapiens
cacctggtatcctgggccctgaagtgattgtgagttgagggcaatccctgccgagctcacgccagttgggcctgccgtgtg

SEQ ID NO: 6825577 - DNA, 67 bp, Homo sapiens
ggctaccagtattgatcattgcaagaacattgcaagcttagcaagaatcagctgctgggtcatagcc

SEQ ID NO: 6825578 - DNA, 58 bp, Homo sapiens
gagatggattatatgtggaccatggaaaatgaggttcgtggctgtgggcatctgtttc

SEQ ID NO: 6825579 - DNA, 55 bp, Homo sapiens
gcgtgcaacagcctcttccattttaggttcctatcctgaaagacatgttgcctgc

SEQ ID NO: 6825580 - DNA, 100 bp, Homo sapiens
ctgcggacttcaccactcacattcactttactttgttaatctggctgcaaggaaatttcttagcccttgacacagtatgtgaagagagttctgttggcag

SEQ ID NO: 6825581 - DNA, 80 bp, Homo sapiens
ccacctctgggggcttccttaccctcttattttgattgtaaaacaagcatcccagggtcaggttaagggagtcatggtgg

SEQ ID NO: 6825582 - DNA, 62 bp, Homo sapiens
ggacagataagttggagcctcattgttgagagtattgataataaggccaaactatctggtct

SEQ ID NO: 6825583 - DNA, 97 bp, Homo sapiens
ttggctttggagttgtaaagacctgaatttgaatactgattctgctactgaatatggtagaatcttgggcaaattcatctatctctccatcagtcaa

SEQ ID NO: 6825584 - DNA, 60 bp, Homo sapiens
cagcagcatggctgactaaagacattgacatcatgacattgtcatgttgctctgctgttg

SEQ ID NO: 6825585 - DNA, 61 bp, Homo sapiens
catgcatgcttcttatagtacttacaaataatttgcaaaggtaagttagaagtgttgcatg

SEQ ID NO: 6825586 - DNA, 95 bp, Homo sapiens
tcttctttaactacagtaccaagaattaagaattttgatgtggatctttagcttcacagagaaactggattgattttggaaactgtatcaggaga

SEQ ID NO: 6825587 - DNA, 66 bp, Homo sapiens
tctgtgaatgttatatctcaatggaaagctgactgtcagtcacataaaggaagtaacgtacactga

SEQ ID NO: 6825588 - DNA, 59 bp, Homo sapiens
gacactgtggtttctgcctctctctcagatcacgtgctctgggggaaaagccaggtgtc

SEQ ID NO: 6825589 - DNA, 100 bp, Homo sapiens
cagtcgctagagactacaactcccggaatgcagcggggcctatcgggcttgcgattgcccggaggacggcatgctgggacgtgtggtttctaagcgactg

SEQ ID NO: 6825590 - DNA, 65 bp, Homo sapiens
caggctatccccacgatatagccaaagcaccctggcttgctttgaaagtgtctggggagtttttg

SEQ ID NO: 6825591 - DNA, 87 bp, Homo sapiens
gacccatatagcaaactggagcttgctttactcattaattctatggtgtgtatgagtgtttccaggtatttgctttcttctcaggtc

SEQ ID NO: 6825592 - DNA, 124 bp, Homo sapiens
cctttcgtctcaccctccagcactaaagggctcaattcacttgtgttaccaaggtttggtgactgcggagttaccaaggtttggtgactgcagagtctaaggggagcctggcagagatgaaggg

SEQ ID NO: 6825593 - DNA, 77 bp, Homo sapiens
gtgaggtacaattttataccctcatcagaagcttctccaattttagcctttctagtgggtataaaatggtatctcat

SEQ ID NO: 6825594 - DNA, 70 bp, Homo sapiens
gctggggaacactacttttcataaaagtaagctcagagaaaggcttgcttttctagatagtgtgaatagc

SEQ ID NO: 6825595 - DNA, 77 bp, Homo sapiens
ccaattcattgattattgaagggtctttaggcaagatggttaacgtctctgaaagattttcctgatctgtgaaatgg

SEQ ID NO: 6825596 - DNA, 75 bp, Homo sapiens
ccagtgtgaaggtctctgttgagaacatttgcttcaaactagagtacatgtctcatggcagaatttttgagctgg

SEQ ID NO: 6825597 - DNA, 90 bp, Homo sapiens
cattacaatcccttgtatttgggtagtatagagaattagaaaaaaatgaacacaaaaagttctcattttacccaagaactgggtgttttg

SEQ ID NO: 6825598 - DNA, 87 bp, Homo sapiens
ggagatgaggagggggcctgaggttatccatctacctgtgatttgatgggtaggtttaatttcaggataaaattccaactcatgtcc

SEQ ID NO: 6825599 - DNA, 59 bp, Homo sapiens
tgggagacttcaggggagaatttgtgtctttgccttttccagcttctagaggtcaccca

SEQ ID NO: 6825600 - DNA, 88 bp, Homo sapiens
gcaactggggttttctgcactattgtgttcactattagcatagctctgtataaatactgtaatagtttcataatgtgcttccagctgc

SEQ ID NO: 6825601 - DNA, 63 bp, Homo sapiens
gagtgtgggtctcagctttaagctgatgggttaaattctatatgtataagcagatccacattc

SEQ ID NO: 6825602 - DNA, 70 bp, Homo sapiens
tttctggattagatgctttcaagaaacagagtcaatgtagtgattaggtatcttagtgtttatctagaag

SEQ ID NO: 6825603 - DNA, 114 bp, Homo sapiens
aggcagacagaaggggaagccactagcttcgggtcctcctcactggttcctttccttggagcagggaaactcacaggtgcaggggcactggaagtggctatctgccttccgcct

SEQ ID NO: 6825604 - DNA, 57 bp, Homo sapiens
ggtgccactcattcagcaggtcctgctaatgccggagtgttggaccgaggtggagcc

SEQ ID NO: 6825605 - DNA, 88 bp, Homo sapiens
ctgaatcttcatcgcaaacctttgagtgtattgtctttcctattttacagctatgaaccacaagattcaaaggggtggaaagcttcgg

SEQ ID NO: 6825606 - DNA, 57 bp, Homo sapiens
ctgctcctggtcatcctccactctctgactcccccaggtcctggagatgctggacag

SEQ ID NO: 6825607 - DNA, 75 bp, Homo sapiens
agtacacctgcctccaatgaagccaactctcaggctctagaagtctctgccttgggatggattcaccagtgtgct

SEQ ID NO: 6825608 - DNA, 69 bp, Homo sapiens
catagattcttatttccatcttagttctatcaaatcaaattatctgagaatgggtcctgagaaactatg

SEQ ID NO: 6825609 - DNA, 72 bp, Homo sapiens
ttatggatcttactggtaagtgatgtgtaacacttttgcccacattctactggccagaactaagtcacatga

SEQ ID NO: 6825610 - DNA, 57 bp, Homo sapiens
cagtttgatgatgagatggggatttaacctctgcttgccatcattatcagttcactg

SEQ ID NO: 6825611 - DNA, 57 bp, Homo sapiens
ccagcacagacgtccagtgggactcggacatcactcccactggcagtttctgcatgg

SEQ ID NO: 6825612 - DNA, 74 bp, Homo sapiens
tcaggaatgcccacaacactgcacttttgggattaagtaaaagtaacagaaatgcatgcttgttccatttctga

SEQ ID NO: 6825613 - DNA, 65 bp, Homo sapiens
gtactcaagagtctgcagtagtctgagcaaaggattaacatggtcagaaagctgattcttgatac

SEQ ID NO: 6825614 - DNA, 90 bp, Homo sapiens
ttcagaagcttctctgagatcagccactgacttggagagataacagtaaggctttgagatctagaggctgatcttagtctgctgtttgga

SEQ ID NO: 6825615 - DNA, 115 bp, Homo sapiens
tcgaccactgcccttctttcccagcataggtcagctaagggcgtgtgggcggagcttatgtgtctctgtccatggtccttattaccagggcaaaacgaaggaggcagaaggaaga

SEQ ID NO: 6825616 - DNA, 88 bp, Homo sapiens
ggagtctcgctgtgttgcccaggctggagtgcagtggcatgatcttggttcactgcagcctctgcctcccgggctcaagcaattctcc

SEQ ID NO: 6825617 - DNA, 59 bp, Homo sapiens
ggatgcttggagcctgcccttcttgtgcctataccataagggcaagatcctaagcatcc

SEQ ID NO: 6825618 - DNA, 65 bp, Homo sapiens
caggggctgatggaactcaggcctccccgactctgagggaggtcctgctctttcattaacccatg

SEQ ID NO: 6825619 - DNA, 90 bp, Homo sapiens
gtggtatgcaaatgactggtatgttttataataaatggtatcctggatttagtgaaattaggcaaattagttataaggcatagaattcac

SEQ ID NO: 6825620 - DNA, 71 bp, Homo sapiens
actatcttataggtgtgccccaaatttatacccaaaattagtataaatttggggtatacctatgagatagt

SEQ ID NO: 6825621 - DNA, 68 bp, Homo sapiens
gcttttgtcatggtgactcagtcacatgaaattactgacctacattgatgactgttatctgataaggc

SEQ ID NO: 6825622 - DNA, 61 bp, Homo sapiens
ggccttgtgttcccttctcctctgcttattttcatgagccagcaggtgggaaactggagcc

SEQ ID NO: 6825623 - DNA, 69 bp, Homo sapiens
ttagtgtgacagcttctctgaaattcatgtgatcatttacatattgtttcccaggagctttggcattaa

SEQ ID NO: 6825624 - DNA, 75 bp, Homo sapiens
cttaaatgtctccaggggccaggtaagtcaccctcatgactgaggtggctgagctgtgcccctggctacacggag

SEQ ID NO: 6825625 - DNA, 55 bp, Homo sapiens
tgtgtttctttgttccttgtggggcagccctttccctgaacacagaataagcaca

SEQ ID NO: 6825626 - DNA, 59 bp, Homo sapiens
tctacatagaattaggtaatttggatgacttgtttccaaactttgcttaactgtgtgga

SEQ ID NO: 6825627 - DNA, 74 bp, Homo sapiens
gtctccaatccatcctaatgtgagtaccacactgatctttcaaggctgtctgttcacatttagcgatggggaac

SEQ ID NO: 6825628 - DNA, 74 bp, Homo sapiens
tcctcccttttggtgtctgcataggcctagggaaggatctacaagaaaaatgctaggctttgaaggagggagga

SEQ ID NO: 6825629 - DNA, 96 bp, Homo sapiens
ggtcagttacttctttaaactttgtgctttgaggttcacagattattgagcacgcctagtttgaactgtagcaggtttagagtaaggtgcatgacc

SEQ ID NO: 6825630 - DNA, 70 bp, Homo sapiens
aataaccacaaaattgtgtgtgtgcatgtgtgtgtgtgtgtgtgtgtttacagtttctcatgtggctatt

SEQ ID NO: 6825631 - DNA, 63 bp, Homo sapiens
tggggcctggagctctccacttggggctgcctgcagcttgtgtttctgcttcagtttatccca

SEQ ID NO: 6825632 - DNA, 58 bp, Homo sapiens
ggtgggctctgcatcagtgcccattcacacagtgaccacagagaagcagagcgctgcc

SEQ ID NO: 6825633 - DNA, 86 bp, Homo sapiens
gtgcccagcaggagctgagacccagtggctgaaatagacagaacattctctggttatcaggcatctggctacactccaggctgcac

SEQ ID NO: 6825634 - DNA, 99 bp, Homo sapiens
atgtcaaggaacatgcccaaggtggcatgtggctcctctcccggaggttgatttctcaaagggctactgcctgccttcaggactggtgtttgttgatgt

SEQ ID NO: 6825635 - DNA, 107 bp, Homo sapiens
ctgggaaagttactgaacctctttgtgcttcagcttatcttttaactacctgagagcaaagctgtgaagagcaagtgaggacatcagtattaaaagcactttgtcag

SEQ ID NO: 6825636 - DNA, 71 bp, Homo sapiens
gaaaggagtgattgctcctttaaacttgatttcctctagcaaataggttctattggagtgtcattctcctc

SEQ ID NO: 6825637 - DNA, 74 bp, Homo sapiens
agggtgaccaactcatcccagtttgaccggacttttcccttagtcccaagcaaacagggatgggtgttcaccct

SEQ ID NO: 6825638 - DNA, 64 bp, Homo sapiens
tgtgtatacatgtctgtgtgcacatgtgtgggtgtgcatgtgtatgtgcatgcatgtgtgaaca

SEQ ID NO: 6825639 - DNA, 83 bp, Homo sapiens
gtttgtaaaggggagcgtgaattagttggtacacagttgatcgtctgtgcagtagggtcatgctcacacgtccctccacacac

SEQ ID NO: 6825640 - DNA, 101 bp, Homo sapiens
atctgactacagcctgtgttacccttatcagaactttctaacagctcctcttctccgctcaggagatgaggggtagaaaggacttaggctaagtggcaggt

SEQ ID NO: 6825641 - DNA, 64 bp, Homo sapiens
ctgcccagcacccagcatgatgcctggtacaatacagatgccccataattgtgtgctgaggaag

SEQ ID NO: 6825642 - DNA, 79 bp, Homo sapiens
ttaagtactggggatacattagtgaacaaaagagacaaagactgttttccatatgaagctgatgctctagattacttaa

SEQ ID NO: 6825643 - DNA, 57 bp, Homo sapiens
tttggtttagggtcatttaacactgaatcagcagtctttccgggataataagccaag

SEQ ID NO: 6825644 - DNA, 95 bp, Homo sapiens
ccaatcaactttgcatttgccctggggctggcctggcagtgctgctatcagaattcagatactggcccagccctgctctagggcctgaagtttgg

SEQ ID NO: 6825645 - DNA, 63 bp, Homo sapiens
atgcatgtcagctgtgcccatgttgccttcacaccccttgccaacgcagggctgcacacgcat

SEQ ID NO: 6825646 - DNA, 61 bp, Homo sapiens
gtactgagatcattatgtgaaaggatgggacactttacccataaagtcatgatctgagtat

SEQ ID NO: 6825647 - DNA, 101 bp, Homo sapiens
cattctgactgttcaaccagtagcagagatacggaacctgactagggtcaatttcaaacctcattcaggtctgtactattgtcttgctgtaactaagaatg

SEQ ID NO: 6825648 - DNA, 77 bp, Homo sapiens
gaaagactcaaagaaacatctgaggagaatatgatctaatcctattgtcttaaacaaatgtgttttctgagttcttc

SEQ ID NO: 6825649 - DNA, 63 bp, Homo sapiens
acaggttcctggtcctcctagagcttcttattcaatgggtctgggatgaagccagaaacttgt

SEQ ID NO: 6825650 - DNA, 61 bp, Homo sapiens
gaatctctccagttcctgttcattttactttagaataagaggccaggaatggatgggattt

SEQ ID NO: 6825651 - DNA, 64 bp, Homo sapiens
gcctctttattcaggaggtgctcgaaggaaatctggcttcttgtgagtttcctggaagttaggc

SEQ ID NO: 6825652 - DNA, 107 bp, Homo sapiens
agtaggaggcagaaggaatcaatggttctggtattttccactcctaattttattgagaagtggcaaagtcttcagaagtttattggctactctgcacatttcctgct

SEQ ID NO: 6825653 - DNA, 77 bp, Homo sapiens
atttctagggaaccggggggtagagtctggggtctgtgactcagtctacagttccctcaggtccctacagcagaagt

SEQ ID NO: 6825654 - DNA, 61 bp, Homo sapiens
actggaagaagcaggaattctttggcttcatggtcagggaacctctcctgtttctcacagt

SEQ ID NO: 6825655 - DNA, 66 bp, Homo sapiens
ggcagagggtatgagtggggctaaactccaatccatgagtgagctctgcccaccaaaccctatgcc

SEQ ID NO: 6825656 - DNA, 57 bp, Homo sapiens
tgggaaaaggtgcctggtgcctcggggctgggaagctgtggctccaggacctaccca

SEQ ID NO: 6825657 - DNA, 84 bp, Homo sapiens
ttagggcctcatgcatctgcaggggaagccagtttgttcttttgatccagaagggttaattttcgctgcaggtgtcaactctga

SEQ ID NO: 6825658 - DNA, 60 bp, Homo sapiens
ggaatattgcagtattgtaagtgtaggccaagtagtcaacatttgtgatgagcaaactct

SEQ ID NO: 6825659 - DNA, 80 bp, Homo sapiens
atttttcaaaatgaaataatttatgacattcaagtggcctaatggcacacttgaagtgaattgctcaccttttggaagat

SEQ ID NO: 6825660 - DNA, 89 bp, Homo sapiens
cagtctccatggcaacaagtaaagggggaagaaacattttcttatgaatgggaagcctttcccttttgccttgcgtggagtggtggctg

SEQ ID NO: 6825661 - DNA, 84 bp, Homo sapiens
ggaccaagcagcagctcccagagcggtggcccagcaaacacgacttgactcgaggccaaggctcttgagggctgagcagtgtcc

SEQ ID NO: 6825662 - DNA, 80 bp, Homo sapiens
agaaagcttgttaaacatgtagaatctcagatccccaccccagatctgctgaatcagaatctgcattttaacaagcctct

SEQ ID NO: 6825663 - DNA, 56 bp, Homo sapiens
tgcagtgtttagaaagctatcagcaagatcaagctggagcagctgtttgcattgca

SEQ ID NO: 6825664 - DNA, 70 bp, Homo sapiens
gaggcttgattggtccctccaggctcaggtgctcatcaatgagcccaagctatgaggtgacctcaccctc

SEQ ID NO: 6825665 - DNA, 77 bp, Homo sapiens
aaatgtatgttggaatatatgtttcctgttattgctactacattttggtaacatggaaactgtgtctgtgcgcattt

SEQ ID NO: 6825666 - DNA, 58 bp, Homo sapiens
ggcagagaatctggctgtttactgggtttgcctataagcaaatggtcagatttccccc

SEQ ID NO: 6825667 - DNA, 56 bp, Homo sapiens
taaagttcagtgcatgaatgtgggatttgttgtctgcatgagtttatagggctttg

SEQ ID NO: 6825668 - DNA, 55 bp, Homo sapiens
ggcctcagggtcactctgtagatatcaactgactctgcctgttgagcctaaggcc

SEQ ID NO: 6825669 - DNA, 101 bp, Homo sapiens
aaaaatttgagtgattgttattctaattatcttgctgatttgattattcttaaataaggaagagaactgtaaaataattggcaataacatcttagattttt

SEQ ID NO: 6825670 - DNA, 77 bp, Homo sapiens
ggggagcggcagcatctgtacatagacgctcaataaatatctgtcgaaggagtgagtgaacaatgtctgtcaacccc

SEQ ID NO: 6825671 - DNA, 76 bp, Homo sapiens
aggcatcttctggctcagtgttcatctgtatgcacagttatgtgtaagcactaggagctgagcctgaaaagtacct

SEQ ID NO: 6825672 - DNA, 101 bp, Homo sapiens
ttatttattgataaattgtcaagacagaatcagctgtgcttatttttactgaaactggaaagttgattatgtccaacaagcttgacaatttatgtggataa

SEQ ID NO: 6825673 - DNA, 102 bp, Homo sapiens
tggcagcatggggagaagaaggagaccctgaagatgctgatgacaatggtgcttgtctacacaatcagctggctccctcttaacctctacctggtgctgcca

SEQ ID NO: 6825674 - DNA, 57 bp, Homo sapiens
tgctttgggctggaattttagtacctaggtctgcctacatggtgccagtcagaagca

SEQ ID NO: 6825675 - DNA, 97 bp, Homo sapiens
tggttaaattctgtgaactagcagatctatgctttagaaacaactgtgataactttcctttctgatgcatgggtctctgttttccaccacggagcca

SEQ ID NO: 6825676 - DNA, 68 bp, Homo sapiens
gctatgttggccaggctggtcttgaactcctgacctcaggtgatccacccgcctcggcctcccaaagt

SEQ ID NO: 6825677 - DNA, 71 bp, Homo sapiens
taccagcttttgatgctagaaaaccccaggtgggaaatggccctctgagtagactggacatgaagctggtg

SEQ ID NO: 6825678 - DNA, 95 bp, Homo sapiens
ttttcatgctgacccagttcaaggccacagagcctcagagaggttccttaccctgtgaggtcatctgtggtaacgctggatgggccggatgaaga

SEQ ID NO: 6825679 - DNA, 57 bp, Homo sapiens
cagagcccatttctttgttcctaaggcttgccctgttcagcaagaaacatgggcctg

SEQ ID NO: 6825680 - DNA, 88 bp, Homo sapiens
cttccactcctctgaggtttaattaggagaatctgtctttctggtacttccgagagccttgctctaaatttctcagaggaaagcgaag

SEQ ID NO: 6825681 - DNA, 127 bp, Homo sapiens
gtgcggttattgaccagaaagaaattgactatggagtaactatttggatgtgatgaatatattacataccttgacggtagatggactccatgggcaactacatttatcagaactttctgaactgtac

SEQ ID NO: 6825682 - DNA, 57 bp, Homo sapiens
ggaaagagctaaaagggtgagattgccacaacactcccgccactggggactctgtcc

SEQ ID NO: 6825683 - DNA, 64 bp, Homo sapiens
attgtgaatagtgctgcaataaacatatgtgtgcatgtgtctttatagcagcatgatttacaat

SEQ ID NO: 6825684 - DNA, 64 bp, Homo sapiens
gtttctccaatttccttgtcaggaaggattgctagtcatcttgaaaattgaggttgaaggaagc

SEQ ID NO: 6825685 - DNA, 71 bp, Homo sapiens
cttccaagagtatgcatgcatgtttgtgtgtgtaagcagtctatacgagtatgtttgtattttcttggaag

SEQ ID NO: 6825686 - DNA, 71 bp, Homo sapiens
ggcaaagatgctacccagccattgctttctaaggaagagtgtagtgctttcatctggagtgtctccctgcc

SEQ ID NO: 6825687 - DNA, 80 bp, Homo sapiens
cctgagggctgctttagacaggagaagcatggttgtgaaatattgtattgtgttcccttctgtagaagttgctacttagg

SEQ ID NO: 6825688 - DNA, 85 bp, Homo sapiens
gaaagccaggcctcttggcaatgaaagctgcccggggcagccctctccctcttcctggtgcaggtgtgttgccagcgtggatgtc

SEQ ID NO: 6825689 - DNA, 90 bp, Homo sapiens
gctgacttatttccttgcttacaacatatttagcttgattgggtcactactctcctacatcaggcaagtatttgtaagtggaatgcaagc

SEQ ID NO: 6825690 - DNA, 55 bp, Homo sapiens
gctgggagaggaacctcgagggtcgggtgaagcccacccagagtcctccccgcgc

SEQ ID NO: 6825691 - DNA, 81 bp, Homo sapiens
tgagagtctgctgcctcgacattgggacaaataagactcttgcctgtcaacaagatgttccgatgttggaggagggctcca

SEQ ID NO: 6825692 - DNA, 85 bp, Homo sapiens
ccatacgcttgcatgcattttttatgttttaggtagtgatataatgcttgaatgtaaataatgtacaggataaaacaggctatgg

SEQ ID NO: 6825693 - DNA, 97 bp, Homo sapiens
tcaaggctactcctggtgagagaatttgagttaaatttaggccatatactttgtttatatttggctaatttctcactctcttgatcacaagctatga

SEQ ID NO: 6825694 - DNA, 67 bp, Homo sapiens
gcatcagaggggccaggtagtggttaggggcagggactttgcagccacatgacctgggtctagatgc

SEQ ID NO: 6825695 - DNA, 96 bp, Homo sapiens
gcaaatactgagtttcacaagtgctgggcttgggagagctctgtcccctccatggggggaggtcctgtgtccaggggcctgtgagtctggagttgc

SEQ ID NO: 6825696 - DNA, 75 bp, Homo sapiens
tgggaatggaaatttattagctttggattgcatttagttcccatgaagtgacctgctttgaagctaccatttcta

SEQ ID NO: 6825697 - DNA, 58 bp, Homo sapiens
tccaaagaagtcacaaacgaagcacttagtaaatgttagttgtttgttctgctttgga

SEQ ID NO: 6825698 - DNA, 72 bp, Homo sapiens
gctgggaagctgggccaggcagagctccagttgccagacactgtggccgctctggtaccagctactcctagt

SEQ ID NO: 6825699 - DNA, 67 bp, Homo sapiens
aaccaacgagaaccaccagtgttctctactcaaagcctcctagaaatgtcaagtgttcttgttggtt

SEQ ID NO: 6825700 - DNA, 64 bp, Homo sapiens
gtggccatcaaagaaaaagagagaaactctggggaaccagccattgtcctggttctgtggccac

SEQ ID NO: 6825701 - DNA, 78 bp, Homo sapiens
tcagccacagtctctagtcatttcacctctcagcgatgttttacattagggtgaaaatgtctgtggaaaggcctatga

SEQ ID NO: 6825702 - DNA, 84 bp, Homo sapiens
gctaattcatctatcatgtggtctgcccggggatgtcaaggtgatgagtgaatcctatgaaagccacaatagatgaggaacagc

SEQ ID NO: 6825703 - DNA, 56 bp, Homo sapiens
ccattttgaggtgtttgtgcaccatctgtgacacacacagcaaacactgtaaatgg

SEQ ID NO: 6825704 - DNA, 68 bp, Homo sapiens
ctggtccagacttgggtgctcagggaaagcttccagaggaggttcctactgaagtcccaaggggctag

SEQ ID NO: 6825705 - DNA, 77 bp, Homo sapiens
agtgctcgtctaggtactttgctatgctgtggatataatccctcacatagagagcacttagaagttttcaaagcact

SEQ ID NO: 6825706 - DNA, 79 bp, Homo sapiens
actaagctcttctcaagtgttaagtttaaagacagttaattatcagctattctttagagcacgggaaaaacagtttagt

SEQ ID NO: 6825707 - DNA, 56 bp, Homo sapiens
gcaggataagtttttgagcttgtaatagcaagaaactggtttgaagaaaatcttgc

SEQ ID NO: 6825708 - DNA, 57 bp, Homo sapiens
gggatacttgtctcaaggtcaaatatatatgaacttggcaatgaggtcagatgtctt

SEQ ID NO: 6825709 - DNA, 117 bp, Homo sapiens
gttcccaagggctggtggagccagagaattcctgagggccccagaggaggcttctcgggggggtcagtggggccccagggggtgatggtttagagatcgctgtccaagcttgggagc

SEQ ID NO: 6825710 - DNA, 58 bp, Homo sapiens
gtttcatctatgtgcctttgtatagaaatcttttctatccaatgggacatggaggaac

SEQ ID NO: 6825711 - DNA, 76 bp, Homo sapiens
gggaggacaacagagaagacttacagccacagtgtcacaatggaatggtatctgcagttaaggtcctctccctccc

SEQ ID NO: 6825712 - DNA, 67 bp, Homo sapiens
gcagtgtggccccagtatcacgcagagcctaaccactttctatgtggccctcgtgggctcgtactgc

SEQ ID NO: 6825713 - DNA, 129 bp, Homo sapiens
cacttaacggtgcattcaggggtttaatttgaagcagtgcaggaagtgagatgcctgaactccacagcgctctcatatctgggcatacacagccttgcgtcaacctggaaccctttatcccactgggtg

SEQ ID NO: 6825714 - DNA, 82 bp, Homo sapiens
aaatattaagtccgttttccactggattgtttggagactattagtattcaggcttgaatccatggaatagggacatgtattt

SEQ ID NO: 6825715 - DNA, 58 bp, Homo sapiens
gggcaataatcttcaaagtgtggtatgtgatctattaccatatggaaagatattgttc

SEQ ID NO: 6825716 - DNA, 94 bp, Homo sapiens
aggaaggaacaaagtctccaggcttaatctcagcttctcagaattctgagaagccgcagttctgggcctgggtttctgctttcccatccatcct

SEQ ID NO: 6825717 - DNA, 55 bp, Homo sapiens
agtgactgacacctgtaatcccagcactttgggaggccgaggcgggcagattact

SEQ ID NO: 6825718 - DNA, 102 bp, Homo sapiens
tgggttgaggggtacagctggcaggggggcatgaataacttttgaacacatctatacaagttactttaagccacaagccccgctcattgctgcctcaaccca

SEQ ID NO: 6825719 - DNA, 69 bp, Homo sapiens
gcaatgttctcggaatgtcctccagagctgagttctctcagcggatggcttgggagattctcgaactgc

SEQ ID NO: 6825720 - DNA, 60 bp, Homo sapiens
gccagctttatagcttcaaaggacaggctagctctcttgttagaagctaatgcagctggt

SEQ ID NO: 6825721 - DNA, 69 bp, Homo sapiens
cactcccctcccacacagcccgctcaccggaccccaccccgtccgggccagatggctctggggagagtg

SEQ ID NO: 6825722 - DNA, 127 bp, Homo sapiens
agtgtggatgtatggatagatgggaaaggatttagggcaaaagattcagtctcaacagtgcaagaaggaatctactactttggttgaatatgtaatgaatcccctgtctctggaggtatcaagcact

SEQ ID NO: 6825723 - DNA, 76 bp, Homo sapiens
gccaaatccatgggttcctgtcccgcctgcctcttccagatctcagccaggccaggaggcaggggctcaatggggc

SEQ ID NO: 6825724 - DNA, 62 bp, Homo sapiens
agagggctaaggtttgggagattcacacctggaagcatctgaccccaaaacccatgctcttt

SEQ ID NO: 6825725 - DNA, 70 bp, Homo sapiens
tgagagtttaaaacgcttgtatttaaggtttaattcttaatcttttaaatttaggtgttttgatacctca

SEQ ID NO: 6825726 - DNA, 70 bp, Homo sapiens
attgtaatagaggattcttagaattctgagactatgctatctccaagttgagagagttctcaaagacaat

SEQ ID NO: 6825727 - DNA, 64 bp, Homo sapiens
cgctccggagaggtcggaaaacagagaccggatcagccggttcctggccccgcctcccggggcg

SEQ ID NO: 6825728 - DNA, 61 bp, Homo sapiens
ttgaaatactgcattgttcagtactcctgtttgggagtcacttagagtgacgcagtgtcag

SEQ ID NO: 6825729 - DNA, 86 bp, Homo sapiens
aggccattttcacgtcttttgtgattcttcagttacttcaggccatctggatgtatacgtgcaggtcacaggtgatatgatggctt

SEQ ID NO: 6825730 - DNA, 72 bp, Homo sapiens
gtcacacttccctccagtctcaatccagcagctttcctgaaggtaaagcttcctgcatgggactgctgtgat

SEQ ID NO: 6825731 - DNA, 71 bp, Homo sapiens
caaggtggttattatgagaaggtatggtgacttgggataaattctgtcccataaccgactcaactttcttg

SEQ ID NO: 6825732 - DNA, 61 bp, Homo sapiens
tcatcaaaagccttctgggttatattaaggaatttgaactagatcctgaaggctgtgatgg

SEQ ID NO: 6825733 - DNA, 76 bp, Homo sapiens
gatgtgacctttcttgtcttcttgggattttcctgtagtcaaaaaaggaaggtgtcactgggacaggaaagacatc

SEQ ID NO: 6825734 - DNA, 59 bp, Homo sapiens
ggcgcgcggagcgggcgcgccgccaacgcggtcacgtgcgcggcccctcctctcgcgcc

SEQ ID NO: 6825735 - DNA, 79 bp, Homo sapiens
ggatgtaagtggccccggagtttgttggctgacttggttatctttccaggctttcccagcctctccattgccatgctcc

SEQ ID NO: 6825736 - DNA, 58 bp, Homo sapiens
tgtgatagaggaaatgttgggaggtggtgtatctgccacctctgtgtcctgtgtcata

SEQ ID NO: 6825737 - DNA, 66 bp, Homo sapiens
cagcaagcattttgaagaggcaattttctaaataacctttatttcaaagtgtattgtttattgctg

SEQ ID NO: 6825738 - DNA, 71 bp, Homo sapiens
gctgagcccccctgcgtgggtcccacggcatggaaacactgcctaacgctcccgcaggctgggggcccagc

SEQ ID NO: 6825739 - DNA, 67 bp, Homo sapiens
ggcgtagagcagatgagagggagtgacgacttggacaagcaggtcactgctcagtctgtactacacc

SEQ ID NO: 6825740 - DNA, 58 bp, Homo sapiens
ccttataacagttggtattatttgggtgaatggctcattaaatgctattgttataggg

SEQ ID NO: 6825741 - DNA, 63 bp, Homo sapiens
aagcatccgtatctcttttttatagttgaggaaactgaggttcagaaaagagataacttgctt

SEQ ID NO: 6825742 - DNA, 74 bp, Homo sapiens
gtagagacggggttactctgtgttggtcaggctggtctcgaagtcctgacctcaggtgatccaaccacctctgc

SEQ ID NO: 6825743 - DNA, 93 bp, Homo sapiens
acagactgaatgtggcccacaagcctaacataacataagtatgaatgggacgtaaggatgttatgttaggcttgtgggccacattcagtctgt

SEQ ID NO: 6825744 - DNA, 58 bp, Homo sapiens
gtcccctttggtcctcaagatggtggatacatctggagaaaccgccaagggagagggc

SEQ ID NO: 6825745 - DNA, 83 bp, Homo sapiens
ttgatcaggcttcattgtggcatcaggacccttgagaatctatttttctttgctcaaattctatgctcaatggagccttttaa

SEQ ID NO: 6825746 - DNA, 66 bp, Homo sapiens
acttgctggaaagtagcagagtcaggactcaaacttaggttctggctcggatttgtctagcacagt

SEQ ID NO: 6825747 - DNA, 64 bp, Homo sapiens
gatcttttcctttctgtgtctaataggatatttctacaaacaagatgctggatggaaaatgatc

SEQ ID NO: 6825748 - DNA, 86 bp, Homo sapiens
ttggactttctgatctgtatatttttcaatgcaatgtaagtttacatatccatatatttatagaaggattatagaaaaaggtctga

SEQ ID NO: 6825749 - DNA, 60 bp, Homo sapiens
tttccctttgttaaattggaagagtttagaatgaaaactcttttcacagacaaatggaga

SEQ ID NO: 6825750 - DNA, 120 bp, Homo sapiens
gtcatagaaaagtccaaaagtagaactaggacttcaggtatagcttgatccaggagttcaagtcatgcctccctgtccttcagttcatggttattttattcttggcattgatgttgtggc

SEQ ID NO: 6825751 - DNA, 126 bp, Homo sapiens
ttacattaaaaaatatcttaacagactgtgcatggtcagtgttataagtttagccattttaatggcttattaatattacttccccattggctagatttattgctgagcaatcagtctttaatgtga

SEQ ID NO: 6825752 - DNA, 58 bp, Homo sapiens
gagcgccaggtagagcagcaagttgagttcccactccatgctggaggcgccggcgctc

SEQ ID NO: 6825753 - DNA, 63 bp, Homo sapiens
tgtggaaaaaccacaagtttgggggtgagagagacctttgtttgaaatctggtttttgccaca

SEQ ID NO: 6825754 - DNA, 130 bp, Homo sapiens
gcctaatacatggccagaatgtcataagcaacatccaggtgaatatcatgagaactcgcacccacagctgctgtgtgggagttcacgtgatattcacctggatgttgctcatgacatggcatgttgtggc

SEQ ID NO: 6825755 - DNA, 65 bp, Homo sapiens
gagagccaggggcagaagggcatgctcaggggctcgctctgcccagtgtggctctgtccgctctc

SEQ ID NO: 6825756 - DNA, 55 bp, Homo sapiens
gtgtgtagatgtgagaggactgtatgtgtgctattgtcaacttacacttatatgc

SEQ ID NO: 6825757 - DNA, 60 bp, Homo sapiens
acatcagtccttagtctggatggcttcttggagccacagcaacctcaaaggagctaatgt

SEQ ID NO: 6825758 - DNA, 61 bp, Homo sapiens
ctcggggcgtggcagtagcatgctgggagctgcagctgatggctgtgccatgaccctcgag

SEQ ID NO: 6825759 - DNA, 72 bp, Homo sapiens
tgctctcttaaagaatgttccagctgctttacttaattgtagtcagcttgaaattacatttgtttaactgca

SEQ ID NO: 6825760 - DNA, 71 bp, Homo sapiens
tcagaatttagaaatgattttgatgcttcataggccatatggtctctgttgcatctagtcaattcttatga

SEQ ID NO: 6825761 - DNA, 62 bp, Homo sapiens
aagagggtggttcactttttgatggtcaaccatttagaagtcttagaactatatttcctctt

SEQ ID NO: 6825762 - DNA, 63 bp, Homo sapiens
gaccctggggttccaatgatgagcaagagatgcatggtctctgccatcttggagctcaaggtc

SEQ ID NO: 6825763 - DNA, 95 bp, Homo sapiens
ctattctaagtgaggaagaacaaggctgtttccaatgccacatcaattaggtggtgagggagctttctttgttgagtgtttccgcttcagactag

SEQ ID NO: 6825764 - DNA, 76 bp, Homo sapiens
cagctggcagcaaggcctcgggtgagctggccttgtacctccagggtttgctgctatctggccttgctctcagctg

SEQ ID NO: 6825765 - DNA, 64 bp, Homo sapiens
tgccaggattgttgagatgattaatgcaataatttacatgaagcattttgcacagtggctggca

SEQ ID NO: 6825766 - DNA, 66 bp, Homo sapiens
tcatttacatgtagtgtctcattgctcatcaaaataacttgattgtgcaaatattatctgtagtga

SEQ ID NO: 6825767 - DNA, 60 bp, Homo sapiens
ggagggttgactctacctggcagatatcaaatctaacttgaggttttgactcagctttct

SEQ ID NO: 6825768 - DNA, 70 bp, Homo sapiens
gctttactgagatgacacagggcacaaagtaagtgcaaacacagacctgttcattttccattcaggaagc

SEQ ID NO: 6825769 - DNA, 76 bp, Homo sapiens
cactgaagatacggtgacaaaatggagacgtgcaaaattatattcttctattgacattcactgtaactcttcagtg

SEQ ID NO: 6825770 - DNA, 82 bp, Homo sapiens
ctacagtaagatatacttcaatattaccagtggctatctctgttggcactgggatttggggtgtcttaaaaaaattctgtag

SEQ ID NO: 6825771 - DNA, 55 bp, Homo sapiens
tgcatcttgagacagggactgtatcttttctttgtagtctctgcaacatagtgca

SEQ ID NO: 6825772 - DNA, 79 bp, Homo sapiens
gactcttgccctctgatgtctgggggctggataacaacagaatttattatccaaacctggacatgagtgggaaagggtc

SEQ ID NO: 6825773 - DNA, 80 bp, Homo sapiens
ttacagtggaaagagctcagattctggtgtcagacccagcttgggttgaaccatggctctgcagtttcttaatactgtga

SEQ ID NO: 6825774 - DNA, 64 bp, Homo sapiens
tcaggagttggcaggtatataattctggatgatagcatgtgctgtgtgtactctccagtcctga

SEQ ID NO: 6825775 - DNA, 67 bp, Homo sapiens
gcgaaggtacatattctacccctttttctctgagaaagagaatgtgggcacgtatgttcttatttgt

SEQ ID NO: 6825776 - DNA, 59 bp, Homo sapiens
agaaagtttgactctctagatagcaaccgtccaggtttctgtcttgctgtcagctttct

SEQ ID NO: 6825777 - DNA, 56 bp, Homo sapiens
aattgatcactgtttttccagtctacactgaggcaggcatcatcagttgatcagtt

SEQ ID NO: 6825778 - DNA, 76 bp, Homo sapiens
gctcaggatcactatgggctgggatctgagtgtcatgcttaggaaatggcattttgttcagtatatggtggagagc

SEQ ID NO: 6825779 - DNA, 76 bp, Homo sapiens
tatagggatagatcatggagtaaaatggaagtcactggaatgctttcagtagaggagctacatgatctgacttatg

SEQ ID NO: 6825780 - DNA, 60 bp, Homo sapiens
tttggtcttccaggggaagaatttttgtaataagcttggttctttccccagaggactaaa

SEQ ID NO: 6825781 - DNA, 77 bp, Homo sapiens
caggcctagtagtttctaaagcttcctaggtgatcatggtgtatacagaaataactctagggagtttagaaggcctg

SEQ ID NO: 6825782 - DNA, 116 bp, Homo sapiens
gattttactcagatggaaaggacaatagaaggaaactgacataaataggattgaatcccacatttctaaatatggaacaatttccattttgttttgtttttctataacagatgatc

SEQ ID NO: 6825783 - DNA, 75 bp, Homo sapiens
cctctgcaaagtgatcaaggttgacatcaacagtggtgtcacagtgatgatgtgaactcttgatatgatgtgagg

SEQ ID NO: 6825784 - DNA, 59 bp, Homo sapiens
ctccctgttttgagggttagaaatgtcaaaccatagactgacaaaggcaaggcaggggg

SEQ ID NO: 6825785 - DNA, 129 bp, Homo sapiens
gctaacccttggaattacctgggaagatttttaaaattcagatgctccagtctcatcatgcagtgattctagcatcaggctcaagcactgatatttttgaaagctccccaggtgactctaacgttcagc

SEQ ID NO: 6825786 - DNA, 65 bp, Homo sapiens
tcctatttcagtaaaacactgcaatgtctggtgtttctagtaatgcatttattttatgaaaagga

SEQ ID NO: 6825787 - DNA, 89 bp, Homo sapiens
gttaggatacatagatctttgcagggtgctgactaggtggaagagccgttcctttggccaaatacacaccttttgagaatgtatcagac

SEQ ID NO: 6825788 - DNA, 56 bp, Homo sapiens
agttattcagggacatttactctaagaagcaagagatttggtggcctgcagtggct

SEQ ID NO: 6825789 - DNA, 56 bp, Homo sapiens
gttgagggggagaagattctgctgcttggaaacatcagagtttcttattccctgac

SEQ ID NO: 6825790 - DNA, 80 bp, Homo sapiens
ggcaggtgggcatgatgtctggctaccactcgcactggacgccacacacacagccagggtggcagaaggccccacctgcc

SEQ ID NO: 6825791 - DNA, 63 bp, Homo sapiens
tttgaggaggacagaaacatttaattgttgagtaatacttcttaaatgatgttttacctcaag

SEQ ID NO: 6825792 - DNA, 123 bp, Homo sapiens
gactcgggtaagttccaaaagagctatgtatttgctaaaaggccattgatttatattgaaactcaatgaaaataatgttatttttagacaagggagtaatattgcccttaacttacctgtttc

SEQ ID NO: 6825793 - DNA, 76 bp, Homo sapiens
cagacagaggtttgacactgatcaaatacatatcgaatgaatgaataaatgaatgagtgagttcagacctcgcctg

SEQ ID NO: 6825794 - DNA, 82 bp, Homo sapiens
gggagagaagccagctccctttctggcaataattgtatttctctaccaaaggcctcagttcttgccaggtggcccctctcct

SEQ ID NO: 6825795 - DNA, 101 bp, Homo sapiens
tgtttgaattagattgtgttcatttaactgttctttatgagctggacgccaggtactgtgctagcatgggggaacacaaatgaataaaaaataagcagata

SEQ ID NO: 6825796 - DNA, 90 bp, Homo sapiens
gcacacgtgtgtgtgcacagcatgttccatgtgtggtcagcttgccctcaggcgtgttacttacctgggacagcaaatgcatgtgtgtgt

SEQ ID NO: 6825797 - DNA, 74 bp, Homo sapiens
gacagtaagagaagagtcttgtcaaattagccttgacaattaagcaagccttaatttgacaaggctttcctgtc

SEQ ID NO: 6825798 - DNA, 58 bp, Homo sapiens
ggaaactgagattcaaagaggttcagtgtcatatctggccaagataatctcagttttc

SEQ ID NO: 6825799 - DNA, 70 bp, Homo sapiens
tatgagaatttgctaattggctgttgttaaaattatgacacttatcacctaatcagtaaatgttcttatg

SEQ ID NO: 6825800 - DNA, 82 bp, Homo sapiens
tacgagtgtggtaggtagtatcatctccatttcactgatgatgaaacttatcagtgattggtggactgcctagcccaaagta

SEQ ID NO: 6825801 - DNA, 90 bp, Homo sapiens
agataggatgggtgcaccaaccagacctgggagggggtaaaaggggagcctttgagccaggtgtggtggcatacacctgtagttccatct

SEQ ID NO: 6825802 - DNA, 110 bp, Homo sapiens
tggcctgaattaagcaatatgccattattgacatgggaataggttgttcttggcaacagagtgtcagtgaggactttttttccaggatggcttagatgactgcagggcca

SEQ ID NO: 6825803 - DNA, 58 bp, Homo sapiens
ccttagcatggctgtgctgtgtggatatatgctctcatgcccacagcaaatgcagagg

SEQ ID NO: 6825804 - DNA, 85 bp, Homo sapiens
ctcagccctgggagctggatgtctgtgccaggcacacccgtggcaacgggaggtgaccagacagagtctagccctaaggaagggg

SEQ ID NO: 6825805 - DNA, 73 bp, Homo sapiens
ctgtgtgtcaaatagagttattaacacccgcacagttggacatatgcgagttaactatggctttgtcacacag

SEQ ID NO: 6825806 - DNA, 100 bp, Homo sapiens
ggtgaaattcatcaagttgtgctctgtgtactggccaagagaatgcagtaggttattattcaagcattttccacagtaggaacacaatttgaccactacc

SEQ ID NO: 6825807 - DNA, 63 bp, Homo sapiens
gctagaatttccagtggtgattcaaagcaagtaattcaggtaatcattctggaaaattcaagc

SEQ ID NO: 6825808 - DNA, 78 bp, Homo sapiens
cagggtggttccacctggcgaggggtatgcctcctgactgtccaggacaatgcccctggcctggggaacatagccctg

SEQ ID NO: 6825809 - DNA, 88 bp, Homo sapiens
tgtgtgttagagttgtttttagatcctttcatttggttataataaagcagatggagaccttggatgaactggacacaacttgcacata

SEQ ID NO: 6825810 - DNA, 95 bp, Homo sapiens
gccttttgtttgcctggctgctttatcggctgctgaaacctgtctgctcagtgttctcaaagcctttgaagtttggactgcagctaacaaggggc

SEQ ID NO: 6825811 - DNA, 73 bp, Homo sapiens
aaaccaaatattcttttctgtatttacctttaaaagctcaacagcctaagtacagaatgaggagatgtggttt

SEQ ID NO: 6825812 - DNA, 105 bp, Homo sapiens
tgccagtatgactgcattatctagacaattccatcctacgtgggcactcgatacaaagatacgtccacagtggtggaattgttcaggcagagcagcagcacggta

SEQ ID NO: 6825813 - DNA, 77 bp, Homo sapiens
acctgtgactctccactagtatgaaatgggctgcctcgaatgagcctgacatattctacagtgttagtgttagaggt

SEQ ID NO: 6825814 - DNA, 84 bp, Homo sapiens
tcctgggcatccggtgcccttcagcggcctcatctgggttgtgctgatcctagatggccgggatgggcatgaggtggccaagga

SEQ ID NO: 6825815 - DNA, 70 bp, Homo sapiens
tgtacatgaataaaagatcttgtaagtcagaagtcacaaaatgatagcaatgggctgtgttcagtgtgca

SEQ ID NO: 6825816 - DNA, 64 bp, Homo sapiens
tggggacacagaggttcgttgggagatagatggaggtttctccttactacctatgtgtctccca

SEQ ID NO: 6825817 - DNA, 126 bp, Homo sapiens
agtaaattattctgcaaatattctgcttatatttcattggcccaaacttagtcgcatcatgccaccttgaggtcatctgaagtactaggctgagaagaaaataatttgcatgacttaatatttgct

SEQ ID NO: 6825818 - DNA, 60 bp, Homo sapiens
tttgcaatatggggatggaggggagcagtgtttaaaagatgctgaagattcccatgcaag

SEQ ID NO: 6825819 - DNA, 70 bp, Homo sapiens
ggtgtaacgcagagcctctcagaggtcagacaattttgttgtgacctcagcaggctactatgattagact

SEQ ID NO: 6825820 - DNA, 75 bp, Homo sapiens
aggatgcatcctgagagcagctgctttggaggaaggttctccctgacctgctcgttcttccatgggattcatctt

SEQ ID NO: 6825821 - DNA, 85 bp, Homo sapiens
tcctgaagcccaaataagatttgtgctctgacagggtgagcatttactttatcagaaaacacattagggtgggcatgtctcagga

SEQ ID NO: 6825822 - DNA, 62 bp, Homo sapiens
tttggcaggtggatggcatggggagagccctttcagacagtgggtccatccatcatgttaaa

SEQ ID NO: 6825823 - DNA, 68 bp, Homo sapiens
gcaggaggcttgtgtgcaagttatctgagctctgactgagcagatgaagatgccactaagaccagagc

SEQ ID NO: 6825824 - DNA, 65 bp, Homo sapiens
aaggaagccccagacccagagtctaggtagaaacaagggcacaggcggggtcctggggctttctt

SEQ ID NO: 6825825 - DNA, 67 bp, Homo sapiens
ttgaggctcagggacagtgagtgactgatttgaccaaacggatttaaactcaaatcacctgcctcaa

SEQ ID NO: 6825826 - DNA, 129 bp, Homo sapiens
agcacccgcagggcctcgtcttcctcctggtcggcacccttctccagcagcaaagctgccggcttcagcagcttctcctggtacagaactgggccgctcatgaactggaagggaggacattgggcagtt

SEQ ID NO: 6825827 - DNA, 76 bp, Homo sapiens
ccttgcctaaggagagagctttgctggaacaattggaggacaactgccagccccttagggctctcccgggcaaagg

SEQ ID NO: 6825828 - DNA, 57 bp, Homo sapiens
ttttcagcaattagcacagagcctggtacaagacaagaactcagtgtttgctgaaaa

SEQ ID NO: 6825829 - DNA, 83 bp, Homo sapiens
ctttagaacagtccattgaagcatacacaatgaggaagctattctttccttattgatttcatctttcattttgacttctggag

SEQ ID NO: 6825830 - DNA, 93 bp, Homo sapiens
tgtatttcatcttttttattcatccctagatacaggttatgaaggcatgtgcttggacattctaggaagtgactaagtagaagataaaagaca

SEQ ID NO: 6825831 - DNA, 77 bp, Homo sapiens
gccagatgaaaaagaaattgcctagagtgatttattaggcaataagttattagatcatcagtgggctcttatgtggc

SEQ ID NO: 6825832 - DNA, 91 bp, Homo sapiens
atgatcaatttcaagctatcttcatgaagtcactgaacacagagtcaggaagaaatgtgtccagtgattctcatgagccggtgaaagtcat

SEQ ID NO: 6825833 - DNA, 76 bp, Homo sapiens
ttgctctattgcccaggctggagtgcagtagcacaatcttggctgactacaacctccacctcccgggttcaagcaa

SEQ ID NO: 6825834 - DNA, 93 bp, Homo sapiens
ctctggaggcagccatcataagagcaagtgggtagtgaagctctcacaccgggctggttctctgatcactgcctccctggctgtctccaagag

SEQ ID NO: 6825835 - DNA, 129 bp, Homo sapiens
ctcaaggaaaaacaagttgagtaggtgagattttgatctcttattcttcttctcttgccaggtgccattctaagccccttcagtgatgagaagaataattctcgaagcctcactagagagatgtgtgag

SEQ ID NO: 6825836 - DNA, 78 bp, Homo sapiens
gactgggaccacagattcctaagtggcaggatgaaattccaaccgagttctgcttgactccaaagtctgtgttctttc

SEQ ID NO: 6825837 - DNA, 83 bp, Homo sapiens
gcaccccactcctcaggtgccatcgggctcctcctgctgtcactgtgcagcaggggacatgaggccccagagcagacaggtgc

SEQ ID NO: 6825838 - DNA, 80 bp, Homo sapiens
ccactcagctgtcacatgtgttgtagcctcattcagcagtgggggtgcagggtggggaaatagcgccctctgctgagtgg

SEQ ID NO: 6825839 - DNA, 75 bp, Homo sapiens
ggaagtccagagtattcaagtaacttgactgagatcacacagctaagtttgtggttatacttgattgagattttc

SEQ ID NO: 6825840 - DNA, 92 bp, Homo sapiens
ggagggtgaagaaaaggccgtctggcggtgactgagctgtgtttgtgcccccacacgccagccacgttagactggcccataccttaacctcc

SEQ ID NO: 6825841 - DNA, 76 bp, Homo sapiens
gcacaggacctagaagaacatgtcaaactataaactgcttgtgattgtgaatgactttgttctttgcttcttgtgt

SEQ ID NO: 6825842 - DNA, 95 bp, Homo sapiens
accagtggaatgagcagcctggtcagagcagtcaggatcagggtcctgggttcctgattatcacctggactcctgctgactctcttttctctggt

SEQ ID NO: 6825843 - DNA, 62 bp, Homo sapiens
gaagctggaggatggactggaagaacacgacttgtgtttcgggccccaccccaccacgtttc

SEQ ID NO: 6825844 - DNA, 104 bp, Homo sapiens
ggggtttcttttgcactcaatttctcaagtaaatgagtcatgctgttctccaggacatcttttactagtgagctttttatttgggctgaagtaacagtgacccc

SEQ ID NO: 6825845 - DNA, 69 bp, Homo sapiens
gcccagagccctaggggagatgcatgtccaggcagttgggcccaggacagccttctggggcttctgggc

SEQ ID NO: 6825846 - DNA, 81 bp, Homo sapiens
ttggtccatgagtccaggaagaaacagtctttatataatcctttccatgtctcctgctgtctcctcctgtctcttgatcag

SEQ ID NO: 6825847 - DNA, 79 bp, Homo sapiens
tgggaattgaggtagagacttaaaactgttttcactaatggctctttagtgcatcatagtgagttttttattcttccca

SEQ ID NO: 6825848 - DNA, 65 bp, Homo sapiens
atgtttgggtctacttggctctgagaaaacacattctctttcaagaatctggtagaaccaaggat

SEQ ID NO: 6825849 - DNA, 68 bp, Homo sapiens
gagacaaagttctgtagtgcactgacttctatcatactcagagtcggagtgtctcagaactttgcctc

SEQ ID NO: 6825850 - DNA, 58 bp, Homo sapiens
gcgccatgcagcgcggtgggcgggcaggtttccagcagctcctggtgctgcgtggcgc

SEQ ID NO: 6825851 - DNA, 95 bp, Homo sapiens
ttcctaaggacccagcatttgaggccttgtgcctcaacccttttcgtcaaagagggaaaggtagtgaggtcacaatcgcttttgcctttagagaa

SEQ ID NO: 6825852 - DNA, 56 bp, Homo sapiens
agtggagaggaacccagctctgttcccctccaacagcccagctctttctctgcact

SEQ ID NO: 6825853 - DNA, 70 bp, Homo sapiens
ctttgagtgttgtgtctgtactgtcataggtcctctgccttcccaggctagaccaacataaaattcaagg

SEQ ID NO: 6825854 - DNA, 74 bp, Homo sapiens
gaaaagaaaccatgtgtaaattagataactcccagagttcataatttttatgcgtcttcgtaggtttgcttttc

SEQ ID NO: 6825855 - DNA, 56 bp, Homo sapiens
gcaagcatgtgcctgggctcaggtctctctgagcctgagcccttgcttatgcttcc

SEQ ID NO: 6825856 - DNA, 96 bp, Homo sapiens
tattttcatccatcatcagaacttagacttgtttcttggtaccttctaccatgtcttcaataagtctaggattagcatttgggttgggtgaaagtg

SEQ ID NO: 6825857 - DNA, 75 bp, Homo sapiens
gggtattttctagttcatattctcaaagaagatcacttcttctttgattttgagggaggtgggcagagtatgccc

SEQ ID NO: 6825858 - DNA, 55 bp, Homo sapiens
ctagaaggtaggcagggatcagtgacaacgctgctgctgtatcatgccttcatgg

SEQ ID NO: 6825859 - DNA, 63 bp, Homo sapiens
gctagtccacagccatccaggccgtttcctctttgtcttggcttggagttgaatggacgtagc

SEQ ID NO: 6825860 - DNA, 57 bp, Homo sapiens
cagattggattaaatagctgccagggacctagcctgcagttctttcatgccaatttg

SEQ ID NO: 6825861 - DNA, 93 bp, Homo sapiens
caaatctatttacatagcaaagcctctatgctcctcccagagtttaggaggcctggccaagcactggggtcaaaatgtgtaaaatgggcattg

SEQ ID NO: 6825862 - DNA, 63 bp, Homo sapiens
gctccaggccacggcttcttggacttggagaccccacctgggagcctagagggcctatggagt

SEQ ID NO: 6825863 - DNA, 90 bp, Homo sapiens
actattttcaaagtctctgagagcattttatttacctataagccagaacactaaaacttaaggagcagaatgcttggaccatgagatggt

SEQ ID NO: 6825864 - DNA, 65 bp, Homo sapiens
ggcagaaaggacacacaggaggtgtctggggaaccccctccaacatagccagaatgtctcctgcc

SEQ ID NO: 6825865 - DNA, 63 bp, Homo sapiens
ttaaaagagacttcctttgtttcctagccaagggcacataagacaaaagaagctgccttttaa

SEQ ID NO: 6825866 - DNA, 129 bp, Homo sapiens
ggtgatgtgcttatgaaataccctcactaaatgactgaggaagaggtaccatttgtagcactaggctacaaatggactctcatcttttgcatttacatgttcctatccgtacttctaagtactagcacc

SEQ ID NO: 6825867 - DNA, 107 bp, Homo sapiens
cacaaatgaattccgagatcctggttatatctattcacaaagctgtgacttcctgaagttttcttggcagagtgaaagaatatattaaaatctggacttcttgtgtg

SEQ ID NO: 6825868 - DNA, 64 bp, Homo sapiens
tcaggatttcaactttatgcatatgtatttttaattaaagtataattgcatggaattggattga

SEQ ID NO: 6825869 - DNA, 91 bp, Homo sapiens
gatcttccagaaaagaacccagcatgactgataccttgacttcagccttatgagattcacagaacttagtcaagcgttcctggattccatc

SEQ ID NO: 6825870 - DNA, 90 bp, Homo sapiens
acctgagagtttgttggaaatgagaaccaacacctggctccacctcagagtcactggatcagaatctgatttttaacaagaactccaggt

SEQ ID NO: 6825871 - DNA, 66 bp, Homo sapiens
gggagctgctgggaatgaacagtgttgtctggtcagcaggaagcctaactggtgctcacagctcct

SEQ ID NO: 6825872 - DNA, 66 bp, Homo sapiens
catgatgtagctggtattcacgtggaggttcacttgtgatagtcactggctataagctatattttg

SEQ ID NO: 6825873 - DNA, 77 bp, Homo sapiens
ggagcccagccgcatgtttcagagggttcagagggttcgggaaactccccaaggccacgttctgcatgcggagctcc

SEQ ID NO: 6825874 - DNA, 83 bp, Homo sapiens
gagcagggcacagctcttcctaccctagttggggccagctgccaagatgcctcttggggttgggaaaaggagctgagctgctt

SEQ ID NO: 6825875 - DNA, 129 bp, Homo sapiens
tatgcctggctaatttttgtatttttagtagagatggggtttcaccacgttggccaggctaatcttgaactcctgaccacaggcgatccacccgcctcagcctcccaaagtgcggggattacaggcatg

SEQ ID NO: 6825876 - DNA, 62 bp, Homo sapiens
aagtgacagtgaactgggactctaacatcatacctagggtcccagtcctctccctgctactt

SEQ ID NO: 6825877 - DNA, 55 bp, Homo sapiens
agagggtgaatgagatagaaaaacaagacatgatttttctgggtactctccctct

SEQ ID NO: 6825878 - DNA, 57 bp, Homo sapiens
cctgctgctatgaaggtgacagtcctccccactgctcacatattgcatagctgcagg

SEQ ID NO: 6825879 - DNA, 122 bp, Homo sapiens
cagatgaagtacccagcctaaggtgaccacaatagcagagggtagtgccggggcagatcatgggtcctctgactgccactcctctctagcaaaggtctctttgcaatgttttcttttacctg

SEQ ID NO: 6825880 - DNA, 67 bp, Homo sapiens
tagatgcttcatgagaaatataatgagactgtttatctttagtttccatgttcagggaagttgtctg

SEQ ID NO: 6825881 - DNA, 75 bp, Homo sapiens
gtcctctcttcacttggatggcagttgagtctctgaaagagattcatcccgaaggtcttttaagtgaagagaggc

SEQ ID NO: 6825882 - DNA, 84 bp, Homo sapiens
gagaggcaaagattgtgtcttgtttgtgtctgtcagaggcctagcaaagtgcctagcacagagaagatttcaattaacactttc

SEQ ID NO: 6825883 - DNA, 126 bp, Homo sapiens
gggcaacagcagggagtgaagcagtaatcaggggagagggcaactgggagacagtttgagtttcctcaccttcttggcctccttactcctgattagtccattgtctgtccacctctggtaatgtcc

SEQ ID NO: 6825884 - DNA, 80 bp, Homo sapiens
gagaatttaaatcatgctgtggcttgcagctggggctgtgtatagctgaagaaaagcctcacagcacaagattgtttctt

SEQ ID NO: 6825885 - DNA, 67 bp, Homo sapiens
tgatgtgactcaggaattccacagctgttggtcagcctggcagttctgggcatatctagtcacatcg

SEQ ID NO: 6825886 - DNA, 99 bp, Homo sapiens
gaggcaggagaatgacttgaacctggaagttggaggttgcagtgagtcgagctctcaccactgcactcccgcccgggtgacagtgcaagactccgtctc

SEQ ID NO: 6825887 - DNA, 68 bp, Homo sapiens
tcacttactaggtgttgaccttgggcgctttcactgggtaagcctcagtgtcaccatctaccaagtgg

SEQ ID NO: 6825888 - DNA, 92 bp, Homo sapiens
cccgggatactcatttcagtgctttacatgcctggggtgtttagcagctttatttcatggaaagagtgaggacactgaatgcagctcctggg

SEQ ID NO: 6825889 - DNA, 68 bp, Homo sapiens
gtgagaggaatggcaaaaggataacaaggatggatactatttttatgtcctattttggcatgctccat

SEQ ID NO: 6825890 - DNA, 61 bp, Homo sapiens
gtgctctgtgaggcccttgagatctgggctcattactccaagacctcttcccttcatgcac

SEQ ID NO: 6825891 - DNA, 55 bp, Homo sapiens
agactccatggggaaatgaaggtggctgaaaaactctgtcatctccatggagttt

SEQ ID NO: 6825892 - DNA, 97 bp, Homo sapiens
tttattctagttcccaagccaaattaatctagaggttgtattaacatagtatcatgtttatggcttttaattagttgcttccattagactagataaa

SEQ ID NO: 6825893 - DNA, 89 bp, Homo sapiens
gagagctgcaccagaccacctctcagggtttcctaatgcaaatccttgaaccctgcagaagtgagcatccagagaggtgggagctactc

SEQ ID NO: 6825894 - DNA, 55 bp, Homo sapiens
tccagtcttgtctcctaaccacccagtgggtttctgctaggaaatagggctgtga

SEQ ID NO: 6825895 - DNA, 63 bp, Homo sapiens
gagaggtgtggcccaaagcactgcagccattttgaatgccagagctttctgtcacattagttc

SEQ ID NO: 6825896 - DNA, 73 bp, Homo sapiens
caggtgttttttattctgaaaggttattttcctcttcttttcaaaatggtgctcagaatgaaaaggcaatctg

SEQ ID NO: 6825897 - DNA, 70 bp, Homo sapiens
ctgagcttctgtgcccactgtgggatcttaacaatgtctgctggctggtcctgggcagcgggacgctcag

SEQ ID NO: 6825898 - DNA, 64 bp, Homo sapiens
gaagttctggtgtatgtgataaattaaaaacagcttgtcactttatagctacaccttggatttc

SEQ ID NO: 6825899 - DNA, 76 bp, Homo sapiens
tgctttcaagtgatggggcatataaaaactgtgattccacggagatcagtgtattgccttatttcactaaaaggta

SEQ ID NO: 6825900 - DNA, 71 bp, Homo sapiens
ctcctctgtgtcttccttccctgaggcaatgtactgtcgtaagcagactcaatgagggaaggacagaggag

SEQ ID NO: 6825901 - DNA, 61 bp, Homo sapiens
gattgctgggtcccactcccagggtctctgattcagtatatgtggggtggggcccaagaac

SEQ ID NO: 6825902 - DNA, 70 bp, Homo sapiens
aatgtattttccattgggactgtgtgctttagattctctttattatttgagtgttaatggaaattatatt

SEQ ID NO: 6825903 - DNA, 100 bp, Homo sapiens
tcacggggtaggctcgggatgggcttagcaaaagcaggctgtctctgtttggtgctgcctgctgcctgtggagggttcccccatctcgggccctgtgtga

SEQ ID NO: 6825904 - DNA, 59 bp, Homo sapiens
gcttcccatcaaccttcctgcagctcacccgagtgtctgaggtggagagtgaggtaagt

SEQ ID NO: 6825905 - DNA, 82 bp, Homo sapiens
ttgaatctgccactttggagtgctcagagaacaaagtttttaaaataagtagtgtagcattcttagagtttggttctttcaa

SEQ ID NO: 6825906 - DNA, 68 bp, Homo sapiens
aggaacaactgattcagtcaacccatatcatcttgggtcaggattggtgctgattcattttgattcct

SEQ ID NO: 6825907 - DNA, 99 bp, Homo sapiens
gaggcaggaaaatcgcttgaacccgggaggcagacgttgcagtgagcagagatcaagccactgcactccagcccgggtgacagagcgagactccgtctc

SEQ ID NO: 6825908 - DNA, 70 bp, Homo sapiens
tgtagtcctccaagtgaaagatatatgtcacatctccaggtgagagacaggatatctgctcatggttaca

SEQ ID NO: 6825909 - DNA, 55 bp, Homo sapiens
gggcctgcccacgtggggttaaggttaccagtggcctctgcctctggtcaggctc

SEQ ID NO: 6825910 - DNA, 116 bp, Homo sapiens
atgcgtgtgtgaagcagtctgttttatagagtgagcatatatgtaatcgttttcatataattgaaaatgtgctgtgtgttgcattttattctcatgtcgacttttctactatgtat

SEQ ID NO: 6825911 - DNA, 72 bp, Homo sapiens
tatagagaatttgctggcttcattgtgagttcataaacatgaccagctttgccccagtaggtttatcatgta

SEQ ID NO: 6825912 - DNA, 90 bp, Homo sapiens
gccctaggtggcagtcactgtcatcctccccattttacaaatgagtaagtcagggtacagagagatgaggtaacttgccaacagtcaagc

SEQ ID NO: 6825913 - DNA, 79 bp, Homo sapiens
cgtctttcattgttctattcataaacagttgggatgtttctacattttggctattgtaaatagtgctgctatgaagatg

SEQ ID NO: 6825914 - DNA, 57 bp, Homo sapiens
tgagtgtgctccctgttgctcaggtctgagctgagcacatgcacagtgctacactca

SEQ ID NO: 6825915 - DNA, 61 bp, Homo sapiens
tccaggatgagcatgattgaaatcactaatttatttctatagcttcagtctctgtcctgga

SEQ ID NO: 6825916 - DNA, 55 bp, Homo sapiens
gaggagagacagctgaacaaagaaactgcccactctccttctgctgtttcccctt

SEQ ID NO: 6825917 - DNA, 80 bp, Homo sapiens
aatatttccaagccagtaagtttttgtcattttttataatgtaatctaaatgatgaaatgtgttggctctgggctgtgtt

SEQ ID NO: 6825918 - DNA, 122 bp, Homo sapiens
gaagaacatagcatgtttgcttgtctgcatacagaatttcagtgatgttttctcaaatgaattgagaataatactgaaatgctgaaatcttgtgatatataagtggaatgtctatgggcttt

SEQ ID NO: 6825919 - DNA, 61 bp, Homo sapiens
agggaattgggcagtatggatgacctcgagttccgccttctctttcctgcccagttgccct

SEQ ID NO: 6825920 - DNA, 85 bp, Homo sapiens
gctgttactagttatatacttgtgtatatgtttgacaaactgactgtgagcttttaatatacaggtgttttatagtaatctaagc

SEQ ID NO: 6825921 - DNA, 56 bp, Homo sapiens
aaaggcagtctggtttcaaagcagatggtttttgctacttcactccagttgccttt

SEQ ID NO: 6825922 - DNA, 65 bp, Homo sapiens
gtgggcttcctggatgcctgggccaatcctaagagaggactgcacacacagaatttagggtccac

SEQ ID NO: 6825923 - DNA, 64 bp, Homo sapiens
gcggagattgttggtttcccactgcacctccatgaagtcagagtcgccgacagtcaacatctgc

SEQ ID NO: 6825924 - DNA, 59 bp, Homo sapiens
ggagcaaccctgcctgacaacagaggattgactgcaatcgtttgaaaggacagagctcc

SEQ ID NO: 6825925 - DNA, 72 bp, Homo sapiens
gtgcaggagttagaggtttaatctgaacacaagagatgactgagtgagaagattgttttgattttactgcgc

SEQ ID NO: 6825926 - DNA, 104 bp, Homo sapiens
ccctgtccagtcccctgtcccaggatcctgactccatgtgaccctgggaagcctgtgccggggctgggttgaggcatcttgggcagggctgactgggaacaagg

SEQ ID NO: 6825927 - DNA, 63 bp, Homo sapiens
gatgttcagactctaggtcagacttttatacttagtcttttctagcgtttatgagcttgagtc

SEQ ID NO: 6825928 - DNA, 70 bp, Homo sapiens
ctcttcttgccctttgtcctagattggcccttacagataagtggcccttagtggcaaagtctgagttgag

SEQ ID NO: 6825929 - DNA, 59 bp, Homo sapiens
ctgctacacagttctgcctaatggcatgaaaacatgcctgctaggctggtgtgtgccag

SEQ ID NO: 6825930 - DNA, 129 bp, Homo sapiens
taaataattgatacgagaagataatagtacttgacataaagcagaggagtcctgaccaccagagaattctgtgtctgccattttctgcctgcgtgtttaggaattaggtgttttgtggacataagttta

SEQ ID NO: 6825931 - DNA, 77 bp, Homo sapiens
gagatggattaaagattaaaatgacaaaactgctagtaaaacaagatattgtcatcttggtctggaataagcctttc

SEQ ID NO: 6825932 - DNA, 73 bp, Homo sapiens
gttttcatcttttcatggtctgcgttgacacgacaaatagtggctctcaggcagaattatcaaaagatgtaac

SEQ ID NO: 6825933 - DNA, 129 bp, Homo sapiens
agcgttcacagtgctaggaatgatgcaagacaggggaggatggaagcggcattggaccagcagttccagcaggccaggctgccaaagcttctgtctcccctccctcgcttccctattactgggagtgct

SEQ ID NO: 6825934 - DNA, 61 bp, Homo sapiens
cccagtgctcattctcatgcctgttttaacagtggaggctggacatgagcttggcagtggg

SEQ ID NO: 6825935 - DNA, 83 bp, Homo sapiens
agtattgtgtatccttatgtaggtctatttgctatcaatttttttctgagcacaattacttacatcttagtggtgcaagtact

SEQ ID NO: 6825936 - DNA, 60 bp, Homo sapiens
agccaggttaaaccacagtcaagcctggcagtcaggaaaactgtgtgtaggcctaaggct

SEQ ID NO: 6825937 - DNA, 63 bp, Homo sapiens
tacatgcaattttttcttgtcagttactcctcaataaaactgggaaggaaaggaatgtaagta

SEQ ID NO: 6825938 - DNA, 55 bp, Homo sapiens
cctgtgtgtgattgtatgagtatgaataccttggtatataccatcccacaacagg

SEQ ID NO: 6825939 - DNA, 60 bp, Homo sapiens
tctagaagatacctgctgccaacacaaattagattagttggcataaaaatctgctctgga

SEQ ID NO: 6825940 - DNA, 113 bp, Homo sapiens
acagaaacatatttcttacagttctagaagctgggaagtccgagaccaaggtgccagcaaatgtggtatctggtgagggttcccctgcttcatagatggtgccttgttactgt

SEQ ID NO: 6825941 - DNA, 84 bp, Homo sapiens
gaggagacagaccaggcaggcctgagaggcagggctggctcacggcgagcacctgtcaagtccaggctgtggatgcctctcctc

SEQ ID NO: 6825942 - DNA, 58 bp, Homo sapiens
actccggggtagatggctggggttcaattcttgactctgtcactttctgctgtggagt

SEQ ID NO: 6825943 - DNA, 91 bp, Homo sapiens
tctccaagaatgataggtgtgagcagaacttgtcaagagttttattgtttgaaagcacctacatttttctattttcaacttcttttggaga

SEQ ID NO: 6825944 - DNA, 67 bp, Homo sapiens
cactgcacagatgaagctgtaaatgaacagtacacacacaaatgttatttctagttgttttgcagtg

SEQ ID NO: 6825945 - DNA, 116 bp, Homo sapiens
aatcacgtgatctctgcttgtacacattgcaccgtatatgtttgctgtgccctgacgtccaagggacacgttgcatatgtggagagcagtggcaaggaatgattgattgcttgatt

SEQ ID NO: 6825946 - DNA, 71 bp, Homo sapiens
tgaatgggtatatagatacattaggtaacttgtggaagtccatattacatttgtttatctacatctattta

SEQ ID NO: 6825947 - DNA, 70 bp, Homo sapiens
gcgtcactcactgggatccacgggctcccaaggccacggccttgggggagagggacctgcagagtgacgc

SEQ ID NO: 6825948 - DNA, 62 bp, Homo sapiens
gtgactctatagtaggatcagtccatgtgttattattggaaatgatttctattattagttac

SEQ ID NO: 6825949 - DNA, 113 bp, Homo sapiens
gctgaaccaaagtgtgtgtaatgatatactggatgctggcatgaacttatgttgtctcaaatggtaacaaagttcactgaccagcactggtctgcaatcaccctttgagtagc

SEQ ID NO: 6825950 - DNA, 129 bp, Homo sapiens
cagattgctattgcagaacactagtctagatatatttttaatggaggggacagtgtttaacaaaataattgcttaataaatactttctgaccaattaattgatagtgtctatgttttctataatatttg

SEQ ID NO: 6825951 - DNA, 88 bp, Homo sapiens
tcccgtggttctttgtggcatttgtattcaagagttccatatatgtgaaagcttctgagaatagtaaatgcccataccaacgtaagga

SEQ ID NO: 6825952 - DNA, 61 bp, Homo sapiens
ctgcactcagtactttatgtatatgatcttattagatccttacaatagcactgagaagcag

SEQ ID NO: 6825953 - DNA, 72 bp, Homo sapiens
agttatattggattcgtgcaaaagtaatagcggtctttgccattattttacttttgcactaacctaatagct

SEQ ID NO: 6825954 - DNA, 97 bp, Homo sapiens
gccaaacaaactgtggaaattgctattaccgatgagaatctcctaagaaaattaattctcttggtgatttgggtagtttcacatatacaaaactggc

SEQ ID NO: 6825955 - DNA, 72 bp, Homo sapiens
ccccttgtttgtgggattgttctggatactgactgtgttcctcttgagaaagaacagccaataaaagagggg

SEQ ID NO: 6825956 - DNA, 79 bp, Homo sapiens
agaatgtgcatttgagttagggtatatatttgcaatcgattcccattcaaagtttgtcacttggctagaattacatttt

SEQ ID NO: 6825957 - DNA, 93 bp, Homo sapiens
ctgggtgctcccatatgccggccagccctgccagagagagctggcgcccactccctgcctggcgcggctgcgggcccctggctcagcacccag

SEQ ID NO: 6825958 - DNA, 67 bp, Homo sapiens
agtttacagttgaggttcattacttctggttctcttagtcctagagcaactgattcaactagaaact

SEQ ID NO: 6825959 - DNA, 57 bp, Homo sapiens
gcatacgggagaaacatctgctctcctcaactaggataggtgggagccccagtatgc

SEQ ID NO: 6825960 - DNA, 61 bp, Homo sapiens
gtttaagaataaatggttgttgctaatctaacatacttagcacaccaggcatgtcttgagc

SEQ ID NO: 6825961 - DNA, 111 bp, Homo sapiens
atcacctgaagagcttgttaagacacagatttattggccccttctcagagatgcctattgaagttagttggggcccaagaatttgcatttttaaccaagctcgcagatgat

SEQ ID NO: 6825962 - DNA, 78 bp, Homo sapiens
cccaataactagaaagattctctgaaccttaccagttgcctgatgggaagcaaggaatcttacctctctattgttggg

SEQ ID NO: 6825963 - DNA, 62 bp, Homo sapiens
cctcttcctcaccatctacaacagcaccactcatgagtgcctcagaagaggagagggagagg

SEQ ID NO: 6825964 - DNA, 70 bp, Homo sapiens
atagggtcactctgagaagtcctgtatttctatttaaataaaatttaatatgatatgtttcaggccctgt

SEQ ID NO: 6825965 - DNA, 70 bp, Homo sapiens
gtcagggacaataagggaattgaatctagctatgagacagcttcccaatcttttgccttttgtccctgac

SEQ ID NO: 6825966 - DNA, 93 bp, Homo sapiens
ggcttctcagactctcaggggttggcttgttgtgtttgcttttgcaaataactcaggcttaagtcctgctactttcagagcctaggggacgct

SEQ ID NO: 6825967 - DNA, 70 bp, Homo sapiens
gtctgaaaatggcctgaagaagcaatcctttgaaagcttctaatcattgattgctgggacctttttcaac

SEQ ID NO: 6825968 - DNA, 62 bp, Homo sapiens
agggttatgtagaaaagcagtttttcaatgctgattagactggcttgctttacaaggactct

SEQ ID NO: 6825969 - DNA, 83 bp, Homo sapiens
ttcctctacagcataatgtgtgtcatacagactttggctttaatccttagctttgtatttgagcatacgaggcctgttaggag

SEQ ID NO: 6825970 - DNA, 99 bp, Homo sapiens
aaggagtccatttgtgttgtattggcttctagtttgaggaaaaacccaaggtgcttctctggctggaaacttgaaacatcacaactagtggcattgctt

SEQ ID NO: 6825971 - DNA, 71 bp, Homo sapiens
agctaaggatgactagtacttctgagaaaacagcctagactcaatcagaagaaaatgggcattcattagtt

SEQ ID NO: 6825972 - DNA, 55 bp, Homo sapiens
ggtggctcacgcctgtaagcccaggactttgggaggcagaggcaggtgggtcacc

SEQ ID NO: 6825973 - DNA, 90 bp, Homo sapiens
gttgataggcagtatagtatagtgtagtgactgagaacatgaatgtcagtgtccacctgaattccagtctctgctctatttcttattagc

SEQ ID NO: 6825974 - DNA, 86 bp, Homo sapiens
ggtctggtttaagagcaggtctgtctgggaccagattctgcgaatacaaatctgtttcttcctagccatgctctcacttcagaacc

SEQ ID NO: 6825975 - DNA, 81 bp, Homo sapiens
gggcaaatcatcggatctctcttagcctcagatgttcagatataatctgaatgtttggactggaaggtccctcaaattccc

SEQ ID NO: 6825976 - DNA, 71 bp, Homo sapiens
gacaaggccaatgggctgacaagacatgcatatttcactggcatatgccttgcacctttggctttcttgtc

SEQ ID NO: 6825977 - DNA, 81 bp, Homo sapiens
gccctcattcctgcccatggaagcttgcaggaatagctggaatccagcctcctgaacagctcctgagcatgggataattgc

SEQ ID NO: 6825978 - DNA, 62 bp, Homo sapiens
ctgggcctgggttcctcctgggcaggggctgcatcccaggcctctggagccccagtgctcag

SEQ ID NO: 6825979 - DNA, 58 bp, Homo sapiens
ttgtcaggggtactacatgcgatgaggagaagcctagcacgctgtgtgcacctgataa

SEQ ID NO: 6825980 - DNA, 73 bp, Homo sapiens
gtagcctagaggtcacgtcttcatgttccatattggatgccaaagagtttagtggaatttccttctgggttat

SEQ ID NO: 6825981 - DNA, 73 bp, Homo sapiens
cctgctagagattgcttctgaactcagcatgtggccaattatggccaatgagatggaagagtctggaagcagg

SEQ ID NO: 6825982 - DNA, 130 bp, Homo sapiens
cttgtaccttgggggcaatcaagaggcaaactggttagcatgacttagaatcaggaggctatgtgtattcttagctccatgtctgacagctgagtgtgtctcagtttcctcttcagtctcctcctcacag

SEQ ID NO: 6825983 - DNA, 71 bp, Homo sapiens
gccaagtgcctagcacagcacctgggtatggtgtgtgctccttccaggagtgtgtgctaatgggcgccagc

SEQ ID NO: 6825984 - DNA, 130 bp, Homo sapiens
attactcccaatatcaacagtgggtgtacactcctcctgtgatattgtttgttatatctaagaaagaagaggatgatattactgtcaatatcacagaaggtgtacagccccttgtgatgttgtttctaat

SEQ ID NO: 6825985 - DNA, 61 bp, Homo sapiens
ttctctctatttcctttaccttctgaaagataaaacttttagcgaggaaatcagtagagaa

SEQ ID NO: 6825986 - DNA, 72 bp, Homo sapiens
gactcaacgcagtgagtctgtaaaaggctctaacatgtaggagcctttgaccagtttcctgttttctgtgtc

SEQ ID NO: 6825987 - DNA, 74 bp, Homo sapiens
gaaactgaggcccagagaggcagagcagagacacaggtccctgacttttaggcctgccctctctcctcagtttc

SEQ ID NO: 6825988 - DNA, 104 bp, Homo sapiens
ggtataatctgtttttcttatacttctagcacaagatatgaaagtgtggaagacatcaaattatgtgctacaagaatgatgatgtaaagaaagcagacaaagcc

SEQ ID NO: 6825989 - DNA, 68 bp, Homo sapiens
ctcatctttgaaaagttggctactttttctgacacaagccaagaaaaggtatttattttaaaggtaag

SEQ ID NO: 6825990 - DNA, 55 bp, Homo sapiens
aaaggttttctgacccttagtacttcagcagaaggatctagggtggagtaccttt

SEQ ID NO: 6825991 - DNA, 95 bp, Homo sapiens
tggccaggccagtctcgaactcctgacctcgtgatccgcccacctcagcctcctaaagtgctgggattacaggcatgagccactgtgcctggcca

SEQ ID NO: 6825992 - DNA, 62 bp, Homo sapiens
ttctgattcttttggcagtcaaaggcagctctgtgctgctgagggctgttaaggaagcagaa

SEQ ID NO: 6825993 - DNA, 60 bp, Homo sapiens
agcacagatgcatgatcaccagacacttgttcatcggctggtgaaagcagcttcctggct

SEQ ID NO: 6825994 - DNA, 58 bp, Homo sapiens
acccaggctggaatgcagtggtgctatcttggctcactgcaacctccacctcccgggt

SEQ ID NO: 6825995 - DNA, 91 bp, Homo sapiens
agaaccatcactgagtgacagcagtacttctcagaggtatttgcagcttgatgcaaagtagtctctaatgagtaggcattcaggtggttct

SEQ ID NO: 6825996 - DNA, 101 bp, Homo sapiens
cattccttcaagcgtcccagagctctaaggcgaagctgctatagaatgatttgcctagaactttgccttagggcaaacctcaagtactgcttttaggaatg

SEQ ID NO: 6825997 - DNA, 60 bp, Homo sapiens
gagcatcaaagtgatcccagtgatgtcatgtagataggcacagagaaaatgttggtgctt

SEQ ID NO: 6825998 - DNA, 61 bp, Homo sapiens
agttctttggcagctgggctggtaaacacagaagttttctagcaaggacgtccaaagaact

SEQ ID NO: 6825999 - DNA, 62 bp, Homo sapiens
atcagttccattttacttgtgagggaactgaggttcagcacagttcaagatggtactctggt

SEQ ID NO: 6826000 - DNA, 85 bp, Homo sapiens
gggcactcagtcaattttcctgcctttgctcagggaaataccaggtttttgtgcaggtataggcggagagaggaccaatatgccc

SEQ ID NO: 6826001 - DNA, 64 bp, Homo sapiens
acagaatgagtagcatcttcacctgtcaaataatagcagttgtgatgacaccctcatattctgt

SEQ ID NO: 6826002 - DNA, 81 bp, Homo sapiens
cttctccttattcagtgcgggaactcagccggttatatacagttaactggttccacaaatgcgcaacctgaagcagagagg

SEQ ID NO: 6826003 - DNA, 74 bp, Homo sapiens
ataaagtggaaggatccactaagttcttgttctcgggctagctatgggacttttggtggatcaagccattctgt

SEQ ID NO: 6826004 - DNA, 77 bp, Homo sapiens
actgtggtaggtcctggggatacagaagtgaatcagaaatggtccttcagttaaagatctcacagccttgctgcagt

SEQ ID NO: 6826005 - DNA, 61 bp, Homo sapiens
gcagctgcgctggtgtggggcatgagagcgaggtggctccaggtctccgcggagcagctgc

SEQ ID NO: 6826006 - DNA, 80 bp, Homo sapiens
agatagtttttacttagtgtggccccaagaggatctgggggacccttcaggaaccctgcgccatactttgaggcctatct

SEQ ID NO: 6826007 - DNA, 63 bp, Homo sapiens
atttattggatgcttacttgggccagtatatctcccattggcgcaggtaagcatctaataaat

SEQ ID NO: 6826008 - DNA, 78 bp, Homo sapiens
gcaaaatactacagcaggttttaactttgaagtgtttaaatgcatttcattgaactaaagaatctgctgtatttttgc

SEQ ID NO: 6826009 - DNA, 62 bp, Homo sapiens
atggtcagttgcagctaatgttgatgagagattaaggaagatggagttgtagcagtgactat

SEQ ID NO: 6826010 - DNA, 78 bp, Homo sapiens
gtccctagccctggcagagccaggtagtgcctgcgggctaaggaaattattaacctggctgtgcccagaggaagggat

SEQ ID NO: 6826011 - DNA, 62 bp, Homo sapiens
gtagttgttgcttagctgtaagctggaaatttcaaggcagaaacagcagataccacaactat

SEQ ID NO: 6826012 - DNA, 75 bp, Homo sapiens
tgctttgcactgtgctagaagccaggggcatagaaccctgtcctgtgagtttacattctggccagagacaaagca

SEQ ID NO: 6826013 - DNA, 62 bp, Homo sapiens
gcacaggttgcaaaagttcacattttagctaacatgttttgtgatgcttttcttaaccttgc

SEQ ID NO: 6826014 - DNA, 58 bp, Homo sapiens
ttgcatttactgcaccgtgagttactgaaatatttagacttattgctagtaaatgcaa

SEQ ID NO: 6826015 - DNA, 89 bp, Homo sapiens
ggagagtgggccagggcaccatgcctacagaactcaccttgctgttgcaatgtctagtctgagggcttggcaaccctgcctaattctct

SEQ ID NO: 6826016 - DNA, 71 bp, Homo sapiens
caatgacttaaattgggggtgacacatctgaacatcagcatgtgctctacatgctccatgtttgggtcttg

SEQ ID NO: 6826017 - DNA, 91 bp, Homo sapiens
ttaaaacgatgacttgtagaatcttctctgcattgaaacaggaacaccaactgagattctgttgctaagatattgctgggtcattttttaa

SEQ ID NO: 6826018 - DNA, 129 bp, Homo sapiens
tttggagctctgcctaattttttgcgtttttctttgactcctgccttctcctgttttgcagtgggtggaaacaacaggtgtagcaggagcatcaaatggagaatcaggagatcccaggtctggtagaaa

SEQ ID NO: 6826019 - DNA, 57 bp, Homo sapiens
agtcagatgaggtcatctacctgcagtatgtgaaggtgaatgtaaagtcatgtgact

SEQ ID NO: 6826020 - DNA, 80 bp, Homo sapiens
ggtgtggcttccagtcccccacaccacagcctgatgaataagctctcagtggtaccaagggggctggaatcctcttcacc

SEQ ID NO: 6826021 - DNA, 64 bp, Homo sapiens
aagcgccaagggaggtgctttgcacagattccatcttggagttagaagcacttgctcggtgctt

SEQ ID NO: 6826022 - DNA, 60 bp, Homo sapiens
tgcggaggggtgagcctcccatccagcaccaaagcgggctctgagggcttatccctccca

SEQ ID NO: 6826023 - DNA, 80 bp, Homo sapiens
ttttcactgactttggtggttgtgttttgacttgagctttccttaagcagtgataagagctaccattgaatcagtgaaag

SEQ ID NO: 6826024 - DNA, 125 bp, Homo sapiens
gtgaggttccaggctttcttcctagatgcagtccctgacacccgggtggaggcggggaggtaaagaatgcctgcctcaccctgtctggcagggcagatctagaattaaaggtcttcaagattcac

SEQ ID NO: 6826025 - DNA, 63 bp, Homo sapiens
tttagtgtgacagtccccagtagctgcccaccttacactggggactccccaatatacactaga

SEQ ID NO: 6826026 - DNA, 127 bp, Homo sapiens
ggccaacagtctctgcttcttcccttgctttgtctctggattgcacttgtgggccagcttaagcagttgagtaactggcagtccaaggcctgagtgagctggttaatggcaggaggaactttcggcc

SEQ ID NO: 6826027 - DNA, 63 bp, Homo sapiens
gttgccagactttcttaccagtgtcatttaagtcaacgaatacatggtaaaagttttggcaat

SEQ ID NO: 6826028 - DNA, 81 bp, Homo sapiens
tgctataatttggctttcataatgttatcttccacaagtggggctcttgtgaaggttaaataatatgatgcttgtaaggta

SEQ ID NO: 6826029 - DNA, 109 bp, Homo sapiens
ggctttgtagatgatgtgaagggtttaagacttgatccaaagaactatgagaactactgaatggttttaagatggatacaagttattcttctcacatgcttactttgct

SEQ ID NO: 6826030 - DNA, 96 bp, Homo sapiens
ggtacaggtacgtcagctctcctttggcgtgtacagtggagcaagggtaagaagcactgagttctgactgtgatgccagtagcactacctgcagcc

SEQ ID NO: 6826031 - DNA, 85 bp, Homo sapiens
gtgtccatccctaggcccaaagggtgacatttagatggtagagaaagtgaatggaaccaagctatgtggtctggggtattcacac

SEQ ID NO: 6826032 - DNA, 66 bp, Homo sapiens
ggtttccctagttatttgaaatggattggaatccacttttgaaagcatttcaaagagctggaaatc

SEQ ID NO: 6826033 - DNA, 56 bp, Homo sapiens
ctcccaagataaataaggcagtgcttgtccttaaattgcccagggtctggtgggag

SEQ ID NO: 6826034 - DNA, 57 bp, Homo sapiens
ctgaccttgtgatccacccaccttggcctcccaaagtgctgggattacaagcgtgag

SEQ ID NO: 6826035 - DNA, 70 bp, Homo sapiens
tctggagtctctgctcaggcaccagccctggcaggcatctgacacagggttgggctctggcattttcaga

SEQ ID NO: 6826036 - DNA, 63 bp, Homo sapiens
ttatgctgatttggttttgtgttctctgaaacatcaagggccaggctcccatgtcaggaataa

SEQ ID NO: 6826037 - DNA, 78 bp, Homo sapiens
ggcaagggatctgctagcggtaacagcgtttgcccattcccatggtgtaaacacccttactgtggcctgtttcgtgct

SEQ ID NO: 6826038 - DNA, 74 bp, Homo sapiens
ggggcttgaggcagagaggggcacagcagctgttgcacaggctggtgcaagattccctgcttcttctcagctcc

SEQ ID NO: 6826039 - DNA, 82 bp, Homo sapiens
ttaaatcgttagtcttccctataattgcacatccattaatgatagaatgtgtgatgttgtggggaggatgtggatgaattaa

SEQ ID NO: 6826040 - DNA, 73 bp, Homo sapiens
aggaagggaagtatttcgttctgaaaaagtattttacccaaactggagtgctcagtgagatgctcccctctct

SEQ ID NO: 6826041 - DNA, 59 bp, Homo sapiens
atgtcacagatggggaaacggaggcaccgagagtttctctaactgccccattgtctcat

SEQ ID NO: 6826042 - DNA, 105 bp, Homo sapiens
gaatattcatgtacaagtttttgtatgaatgcatattttcatttctcttgagtgtatacctagaagtgaaatggctaggtcatatggcaactctgtttaatattt

SEQ ID NO: 6826043 - DNA, 81 bp, Homo sapiens
tataagccctggcctatttagttatctttcataaaataaaatgtaataacttatttcaagatctttgggtaggcttttgta

SEQ ID NO: 6826044 - DNA, 59 bp, Homo sapiens
ggttttcctagtaggcctattagaatcacaggattctagtaatgagaggcaggagaatc

SEQ ID NO: 6826045 - DNA, 87 bp, Homo sapiens
gagttcaggatagtgtgcttgttgacaggggttttggtaccctgtctgtcacagagcaactatttcttgatcaagttgataatactc

SEQ ID NO: 6826046 - DNA, 98 bp, Homo sapiens
tagagccccctggctgggtgggtctgggcaggcgcttcctcccggagctggctgggcaccgctcccagacccaggcttttctaggtcaggcagttcta

SEQ ID NO: 6826047 - DNA, 55 bp, Homo sapiens
gaaatatccatactgattttccgttacttgttctgagaaaaagtgtggaaatttc

SEQ ID NO: 6826048 - DNA, 62 bp, Homo sapiens
caggccctctgagtagctgcaaacattctcaaaatgttgaaacagaactctcaaaggtcctg

SEQ ID NO: 6826049 - DNA, 58 bp, Homo sapiens
taggttccatgagggaggcaaacatgaataagacattgtccccacagagaggggctta

SEQ ID NO: 6826050 - DNA, 56 bp, Homo sapiens
caccagctactcgggtttcctggtgattcccacatttgccccaggggtggcaggtg

SEQ ID NO: 6826051 - DNA, 59 bp, Homo sapiens
acacaggacagggatgtgttttccagtttgccacagtccctgccactccctgtccttgt

SEQ ID NO: 6826052 - DNA, 79 bp, Homo sapiens
gagatgatccagaaactcaaagattattaagtcacgtcacctgtaaatgaatggctttgagtattttctggagtttttt

SEQ ID NO: 6826053 - DNA, 81 bp, Homo sapiens
gcatgagaggaaatgttgaggtagagaaaggaaatgagaaaagtttcattttcattgttttgcttcagcttgctctaaagc

SEQ ID NO: 6826054 - DNA, 64 bp, Homo sapiens
cttgtcaagggtgaccttcagcttttacgttaggtgactggtgaatattggaggcattgagaag

SEQ ID NO: 6826055 - DNA, 69 bp, Homo sapiens
gcaaccctaggaaactaatgaagaaacgcaacttgaaaataggttatttcagaagtggtcctaggaagc

SEQ ID NO: 6826056 - DNA, 71 bp, Homo sapiens
cagccctgcggctcctggacctccgctggatcgaggatgttaaagactcccagctccgggagttgctgctg

SEQ ID NO: 6826057 - DNA, 71 bp, Homo sapiens
ataagaaatggaaaggtggtaccctccctagtgtgggagcaacttgagggccggtatcacttgttttttgt

SEQ ID NO: 6826058 - DNA, 77 bp, Homo sapiens
cttctgaacaaagtctgcactcaggtggaggtcaagtccgaaatggtcttcacaggaggtgtaggtccttcaaggag

SEQ ID NO: 6826059 - DNA, 58 bp, Homo sapiens
ttgagaaccactgtggagggctatcaagtgcttctagtccctcccagatgcttcccaa

SEQ ID NO: 6826060 - DNA, 78 bp, Homo sapiens
ttctctgaccctgtaaatgtcctgctacagagtgcatacgaaaggatgtacttaggtgagatattttcttgcagagaa

SEQ ID NO: 6826061 - DNA, 59 bp, Homo sapiens
cacatttccttggcctttaattttcatctgggcttggcccttaagggccctgggatgtg

SEQ ID NO: 6826062 - DNA, 71 bp, Homo sapiens
tctcaattcagtttagcaaatttgtatcaagtatcccctatgtgcaaaatgctagactaggtacagtgaga

SEQ ID NO: 6826063 - DNA, 58 bp, Homo sapiens
ataaaatcagagttggattggatgacctctaaggtctgttctgattctatgattttat

SEQ ID NO: 6826064 - DNA, 85 bp, Homo sapiens
ggagtctcgctgttgccagactggagtgcagtggcacgatctcggctcactgcaacctccgtctcccaggttcaagcgattctcc

SEQ ID NO: 6826065 - DNA, 55 bp, Homo sapiens
cttccgtgtcagttccaggtggcacagcgccagcttgtccgaggagacgcggaag

SEQ ID NO: 6826066 - DNA, 76 bp, Homo sapiens
cagggggctgatgcagtggcttcagtgtcagtgactaaccagtggccctggagtgactcgtaaggcaggtaccctg

SEQ ID NO: 6826067 - DNA, 130 bp, Homo sapiens
ttcttagactaactattgtctgattttagaagcttcaagatatttggtatttcagttaaatacagaataaagcgtgaagcttccaatataatgtaaaaaatgataatagtaaaaataataatagctaaca

SEQ ID NO: 6826068 - DNA, 56 bp, Homo sapiens
attctctggctaaaacctgaaggttatacatggcatgtagggaatagctagaggat

SEQ ID NO: 6826069 - DNA, 83 bp, Homo sapiens
tgtctataggcagttttatagtcatgtcaatgtcacatagattctgagtaacaatgattagtgactacagcatgctttccaca

SEQ ID NO: 6826070 - DNA, 55 bp, Homo sapiens
gtttatgcacttggtttgtgtcaattttccatgacacacatcacgttgcaaaaac

SEQ ID NO: 6826071 - DNA, 68 bp, Homo sapiens
cccactcgtgggaaggagctggtcttcgcagctttgcgtgaagctctgatacttcctacctgagtcgg

SEQ ID NO: 6826072 - DNA, 73 bp, Homo sapiens
ggtttaaactaggtctgtgctgagtaaactgtgatacatggttacaatacatacagagatgctagttaatatc

SEQ ID NO: 6826073 - DNA, 86 bp, Homo sapiens
ggccaacaggagttcaaggctctggaccaaatcccatcactaaattgctgtgggatcttgaatcagtggcacaagatttgggggcc

SEQ ID NO: 6826074 - DNA, 57 bp, Homo sapiens
tgagctgcttagagtcctcaggattagccacaagtcctttaacctccaggcatctca

SEQ ID NO: 6826075 - DNA, 66 bp, Homo sapiens
gtagttttctctgtgttctgcttactatgtttgaataatgtcttaactggggtaggagaaggctac

SEQ ID NO: 6826076 - DNA, 65 bp, Homo sapiens
ggtattggcttgcatgatatggcatctgggaagtctcacaatctgccatctgcaagctggagacc

SEQ ID NO: 6826077 - DNA, 68 bp, Homo sapiens
gaccccatgtgatctaacccaggcagtccaatgaccgtgccaggaggcctgggctgggctacagggtc

SEQ ID NO: 6826078 - DNA, 90 bp, Homo sapiens
ggttttcccatgaagcagggtgtcttgacccatggccgtgtccacctgctactgagtaaggggcattcctgttacagaccaaggagaact

SEQ ID NO: 6826079 - DNA, 69 bp, Homo sapiens
gttttctgctcagaaaagtgaggctcagtatcatctatattgaaaactagtttttctcagcagacctac

SEQ ID NO: 6826080 - DNA, 68 bp, Homo sapiens
actgaagcacatttgccatgaaaataactgttattgctgttgccactcaatggtcaatgccttacagt

SEQ ID NO: 6826081 - DNA, 58 bp, Homo sapiens
gagtggggttcaggaggcctgggaagtgtcctgaagctgcctcctggtgccccatctc

SEQ ID NO: 6826082 - DNA, 81 bp, Homo sapiens
tctgaatccatcatgcagaacaatggattagcaaacacccaacgaaaatgcaaagaacatttcagacatggtggaggcaga

SEQ ID NO: 6826083 - DNA, 79 bp, Homo sapiens
tttgtaagcacaagccagaagtgtgtggtccattttctctttaataagaaatgccagcacacgtctgtggactcgcaga

SEQ ID NO: 6826084 - DNA, 85 bp, Homo sapiens
gtagtgggtggggtatcagttatggaatggcacctccttccagaggactgatcatgtcattttcagcttatgcttccctttatgc

SEQ ID NO: 6826085 - DNA, 77 bp, Homo sapiens
tgaccttcaaattacctaattctgacattttctctcttaggaatatgggagtgaaggaaacaattggttgagggttg

SEQ ID NO: 6826086 - DNA, 86 bp, Homo sapiens
tccgtactcctggcaggatggccccggggctgtgctccaggacccacgtcccgatgccagcctgaggccgtgcctgctcctccgga

SEQ ID NO: 6826087 - DNA, 75 bp, Homo sapiens
ggctttacagggtttgtatcttcctttacctgcaaagacagaaaagcaaaaggaggcaaacagcctagatgagtc

SEQ ID NO: 6826088 - DNA, 90 bp, Homo sapiens
gggaaactttatatggttggggataagaattgaatgcaaattaatgaactagatttgcatttatggagttacctcatcatggagttacct

SEQ ID NO: 6826089 - DNA, 113 bp, Homo sapiens
ctcttctatagggatctcacttagagtttatagaattctttgctatcctttactttaattcattttggcaaggtatgtagtattaactccaggtgaggcaaccaagagagggg

SEQ ID NO: 6826090 - DNA, 55 bp, Homo sapiens
ctgactggcataaagcaaccactattttactgtgcttgcaaatatcgtgggtcag

SEQ ID NO: 6826091 - DNA, 67 bp, Homo sapiens
tacccagttgatgagtattttattttagcagcccaaatggactaagatgactacttaccactgagtg

SEQ ID NO: 6826092 - DNA, 98 bp, Homo sapiens
ttccagaggtcatccctgtgtcttctaactgcatttgtctgtctcaattgatcagtaaaatgagcaattacagtcggagcagcactgggattctggag

SEQ ID NO: 6826093 - DNA, 61 bp, Homo sapiens
ccagggaaggactctctttcccttggactgtcagctccacaggataaggatttttgcctgg

SEQ ID NO: 6826094 - DNA, 71 bp, Homo sapiens
catccgttttgcccaggatattgagtcagcaaaggaaatgatggcttcagtctccttgggtcccctagatg

SEQ ID NO: 6826095 - DNA, 60 bp, Homo sapiens
ggacctggggtggaaggaaggcaagactgaccttaatgttctctgttcaccccagctgcc

SEQ ID NO: 6826096 - DNA, 78 bp, Homo sapiens
ctgactgcagctctgcttccttgtacaggtctgttgtgggcatcccgacctgcgagtccgtggtgcagctgcagccgg

SEQ ID NO: 6826097 - DNA, 69 bp, Homo sapiens
tcaaattcatagtctatctttagtatatcaatttatgaacagtatgagatttggattcagtgaatttga

SEQ ID NO: 6826098 - DNA, 75 bp, Homo sapiens
gtaggtgtagacttcccactgcagtgactgagcctaggggactttgccagtgacaaagtcggaagtcctgtctac

SEQ ID NO: 6826099 - DNA, 61 bp, Homo sapiens
tctttgatccattaaaatccaagagtgagcccttcctcgtctctagagtgtggagcaaaga

SEQ ID NO: 6826100 - DNA, 95 bp, Homo sapiens
gcaggcttgtttgaggacttgacaagctgattctaaaatttattatcccaaatattaataattttaaagaaggctagagaacttaagctacctgc

SEQ ID NO: 6826101 - DNA, 78 bp, Homo sapiens
ctgatggttgctgtactgttttttatctgttgtgatggccttaggcttgggtggagagggaacagtgaaaggcatcag

SEQ ID NO: 6826102 - DNA, 57 bp, Homo sapiens
tgatgccaccacctccagggagacttccagggtctcctccagtaggaagtggcctca

SEQ ID NO: 6826103 - DNA, 63 bp, Homo sapiens
tcctgatctcttcatagatttaataattttcatccaaggatgaaggtctgtaaagtgacagga

SEQ ID NO: 6826104 - DNA, 65 bp, Homo sapiens
ctcaagatcagctcccgagtctgagatctcttctctcaatggcattggagctggctgtgcctgag

SEQ ID NO: 6826105 - DNA, 83 bp, Homo sapiens
gtatgtcaactactcatcaagacaaatactaatggaaggtttccacaaattaggttttgcttgtgtaatggtaggaagacaac

SEQ ID NO: 6826106 - DNA, 56 bp, Homo sapiens
agtctgatggcagtgtagtgcttcctgaatcatggaagcaaggctaaatcatgatt

SEQ ID NO: 6826107 - DNA, 80 bp, Homo sapiens
gagaggaggacagcgagaatgtaaggagccctcagcccacacccagcagagaatgcttctatttttcctgctctcttttc

SEQ ID NO: 6826108 - DNA, 92 bp, Homo sapiens
tcttgttttaatcatgttttagcatggaaaaatgacacatatctcaaagtatacattttgaggtttttgatatgtatatggctaatttagga

SEQ ID NO: 6826109 - DNA, 127 bp, Homo sapiens
gtgcccctagctgactgttgagggtaagcagagccacagcctccagattttattcaaggtgaaatggacattgggtgagctctcttgttctcagatgatctgctttatagtacaggactagggccat

SEQ ID NO: 6826110 - DNA, 58 bp, Homo sapiens
tggtgtgagcaggtcaagttcatcccccagatgaatgtggtagtctcctgttcagcca

SEQ ID NO: 6826111 - DNA, 94 bp, Homo sapiens
tactattttcaaatagcaaagaagggttcttcattaggttgtcaaatctaattttgtgtgagctttatcttcactctgctgttttaaagtagta

SEQ ID NO: 6826112 - DNA, 65 bp, Homo sapiens
actgtccttcagctttatctgaacacccccataacaatgtgtgactaagtggagttgaggacagt

SEQ ID NO: 6826113 - DNA, 76 bp, Homo sapiens
tgtcatcagcattttggggatggtgtttatttcttcaacgagaataagattccagatcccaaaaatgatattgata

SEQ ID NO: 6826114 - DNA, 96 bp, Homo sapiens
tagaaatatccctgttttcagtagaaaggagcattttagactacttttaaagataataaactggcaaatgctccttccattacagttttgtttcta

SEQ ID NO: 6826115 - DNA, 105 bp, Homo sapiens
gccctcaaaagcccaggctgacgttatcagagggcaaccagatgtcagtgtttgcacagcctgtccctgtcctggtgattttgtccttggcctgggaatgactgt

SEQ ID NO: 6826116 - DNA, 92 bp, Homo sapiens
ccaaggtggtctggcgtcagaagtcactgacttggccctcgtgctttctctggcagcaggagtcactgacttggtcctagtactatctctgg

SEQ ID NO: 6826117 - DNA, 73 bp, Homo sapiens
gtcctctggaagatgagttcttctcttgcctttgtttctttccaaacctgcgtagcttaccttccagacgggc

SEQ ID NO: 6826118 - DNA, 55 bp, Homo sapiens
actatcagtagtttccagcctgtgatcctagacccctggaaaccctgctgatggt

SEQ ID NO: 6826119 - DNA, 79 bp, Homo sapiens
tgtgttcttatcattagaccaaactagagctgataggttgaaaatgtcagctttcagttactaatgaagggaaatgtca

SEQ ID NO: 6826120 - DNA, 63 bp, Homo sapiens
tttctccttccctccctcctgtgttctaatagaggagtgcatttggggtagtggaagcagggg

SEQ ID NO: 6826121 - DNA, 65 bp, Homo sapiens
agcagcagagcctggcgatgtcatggaatattccttcctttcttccattccccgagctctgtgct

SEQ ID NO: 6826122 - DNA, 88 bp, Homo sapiens
cctctgtctgctatcaggcagggtgagcagctgtctgtatggatgtgcttatcttgggcagcttgctcgccccctgtgcacacccagg

SEQ ID NO: 6826123 - DNA, 65 bp, Homo sapiens
ctgcagtgaggacctgcctctatttaccatccaggtggaacaagaagcaggtcgctttagagcag

SEQ ID NO: 6826124 - DNA, 70 bp, Homo sapiens
tggctgtggggggtgttcatgacctctcacggccccttctgtgtttggtcgtgcaaacctgacacagcca

SEQ ID NO: 6826125 - DNA, 72 bp, Homo sapiens
tataaaaatgggtatgttattattgttatagttacaggaactatttagcaagtatgatactccatgagtata

SEQ ID NO: 6826126 - DNA, 76 bp, Homo sapiens
aactgggtcccaatagcttttgtttctgtaaatcactgtctcttagaggaaaaggccacagggacacattccagtt

SEQ ID NO: 6826127 - DNA, 57 bp, Homo sapiens
gccgggctcagacatccctcctggagcttgtatttccaggtcccctctgggtcccgc

SEQ ID NO: 6826128 - DNA, 57 bp, Homo sapiens
agactggaattctggaaacacagaaccatttgttctgccagctcagagctctagttt

SEQ ID NO: 6826129 - DNA, 130 bp, Homo sapiens
gctgtaaataggttgggcagccatctcagtttgcctgaaacggaggggtttctcaggacatgggactgttactgcttaaactgggaaagtcttggggaaaccaggatggttggctatcctactgtaaagc

SEQ ID NO: 6826130 - DNA, 65 bp, Homo sapiens
tgaggagtttagatatagggaatagcacagaaagagcagaaaattccttatatttgaatacttta

SEQ ID NO: 6826131 - DNA, 65 bp, Homo sapiens
ggccaaggtccagggaaaggctctagctgtctagtcatcttcatggagctcctgggctctgggcc

SEQ ID NO: 6826132 - DNA, 70 bp, Homo sapiens
gttctaaagtaggtgagtgatgctcagatttacatttttaaaagagcattcaatcttctgcgtagaggac

SEQ ID NO: 6826133 - DNA, 59 bp, Homo sapiens
aagtgttttggcttctgtacacataaggaaagaaaaattgagtagaagttagaacactt

SEQ ID NO: 6826134 - DNA, 70 bp, Homo sapiens
ggccagtagtgtttttctgaatttgaagtttgtttagtcgtcaagtccaggaaagcacagtcatatggct

SEQ ID NO: 6826135 - DNA, 112 bp, Homo sapiens
cttcaaagattgttgtgaggatttaacatttgtgaagcatttagcatagttcctgctgcgtatgtgcttaatacatggtgttttgttcttattattttaagaatagatggag

SEQ ID NO: 6826136 - DNA, 86 bp, Homo sapiens
gcctcccagcctcagccagctgtgtgcttctgcattattgcagtggggcgggcaagcgtggagggcacagctggcagggcagaggc

SEQ ID NO: 6826137 - DNA, 80 bp, Homo sapiens
tacctctaacttgctattgctacatgtgctgcatttggggacaaatgctcatagatggcaatgacccacagtcactggta

SEQ ID NO: 6826138 - DNA, 60 bp, Homo sapiens
tgctgtattttagttagctggagttggttgcaaccaagattcttgactagaatgattgta

SEQ ID NO: 6826139 - DNA, 84 bp, Homo sapiens
tatttttaattttagtacatttagtttatgaacatgcaatttgtggatgtctgtggcattatatgttttataaaattgaaagtg

SEQ ID NO: 6826140 - DNA, 85 bp, Homo sapiens
acccttttgctcctattgttcatccaatcctgagcctacccatagggtggatttcagcaagggtgggtgggaggaggaggagggt

SEQ ID NO: 6826141 - DNA, 107 bp, Homo sapiens
ctctagacagcctcggtgccttactctgagggatgtacaagaaacatttttccagtgatggaaagattcttacctatacccagtgagaggaaagagagcatttgaag

SEQ ID NO: 6826142 - DNA, 56 bp, Homo sapiens
cactcctactccagagtgctaggctatgtaaactccagctcctggactagagagtg

SEQ ID NO: 6826143 - DNA, 66 bp, Homo sapiens
tagatttcagccccgctcccagctgtctgagtcacatcccgcacctcggggcaggcatggaccctg

SEQ ID NO: 6826144 - DNA, 57 bp, Homo sapiens
ctgcatgtgtgttaagatgctttctgcgttgtcagccaaggaaagccccatatgcag

SEQ ID NO: 6826145 - DNA, 91 bp, Homo sapiens
acagctgaatcataatttttgttgctctgtttacttgatgatcaaggccaaagtccagtaaaaagcgacaggaagtgtatattcaggttgt

SEQ ID NO: 6826146 - DNA, 79 bp, Homo sapiens
tgtttctaaatgctgatttagataaatgcttttctaaccaaaatgaagcagtatggtatttaagtcaaccatggaaata

SEQ ID NO: 6826147 - DNA, 59 bp, Homo sapiens
ccaagacagaaagtgggtctagaatggcccttgggctaagactgccattgttcttttgg

SEQ ID NO: 6826148 - DNA, 57 bp, Homo sapiens
gcaaattgctttgtacatgcctagcaccttgtaagtgctcagcatgttaagcattgc

SEQ ID NO: 6826149 - DNA, 130 bp, Homo sapiens
catgtatttgtgctttacagactcttccctgtgttggttgttttgtctgttttgtctttgtccctcataaagtcatggcagctagaattgaagatcgcatttcgggagtgttctgaccagcacaaatcag

SEQ ID NO: 6826150 - DNA, 78 bp, Homo sapiens
ggatccctgagcctctgaggggttggatgcatctggctctccagccagactgtcagcaacttcaagcttaggatttcc

SEQ ID NO: 6826151 - DNA, 80 bp, Homo sapiens
ctcttgggaagattattcttaacatgaaaaataataaataagtattagaaattattagtgaatagtctcagctcatagag

SEQ ID NO: 6826152 - DNA, 69 bp, Homo sapiens
cgggagcctctgggtcacactggctactgtgtacttgtgccaccctgtgtgttcccggagtagctcccg

SEQ ID NO: 6826153 - DNA, 97 bp, Homo sapiens
gaaacagtgccaggcattggagtgagaatcttcacagaaaaatgtctgcccagaggcagatgaggtccttcagctccagtgctgattggttcctttc

SEQ ID NO: 6826154 - DNA, 66 bp, Homo sapiens
gctatgtttggacataggtggtaatagtggcggactgctgccaccatgacctcaaatgtcaatggc

SEQ ID NO: 6826155 - DNA, 95 bp, Homo sapiens
tcaatatgccaagtattgggagtaggtgtttaaaagtatggtggtcctttttaaataaatgatttaaatcactgtactttattcctgggcagtga

SEQ ID NO: 6826156 - DNA, 79 bp, Homo sapiens
gggaaaatgagctcacaggcaggcgtctggaaagctgaggaaccctcagaccccacagggcctgtcctgttggtttcct

SEQ ID NO: 6826157 - DNA, 57 bp, Homo sapiens
catgcttgctctcagccttctcaagtacaactggcaaaggctggagatgcaggtctg

SEQ ID NO: 6826158 - DNA, 58 bp, Homo sapiens
gctgtttctttcctggcacttgaacccatgtcattctgggtagttagtaaagaaaagc

SEQ ID NO: 6826159 - DNA, 83 bp, Homo sapiens
tagagccaccgtataaagtcatttcaaaagttgaagtgggaatgtatttagatttttgagatattttatttggtacagcttta

SEQ ID NO: 6826160 - DNA, 130 bp, Homo sapiens
ttgtagcaagtgttgatctctgtggtgtaaatattcccatcatgtgtaatttcaagctacaatgcaaagttgggaagagatttccacatcattagatagtattcccatcatatagatgatatagatgcaa

SEQ ID NO: 6826161 - DNA, 86 bp, Homo sapiens
gcctatcacatcagatagaaggatagatttctagatagaagaaatttgggcccatctgttatctagaaatttcttttgttgaaggc

SEQ ID NO: 6826162 - DNA, 87 bp, Homo sapiens
ctgctgtgaaattcctagatcataagtgaaagtctaactcagagccatcagggccatgagtagcgatttcatttttagttcatacag

SEQ ID NO: 6826163 - DNA, 90 bp, Homo sapiens
cccacccagtaggcgatgcttcagggcagactttgggcctagcaggcagctgggtcagaatctccctgtgcagggcaaactggtcagggg

SEQ ID NO: 6826164 - DNA, 62 bp, Homo sapiens
ggggatggaatgtagtagtgatcttgataccccatccaattcactctcctattcatttccct

SEQ ID NO: 6826165 - DNA, 63 bp, Homo sapiens
attgtcactttgaggttctgttaacattttgtaagacaacaaataagaccctctaagggcagt

SEQ ID NO: 6826166 - DNA, 76 bp, Homo sapiens
tacagctgaagctcagcccagtagttttctcttactcaccatcaatcagaaaattaatactgtgcttgggctagta

SEQ ID NO: 6826167 - DNA, 60 bp, Homo sapiens
tctccaggtacactttggccagcaccagcatgtagaactgtgcctcatgtatctggatga

SEQ ID NO: 6826168 - DNA, 103 bp, Homo sapiens
ctttttaaagaaagataaagtcctataagtgactgcagggaattcactaagctttttgggcaaatgggctctgcagcattaggtctatatttgctttaaagag

SEQ ID NO: 6826169 - DNA, 62 bp, Homo sapiens
tcacgggggtatccagaggattaaaaaatagatttttataaagctctttggagatccttgga

SEQ ID NO: 6826170 - DNA, 60 bp, Homo sapiens
gggtcatccagcacctctgggtcttgtctttcaataaaggaatggctagaagtgtgaccc

SEQ ID NO: 6826171 - DNA, 124 bp, Homo sapiens
gcaggatcaaccaggagtgagcagggagcactgcagagaaggggccctccggacatgccccaactggggagtgctggcacccctctccagttcgcatctactgcctttcaaaactggctcctgt

SEQ ID NO: 6826172 - DNA, 97 bp, Homo sapiens
ctgtttaacctttggtctccacaagctttctccttttaacaaaaaggtctattatttcgagttgtcaggagataatttgtgagttgttaaaggacag

SEQ ID NO: 6826173 - DNA, 83 bp, Homo sapiens
gtaaagttcacaagatgtggtggggaggaaatgaccactgtaactctgtggtccagttcccacacccatattgtgatttttgc

SEQ ID NO: 6826174 - DNA, 123 bp, Homo sapiens
ggagttgttgagatggactttagaggatgcctgcagccatgtggagctgtattccaactcagagaggcagctgaatgtccattgctgcaggcaaacttcagatgtcccagtcttacaaattcc

SEQ ID NO: 6826175 - DNA, 56 bp, Homo sapiens
ttgtacaaataggaacctctgatgtcattcttcaacgtttgttcctgtgtgtacaa

SEQ ID NO: 6826176 - DNA, 127 bp, Homo sapiens
ccacaaccccaagttacagggaagataaaatgaaactgaaaggtatttataggatgtcttgcaattgctcaagaaatattaaagtatctttcaatttgattgcaggtaacttaaaagtatactgtgg

SEQ ID NO: 6826177 - DNA, 56 bp, Homo sapiens
ttggcgcccaggacgccgccgctgtactccccggcggccgcgtccagggccgccag

SEQ ID NO: 6826178 - DNA, 69 bp, Homo sapiens
gtggggtggtgtctttgcattatggtgctaggataaatgtacaggtggagcataacacactagccttgc

SEQ ID NO: 6826179 - DNA, 61 bp, Homo sapiens
tccttgttgtgtagggagccagggacattggagtgatatctccttggcttaataataggga

SEQ ID NO: 6826180 - DNA, 83 bp, Homo sapiens
ctctcttggaacttctgcttttacaggcagtcacacaaatttgtccagcatgactggggtgcaggcaggagtggctgaggggg

SEQ ID NO: 6826181 - DNA, 87 bp, Homo sapiens
gcttggagaggttgaacaacatactctgaaagagcatgaacttgttatgaccagggtgggttgttggagtttaaaggtctcataggt

SEQ ID NO: 6826182 - DNA, 60 bp, Homo sapiens
tttctgctttatggctcagagactactagacatcagtatcatgggtcacaaagccagaaa

SEQ ID NO: 6826183 - DNA, 65 bp, Homo sapiens
cagagagagattaatatatagatttatatatatatgtgtaggtagatatgttgatttgttcactg

SEQ ID NO: 6826184 - DNA, 58 bp, Homo sapiens
ggattagctttccttgttgcctgtgctcagcacagcatgaagagaggaagcatggtct

SEQ ID NO: 6826185 - DNA, 126 bp, Homo sapiens
aatagtctgccccatttgtgaattttctgaatctctgtctgtcctgcttccttggactcctcagcacctccagaagcctagggaagaggtggaagtgaattcagcccgtatttataacgtactgtt

SEQ ID NO: 6826186 - DNA, 88 bp, Homo sapiens
ctctgttgggtggcaaagggctgatgtgacatagctgtgacatagatgtgatgttaggcccttggcctctcctccttcccatacagag

SEQ ID NO: 6826187 - DNA, 74 bp, Homo sapiens
acaatgtagcccagcatgagcagagctggttacctacaaataaacctgcttttgcttttttgggtgtcacctgt

SEQ ID NO: 6826188 - DNA, 56 bp, Homo sapiens
catagcccggggggcggctgctgggggaacagcagcaggattttcgttgggatgtg

SEQ ID NO: 6826189 - DNA, 87 bp, Homo sapiens
catttggcagtcagtataatagagtggaaaaacctttggtttgaaagaactgtattctagtcatgtttgtcactgtctagtcaaatg

SEQ ID NO: 6826190 - DNA, 92 bp, Homo sapiens
gtggtgggttttaggtaatttgaataagaatttagaattagaaaaaaattatttgaaatttctgcattcaaattatgtgagaaatccatcat

SEQ ID NO: 6826191 - DNA, 68 bp, Homo sapiens
ggtagcttgcagttcctgctccatgctctgccctgggcaatgagctgtggaaggcagggaccaggtcc

SEQ ID NO: 6826192 - DNA, 65 bp, Homo sapiens
ctagagatgtgggcaatggaatggagaagtagggccacatcaccacacaatgtcccacatcatag

SEQ ID NO: 6826193 - DNA, 119 bp, Homo sapiens
gacagagcaagactccatcttgtgggggaaaagaaggtgtggaaagatgctctactcctcagagcatcttgttcccaacttctcctcccaggttttttggttagtcttttgtttgcttc

SEQ ID NO: 6826194 - DNA, 74 bp, Homo sapiens
gtagattgtaatggtgtggtgtgggaagcagggtaataattcctttcttttatccaccagccagacaagcttat

SEQ ID NO: 6826195 - DNA, 71 bp, Homo sapiens
cacatttctaactagaacgtctagttgctggaggctcaagttgaaatccctggactttctagtataatgtg

SEQ ID NO: 6826196 - DNA, 86 bp, Homo sapiens
gatgaagatgacatctcaatttgttcttcagtggttgatcattttttataccagaaaggaggagctagattgtgtcatgattcatc

SEQ ID NO: 6826197 - DNA, 58 bp, Homo sapiens
aggggagcaccggtcggtaggactcttggttgaatcagtccagctccgtgttcttcct

SEQ ID NO: 6826198 - DNA, 80 bp, Homo sapiens
tgacatcaacccctctggctctgagcttttcttctccagaaggaagcacagaaaaggagcatggagtgggctttgagtca

SEQ ID NO: 6826199 - DNA, 77 bp, Homo sapiens
tgtggccccatgtggtaccttctgtggatccatgtgggatcctgcaggggctgaggaaccacggagaaggggctgca

SEQ ID NO: 6826200 - DNA, 57 bp, Homo sapiens
tcaagtttaagtacatagaaaagattccccctataatgactgtgtacttgaacttga

SEQ ID NO: 6826201 - DNA, 71 bp, Homo sapiens
ggctggcaggactcacacttggccgggcttctatagacatgataggccagactgtggagttcctggtggtc

SEQ ID NO: 6826202 - DNA, 67 bp, Homo sapiens
gtgttcagtcctgccagaggctcaggccaaatctgattgatacctgggctctgtcagaattgggtat

SEQ ID NO: 6826203 - DNA, 56 bp, Homo sapiens
tggggggaagatggatgttaagttaattcttagatctgaaaatgctcttcttctca

SEQ ID NO: 6826204 - DNA, 74 bp, Homo sapiens
gctatataccagaacaaatgagatcctggcccagtacctcctccaaggaattcattctgcttttggagactagc

SEQ ID NO: 6826205 - DNA, 91 bp, Homo sapiens
tgttaacctagtgggacagctgcacagtttgcatggcatgaatgtttgtacattcacctgtcactgcacaactgactgtttcacggtgaca

SEQ ID NO: 6826206 - DNA, 89 bp, Homo sapiens
ggcagggaggcatctagaccaggcccacacacggggcaaaagatgggccctggagtcaggttggcctgggcttggattgaggctctgcc

SEQ ID NO: 6826207 - DNA, 64 bp, Homo sapiens
tcactcagcactgaggatctgcgtgatatttaacaaattaccagcatcacagcatgttggatga

SEQ ID NO: 6826208 - DNA, 75 bp, Homo sapiens
gctcttaaggaagtacccattcttagggtcatgcttgtgcagtcagcccctgagagtgagtgccaccttaagtgt

SEQ ID NO: 6826209 - DNA, 68 bp, Homo sapiens
tcagtagtggcttagaagaaggatatgaaaaacaattagtctgtgccttctatcttgccactggatgg

SEQ ID NO: 6826210 - DNA, 72 bp, Homo sapiens
gactgcgctcctctagaagctgacctggagatatgggttcatcttcaggcagtttattggagaagtgatgtc

SEQ ID NO: 6826211 - DNA, 64 bp, Homo sapiens
tttgttctgtgcctgtgatctgggattttattttagttccagagtttaggggacacagaataaa

SEQ ID NO: 6826212 - DNA, 126 bp, Homo sapiens
gattcgtcaatgaatgaaaagtcaagtaataaatgtgtctgttgtttgtgtgcaaaaatgttattactaacacacccttagcagtggcatacattttgagtgtttttccattagtcgtgatgtatt

SEQ ID NO: 6826213 - DNA, 62 bp, Homo sapiens
tcagtttcctggttttgacattgcactatcctacgaaaaatgttacttttataggaaactga

SEQ ID NO: 6826214 - DNA, 85 bp, Homo sapiens
cggcttggtgttttcagatgaggaaatggagcctgaggaatgctaacttacagattccggtcatctctccttaacagccaagttg

SEQ ID NO: 6826215 - DNA, 72 bp, Homo sapiens
gcctgcagcatgctaggtcttgtcaaaccctctgcaccttgggctgcgcagttatctggacatgtgccaggt

SEQ ID NO: 6826216 - DNA, 70 bp, Homo sapiens
tcagagttgcttattataatttcttgattgtttgataaaaggtacatcccaagacatatgagtactctgg

SEQ ID NO: 6826217 - DNA, 57 bp, Homo sapiens
atcaggcagtgacatgatcagatttatgctttggaaaggtcactgtggctgcaggat

SEQ ID NO: 6826218 - DNA, 128 bp, Homo sapiens
gaagggaagtagaggattatagaagagggaaagacaatttaagttggttaggggcatcgctgtttccttattgtcctacttattgtctttccaaagcaaaatctctacctggtctccttttgcctttc

SEQ ID NO: 6826219 - DNA, 75 bp, Homo sapiens
tccctgccttctcaccatcttgaatcccttatctgtaaaatcaggggtgagtttgggggaaaaggtaggcaggga

SEQ ID NO: 6826220 - DNA, 89 bp, Homo sapiens
gccaggaccaggagctcagagcccttggctccccagggcgggaagacggttatttaccaaggcaggaccaggagctcagagccctcggc

SEQ ID NO: 6826221 - DNA, 79 bp, Homo sapiens
ataagcttgtgagtgcttatatgttaaattgaggtatttaggtttctctttagcaacgaagcactcgacagaaggttgt

SEQ ID NO: 6826222 - DNA, 79 bp, Homo sapiens
gtaattgtggttttgccattacaagtaataacaaattaaaaaataatggcattaaaagtaatggtaaaaccacaattac

SEQ ID NO: 6826223 - DNA, 61 bp, Homo sapiens
gaataagtgaagttggcagcttcctcatgaatagagtgactttgttaagcatcactttttc

SEQ ID NO: 6826224 - DNA, 70 bp, Homo sapiens
gccttttcttcctgtgtctgtgcccccattttcctggaagactccctgcacatactacacagaaaatggc

SEQ ID NO: 6826225 - DNA, 83 bp, Homo sapiens
tctattgaggatgccatttgggtctggcttgagctgggttcttgtggatgagaagaggcagaactaggtggcatcttaagaga

SEQ ID NO: 6826226 - DNA, 81 bp, Homo sapiens
agtgatttggtgcctacctttcaaaatattgtgcaaagatagttcacactagataattataaaaggtaggaactcctcatt

SEQ ID NO: 6826227 - DNA, 71 bp, Homo sapiens
aaagccaatctaggatgtgttttgagctgactaccaactatggtggttttaaaaacatgctgcatggtttt

SEQ ID NO: 6826228 - DNA, 87 bp, Homo sapiens
gagtcttgctcttgtcacccaggctggagagcagtggcatgatctcagctcactgcaacctctgcctcccgggttcaagctattctc

SEQ ID NO: 6826229 - DNA, 63 bp, Homo sapiens
ttattctgtttgccgaccagtaagaaggtcacgtggctggagctgagtaagcaaggggaataa

SEQ ID NO: 6826230 - DNA, 88 bp, Homo sapiens
agcaaatttctaacttgactagtaggatgcatagttattttaggtgagtgcaaaagtaattgtggtttttgcattgttggaagttgct

SEQ ID NO: 6826231 - DNA, 130 bp, Homo sapiens
tgtgctaggtgctgcattggtggccttacatagtttttggctttcacagtatccatttgagagatgaggaagtgaagacttggagaagttaagttactcttgaaggttgttacatagctaggaagcagca

SEQ ID NO: 6826232 - DNA, 55 bp, Homo sapiens
agatgtagtagtgggtcttttatgaaaatataaataatgatctacaactatttct

SEQ ID NO: 6826233 - DNA, 77 bp, Homo sapiens
ggcaagtcaggaagagtagcagaggcagaggcagccagcatgtgctgccagtctatgctgctcggcactgcttggcc

SEQ ID NO: 6826234 - DNA, 60 bp, Homo sapiens
gctacacaatagcgttcacttagattttagtttaagaggaaaaaaaagttgttctgtagc

SEQ ID NO: 6826235 - DNA, 69 bp, Homo sapiens
ttcatttgtgactacggaggaaagtccaccagtgggctttctggacccttctgtgagtgaacaaatgaa

SEQ ID NO: 6826236 - DNA, 68 bp, Homo sapiens
tgagaagagaagaaagtgtctacacagaagttagtttttgtttaatttgatattttctctttacctcg

SEQ ID NO: 6826237 - DNA, 63 bp, Homo sapiens
gcttaagggaatgttgtggctggtttgatctgttcagaccaccaaaactttctccatatcagc

SEQ ID NO: 6826238 - DNA, 65 bp, Homo sapiens
ctctccagtcatattctcagtcaaggcttccctgacagtcccactactagaaagtcactgggggg

SEQ ID NO: 6826239 - DNA, 61 bp, Homo sapiens
gttcacatcacttcactgaaccacccaagcaaggatcctgctggtttagtgacatgagaac

SEQ ID NO: 6826240 - DNA, 66 bp, Homo sapiens
gagagtggaagaaaactgaacacaggtgccagcttctctgacttaggttttatttcctccaatctc

SEQ ID NO: 6826241 - DNA, 68 bp, Homo sapiens
tgtgaagcatacagtaggtgctcagttaaggctgatttcctaattgagtgactgctgcatgtcaagca

SEQ ID NO: 6826242 - DNA, 80 bp, Homo sapiens
gactgaccttggttggaatcctgcctctgctacttaaaagctaagtgacattgggcaggtttccttaatctccttcagtc

SEQ ID NO: 6826243 - DNA, 70 bp, Homo sapiens
ggtttgtccagagaagtcattacttcattgtagatttaactgtggggcgatgctttatttggttcaaact

SEQ ID NO: 6826244 - DNA, 69 bp, Homo sapiens
aagagagagaacaattgagtttctgagggttttccaggtcctgtgaaatccagctcaattctcttcctt

SEQ ID NO: 6826245 - DNA, 106 bp, Homo sapiens
catctattccctagtgcagggttaccattagcaatctgcaatggctgtcacagagctgtgtgatcagccggtggtattctatatgaccagagttgctggggagatg

SEQ ID NO: 6826246 - DNA, 130 bp, Homo sapiens
catcagtatcacttggtaatttgttagaaatgcaaattcttggccctcaccccaagcctggtaaatcagaagctctggaggttgagcccagcaagctgtagtttgataaaaccttcaagtgattctgatg

SEQ ID NO: 6826247 - DNA, 75 bp, Homo sapiens
aaagagaaaagacatgcacctggaaaaaaatgttagccactgtttatctccagagctgtatgatttttttacttt

SEQ ID NO: 6826248 - DNA, 88 bp, Homo sapiens
tttttcactacgcttgagctcctacttattccagcaatgctgccacatgctgtgtgggagcaaatgactgggagatccgagtgaagaa

SEQ ID NO: 6826249 - DNA, 93 bp, Homo sapiens
gtccgggttgagtcggcagcgtcggggccgtccgtcttggcagatgcagagctggcagtcggccttgatgcgttgcccaggccagtagcgggc

SEQ ID NO: 6826250 - DNA, 55 bp, Homo sapiens
accacaaacttagtggtgcaaaggtacacaaatttattatcatgcagtttgtggt

SEQ ID NO: 6826251 - DNA, 130 bp, Homo sapiens
tggagcagaggatgctggtacaaggggaatctggtttgagagtgtgagcttttccagggggataaaggcaacagcttcttgtataatgagattgacttttaaattgaaagtgctagtgcttgtgctgcgg

SEQ ID NO: 6826252 - DNA, 96 bp, Homo sapiens
tttatccaaatctactctttgcagattactggactgattccattggatgtaggtaaatgggatggagttggggtctgcagagttaattaagataga

SEQ ID NO: 6826253 - DNA, 60 bp, Homo sapiens
gaggggctcctttgtgctgcgtccactgcatctgcggcagacattgcatggtggcctctt

SEQ ID NO: 6826254 - DNA, 89 bp, Homo sapiens
tgttcctcttgacatctctctaaagagacatgtgtagaaacttgtactacacagggaaaggtctcagagctgtcagtactgaaggaaca

SEQ ID NO: 6826255 - DNA, 56 bp, Homo sapiens
agacacttggcagagagctgttggagcaggccagcggtgagatcattcgcgtgtct

SEQ ID NO: 6826256 - DNA, 94 bp, Homo sapiens
gcttctgaccacgtgatctcaggcactgctttctgatatgtgatgctcagtccatgtgtcatatgtgcagcacttgccattactgcagagaggc

SEQ ID NO: 6826257 - DNA, 66 bp, Homo sapiens
ctttatttgcctccagaagggctagaagcaaaccccatctgcattcccaagggaggcaggataagg

SEQ ID NO: 6826258 - DNA, 59 bp, Homo sapiens
atttaagcctgggtactgtgtcacccgaagtcttcaggcacattgttccaggtttgggt

SEQ ID NO: 6826259 - DNA, 56 bp, Homo sapiens
tagcagtgatagtagaaagccaggaccccaaatctttggccagctgtctcctgcta

SEQ ID NO: 6826260 - DNA, 56 bp, Homo sapiens
gcacatgtcttattcactgttatgtcctgttggatacacagtgcctaacacagtgc

SEQ ID NO: 6826261 - DNA, 57 bp, Homo sapiens
tgctctggagggtgaagcttttactgccaacgaatgtgtctgggcccctctagggca

SEQ ID NO: 6826262 - DNA, 86 bp, Homo sapiens
aatacttcacgatgatgcatccgttaataaaaagacagtgtgtatgaagcaaactgttattgtgaacgggcaatggtgagagaatt

SEQ ID NO: 6826263 - DNA, 59 bp, Homo sapiens
tccaaagagcttaggagagaaatggcataaaccttaaattctctactcagcttttagga

SEQ ID NO: 6826264 - DNA, 100 bp, Homo sapiens
gtgcttcccactctttagcatggatcagaatcccgggagggctgtgaaacagccaccacacctcaccctcatttctgattcagtgggtaggggtgagcac

SEQ ID NO: 6826265 - DNA, 65 bp, Homo sapiens
tactttgtataagacaataaagaaatccaagctatgctaagaccgtcttgtgtctgtgcagagtg

SEQ ID NO: 6826266 - DNA, 130 bp, Homo sapiens
tatgagttctattttacctgttctggttcaagggctatatgagtttcccacttctggaaaagataacattttctagaagtgtaaaactcatatagcccttgattcatgcttttctgtggaatccaatttg

SEQ ID NO: 6826267 - DNA, 59 bp, Homo sapiens
tttggcggggcaattctgaagcagcttccacgtgccttctcagaagctccccagctaaa

SEQ ID NO: 6826268 - DNA, 61 bp, Homo sapiens
agaagttctggagacggaagtgtcagcagggttggctgacacttccgtctccaggatttct

SEQ ID NO: 6826269 - DNA, 57 bp, Homo sapiens
ttccactttccctgcctgggtactcacaccttgtgtgcccatgtgggaggggtagaa

SEQ ID NO: 6826270 - DNA, 56 bp, Homo sapiens
aatgttgacgttggccagggcctttccaaacaagccaggccaaaaggttcaacatt

SEQ ID NO: 6826271 - DNA, 61 bp, Homo sapiens
tttctctggcctcagtttaacaggatttgccatattttggtgaacaatgaggtgagagaaa

SEQ ID NO: 6826272 - DNA, 129 bp, Homo sapiens
agttgtgggaatgagatagtttggatgctgtccaaaatagcatgaaaggcctttgatccagttttcagtagatttgacattattatggcagtaacttggaactattttattgtgttcagccagttaact

SEQ ID NO: 6826273 - DNA, 68 bp, Homo sapiens
cacttgggataaggtatgtgaagtacttagccaagggcttggtacatggccctccttgtcagcatgtg

SEQ ID NO: 6826274 - DNA, 90 bp, Homo sapiens
tagatttggaaggtgctgaaactggtcaattaatctggatactcagatgacttttaggttcattttgatttttcagtccttctgactctg

SEQ ID NO: 6826275 - DNA, 61 bp, Homo sapiens
tagcatgtagtcatagagtttgtgtgtatagtgtgtacatatatagcgtgtctacatgtta

SEQ ID NO: 6826276 - DNA, 123 bp, Homo sapiens
tgtaccacagctcacttgtgatgagatggggaaacaacaaagtatctatgaatggttatgtctcagtttctgttcatcgtactgttggtttcctgttctctttatttaactttttaggttgca

SEQ ID NO: 6826277 - DNA, 122 bp, Homo sapiens
gtggggatctccttcctctgagatcagccatgcaagacccagaaatcattagccccactcttaagggtctggtgatttctgggtcttgcacggctattttttggaggatggtggagctccac

SEQ ID NO: 6826278 - DNA, 67 bp, Homo sapiens
cagtctcctgttatcactttgaggaagatttgatatttctcaaaattcagtggtatcagtaaggctg

SEQ ID NO: 6826279 - DNA, 100 bp, Homo sapiens
cacctcttggctcgtggagactgccagaatgtgaggcctgcggctggggctcatcttgctgatttgggcttcccgtcactggcagctcccacagcaggtg

SEQ ID NO: 6826280 - DNA, 88 bp, Homo sapiens
ctgcttatcaggcggctttgtgcctttaaggggagctgagtggtgtgtacatgggtctctgaaaggcggaaatctgcaagatgtgcag

SEQ ID NO: 6826281 - DNA, 55 bp, Homo sapiens
cctgggggtgtgctatgatctgtgactgggcatttcagaagcatgccctcttagg

SEQ ID NO: 6826282 - DNA, 58 bp, Homo sapiens
tttacagttccatgtgataggcacggtgggctggggccggatcaggggagtctgtgga

SEQ ID NO: 6826283 - DNA, 124 bp, Homo sapiens
tggatgaactaatgaagtatatatctttgagcttacaattctgagagaaatatttgcccatctgtcccactagatgacaaactctttgagaacaaggactgtgtctcttatctcagtttttcca

SEQ ID NO: 6826284 - DNA, 61 bp, Homo sapiens
acaaaatagatataatgtgttgaatgttgactacattctggccactttatttctgttttgt

SEQ ID NO: 6826285 - DNA, 66 bp, Homo sapiens
ggctatttgatggttctaaaacagcttgtagttaagctgtggggagagaacacacaagcagtagcc

SEQ ID NO: 6826286 - DNA, 60 bp, Homo sapiens
aggggagcgctcctgtatgtgtgtgtgtcttgcatctgtgcacatgctgtgtgtttctct

SEQ ID NO: 6826287 - DNA, 76 bp, Homo sapiens
ttggcagcaaatattgtcagctgtttccttgaagtgacagactcacttatttcatatttgagaaaatttctgccaa

SEQ ID NO: 6826288 - DNA, 70 bp, Homo sapiens
catgcagttcacattctgaagttttgaaaagccctgttcctgggggtagagccagggtggacactgtatg

SEQ ID NO: 6826289 - DNA, 64 bp, Homo sapiens
tgcattgatcatatccttcctgggctccactttatcatccttctgggctaggtggtcagtagca

SEQ ID NO: 6826290 - DNA, 69 bp, Homo sapiens
cggcccatggtggcttggaccagtcacagtggtccgggggcccagatgaggtctgagcagagtggggtg

SEQ ID NO: 6826291 - DNA, 58 bp, Homo sapiens
agctgcagagacagctgccgatgctccgggggcaggtatcagtgttgtctctgcaact

SEQ ID NO: 6826292 - DNA, 61 bp, Homo sapiens
ggcactagcttttcccagcctcacttgcagcttggcaaaggctcatgaaccaggctcggcc

SEQ ID NO: 6826293 - DNA, 70 bp, Homo sapiens
tagagagtgaggcttttggatgaactgtaagtgacttctatatagattcttgaaccagtgcctctcacta

SEQ ID NO: 6826294 - DNA, 112 bp, Homo sapiens
caggtgagttttgtgaaatgtaggtagaaggtaagtttattctctgggagtgaggtgtcagctcctggatgaggcttatgtgacttctccaattgcattcacaggaattctg

SEQ ID NO: 6826295 - DNA, 75 bp, Homo sapiens
agccatactatattaggggaaggatagggagaaaagcagaaacagtctccttatgctactagaaataaaatggct

SEQ ID NO: 6826296 - DNA, 62 bp, Homo sapiens
acaaagaccatgtggcctgaaaagcctaaaatgttgaggctttaaaatatttgggtctttgt

SEQ ID NO: 6826297 - DNA, 107 bp, Homo sapiens
agaaagctgtcctattataaatctttgcatacatgagaatgtctttgttattttaacatgcaaaagacaattttgagtatgcacacaatttgagggccacaatttct

SEQ ID NO: 6826298 - DNA, 65 bp, Homo sapiens
ctctgaatgaagttatattggcagcgctacgtttatcacattggccactgtagactcattctgag

SEQ ID NO: 6826299 - DNA, 72 bp, Homo sapiens
ttctgggtttacatctgacttctgattgggttcttatccgttaaaaaagttaaaatgtcaattagcttggaa

SEQ ID NO: 6826300 - DNA, 81 bp, Homo sapiens
agtgtagagattcagcagaggtggttcacattgtaagtaatacttatagttactcatgatcttatggcttactcctacact

SEQ ID NO: 6826301 - DNA, 61 bp, Homo sapiens
ggaataaacataaaagaacagcagagacacattcttgctagttcttaactgttatgattcc

SEQ ID NO: 6826302 - DNA, 95 bp, Homo sapiens
taaaatgaatatgacatatttctttcaagggcatgaattatattcggtagacaagtttccacattcagtttttgaagggaaattcgttcatttta

SEQ ID NO: 6826303 - DNA, 98 bp, Homo sapiens
gtgtctctctctgtgtcctgccagtggttttaccctatggtaggttacgtcatgctgttctaccacagggtagaaccacggacaggataccggggcac

SEQ ID NO: 6826304 - DNA, 69 bp, Homo sapiens
ctgacttgttaactctcaaagaacatgactctttgtgtttagcatgttttctgatggttaatgagtcag

SEQ ID NO: 6826305 - DNA, 84 bp, Homo sapiens
gctctctacctccatgagccctcttcccattttattcctcacttgaaatagtctgagatatggggcattgggtggtaagggagc

SEQ ID NO: 6826306 - DNA, 56 bp, Homo sapiens
ggtctggaagcgcagtaggctggtaacccttctccagtactgtggctcttcaggcc

SEQ ID NO: 6826307 - DNA, 78 bp, Homo sapiens
ttggaagcttgcatcagttgagagaatggtagtttaatatattttagtctatcgcctctcacacgtgagataatccaa

SEQ ID NO: 6826308 - DNA, 77 bp, Homo sapiens
cagtctgtgctgcagtcgattcttatagtgattctatgcagaagttactttagaggaggctgctggggcgcagggtg

SEQ ID NO: 6826309 - DNA, 66 bp, Homo sapiens
ctgagggagagaagttatacaagattttatcaatttccagtggcatcatgtgcttctctcgctcag

SEQ ID NO: 6826310 - DNA, 112 bp, Homo sapiens
gggaccagccagagaccagattgtgaggtaggcttatttcacccattgtgtcccctcaccaggggtctaggcttgctgcagaatctgcccatgtccacaattggcggctccc

SEQ ID NO: 6826311 - DNA, 70 bp, Homo sapiens
ggagattggcattgctgcacctgagaaagcttccaacacttgtggactcatgtgcaaaagtccaaattct

SEQ ID NO: 6826312 - DNA, 80 bp, Homo sapiens
ctcccttctgagttgtaaagctgagaaagaggtttggtttgtaaggccaaaccattaggttttatctactcagatgggag

SEQ ID NO: 6826313 - DNA, 68 bp, Homo sapiens
ttgctagtagtgtgtaggagaaccagtggtgcacaccttctgggcagttttacatcattgcatagtag

SEQ ID NO: 6826314 - DNA, 83 bp, Homo sapiens
tcagtaagaaagaggagagatctggccaaagaaagctcattttcctgttttcagtcaggaggatctctcacattggttattga

SEQ ID NO: 6826315 - DNA, 64 bp, Homo sapiens
ggtaatgagtgctatccctggagccttagaagatgaccttttggctttttggcactgatagacc

SEQ ID NO: 6826316 - DNA, 55 bp, Homo sapiens
ttggaggattgctctcagcccagtacaactgttcttctactgagactttctccaa

SEQ ID NO: 6826317 - DNA, 65 bp, Homo sapiens
acatgatattaatgtcttatttttcttaaacacttgttatgcggattaagtgagatattacatgt

SEQ ID NO: 6826318 - DNA, 82 bp, Homo sapiens
tgatggacaggccctctcggatgttggcagggggccccttctctgagtaggccctcttgatatccagcggcacccgtccaca

SEQ ID NO: 6826319 - DNA, 69 bp, Homo sapiens
ggtgctgtgttaggctttttctcatgtcatcacatcaacctctcagtgagccagctatcacacagcatt

SEQ ID NO: 6826320 - DNA, 70 bp, Homo sapiens
ctattgcccagatattagcatgcatatgaatcacctggggctcttgtaaatgcagattctgattcagtag

SEQ ID NO: 6826321 - DNA, 57 bp, Homo sapiens
ttgtctaaggaggtagaggacttatgcaactgcaatcattttaccttccttagtcaa

SEQ ID NO: 6826322 - DNA, 114 bp, Homo sapiens
gtgcaataatttttaaggacgtatgaatatggagtttacttagtgtaatatttgtgttacacccacaaaaaattccaaattgcagatgttttataccttaaagctctttgtcac

SEQ ID NO: 6826323 - DNA, 80 bp, Homo sapiens
gggaagggagaagaaaagagaaggagggagaaatatgtaaatgacccgattagtcttcacctctctttgggtctgtttcc

SEQ ID NO: 6826324 - DNA, 129 bp, Homo sapiens
ttgttgttttcttcatttttgtaggcactgcatttatgttgttagacccactgcccgaaacacttcccagtaaatggtcacaataagtcagcaaatcagtccaaaaacacattagataagagacaaacg

SEQ ID NO: 6826325 - DNA, 112 bp, Homo sapiens
agcttttgtatcaaattacagatctggggcacagtgcatctcagtgaagaatcccattttccatcagtttagatgcatttgtcgtactgtcaaggggtaaaatattaaggct

SEQ ID NO: 6826326 - DNA, 69 bp, Homo sapiens
ccaatgcctgctttaagaatgagtgtaagacttcatcccagcaaacagtcttgaagcaaagtctgttgg

SEQ ID NO: 6826327 - DNA, 76 bp, Homo sapiens
agtggttgagtgcatatgcatgagatttggttctgcatttatttcggatggtctcatgtcctatgtgcttatcact

SEQ ID NO: 6826328 - DNA, 74 bp, Homo sapiens
tgagttccccaaaggaggtagtgagttaaacagatgctgcggtgtctggcttatctcagctgctgggttaatca

SEQ ID NO: 6826329 - DNA, 79 bp, Homo sapiens
cctgtttctctgaggctggcctccctacggggctgcagcagcaaagggaagccaagccttagagaagcctcatggaagg

SEQ ID NO: 6826330 - DNA, 60 bp, Homo sapiens
gcttggaaaataaaagttcaggactctgtttttatagctacagtcttgtatttttcaagc

SEQ ID NO: 6826331 - DNA, 61 bp, Homo sapiens
gcagaggccatttgcttggagaactttaagagattttattcatcatgtggatggcccatgc

SEQ ID NO: 6826332 - DNA, 85 bp, Homo sapiens
ggagtcaaagtgggtgccctgatgctccaagaactcctcaggggtggcgcagagggtagagcactcaggacactcatagggctcc

SEQ ID NO: 6826333 - DNA, 106 bp, Homo sapiens
ggcagatttcaaaggttgcaaagcttaaggccagactctggaatgacaaattcctatatgtcatctacccgttaggctttaagaaagccagctgactagcctgacc

SEQ ID NO: 6826334 - DNA, 63 bp, Homo sapiens
ggtttcaaacatctgacttgctttttcagggtctagatcttgaagattcagtgcttgaattcc

SEQ ID NO: 6826335 - DNA, 82 bp, Homo sapiens
tagggagtcgacggggtgatggctgatgaggccttcaaccctaataactgctttatcatcactgtaatccgttgagttctta

SEQ ID NO: 6826336 - DNA, 68 bp, Homo sapiens
aggattttaagatggtttgtaggtcttggccctccagacagtgagtttgcaagcctctgtgagattct

SEQ ID NO: 6826337 - DNA, 64 bp, Homo sapiens
tagaagttggacttgttggtacagtcatgcctctgaagggggcatttggtcaaggacaactctg

SEQ ID NO: 6826338 - DNA, 55 bp, Homo sapiens
tctggtccatcttgttagctgtccactccctttccagcaaacaggctccaccaga

SEQ ID NO: 6826339 - DNA, 70 bp, Homo sapiens
ggctccctccccagggtcatattgaaggagagagacatccctgcaaagtaaaactcctggggagcctgtc

SEQ ID NO: 6826340 - DNA, 104 bp, Homo sapiens
ttgagacagagttttgctctttttgcccaggctggagtgcaatggcgtgatctcagctcattgcaacctccgcctcccaggttcaagcaattctcctacctcag

SEQ ID NO: 6826341 - DNA, 59 bp, Homo sapiens
tggggggagccagaattcacaatctgatttttctgattccagagtctgtgttctttcca

SEQ ID NO: 6826342 - DNA, 92 bp, Homo sapiens
cccaaccccacccctccccgcagcctggccaaaggccccgggccccggatgcggcctgaccttcgggcgggctgcggcggcgggagggaggg

SEQ ID NO: 6826343 - DNA, 59 bp, Homo sapiens
gagatgtcttcagatggcaagagaaagggctaaatctaatgcttgactgggggcttctt

SEQ ID NO: 6826344 - DNA, 62 bp, Homo sapiens
tggccagtgtttttcctgggctggcatagccttggtcagctagagctgagaagcacttgcca

SEQ ID NO: 6826345 - DNA, 56 bp, Homo sapiens
gagcagacactgttcccgtttccctccaggggtgtctagagggaatgtgtcttctc

SEQ ID NO: 6826346 - DNA, 77 bp, Homo sapiens
caatggaagagtaaagtgcagaactgttctcactaatgaactttagtgagaaatgtttgtttttacttttgccagtg

SEQ ID NO: 6826347 - DNA, 68 bp, Homo sapiens
ggccaaatctgtaaggcaagatctgcctacgatggcataaataatggtgtgtatttgcagtttaggcc

SEQ ID NO: 6826348 - DNA, 71 bp, Homo sapiens
ggcatgccatggcaggaaaatgaacaggcgctgtcagagagccagcttggcagggcctgctggagcatgcc

SEQ ID NO: 6826349 - DNA, 129 bp, Homo sapiens
gggcttgtccatgaaatccctaaagctgtgggtcaaatgtgtaaggtcaggacattttagaagggaaagagtgttactgtgttctgcacagcattcgtgacccatagaaggttacaacacacccagcct

SEQ ID NO: 6826350 - DNA, 79 bp, Homo sapiens
gaggggcacctctccccgcagctgtctatgtgtgggggcacctctccccgcagctgtccatgtgtggggggcgcccctc

SEQ ID NO: 6826351 - DNA, 58 bp, Homo sapiens
gaccccagtgagggggtgggtgcaggtttcagcaacatgccaggcctgagctggggtc

SEQ ID NO: 6826352 - DNA, 62 bp, Homo sapiens
cggcagcttgtccttcaggagagctttattaaacaaggcactctgagaagtacaagctcccg

SEQ ID NO: 6826353 - DNA, 90 bp, Homo sapiens
gggagtacatgtggggtgtatgtgccttacattttatttctacatgtgggggtgcatgtgtgcgtacatgcttgtggccgcacaactccc

SEQ ID NO: 6826354 - DNA, 55 bp, Homo sapiens
aggagtgggtggcagggttgtagtgctaagtgcaccattctttacacttatttct

SEQ ID NO: 6826355 - DNA, 74 bp, Homo sapiens
agcagtgtccctagtccccggatcctgtccagctgagcgtagacggcagtagccagggactggcagcacaggct

SEQ ID NO: 6826356 - DNA, 78 bp, Homo sapiens
cgtgtcagatttggcagtataaattctggctatattttttgttgttagatttatttggctgttaagtattgcgatatg

SEQ ID NO: 6826357 - DNA, 57 bp, Homo sapiens
ttcctgggccttaaatcttttgggtttggggtgcccttttagatcaggccctaggga

SEQ ID NO: 6826358 - DNA, 56 bp, Homo sapiens
tcctcactgtgaccataggtgggtactgttatttgtttgcattttacatgtgggga

SEQ ID NO: 6826359 - DNA, 65 bp, Homo sapiens
agtttctttctggtctgtggactataatgggtacagttcacctctccacaagttagaaggaaatt

SEQ ID NO: 6826360 - DNA, 88 bp, Homo sapiens
ggggtctcactctgtcacccaggctggagtgcagtggcgtgatcttggctcactgcaatctccgtctcccaggttcaagtgattctcc

SEQ ID NO: 6826361 - DNA, 75 bp, Homo sapiens
cacaatcagaaagacccaatggtatttggcaatgaaaagttttatacaggaactgttggctcccttttgtctgtg

SEQ ID NO: 6826362 - DNA, 78 bp, Homo sapiens
ccggccaccagccacctttgcaaaccaaatctgagctgctgccagtcagagactggtctgcagatgcctcttggctgg

SEQ ID NO: 6826363 - DNA, 62 bp, Homo sapiens
agtgcttgctttgccaccagaagtctatgctgtagctataacttcgtgggcaaatgcacact

SEQ ID NO: 6826364 - DNA, 59 bp, Homo sapiens
attcagactcttgagcagtcccgttctacattgaatgtgactgatcctgtgatttgaat

SEQ ID NO: 6826365 - DNA, 58 bp, Homo sapiens
gtcttgaataagtttcatgagctgccttatgcattagctcttgtttttgtttaatgac

SEQ ID NO: 6826366 - DNA, 80 bp, Homo sapiens
cccgaggccatgcagcagctacttgggaaggaaagagtgaccctcccattcctacccaaagctttggatgcatcttaggg

SEQ ID NO: 6826367 - DNA, 91 bp, Homo sapiens
ggagcccagagctgggtctgctggtgcctggcctgcggcagctgcttacacaacagtgcatcagcaggtgctcccagggcttctgggctcc

SEQ ID NO: 6826368 - DNA, 69 bp, Homo sapiens
cactctactttctcaggaattcacagacctcgggcaccgcctcgactgtctggacctgaaaggtgtgtg

SEQ ID NO: 6826369 - DNA, 123 bp, Homo sapiens
ctccatccctcctgctaagaatccaagttcacttcctggttctccattctaggggcttgtttctcacaacctctgacctctgagagagaagtgaattttgagcttcagggagggaactcagag

SEQ ID NO: 6826370 - DNA, 59 bp, Homo sapiens
cttcagttagccaattcaggtcctagggtctatcctcatgcctgaatgcttaactggag

SEQ ID NO: 6826371 - DNA, 101 bp, Homo sapiens
tgaggcaggagaatcgcttgaacctggcaggcggaggttgcagtgagccgagatcatgccactgcactccagcctgggcaacagagcgagactctgcctca

SEQ ID NO: 6826372 - DNA, 88 bp, Homo sapiens
ggcaggggagagggagcgggccagccttacagagcaccccctgcagcttgagggatctgagctggagcccatcacctctgttactgcc

SEQ ID NO: 6826373 - DNA, 55 bp, Homo sapiens
ggtccctgctgaagccttggtgtttgggtcctgatacctttggcccaaggggtcc

SEQ ID NO: 6826374 - DNA, 127 bp, Homo sapiens
cacgatgaagatgagagagttgaaatgagttttggctgtatcctggttttggagagttacggaaggattttaacaagggaatgatacaaacagatttggtttccaaaagacactcttaggcattgtg

SEQ ID NO: 6826375 - DNA, 79 bp, Homo sapiens
tttatctcatttaattccaaaatattaatccagtcagtcattctcttgaatagggttagttggtagttaattgaataga

SEQ ID NO: 6826376 - DNA, 67 bp, Homo sapiens
gtgttagtaaagctgtttctccaccgtctttttattctagggcgacaatgacgcagtttacttttac

SEQ ID NO: 6826377 - DNA, 80 bp, Homo sapiens
gcaagaggatgaaagtgctcggcgctggtcccaggtaaagttatgactctgggcaggtggtctgaggattgcccatttgc

SEQ ID NO: 6826378 - DNA, 60 bp, Homo sapiens
tggttcagaattgtggagaaaggggagctgtgtttctctgcctcacaggtctaagcacca

SEQ ID NO: 6826379 - DNA, 99 bp, Homo sapiens
gccagctctagttgtcaccttgtctgtgggaggattcagaattgggaccaaaaattgttgtagcctcatttatcttccccaggtaccatgccagctggc

SEQ ID NO: 6826380 - DNA, 59 bp, Homo sapiens
gtggagtgggttgtactcagggagtgtagttggaagcacttgcctggcaccagctccac

SEQ ID NO: 6826381 - DNA, 97 bp, Homo sapiens
gagtgtatcctctagatctggtgggcactagaatcccttcaagaagccctgggtgaagggctccagattctggatgactgggttttctggatgactc

SEQ ID NO: 6826382 - DNA, 111 bp, Homo sapiens
gcagctggtggggatgttgttagcatttggggggtgttttctgaggaggaacagactgtgtccctggcaaaacactctcttgagggccagcagacagaaacttccatctgc

SEQ ID NO: 6826383 - DNA, 84 bp, Homo sapiens
ggcagaatgattcagcttcactctgaatgatcgtctcctctttgtgcagacagatgcatgtatggagtgagggtgttacctgcc

SEQ ID NO: 6826384 - DNA, 93 bp, Homo sapiens
aagttaagtaagaggcagtagccattcagagtatatgtctaatttcagcttcttccttatattctttgaaatactgttttgcccccttaattt

SEQ ID NO: 6826385 - DNA, 57 bp, Homo sapiens
ggggcatcagaaccctgtgggaaagattaatcttgcacacttgggagctggtacccc

SEQ ID NO: 6826386 - DNA, 60 bp, Homo sapiens
ggtggctcgtttttcttgaaaggctaagtaactaatgccttttattgatgaatggccact

SEQ ID NO: 6826387 - DNA, 91 bp, Homo sapiens
gcatctggggacttgtaagaaatgcagaacctgagaccatacctcgcacctaatgaatcagaatctgcattttaactaaacctctaggtgc

SEQ ID NO: 6826388 - DNA, 60 bp, Homo sapiens
cctggccccattgcctgtgtctgccttcaccacctttagcttcacaagcagtggccatgg

SEQ ID NO: 6826389 - DNA, 88 bp, Homo sapiens
ggaatcaagctgtatgatttggttgcaggaagcaattgcctaaaaagcagttatgtcctcagcaaatcaagagcccttgaacatttcc

SEQ ID NO: 6826390 - DNA, 59 bp, Homo sapiens
ggagctgaaccccatcgtgctgctgctggacaacaagtgaggctcctggggctcagccc

SEQ ID NO: 6826391 - DNA, 72 bp, Homo sapiens
gtgccaaaaccatactgggtactttgtgtctattatctaatttaatgttcacaaagactctgtaagtggcat

SEQ ID NO: 6826392 - DNA, 83 bp, Homo sapiens
ccagggaagaggcctttgggcaacatcccaattcattacagctagaaaagaagaagggctgcttttaagggtctcagctttgg

SEQ ID NO: 6826393 - DNA, 55 bp, Homo sapiens
tcttatatgtaagttcccctgggtgagaaaacccagccaggactcccatttagga

SEQ ID NO: 6826394 - DNA, 63 bp, Homo sapiens
gcaggggcagcagctgaggaatgaaactgggaaggagcctgggaaccctgttgttgcctttgc

SEQ ID NO: 6826395 - DNA, 57 bp, Homo sapiens
ttgttttggtaggactgtaaaagacctgcatgcaaggtctccattcctacaaatcaa

SEQ ID NO: 6826396 - DNA, 74 bp, Homo sapiens
cattgctaagttgtactccattttgtaggtatgctacagtttatctgtttacctattgatggacatttgcattg

SEQ ID NO: 6826397 - DNA, 60 bp, Homo sapiens
tctcaggctgtgtgtggaggactcaggttcctggtgaatccttctacactgcctctgaga

SEQ ID NO: 6826398 - DNA, 85 bp, Homo sapiens
tccagcaaagggaacagacatctatccatttaattaagctctgctaagatgctttgagttaaattgtgtatgtttgtgtgctgga

SEQ ID NO: 6826399 - DNA, 100 bp, Homo sapiens
ccagcacctcaaattatttaggcttgcaattaggatggaaagtggacaaatgccacattccatcctatttgtatgcctaaataatgtgcaggggtgatgg

SEQ ID NO: 6826400 - DNA, 78 bp, Homo sapiens
ggcctaaggcccagattttgttctgtttgtaccctcctgggtggtggcacaagggagagaatctgaggtctttcagtc

SEQ ID NO: 6826401 - DNA, 68 bp, Homo sapiens
tctcgcatgtacacaccatgatttatttacccattccactgttgatgggcactggggtgatttgcaga

SEQ ID NO: 6826402 - DNA, 73 bp, Homo sapiens
ggttcttaatgagtgcctaactgtcagattcagatatgacagaagaatcactaagctaggctactttggaatc

SEQ ID NO: 6826403 - DNA, 91 bp, Homo sapiens
tgaatattaggttggtgcaaaagtaattgtggtttttgctgttatctgcaatggcaaaaaatgcattacttttgcaccaacctgaaattta

SEQ ID NO: 6826404 - DNA, 65 bp, Homo sapiens
gagccctcttctgatgccagtaaccatgatgactcaacacggtcacccatcagagtccagggctc

SEQ ID NO: 6826405 - DNA, 81 bp, Homo sapiens
gcatgtacatgttttatgtgtgtacatgcatatgtgtatattatgtatgcatgtgtacatatggtatagatatgtgggtgt

SEQ ID NO: 6826406 - DNA, 99 bp, Homo sapiens
ttccctttcagctgcgttcctgaattgctagcgcaccaattctgctttactgaccacaattggtgcagctgggatggcgaaggagcaactgaaaaggaa

SEQ ID NO: 6826407 - DNA, 89 bp, Homo sapiens
ggtcaaatgtgattaacttgcaggggagaggaacaaacagggccagtttcccttgtagtctcatactttgtttgtgtaatcaattggcc

SEQ ID NO: 6826408 - DNA, 62 bp, Homo sapiens
gtccaggagagctctcgttcagtgtgcggaagaacactctgacctctagagctgtcctagat

SEQ ID NO: 6826409 - DNA, 121 bp, Homo sapiens
tagcctcacttgggaagattcttcaaacacagatgaccaggctccacccagaggaatcaaatcagaatcactgaggtggggcctgggcatcagtgttttttaagttcctcagatgaggcta

SEQ ID NO: 6826410 - DNA, 91 bp, Homo sapiens
ctgctgggtcaggagtcctgcctgcagccttcatccagtgcatgttgatggagcacgggatgcatggcaggtgctaatctcagatctgcag

SEQ ID NO: 6826411 - DNA, 109 bp, Homo sapiens
ccatgttagccaggatggtctcaatctcctgacctcgtgatccgccctccttggcctcccaaagtggtgggattacaggcatgagccaccacgcctggcctagcatagg

SEQ ID NO: 6826412 - DNA, 109 bp, Homo sapiens
tgctcttcatctaatcattgtctgaattactgaaggtcaacttatctgataaaataggtgagctttgtggtaatgaagtcagataatgtcttatattcgtgtcagggta

SEQ ID NO: 6826413 - DNA, 60 bp, Homo sapiens
ccagattgggtactgtgtgagatcactgcccaacagagggaacatggctctccagtctgg

SEQ ID NO: 6826414 - DNA, 81 bp, Homo sapiens
accttggggaagttacttctttgtgcctcactttcctcttctgtaaaatggggttaataatagtaactcccccacgtaggt

SEQ ID NO: 6826415 - DNA, 90 bp, Homo sapiens
tcctgttcatatgaaactctagagcagacacaactaatctaccgataccgaagtaagaatagtgtttgcctttgggagatattgactaga

SEQ ID NO: 6826416 - DNA, 58 bp, Homo sapiens
tagatgaaatttgtgtgtatgcatgtgtgtgtgcgtgcatatgtatatgatttctctg

SEQ ID NO: 6826417 - DNA, 86 bp, Homo sapiens
gttctgtgtgtttcaatctcacatcctcagtagtgcaagccctgttctatttatggtgtttgtgagtgaggttaacacttgtatgc

SEQ ID NO: 6826418 - DNA, 92 bp, Homo sapiens
acagagctgacatttgttcatttgtattgattttatttacatttttcaaaaggaaatagatgcagatggtatagaaagtttcagtgaaatgt

SEQ ID NO: 6826419 - DNA, 63 bp, Homo sapiens
cagagagtgggcctcagagatccatttgttcatgccagatttcaatctcaaccctactctctg

SEQ ID NO: 6826420 - DNA, 61 bp, Homo sapiens
cgggagggtgtacgtgtgtgttcccgggttgttaccttgcacacccacttatgcccgcttg

SEQ ID NO: 6826421 - DNA, 120 bp, Homo sapiens
cgagactcccattcagcccacaccctcatgtaggcacagcatctgagcacctggcttgtgggacatcacacctcacacctcgcatgctgcgtcgctcagggtgggagcagggagatttcg

SEQ ID NO: 6826422 - DNA, 62 bp, Homo sapiens
cctgcttcaccaccagaagggcaccaacaggagtgattcagagcatggtggctggagtcagg

SEQ ID NO: 6826423 - DNA, 59 bp, Homo sapiens
catgcagaaggtcaaagcaagatgtatcatcctactcttagtcaggacctttctgagtg

SEQ ID NO: 6826424 - DNA, 75 bp, Homo sapiens
tgaggtggcttttgtatgattataaagttttaacagtttaaattgagagaacatttgtcaaaaagccaacattca

SEQ ID NO: 6826425 - DNA, 92 bp, Homo sapiens
tctttttgccctttattcaattagtcctaatgtttcagttctctaattaccaattagttaaattatggaaattggggaaagtggtaaaatga

SEQ ID NO: 6826426 - DNA, 69 bp, Homo sapiens
cgggtacactggggctctgggagtgatctcggacaaaggaatgcacctctctgagcctcagtgttcctg

SEQ ID NO: 6826427 - DNA, 101 bp, Homo sapiens
tgaacgttttttaaaaccagaaaaggaataacaggtgtcttcactgttcatttcagttggaggcatttgatgttcataatcaacattttgaaatatgttca

SEQ ID NO: 6826428 - DNA, 76 bp, Homo sapiens
cagatggaaactggtttctgagatggaacttggcagtggtacctatgttccctctcagaaatccaggttttatctg

SEQ ID NO: 6826429 - DNA, 56 bp, Homo sapiens
tctcgtgctccttctggggagaagtttgcccttttcagcccgaggtcaggatgggg

SEQ ID NO: 6826430 - DNA, 96 bp, Homo sapiens
taagtttttttcccttgcttcattagtgtcttagtccatttgggttgctataacaaaataccattgactgggtagcttatgaacaacagaaactta

SEQ ID NO: 6826431 - DNA, 77 bp, Homo sapiens
cctgctcctgtaagtctggcttatagctttctttcataactgaaggaaatgctaaatttcagctacaggttagtagg

SEQ ID NO: 6826432 - DNA, 64 bp, Homo sapiens
gtgtgcctcgccaagctgtcggcatgatgaacagcttcccttggctgagcagataacagtacac

SEQ ID NO: 6826433 - DNA, 129 bp, Homo sapiens
ctgcctgggcataacctggaaaatgcattggaggaaagtgggccacaggttgattggacatggtgctggaggtctcaccaggaaactgtgcccacgacctctgcattttttctcatcccctagatgtag

SEQ ID NO: 6826434 - DNA, 67 bp, Homo sapiens
tgtagctagtagttcagagaacagattctagaactttcaatctgtatgactttgaattctagctcca

SEQ ID NO: 6826435 - DNA, 77 bp, Homo sapiens
gggcagatttactcagctcctggaaaaaaaccaaaggcctatgctcttttctcaggacaatgggtgaatacttgctc

SEQ ID NO: 6826436 - DNA, 77 bp, Homo sapiens
actctggactgaggctgaagagggcctacgggaggccatattataacttctgtgggccctaggcaccttgtctttgt

SEQ ID NO: 6826437 - DNA, 57 bp, Homo sapiens
caggccaagtcccaagtgcggggcaagggagcaagcttcgtgctgtccttggtcctg

SEQ ID NO: 6826438 - DNA, 55 bp, Homo sapiens
caactactgtttttgcctctttagaaggctctcctttttgaggaagaataagttg

SEQ ID NO: 6826439 - DNA, 90 bp, Homo sapiens
cagggagttgctgttaatttgaagtgcaatgaggattctgaatgtttagagattcaccacatctttatgaagtaacctggcaacttcgtg

SEQ ID NO: 6826440 - DNA, 96 bp, Homo sapiens
gttcattgatgcctactctgttccaggctccattccaggagctagatgttgcaaatacattatatttcaaagggtggggccaggaaggcagtgaac

SEQ ID NO: 6826441 - DNA, 109 bp, Homo sapiens
ggttgaggagacagtctctaggtagataacttgtccaaggtcagtggctaaaaagtggcagatgtggtttgagacaggtcttcctgctctagagcctgtattctttttc

SEQ ID NO: 6826442 - DNA, 59 bp, Homo sapiens
catctttgagacagcattacccatggatactaactggatgatgtttggtcacaagggtg

SEQ ID NO: 6826443 - DNA, 73 bp, Homo sapiens
ggtaatagctctgaccaagagactgagggatatagatttctccccacccttctaaactcagagcctagctacc

SEQ ID NO: 6826444 - DNA, 81 bp, Homo sapiens
tcttagggttggggtaaggaaatatggcttctcaggattattcaagctcagaagccctgtcaccctgacttcaagctcaga

SEQ ID NO: 6826445 - DNA, 57 bp, Homo sapiens
caagagtcagttgtttatggaaagtactttttggttctgtaaacaatagtgttcttg

SEQ ID NO: 6826446 - DNA, 84 bp, Homo sapiens
aatgtgacgtctttagccaggtacttaattatttttccacattttaagggttaaagagctgagacctggtggagttaaaacatt

SEQ ID NO: 6826447 - DNA, 56 bp, Homo sapiens
agtgagttcttcctatctctgcctaacagaatgggcaatgctatgaagagctaact

SEQ ID NO: 6826448 - DNA, 65 bp, Homo sapiens
ggggattactgcacacatcgcactgcccgtgacaaagagtaatgattcagggctgtggcttcccc

SEQ ID NO: 6826449 - DNA, 59 bp, Homo sapiens
ttcccaggctgtgctaccagagaatctgtttttctctggcctggatatgagtctgggaa

SEQ ID NO: 6826450 - DNA, 69 bp, Homo sapiens
tttccgctcatctgcatgcatcttagagagagctgccctgaggtggctgatgtagcagtgtgctgggaa

SEQ ID NO: 6826451 - DNA, 90 bp, Homo sapiens
aacatggtagagccttggacagcccatgaacccaaacaatactctggtagctctgggttgcccagggctgctatactcaaataccatgtt

SEQ ID NO: 6826452 - DNA, 105 bp, Homo sapiens
gccatgattggcatgttctttttcttcgtgtgaaatgttttgacaatgcaattcatgcattgcaactgacagatcattttgaagtagttaatattgaatcatggt

SEQ ID NO: 6826453 - DNA, 130 bp, Homo sapiens
ttccaattattcatgtccctttgttattgtgctattatctttatgtttattttgtttgactgttttggtaaagacagaacaggctgagaaaaacatgaatttgaaatggtacagcgtgggtaccctggaa

SEQ ID NO: 6826454 - DNA, 58 bp, Homo sapiens
tgtattaaatagagagacagaggttatgagcccagaatctgtcattctatttcatata

SEQ ID NO: 6826455 - DNA, 57 bp, Homo sapiens
catacatttatacacatctatgtatataaatgtacgtgtgtgtggagtatgtgtatg

SEQ ID NO: 6826456 - DNA, 55 bp, Homo sapiens
gaacctgagcgggcagcaagcggttaaatatggcttccctggagggttcaggttc

SEQ ID NO: 6826457 - DNA, 81 bp, Homo sapiens
ctgatagtgtgtgttcaaggattatacaggatcgagtctccttaggagatgatgtccatgactgtgactcacatggatcag

SEQ ID NO: 6826458 - DNA, 81 bp, Homo sapiens
tctggccacatggtcatgctgagctacaaaggagactgggcaatacagcctttgttcttagtatctgtgtgcttagctgga

SEQ ID NO: 6826459 - DNA, 84 bp, Homo sapiens
gggttgtagctgtatcttcagctgaagcagagtccattggagggacattgtggacttcggtagaagaactaagccacttacact

SEQ ID NO: 6826460 - DNA, 58 bp, Homo sapiens
agaaagtcatattaccctggggccagaactcaatcagtggaatcaggtgtgacttttt

SEQ ID NO: 6826461 - DNA, 55 bp, Homo sapiens
tcccttgcatcacttttctaagtattttgaggcgtagcaaattggtggaatggga

SEQ ID NO: 6826462 - DNA, 55 bp, Homo sapiens
gatccttctcctttttcatgctttcctaaacctggtagaaaaggaggctaggatt

SEQ ID NO: 6826463 - DNA, 97 bp, Homo sapiens
cagttggggtcggtggatgtgctggtctgaggagagggagttccctgtgtgcttcctaacgccagtattttcatcaaatgagtttgacctgagagtg

SEQ ID NO: 6826464 - DNA, 75 bp, Homo sapiens
ccatagcgaggccgtggggctctgccgcccaggccaatgcctgtgatcctggccagggctcgcggtccctcgtgg

SEQ ID NO: 6826465 - DNA, 87 bp, Homo sapiens
gcagagactgaatgacatgacctggtagagacagatttgagattcaaggtcagtgttctttctacctgttatgtttttataatttgc

SEQ ID NO: 6826466 - DNA, 72 bp, Homo sapiens
tcctggtgtctgggggttctgaaagctgacttttcacctttggcaggaacttttaaccctcagagctcagga

SEQ ID NO: 6826467 - DNA, 78 bp, Homo sapiens
agagatttttaggaaatgacttggtgcttcgtttctttgggggaagtgagtgattaggtttttccttcttgggttttt

SEQ ID NO: 6826468 - DNA, 65 bp, Homo sapiens
ttcccgaaggacacctgcagagggaccagaagagcactttgtgtccttctgggagtcccagggaa

SEQ ID NO: 6826469 - DNA, 91 bp, Homo sapiens
gtaacatttgtatttcgtttttagtatagtatgtgctcaaagtgtagtactctgtagtatggtacttatttaaacgaatcactcatgttac

SEQ ID NO: 6826470 - DNA, 75 bp, Homo sapiens
cccgggcagacgtgaaggcagcggggctcggggacacccaagtcaaacgacccccggccctcgcgcctgcccggg

SEQ ID NO: 6826471 - DNA, 62 bp, Homo sapiens
gatctcttcttcatttaggaaccctgcctgccctaattctgtccctgtgtggggtagagatc

SEQ ID NO: 6826472 - DNA, 84 bp, Homo sapiens
gaaaaatttggtttgcactgtgttttttaaaaacttcaaaggtaattgccagtggagttaaaaacaggatgcacacctgttttc

SEQ ID NO: 6826473 - DNA, 129 bp, Homo sapiens
ggaagtagctgtagatgcccacacctatggcatagaggatggctgtaaattcagagatggacaactgagtccaaatcctgcacctacagttttctagctgtgccaccaggacgggttccccagcctttc

SEQ ID NO: 6826474 - DNA, 57 bp, Homo sapiens
agacacaggtgtaatttctgcttagttgtttcatgatgtagctcagtgtctgtgtct

SEQ ID NO: 6826475 - DNA, 65 bp, Homo sapiens
gcctcctggatgggctcatgactgtcaacaaattgcatcccactgcagcaccatgcagggctggc

SEQ ID NO: 6826476 - DNA, 61 bp, Homo sapiens
aggctcagaaggactcactagtgaatactgtagtagtgaacactgtatattcttcttgtct

SEQ ID NO: 6826477 - DNA, 71 bp, Homo sapiens
tttcttttgctcttgctttttctagaaagatgacaacatcctggctgttagagaggcaaggaaaggagaga

SEQ ID NO: 6826478 - DNA, 59 bp, Homo sapiens
actcggcagcctgagagttcacggggggccagcctgccttggacacagccctgttgagt

SEQ ID NO: 6826479 - DNA, 96 bp, Homo sapiens
ggaaacagtaggagaggaggggtaggcaggagccaggctgaggatttagcacctcttctggtaacctttatccctcctcattcttcctgtgtttct

SEQ ID NO: 6826480 - DNA, 77 bp, Homo sapiens
caggacttgtccaagggataagggtgggacactgagagcatcagctgcaatacccttcttccttccacagaggactg

SEQ ID NO: 6826481 - DNA, 70 bp, Homo sapiens
gctccaggcagagcctctttcgtgtgggtgggaaaatagggaaaatttcaaggaggagatgctctggagc

SEQ ID NO: 6826482 - DNA, 68 bp, Homo sapiens
gacacactgtttggactagggtttggctgacagtaaagggtataaaaggatctttcaggctgtgtgtc

SEQ ID NO: 6826483 - DNA, 58 bp, Homo sapiens
agatgcttgttccatcttaacccagagactggagaaataggcagaggagcaggtatct

SEQ ID NO: 6826484 - DNA, 58 bp, Homo sapiens
tatttctgtcagccagatatggggcagccattcttcccatttcatgattatagaaatg

SEQ ID NO: 6826485 - DNA, 105 bp, Homo sapiens
agagggtctcacaggaggtgacatgtagctagaatagaggtaagagcaagctaccagagctgactggctttgttctgattgcttctttctgctttgagatctttt

SEQ ID NO: 6826486 - DNA, 56 bp, Homo sapiens
gcagtcctcctgcctcagcctcccaaagtgctggaattacaggcaggagtcactgc

SEQ ID NO: 6826487 - DNA, 71 bp, Homo sapiens
atgtgaagtaatgcatgtattcattgtggaatggtttggccattccaaaatgtgcatgtgtttcagaatat

SEQ ID NO: 6826488 - DNA, 63 bp, Homo sapiens
ccgagcgggacacattagtcatgcacaaacaagagcagcccttgcctgactttatttgcttgg

SEQ ID NO: 6826489 - DNA, 57 bp, Homo sapiens
cagatcctgccaggctgagttgctcccactgcttctccagccactcagcagggattg

SEQ ID NO: 6826490 - DNA, 59 bp, Homo sapiens
tctttgctcttatgttactatggcttttggcagttagctttggttgaggggagtgtgga

SEQ ID NO: 6826491 - DNA, 91 bp, Homo sapiens
gtttgagtgtaagatctgaagagttattttctgatgtggctgaaaagttgtgtacgatgaaagacttaagggtttaacttacagttcagac

SEQ ID NO: 6826492 - DNA, 74 bp, Homo sapiens
tcttagtcactttgggttgtcccagcaacaggagacttaactctgaccataggtaaggagcccagaggacagga

SEQ ID NO: 6826493 - DNA, 64 bp, Homo sapiens
gctggcacacagtacacgccttctaatgtttgctgtaacagaacaaggctatgctgtggtctgc

SEQ ID NO: 6826494 - DNA, 76 bp, Homo sapiens
catgtggcatttttaatacagataactgaatgacaaagtagtaatcagtttatagatattgctgatgtcaaacatg

SEQ ID NO: 6826495 - DNA, 55 bp, Homo sapiens
aagagctttggagacaggctggctgaatctgaatcccagcttgcctcaagctttt

SEQ ID NO: 6826496 - DNA, 119 bp, Homo sapiens
ccacatttgaggcagcccgggagaggaataattatattctagtgtcagcacatcctctttccacaatggccatacacatagaaaataaatagttattttgggctgttttacagctgtgg

SEQ ID NO: 6826497 - DNA, 83 bp, Homo sapiens
gtctatagtatagatgattctgttgcttttagattctgttgcttttggaatagaattacagcttttagaatagtataatggac

SEQ ID NO: 6826498 - DNA, 77 bp, Homo sapiens
gcagtttatttaaaggttctacttttaaagaatatctaaggtattcttaggacttaggacgtttcaaagtcactagt

SEQ ID NO: 6826499 - DNA, 85 bp, Homo sapiens
gtgcaagaggagatacttggtaggcaaagtgtgggtcacctggtggttttgacctcgagttctttcaattcactcatccttgcat

SEQ ID NO: 6826500 - DNA, 61 bp, Homo sapiens
ctgggtctctgtgccagccagaggcagaaatcaatgcatcgagctggcccctgggatccag

SEQ ID NO: 6826501 - DNA, 77 bp, Homo sapiens
gtattcagaaggcctagctacttactcttccttgatcttccgactgatgatatttggggtgaaggttttctgaaagc

SEQ ID NO: 6826502 - DNA, 66 bp, Homo sapiens
acaattcaaatgcatagttcacagcccaactcaatgccttgtgaattctctgtccatttgggttgt

SEQ ID NO: 6826503 - DNA, 84 bp, Homo sapiens
tggcttggcactcaaagccctctgcaacctgcccacataaccatcattttgcatggatgcagtcttgcattgatgcttcagcca

SEQ ID NO: 6826504 - DNA, 58 bp, Homo sapiens
tgctatataatggaatttctaacctagaagagagtgtagaaaatcttggtatatagca

SEQ ID NO: 6826505 - DNA, 69 bp, Homo sapiens
agcagacattgaagcaactccctcctcatttttcccgtctgttcctgggaaaagagtgcttcaactgct

SEQ ID NO: 6826506 - DNA, 104 bp, Homo sapiens
gttttgtaggttagatgtgtaaagaatatgtatctgagtctagtatgtggagtaagttgttatttttatttctttcaggtatgtgttgttattttgcccaagac

SEQ ID NO: 6826507 - DNA, 89 bp, Homo sapiens
cagacaatcagtttctgttgtataatcacctcactctcagacatgctgtttctgttggaattctttattatggatggaaattgattctg

SEQ ID NO: 6826508 - DNA, 78 bp, Homo sapiens
tccagcactgagtcaatgtcagatgttcctggtaatagtgtcccccagagatttgtcaatgatttccagagtgcttga

SEQ ID NO: 6826509 - DNA, 85 bp, Homo sapiens
atggcatattagcaaaaatgacaccagcagaggcctgaaaagcattttcatattttctgcttgctcactcttgctcctttgccat

SEQ ID NO: 6826510 - DNA, 80 bp, Homo sapiens
tagttcccatgtgtggccttgggagaggtctgagctggacggttagacccgcaggctcccacaggccaccgtggctgctg

SEQ ID NO: 6826511 - DNA, 55 bp, Homo sapiens
cccttgctccaccgcatcccgggcaggaggagccctggagcatcaggaggaaggg

SEQ ID NO: 6826512 - DNA, 74 bp, Homo sapiens
ttccttttcaaatgtatcagcccagggatttgtatcattacaaatttgtgaatatggatgcagatttgttggaa

SEQ ID NO: 6826513 - DNA, 130 bp, Homo sapiens
aaccctattctgcttgccaaaaataattacatcccatttttttctgccaaccatttaaactcatttcatagaaaacggaaaaagagggttggtgcaaatgggatgtttcccgcaagaaagaagaacggtt

SEQ ID NO: 6826514 - DNA, 77 bp, Homo sapiens
ctactggtcatctgatctacaaatgcggtggcatcgacaaaagaaccactgaaaaatttgagatggaggctgttgag

SEQ ID NO: 6826515 - DNA, 71 bp, Homo sapiens
gggttaaagaacatagctgttggttttggtgttgaactctggtttgcctacctgcctagttggttctgccc

SEQ ID NO: 6826516 - DNA, 87 bp, Homo sapiens
gaatgaaataattggagagactatgtattagcaatatgcgttttcacgtatgcataaggcatatagtcacttttttctagatcattc

SEQ ID NO: 6826517 - DNA, 101 bp, Homo sapiens
cacagtgagcaggcagtcacctacaagccaggaagagaggcctcaccagaaaccaactctggtggcaccttgatcttggacttctagcttctagaactgtg

SEQ ID NO: 6826518 - DNA, 117 bp, Homo sapiens
aatagtcttaaaatgcttttttctctcagttatttgcaatgtgcttaggcatggaacaatttagagacaagtgtgagatacctgttcaaattacctgaagctaagaaaaggacaatt

SEQ ID NO: 6826519 - DNA, 85 bp, Homo sapiens
actcaggtgctggctatgtggttagacataagaattatgtgtgatagacgtatgaattatggtactatgaagccaaagctagggt

SEQ ID NO: 6826520 - DNA, 59 bp, Homo sapiens
tgaggcagggttttgcccttgttgtccaggctggagtacaatggcgagatcttggctca

SEQ ID NO: 6826521 - DNA, 58 bp, Homo sapiens
cctggctctgaagtccacatcaattccactacactggatgttaggattcagcatcagg

SEQ ID NO: 6826522 - DNA, 79 bp, Homo sapiens
tgtgcagtgtgtcctcagaatatatacctaagagtagaattgctgaattgtagctatgtattctcagatttactaagca

SEQ ID NO: 6826523 - DNA, 85 bp, Homo sapiens
gttatcatgtcctgtggggggatatgtgtgtgtgtgtgtgtgtgtgtgtgtgtgtgtgtatgtcttccctagcaggcagagaaac

SEQ ID NO: 6826524 - DNA, 73 bp, Homo sapiens
ttcacactgaatgggactttatggtgttttgagataaaacaagaaaggccagattcactttacaatgtgtgag

SEQ ID NO: 6826525 - DNA, 66 bp, Homo sapiens
tcactacccatcatgaggtggaagagctagagaagacctgagctgctctacatgatggggaagtga

SEQ ID NO: 6826526 - DNA, 82 bp, Homo sapiens
attgtcactatttctcataagactttccctcatcagaacgaacgcctctttgctaggtgaaagtcttttgggttctgtcagt

SEQ ID NO: 6826527 - DNA, 104 bp, Homo sapiens
agaggcgcaaggagatttagagcctcgagcagctgaggcagtggcagttttcccactgcatcgctcgcttaggtcctctacattatcacccatcacgtgccttt

SEQ ID NO: 6826528 - DNA, 70 bp, Homo sapiens
ggcggcggttctgggaagagcaccaggctgctccaggcaggaaagggctctgaatcccaggtctgcctcc

SEQ ID NO: 6826529 - DNA, 65 bp, Homo sapiens
agaaagacttggcttatgatttgcgtatgtgttacctaatttgcatatcatttataagtctttct

SEQ ID NO: 6826530 - DNA, 55 bp, Homo sapiens
tgtatgagagttggtatagtctagtgatattaagactgatattaaccttataaca

SEQ ID NO: 6826531 - DNA, 94 bp, Homo sapiens
gagtgaggtacttgatatgcggtgtgtttcttctctgtgaatcaattcagctgagaagcaaagaactgcacttcagacttcaggcgttttattc

SEQ ID NO: 6826532 - DNA, 63 bp, Homo sapiens
actgaaaagagaaatagacaaatctagtgttacagctggaaatgtcaaaacctctgatttagt

SEQ ID NO: 6826533 - DNA, 66 bp, Homo sapiens
agttattcagtgaatttcaggtcaagagtcagtcatgatttttgccctgcagtacataaattggct

SEQ ID NO: 6826534 - DNA, 56 bp, Homo sapiens
gcagcatgttgaaagggccacacattctcttgtctcagggcctttatacatgctgc

SEQ ID NO: 6826535 - DNA, 82 bp, Homo sapiens
taatcaggcttgtaattatgttaattgctggagacttacatcaatcctccagcaaagtgataggatttcaggggaacgatta

SEQ ID NO: 6826536 - DNA, 65 bp, Homo sapiens
ccgggggttgtcaggtttggtacgccaagctggtcggctggttccactaacctgagagcctttgg

SEQ ID NO: 6826537 - DNA, 79 bp, Homo sapiens
acccaacctggctcttcttgttgttagggtcctgtcgtagtctgatagggctgccatcacagaagagcttagactgggt

SEQ ID NO: 6826538 - DNA, 55 bp, Homo sapiens
cgtggcagtggtgtttcttaggacgatgggttctggggggtcataatctgcttcg

SEQ ID NO: 6826539 - DNA, 81 bp, Homo sapiens
tttctgaatactttttgatttgtgtggccaagtcctcagccatgatccaccaggcctagcaagtacattaatatcaagaaa

SEQ ID NO: 6826540 - DNA, 70 bp, Homo sapiens
tgtggcttttaatctagattcggatcaaaggggggaacttcagtgggcaaaatttagcattaattccata

SEQ ID NO: 6826541 - DNA, 56 bp, Homo sapiens
gcccttggaacagcctcctgctctggggcagaatctggggtgaggttgttctgggc

SEQ ID NO: 6826542 - DNA, 67 bp, Homo sapiens
gaaagaggttattgttcccagcttatagactgagaaaactgaagcgtagagggagtaacttactttc

SEQ ID NO: 6826543 - DNA, 104 bp, Homo sapiens
gctgtgttttatgcacttggttgctgtgagtttggccctgagaggtgactctactcttagtgtgtaaagccaaatttgtgagcccccaaggtgagaagcagagc

SEQ ID NO: 6826544 - DNA, 56 bp, Homo sapiens
gcctgccttcggtgcgcagcgggggaacagggctagtgcagccgccggaggggggc

SEQ ID NO: 6826545 - DNA, 88 bp, Homo sapiens
ttaatcagcatctttccttgtgatttgggttttataacaatagtatgtaaacaaaactttctataggttgggatttttagttgattga

SEQ ID NO: 6826546 - DNA, 64 bp, Homo sapiens
tagggaaaactgggtgaggggtccatccaaaaggagactgtattgccttcgcaagttttcttta

SEQ ID NO: 6826547 - DNA, 60 bp, Homo sapiens
tacttaagaggaaaatgtgtggatgttgcctccagcatgcacaggacggccttataagta

SEQ ID NO: 6826548 - DNA, 64 bp, Homo sapiens
aagcaccttctgagaaagatttgcctccgtggatactcctcaggaggccattctcaaggtgttt

SEQ ID NO: 6826549 - DNA, 75 bp, Homo sapiens
agtattatagatataggacagtactgtatcatacctctgtgaatgtaaaatatcttgtacttgctttatgatact

SEQ ID NO: 6826550 - DNA, 81 bp, Homo sapiens
gaaactgaaacacaggtgtaatttgcccgaggttacagagtgtgtgccagaagggaggtttgcatctatgtatcctgtttc

SEQ ID NO: 6826551 - DNA, 63 bp, Homo sapiens
tccaggaactcttgatggtgattcagcagtgtgttctgtcatggctaggaaagagttctggga

SEQ ID NO: 6826552 - DNA, 84 bp, Homo sapiens
agtctcactctgtcaccgaggctggagtgcagtggcccagtcttggctcactgcagcctccgcctcccaggtttaagtgattct

SEQ ID NO: 6826553 - DNA, 65 bp, Homo sapiens
ggacagcatgctttatagttaggacattcttctttatatccagcctgacttcttcatgctgtact

SEQ ID NO: 6826554 - DNA, 62 bp, Homo sapiens
tagggtgaccctgtttctacaaataatttttaaaattagctgggcatagcggtgcacaccta

SEQ ID NO: 6826555 - DNA, 56 bp, Homo sapiens
gcacagccggaccgaggaaaaggattattcccctcttcacgcgggtcgggccgtgc

SEQ ID NO: 6826556 - DNA, 58 bp, Homo sapiens
aaatctgtattgttaacaagtaatcacctcctggtgatccttgttatcaagcaggttt

SEQ ID NO: 6826557 - DNA, 59 bp, Homo sapiens
agtgggaaatttctggactcctgcactgcccagggttaagtgtccacagattcttcact

SEQ ID NO: 6826558 - DNA, 92 bp, Homo sapiens
agaaaattactattgtgtagtagaagcatctttagctaaaactctcaaatatagcatgattgcattcctttgcatatcttagtgatattttt

SEQ ID NO: 6826559 - DNA, 56 bp, Homo sapiens
ctaagagctctgcaaacagtcttcaacagataaactgctttagctagtgctcttag

SEQ ID NO: 6826560 - DNA, 68 bp, Homo sapiens
tccctttgcaatttggcttccattttctcaattctaatgaaaggggagagaaatccgaatgcagtgga

SEQ ID NO: 6826561 - DNA, 76 bp, Homo sapiens
gtttatgaaggtctgagaactacctataggctttgttacattcttcacatttgtaggatttctcagcagtatgaat

SEQ ID NO: 6826562 - DNA, 82 bp, Homo sapiens
gagatttatccatatcattaaaatctatccatagaatagcacctaaatgctggcaggatttttttggtggggatggatgctt

SEQ ID NO: 6826563 - DNA, 90 bp, Homo sapiens
aaaactttaaaggttatactaatttaatgattaatgtggacccaaatacataatttggccaaaaaagtcattagaatgggtaatggtttt

SEQ ID NO: 6826564 - DNA, 57 bp, Homo sapiens
ctggctggtttttaaagctaggagaaattttagtttgtaatgaggagaagtagccag

SEQ ID NO: 6826565 - DNA, 64 bp, Homo sapiens
atgttcagaataaaggtacaattgagtaagcagatgcagctccgtggtaccttatttattacat

SEQ ID NO: 6826566 - DNA, 60 bp, Homo sapiens
tgacactgtttccagcagcgtagcatgcaacaatgtgaatgcatgctggaaatacgttca

SEQ ID NO: 6826567 - DNA, 56 bp, Homo sapiens
gggtgtctgtagtccctgctactcgggaggctgaggcaggagaatggcgtgaactc

SEQ ID NO: 6826568 - DNA, 64 bp, Homo sapiens
gttaaagcttaggatagggaatatatatgtatgtgtatatgaaatgatgtcttcgagttttaac

SEQ ID NO: 6826569 - DNA, 75 bp, Homo sapiens
tttgtgagcttaatgtggacctggtttctagttctaataaacatagatatggacatttcaacattaggtttcaaa

SEQ ID NO: 6826570 - DNA, 74 bp, Homo sapiens
ggtgtagctgtctgagtttttacttactcaattctcacattgtcctgagataaggaacagaccttttctgcact

SEQ ID NO: 6826571 - DNA, 61 bp, Homo sapiens
tgctgttaggttcctggtctcatgctacctacttctcaaaaggctcagagatcaaacagta

SEQ ID NO: 6826572 - DNA, 72 bp, Homo sapiens
atggcagaagagtagaagagcaagctagctgaatgctgcatgaagtcttttttataggcgtcttaataccat

SEQ ID NO: 6826573 - DNA, 89 bp, Homo sapiens
cctgggacgctgactccaaggtggccctgatgtcatgtgctccatggagcctagggggtcctgggccaccccgagagtgttgccccagg

SEQ ID NO: 6826574 - DNA, 67 bp, Homo sapiens
tgctagccaggtgaacctaatctaatcacaggaacccttgaagagtaaagtgttttctctggctgca

SEQ ID NO: 6826575 - DNA, 98 bp, Homo sapiens
cagtgcacttggcattttctgtctttgttggaataattcacaaagtgagcaactgagaggaattcctgggaaggcacagccagtgtgagggggcactg

SEQ ID NO: 6826576 - DNA, 55 bp, Homo sapiens
ggggcagcagttgccctaatcaagaattcacactctggaggtggtctgctgtcct

SEQ ID NO: 6826577 - DNA, 73 bp, Homo sapiens
ctggcctcccttgtatcatatgctgggcttaaggggattaagagcgagtgagtggtgcagaggaatgggccag

SEQ ID NO: 6826578 - DNA, 67 bp, Homo sapiens
atgtttaaatttatagacagtgaaatggacttccatgtagtgtacagttctatgagttttaagacat

SEQ ID NO: 6826579 - DNA, 58 bp, Homo sapiens
gattctcttttctctgtttcaatagatctatccaagctgactcagggaaaggagaatt

SEQ ID NO: 6826580 - DNA, 63 bp, Homo sapiens
tcaattttggctgtcagggtattatttgggaaactaggtatttccaggtggctagctaaatga

SEQ ID NO: 6826581 - DNA, 55 bp, Homo sapiens
gagaatggagtagaactgacaattagacctatctgtcatgagtctcctccatctt

SEQ ID NO: 6826582 - DNA, 63 bp, Homo sapiens
ggctgggaatgggcctagaaggctggctttgcagccagaagcccgcttcctaacttcccagcc

SEQ ID NO: 6826583 - DNA, 60 bp, Homo sapiens
tttgcactggaagtacatgcattcaaaatggatacctaagtgtatattttctggtgtaaa

SEQ ID NO: 6826584 - DNA, 55 bp, Homo sapiens
aaacaagtgtaaactagtctgtgtctttaacaaaggcataccctaacacgtgttt

SEQ ID NO: 6826585 - DNA, 58 bp, Homo sapiens
gaaatgtcaagatatgtttggactttgccttggacatcgccgagcagattgatgtttc

SEQ ID NO: 6826586 - DNA, 83 bp, Homo sapiens
ctttctcacctgggtcagacagttgttttgacacagtaacctaagggaaaaacatacagcattgttcacccaggtggtgaaag

SEQ ID NO: 6826587 - DNA, 123 bp, Homo sapiens
tgatcagtgagtgaaaagatgttgggagggaagctgaggcagggcttgcatgtctggctagacttgctggctccttgcttctagcactcccactatgctaatgtttctcattcacttgataca

SEQ ID NO: 6826588 - DNA, 76 bp, Homo sapiens
gatggtcacacctgttctcatcccattcagtgtctttattgcactcaggagtagttcagcagctgttcagaccatt

SEQ ID NO: 6826589 - DNA, 103 bp, Homo sapiens
ttgaggtggagtctcgctctgttgcccaggctggagtgcagtggtgcaatctcggctcactgcaatgtctacctcctgggttcaagcgattctcctgtctcag

SEQ ID NO: 6826590 - DNA, 84 bp, Homo sapiens
gtgttctaatagaaggaggtagtgaaatgataacagagcagtaggggatattcctactcatttcagtttcttctcatagatcat

SEQ ID NO: 6826591 - DNA, 65 bp, Homo sapiens
gtggagggcctggcctgtgttgtgtaagagccaatggagtagagaaccagagccaggctctcagc

SEQ ID NO: 6826592 - DNA, 55 bp, Homo sapiens
ttttttgctctgcacagaagttataagtgcttagctgaggtgcagatccaaagaa

SEQ ID NO: 6826593 - DNA, 57 bp, Homo sapiens
atacatagctgaaaacttgtagaagttaagactaaacctctgcaggtagccatgttt

SEQ ID NO: 6826594 - DNA, 65 bp, Homo sapiens
gctaatccctcaagagttctgttctacaacaaagaaagagcaggcttatggttgaagggagtggt

SEQ ID NO: 6826595 - DNA, 57 bp, Homo sapiens
tgaggtagaagcctgggttgagtaaggcccacttagccctctcccagtctctaccca

SEQ ID NO: 6826596 - DNA, 83 bp, Homo sapiens
ctgctgtgtgtcagttgctattccaggccttaagatacaatgttgaatgggggagagaagcagagctgatattcaaccagtag

SEQ ID NO: 6826597 - DNA, 75 bp, Homo sapiens
gttcttaaactggtagcaatttaagggtggttgatgtataacctttaaacaaattgatgcaagctttttaagaac

SEQ ID NO: 6826598 - DNA, 109 bp, Homo sapiens
gctcccttacatctccctggactgttcagggcctgacaggctttcttctcattcctagtcgtcactctggcctctgcagcagttccttagatagatggatgtttggagt

SEQ ID NO: 6826599 - DNA, 57 bp, Homo sapiens
ctgtgtcttcctccccagttctgtactgactcaggcagaactgggcagggagcagag

SEQ ID NO: 6826600 - DNA, 56 bp, Homo sapiens
atcgggcatgtccatgctttcatcaatgaaatgggagcagaggggacatgtttgat

SEQ ID NO: 6826601 - DNA, 69 bp, Homo sapiens
gggttaggtccctcccttctggagtcttcactactacactttcaaagaaaacacagatggatctaactc

SEQ ID NO: 6826602 - DNA, 61 bp, Homo sapiens
ttcaaatatcatctgcaaagcacatctagaaatttagctggtgatgcagataatgtatgaa

SEQ ID NO: 6826603 - DNA, 82 bp, Homo sapiens
ggaaaacttatgtgctttagatctgactttctgtgcaaaaatgtgagatttgctacaggtgggacccaggtctgagttttct

SEQ ID NO: 6826604 - DNA, 58 bp, Homo sapiens
ttctaacttttgaggcaatgtgactcccactggaaacattgttcaatgaaagttagga

SEQ ID NO: 6826605 - DNA, 61 bp, Homo sapiens
tatttcagtgcacaatgacggtggctttcagctcatgaaaggcttcctcgtgccttagata

SEQ ID NO: 6826606 - DNA, 67 bp, Homo sapiens
tattttaatcttcacagccaggccgtgggttaggaaccacagcttatggtacagaggaggtgaagtg

SEQ ID NO: 6826607 - DNA, 64 bp, Homo sapiens
aaactccagaggatcagtactggctggggaagaggacccagtgtggccaggtcttctggttttt

SEQ ID NO: 6826608 - DNA, 63 bp, Homo sapiens
ttggcttcttttctagacagaagttccccagtggaaaatgtgtctatgagaagttcaggctag

SEQ ID NO: 6826609 - DNA, 77 bp, Homo sapiens
gtctggacccctccccacgagtaggtaacccaggcctcctgcctctctggggcctccaggcctactcagggccagac

SEQ ID NO: 6826610 - DNA, 67 bp, Homo sapiens
tgaaaatgtatttttgatttgttagaaagaaaaataactggcaaagtttatcaggaatatattagca

SEQ ID NO: 6826611 - DNA, 69 bp, Homo sapiens
ttgtgcctttctgggcctcagtttccccatctctacaaagacagggtgggcccagcccagagaagccaa

SEQ ID NO: 6826612 - DNA, 128 bp, Homo sapiens
ggatgtgcatttttctatgaagaacattccagaggattgatcaaacactgcagagaggctgggttcctgtaaaagtttgtcgatccctgcagtatatccttcatgtcagaaattcatgcaactatacc

SEQ ID NO: 6826613 - DNA, 64 bp, Homo sapiens
gagaggaaaaaagcctaggctttttcctaagttacttaacttgggaaaccaatgggctcctttt

SEQ ID NO: 6826614 - DNA, 123 bp, Homo sapiens
ggctatttaatacacattttctgagtctctactatgtgcctgttggacactgctggggtaatagtttccacatctgtcctctgcagagctcagagtgtggaagagcagtgagacttgagtacc

SEQ ID NO: 6826615 - DNA, 62 bp, Homo sapiens
tacaggctcttgtcagacgtatccgtggcctcttgaggatatcaaggaactgagagcccgtg

SEQ ID NO: 6826616 - DNA, 57 bp, Homo sapiens
gagggacagaactgccttgattcctggtgagtttccagttcatggctttagtccctc

SEQ ID NO: 6826617 - DNA, 74 bp, Homo sapiens
tctagactactcttggatgtgtcgccttcacacaactgaaaatgacaaatgcaacatgtaagagagtttcaaga

SEQ ID NO: 6826618 - DNA, 87 bp, Homo sapiens
ctctagtagtacttgttggtgatgccacacatattttactttgaagaagccagataatgtttatacacctgcaggaactagctagag

SEQ ID NO: 6826619 - DNA, 63 bp, Homo sapiens
ttaagacagtgtatttgttttctatggctgctataacaagttaccacaaatgtagtgtcttaa

SEQ ID NO: 6826620 - DNA, 60 bp, Homo sapiens
cgccaccatagaggaagtcctggaggtcttgttcttcaggatccccttgatgggctggtg

SEQ ID NO: 6826621 - DNA, 73 bp, Homo sapiens
gggttaatggcaaattatgactgaatgggtttgctctcccaggagagatgcattcagcatggatgcctggcct

SEQ ID NO: 6826622 - DNA, 62 bp, Homo sapiens
taggaccagatcaagactcttggactttatcctttagacagagaagagccttgaaggtccta

SEQ ID NO: 6826623 - DNA, 88 bp, Homo sapiens
gagatttgttaaattgatcgtttgggatgaaatcaagcaaagagaatactaggcaaacttttaagatttcttcctaaatacagatctc

SEQ ID NO: 6826624 - DNA, 55 bp, Homo sapiens
cgggaggaaaggcgaggctctgcatctagatttacctcgttctcttttgtctccg

SEQ ID NO: 6826625 - DNA, 76 bp, Homo sapiens
cccattgtgcctgaatggtctccaaatagatttttggagaagctcaagaatctcctgaccctttacacacaattgg

SEQ ID NO: 6826626 - DNA, 76 bp, Homo sapiens
gaattttataaagcactatgtaattagtaagtagtataactgctataagctagcagcatggtgccactggaaattt

SEQ ID NO: 6826627 - DNA, 61 bp, Homo sapiens
gctaggatcccagagttccttctggcctgagagaggctccttatggctttggggttccagc

SEQ ID NO: 6826628 - DNA, 96 bp, Homo sapiens
aaaatagtacagaagaacttgtaatgaaaggcaatagtcctattattctctgtatccattgaagccaccactgtaagtcacttttgttattatttt

SEQ ID NO: 6826629 - DNA, 88 bp, Homo sapiens
caggcagcagggagcaaagcaggagagcctgggtgagcgcacgaagggtgagtctcccatcccggggtctcctccgcctctgtgcctg

SEQ ID NO: 6826630 - DNA, 59 bp, Homo sapiens
gggtgagaagacctcctggaaggtgttttccatggcatttagtccttgacttctctccc

SEQ ID NO: 6826631 - DNA, 73 bp, Homo sapiens
gcttggtgccatctgcagtgtgcccgtttatcctgtcttcactggcatttacgatactgcatagggcatcagt

SEQ ID NO: 6826632 - DNA, 68 bp, Homo sapiens
tgccaacatattttcaaagtaagggagtgagtgtttatgagactgccctggaaatgagaggtgtggcg

SEQ ID NO: 6826633 - DNA, 73 bp, Homo sapiens
agtggaattgaggcagactgccggcagaactgcttaaattcaactgtcacatcaccctgctcttaattctgtt

SEQ ID NO: 6826634 - DNA, 69 bp, Homo sapiens
tggcatgcaggggcttttcctctataaggggctgtcactgtccactgtttaaagcctctgcttgagcca

SEQ ID NO: 6826635 - DNA, 55 bp, Homo sapiens
acacagttcaggatcaaatagcaccacttactgggtttttaactcttgactgtgt

SEQ ID NO: 6826636 - DNA, 111 bp, Homo sapiens
ctggaattttgatgtggagatttgctctgatatttaacaagacagagaactgggtcattctgttgatattgccttgtagattccagaggcaacatttccagaaaattttag

SEQ ID NO: 6826637 - DNA, 76 bp, Homo sapiens
atgtcagtctttgcttatgacaatagaaatgatcaaatgaacctgttttttatattccttttggcagggactgcat

SEQ ID NO: 6826638 - DNA, 72 bp, Homo sapiens
tgttctgtacctggtgtgttagtttcctgtgcctgccctaacaaagcaccacaaaccaggtgagttaaaaca

SEQ ID NO: 6826639 - DNA, 63 bp, Homo sapiens
tgaattcatcgtcttagctgccatttgttctgtatttacatcctggggctaagtgtgaattca

SEQ ID NO: 6826640 - DNA, 59 bp, Homo sapiens
ctgggaggcttctggataaggtgtgagatcccgtcttcatgcagcctggaacctcccag

SEQ ID NO: 6826641 - DNA, 75 bp, Homo sapiens
cataattcctacctatgtatttattcctagtatattctagacaccaccaggaagggatacataggatagtttatg

SEQ ID NO: 6826642 - DNA, 101 bp, Homo sapiens
tctggtccattagtcctttcagattttgttaatacccacaccagaggctgagtgggaaaaagagaggtgttaacaaagattgaaatgactaatggacgaga

SEQ ID NO: 6826643 - DNA, 99 bp, Homo sapiens
ctggctataagtattgtatttggagaggagaaaaaagaggatgcatcactgcagtgctttagtctgtccttttctacccaggtacaaatttaattccag

SEQ ID NO: 6826644 - DNA, 67 bp, Homo sapiens
acaggactttgccatatgggtcttgtttcctcaactggtgtgaaaactctgtgtgagtagagcctgt

SEQ ID NO: 6826645 - DNA, 60 bp, Homo sapiens
gcatcttgttcactgctgtatttgcagtacccagaactgttcatggcagatgataagtgc

SEQ ID NO: 6826646 - DNA, 55 bp, Homo sapiens
gccaggctcttcccacacagtactagacttcactgcctctgtgggccttcctggc

SEQ ID NO: 6826647 - DNA, 62 bp, Homo sapiens
gcatagtgaagctgtaggtggatatggaggatggtagccctcttctcacagctctactatgt

SEQ ID NO: 6826648 - DNA, 59 bp, Homo sapiens
aaacctctgtggcgaggggaggggatcaggccctgatttggttcccaagctacgtgttt

SEQ ID NO: 6826649 - DNA, 80 bp, Homo sapiens
cggaaaaggcttactgtgcattattcttacctttctttgatcttttttagggaatgctgggagaaatgttggcctttccg

SEQ ID NO: 6826650 - DNA, 75 bp, Homo sapiens
taaggcctgtctggggctcagccaaactggggagtagtacacgagaagaggaatggggagccctagagggtttta

SEQ ID NO: 6826651 - DNA, 124 bp, Homo sapiens
gcccagggaagttttgctctgggtcacacccacctctgggtggctgccaatctgcctgccagaaaccgcaggctgggccgcggctacccagagtcagggccacggagcttaggagaccttgggt

SEQ ID NO: 6826652 - DNA, 65 bp, Homo sapiens
accagcagaaaatgcctactgtggactcccttcagaaacattcctgcaaaataggctctgttggt

SEQ ID NO: 6826653 - DNA, 75 bp, Homo sapiens
gaggcttttcagggtcatttcttcacactctctgcagggaagcacggagacagcaggaagaaatatcctaacctc

SEQ ID NO: 6826654 - DNA, 70 bp, Homo sapiens
tgtggcaaaggtgatggaatgtcacttctgtggttaggttacaaaagattgtgacttccatcttgctgca

SEQ ID NO: 6826655 - DNA, 78 bp, Homo sapiens
tgatttgaggtggttttcaaggggatttaactgaattcaggtgtctgatttacgttcccgatgaaagacttaaaatca

SEQ ID NO: 6826656 - DNA, 69 bp, Homo sapiens
agtgccatacttagactctatctagagatgtccacattttagattagagagttgtaagcttatggtatt

SEQ ID NO: 6826657 - DNA, 81 bp, Homo sapiens
aagagcactttacagttacgctgagaaacgaatgttcaggactatttgtgtctcaagtgtgaactcttttataaggctctt

SEQ ID NO: 6826658 - DNA, 66 bp, Homo sapiens
tgctaggttaatcattctctgttgctatgttaacagaagtgatagcagctgtggtttaccttagta

SEQ ID NO: 6826659 - DNA, 87 bp, Homo sapiens
gtgttgatgtttgaaaaaaggactcagactgaagggagaggaatgatgtcatctcttgaagcaggggccagttcttaaacttaacac

SEQ ID NO: 6826660 - DNA, 67 bp, Homo sapiens
gctttgatttggctaactgcaaaaagtacaggtttaaactggacttgcctttagttaaaataaaggc

SEQ ID NO: 6826661 - DNA, 103 bp, Homo sapiens
aagacagtctaggaggaggaggaggtagggtgtgaaacagccaggctctctccaaatcccaagtgttgacacagccatcttgtcccatccctggaagcctctt

SEQ ID NO: 6826662 - DNA, 63 bp, Homo sapiens
gtcctgggcctgctgaggctgagccagtggagctggatgacagcctgtatcagggaccaggat

SEQ ID NO: 6826663 - DNA, 85 bp, Homo sapiens
ctattcccatttaaaaatatgctatttatgattacagttgacttatcccaaaggagtacagtggtcataatataaaatggaatag

SEQ ID NO: 6826664 - DNA, 65 bp, Homo sapiens
tggccccactgccaaggctgttgtactagaaggaaatgggcattcagcccagagcagtggggcca

SEQ ID NO: 6826665 - DNA, 70 bp, Homo sapiens
aagtctttgctactgtgaatagtgccacaataaacatatgtgtgcatgtgtctttatagtacaatgattt

SEQ ID NO: 6826666 - DNA, 87 bp, Homo sapiens
gtacctgtcctactagatagtgagtattctggttaattaaatgtccacgttaataccactgtgctcattataactgtagataaggac

SEQ ID NO: 6826667 - DNA, 80 bp, Homo sapiens
gcaggcacatgacttcaggtgactgcctccaggcgctcgcctggaggaagttgctggaagtcagtgcaaatgagaactgc

SEQ ID NO: 6826668 - DNA, 65 bp, Homo sapiens
gtgtttcccaagcctgggaaggcttacaaagatgccatccctgcctgcccagatttggaaaacat

SEQ ID NO: 6826669 - DNA, 75 bp, Homo sapiens
tagttgagaggtccatacagctattctacattcctgctgaagggcctgaagaaaattggtagggatttttcactg

SEQ ID NO: 6826670 - DNA, 83 bp, Homo sapiens
gagcacttaaatatgagcagaattgatgtttggcatttctgtgtggagtcatttaattggttttgctcgtctttctaagtatc

SEQ ID NO: 6826671 - DNA, 68 bp, Homo sapiens
aacaataggagtgatgcagtatgattcctgaagctagtttctaaaaatgtatccacttctaccttgtt

SEQ ID NO: 6826672 - DNA, 88 bp, Homo sapiens
ttggaatgctgaggtgggagaattgcttgagcccaggagtttgagacaagtgcctgggcaacatagcaagaccttgtctgtattttgg

SEQ ID NO: 6826673 - DNA, 74 bp, Homo sapiens
atgtagtaacgggtgtatagaatgcttctgtgtgttgggggcaactcagggagtcatatatacctgcatgatgt

SEQ ID NO: 6826674 - DNA, 84 bp, Homo sapiens
gactatgggcaaaactatatacatggaaagctattatcattattattattctatgtggatatagaactgcttacagacatggtt

SEQ ID NO: 6826675 - DNA, 73 bp, Homo sapiens
gtgaaaacataccactgtcagacatgaggatgttttggactttgattgtctgtaaggtgtttatgttagttac

SEQ ID NO: 6826676 - DNA, 62 bp, Homo sapiens
cggggggacaagagggacgagactttccagaccctactctggtgggccctgcttgctcactg

SEQ ID NO: 6826677 - DNA, 83 bp, Homo sapiens
accgggctgtgcggaccaaatgctttttaattgaaaatttttttaattcaaaaaggatttgctgtttgttcgcaagtgcaggt

SEQ ID NO: 6826678 - DNA, 91 bp, Homo sapiens
gggacatattagtgtctgtgaataattctctccatcttaaaccaagggaagggggcctaaacaggattgtccacagacagcaatggctctc

SEQ ID NO: 6826679 - DNA, 61 bp, Homo sapiens
ggacctgaaaatctcgagggctctttcccattccagtctttcagcattctagttcaggttc

SEQ ID NO: 6826680 - DNA, 86 bp, Homo sapiens
ctttaggaaagctcagatcttgttggaagatccatgcatgactgaagagatggtagcattcaataaagattttgagcgatatgaag

SEQ ID NO: 6826681 - DNA, 129 bp, Homo sapiens
ttttttcctgccaattttagtttttatctttgtgctgtatttaattgtatcatcacaggccacattaaatcatttctggaagatcagttttaaataaatagatgaataaaaaaatagcagttaaaaaaa

SEQ ID NO: 6826682 - DNA, 68 bp, Homo sapiens
atgttttggaaaggaaatgggtaagcatttattccctatcttgattgtaactcatctttccagaatat

SEQ ID NO: 6826683 - DNA, 123 bp, Homo sapiens
aggggctggcctccagctggtgcaatacagatgctctgatgtctgggtgctttgataaaatggagaggcatgccagaattgtcagtgcatctggactaggtattggtaaactattgggcccct

SEQ ID NO: 6826684 - DNA, 74 bp, Homo sapiens
tctctccttattgcacagaatcattttcagctgttttatgaactgctggaagattattttgtatttagggtgga

SEQ ID NO: 6826685 - DNA, 64 bp, Homo sapiens
tcctggctcctgatctgtcactgtcccaccagcttgaggggtagtgtttaggtagtagttagga

SEQ ID NO: 6826686 - DNA, 68 bp, Homo sapiens
tgtaatagtttcatataccaagcacttgagttgagacttcaatttggggccattatgaagctggtata

SEQ ID NO: 6826687 - DNA, 70 bp, Homo sapiens
agtgttgatcagtgtacttcttaccagaacttgggcctctctaaggtggtaatagtgcaggattatcact

SEQ ID NO: 6826688 - DNA, 59 bp, Homo sapiens
gtctgttttggtcacctttatatccccagcctggcagatattaggtgctcaatacatgc

SEQ ID NO: 6826689 - DNA, 83 bp, Homo sapiens
gccgggtgctgcagcagtgcgggcagcttcagaagctcatcggcatctctcttggcagcctgcgcgggctgcccaccaagtgc

SEQ ID NO: 6826690 - DNA, 78 bp, Homo sapiens
gcatgaggtatagaaacatcgcacagattgtaaggggtggccatcccagttgtgtgataagtctcttgtgccacaggt

SEQ ID NO: 6826691 - DNA, 63 bp, Homo sapiens
cacgcatgtgccatgtgtgcagatatgtatcgtgtgtgcatgtacatgcatgggcactgtgtg

SEQ ID NO: 6826692 - DNA, 69 bp, Homo sapiens
gcagtcattagaggtgggctaggtactatagaacatattgaacctgacagtccttttctagtgtattgt

SEQ ID NO: 6826693 - DNA, 111 bp, Homo sapiens
ccaggaccctccattctccccaccccacttccacctttgggggtgtcggatttgaacaaatctcagaagtggcctcagagggagtcggcaagaatggagagcagggtccgg

SEQ ID NO: 6826694 - DNA, 58 bp, Homo sapiens
ttgtatataaagcccccactgtttgtcaagaaagtgatgttaggggtattatttataa

SEQ ID NO: 6826695 - DNA, 68 bp, Homo sapiens
ggttgcaacttctcccatcactcttctctaaaactgaatggggaaaggagggactggagtgtgctacc

SEQ ID NO: 6826696 - DNA, 68 bp, Homo sapiens
ggttacagtttgtgctgagaataggctgcacgtggctgcagcccttttttggtacaaccgttgttccc

SEQ ID NO: 6826697 - DNA, 66 bp, Homo sapiens
agcacttggatttgaacccaggtagttgataattcagatttcttgataattcaaatcccatatgct

SEQ ID NO: 6826698 - DNA, 89 bp, Homo sapiens
ggaagaggaaacaccctggctgtttatttcggggctgtaggatctgttgtgaatgagccccaggatgggccgcaggatgtctttcttcc

SEQ ID NO: 6826699 - DNA, 74 bp, Homo sapiens
atggtctacaaagccattcaggatctagccctcactttttttggtagatcccttgtggtttttagttcagccat

SEQ ID NO: 6826700 - DNA, 88 bp, Homo sapiens
gagaatgttaataattattgaagctggatgatgagtatttgggggattattatactcttgtctcaacttttgtatgtttgacattttc

SEQ ID NO: 6826701 - DNA, 78 bp, Homo sapiens
gcattcatcatcagaactgttcactgctagataatttgaattcccccccttcccagtgttgttctgtgagtggattgc

SEQ ID NO: 6826702 - DNA, 90 bp, Homo sapiens
ggaattagtgaaagaccttagaattcacaggaggtatttgtccttcacgcgagtgtagaccaaacgtaacctatgagtttcttttattcc

SEQ ID NO: 6826703 - DNA, 87 bp, Homo sapiens
tcaatgcccaggatttaaagtagacctttgtttaaaaaacttttgtataaagacaaataaaggtccactttagggcttgggcattgg

SEQ ID NO: 6826704 - DNA, 69 bp, Homo sapiens
gaagataatggtagtagaatctctgctaacagaaaatagagcggagcttttcagctaccaggtatcttc

SEQ ID NO: 6826705 - DNA, 58 bp, Homo sapiens
tgccaggatgaggtcaatgtttggttactgatgagaacaaacaggcctcagtcctgca

SEQ ID NO: 6826706 - DNA, 68 bp, Homo sapiens
aggcagaagctgagaatgaattaagactccttgtacaagtcttttttagctggttcttagctttgcct

SEQ ID NO: 6826707 - DNA, 55 bp, Homo sapiens
gcaggccggggtccacgcagcatccagctttgtctgcagctgggttctggtttgc

SEQ ID NO: 6826708 - DNA, 55 bp, Homo sapiens
agttctccaggcatttctccatttttcaaattgtgagaaacatttcttgagaact

SEQ ID NO: 6826709 - DNA, 106 bp, Homo sapiens
ggctgcagtacagtggcatctcggctcactgcaacctccgcctgccaggttcaagtgatttgcctgcctcagcctccggagtagctgggactacagaactacagcc

SEQ ID NO: 6826710 - DNA, 87 bp, Homo sapiens
gtttgctgctctccaaggagctcctgtgccggccgcattggacaagcatctctgccctgcggcgcagagtctccaggaccagcagat

SEQ ID NO: 6826711 - DNA, 72 bp, Homo sapiens
cagggcaggacagatacattacctcccagtagagctgataactgggagtagagtgccttctgccctgtcctg

SEQ ID NO: 6826712 - DNA, 61 bp, Homo sapiens
gcttccatcagaagctgcagtggaaacaatcaccttttccggcagcagctctgaaggaggc

SEQ ID NO: 6826713 - DNA, 70 bp, Homo sapiens
gcctggaaacaagcaagcacataattttctgcaagcccagaaatagtgtttgtttgcttgtttttcaggt

SEQ ID NO: 6826714 - DNA, 71 bp, Homo sapiens
gcaagcaaattatttataggcaaatacctgatccaactgcctactgaaactcttgtaaatatcttgcttgt

SEQ ID NO: 6826715 - DNA, 79 bp, Homo sapiens
agagctcagtgtgttatggttaatggaaatgttgtcattgtcagattgcctcttaactgtaatataaatatgagtctct

SEQ ID NO: 6826716 - DNA, 129 bp, Homo sapiens
tgttcccctctttgtcacagccctgaaacgcactggcctgctgggtgaggtcctgaaagggtcagagctccaaggattactaagtagggtagtgtcagtcccaagccatgctgtggatctagggttaca

SEQ ID NO: 6826717 - DNA, 92 bp, Homo sapiens
ctgccaccctccctgtgtgccagaagggcctctggtcccatgggcaccttccctgcagatctagggtccttcagggggcgcagcgtgtgcag

SEQ ID NO: 6826718 - DNA, 57 bp, Homo sapiens
atggcgtcgtcggcggagtgacaggggtccctctgggccggagccgacggcagtggt

SEQ ID NO: 6826719 - DNA, 71 bp, Homo sapiens
tcttgtgttttattgctggccacctgtagccaggcactgtgcaggatgatgggatccagcaatgtacaaga

SEQ ID NO: 6826720 - DNA, 55 bp, Homo sapiens
gagctgctgcagtggtcttgctggaaaacccctctagcacctgtgtagaagcatc

SEQ ID NO: 6826721 - DNA, 76 bp, Homo sapiens
tcataaaacaaggatgctttctggtgatacagtacaagaatgctctgtacacagtatgaggcatctttaaatgtga

SEQ ID NO: 6826722 - DNA, 81 bp, Homo sapiens
gtagaagagatcattgtaatgatactgatgtagtcaacctttcattgttcatcaacatggcaatgcccatctgcattctat

SEQ ID NO: 6826723 - DNA, 56 bp, Homo sapiens
gacttgggaatcacccctcaggcccattctccaatgctgagcccagatcccaggtc

SEQ ID NO: 6826724 - DNA, 68 bp, Homo sapiens
acttggccagtgtgaccatctgttagctcgcagccatggtagcttgattcctggtcaaacttccaagt

SEQ ID NO: 6826725 - DNA, 76 bp, Homo sapiens
aactttcacatgtgtgcagacaggtagaggcacaaagctgaactctgcaatgcactgctgtactgctgtgagggtt

SEQ ID NO: 6826726 - DNA, 60 bp, Homo sapiens
ctgcaggattctcccagttggacgttctgttaaattgctccatgggaagcatcctcgcgg

SEQ ID NO: 6826727 - DNA, 59 bp, Homo sapiens
gtggtgaagccccatctctgctaaaaatacaaaaattagccaggtgcagtggcacacac

SEQ ID NO: 6826728 - DNA, 65 bp, Homo sapiens
tcatttacacagttccatttaagccagtttcattgatcaagaagccaggggaactgatgaagtga

SEQ ID NO: 6826729 - DNA, 63 bp, Homo sapiens
ctacaaggcagcaatgaatgaaatggattggtctccacctccatggaacattctgcctggtag

SEQ ID NO: 6826730 - DNA, 67 bp, Homo sapiens
gtgtcataatttctgtttcagtggtcttctgaatgtccagagccactgtaaggggaattgcctatgc

SEQ ID NO: 6826731 - DNA, 69 bp, Homo sapiens
ttgcccttttgtacacttactatatatcttgctgccagcagttatgggggaaagggtacaaaggggcag

SEQ ID NO: 6826732 - DNA, 75 bp, Homo sapiens
gggactctggccaggtgcggtatgtgtctggtcctcggctaagttctcagtgatattcacgccgccagaggtccc

SEQ ID NO: 6826733 - DNA, 57 bp, Homo sapiens
gctcgactcattttccaggctgaatgctgtagctcatttagcctggagggttgaagt

SEQ ID NO: 6826734 - DNA, 56 bp, Homo sapiens
ccattgcagattcttctcagggagataactatcttgtttagaaaaatgtctgctgg

SEQ ID NO: 6826735 - DNA, 60 bp, Homo sapiens
ccattaaaattgtgacataggagaatgttttccaaaatgcaagtcacaatccattaatgg

SEQ ID NO: 6826736 - DNA, 57 bp, Homo sapiens
gcctttgctttccgttttgttacatatctttctgtgcaggactcaagaaagaaaggc

SEQ ID NO: 6826737 - DNA, 69 bp, Homo sapiens
cctcatgtgtcctattcttggagctaaaggagcctgcagctcagaaatgccagtaggtacatgtgaagg

SEQ ID NO: 6826738 - DNA, 68 bp, Homo sapiens
cattctcctgccagaaaagagggagttcaagtcttctttccaggactcctgtgttttggctgagactg

SEQ ID NO: 6826739 - DNA, 77 bp, Homo sapiens
tccccgcgttggccaggctggtctcaaactcctgacctcaggtgatccaccagcctcggcctcccaaagtgctggga

SEQ ID NO: 6826740 - DNA, 82 bp, Homo sapiens
ttcagcaattaccaatttggtttatgtgttcagaccttatatggatcattgtattgtatgaatcaaaaggtgaatcgttgaa

SEQ ID NO: 6826741 - DNA, 57 bp, Homo sapiens
cctcaggggtgcccacagctgccccacgcagtagctgcttgtgggaatccttggagg

SEQ ID NO: 6826742 - DNA, 70 bp, Homo sapiens
gtccaggactgctccagacacctgcaggggcagataaaattctgctgcaggtgctgtgagcaggtgggac

SEQ ID NO: 6826743 - DNA, 75 bp, Homo sapiens
cttggggttgggggacagtcaggagaggccttgggagggaggggaggcccactgagtgactccctcaggcccagg

SEQ ID NO: 6826744 - DNA, 55 bp, Homo sapiens
cagaggtacagccattgaagatactcaaaaggcaatctcggtcactgtgcctctg

SEQ ID NO: 6826745 - DNA, 64 bp, Homo sapiens
ctctggcaggggaagaaaggaaacggggaatctctcttgaccttttcattgccttagcgcagag

SEQ ID NO: 6826746 - DNA, 67 bp, Homo sapiens
tccatgatgctgtgagaccatttgttgaggaaggtgtccttcttaaagttgtcacagctgctaagga

SEQ ID NO: 6826747 - DNA, 96 bp, Homo sapiens
aagaagtcatcatggaagaatcttatactgcagcatagatttaaagttggagatccatggctaagtatatagagcttgattcgagattgatttttt

SEQ ID NO: 6826748 - DNA, 73 bp, Homo sapiens
ccgagaaataagaatgtgtgtccaggtccaatttatgtaattacacaatagatactgggcacatatcgactgg

SEQ ID NO: 6826749 - DNA, 70 bp, Homo sapiens
ctgaacactcaggcaccaactgccacgtccaaaccaagggcttggggtgttggatggagcaagtgtccag

SEQ ID NO: 6826750 - DNA, 60 bp, Homo sapiens
ctttggcaagattgtgtggctgaagtaatattagttttcttcctatgtatcttgctgggg

SEQ ID NO: 6826751 - DNA, 100 bp, Homo sapiens
atttgttaaaacctgaaatgcagtaatttaggtccatgttcgttcatccttctgaatcagcaggcttctaaatttttaactgtgtcctatggaaataaat

SEQ ID NO: 6826752 - DNA, 100 bp, Homo sapiens
tatgccagtacagctttcattaaaaattccaaatctcaggggcttcaggagcttaaagtatttaaatttcaatagaaagttggtactgaagttaagcgta

SEQ ID NO: 6826753 - DNA, 59 bp, Homo sapiens
ctcagagagggcaccagggccatcctgagttggggtcctgggctgtgtgccactctggg

SEQ ID NO: 6826754 - DNA, 86 bp, Homo sapiens
tccatagctcatctttctccaggcagtgcaagatgaccaccagcagtgccaagcttctattttgcctgcctagaaatctctgtgga

SEQ ID NO: 6826755 - DNA, 57 bp, Homo sapiens
tagcctttcattctattattttggagctaaaggcttcagcatgaagagtgaaggctg

SEQ ID NO: 6826756 - DNA, 79 bp, Homo sapiens
gttgagagtaaggctcactgaaatgtaggcagcaagtataacttgtgcctaggtcaagagagccatcatctctctcagc

SEQ ID NO: 6826757 - DNA, 57 bp, Homo sapiens
gtctggccctctgcaagattctggacactatggtgtgcaagaaaggtggggccaggc

SEQ ID NO: 6826758 - DNA, 64 bp, Homo sapiens
tcaacagggctacaagccaggatgtccaggggcaaacctgctcttccacttactagctctgtga

SEQ ID NO: 6826759 - DNA, 74 bp, Homo sapiens
gtgttaaatgagatgttttggtttgttttgatgggtacttataaaggcaatacacagcatttcacacttagcat

SEQ ID NO: 6826760 - DNA, 89 bp, Homo sapiens
gggctgctttgccgaggttgtgtcccttatggaatagaccacatccatggctgattgatgagggagcataaagatctgtatgttagccc

SEQ ID NO: 6826761 - DNA, 66 bp, Homo sapiens
ctgtttgagtcctgctttcaattcttttgggtaaacacctaggagtggaattgctggatcatacgg

SEQ ID NO: 6826762 - DNA, 87 bp, Homo sapiens
ttgcatcaaactttggtccaaagtcctctgagtaatgaataataattttgtctacccagaatattggcccaagatttgaaccagcaa

SEQ ID NO: 6826763 - DNA, 77 bp, Homo sapiens
gcacatttcttgttctttttctccatgagatttattgcatcttacccatgatctcagaaaggagaatagaaactggt

SEQ ID NO: 6826764 - DNA, 56 bp, Homo sapiens
ggaggccggggccgggaggagcacccagacggagtgacttctggccctgagccacc

SEQ ID NO: 6826765 - DNA, 129 bp, Homo sapiens
gtggctgccaggctgtcccccacagcgcctccctcaaggctagaggagcggcgagctgagctggccgtactaccggctgcgtcctgtgttcctcgaggtcccaggaggccggggaccgcattcacccac

SEQ ID NO: 6826766 - DNA, 56 bp, Homo sapiens
cccaggaggtggaggttgcagcgagccgagatcgcaccattgcaccccagcctggg

SEQ ID NO: 6826767 - DNA, 96 bp, Homo sapiens
gtgtggagagctctgtcacccgagcaggcgagaactacttagctgattaattagcaaagctgagaaatctcaattgtgggtgaggagcacacacac

SEQ ID NO: 6826768 - DNA, 56 bp, Homo sapiens
gtccatcttgcaatgagacctaacttgcacctgcctgtttttctgcatgattggac

SEQ ID NO: 6826769 - DNA, 68 bp, Homo sapiens
ggcatggtaatcaggacacttctggggatttcagagtaagcttactctcctgtcctaattaccacccc

SEQ ID NO: 6826770 - DNA, 72 bp, Homo sapiens
gcatcctgtatgttttcctgggaaattacggtatttgatttagattcatcaggaaacttatgcagtggttgt

SEQ ID NO: 6826771 - DNA, 73 bp, Homo sapiens
ggtaggaggacaggtctgcagtaactgggaacttgggtgagttacccaactgctgagccttggttttctcgcc

SEQ ID NO: 6826772 - DNA, 57 bp, Homo sapiens
cagaaatgtttatgcttttgaagagtggcattgagccctttagaagttgaaactctg

SEQ ID NO: 6826773 - DNA, 59 bp, Homo sapiens
attcacagggacaatgggagagcaaaataaagttgcttttaggatctcactctgtgagt

SEQ ID NO: 6826774 - DNA, 75 bp, Homo sapiens
tgtatgtgtaaaacttcagtaggagccaacctcttttaacataaggtgttggttactaaggaggaaatcacagca

SEQ ID NO: 6826775 - DNA, 86 bp, Homo sapiens
gtgtaatcctgggtaagttcctaaggctcattttcatcatatataaaatgcagataatactagaacttactgtttaggattttcat

SEQ ID NO: 6826776 - DNA, 65 bp, Homo sapiens
cactgaaggaaggactactgcatccctaataatgagcggacctgtaataggatttcactgcagtg

SEQ ID NO: 6826777 - DNA, 76 bp, Homo sapiens
gctagcaatatactttctggcagtgaaataaattacttgatatttaaggtcagctgcataagtcaccttgcatggc

SEQ ID NO: 6826778 - DNA, 64 bp, Homo sapiens
ttgactgtaaagcttttctcatgcggaaatatggatgatctgtatagaaaggttttggcattaa

SEQ ID NO: 6826779 - DNA, 79 bp, Homo sapiens
aggatttcctccccagccccgcaggctcacctggtctttgtcacaagttgtctcagggcagctggaggaggcaaaccct

SEQ ID NO: 6826780 - DNA, 91 bp, Homo sapiens
gaatctatggcccattacccagaggaacgtttggattgattatcagaagtacacttcaaggaattcaaattttctctggagtcatagattc

SEQ ID NO: 6826781 - DNA, 76 bp, Homo sapiens
atacttaatcaagaatctctgatcaggctttattaacatgagagtcaggccaccaaaggattctatggaccagtgt

SEQ ID NO: 6826782 - DNA, 75 bp, Homo sapiens
gtggcatgtaggagtacttcattctattttattaccaaacaatattttactgaatgcagtactgatacatgccac

SEQ ID NO: 6826783 - DNA, 57 bp, Homo sapiens
ttctcaaagaaagctgtcattactctctgtaatttttcaatgagttttctttgagag

SEQ ID NO: 6826784 - DNA, 77 bp, Homo sapiens
cagtttatgaatagcattatgatgctgcagacctaccccgtctccatccaccctgcattatatttgctgtaaaactg

SEQ ID NO: 6826785 - DNA, 56 bp, Homo sapiens
cctttagaaagtcagtagttgccccaaattggcacttcatggcactgtcttagagg

SEQ ID NO: 6826786 - DNA, 58 bp, Homo sapiens
cctgggcatagaaccccaggtgaaggcacttaacactggttatccctgtgcatccagg

SEQ ID NO: 6826787 - DNA, 90 bp, Homo sapiens
tggattcaaacccaacattctttgtactttttctcaccacctctcaaacaggaaggtaggaagatagagcaaagtttgtggtgatggcca

SEQ ID NO: 6826788 - DNA, 58 bp, Homo sapiens
accctttgacaacaaggatcctgcctggccccaaaggccacagcttgtctgttagggt

SEQ ID NO: 6826789 - DNA, 68 bp, Homo sapiens
tcttcctttattattctctggagaatgtaacttcaagagttggcaaaggagaaaatagtaaatgaaga

SEQ ID NO: 6826790 - DNA, 69 bp, Homo sapiens
catttaatcctctgggcataccttggttctcttctgccagagctattgtgtgcccagcaggagtgagtg

SEQ ID NO: 6826791 - DNA, 129 bp, Homo sapiens
gatttgttcatcagttgaaagttactcgggtcacatctgaaggcggctctaggtcaccctagaggcctaggctggctgtcttcaggtcagggggctgagttgccattcaaagactcaaaggagtgaatc

SEQ ID NO: 6826792 - DNA, 56 bp, Homo sapiens
ccagtaaaaaattaagtcaaaatttgaggggaaaatccctgcttaattttgactgg

SEQ ID NO: 6826793 - DNA, 71 bp, Homo sapiens
gggtggggctggggtcccgggtcaggccagggaggggactctggccacccagctgacgccttcccctgtcc

SEQ ID NO: 6826794 - DNA, 77 bp, Homo sapiens
aaatcctagatatactgtagactggagtgctgaagtgaattacacatgaggtgcccagtctcacgtatacaggattt

SEQ ID NO: 6826795 - DNA, 60 bp, Homo sapiens
ggtgggagagctctgtctccagagctgtagcagtagatgggatagtggtctctccttatc

SEQ ID NO: 6826796 - DNA, 96 bp, Homo sapiens
caggatgcctctatgttttcctaagatgaccttataaagagcatttaatctgactgggatgcaatcttctcatctggaaaacaaagtgacaatctg

SEQ ID NO: 6826797 - DNA, 87 bp, Homo sapiens
tctaatgcaattatcactaaggggcgagcaagatgtttatatgatcttaaaatgtctgtctgcacgttgcttattagttgcaaaaga

SEQ ID NO: 6826798 - DNA, 88 bp, Homo sapiens
gcttcctggtttgctatcagttagagttgctgatactaccagtgtatgttcagctcagcactgacaagataaaacaaaacaaaaaagc

SEQ ID NO: 6826799 - DNA, 57 bp, Homo sapiens
cagagcctgctgccttctgaagtagatccttatttcattttaacaagtaaggctctg

SEQ ID NO: 6826800 - DNA, 86 bp, Homo sapiens
agttcatcagcacacacattcatgtttttgactagtgcctctctcccaagaggtgcacaggtgggaaaatgagtggggtcagaact

SEQ ID NO: 6826801 - DNA, 84 bp, Homo sapiens
catataccacagaactatctttcggccaactcttttcagttaatgacaaattatgaagtggttctattggttttgggacatgtg

SEQ ID NO: 6826802 - DNA, 55 bp, Homo sapiens
ggttcagcaggctctggttgaccgtgatgtcagtgatggtcccatactgctggcc

SEQ ID NO: 6826803 - DNA, 78 bp, Homo sapiens
aagtgcattgggttggtgcctgatttcagtggggagcctgtaagggctacccggaaaggcgattatccctctgcagtt

SEQ ID NO: 6826804 - DNA, 58 bp, Homo sapiens
ccaggatttgggatccctgaggcctttaacacatcactcagtcattgcctccttctgg

SEQ ID NO: 6826805 - DNA, 70 bp, Homo sapiens
gctgagctcatgtctgctttcagggaagcttaaagcctccaaagtctggagcagcagagcaagaatcagc

SEQ ID NO: 6826806 - DNA, 106 bp, Homo sapiens
ttagttagggcttttaattaacttccaaatgaatatttccatgggttcttgtaatccataaattcatggattatgttcagtgtttatgagagctggccctaactga

SEQ ID NO: 6826807 - DNA, 64 bp, Homo sapiens
tggtgggaaatacggccagctgcagagtgaatgtccactaagggggaaggctgtttttccacca

SEQ ID NO: 6826808 - DNA, 66 bp, Homo sapiens
gagtcttgtctgacccaatctttactatcatggttgtgaagtaaaggtctttcagtgccggcactc

SEQ ID NO: 6826809 - DNA, 117 bp, Homo sapiens
gctttttgccatgtgtcattcagttttagaatttctgctcactttgattgtaccatgaaacctacacttagatggagcagaaaacttcaatagggctaaggcatgtgagcaagaagt

SEQ ID NO: 6826810 - DNA, 59 bp, Homo sapiens
tctgaagcacagaagttcaattttccactgccagaaagttgagttttatgtgttacagg

SEQ ID NO: 6826811 - DNA, 91 bp, Homo sapiens
ctatcagttgagcagtggtgtttttctatccccaggtattgatcatataactaaaccttaaaggattaaagatctatttctcaaaatgtag

SEQ ID NO: 6826812 - DNA, 59 bp, Homo sapiens
ggcagcgagtcgccaagtctcgtatgcgccccgcaacgcgggaactaggcgatcgctcc

SEQ ID NO: 6826813 - DNA, 67 bp, Homo sapiens
gatggagtatgaggccatggtctgccctcagcagatggggcatctgacaaggccacatattctcttc

SEQ ID NO: 6826814 - DNA, 63 bp, Homo sapiens
acacgaccctggtgcgtgtacatacgcctgtgcttggacgggtgtgcattgaactgggcgtgt

SEQ ID NO: 6826815 - DNA, 83 bp, Homo sapiens
ttttctctgtacttctttcagagcaccccaccctcattagacagattctgactctggggtgctgttgaaagtgcagcaggaga

SEQ ID NO: 6826816 - DNA, 55 bp, Homo sapiens
tttggtcagggtaggacagttgcatatttttagtatgtaggtctaactgactaaa

SEQ ID NO: 6826817 - DNA, 67 bp, Homo sapiens
tgggcaagttaattaacctctccatcaaggagcatgatctttgaactggaaagagaattaaagccca

SEQ ID NO: 6826818 - DNA, 56 bp, Homo sapiens
tacctcactgaagctgagttttcatatcacaaaaatggagtagtaattgtgaggtg

SEQ ID NO: 6826819 - DNA, 79 bp, Homo sapiens
tgccaagagcctttgaaaagtgtttgctttcttttcatcccttatgatacagagcaagcatcttttccatgccttgaca

SEQ ID NO: 6826820 - DNA, 125 bp, Homo sapiens
gatagccacccaaacaaagtgttgaatgattagttccacaaaaggtctagtttaatgtacattgaatagatctctgattgttttaaaaggggagaatcttggaaatatctttgttaatgtgcatc

SEQ ID NO: 6826821 - DNA, 87 bp, Homo sapiens
cctgtgctgggaacctgcatgggggaaggaggaggagacgtgaccagccctgctcctgctggccctcgtgcctggtcctgccactgg

SEQ ID NO: 6826822 - DNA, 65 bp, Homo sapiens
ttgagttctggtggtttggagatctttgttccccagaacaaaggaatgctttcaccaggacacaa

SEQ ID NO: 6826823 - DNA, 88 bp, Homo sapiens
ggtatgtttctgagttgttgtccatgttgcatgcaatgttttatgaaataattggtagctggtataatgcctcattgaaataactgcc

SEQ ID NO: 6826824 - DNA, 84 bp, Homo sapiens
gagcagtcagatggatggagatgctttctctgagatggagacgctgagagcaaagcatgtctagggggccgtgatgaagtgctc

SEQ ID NO: 6826825 - DNA, 62 bp, Homo sapiens
tgctgaaatatttatgggtcaagtgtcatgataattgcaactacctttcaaatgattcagca

SEQ ID NO: 6826826 - DNA, 64 bp, Homo sapiens
tcaggcttccagaggaactctgcagtgcgtgacgaacgtattgttgcatcctctgaagagctga

SEQ ID NO: 6826827 - DNA, 88 bp, Homo sapiens
tcccatgctgtgaccctccaaagggaagcgctttctgtttgttttctcttaaacaaagtgcctccctttagagtgttaccgtttggga

SEQ ID NO: 6826828 - DNA, 70 bp, Homo sapiens
aaaagtccagtccaaggtggtttgctaatcccaactctagacagtggttggcaaagctccaccgattttt

SEQ ID NO: 6826829 - DNA, 73 bp, Homo sapiens
cactcgactgatgtaggcattctgttgttcgtatttgccgagttcagctaagaatgtctgagatcaacaggtg

SEQ ID NO: 6826830 - DNA, 74 bp, Homo sapiens
gaaggaagaagagataatggggagcaagtacaaggggaaacgagatgatgtcttgcccctcttttctttccttc

SEQ ID NO: 6826831 - DNA, 70 bp, Homo sapiens
atgccttatgaacagtatccaaaatgtgactcacctgtcgacatcggatattattccatgttgaatgcat

SEQ ID NO: 6826832 - DNA, 90 bp, Homo sapiens
agaatagaagtgtgggcagggcatttctggttgccagccaagatggtggagaaggggtggcttttagagccttcccacactgctgttgct

SEQ ID NO: 6826833 - DNA, 63 bp, Homo sapiens
gccggtgagcctcactgcccgctgctgccgcctccgcagagtgggcaggcagggtgcgcaggc

SEQ ID NO: 6826834 - DNA, 96 bp, Homo sapiens
tgttggccaggatggtctcgatatcttgaccttgtgatctgtccaccttggcctcccaaagtgctgggattacaagcgtgagccaccgatataaca

SEQ ID NO: 6826835 - DNA, 58 bp, Homo sapiens
ccaggaggccctagcagaagctgctctggtgtccagctcctgtgtgaagcctccctgg

SEQ ID NO: 6826836 - DNA, 92 bp, Homo sapiens
ggagggaagaggcaggctgtgggtctcaggctcagcctaggacacttcccccagggctggatcctccagactccccttccccactttcctcc

SEQ ID NO: 6826837 - DNA, 70 bp, Homo sapiens
aaagcatggaggagttttctggtactgggttccacagggaaagcacatgctaattaattccacctgcttt

SEQ ID NO: 6826838 - DNA, 60 bp, Homo sapiens
cacctggtggggcccacaaacctctgtttgcttcattttgggactctagagactcaggtg

SEQ ID NO: 6826839 - DNA, 108 bp, Homo sapiens
cttttgggcctattggcacccagggaaattaatgagttaatctattttcttaaataccagggagagattgaacattatttaatctgtgggctcaaaatggccttaaag

SEQ ID NO: 6826840 - DNA, 66 bp, Homo sapiens
agtgggcttgactgaaatagttcatttaggatgagaactttgtgtatagttgagtcaagtttcact

SEQ ID NO: 6826841 - DNA, 88 bp, Homo sapiens
gctgagtatcaatgtcttacatttactgagcactttcttcttgcgggatattgtgctcagaactgtgaatacatgtgaaccctcaagc

SEQ ID NO: 6826842 - DNA, 59 bp, Homo sapiens
gccagagaggccgaggtacccagagacaagcacagtgggaagccctcgccactctaggc

SEQ ID NO: 6826843 - DNA, 80 bp, Homo sapiens
ataataatattctatattggaagtgagaaattctgccaagaagtctcatgctgccaatagcctacaaagaatgaaattat

SEQ ID NO: 6826844 - DNA, 88 bp, Homo sapiens
taaagtgcttagtacactgcctggccctcagtgagtgctatgtaagggaataatgttaatgggtccaggcactatgctaagtacttta

SEQ ID NO: 6826845 - DNA, 103 bp, Homo sapiens
taaaggtgagcaaacccatgagcagtttttaaattgatgtgttttagtctacacatgaacaaattctgtttgagggttaaagaagctattattttgtccttta

SEQ ID NO: 6826846 - DNA, 75 bp, Homo sapiens
ccttaggagctggaaggcatccagtgagacacactagaggagagatggtctctgaggttgtttccagcactaagg

SEQ ID NO: 6826847 - DNA, 127 bp, Homo sapiens
ttgagcagctgttttgggctgtgagggtgtgggagctacaatcaatgtacatcatctcagcgactctgtgaaagaactttgggagaggtgcattatctacaccttacgggtggagagataggttcag

SEQ ID NO: 6826848 - DNA, 99 bp, Homo sapiens
cctttagggctgctgaacttggttatgcaatttctttgctgcatggaggtatcagccaaagagaccccatatccacaaggtattgcacttgcccagagg

SEQ ID NO: 6826849 - DNA, 61 bp, Homo sapiens
gcaagaagggtagttgtaagagtgatgcaacagcactacctcatttttattgctaccttgc

SEQ ID NO: 6826850 - DNA, 62 bp, Homo sapiens
acgacagcttcttgggccgggcctctggggacaggggttcctgctctctaggagctgcctgt

SEQ ID NO: 6826851 - DNA, 69 bp, Homo sapiens
ggactgattgcctggaacaggaacaacccctgtctcttctcagcttcctgtttacctggcagtctgacc

SEQ ID NO: 6826852 - DNA, 56 bp, Homo sapiens
gctttgcataatgaatgatcataatcaattgatatgaatgttccattttgcaaagc

SEQ ID NO: 6826853 - DNA, 78 bp, Homo sapiens
cccctaaaatgcatggcagcctgccctgcttgccttgccatcgctagttgcattagcctgggcaggctgcaaaagggg

SEQ ID NO: 6826854 - DNA, 63 bp, Homo sapiens
cctgacaaccagcactgctggggcctgcgtgctccaggcaggcatccaaggctgggctgcggg

SEQ ID NO: 6826855 - DNA, 79 bp, Homo sapiens
cagaccctctgcaactccagagtgctcactgatctggagacacatgcactctgtgatctgcagagcctacgaaggtctg

SEQ ID NO: 6826856 - DNA, 75 bp, Homo sapiens
ctttcctttccagccctttccttctcagcttttagacatgttttgtaaaagtaggggaaggggtggatacataag

SEQ ID NO: 6826857 - DNA, 76 bp, Homo sapiens
gtcatttggaaatgtaagaatgcaattaagcctgtaaaaataactaggattttgctcattctcatatttcctttgc

SEQ ID NO: 6826858 - DNA, 63 bp, Homo sapiens
gggatacagtcctgttcctggagtagttcacagctgtgaagggcagagacagggcaggacccc

SEQ ID NO: 6826859 - DNA, 56 bp, Homo sapiens
cccaggctggagtgcagtggcacgatctcggctcactgcaagctccgcctcccggg

SEQ ID NO: 6826860 - DNA, 56 bp, Homo sapiens
cccaggctggagtgcagtggcgcgatctccgctcactgcaagctcagcctcccggg

SEQ ID NO: 6826861 - DNA, 66 bp, Homo sapiens
tggtctaaggaacagatgtcagcagagctgaaaaccacctctaggatatggtgttaccttagatca

SEQ ID NO: 6826862 - DNA, 55 bp, Homo sapiens
acattgcagttatcagattgcctctgtgatccctgcagtctggtggcgtgcatgt

SEQ ID NO: 6826863 - DNA, 55 bp, Homo sapiens
gtatttaattccattaagttagtattaattttaacttaatactgggataagatgc

SEQ ID NO: 6826864 - DNA, 56 bp, Homo sapiens
tgctattctgattcctttggttgggtgacagtttccaggagggacctggattggcg

SEQ ID NO: 6826865 - DNA, 91 bp, Homo sapiens
ggagggatgggtgaatggatggatggatggattgatggataactaaagttccagtcaatcattcttgccatttattttctcaggaatttct

SEQ ID NO: 6826866 - DNA, 83 bp, Homo sapiens
tctctttaggcatcatgtagacatagtcaaacactcatctccagttttctctgtgtttggatgatttaaaaacctaacagaga

SEQ ID NO: 6826867 - DNA, 55 bp, Homo sapiens
gccctacctcagtccagatctgagtcagggtctggaaagagctgaggttcagggt

SEQ ID NO: 6826868 - DNA, 65 bp, Homo sapiens
gtggggggtgttggccttaatctggaatggcaactgtatttctcatcaagtgccaactctgacat

SEQ ID NO: 6826869 - DNA, 57 bp, Homo sapiens
gcttctgaaggctctaggagataatccatttccttgtcttatctagcttctagaggc

SEQ ID NO: 6826870 - DNA, 72 bp, Homo sapiens
tggcagctgcaggcctcctgaggccctggctcagaacatgcactgcctccctcaggctgtctgctggttcca

SEQ ID NO: 6826871 - DNA, 81 bp, Homo sapiens
caggcacccaccaccatgcctggctaattttttgtagagatggggttttgaaatgttggccaggctggtcttgaactcctg

SEQ ID NO: 6826872 - DNA, 71 bp, Homo sapiens
agttatgaagattttcgggtacttgataaacatcttcatctgtgtatttatgaccgaagattttcccagct

SEQ ID NO: 6826873 - DNA, 55 bp, Homo sapiens
ctgccagggccctactcagtttaatttccaaaactgattaggcattacctggaag

SEQ ID NO: 6826874 - DNA, 80 bp, Homo sapiens
cctgcacatgctcacacaagtcgaatctgtaataggacttaaaactctcctgtcccagcactttgggagtctgaggcagg

SEQ ID NO: 6826875 - DNA, 97 bp, Homo sapiens
ggttgaacattgtttaatggttagatgttatgtgtgtctgcatttaaaaaaattgtgtacatgttatttcactattggtattacaatattcataacc

SEQ ID NO: 6826876 - DNA, 60 bp, Homo sapiens
tccagcactggcctgagtatctgtgtcaatcccagcatgggtgtccagggcgtgtctgga

SEQ ID NO: 6826877 - DNA, 73 bp, Homo sapiens
tggaggatgagacgccacacatctggattgttaaggagctagcaacccaccagctgtggtgtcctaccctgca

SEQ ID NO: 6826878 - DNA, 71 bp, Homo sapiens
agggaaaaattgaccagtgcacactgtcttctgtctcaaagaggctgcacaaagtgttggttaagttccct

SEQ ID NO: 6826879 - DNA, 71 bp, Homo sapiens
gcttttttcttgtttagattctttgtcttgtgcttcctgtatcttatatggcttctgaggaatggaagagc

SEQ ID NO: 6826880 - DNA, 63 bp, Homo sapiens
gcttcggtcattgcagtctcagtcaggtccccacttaactgaccacagacccaatgactacgc

SEQ ID NO: 6826881 - DNA, 79 bp, Homo sapiens
gggcctttctctggaggggagtggttaaaaggacatgggaggttaatgtcgaaactgcctccccattagagagacgtcc

SEQ ID NO: 6826882 - DNA, 61 bp, Homo sapiens
taaatacagtcatttgagccattattagcgaaaggtattgtctttgttaggactgtgttta

SEQ ID NO: 6826883 - DNA, 100 bp, Homo sapiens
gcaggaaaatcaggttcggggccagacagacttgagtttgaggctcagcaatgccgcttctgagctgtgtggtcctgggcaagtaacttgacctccctgc

SEQ ID NO: 6826884 - DNA, 72 bp, Homo sapiens
ctctgttgcctaggctggagtgcagtgacgtgatctcggctcactgcaacctccgcctccctggttcaaggg

SEQ ID NO: 6826885 - DNA, 92 bp, Homo sapiens
ttcaggtcatgaggtggcacacacttcctgccccacccacccctattgtgtggtcaataggcagaattgaaatgtgtcacttctggactgag

SEQ ID NO: 6826886 - DNA, 60 bp, Homo sapiens
gaggaagaagggattagaactctcggccaccatactgcctcgttctgcagcttctttctc

SEQ ID NO: 6826887 - DNA, 77 bp, Homo sapiens
gccccagcacctcctctgtgcagctgtgggtagtcatatcaacaaagggagacccagggcagccagcggggaggggc

SEQ ID NO: 6826888 - DNA, 55 bp, Homo sapiens
ttttctttccatacatattgctatcacttcggtgatggtaatgtaagagaggaga

SEQ ID NO: 6826889 - DNA, 59 bp, Homo sapiens
agtgctgtggctttcatggaggaaacaggactcacttctagcctccaagtccccagcct

SEQ ID NO: 6826890 - DNA, 59 bp, Homo sapiens
tacaatacttaacctattttgcaaatgaagaacatgagtcaggaaggttaagtaatgtg

SEQ ID NO: 6826891 - DNA, 66 bp, Homo sapiens
gtccaccatagggagggcgtggcgtgtgcctggttggcaggcccgtaggtcccttgtggttggagt

SEQ ID NO: 6826892 - DNA, 126 bp, Homo sapiens
gcatctggtggctgcttaagtagtaaccctgctgcaggcttcaggaggagcaaatcacaacatctgtgtttctccagcaaaacagcagggctattaaaatagctcttaggcacaatctatcactgc

SEQ ID NO: 6826893 - DNA, 85 bp, Homo sapiens
gagctagccagcagatcaatgtagaatattctgaatttttaattttaagtgcttctaagttgaatcatgctgaatataaatgctc

SEQ ID NO: 6826894 - DNA, 83 bp, Homo sapiens
ggctctggtaactttagtcatctatttggtgggcagggggcctactcaggccctccctatgtagatgatgttttacaaaagcc

SEQ ID NO: 6826895 - DNA, 61 bp, Homo sapiens
tttcaaactgctaccttttatgtgcagcactcacagctgccacttgaagctcagtttgaag

SEQ ID NO: 6826896 - DNA, 64 bp, Homo sapiens
acaggggctgtttgcctcaggcccttggctcctttccccaagggcctgtgctgtcagccctagt

SEQ ID NO: 6826897 - DNA, 62 bp, Homo sapiens
gaggcagagccagtctctcactaaaaaatgctgttaaatgtcagatactagctctcagcctc

SEQ ID NO: 6826898 - DNA, 65 bp, Homo sapiens
ggggtgaggaatgccagatagttctcttcccaccggaattccagctactaggattcattcaccct

SEQ ID NO: 6826899 - DNA, 93 bp, Homo sapiens
ttcctattgctccttttgttgctatttagcacctgtgcacaccaggcattagtcggtgcattgggagtcagtgctgaacaaagggggtaggag

SEQ ID NO: 6826900 - DNA, 124 bp, Homo sapiens
gtttcactctggaggctcccagcagcagccgacctggacacacacagcatatacctgagctaggtatgctgttgtcttcggccacgtgcccctggcatttccaaagccccaccctttgtggagc

SEQ ID NO: 6826901 - DNA, 82 bp, Homo sapiens
agccgtttccagtgagtttggggaaagttcttgaaagtaacaataaagttatttacaactcttctcttcctgggaaaaagtt

SEQ ID NO: 6826902 - DNA, 69 bp, Homo sapiens
tagcagggttttgaagagggttgctgggggtggctgactctgccaaaatgtttcctttttctcttgctg

SEQ ID NO: 6826903 - DNA, 83 bp, Homo sapiens
gctctcactttggtatttcctcaggcatgtcggtgcaataagatgtcagcaccatgacactgttatggtgaggtaaggagagc

SEQ ID NO: 6826904 - DNA, 65 bp, Homo sapiens
tatcatttgttattattagtggagatgggacgccaagtccctggaatgctaaaataaggaagatg

SEQ ID NO: 6826905 - DNA, 74 bp, Homo sapiens
aaatcagatactggtattggatactttaatttataacatttttttaaagttacagtaattcagtgtaaaggttt

SEQ ID NO: 6826906 - DNA, 72 bp, Homo sapiens
attcatctctgtgtccccagagcttgttctgtgtcaaacattgtcctgggttctgaggacaacagagggaat

SEQ ID NO: 6826907 - DNA, 68 bp, Homo sapiens
gacttgccctggcattgagggtcacaaggctactcatggactcaggccccaccttgctattccaagtc

SEQ ID NO: 6826908 - DNA, 57 bp, Homo sapiens
acagagcaactttatttcatggtccttcatgtgaccactccatatggttgattctgt

SEQ ID NO: 6826909 - DNA, 77 bp, Homo sapiens
tgccagctttggcacagggtggtgccccttttcattcttatctccatcacccttgattgccaagccttcccttggca

SEQ ID NO: 6826910 - DNA, 81 bp, Homo sapiens
ccagataatgaggaagctcttgaagaccaccaggatcatgttgaaaacactcaggggtcacctcgaagaggcttccactgg

SEQ ID NO: 6826911 - DNA, 68 bp, Homo sapiens
gacatgctaatgctctgaaggggtcttagcttctctgaagtgaagtgattgaagggtagggtagagtc

SEQ ID NO: 6826912 - DNA, 56 bp, Homo sapiens
ggggctgcctttcttctgggagcctcgtccctgctgcctcccacttgggcagcccc

SEQ ID NO: 6826913 - DNA, 56 bp, Homo sapiens
atagtgctggagctaggatttgaatccatccaggtcatctgcctccaaagcactat

SEQ ID NO: 6826914 - DNA, 103 bp, Homo sapiens
ggtctgaaaaccagtgacctaagacaacatgatcagcagtccttcccagataataattatttttccaggatttgtttataggtcttaaagtgactttcaggcc

SEQ ID NO: 6826915 - DNA, 71 bp, Homo sapiens
tagaggctttatatgacaagatggctaaaattattcagtttgaagacatattgttacataatgaccctctg

SEQ ID NO: 6826916 - DNA, 66 bp, Homo sapiens
gaagggaatttggagggtttcaccacatagctgctgccttgatggaggctccctcacacttctttc

SEQ ID NO: 6826917 - DNA, 59 bp, Homo sapiens
tgctttcctgggccaaaagaagtgttctttgctcaaaggaactgaggcctagggaggta

SEQ ID NO: 6826918 - DNA, 67 bp, Homo sapiens
tgtgttgaatgcctgctgtgtgccagacagctcagtgcctgggtgcgtggacacagagattaacaca

SEQ ID NO: 6826919 - DNA, 99 bp, Homo sapiens
gttgatctcagtcttctgatgggtggagtcttaaaaatcaaatggatggagtaatcaagtcctgggtgaggctttattttaggtgagaatgagatttac

SEQ ID NO: 6826920 - DNA, 77 bp, Homo sapiens
gcaaatatagcagtggataatggagttgatctgtagctagcctatagcaactgcctttactatattttaatatgtgc

SEQ ID NO: 6826921 - DNA, 67 bp, Homo sapiens
gctgaatgaggcgccagcttgcatctagaggtcaattctctgtattcaagcttctgcccaaacaagt

SEQ ID NO: 6826922 - DNA, 59 bp, Homo sapiens
gccccttccactggcgaggagacagcgagaaggcgccatctctgacccaggaagagggc

SEQ ID NO: 6826923 - DNA, 90 bp, Homo sapiens
ttgaattttatgtatccataagtgcttgttgaataatagcatttattgaatgctgtcagtatgcttaagcactttttatgtgttatttaa

SEQ ID NO: 6826924 - DNA, 115 bp, Homo sapiens
ctctttttcaggattctggaacataccacctgttttagtctttaatcatctctccactcattacaggtgcagaaggttgaagcagctggaaacatctgttcccagagaaaaggag

SEQ ID NO: 6826925 - DNA, 55 bp, Homo sapiens
cttgaagaaagtatgttgggatcataatgatgtcaccctcagttctctcttcagg

SEQ ID NO: 6826926 - DNA, 58 bp, Homo sapiens
tgtgtggcatgggcatttgggcattttgtatagcatgaacatctcccacagccacaca

SEQ ID NO: 6826927 - DNA, 63 bp, Homo sapiens
ttgctgaaaatgcgtatcttccaggacacacaggagtcttggccttgccacatttgtcagcaa

SEQ ID NO: 6826928 - DNA, 82 bp, Homo sapiens
tacctttgcctctgctagaaggtcaatctcttttccgcttaagaggagatctgggctgtttctggcaggggaaagaagagta

SEQ ID NO: 6826929 - DNA, 69 bp, Homo sapiens
tgggactctcaggctttgaatccagccatgatgctctgaggaagtcaagtagccacatggagagaccca

SEQ ID NO: 6826930 - DNA, 61 bp, Homo sapiens
tctctaccttccttcagagcccacatccttgtccatgtttgttgaatgaagaaaggagaga

SEQ ID NO: 6826931 - DNA, 61 bp, Homo sapiens
catttattgagtggccacagtgtgtcaggtactaggatacatttgggagcaaaaatagatg

SEQ ID NO: 6826932 - DNA, 70 bp, Homo sapiens
gcagggagggcttgacaagggctggagcccctggtcaaggggcacaaccagttctatcgggtcaccttgt

SEQ ID NO: 6826933 - DNA, 64 bp, Homo sapiens
cttgcttttgtgtgctctctggagctcacccatgcatgatgttccagtggacttcaaaggcaag

SEQ ID NO: 6826934 - DNA, 77 bp, Homo sapiens
aaggaaccctttttctgtcaagtttctctgcaatttatttaagcgaaggtacatttgataaaaatagcaggctcctt

SEQ ID NO: 6826935 - DNA, 89 bp, Homo sapiens
taacccagggaccaagtccatacattgagaataacagagaggaaagataaaagaaacctgtgttctcattgatgtgagttactgagtta

SEQ ID NO: 6826936 - DNA, 122 bp, Homo sapiens
tcagggagttgggaaaggagatgtaacttccatcatgggcctgagccgattcttgagagatggtcagggctgggtatgaagagttgggaggagacacattccaggcaccgagaacaccctga

SEQ ID NO: 6826937 - DNA, 92 bp, Homo sapiens
agtgtattgcctaggatggtcggtttattttcaggaactgaatttataaataattcaggaaatgaatcagaccttattttatcagcaacatt

SEQ ID NO: 6826938 - DNA, 77 bp, Homo sapiens
gaattggtcctcaggaagtctcttccattctctgcctcagagattgtatcctcggagacttctctctgggctgagtc

SEQ ID NO: 6826939 - DNA, 58 bp, Homo sapiens
gtacctgtagcaaatgatgtactttgaaagttttcagagacagtattggctattgtac

SEQ ID NO: 6826940 - DNA, 61 bp, Homo sapiens
tacatccacttaaaagttcaggtatggatacacccattgatttggaatgctagtgaatgta

SEQ ID NO: 6826941 - DNA, 61 bp, Homo sapiens
acccacatcaaatgctaattctgatgtgcatccccatcagatttggaaagctgagtggcgt

SEQ ID NO: 6826942 - DNA, 65 bp, Homo sapiens
ctcctggctcgcccccagctgaggattgctgcacagagaaatagtcactggacgtgagccagggg

SEQ ID NO: 6826943 - DNA, 58 bp, Homo sapiens
gttggcccagaaatgaacttgctgtggatttgatcctcccagtcatagttggggcagc

SEQ ID NO: 6826944 - DNA, 117 bp, Homo sapiens
gccactgatgagcagcagccatgtttctgtggtctcccatgtctgtgggtctcagtgagggccacaaggtgaggaccaagaatgtgagcaagcatggccactgctgccaccgcaggc

SEQ ID NO: 6826945 - DNA, 79 bp, Homo sapiens
ttctgatgcggtccctctgctcaatggctcagcagatttgtcaggagcatttctgggcaaaggctgtaacccatcagag

SEQ ID NO: 6826946 - DNA, 68 bp, Homo sapiens
ttcctcagaagcgagcgagcctcttccacaatttggggacactgtggaagaacttcttgcttggggag

SEQ ID NO: 6826947 - DNA, 57 bp, Homo sapiens
gttcctggggggatagatttcacctgatagcccaggcacatccctatacttaggagc

SEQ ID NO: 6826948 - DNA, 60 bp, Homo sapiens
caagatgaaactacagggaggaaagattagtcaccttggttccctagagtgctcatcttg

SEQ ID NO: 6826949 - DNA, 87 bp, Homo sapiens
tatgcagcagccataatagcagataggacatttcattctcagccaccttctggcaaagatggaattcagtcctgggctttttgcatg

SEQ ID NO: 6826950 - DNA, 60 bp, Homo sapiens
cgggcaccagcggccgcactgccctggccgacccacgtcctggcacggcccctgggcccg

SEQ ID NO: 6826951 - DNA, 65 bp, Homo sapiens
gtttagatgggaggcatttcaggaaacaaatgtgtggggagaagctgccttttatacctttaaac

SEQ ID NO: 6826952 - DNA, 78 bp, Homo sapiens
agaaaacaggcaaggaggcactgagggagaaagacacagactttatcgctctgtggctcattgttactggaatattct

SEQ ID NO: 6826953 - DNA, 76 bp, Homo sapiens
gcagttctaaggcaaacaggaaagcaggcaccactttttataaaggccttctcagatttgttcccttagtgactgc

SEQ ID NO: 6826954 - DNA, 99 bp, Homo sapiens
ggctcttgctccatccccactgcccctggtgatggacgccatgggaaatggtgagcaaggcagggaggtggagggaggtggggaggaggagggggagct

SEQ ID NO: 6826955 - DNA, 70 bp, Homo sapiens
gtagatttgtcaatgccaagattaatcacaggacagataggaagccttggtcatcgataattgaatctgc

SEQ ID NO: 6826956 - DNA, 59 bp, Homo sapiens
tgagacagctgtggagaggcatgtgttagtgctccagccaacagtcccagctgagctta

SEQ ID NO: 6826957 - DNA, 81 bp, Homo sapiens
tggcttgatgctgctatctttctgcaccataattagttgcatgtatagttaattattatgagaaaagcagaacatctccca

SEQ ID NO: 6826958 - DNA, 60 bp, Homo sapiens
tctccatcaagaatccaagggtctaatgcagcttccagaagtaccctttattggtagaga

SEQ ID NO: 6826959 - DNA, 77 bp, Homo sapiens
tgcttaagtgttgatctctgacttgttttccaaataatggtcattttttcatggttcaatcagttggcatttgagca

SEQ ID NO: 6826960 - DNA, 60 bp, Homo sapiens
ggcctgtgcaagacagcaccccgcaactgcataaaggtcaaggggatgctgcttgcagcc

SEQ ID NO: 6826961 - DNA, 83 bp, Homo sapiens
gcccaagaccacacagctagggagtggcagagcttggaataacacccaagcttgtctgagatccctaaggctgtgctctcagc

SEQ ID NO: 6826962 - DNA, 73 bp, Homo sapiens
cttaaagcactttggaaattgtctataagagggcagggtcttcaaatagctcctccaagtcctaggttttaag

SEQ ID NO: 6826963 - DNA, 84 bp, Homo sapiens
ccgtctctgcagcctgtctgggcagagtggattgtggctgaagccaggtgtcccacgactcagacaggctggtgccagaggtgg

SEQ ID NO: 6826964 - DNA, 58 bp, Homo sapiens
gtgactgaagaagccacattggatgttgatcttccagcctccagctgttttgagtcac

SEQ ID NO: 6826965 - DNA, 81 bp, Homo sapiens
cagaaacgtatttagaaggctgctgaaaagactggcaagtcgtttgatatttttaagtgcaatctgaatgcgggaaatctg

SEQ ID NO: 6826966 - DNA, 59 bp, Homo sapiens
ttgctgagatgatctgttgtggtagctatgagtctagcataacacccgacactcaggaa

SEQ ID NO: 6826967 - DNA, 55 bp, Homo sapiens
ggactgagacggctccaagtgtcctcagagtggggcagaaaggaatcttaggtcc

SEQ ID NO: 6826968 - DNA, 75 bp, Homo sapiens
gcaccttgaggatcatgcctgccttgtgtcatcataacccagtgcctacagcagagcctggtacttactaggtgc

SEQ ID NO: 6826969 - DNA, 59 bp, Homo sapiens
agtttctaactggtgcagtgctgcaacattaatagttgctctgtgaatagttggtgact

SEQ ID NO: 6826970 - DNA, 58 bp, Homo sapiens
cgcgtcccgggggagatccgtgcggacgggacgccggagcagagccactcgggccgcg

SEQ ID NO: 6826971 - DNA, 64 bp, Homo sapiens
gcattctggaggctggcttcccctggctcataaaagtggccaaagctcagccctgcatggatgc

SEQ ID NO: 6826972 - DNA, 57 bp, Homo sapiens
ttgctcataatctatggggcaaggcttccgccgcctggctccaggatggctgggcga

SEQ ID NO: 6826973 - DNA, 89 bp, Homo sapiens
ggatgatcagaaaggagatcagtagtaagatggaggaacaccagggaaagatcatcttgccacttcatcccctttccagctccccatcc

SEQ ID NO: 6826974 - DNA, 69 bp, Homo sapiens
aagaatgccaataagacacacaactgtcaaggggaacaaacacttctgcttgctggtcagggtattctt

SEQ ID NO: 6826975 - DNA, 81 bp, Homo sapiens
ttactatatactatattgctgatgagacagcaaattgaatatcactgacaagttgtctcaacagtgaaatgtgtttgatga

SEQ ID NO: 6826976 - DNA, 89 bp, Homo sapiens
gttaaggggagactaacccatcacagacactgggttattgcaagttatccagatccagtatctgtgatgggttaaagtctcccctagat

SEQ ID NO: 6826977 - DNA, 68 bp, Homo sapiens
tccatatacctgcagcctggtttttccaagagagcaaaaaggactaagctagttgcttgtgtaatggg

SEQ ID NO: 6826978 - DNA, 73 bp, Homo sapiens
cccgacttgttcctctagtctctgtatttcctgccaacaggaagctgaatccagagacagggtccgattcagg

SEQ ID NO: 6826979 - DNA, 75 bp, Homo sapiens
ggaggcgctgaccagcagtgtgggactcctggggcccaacccccagcctgctctcagatgttgagccagccctcc

SEQ ID NO: 6826980 - DNA, 100 bp, Homo sapiens
ctttcaaaatgcaggttcctgtgccatctctagagactgaagtttaccaggtctgtagttattctggtgaggtagtcagaaggaccatgcattgagaaag

SEQ ID NO: 6826981 - DNA, 98 bp, Homo sapiens
tcagtcttcataattacattgtctgatttagagtgtgattacattaatgctagatcatgttgctcaaaattaaacaagtgggtaatttccaagattga

SEQ ID NO: 6826982 - DNA, 72 bp, Homo sapiens
aaggattagtataattgttctggaatcaagagttcctgttctcttgctagaattaggttaaacaaagttttt

SEQ ID NO: 6826983 - DNA, 59 bp, Homo sapiens
gccccagtgtcctgcagggcagtagctttttgacattgttcatgccctgtgcctggtgt

SEQ ID NO: 6826984 - DNA, 64 bp, Homo sapiens
ggcccgggcgaggggagcccagctaggtccacggcggccgccggaggggctcctgttcgccccc

SEQ ID NO: 6826985 - DNA, 65 bp, Homo sapiens
aggagggaaggagttgaatggcctgctcctgtctttcaggaagtcctgaaacttctttctgaact

SEQ ID NO: 6826986 - DNA, 71 bp, Homo sapiens
gaaattcaggggcttcttcctggctcctattaattatcaggttgggtgagtgggaaaagcccagaatcttc

SEQ ID NO: 6826987 - DNA, 58 bp, Homo sapiens
gtttaatttcctgatgggggtgctggttacatgtgttctctctacaggaatttattac

SEQ ID NO: 6826988 - DNA, 78 bp, Homo sapiens
gtttggtctccatggagcccacagggaggctgctgttacctggcggccttctccctgggcatcacaggagagtcgaac

SEQ ID NO: 6826989 - DNA, 63 bp, Homo sapiens
ttgtgataaaacattagacatttatgtcaaaagcagtattgtctcagaagtgttttataacaa

SEQ ID NO: 6826990 - DNA, 65 bp, Homo sapiens
ggagttaacatggtcctgaatgccttcatagtcccataccctgggaggaggcatcttaggctttc

SEQ ID NO: 6826991 - DNA, 64 bp, Homo sapiens
gcacctgttcttttacttcattggatccttacaagagtcccatgtaagaaggagacaggattgc

SEQ ID NO: 6826992 - DNA, 55 bp, Homo sapiens
ccattaggcagtatttctgaaagcaggcctacctgacagcaataatgccagatgg

SEQ ID NO: 6826993 - DNA, 88 bp, Homo sapiens
tgggagaagaggctggaaggtgtgggtttgggagagagctgtgagcccaggtctggctgttaggcctgaccttccacctcttctccca

SEQ ID NO: 6826994 - DNA, 74 bp, Homo sapiens
gcgcaacacctctatttacaagtattatcattctgctcctgtgagaagtgatggcagtgaataaggctgtgtgc

SEQ ID NO: 6826995 - DNA, 70 bp, Homo sapiens
ctctgagcgattaaggaggcatactgatttagtcttgacctctcaagactaaggcttctttaagacagag

SEQ ID NO: 6826996 - DNA, 64 bp, Homo sapiens
tttccccatatgctatgtgtgggctcatcctgtggaaacaggccagagcgcgtggttgggggaa

SEQ ID NO: 6826997 - DNA, 71 bp, Homo sapiens
cacacacgtatgtgttagccaactgtttatcatatgtacatgttatacatatgtgttaacaaatgtgtgtg

SEQ ID NO: 6826998 - DNA, 61 bp, Homo sapiens
tctgcgtgtttttgtttgtaatgagatggataagtacatcagactagatacaacatgcaga

SEQ ID NO: 6826999 - DNA, 56 bp, Homo sapiens
cttcagtgtgcctaagtcagttgtgctatgttgcataattccagaggtcactgaag

SEQ ID NO: 6827000 - DNA, 57 bp, Homo sapiens
agaaggcttttctaccagatctttacatggcaggatcctccttagaaaagacctttt

SEQ ID NO: 6827001 - DNA, 66 bp, Homo sapiens
attcatgctgtgctattcgtgctgtgctattctttaaggcactcaatgttctcatagcacctgaat

SEQ ID NO: 6827002 - DNA, 58 bp, Homo sapiens
ggggagctgcggtgagcgcggccgagagatggccgtgagctcccagcctgcagtcccc

SEQ ID NO: 6827003 - DNA, 79 bp, Homo sapiens
ggtcaccgctggacagccctcactgtgtgccaggcctgtccttagcgctgtgagggagggctgtcctcaccaggtgacc

SEQ ID NO: 6827004 - DNA, 83 bp, Homo sapiens
gtaggttctctgcagggcccaaggtcaacggaacattccaggctgactttcctctgggccctgccacccacggaggaacctac

SEQ ID NO: 6827005 - DNA, 63 bp, Homo sapiens
aagtgggctgtcggaggagacatggggagcctgctcctaccgtggttttccctggagcccctt

SEQ ID NO: 6827006 - DNA, 58 bp, Homo sapiens
tgactagtttatgctcagatgtcttccattaggaaacctaaaagtcttgaactagtta

SEQ ID NO: 6827007 - DNA, 87 bp, Homo sapiens
gctctttggcttctgttttggctctgttcttaggctagtttattgaagggcagagaaatagatgccgacaatatctggatttagagc

SEQ ID NO: 6827008 - DNA, 65 bp, Homo sapiens
ggccacaatggactggaccagtgagttaagggtaacttttgctttactttgccattcgttgggct

SEQ ID NO: 6827009 - DNA, 61 bp, Homo sapiens
tctctgagaagttcctttgtgaaagtacaaaagtctcacagaattgatggaaatctcagga

SEQ ID NO: 6827010 - DNA, 110 bp, Homo sapiens
ttcatatggatgcagagctttttaaccatatcaaagagaaggataggagcttaaaatatgaaactcctgcttttgatatgcttaaattctgggtctgatatctttttgaa

SEQ ID NO: 6827011 - DNA, 88 bp, Homo sapiens
ggatccgagatgattcttggctttagaacatgggagccaggtaaataattatgctaccgtgttctgtgctaaaattgagacttggtcc

SEQ ID NO: 6827012 - DNA, 69 bp, Homo sapiens
gtccgggaacccggcgtctccgcctccggctgctccgcgcggagagcctgttcggaggcgcccccgggc

SEQ ID NO: 6827013 - DNA, 77 bp, Homo sapiens
taaaattattgctttatgtggctgatactcattctgttgggtcagtgccattgccatatgagttgctaaatattttg

SEQ ID NO: 6827014 - DNA, 85 bp, Homo sapiens
gacctatataattaagtccttcacctaatcctcaatattttctgcccttgagatgcaggagatgggactgtttttatatgctgtc

SEQ ID NO: 6827015 - DNA, 62 bp, Homo sapiens
cagcccagaactcacgtctccagtactccacgccctccatctggactggtgagtttaggctg

SEQ ID NO: 6827016 - DNA, 66 bp, Homo sapiens
gcatgaggtttgggctctgtgacctggacactgaggaagctcccagaaagagactaggacccatgc

SEQ ID NO: 6827017 - DNA, 89 bp, Homo sapiens
gtgttatcaatgcttattcaagatgttgtgaactctcagcaaaatcattccattcttaggagggtgcagctttgaaagcatgtaaacac

SEQ ID NO: 6827018 - DNA, 64 bp, Homo sapiens
taatgtacctcattctttctaggcactaatcagatttgcaagtactgggagaagaggtacattg

SEQ ID NO: 6827019 - DNA, 78 bp, Homo sapiens
ggaatataaaggtataggacaaggatagagactaaacatttctttggtttcatgtttcctcttgtgctgctgtattcc

SEQ ID NO: 6827020 - DNA, 58 bp, Homo sapiens
tgtgacatgcaggaggtgctcacgtgcctctagcccaccagcatctctgcctgttaca

SEQ ID NO: 6827021 - DNA, 61 bp, Homo sapiens
aggagcaggcttgacagcctgggcacctgcacctgccacagctacctgcatgcctgctgct

SEQ ID NO: 6827022 - DNA, 56 bp, Homo sapiens
aaggcacagccacttgatcatcctggtgactccatttgaaataaggagttgtcctt

SEQ ID NO: 6827023 - DNA, 65 bp, Homo sapiens
gagacaggggagagtgaagaggtagggagcccggcagtctttgctgagtacatctccaaagtctc

SEQ ID NO: 6827024 - DNA, 120 bp, Homo sapiens
cattatatacacatctaaaataaaggagacttggcatcacttaatagctatgtcatccaggacaggtaacttaactttaagggatccagtttccttatatgtcagatagagataataatg

SEQ ID NO: 6827025 - DNA, 64 bp, Homo sapiens
gtttcctttgccagtaaatggggatatgatcccctacaatattatagtggaaattaaaggagat

SEQ ID NO: 6827026 - DNA, 64 bp, Homo sapiens
ggtgaccatttctaggaatcagactccagcctaactacagtcaagaaatcctgaaggagtcatc

SEQ ID NO: 6827027 - DNA, 65 bp, Homo sapiens
ggtgactgggaggtgaacagaaaaactaagaaagacttagtttttccttatatatcctttgcacc

SEQ ID NO: 6827028 - DNA, 111 bp, Homo sapiens
gctaggtagagaaggattaaatcagatgatttcaatcaacatctatgggttgcgccctatattatgtgcaaactattctgcttgaaattattctcttgaaaatccaccagc

SEQ ID NO: 6827029 - DNA, 66 bp, Homo sapiens
cccccagtggcaggggaagcaggtgtggagtgggttcaggctggctgggtcctgcagactgggtgg

SEQ ID NO: 6827030 - DNA, 59 bp, Homo sapiens
ccctcataccctgccccactgaggctgactcttcagtgctaaaagagctggtgtgaagg

SEQ ID NO: 6827031 - DNA, 66 bp, Homo sapiens
gtgtgtgtatatatacacacacacacagaaacatgtttctgtgtgtgtgtgtgtgtgtgtatatat

SEQ ID NO: 6827032 - DNA, 90 bp, Homo sapiens
gcatggtgttccattccttggaccactctttaagaaggacaaagtcaaataggccttcattcaaagaggcatccaagagggaaagtatgc

SEQ ID NO: 6827033 - DNA, 55 bp, Homo sapiens
cattcctggcccgggcgccgtcgtaaggggcaggccgagcccgcggcccggggtg

SEQ ID NO: 6827034 - DNA, 60 bp, Homo sapiens
agctgttttactggttgtataactaaaaataagataatgttatgctgggtaaccacggct

SEQ ID NO: 6827035 - DNA, 61 bp, Homo sapiens
gggcgaggggccagtctcctctgggagctccccggagagtcagagcgcggcccccacgccc

SEQ ID NO: 6827036 - DNA, 61 bp, Homo sapiens
gatgtgtaacatgctgtgacatgggtgttgtcaaaagcactggacaggaatattgcatatt

SEQ ID NO: 6827037 - DNA, 80 bp, Homo sapiens
ggttattttgaaactgcatttgcataagtccatctgagcaaacatttttatggagttatgaggtgtggtttgcatcagcc

SEQ ID NO: 6827038 - DNA, 78 bp, Homo sapiens
attcttccatctggctatcccttagtcaattcaaataaatatttatggggcactttgggtaagccaggtgctaagaat

SEQ ID NO: 6827039 - DNA, 62 bp, Homo sapiens
tatgcattatgcctgtgcctgagggacccgtaatgagggaaattgtgtaggtctaatgcata

SEQ ID NO: 6827040 - DNA, 67 bp, Homo sapiens
tgcagtgtgcctaacacgtaattcaccaggacgtgtcttctgggagtcatcgtgtttggatcctgca

SEQ ID NO: 6827041 - DNA, 73 bp, Homo sapiens
ctgtgtgacctgggttgctggcgtgagggtctgtcgggctgaggcctccttcctgcctgcagccggttcacgg

SEQ ID NO: 6827042 - DNA, 101 bp, Homo sapiens
ggtggcacattgcctgtaatcccaactacttgggaggctgaggcaggagaatcgctttaacctgggaggtggaggttgcagggagttgagatagtgccact

SEQ ID NO: 6827043 - DNA, 130 bp, Homo sapiens
ctatttggtgctacttctactcctcatgaccaaagctggctttcatggtttactcatgtacttactgatgaaaccctgagacttggggccagtgactgttcagaggtccatgtgaagatgcgctgaatgg

SEQ ID NO: 6827044 - DNA, 71 bp, Homo sapiens
gccacagccccgcggcaggaaacattccaggagcacctgtttcctgaggaccctgtcaggggctcccgggc

SEQ ID NO: 6827045 - DNA, 73 bp, Homo sapiens
aagggttgtttttaatggagtgacaaattggattcagttatcacagaatcaatgctccattgacatggccttt

SEQ ID NO: 6827046 - DNA, 55 bp, Homo sapiens
aactattcaccaccttgtggtaagggacaacatcctaaggctggtgccaatagtt

SEQ ID NO: 6827047 - DNA, 69 bp, Homo sapiens
cccaggcactgggcgtgtcctgggtgagggctgagtgctgtctcccctagtctacgctcagctcctggg

SEQ ID NO: 6827048 - DNA, 60 bp, Homo sapiens
ttgctgtgttaaccagctttagtttattatctcagaactctggctgcaccattatagtag

SEQ ID NO: 6827049 - DNA, 87 bp, Homo sapiens
gggctcatgaagtctgctcaggcattgtgcagagccttgagctaagtttggcctgtcagtgcttgagggaccttgacagatgagcct

SEQ ID NO: 6827050 - DNA, 69 bp, Homo sapiens
ggaaggggaaggttgtattcagaatcaggtgatccccgtgcacagtcagaggactaccttctccagtcc

SEQ ID NO: 6827051 - DNA, 83 bp, Homo sapiens
tccacttcaggggtacttagcacctatggcatttttttgtgacaggagagaagacagagagtgtgggtacatatcctggtgga

SEQ ID NO: 6827052 - DNA, 127 bp, Homo sapiens
aaggaggtacctgaaaacaagcagaactcacaaggcaatgactgatttagaattcgggcaactgggttcttttgtaccagttatttcttgctgtttttaatgcttacgtgcttcagttgtatgcctt

SEQ ID NO: 6827053 - DNA, 129 bp, Homo sapiens
ttacggcttctgacccagggcttcactttgtagcagtgtttttcttctgtttttgcctttggctgataccactgctagagtgcagataagagaatgttactaccagggggcttgagtgtcgggctatga

SEQ ID NO: 6827054 - DNA, 60 bp, Homo sapiens
cctgaaaatatcctctcctttgcatacgggaacacacagatgggaggatgcgtcttcagg

SEQ ID NO: 6827055 - DNA, 122 bp, Homo sapiens
cccttggccacttgcttccttcaaaagccccaaggccccgctgtgtcctgggggacttcaggttcgcagaagcagcctggatcctaggctcagctgggctccctctgcagcaagaacctggg

SEQ ID NO: 6827056 - DNA, 87 bp, Homo sapiens
tggccagttacgcagcctctccgagccactgcctctctgtggaaggagggcctgaggctgacggggagcagccgcctcgcttggcca

SEQ ID NO: 6827057 - DNA, 78 bp, Homo sapiens
tagtagaaagactggctctatctccttggcgttggaggacagagctctaaggaataagggcagagtcgatctctacta

SEQ ID NO: 6827058 - DNA, 55 bp, Homo sapiens
tggcctgctttcatttgatgctgttagttaatcaagcacatcagttaccaggcca

SEQ ID NO: 6827059 - DNA, 59 bp, Homo sapiens
gccgatggcctcagtgcccaaaggagaacgcttcttactggcctatggaagccactggc

SEQ ID NO: 6827060 - DNA, 58 bp, Homo sapiens
cctgaatctgcctctctactgctgctgcttgaaataagtacaaagaatgaggttcagg

SEQ ID NO: 6827061 - DNA, 62 bp, Homo sapiens
ccacctggcagcaggctcggcacagctttcatcttctgcacctgagtcagctgcatgggtgg

SEQ ID NO: 6827062 - DNA, 59 bp, Homo sapiens
gttgttctaagcaggggtcaagtgtacaaggcatagctttgtcatctgcataggacaac

SEQ ID NO: 6827063 - DNA, 64 bp, Homo sapiens
gtgggggcagttgggtggggcacaaaagactccttggatcacctgtgtatcttgctgtttccac

SEQ ID NO: 6827064 - DNA, 60 bp, Homo sapiens
ctcagggatgggcagatgttaaggatattctccccacttaccctactgctcccctctggg

SEQ ID NO: 6827065 - DNA, 94 bp, Homo sapiens
ttgcagagttcaattttatgtccagaggcttggtccccaggttcctggcctgggagataatggtaagtgattcatggattcttgaatctgacaa

SEQ ID NO: 6827066 - DNA, 58 bp, Homo sapiens
cagacatccaggtacgagctttacagggttaaacttctgatcgttgcctggaagtctg

SEQ ID NO: 6827067 - DNA, 61 bp, Homo sapiens
gtgtgaaggtaatggaatctcctgattctcaaagggtcagaggactgagagttgcccatgc

SEQ ID NO: 6827068 - DNA, 57 bp, Homo sapiens
agcactgttctcctttggctatatccaataggaagccacagggaaggagaacaagct

SEQ ID NO: 6827069 - DNA, 66 bp, Homo sapiens
gcccattttcacccaatataactagaggaaggtgacccttcctggaaagggagtgagacagttggc

SEQ ID NO: 6827070 - DNA, 77 bp, Homo sapiens
tatgtgaattctcagaaggcaagggctgggggtaatactgcttttaatgaaaatctgcttttatgagttttcagatg

SEQ ID NO: 6827071 - DNA, 81 bp, Homo sapiens
agtcctggaggctagaggtccaagatcaaggtgccagcagggttggttccttctgaggtccctgtacattgcttgtagact

SEQ ID NO: 6827072 - DNA, 81 bp, Homo sapiens
ggggtcactatgtcatattttggtttggttgcagtgctgaaccttatgcaaccctggccctggaataggcatggtctcctc

SEQ ID NO: 6827073 - DNA, 58 bp, Homo sapiens
tgggaaagagttgttgtataacaggaatcctacctaggcctcctattgctcattccca

SEQ ID NO: 6827074 - DNA, 70 bp, Homo sapiens
ggcctgtgtctcccccagctactctgagtgtctgaacactcatcttccctcctggagggaggcttaggcc

SEQ ID NO: 6827075 - DNA, 73 bp, Homo sapiens
ccaactgcagtgcgctctttttctcgttgttctggacagagagaagcaatcagtggccatccactgcagctgg

SEQ ID NO: 6827076 - DNA, 90 bp, Homo sapiens
tggggtggagagttctgtagatgtctattaggtctgcttggtgcagagctgagttcaattcctggatatccttgttaactttctgtctca

SEQ ID NO: 6827077 - DNA, 59 bp, Homo sapiens
aggcaggtagaaggatctttatgcagtagcactataagattgccccatttacactgcct

SEQ ID NO: 6827078 - DNA, 61 bp, Homo sapiens
catgtgcatagactttcaccacctccctatgaagtggacaagattctgtgctttaaacatg

SEQ ID NO: 6827079 - DNA, 77 bp, Homo sapiens
atattttggaaatagctccagtttcattgtgtagaaatctgctgaaatgtaatatagactatttaacttcaggatat

SEQ ID NO: 6827080 - DNA, 89 bp, Homo sapiens
aattttgcttactctgttaaatgggaatcacaatgccatccgtgcataagaaggcaccccacagacctctatttacagaaagcagaatt

SEQ ID NO: 6827081 - DNA, 60 bp, Homo sapiens
tgaagtttggtggaaatttcctgcaatattacctgagcctgaaatttttatgtgacttca

SEQ ID NO: 6827082 - DNA, 109 bp, Homo sapiens
ggtggcgaataggaagactgggaggatgtcttgtttaatgaactgctaaaacttttggaaaattttaagctagtgaagtccctcaacacggtatttccatttgaaaacc

SEQ ID NO: 6827083 - DNA, 65 bp, Homo sapiens
atagaagtttgtaacttgtgcttcctggagatctaggtaataacaactttacagatacattttgt

SEQ ID NO: 6827084 - DNA, 93 bp, Homo sapiens
tgaacttgcccaaagctaatgagccattgtttctccaaggtgacagagaacagctagaaattctaagcatcaatagcattgaggttaggttta

SEQ ID NO: 6827085 - DNA, 74 bp, Homo sapiens
ttgctccacctcccagctaacatttaataagtcagtcccttttatgttagactttctggtgaaggtgagggcag

SEQ ID NO: 6827086 - DNA, 66 bp, Homo sapiens
tccacatgaacatgctggaaaagccagctttccaaggaacatggcttttgatggctgttcatggga

SEQ ID NO: 6827087 - DNA, 61 bp, Homo sapiens
tctgcaggtgttggaagggtcagtcaggaagactttctcgaggtgttcagcccactgcaga

SEQ ID NO: 6827088 - DNA, 87 bp, Homo sapiens
cccgcacgccactgctgggggtagctctgcgtaggactccacaatgttccccgcattgttttgtgctgactgcgcccagctcgcggg

SEQ ID NO: 6827089 - DNA, 61 bp, Homo sapiens
ctgaggctggagtgcagtggtgtgatctcagctcactgcaaccactgcctccaaggttcag

SEQ ID NO: 6827090 - DNA, 76 bp, Homo sapiens
tttcagaaggaggccgaatactttaagtcattatcctgatgaaatgactttgaaatatttgagtttcgatttgaga

SEQ ID NO: 6827091 - DNA, 92 bp, Homo sapiens
acatccaaagtatgtagcagtgggttgggtaccagtgccagagcaggctcctggaggccgctggctgggccgggccttgtgcctttagatgt

SEQ ID NO: 6827092 - DNA, 71 bp, Homo sapiens
catccatttctgattacagaatactaggttagtctgtctgcccttgtttctagctaatcacaagtaggatg

SEQ ID NO: 6827093 - DNA, 56 bp, Homo sapiens
ggttaagccatcagatggatctctgtttctgcagatgaacttcaaaaggcataacc

SEQ ID NO: 6827094 - DNA, 65 bp, Homo sapiens
gtgtgaaatcatcaaaagagccattggaggggacaccagagagtcgtgtggctgaggtttcacat

SEQ ID NO: 6827095 - DNA, 69 bp, Homo sapiens
gttacatcttgcaatgacctatttaggaataaggtcacattcttaagtatcaaggttgagggtgtcaac

SEQ ID NO: 6827096 - DNA, 88 bp, Homo sapiens
ggagcatcgctctgtcgcccaggctggagtgcagtggcacgatctcggctcactacaacctccgccttccaggttcaagcgattctcc

SEQ ID NO: 6827097 - DNA, 64 bp, Homo sapiens
tataagtgacagattatccaaattaatggtggcttaaacacagtaggatttcttgtctcttata

SEQ ID NO: 6827098 - DNA, 68 bp, Homo sapiens
gctttctcagcccagagccgcccccttggtgcccgcagcgaggatgaggcactaggcccggaggaagc

SEQ ID NO: 6827099 - DNA, 67 bp, Homo sapiens
tggtccctcctggatggatttggtggagcctccttcatgggttcctatagaatcctccagagggtca

SEQ ID NO: 6827100 - DNA, 58 bp, Homo sapiens
ctgtaacctcctctttccattccatgccttgtggaatgtcctctttagagggttacag

SEQ ID NO: 6827101 - DNA, 57 bp, Homo sapiens
cttctttcctgttccactgaagtcttgaatctaatgtctgggaaattgggaaagaag

SEQ ID NO: 6827102 - DNA, 64 bp, Homo sapiens
ttcgaagagctcatttgtttgctctcggtctccctgggcctctgggcaggcagtggcattcgga

SEQ ID NO: 6827103 - DNA, 60 bp, Homo sapiens
gagacagagatcttgctgagtcctggtcctcgacttggtcttccttgtcatttctgtttc

SEQ ID NO: 6827104 - DNA, 57 bp, Homo sapiens
gcatagaccctgatggagtgagtaatatgaggttgcaaatggtaccaagggtcttgc

SEQ ID NO: 6827105 - DNA, 74 bp, Homo sapiens
atgagaacattctggatgtctgatgagagcttttgaaatttctgctcttattcaaatataagaataagaaacat

SEQ ID NO: 6827106 - DNA, 88 bp, Homo sapiens
ggagtctcactttgtcacccaggctggagtgcagtggtgtgatatcggctcactgcaacctccacctcccgggttcaagtgattctcc

SEQ ID NO: 6827107 - DNA, 90 bp, Homo sapiens
gatacttaacacgttcatggtctgttaggagctacttttgtatgcttcactgaaagtgccccagacaagacccctgatgtgtgtgtggtc

SEQ ID NO: 6827108 - DNA, 77 bp, Homo sapiens
catgttagtcttcactcttcactactattctatacccgagatggtggaatgggggttccaagagatgggggaacatg

SEQ ID NO: 6827109 - DNA, 76 bp, Homo sapiens
gccatgtcagcctgtagtctggtccaggtgaaccgaggaagccttggggcttggaagtaggattgggagatatggc

SEQ ID NO: 6827110 - DNA, 90 bp, Homo sapiens
aagttacctacctcaagtagccagtttctttaacagcaaagtgatgataaaatctttgtgttaaggtggttggcaaagtgttaggaattt

SEQ ID NO: 6827111 - DNA, 67 bp, Homo sapiens
actacaaactctggtcatctagcagtataggatattccactgccccctgaagaccaggttttatggt

SEQ ID NO: 6827112 - DNA, 130 bp, Homo sapiens
tgttatgtgtatttactacaattttttaaaaatcgtatatgtagtttaacaggtgtggtcaatatcaaaacttaggtatttaatcttgttaaattatataagcagaaaatgctggaaaaagtacctgtca

SEQ ID NO: 6827113 - DNA, 63 bp, Homo sapiens
gagacagcctactccagtctcagattggaccacacagggttgggcctggtttgtgggtgtctt

SEQ ID NO: 6827114 - DNA, 59 bp, Homo sapiens
aaggtcacacagtgattaagtggcaaagccagaatttgaacccacatcagtgtgacttt

SEQ ID NO: 6827115 - DNA, 56 bp, Homo sapiens
ggataggggctggggagcccagaggtcttgggctcagcaatgatgagcccctgtct

SEQ ID NO: 6827116 - DNA, 73 bp, Homo sapiens
attgagaagtctagaaatcatgtactgtgatctgggctagactaggtcatgaggatttactagactaggtaat

SEQ ID NO: 6827117 - DNA, 65 bp, Homo sapiens
gagggagtcagcagggtccccttgagtggtgggtaaccctaagatggtcttgttggctaaccctt

SEQ ID NO: 6827118 - DNA, 80 bp, Homo sapiens
tggaggctggaagccaaagaccaaggtgtcagcagagttgatttcccctgaggcccctcttgtgagcatccagctagcca

SEQ ID NO: 6827119 - DNA, 65 bp, Homo sapiens
tttgggttctgtcccagcatagggcacaaatgatgactcagggtagtccagctggtatgcccaga

SEQ ID NO: 6827120 - DNA, 84 bp, Homo sapiens
cttaatcgtatctgcaaagtcccttttgtcatgtaaggtaacatattcacaggttctggggatcaaaatgcagatacctttggg

SEQ ID NO: 6827121 - DNA, 57 bp, Homo sapiens
ggccctctgatccaactggtatcttcatttgcttgacttacttcttggcagagggct

SEQ ID NO: 6827122 - DNA, 66 bp, Homo sapiens
ctgggcaagtactggttgaagtgtcctgaataaaacaggtatccatgcctttgtgccttagcccag

SEQ ID NO: 6827123 - DNA, 79 bp, Homo sapiens
gcctgagctaagaagcaaataaatcatcatggggcatcatgtgtgttgatctgatttgctttgataatgagtgtcaggc

SEQ ID NO: 6827124 - DNA, 93 bp, Homo sapiens
tggggtcaggcaattctctgcagagcaattctcaaggaggtgtcttagcttgacttgccccagaattgctgctggggagtcccagctgcccca

SEQ ID NO: 6827125 - DNA, 56 bp, Homo sapiens
tgctgggtcccttgagagctcatgggattacctgactgttgagcagggcccagaca

SEQ ID NO: 6827126 - DNA, 88 bp, Homo sapiens
ccacccagcagcctagctgccttcagccctgactggccaggggcaggcggccctggggaaggtgctggaggccctaggctgctggggg

SEQ ID NO: 6827127 - DNA, 62 bp, Homo sapiens
agtaacacttggaatgatagcattgtttctttgcagcatgtcataaaacacaagctgttgct

SEQ ID NO: 6827128 - DNA, 61 bp, Homo sapiens
atgtgtaatgtggtattttaataaccattgcaattggctattaaaatgcagctttgcacat

SEQ ID NO: 6827129 - DNA, 67 bp, Homo sapiens
tggttcaaaaagttaggcttagttgagatttgttggtgtgaacaaactcagctctcctaatgaacta

SEQ ID NO: 6827130 - DNA, 62 bp, Homo sapiens
agagcccctgggtcacacagcccgtctccagtagggctggggaaaagaacccagggcgctct

SEQ ID NO: 6827131 - DNA, 63 bp, Homo sapiens
tgcagaccgtggttacaattttaagggaaatgaaaccagaagtttgtagcgatacagtttgca

SEQ ID NO: 6827132 - DNA, 129 bp, Homo sapiens
aatatattaacaaatgtcaccggcaggtgagaagcatctttgttgtttgttgcagacaagatatttagtacgactcttgctgttacagaattaacagtcttcctccctgctaattcccccatatatgtt

SEQ ID NO: 6827133 - DNA, 57 bp, Homo sapiens
caggagagaagatttggagcaagccagggtcccctggtgatccagcctcctctgctg

SEQ ID NO: 6827134 - DNA, 61 bp, Homo sapiens
atcggtttaagttcttgcttttaatcattttgggtatatacctagaagcagaattgctgat

SEQ ID NO: 6827135 - DNA, 130 bp, Homo sapiens
tcctagctacactaatatttatagaatgttgatattggatgggccttggagagcacataattcaaatttttagttttcagagaggcaatactgtttaatataaagagttttggcaaccaggtggcaaaaa

SEQ ID NO: 6827136 - DNA, 56 bp, Homo sapiens
agaagagagtcctaccccatacacatatgtagttggaaaagggaggactttttttt

SEQ ID NO: 6827137 - DNA, 57 bp, Homo sapiens
ctgcttgcctctccctccctccatcccatctgcctgggggaggcgagggctgagcag

SEQ ID NO: 6827138 - DNA, 57 bp, Homo sapiens
gcacttaagcaaagaaggtgacaatgtcagcaagtctctttcaagagcttaatgtgc

SEQ ID NO: 6827139 - DNA, 77 bp, Homo sapiens
ggtgagtgggccaaaggtaaagatctgctgtgggcatgcaattgcctctcagctagctatacctcacctctctcatt

SEQ ID NO: 6827140 - DNA, 63 bp, Homo sapiens
aagcgtctatcacactggtgctttattcctcctcccaaaagattagctgtgaagaagatgctt

SEQ ID NO: 6827141 - DNA, 55 bp, Homo sapiens
tctggttatcacctgagagcttgttagaaatgcagaatctcagggcatacccaga

SEQ ID NO: 6827142 - DNA, 74 bp, Homo sapiens
cagtagagcccagctaaatttatataattataataggtaatatttatggaatgcttgctgtgggtcaggtgctg

SEQ ID NO: 6827143 - DNA, 57 bp, Homo sapiens
cgggacaggcttcagatgtattaactaagagagttttgtctttgtggcttgttttcg

SEQ ID NO: 6827144 - DNA, 76 bp, Homo sapiens
tggcatctatgacttgttctctgactgctttatgaagaaatgattatgaaggggcagaggagaagcatggaggcca

SEQ ID NO: 6827145 - DNA, 58 bp, Homo sapiens
ccatgttcagggtcacaagttggcttggaaaacaaatccacaactgagaaccctatgg

SEQ ID NO: 6827146 - DNA, 66 bp, Homo sapiens
gaggagctggcgctatttatgattccatttttatctcttaaatgccatgacagatggcagcttctt

SEQ ID NO: 6827147 - DNA, 77 bp, Homo sapiens
cggcgggaggaagcccagacaatgagcccttgttccctgtcctcgggcccagggccagcgtctcgggctatcagccg

SEQ ID NO: 6827148 - DNA, 67 bp, Homo sapiens
tactaggaatggtgctcagcagaaatcctgcaacatatggatctgtttacacactattcactgtgta

SEQ ID NO: 6827149 - DNA, 78 bp, Homo sapiens
cctggccctttcttccgtgacttctgctactcattagtatctccaccagagggcagacagtaaaagagaaaggaaagg

SEQ ID NO: 6827150 - DNA, 68 bp, Homo sapiens
gagtgattgtagttcattgaatgagtaattgaatatccatactcaaggttaatgattgaatgtcagtc

SEQ ID NO: 6827151 - DNA, 129 bp, Homo sapiens
cacaaagtgatggataacccctggactgtgatttgagggattctggaaagagtatcttgatcaaaataataccatctgccctatgtcaggatgtccaaaatccagccattggggttatagtcctttggg

SEQ ID NO: 6827152 - DNA, 62 bp, Homo sapiens
tttcctgttttgcaactggctgccatactcacccgagaactggctttattgcagtgctgaag

SEQ ID NO: 6827153 - DNA, 56 bp, Homo sapiens
agagctaaatcagactttctttgtggtaaagaacacaaggtctagaattagcctct

SEQ ID NO: 6827154 - DNA, 76 bp, Homo sapiens
atgaagatctaagaggcatcaagacaagcttcatatttatatcttgcttctcttaatgcctggctttaagtttcat

SEQ ID NO: 6827155 - DNA, 64 bp, Homo sapiens
tgggagaaaattgatgaagttggctgcttccagtagatcagataatccatgaatttgtctccca

SEQ ID NO: 6827156 - DNA, 125 bp, Homo sapiens
ggtgaccatggttatgttttgcacattgatttccatttgtttcatgttagaaacagtactaaactgttctgtgaccataatttgtaaataaagtggtgttctgtttaaaaacaagccctgttatc

SEQ ID NO: 6827157 - DNA, 76 bp, Homo sapiens
aggctgggaaggcggttggggcagcttgggggcagctccagagttgccaggctcagcccctatcttcttccctcct

SEQ ID NO: 6827158 - DNA, 58 bp, Homo sapiens
gtttcgtcaattcaggtacaggtctgtctgggagacctggccctgtggaggcaggaac

SEQ ID NO: 6827159 - DNA, 81 bp, Homo sapiens
gtctggcatacaggaagcactcaagaaatgctggctctgactgtaatcgccctggctattttctgcttgctgttgcctgac

SEQ ID NO: 6827160 - DNA, 69 bp, Homo sapiens
tctgagtaatgtctgcctctattcagttcaacagcccacaaagagagtaatagacaaagacatgccaga

SEQ ID NO: 6827161 - DNA, 73 bp, Homo sapiens
aagtcagatgcattaacttgagaagcagagtcattctggtgaatgggaattttcatgttggcatgactgactt

SEQ ID NO: 6827162 - DNA, 73 bp, Homo sapiens
tggtgtgtatgaaagaacaagggcttaaaactagaaatctggacgtaagtcttagttttgccattatttgcca

SEQ ID NO: 6827163 - DNA, 68 bp, Homo sapiens
tgaagataaatgagttttctcagggagtcagggaactgtaactaaagagtacagctcttttgttttca

SEQ ID NO: 6827164 - DNA, 62 bp, Homo sapiens
cattagcagtcattactgtgctctgatggactgacacagcagcaaagccgagacagccagtg

SEQ ID NO: 6827165 - DNA, 82 bp, Homo sapiens
taacttattctgaaggactaatggtattttactttttgaatagagatgtagggacccacagtctatattttggggcaagtta

SEQ ID NO: 6827166 - DNA, 103 bp, Homo sapiens
ttgagacagggttttgctctgttgcctaggctggagtgcagtggcgtgatctctgctcactgcagcctctgcctctcaggttcaagcaattctcctgactcag

SEQ ID NO: 6827167 - DNA, 78 bp, Homo sapiens
acagagaactgccagaggaggtatctgaagtcattcacagacacaagtgattctgatttgttcttttggtgtctttgt

SEQ ID NO: 6827168 - DNA, 68 bp, Homo sapiens
ggaagagctgcttagttttgattttcattaagataagaatgctgtgtcaaagccaggcaactctctcc

SEQ ID NO: 6827169 - DNA, 80 bp, Homo sapiens
tctctgctttctaaggcagcctcagggtagggtctggagcctctgctctcaggtagcctcctatcagagctgagcagaga

SEQ ID NO: 6827170 - DNA, 88 bp, Homo sapiens
acatgtctgagacctggaggcaaagctggcttttacaggggctggcttggctcctggggaggtgagcttgtgtgcccttctgacatgt

SEQ ID NO: 6827171 - DNA, 56 bp, Homo sapiens
cttggcacgtgataggtgttgagcaaacgtttactgaacatctatcagatgccagg

SEQ ID NO: 6827172 - DNA, 91 bp, Homo sapiens
ataatacaaatgcaggacataagcatcgacacaagcgacttcatttgccattggtgtctctgtgcatttgtgcttcttgtctttgtaatat

SEQ ID NO: 6827173 - DNA, 61 bp, Homo sapiens
ataggtttgggaattaggcagacttggcttggggccaacttctgtctttgccacattctat

SEQ ID NO: 6827174 - DNA, 75 bp, Homo sapiens
gagggccccctgggcggtgtgcaggctctgctctgggcgaaggcctgaggggcttgcgctgccgctttggctctc

SEQ ID NO: 6827175 - DNA, 69 bp, Homo sapiens
gccatcagctttagtaacccactgctctgtggacaagaaacaagagcagtgtgggggcgaaggtagggc

SEQ ID NO: 6827176 - DNA, 70 bp, Homo sapiens
gccagcaaaattacaagtatttaagatgctgtcaggtaactgggggtacatatttggtaataagtgctgc

SEQ ID NO: 6827177 - DNA, 58 bp, Homo sapiens
tggcttaacctttccagaagaaagcaataggactcattctctggttggagttgtgcca

SEQ ID NO: 6827178 - DNA, 68 bp, Homo sapiens
ggacatggagcatgtagagaaaagaatccaaagagagaagctttggtgttcactcattctccatttcc

SEQ ID NO: 6827179 - DNA, 63 bp, Homo sapiens
ttcctaggcctgccgtggctctgccccttctccaggttagagctctgcagctggcctcaggaa

SEQ ID NO: 6827180 - DNA, 73 bp, Homo sapiens
gggcaaatctttgtcagtatggtttagagaaggtaatactttctctaatacattttgacaaatatgattgacc

SEQ ID NO: 6827181 - DNA, 69 bp, Homo sapiens
tggtgccattcacctgtagaccattcagttacaccactgagggagagtcttaggttggagtcttcacca

SEQ ID NO: 6827182 - DNA, 71 bp, Homo sapiens
ttcctctcctcccaccaggtgaacaattctatatcctgcttctccatggaaattcctgagtgggagaggaa

SEQ ID NO: 6827183 - DNA, 61 bp, Homo sapiens
gcctctgtttcccacagtgtggagagcgaaataaatactctctcacagtcaatgcagaggt

SEQ ID NO: 6827184 - DNA, 69 bp, Homo sapiens
tccaggggaccaggagccactttgggggaacccctcccagaaatcctctctttcttgcagtccccagga

SEQ ID NO: 6827185 - DNA, 60 bp, Homo sapiens
tctttcagtgaaggctcagattgtttgattaccccaaagcaagagcatagtacaggaaga

SEQ ID NO: 6827186 - DNA, 57 bp, Homo sapiens
gaattggtgctctggcacattcctctctccatctgaggagtgtgaagagcctagatc

SEQ ID NO: 6827187 - DNA, 129 bp, Homo sapiens
tgtaatatcaaaactaaaatggaaatttttcatctgtagtttttccaaggttgtgtggggttagatgtgataacatggtgcaccaaggtgaagtggcagatgagagagacagagaatacaatgactgca

SEQ ID NO: 6827188 - DNA, 65 bp, Homo sapiens
ctggtaaggggtggaaccagagcccaaatgggactcacattgaagcttttccatgctcttcccag

SEQ ID NO: 6827189 - DNA, 88 bp, Homo sapiens
aatgttcatcccctgctgaatgtggcctgcaaagcgggtgaatgaagcaattcaaagtaaggcagcatccagaggagaatgaagcatt

SEQ ID NO: 6827190 - DNA, 56 bp, Homo sapiens
agggcagttatgaatgtctccaaaactatttcaggggtaattcatgaacatgtcct

SEQ ID NO: 6827191 - DNA, 102 bp, Homo sapiens
ctgagatttccccgggcaacacatgaaaagagctcgattgtcagtgttagggagacagacgttttcagcactggacagcgagtctcaggcctgagggttcag

SEQ ID NO: 6827192 - DNA, 105 bp, Homo sapiens
gcctgggaatgtcggggcctccacctgcctggagctgagtgtggagcttgcaacgcgcagactctgacatctcttggggcagctgctggctgtggaagccggggt

SEQ ID NO: 6827193 - DNA, 62 bp, Homo sapiens
ggttgagccagggtttccggctgctgccttagcaacagcagaggagcgatggctgcccagcc

SEQ ID NO: 6827194 - DNA, 61 bp, Homo sapiens
ggctctgggtttaggctcaggaagtggatctctgcacctccttgagtgtcccccaagagtc

SEQ ID NO: 6827195 - DNA, 81 bp, Homo sapiens
ttggcaacatttgtcatcactgaggagagaggtaactagaggatgatttattgcaaccttttctggtgtgataagagccag

SEQ ID NO: 6827196 - DNA, 107 bp, Homo sapiens
agggcctctcgctggggtcaaactaagctggaatctctttggggactgaagatcgtttcctcccctagagaggtttgctccattgtgcttccaggggatgctgccct

SEQ ID NO: 6827197 - DNA, 88 bp, Homo sapiens
atctgtggctgttgacagaatgagtcatgaagattagcaatgtgtttattggttacagaaaatgatttataatgtggaagatacaggt

SEQ ID NO: 6827198 - DNA, 77 bp, Homo sapiens
ggaaagagggagcaagtagcaactctcaggactgcaggaatccaggctgactttaggccctgcctgtccctcttttt

SEQ ID NO: 6827199 - DNA, 106 bp, Homo sapiens
ggtccttgggtggctgaaccttccagctggggcagtggctggggagcctgctctgagctcaccccttgcccaggctccagctgggatgacgtgagcacctttggcc

SEQ ID NO: 6827200 - DNA, 129 bp, Homo sapiens
tgactctccatgacctgctcacagtgcgaaagaaacccagcctctgaggctgcgaaacagaaaaacaagctaaatggttgggagttttctatatgcatttactgtagtgggtaattcactctgatgtca

SEQ ID NO: 6827201 - DNA, 64 bp, Homo sapiens
gggctgggcagggaaaggaagggcccaggcttcctggctttagctgccttccctaccccagccc

SEQ ID NO: 6827202 - DNA, 59 bp, Homo sapiens
gttcatttttactttgatctactgttattatgagaaagtggattgaggtgacagtgtgc

SEQ ID NO: 6827203 - DNA, 83 bp, Homo sapiens
tgcaggaaggaggaaccagaggaggaattaccttccgtctgtggagtagagtcccgtcttctggagtctgtgaccttcctgta

SEQ ID NO: 6827204 - DNA, 66 bp, Homo sapiens
accactggtctcacccagcccttcctcttcttgcaaatgaagaaagggagcgtggatcaatttggt

SEQ ID NO: 6827205 - DNA, 62 bp, Homo sapiens
ggggaccctacagcaagagcagtcgcaagtatgcaagtgatggctatccctggaagggcccc

SEQ ID NO: 6827206 - DNA, 78 bp, Homo sapiens
aatctgtaacactaagggcaaaggaaactgtacataagcactatagttgaaaaagttattttcccataggtacaggtt

SEQ ID NO: 6827207 - DNA, 60 bp, Homo sapiens
gtgcctcagttggaaatgcagaaatcacccaccttctgtgtcaatcttgctgggagctgc

SEQ ID NO: 6827208 - DNA, 70 bp, Homo sapiens
gttgcttgggctggagtgcaatggtgcgatctcagctcaccgcaacctctgcctcccaggttcaagcgat

SEQ ID NO: 6827209 - DNA, 70 bp, Homo sapiens
tggagggggatagggtctaaaggcacatagctgtgttttattcacatagtgcagccccttttctattcca

SEQ ID NO: 6827210 - DNA, 55 bp, Homo sapiens
tgattccactctgaggatcgtattggatttatacttaactcaaatggtggaatga

SEQ ID NO: 6827211 - DNA, 121 bp, Homo sapiens
gaactaattgttctgtgattgattgatagtttccctcttgttgctacatacagcccaatgacatgcattgtacacacaacaggaggtaagagagtcaatcaattagggaaacaattagttc

SEQ ID NO: 6827212 - DNA, 63 bp, Homo sapiens
ggtaagttctacagcttcgcaggcatgccctactcattcatgcttgggcttagcaaccttccc

SEQ ID NO: 6827213 - DNA, 59 bp, Homo sapiens
agtagggtattgagtctattccttttctttatactgtggtaatagattaattatcctct

SEQ ID NO: 6827214 - DNA, 90 bp, Homo sapiens
taatactatgattgtcagaagctaaatttgatatttgctgactataaaaatgtcatcaagtggagtttatttttatgattatctttattg

SEQ ID NO: 6827215 - DNA, 84 bp, Homo sapiens
ttctgagcttacttctgtacacagatgccaccaatgtcaagttctccatgataatagcctctgtgtggggaggtagagtgtgaa

SEQ ID NO: 6827216 - DNA, 60 bp, Homo sapiens
atgtttgtcaggattgtaattaaggtggtgtgtataccagggttgcaagaggacagagat

SEQ ID NO: 6827217 - DNA, 56 bp, Homo sapiens
tacattctggtggagaaagtaaacagaagatggttatttgttcaactaagaatgta

SEQ ID NO: 6827218 - DNA, 73 bp, Homo sapiens
tagttcttctaggcttataacttcctggaaaacccatgtgagaaattccaaagtgctatgtttataagagctg

SEQ ID NO: 6827219 - DNA, 61 bp, Homo sapiens
cagggctttgtgtgcctggggagaagttgggattttatgcttaggtgataggaagccgctg

SEQ ID NO: 6827220 - DNA, 56 bp, Homo sapiens
ctctagagccaaagtcttggggggttgtgcttccctctgacccactggactctgag

SEQ ID NO: 6827221 - DNA, 56 bp, Homo sapiens
gggctctggggtcagacagcctgggttcgaatcccagcctcactgttccatagccc

SEQ ID NO: 6827222 - DNA, 118 bp, Homo sapiens
aagaaataggagagagaaatggatgaggagaggaaaagcgaggctattattgaatagtaaaatggaagccattgttgtcttcatcttcagcccatccccaacactcctttcatttttt

SEQ ID NO: 6827223 - DNA, 58 bp, Homo sapiens
tcaagttgtaggtattcctgggtcatcagggcagcactcatacctatatttacttaga

SEQ ID NO: 6827224 - DNA, 69 bp, Homo sapiens
gccatgggtagaatcatttctggacacgtagtccctattgctgaggtcaaggaaggagtcactgatggc

SEQ ID NO: 6827225 - DNA, 62 bp, Homo sapiens
cagacttgagaaccatgtgaatggatcatctctgaggtttcttcccatcttttctgagtctg

SEQ ID NO: 6827226 - DNA, 80 bp, Homo sapiens
ataccccaaaactagtagtaccattgtaggtatgtaggagagaaattaattcactacatacagtggatgctttagggtgt

SEQ ID NO: 6827227 - DNA, 67 bp, Homo sapiens
aagctcacacttcaggactctggggcaacagaaacccgttgcaggttccccttttgatgtgtagttt

SEQ ID NO: 6827228 - DNA, 56 bp, Homo sapiens
agtactttaaagtttcagaagcaagatgctgtcttgctgctgatcatttatagtct

SEQ ID NO: 6827229 - DNA, 55 bp, Homo sapiens
ccaaacttggggtgctggatgcagaatggactgcaagcagctgtgccctgtttgg

SEQ ID NO: 6827230 - DNA, 85 bp, Homo sapiens
gaattggtctctgagcccagctctacctcagacttgctgcttatgccgcagtgtagatcctgaggcttggtgagttgcccggttc

SEQ ID NO: 6827231 - DNA, 60 bp, Homo sapiens
gtagtcacttatgtgcagctgctgaactctccaaacaaacagctgggcaattatgactat

SEQ ID NO: 6827232 - DNA, 68 bp, Homo sapiens
ctagaggatgatccttccttgcctcttcccccttctggtggttactggcaatcattggcattctctgg

SEQ ID NO: 6827233 - DNA, 58 bp, Homo sapiens
aagacattccaaagtggctaatcatgtatataagtacacaatgctgtttgggatgctt

SEQ ID NO: 6827234 - DNA, 129 bp, Homo sapiens
gagggtgagaagagctccagcccaccattaggcctttgctgcctcccccatggctggaagggcaggtgctttgtttttgctgggtgggggaaggttgcggctttccactgggcctcctctgatgccttc

SEQ ID NO: 6827235 - DNA, 80 bp, Homo sapiens
agacccaggctgatcccagggagccccaattccatgcctttattatcacaagggaggatggctctcggacatttgggttt

SEQ ID NO: 6827236 - DNA, 70 bp, Homo sapiens
gtcattgagatgagtcagctctgctctgaatattcccttattttagcaaggtgacatcatgctgagtggc

SEQ ID NO: 6827237 - DNA, 112 bp, Homo sapiens
catattttaaagatgagaatggtagatatatggatagtgatcataagaattatgttagtggtcttcactatctgtatgtatttattcactgccttgctttcctttaaaattg

SEQ ID NO: 6827238 - DNA, 71 bp, Homo sapiens
acctcagttctctcatgcctgccctaagtcagttgacatcagtgcagtggcattgaggagaaatgagaggt

SEQ ID NO: 6827239 - DNA, 85 bp, Homo sapiens
gccagcagcagggcaggcaaggcccaggctccttcaggcccaggacatccttccttagatctggccctctcagccctgttagagc

SEQ ID NO: 6827240 - DNA, 55 bp, Homo sapiens
atgagcacactgataagccccttccacatctggcttctacttgtctgttgctcat

SEQ ID NO: 6827241 - DNA, 92 bp, Homo sapiens
gtttttacatttgtgtgaatacatatgatctattttatgttctggaagaaaacttgctccagtgcaatggctcattcatgtaaggtggaaat

SEQ ID NO: 6827242 - DNA, 85 bp, Homo sapiens
ttccttctgctggacatgttccaagggccaaaacctcaaataatgtgactttgtagattggagagtgtgtgaccacagaaaggaa

SEQ ID NO: 6827243 - DNA, 84 bp, Homo sapiens
gggacagcctttgtccagtgcaccagcctcagcccacggagaagagtgactgaggccctagggcatgggagaggagggacgccc

SEQ ID NO: 6827244 - DNA, 61 bp, Homo sapiens
gagactaggctcagaggcagaggctgagcagaggctgcaggatgggcctgagcctagtgtc

SEQ ID NO: 6827245 - DNA, 68 bp, Homo sapiens
gtcaggttggcttgaagtgatatctggagtttgagactgtccagaccccagtgctacagctgcctgac

SEQ ID NO: 6827246 - DNA, 65 bp, Homo sapiens
ttcttagtagcatagctatattaacatccacagaggttggaaaatgtagtctagctgccttggaa

SEQ ID NO: 6827247 - DNA, 92 bp, Homo sapiens
ctagtcttgtattgtacagtgggtgtagtcttcctcctgagtttccttgagatgagggctgcactcaaaaacaaagaggaaaacaaggctgg

SEQ ID NO: 6827248 - DNA, 79 bp, Homo sapiens
ggacgggaacagagaggtggcagccgagacataaggcacctgttcctcaggacttgtctgcctgcacccctgccctgcc

SEQ ID NO: 6827249 - DNA, 70 bp, Homo sapiens
ggagaagtcctgggcctggtttggagctggtgaggtctgaggacctctaggccatccagggccattctcc

SEQ ID NO: 6827250 - DNA, 68 bp, Homo sapiens
gccttcttctctcagctcgtcaaagtcattctccatccagctttgatccgttgctggtgaggaactgc

SEQ ID NO: 6827251 - DNA, 65 bp, Homo sapiens
gtcactgactctgggagatgtgaggaagtctaagtacaaaaccttacgatttccttgttagagac

SEQ ID NO: 6827252 - DNA, 127 bp, Homo sapiens
cttacttaaactcaggacttacggttactcatatggctttaaacttttcatttcatcataagtcctttgaaatgtgagacgtagagttaatggaaaatgataaggaaaactgctgcatttaagtaag

SEQ ID NO: 6827253 - DNA, 120 bp, Homo sapiens
ccccagtgggtgtccagggggtggctctgagatgaggtagcttggcccaggggctggtggcctccccctggggctagagactgcaaggccaggccccctggactgctttagacactgggg

SEQ ID NO: 6827254 - DNA, 60 bp, Homo sapiens
tgtgactgaaggccttggtgttttgctgttttatcagctggaagccaccctcagattcca

SEQ ID NO: 6827255 - DNA, 81 bp, Homo sapiens
tgagtttctgttctgtttataatttgcagttgtccagaatggattaacgcatctggaaacaggacaggtttctgtaattca

SEQ ID NO: 6827256 - DNA, 68 bp, Homo sapiens
gggtatatgtgcccaacgtgcaggtttgttacataagtatacatgtgctatgttggtatgctgcaccc

SEQ ID NO: 6827257 - DNA, 117 bp, Homo sapiens
ccatgttgtggtgtttcctattgatgtatacaattttattttcctaacctcactgtccaacaaaaggagaatggctgagtaagttgtgatatgtctgtacaatggattacaatatgg

SEQ ID NO: 6827258 - DNA, 58 bp, Homo sapiens
gcctaggggtaagagtactggcctagaagatggaagccttgtctctcaccaccagagc

SEQ ID NO: 6827259 - DNA, 80 bp, Homo sapiens
gtatcagcatcatctgggagcttgttagaaatgtagaatctgcatttaaccagatccccaggtgaatgaatcactggtac

SEQ ID NO: 6827260 - DNA, 109 bp, Homo sapiens
ttcttgctgtagatggtagtttgccattttgctcagcaccaccagcactgtatcaggagtgtcaaatggccctgctggccaaaggctacaatcaacagggtggtaagga

SEQ ID NO: 6827261 - DNA, 63 bp, Homo sapiens
agtgctttatgttgttgtgcaaattcagcaaaaggccaaaacagccaacagtactgaagcact

SEQ ID NO: 6827262 - DNA, 64 bp, Homo sapiens
agttcattttatttgtcagggtatgttaatcataaaacaaacaagccctgaatttgaatggatt

SEQ ID NO: 6827263 - DNA, 57 bp, Homo sapiens
tctctatgacttttctctccatgtgaagaaaatgtatggatggaaaagttgaggaga

SEQ ID NO: 6827264 - DNA, 64 bp, Homo sapiens
gtgctttttgatatggtttatgtatatgcccaactcctaatgcacaaacctgttagtagagcac

SEQ ID NO: 6827265 - DNA, 78 bp, Homo sapiens
taggtaacttggtgcaagtatgacagccccatggtatcaccaggatcccagcttttttcattttgcatcaccatccta

SEQ ID NO: 6827266 - DNA, 68 bp, Homo sapiens
ctgagctctgctgctgagcacactcctatgggaccttctgtgggattcagctgggcggcatggcacag

SEQ ID NO: 6827267 - DNA, 84 bp, Homo sapiens
ggcaaagctaagaggtagtatgaacatgtaggtagaagaaccagatggaatctgtaattttcatgctttcttctggcctttgtc

SEQ ID NO: 6827268 - DNA, 102 bp, Homo sapiens
gttgccctgatgatgattaatccagagccttcgataagaagagtctcagattcaaagattccctgtaaggttctgagatttggacatcctcaaattcgcagc

SEQ ID NO: 6827269 - DNA, 74 bp, Homo sapiens
gagccattatttgatagtatgacagggcagcatttcatggacttaagtgttgtttgctcttcaaatatatgctt

SEQ ID NO: 6827270 - DNA, 72 bp, Homo sapiens
tcttcaaatcgtcagctccttgagggtggggtgtgtatctccacccagaccagggatctggggattcctaga

SEQ ID NO: 6827271 - DNA, 90 bp, Homo sapiens
ttatctttatggttttaaccactgtctgttagattttctgttgtggcagaaaaatgaattcttcagtggcaagggacatgatgaaggtgg

SEQ ID NO: 6827272 - DNA, 114 bp, Homo sapiens
gacacattcaaggtttggttttttcaccttgactagatgatttttcctgtgtgaatcagcagaagtggtcagtcatgggagatttgaacaagcaagctgagccctatccatgtc

SEQ ID NO: 6827273 - DNA, 62 bp, Homo sapiens
ttcactttgtagacatgtattttatagccagctttgccaagatgcatgttccataaagtggg

SEQ ID NO: 6827274 - DNA, 96 bp, Homo sapiens
atgtgattattaacttcttgagactatattgttagtaatattttgaaagtaatattgttagtaatatttcgaaagaataaagtgccataaagacat

SEQ ID NO: 6827275 - DNA, 60 bp, Homo sapiens
cctgtttcacactctatcataattgcctccttactggtctgtgagctttgtgaaagcagg

SEQ ID NO: 6827276 - DNA, 71 bp, Homo sapiens
gctggaatctagtctccttaagtctttccattatcagagagaattaattaggagcactgaaaattcacagt

SEQ ID NO: 6827277 - DNA, 66 bp, Homo sapiens
aagcaattggttttagtaaaatgagacttcttcaggagtcactcctttactgtggacccattgctt

SEQ ID NO: 6827278 - DNA, 89 bp, Homo sapiens
ggccgagagctttcttcttttccctccaacctcatctttgtgtccacgctccttaatgttcttggaggtaggacgaagaactctgggtt

SEQ ID NO: 6827279 - DNA, 63 bp, Homo sapiens
ctgcctgcttaccatgcatcaggcacagagttaggtcttgtgttataggggtgagctgggcag

SEQ ID NO: 6827280 - DNA, 65 bp, Homo sapiens
cccacttggcataatattcaccaccctatctccccaaatacctagtggtgtcttattacagtggg

SEQ ID NO: 6827281 - DNA, 72 bp, Homo sapiens
ggtttacactgaaagagaggattgaagggcaaatgaggaaccatttaggaatattttctttcaggtttgatc

SEQ ID NO: 6827282 - DNA, 62 bp, Homo sapiens
tctgattcatcttcaagtctccaggatctaatacagttcctggaacatagtagatggtcaga

SEQ ID NO: 6827283 - DNA, 77 bp, Homo sapiens
tcctgatacctgggcttcaggccaattttgtaatgcttttaaatcaaaggtggtcttactgatggtataggaaagga

SEQ ID NO: 6827284 - DNA, 66 bp, Homo sapiens
gggtcacttttgctatgttggctctatcctgaggcagtctctctcctcgtggtaaccaggtggctc

SEQ ID NO: 6827285 - DNA, 66 bp, Homo sapiens
gatatggccctatcattcattgagtgcttttagatctctggcaccccaagatggtggaggcttatc

SEQ ID NO: 6827286 - DNA, 64 bp, Homo sapiens
aggtgagtcatgctaaagtgagagtcaggattctgtctggttttcacaatagctggcatcatct

SEQ ID NO: 6827287 - DNA, 64 bp, Homo sapiens
catcatttggctttagggcctgtgctctgaaacatgcaaaccccttgagacacagccaaagatg

SEQ ID NO: 6827288 - DNA, 66 bp, Homo sapiens
ggggtttgggatttgttcacagtaatttttctgctctgagtccatagtggatccttcaaaaaccct

SEQ ID NO: 6827289 - DNA, 60 bp, Homo sapiens
ggaagaaaggtggacaacaggtggccagcagtggtccacctgtggttattttactcttcc

SEQ ID NO: 6827290 - DNA, 88 bp, Homo sapiens
ttagtaagtgctctatacacattcagaaaggtaaatggatttctcagagtgggaaaaacagacctttcatgatttcagcatttactga

SEQ ID NO: 6827291 - DNA, 71 bp, Homo sapiens
gttatcccaagctctacaagtgatttctttgaagtttccatcccacacttgcttagagaggtgggaataac

SEQ ID NO: 6827292 - DNA, 69 bp, Homo sapiens
gcactcagggtagggtaaatgatgcatcatgcctgctggcaacatgggccctatctggaaagcgagtgc

SEQ ID NO: 6827293 - DNA, 101 bp, Homo sapiens
tgaggcaggagaatcgcttcaacccgcgaggtggaggttgcagtgagccgagattgccctattgcactccagccctgcaacaggagtgaaactccacctca

SEQ ID NO: 6827294 - DNA, 61 bp, Homo sapiens
tcatagaagtagtatccacatttccacgtaaggtggcatcctgggtcctgcttcttcctga

SEQ ID NO: 6827295 - DNA, 57 bp, Homo sapiens
gtgactctcactttacctgactccaaaagaaaatgggtaggttagaaagagagacac

SEQ ID NO: 6827296 - DNA, 73 bp, Homo sapiens
agcaggttagccttgttcatcaaggggcaatcctcctgagttttgtctctggaaggaaaaagcaatgcctgct

SEQ ID NO: 6827297 - DNA, 130 bp, Homo sapiens
ttacatatctactggttgcaaggcaggaaatattggtgaaatgctagcaaagtcacaatttctactctgaacatgatttgcagtgttcatcagtatttttctgaaccctgctttaccattttctatattg

SEQ ID NO: 6827298 - DNA, 115 bp, Homo sapiens
gaactaattttggatatgctgaaagtatttggtaatttattttgagagattattagatttaactttaaggctataaattatgacaattaattttggcatatatatttattatttc

SEQ ID NO: 6827299 - DNA, 63 bp, Homo sapiens
aattggtatgttgttggtgaagaaaagatgagtagctttatttcttcccattatgttccaatt

SEQ ID NO: 6827300 - DNA, 74 bp, Homo sapiens
aaggctaacttgtactttccccagcaggcagctggcaccctgagccctcggctggggcagagcaaaggagcctt

SEQ ID NO: 6827301 - DNA, 82 bp, Homo sapiens
acttggcttggatttaagataagatactctatggtaattttgaacatactgtagaaattccatttactttgactccccaagt

SEQ ID NO: 6827302 - DNA, 69 bp, Homo sapiens
gtatgtgttgcagggctggaacatggaattgtgttctacacgaatttatagaagcgcttgcagccagac

SEQ ID NO: 6827303 - DNA, 63 bp, Homo sapiens
tcatgctgaaacaataacatactggggaaggacattccttagtgtttatagtttgtagagtga

SEQ ID NO: 6827304 - DNA, 83 bp, Homo sapiens
tcttctctgtcagcatgaaccctgaattacttactgtttttctaaacacattaataggtggttaatgcatggtttgagaatga

SEQ ID NO: 6827305 - DNA, 116 bp, Homo sapiens
gccagggttgtcagggagggccattctgagggggtgacacttcagcagagacatgaataaaaactggtagtcaaccctgggggaagagctttccaaacagagaggacagccagggc

SEQ ID NO: 6827306 - DNA, 82 bp, Homo sapiens
gaggcacagagagggaaggtaacttgctcaacatcacacagcaggtaaatgtcagagcctttaaccactctgttactgcttc

SEQ ID NO: 6827307 - DNA, 59 bp, Homo sapiens
ggctcaggagcacttccttgtccaggaagcccctccctttccaagagctgctcctggcc

SEQ ID NO: 6827308 - DNA, 61 bp, Homo sapiens
agtgagcattcgtttggaaccctgtaagggcttgtggatggtctggacagaatgtgacact

SEQ ID NO: 6827309 - DNA, 56 bp, Homo sapiens
gcaagaaaaaggcttcatgaacttaggccactgagatcatggaggtttgttcctgt

SEQ ID NO: 6827310 - DNA, 56 bp, Homo sapiens
gcccaaagggacttctcacacctgtatttggatgattacaggtagaactccctggc

SEQ ID NO: 6827311 - DNA, 69 bp, Homo sapiens
gccaccgcccagttccagtggccccacgaagcccccagtggctggctgtccagctgggcaaacagtggc

SEQ ID NO: 6827312 - DNA, 64 bp, Homo sapiens
gtcctcttctaagctcattcagggtgttggccaaatcccatttcttgttgctataggacaggac

SEQ ID NO: 6827313 - DNA, 59 bp, Homo sapiens
catggcctctgttgcaactcttcaactctgttgtatgagaacagccacagagagctgtg

SEQ ID NO: 6827314 - DNA, 85 bp, Homo sapiens
attcttgcacatgtttacttcatcgagtacttccaacagcccagctgtcgatagaatttttcagatgaggtgaatgaggcagagt

SEQ ID NO: 6827315 - DNA, 104 bp, Homo sapiens
ggcagtgagcacaaaggagtaggggagcatctgtgatggttaattttatgtgtcaacttgacttggttaccagatgcccagatatttgtttcaacgttattgct

SEQ ID NO: 6827316 - DNA, 55 bp, Homo sapiens
tgagtccccctgggaaaagtaaaactttgcatttcaaacattcctgggagactca

SEQ ID NO: 6827317 - DNA, 84 bp, Homo sapiens
ctgccacacagagccaggtgtgttccaggaatggtgaggggttaggtgttactagagaagggggccacgtggttagtgagggag

SEQ ID NO: 6827318 - DNA, 68 bp, Homo sapiens
ccatgaaccaggaggcagccagcacacagcaatgagaggcttgtgaggctgcatagtttggtgattgg

SEQ ID NO: 6827319 - DNA, 83 bp, Homo sapiens
caaattcaaaagaagtataaagcaggccattcatggcaaactcccaatgaaatggaattaatttgtattgtgttttgaaagtg

SEQ ID NO: 6827320 - DNA, 83 bp, Homo sapiens
ggctctagctgagtggggtgcagcagtactgtgtctggtaaaggcacagcaacatagtctgtggacctctgtcagctaaggtc

SEQ ID NO: 6827321 - DNA, 82 bp, Homo sapiens
gaggaagaagaaaccagctccagcctccattcaccctgggatggggtatgggtgggctggggtggtaatgaaggtcttcctc

SEQ ID NO: 6827322 - DNA, 70 bp, Homo sapiens
aacaaagattcctgggctcccccttgaacttctgcaccagaactgccaagatggagtccgggaatgtgtt

SEQ ID NO: 6827323 - DNA, 88 bp, Homo sapiens
cccacccgccacgtggtctggaggcttctatagtgtcttctgggaagagacaagaaactgggagtctctgcaatgacaggcaggtggg

SEQ ID NO: 6827324 - DNA, 58 bp, Homo sapiens
attgtgctgtgagaatgctcattctgaagcaattatatgagtgagtgtacagtagaat

SEQ ID NO: 6827325 - DNA, 71 bp, Homo sapiens
ggtagtaagctgcagaagagtgttcactgctttttctccaattgaaagaaatacctttctcagctttaacc

SEQ ID NO: 6827326 - DNA, 91 bp, Homo sapiens
gcagggagcccggtcctgttccaagagctgctggggtaagtttgtaaagtgcagtccttccccagctgctcaggtgtggacctctctctgc

SEQ ID NO: 6827327 - DNA, 61 bp, Homo sapiens
gcactctcctggctgccacagtaggaatcacctggctgctgaggaggaacccaggagaggc

SEQ ID NO: 6827328 - DNA, 80 bp, Homo sapiens
gaagggagcttgcaggtgggaacccagcagggccctgggtgtccttgggcactgacagggtcccaactgtgagcaccatc

SEQ ID NO: 6827329 - DNA, 78 bp, Homo sapiens
gggctcgtcttgcatgtgacagcagcacatatgtccgaggaagctggactctgtcacatacacttttcaggggagccc

SEQ ID NO: 6827330 - DNA, 62 bp, Homo sapiens
cttggtcaaatgcaggcttccctaaagaaccaacaccaggtgagcctgttcagatgacaaag

SEQ ID NO: 6827331 - DNA, 59 bp, Homo sapiens
caccagctaattaaaacagcagtctcatgactattagtgaggtgtttggttgattggtg

SEQ ID NO: 6827332 - DNA, 96 bp, Homo sapiens
aaatatctcctggggagcccctgccttgtctgggctaggtgagaggcacatcgatcccgcgtaaggccccgtctggggaaatcctggaagatgttt

SEQ ID NO: 6827333 - DNA, 96 bp, Homo sapiens
ggattcagatctctagaaaagtttccagtctagtgtgggaaatgtgaaatgaagtgtatttctccaactgcactgttcttttctacaatctcatcc

SEQ ID NO: 6827334 - DNA, 68 bp, Homo sapiens
cttctgcaggtgccatagacgggcctggggggagcatgcccgccggtagttgagggcactagttgaag

SEQ ID NO: 6827335 - DNA, 87 bp, Homo sapiens
gggaggaagggaggaagggaggggtgtagagggggccagaatgatgtctcccagctctgcagacctgccctacaccatccccctcct

SEQ ID NO: 6827336 - DNA, 78 bp, Homo sapiens
gggaccagctagtgcccagatgagccagcagctccctccagatgcaggggtgaggcccatttgaggccagctgagccc

SEQ ID NO: 6827337 - DNA, 78 bp, Homo sapiens
gaagccggggaagaatatgtatttttacagttaaaggacatttttgaggtatattcacatatatcttcctaacatttc

SEQ ID NO: 6827338 - DNA, 59 bp, Homo sapiens
tcagcgcctaagttttaagccagtgggaatactctgctgcctggcttcacaggcactga

SEQ ID NO: 6827339 - DNA, 82 bp, Homo sapiens
acaaacccaggcccctgagccagctggcatgtgctaaaggctcttctagtatcacaccctggctttctcttcctgggtgtgt

SEQ ID NO: 6827340 - DNA, 63 bp, Homo sapiens
tgcatattataaagagaattaggttgattcttggaaacttgaaactcatcttagtgatgtgta

SEQ ID NO: 6827341 - DNA, 73 bp, Homo sapiens
cgtgtgtgcctgcttgtgtggatgcagcgtgggtctctgcacggaccctgcgtgtatccacactgcatatatg

SEQ ID NO: 6827342 - DNA, 126 bp, Homo sapiens
ggaagggatgaaggtgatagggtctccttggcaaagagacatgcatcggggctttgacaaacatgagtcctccttgttttgtctctgctgattaatgaggagatgctgccatctttctttactttc

SEQ ID NO: 6827343 - DNA, 82 bp, Homo sapiens
ggatttggggcccagaatctgttatagctgtttgtattctcctaggctggaggccagacagctagaaacagggccgagatcc

SEQ ID NO: 6827344 - DNA, 87 bp, Homo sapiens
gtattcaattataactatcttcatcatgaaatgttagaattagacagagctcagcactttgattttattggtgaggaaattgaatac

SEQ ID NO: 6827345 - DNA, 66 bp, Homo sapiens
tcactgccaatctgaagagcttctttttgaagacggaagtagcatggggagtcttagatatgctga

SEQ ID NO: 6827346 - DNA, 65 bp, Homo sapiens
actccactctgggccaccgctggtgtatccaagatcaggacaccagtccctgggcaccagggagt

SEQ ID NO: 6827347 - DNA, 61 bp, Homo sapiens
tttccactggcagctattataaccaggagaggatcctgcctttggctaaggccagcggaaa

SEQ ID NO: 6827348 - DNA, 66 bp, Homo sapiens
gaatcagagaagctgccaggcgagctgttgtgttcaagagtgcttggccttagctgctctccagtc

SEQ ID NO: 6827349 - DNA, 74 bp, Homo sapiens
gtgtgggacatagggatttatgggtactgctcactcttttggcacattttccacatctcttgatgtacctacat

SEQ ID NO: 6827350 - DNA, 119 bp, Homo sapiens
gccccagtccagcccagaagaaggagcacaggctttggtggacaccaggggcttccacccagctgtgttacgtcccgactgtgccaccccagcctggctgcctgggctccctggcctgc

SEQ ID NO: 6827351 - DNA, 69 bp, Homo sapiens
ggtctagtaatgaagaaatgccataacttcttcatttcaccaagggggcatttatttctttactgcatc

SEQ ID NO: 6827352 - DNA, 63 bp, Homo sapiens
tccagtcatttgctaaattcccactggctccgaagagaaaagtctggaagtgcagtggctgga

SEQ ID NO: 6827353 - DNA, 103 bp, Homo sapiens
gatcagcggtgactagattctcataggagcgtgaaccttattgtgaactgtgtatgcgagggatctaggttgcacactccttatgagaatctactgcctgatt

SEQ ID NO: 6827354 - DNA, 83 bp, Homo sapiens
cagctttcttatagtcttccacatttcaagaggctgccgccaaagtgtatggttttctgtgggaagacagggagaggaggctg

SEQ ID NO: 6827355 - DNA, 55 bp, Homo sapiens
ggggctctaggtaaagcaacatagcaactactatgtgatgcagggcctgggcctc

SEQ ID NO: 6827356 - DNA, 83 bp, Homo sapiens
gttatcttccttttcagacacccagttcaggtactccgatcataaaatgtgagttctgaagaactgtctagagaaccaatagc

SEQ ID NO: 6827357 - DNA, 69 bp, Homo sapiens
ccagccaagggagtggaaatactttaaccttaaatcaaggtcagagtttggatcattccttgggactgg

SEQ ID NO: 6827358 - DNA, 103 bp, Homo sapiens
gtggccctggcctgtggccctcactgagggcaccgacagagtggagggtctctgctgattctctcttgtccttaagggcctgcttcaggccatgtggggtcac

SEQ ID NO: 6827359 - DNA, 62 bp, Homo sapiens
gatgtagctgtgtacctttttcactgttagcacctctgtaacagttacattccagcaacatc

SEQ ID NO: 6827360 - DNA, 59 bp, Homo sapiens
gaatctggtctaagtgaggatagctgaaggcattctcagtttacgcatggataagattt

SEQ ID NO: 6827361 - DNA, 61 bp, Homo sapiens
tcctctgctcagcattcctcaccaggtactcattaggcaatgaggatgtgcagcagcagga

SEQ ID NO: 6827362 - DNA, 99 bp, Homo sapiens
gaaaaaatgtcttcttgtaaactttctaggcctatgattcagatacatttagaggaacagggattataaagcctttctgttttcagggagacagaattc

SEQ ID NO: 6827363 - DNA, 63 bp, Homo sapiens
tcgggaactttgctgagacctcttaaaatatttagggagtcaacacagtaatgttaaccctga

SEQ ID NO: 6827364 - DNA, 70 bp, Homo sapiens
tctctttagttgtctcctcaagggtactagtcactcagtagagtaccatttggttgggcagccaaagaga

SEQ ID NO: 6827365 - DNA, 55 bp, Homo sapiens
tgcacatacaagattcggggtcaagtgggacaaaaacctcatcttggtgtgtgca

SEQ ID NO: 6827366 - DNA, 76 bp, Homo sapiens
tgatatggaggtactgaaaaaatgtttgcattatttaaagtgacaaatgttaattcagtggataagcaacctgtca

SEQ ID NO: 6827367 - DNA, 59 bp, Homo sapiens
caggtgcctgttgtgacctgttcttgctggctcttccctagctctcagcatgctgcctg

SEQ ID NO: 6827368 - DNA, 77 bp, Homo sapiens
ccctctgtttctcttttgtatcacagtgttgtttggatcttgcttcagccctacactgtatgaaaacaggaaatggg

SEQ ID NO: 6827369 - DNA, 86 bp, Homo sapiens
tttccactaagtggaccagaagactgaagctcacataagctacaagccttgctcaagcctctttttcaaggtccacaaggtggaga

SEQ ID NO: 6827370 - DNA, 55 bp, Homo sapiens
tgaattagagtgaattctgtgcatgcgtgtatgcacagctgaacactctaaaaca

SEQ ID NO: 6827371 - DNA, 66 bp, Homo sapiens
gtgtggactattgttagtaatagtctacacagggctgtgtggactattgttagtaatagtccacac

SEQ ID NO: 6827372 - DNA, 70 bp, Homo sapiens
agactggacaagaaaggtaggattcaggtgctgaagtggcatcatctgatttctctctctctctctttct

SEQ ID NO: 6827373 - DNA, 98 bp, Homo sapiens
ttgtggtgatatatgacatttaattaacgaatgctctggaattttcagtaaaacacttcataagctcgtaactaaatgattcaaaggtgtcatgacaa

SEQ ID NO: 6827374 - DNA, 69 bp, Homo sapiens
gactgaggcactgggagagcacactaggcatgagaaagttgagtgtgactgatttagtgcatgtaggtc

SEQ ID NO: 6827375 - DNA, 69 bp, Homo sapiens
tgaatttggtctcaggaaaattgcatatataatttagtcttataacgataaccccgagatcaaagatca

SEQ ID NO: 6827376 - DNA, 127 bp, Homo sapiens
cagtgcctggcggagtcagcattcaagacatgttaactgctaccattattttccaagatgggttcatgtggggtaggatgggagtattaaatcagcttcttggggccctactgagccagtgtacctg

SEQ ID NO: 6827377 - DNA, 72 bp, Homo sapiens
tcaagtatgatgatatttcttgtattaaaggacagagatgcctaagtcttatttaaggacaagaagacttga

SEQ ID NO: 6827378 - DNA, 81 bp, Homo sapiens
gtttttcatttggtgcttaacctagtttctagtacagaaaaagaagtctttgctggcgttagttaagtataattgaacaac

SEQ ID NO: 6827379 - DNA, 74 bp, Homo sapiens
tgtttacagggaaataaatatgtgccaggtactgtgctaagtgctttttagtactgtcttatttcattttcaca

SEQ ID NO: 6827380 - DNA, 61 bp, Homo sapiens
tgtcttctagtctctgtgggagaagagaatgcttacttcaattgccaccagctagcagaca

SEQ ID NO: 6827381 - DNA, 57 bp, Homo sapiens
ttggtcctgcagaggggtctggcttgtgacaagggagatccctactgccaggacgag

SEQ ID NO: 6827382 - DNA, 60 bp, Homo sapiens
gggtagcatgtgtcagagtttgtttgcagtatcttgttagctcttatatcatgcttatcc

SEQ ID NO: 6827383 - DNA, 99 bp, Homo sapiens
gtctgtggcattctgggtctctcctcttaatttagctcaaatgttgagaaaccagagaaagttaagggaagattccaaacaagttgagctgccactaac

SEQ ID NO: 6827384 - DNA, 61 bp, Homo sapiens
cttcttaaattggattgctattggacaagattttcagtatttatcccattgatttaaggag

SEQ ID NO: 6827385 - DNA, 87 bp, Homo sapiens
acatggatttctcccattactaagcctggtctaagagcctcatatcaactctgtgagcttaggacagggctatgggatgaattctgt

SEQ ID NO: 6827386 - DNA, 84 bp, Homo sapiens
ggggaaactgaggtacacagaggaacactgacttgctcaagggtgtggctgtgacaagtcactgttcttcaatgacctctcccc

SEQ ID NO: 6827387 - DNA, 58 bp, Homo sapiens
gcccatgaggttgaggctgtagtgagctgtgatcatgccactgcacttcagcctgggc

SEQ ID NO: 6827388 - DNA, 66 bp, Homo sapiens
aggtggtattattctggaggaagcaaatgggtgatatctatgcttacctctatggatacctcactt

SEQ ID NO: 6827389 - DNA, 55 bp, Homo sapiens
tcatgccctctgtgtcactacacaataatgactgacagctgcccagagggtttgg

SEQ ID NO: 6827390 - DNA, 68 bp, Homo sapiens
agagccgcccacgctgccgtctttcttgcggttcttccgtgggaaaattggcgcgtggggctggccct

SEQ ID NO: 6827391 - DNA, 61 bp, Homo sapiens
tcctttgctgcttgttcctgctgctgctcagtggcagctgccaagttggagtagcaaaggg

SEQ ID NO: 6827392 - DNA, 58 bp, Homo sapiens
cagtctgggagggatgccagtgtacaagcgtaaatgagcaaataaagctctcagattg

SEQ ID NO: 6827393 - DNA, 58 bp, Homo sapiens
actgggggaggaggtggtttgctgacgatcagtagcatttccgccctcttctgcctgt

SEQ ID NO: 6827394 - DNA, 57 bp, Homo sapiens
tgtattggacactgtggatgacttaggcttaggttccatctccagttgttcagaaca

SEQ ID NO: 6827395 - DNA, 75 bp, Homo sapiens
tggccaggggcagtgtaacaacctgaggatatctggcaaaggtcactctcaggaagtgatattgagacctgacta

SEQ ID NO: 6827396 - DNA, 59 bp, Homo sapiens
acaacagtgtggtggaaggagcactagattaagtactaattctgctgccacatcgttgt

SEQ ID NO: 6827397 - DNA, 55 bp, Homo sapiens
gagggggatggaaaagttgggttgaagtcagaatccaagaagagcctttctcctc

SEQ ID NO: 6827398 - DNA, 71 bp, Homo sapiens
acacaatgtgatagctatggtggggcagaaaacaatttctgatataacactctagctataacaactggtgt

SEQ ID NO: 6827399 - DNA, 58 bp, Homo sapiens
actagggagaagcacttacacagcaaaatctgctgagtttctgaattgtctccttagt

SEQ ID NO: 6827400 - DNA, 106 bp, Homo sapiens
cagacctagagttttcagttaagtctttctgagtccaacccctgatactgaatcaggggattttctgaatcaggagttggactcagaaagacaaactctaggtctg

SEQ ID NO: 6827401 - DNA, 82 bp, Homo sapiens
gtgggatgtctcaggggcagtctgtgtgcgtggacagtggaagttctgcttgcgttctgctccctcccatctttgtccctac

SEQ ID NO: 6827402 - DNA, 58 bp, Homo sapiens
gggggccccaggtctgaacacgctgcccaggtattctaggcagaggctgggagctccc

SEQ ID NO: 6827403 - DNA, 76 bp, Homo sapiens
tcctgtgctggtgaaacccacagagaccctcacgctgacctgcactctctctgggttctcactcagcacttctgga

SEQ ID NO: 6827404 - DNA, 61 bp, Homo sapiens
ggtcttttcacagtggtttgaggttggtggcagagctaataattgatgtgtgggtgggacc

SEQ ID NO: 6827405 - DNA, 73 bp, Homo sapiens
cattattaaccttaaaggccgaagtaaagatttataggactaagtgtttgctttagtcttttggtacatagtg

SEQ ID NO: 6827406 - DNA, 58 bp, Homo sapiens
cagacctgaggttgagtaccagtcttgactcttactaactgcttggacttcagttctg

SEQ ID NO: 6827407 - DNA, 67 bp, Homo sapiens
agggcttacagttcttcccctttctctttccagttggctggaaggcagatataaagactagagctct

SEQ ID NO: 6827408 - DNA, 67 bp, Homo sapiens
cacccccacgccccgacttaaatgcatcagggaattcctgaggtctagagtcagggtgtcttgggtg

SEQ ID NO: 6827409 - DNA, 91 bp, Homo sapiens
ggtcagggcatttgaactaataactgtgctggcacctattactggtgcttgtattatcttaggcaagttgctattctttaatgccttgatt

SEQ ID NO: 6827410 - DNA, 79 bp, Homo sapiens
ggcaatgattgcattagaagatgaagctactaatgtcaatggcagaactgctcagcatctctacccatgcagatcagcc

SEQ ID NO: 6827411 - DNA, 104 bp, Homo sapiens
gtggcagaaatgcaacggcctcactcctggacagatccccatcatccaacagggtgggtgtagaagctgccagcctgtggtaggagccagcattcacttcccac

SEQ ID NO: 6827412 - DNA, 55 bp, Homo sapiens
aggtttatctgaacccggggaatgctttggtcagcaaaactggacagaaaaacct

SEQ ID NO: 6827413 - DNA, 76 bp, Homo sapiens
gatgaaaaatccagttcttggaagcacaggagaaacaaggaatacctcctgcctccgtggaactggagaagtaatc

SEQ ID NO: 6827414 - DNA, 114 bp, Homo sapiens
tcactccattagattgtgagttcccatggactttgtctatctagttccaggcatggtcctcatgctctggaatagtcctaggcacatattgggtgctcaatgtttgtggagtga

SEQ ID NO: 6827415 - DNA, 59 bp, Homo sapiens
ctcagcaaccctagaacatttgccattcataacggcaaattttaatcagtggtgctgag

SEQ ID NO: 6827416 - DNA, 92 bp, Homo sapiens
aaaggctaaagtgggccgggaatctttttcataagcctcacgtctctcatgagatttggaaaatgattcctgtgcttcccgcttttgtcttt

SEQ ID NO: 6827417 - DNA, 75 bp, Homo sapiens
ccacccaaagggcttgttgaaacacagattgtcgggctccacccccagagtatctgattcagtaggtcagggtgg

SEQ ID NO: 6827418 - DNA, 56 bp, Homo sapiens
gaccactgaatgcacttctaatagagctttaatctaaagaagttagttcagtggtt

SEQ ID NO: 6827419 - DNA, 101 bp, Homo sapiens
ttgtcttctcaaagttcagcttctgatttagactctgtcattcaagaacataatgaatattatcagtatttaggattaggagagacagtgcaggaagacaa

SEQ ID NO: 6827420 - DNA, 88 bp, Homo sapiens
tgaggcttctggctactcatcatcagagaagggatatggcttcttgactttggttgagtcaggtcccatctcagagagctggtcctta

SEQ ID NO: 6827421 - DNA, 57 bp, Homo sapiens
tgaagtgtttgcctgagctgagttataacagagtgactatggcttggcaaagcttca

SEQ ID NO: 6827422 - DNA, 72 bp, Homo sapiens
tcttctcatcagagtggggactaataacagtgacctccccgccaggtcctgtgtgttgccggctgaagaagg

SEQ ID NO: 6827423 - DNA, 66 bp, Homo sapiens
tgctgcactcaccaacagataaaacaggagttccaggtctttatctgcctggtctttgatgcagca

SEQ ID NO: 6827424 - DNA, 102 bp, Homo sapiens
aggttagcaggtgatggagctggtgattgtgtttgtgcatatctgagggtgtgataagccccagctggttttagcacagttagctctcagtgcttgagtcct

SEQ ID NO: 6827425 - DNA, 79 bp, Homo sapiens
ttggaacctggcagctccgtggccttccggagctctgagggctgtgggctatgggagggttggatggggttgtctccaa

SEQ ID NO: 6827426 - DNA, 70 bp, Homo sapiens
gatgaagactcgggctaggttattgcccatgggcacacagccagggcttctcccagccaggtcttgcatc

SEQ ID NO: 6827427 - DNA, 56 bp, Homo sapiens
cctgtgtaaaagtggttgaaatgtgcacatatgcatgcaaacactattgcatttgg

SEQ ID NO: 6827428 - DNA, 80 bp, Homo sapiens
agctcttatttactgagttgccagagtgttaatcatgtctaatggctttaacacaaaagcagccaacctttaaatgtgct

SEQ ID NO: 6827429 - DNA, 79 bp, Homo sapiens
tgtactcatttgcgtgtgtgtgtgtgtgtgtgtgtatactcagttgtgtgcagttttatcacatatataggtttgtata

SEQ ID NO: 6827430 - DNA, 55 bp, Homo sapiens
gcccagacatctgttgggacctgacccccggtcattggttaccagtgtgtctggc

SEQ ID NO: 6827431 - DNA, 80 bp, Homo sapiens
cattgcaacatgccacataattacaaatagagactgccttttaaaagcattctattaaactgttgtgtggtaccgcaatg

SEQ ID NO: 6827432 - DNA, 60 bp, Homo sapiens
gaggtagtaagcagagtggggttaaaagctgtatttcctgactctgtacctgtctgcctt

SEQ ID NO: 6827433 - DNA, 57 bp, Homo sapiens
tacatacatatgtggatgtcatatttaatatttgagtgtggtgagtgtgtgtgtgta

SEQ ID NO: 6827434 - DNA, 82 bp, Homo sapiens
agaacgtatcaacttgctgtaagaggcaaacctgtgcaaattaagtttgtcgaaattatcagcaaacagttggtttctgtct

SEQ ID NO: 6827435 - DNA, 59 bp, Homo sapiens
cagcaccctcggaggctgccgtgggcccccctggccacaaggcagtggaaagggtgctg

SEQ ID NO: 6827436 - DNA, 65 bp, Homo sapiens
ggctttgcaaactgtcacactttccccaggaaacggggaaaggtgatttggtttgaaataaatcc

SEQ ID NO: 6827437 - DNA, 90 bp, Homo sapiens
cctgtgcaggagtcagtcgcagtcaggacacagcatgaacatgaggatccccgctcagctcctggccttcctgctgctctgtctcccagg

SEQ ID NO: 6827438 - DNA, 55 bp, Homo sapiens
ctttttactctgttgtctcagccgcactggggcggaggcggtcaagggtgagaag

SEQ ID NO: 6827439 - DNA, 78 bp, Homo sapiens
aaaatgctgattccagggcctcatcctcagagatttgaattcaacaggtctagagtggggcctggaaatatgcatttt

SEQ ID NO: 6827440 - DNA, 77 bp, Homo sapiens
tcctcttccacatgccttttcgggtacttctctgcttttttgcagaagcactagagggtatggaagctggaagggga

SEQ ID NO: 6827441 - DNA, 61 bp, Homo sapiens
agcactgtagttatagctaacataaataggcaacaatgaccggaaagcatggcacagtgct

SEQ ID NO: 6827442 - DNA, 130 bp, Homo sapiens
tgcctataaaaattatgtatgtatgtatatatgtatacatatgtgtgtacatgcacacatgtgtacatatgtgtacatatgcatatacacacatgcgtacaggtatacatgcatgcaaacattttgtata

SEQ ID NO: 6827443 - DNA, 79 bp, Homo sapiens
tcctgatggccctgagtctcctggggaggtgaatgacaggatttctgctgcgacccaggagttagcggtgaggttagga

SEQ ID NO: 6827444 - DNA, 55 bp, Homo sapiens
tatttctgggagttcagaaattttaggccatttttggctaaactcctaggcaata

SEQ ID NO: 6827445 - DNA, 68 bp, Homo sapiens
gtggcagtgggacagtcagaagtgagcagggagttttaagtcctgccaccctcaatttctcttgccat

SEQ ID NO: 6827446 - DNA, 78 bp, Homo sapiens
gtgagggcggggagggagaggacagttctataaggtggaccttgggtggagcttttatctccttctttatgcccatac

SEQ ID NO: 6827447 - DNA, 71 bp, Homo sapiens
gccctaagaacattttcggaaagatatgcaagaaattaatcttaattatctttgagaaatgaactaggtgt

SEQ ID NO: 6827448 - DNA, 87 bp, Homo sapiens
ctattgacctactccctttcacagtctgttttggatctttttagctgaagagactggtgagaggtgacagaggaaaaataacaatag

SEQ ID NO: 6827449 - DNA, 100 bp, Homo sapiens
caccacctgcttggtggcttcggggatgtgcacggtgtcaaacggggctgccacagcacacgtcccgcccttgtacttgccgagccgacagcccacggtg

SEQ ID NO: 6827450 - DNA, 130 bp, Homo sapiens
cccactatgtaaggtcagattgggcagtgagtgttgaaagatgaaagcaggctggtgagcaggccgactgaggaagcccacacggcctgccttaaattctagtcccaccactttccagctgcgcctcggg

SEQ ID NO: 6827451 - DNA, 58 bp, Homo sapiens
ctctgggtctataatgcagctgattaatatgaatcatatcattgtgtctggctcagag

SEQ ID NO: 6827452 - DNA, 86 bp, Homo sapiens
agaattctgaaatcaaggtgttggcagggccaggctctctctgtagcctctaggagaggatccttccttgccccttcccagcttct

SEQ ID NO: 6827453 - DNA, 71 bp, Homo sapiens
gctgcatttctggaattttctagggcatcattttatcttgtgatagttacaagaagggttcaaaatgctgc

SEQ ID NO: 6827454 - DNA, 62 bp, Homo sapiens
ggtggtgaggatcacagctcactgcagcctcaagtgagccaggctcaagtgatcctcccacc

SEQ ID NO: 6827455 - DNA, 95 bp, Homo sapiens
ggctaaggcgggtgtatcacctgaggtcaggagttcaagaccagcctggccaagatggtgaaaccccgtctctactaaaaatacaaaaattagcc

SEQ ID NO: 6827456 - DNA, 74 bp, Homo sapiens
gggccaaattgattatattttaggtaatatccattgtgatagaatcagaagggttttttaaaaatctttgggcc

SEQ ID NO: 6827457 - DNA, 70 bp, Homo sapiens
cctcattggccaaagtacaaatctcaggagagagaaattgagcagtttgaatcaatggccagaagtgagg

SEQ ID NO: 6827458 - DNA, 93 bp, Homo sapiens
ggggacaggattcttgaagatgtttctaaactgcagaagattaaaaatgtagctagcggcactttgatagtttaatctaggatcattgtcctt

SEQ ID NO: 6827459 - DNA, 64 bp, Homo sapiens
cttctgtgttttaaacagtagaaagaatagagaaatactggtttaatgggtagaacacagggtg

SEQ ID NO: 6827460 - DNA, 81 bp, Homo sapiens
ggttgtagctgtcagtgctgtgcctgtatcccctctgctcatgcctttttcgtgcaggtaggcctgacttccagcagcacc

SEQ ID NO: 6827461 - DNA, 60 bp, Homo sapiens
tgcttaaagctgctcagttgtagggttaaattagttccttcagtctgagtacttaaagta

SEQ ID NO: 6827462 - DNA, 63 bp, Homo sapiens
cctgggcctgaaaacatttctcgggtttatttgacaaagcaagagggcagtggcggggccagg

SEQ ID NO: 6827463 - DNA, 79 bp, Homo sapiens
gagggcttttcattgaatctcgaggctatagaagtgccttttccgatgtggatggcactgctttattcatgaggctctc

SEQ ID NO: 6827464 - DNA, 79 bp, Homo sapiens
ggagaaatgtggggatgagagtggaggaggcaatttatgagtgtggttggctttgctctctgtcctagtattcagctcc

SEQ ID NO: 6827465 - DNA, 86 bp, Homo sapiens
cattttgtcttgttctagtgcttttgtcattgaatcttgctttcatatgggtaagtttagatataggtattctgatatgaaacatg

SEQ ID NO: 6827466 - DNA, 83 bp, Homo sapiens
tgtgttgattatggttgcaggacagagaggcctcaactacttttgcttttaggagtgctttagttcttgcaactggaagcaca

SEQ ID NO: 6827467 - DNA, 56 bp, Homo sapiens
tcatccttttgcatgggaaggcttctatacaagcagaaaacatgcataaacgatgg

SEQ ID NO: 6827468 - DNA, 70 bp, Homo sapiens
tttccactacgtctgcatctgactggtcattttgggatcctctggccagtagataggcaggcaaaggaaa

SEQ ID NO: 6827469 - DNA, 83 bp, Homo sapiens
agggataccacagaatgatgacacttcagcaaaactttagcagtatgtgcatgacatgttgacagcttctgacaggttttcct

SEQ ID NO: 6827470 - DNA, 124 bp, Homo sapiens
gatggtgtttgtggggttttgcttggttttgttctgttttgctttcactttttattatggaaaatttcagatatatgtaaaagtagacagaatagtttcatgaacccccatgtatgtacccatc

SEQ ID NO: 6827471 - DNA, 55 bp, Homo sapiens
ggggaggggataaggggcccgggggcaggtgcctctgagccagggtctcctccct

SEQ ID NO: 6827472 - DNA, 62 bp, Homo sapiens
tagagtgctgtcaaagacttgtgttactcattcctaagcatatgtcatgcaccagcacttta

SEQ ID NO: 6827473 - DNA, 56 bp, Homo sapiens
taccagagcacctccacctttcctgtgcacttaggcctctgtgcagctgcctggta

SEQ ID NO: 6827474 - DNA, 95 bp, Homo sapiens
aaaaacatgacggacatcataatgttaagtttagattataacttggaagtcagtaccaggttacataatactgtagattgccctgttatgttttt

SEQ ID NO: 6827475 - DNA, 74 bp, Homo sapiens
tctggaaggtcctgcccacccaccccatcccagcccggccaccatggtctgggatagtggccaggacccccagg

SEQ ID NO: 6827476 - DNA, 70 bp, Homo sapiens
agaaaaggtcagaaacactcttcttctgtctccctagagcagaaatgtgtgaagtgtgtttcctttttct

SEQ ID NO: 6827477 - DNA, 78 bp, Homo sapiens
gtgagggtgcaatcctcatagaactcattgctgggaagatgtggccagtgatgagttccgtgaggactgaatcctcac

SEQ ID NO: 6827478 - DNA, 58 bp, Homo sapiens
gccccctagtgcagagatggtggcagtggccaagcagcctggacttgggctggggggc

SEQ ID NO: 6827479 - DNA, 65 bp, Homo sapiens
gtgagggattgggacggacaatcttttattcatgaggcagatgtacaactgtcacaatacctcgc

SEQ ID NO: 6827480 - DNA, 115 bp, Homo sapiens
aaagctataaccacatagagtttataccttgcttagctaagtacacattgaataacatcttatatgttgatgcatgatcttgggcaagttatataactctttgtttctcggcttt

SEQ ID NO: 6827481 - DNA, 82 bp, Homo sapiens
gcctggctttggtgtttaaagaccggattgcagtcaaagctctgctgtttgctggctatgaactccaagtaagttgccaggt

SEQ ID NO: 6827482 - DNA, 56 bp, Homo sapiens
tgcttctaggacagcacaactgtaaaactttccagattgaggcatgtctagaagta

SEQ ID NO: 6827483 - DNA, 64 bp, Homo sapiens
ggtgcaagtggctagggaccagaaatttttgttgttgtttaatccctctttgccatttgttgcc

SEQ ID NO: 6827484 - DNA, 66 bp, Homo sapiens
gcctttgaattgttgtggtgagtaggaatatgttttgtttccgtgtattacccattcagtcagagc

SEQ ID NO: 6827485 - DNA, 57 bp, Homo sapiens
ggtgaccaagcatctgtcccctgagctcccagggcagagccagggatgcatggtccc

SEQ ID NO: 6827486 - DNA, 71 bp, Homo sapiens
tcccctttgtacacctacctaatacagggcatgtatgccctgtattagccaggtgcacaaggaacaatgga

SEQ ID NO: 6827487 - DNA, 74 bp, Homo sapiens
tgagtgagtcagctttgggggtctcaggagactctgggtgcggggtttctcggaggtcagggttgaggggctca

SEQ ID NO: 6827488 - DNA, 85 bp, Homo sapiens
gtagattaattttatgtcatctgtgtcagttaggctttctaccttatgagctatgcagaatttagtgacttaaaacaatatctat

SEQ ID NO: 6827489 - DNA, 71 bp, Homo sapiens
gaaacatgttaatatgcattgagtactaagcatgggccagcaaggtactcagtaatataacatattgtgtc

SEQ ID NO: 6827490 - DNA, 71 bp, Homo sapiens
taactatagtttgtatttggctttgaatgttgtgtttataactccaggcctgactataaatgtatcagtta

SEQ ID NO: 6827491 - DNA, 70 bp, Homo sapiens
atgccagaactctgtctgttctgagtcacagtgatgttcttggcactcaaaatagatggttttctggtat

SEQ ID NO: 6827492 - DNA, 80 bp, Homo sapiens
ttgtaaaccaattcttaaagtagaatacaagacctgcaaaaacaggtatgcatttttactttagggaaagagggatacga

SEQ ID NO: 6827493 - DNA, 66 bp, Homo sapiens
atgcgctttgtgtgaagcagtgacagtgcaatctgctaagatagctgctgctgtggacaaagccat

SEQ ID NO: 6827494 - DNA, 55 bp, Homo sapiens
ggttgtggttccatttgtattcagtcaatatggaggcaaatggatcccacaagcc

SEQ ID NO: 6827495 - DNA, 65 bp, Homo sapiens
tctctattgctgttgtttcatttggccagaaaatggttctttatgagcacaaacagcaaaaggga

SEQ ID NO: 6827496 - DNA, 62 bp, Homo sapiens
taaggcagctgagcttctaacagctcatatggagtctagaaagccctgtgttcactgccttg

SEQ ID NO: 6827497 - DNA, 80 bp, Homo sapiens
ggatggatttggagctgagagttaataaggattgatgattcagagtccactccttcagctactcagtttccatatgcacc

SEQ ID NO: 6827498 - DNA, 56 bp, Homo sapiens
cagatgttttctggaaaatgaatgacatgagcctgtcacattaaggaaaacaactg

SEQ ID NO: 6827499 - DNA, 57 bp, Homo sapiens
gtcacagggtccccatatggagaagtcttgttttcacgggggtttaaagccctggac

SEQ ID NO: 6827500 - DNA, 72 bp, Homo sapiens
tgccctctcctttatttatccaaatcttggaaaattcacttgattcaaggttcagggagaaattgagaggca

SEQ ID NO: 6827501 - DNA, 60 bp, Homo sapiens
ggcaagtaggaatccgaatgagtagtttcacataaggctactcatttatttttgcagtcc

SEQ ID NO: 6827502 - DNA, 74 bp, Homo sapiens
atgaatggatgattggttggatggataagagaagaatgtaaaattctattacttaccactaattcagaattcat

SEQ ID NO: 6827503 - DNA, 65 bp, Homo sapiens
gtagatccgattttgttgataccatcgttgttgttgttaacaatgatgtttagataaaatcctac

SEQ ID NO: 6827504 - DNA, 56 bp, Homo sapiens
gtggtggctcatgcctgtaatcccagcactttgggagtctgaggcgggtcgatcac

SEQ ID NO: 6827505 - DNA, 76 bp, Homo sapiens
gtacatattaggagacagagatgttcaaagtgcatttccaaggtgactgtacacacttctctgtcttcccatgtac

SEQ ID NO: 6827506 - DNA, 79 bp, Homo sapiens
tctttcttccgttactgtgttccaagaaatttgaaaatatgctacatatgttttttctggaacagtaattgaagaaaga

SEQ ID NO: 6827507 - DNA, 90 bp, Homo sapiens
gagactcttgggtcagaggcaaagaactttattacagcaatagcagtagctagagcatttgctttatcttgtactgattctctgagtctc

SEQ ID NO: 6827508 - DNA, 96 bp, Homo sapiens
ctgcaagcagccagggtcagagacagggcttggttctgcttcctggtgaagcatggcttcggggtgctgcctctccctccctgtttgaatctgcag

SEQ ID NO: 6827509 - DNA, 64 bp, Homo sapiens
tcatctgtaagatttttggctttcgaggtacttatttgaaagctaaatgaggtcttacagaaga

SEQ ID NO: 6827510 - DNA, 85 bp, Homo sapiens
gacagcaatcaatgttgccatggtaatagccaatccgagccaccccctgctgtctgctgcccaggcaacattgacttcatgtgtc

SEQ ID NO: 6827511 - DNA, 74 bp, Homo sapiens
gccaaaaaggaggactgaaatatctaagtaacctgaaagagattaataagaataaatcagtttctcttattggt

SEQ ID NO: 6827512 - DNA, 69 bp, Homo sapiens
ctgatggccagggtggcactgtggtcggcatgtgtcagcaacatcagagtcactactcgtggccctcag

SEQ ID NO: 6827513 - DNA, 87 bp, Homo sapiens
atcttaactgtacttagtgattggaaggtgcttaaggtgaaaggctatgttgacactaagatttccaaacatctagtatatttagat

SEQ ID NO: 6827514 - DNA, 76 bp, Homo sapiens
atggggatgaagatatttttgtgcaaagtttatcatttgtcataaagttcaagctctgcctaaaatcagctcccat

SEQ ID NO: 6827515 - DNA, 56 bp, Homo sapiens
ttgaagcccttcttgatagtcattatgctctccatcttgcttatctagggttttaa

SEQ ID NO: 6827516 - DNA, 56 bp, Homo sapiens
agctagccagattcttgggctaaagagttatgtttagcccaggagtctggctggtt

SEQ ID NO: 6827517 - DNA, 57 bp, Homo sapiens
ttagttacttataggtgatagaccttatagaatagaatgttctctataggtgattga

SEQ ID NO: 6827518 - DNA, 62 bp, Homo sapiens
tcatgtgtttggagccaggccctggcagggagtgaccagtgcccggggtgccagacacatgg

SEQ ID NO: 6827519 - DNA, 75 bp, Homo sapiens
gtgccttccttcttgctactgctgttgactcctctattagttggagacaagagcctttgggcagaaggatggtac

SEQ ID NO: 6827520 - DNA, 116 bp, Homo sapiens
ccccgctctaagggtcagtgcaggaggcggcgatggccctgggcaaggttctggccatggcactggttttggccttggccgtgctggggtcgctgtcccctggggcccgggcgggg

SEQ ID NO: 6827521 - DNA, 91 bp, Homo sapiens
gcccaggattatgtgcatttcatatgggcattggcaatattttaagtgaatgtgggctatgaacatgttaaatttgtgaatgatcaagggt

SEQ ID NO: 6827522 - DNA, 66 bp, Homo sapiens
gacagtcctgcaggttgaactcctggccccatcagaagttacagtaagccagccagcaggcctgtc

SEQ ID NO: 6827523 - DNA, 62 bp, Homo sapiens
caaggcctttgccccgatacaggaatgcatccttatgctcctgtatctgggcaaaggccttg

SEQ ID NO: 6827524 - DNA, 86 bp, Homo sapiens
cttccccatcagtgctggtgccccttgaggagaagccttacagaggaagagttggccaaaaggggcatttatgtgtgatttggaag

SEQ ID NO: 6827525 - DNA, 73 bp, Homo sapiens
gccctcccttctgcaccctcctgccaccggctgttcctctggcagcttctgctcatggaggggtggaggtggc

SEQ ID NO: 6827526 - DNA, 65 bp, Homo sapiens
gcctaatctattttattacatccagagagacttttataatctctggaagtgatgttcatagtggt

SEQ ID NO: 6827527 - DNA, 58 bp, Homo sapiens
tctccacatgtataacctggcaagaagttactgaccagtgtctagttgtgcaagggga

SEQ ID NO: 6827528 - DNA, 57 bp, Homo sapiens
ggtgaaagtggcatctgggagtgaaacctaggttcctagattctttctactattatc

SEQ ID NO: 6827529 - DNA, 56 bp, Homo sapiens
gaaattgtgttagatatggttgtgcattttaacatctgttcatctgacacagattc

SEQ ID NO: 6827530 - DNA, 79 bp, Homo sapiens
ttctgatcttaacactcatgctcagctggtgctctaatactcaagagcaggagaaagagtatgggctctgtggttagaa

SEQ ID NO: 6827531 - DNA, 109 bp, Homo sapiens
ctcagcaggctcccccaatttgtctggatagagcctaggcccagtgtcccaggaaggtggatacttgggagtctttggcattcagggaaattggggggactctcctggg

SEQ ID NO: 6827532 - DNA, 60 bp, Homo sapiens
cagggccacacagaacctcctggtgggacagggcccagacccaggcttctgtggtcactg

SEQ ID NO: 6827533 - DNA, 79 bp, Homo sapiens
atttcagagcagttatttctcttttgagggattgaatttctttctggtttgtcttgggaggatgtatgtgttcagaaat

SEQ ID NO: 6827534 - DNA, 57 bp, Homo sapiens
tttgcactttaatataatgtgaatgcaagcacagaaatattgtaggtaaagtgcagg

SEQ ID NO: 6827535 - DNA, 81 bp, Homo sapiens
ttctctcagcctttccttcttggtcacaaagtggtagctactgctccagccattctgtccagaggaggaagaaggaaagaa

SEQ ID NO: 6827536 - DNA, 63 bp, Homo sapiens
ggtatgtaaagcccttagaacagtatctggcatttcataactgatcaagggtttaattttact

SEQ ID NO: 6827537 - DNA, 107 bp, Homo sapiens
aaaaacaagaaagaaagaaagacatcatgttctgctaatagtcccatttaaagtcatctggggagtattaggcacggcgggactgcactttattttgctttgttttt

SEQ ID NO: 6827538 - DNA, 101 bp, Homo sapiens
agtgctgagcaggcatggggcactggtgtcttcagggacggctgctcccacgcaaggctgagacaacctgggacccagtcacccacatcgccatcagcatt

SEQ ID NO: 6827539 - DNA, 74 bp, Homo sapiens
gctgctggttcgcagatggccttgcacaagccttggctgctcagagctttgcactccagctgtggcccagcagt

SEQ ID NO: 6827540 - DNA, 92 bp, Homo sapiens
acatttttctaagagaggttgtcacctatactgagcttaatagaaattgttaatcttatatgtaaaggtaataatttgtcataaataattgt

SEQ ID NO: 6827541 - DNA, 60 bp, Homo sapiens
agaaggctcactaagagtgactgcattagcataaattcaggtatggttattgggccttct

SEQ ID NO: 6827542 - DNA, 79 bp, Homo sapiens
ggaacagttgcacagtctttcctggacttacaacgttgatactttggaagagtccaggcaagttgttgtgtagaatgcc

SEQ ID NO: 6827543 - DNA, 55 bp, Homo sapiens
cttcaggaaaatctctaaggatgaaaattccttggccacctagattgtcttgaag

SEQ ID NO: 6827544 - DNA, 82 bp, Homo sapiens
actgggagggagctgctgacactttattaagctgttgttttgcttaaattgcagttatctaaagtgacacttcccctccagt

SEQ ID NO: 6827545 - DNA, 71 bp, Homo sapiens
gcccccgccggggcagcgtggcgactggcgccgctttggcagccattttctgcagctgccgcggccggggc

SEQ ID NO: 6827546 - DNA, 70 bp, Homo sapiens
gtcattcctttacagttgatcctgcaaatcccaccctggaagtagaaggttctggagcttagagggaggc

SEQ ID NO: 6827547 - DNA, 65 bp, Homo sapiens
cttcaaagtataatgtgaaactggcttgcactggatatgagagaaattcacattttgctctgagg

SEQ ID NO: 6827548 - DNA, 98 bp, Homo sapiens
ttttgctgcattcaaatcacctcatctgctgaaacatgtggagacaaataaccacagacgtttgcatgaaggttcaggtgtatttaagggcagcttaa

SEQ ID NO: 6827549 - DNA, 127 bp, Homo sapiens
tccgagcatctgagcctctccatggtactcggggagaggttacccgagcaactttgcatctggacgacgaatgttgctcggtgaaccccttttcggtatcaaattccaccagggaggccgtcttgga

SEQ ID NO: 6827550 - DNA, 62 bp, Homo sapiens
aaaggtttatttgttgctcacatcttgacccagtacaggtcagctgagcagagtaaggcttt

SEQ ID NO: 6827551 - DNA, 55 bp, Homo sapiens
gtgagctgatgtctgcctgtgcactgatatgttgtatggctttactaagctgcac

SEQ ID NO: 6827552 - DNA, 76 bp, Homo sapiens
ggacgaggtgctgctgtacttcttgcggctggaggccatccctgccctgaacagcaagagacagagcatcctgttc

SEQ ID NO: 6827553 - DNA, 57 bp, Homo sapiens
taaacgttcgtgcaactaagctgaggtttttttcagctgagaataaggagccgtttg

SEQ ID NO: 6827554 - DNA, 60 bp, Homo sapiens
gagcaggtactcctgtgtgggcctccacccaccttggagtagcacatacagtacttgttc

SEQ ID NO: 6827555 - DNA, 91 bp, Homo sapiens
gttaggaggctattacagtcacccatgcaagatgtatagaagacttgaattgcaactatgtactgattgtggtcactgctgaggccctggc

SEQ ID NO: 6827556 - DNA, 72 bp, Homo sapiens
tctcagccatccttgaagttttttgcatggtcttagtgagtctgtgtgagcatcacttcagatgtggtgaga

SEQ ID NO: 6827557 - DNA, 64 bp, Homo sapiens
ccactaggggctcaggcccagggatatccaggttctgtccctgagcccctgagcctctggctgg

SEQ ID NO: 6827558 - DNA, 62 bp, Homo sapiens
ctgataagggcaggttccaaaagggtgtgcctggtgtgtaccatggttctgccacttactag

SEQ ID NO: 6827559 - DNA, 68 bp, Homo sapiens
tacaggaaagtttgctgatgaagaaaatttcagaaagggggagattttggggttggcaggctcctgtg

SEQ ID NO: 6827560 - DNA, 95 bp, Homo sapiens
tgtgtagggactctggagccatgtatagcctatgaatcctttcaagtttattcgaacttatagtgttttatattggctctaatagtttaaacgca

SEQ ID NO: 6827561 - DNA, 70 bp, Homo sapiens
tatgggcagcacagacagtgaaggccaggatcattttccttgtcaattacaaactgtggctgtgaccatg

SEQ ID NO: 6827562 - DNA, 85 bp, Homo sapiens
gcagaacaagtggagggcacagagggtcttgaagaacagggatgcagcccctgcttccaagacacctttagtcactccctactgc

SEQ ID NO: 6827563 - DNA, 66 bp, Homo sapiens
cttgggtaccatgttgtttggaaggctcccctaggaagctcttcccacatagccatgggtatcaag

SEQ ID NO: 6827564 - DNA, 59 bp, Homo sapiens
tctttgccttgattttgttggtctccccatccagatgatcggcttcctgaaggcaagga

SEQ ID NO: 6827565 - DNA, 56 bp, Homo sapiens
ggcactgcccaaccccctgccctgtcacacacagagcacatgagggagggcatgcc

SEQ ID NO: 6827566 - DNA, 63 bp, Homo sapiens
tcgggcgccgcggctctcaggcgggcccctctgggccggctgcttctgagccccggcgctgga

SEQ ID NO: 6827567 - DNA, 72 bp, Homo sapiens
gggcacttaactgcaaagccagatattatcatgttcttcactatgagtctgttttgcttggttttatgcatc

SEQ ID NO: 6827568 - DNA, 130 bp, Homo sapiens
gcgcttagcatcgcgtgttctcttggaagtcgtacaggaagccctggcaatgtcagatgaggggtattctaatttgagctatgggcatctggatacgaattcttttgggggctcatgaagggataggtgc

SEQ ID NO: 6827569 - DNA, 80 bp, Homo sapiens
ccattattgcttcttatgtagtgactgactgttaggtaggctgattctttttcatattgcaaacttggggagcatgatgg

SEQ ID NO: 6827570 - DNA, 111 bp, Homo sapiens
ttgaaattaagcttttggtttcttcttgttaagaatgtgccttttggttggcattataaaatgcttaacacatgaaagcaccttcttttgaagctggtacagtgattacag

SEQ ID NO: 6827571 - DNA, 69 bp, Homo sapiens
tatgttgccttttgactgtttatgaatggatagctgctccagaacataaatctcttaagactcaacatg

SEQ ID NO: 6827572 - DNA, 77 bp, Homo sapiens
tacaagcgcttgttgtctttcccatggattgtagtactcatggcagagaacaaagcaacaagtattaaggcaatgta

SEQ ID NO: 6827573 - DNA, 78 bp, Homo sapiens
gagagctttcttgggttccagttcccagactcacaactcctattctgtctgctgctactcagccctggaaatgttctt

SEQ ID NO: 6827574 - DNA, 56 bp, Homo sapiens
gattctttgtttgcttctttccctcagaactctggagactttgcttgcagagagtc

SEQ ID NO: 6827575 - DNA, 62 bp, Homo sapiens
agtttgagatgacatgttataagtggtaaagccacaagtgaattatgcaggtcatctcaact

SEQ ID NO: 6827576 - DNA, 58 bp, Homo sapiens
agtaggaagtgcattgttttcctagaatatgtactttgggaagaaaccacatcttact

SEQ ID NO: 6827577 - DNA, 55 bp, Homo sapiens
ggccatgctcgtggctggactgctgcccacacacagacagctcctgcccatggct

SEQ ID NO: 6827578 - DNA, 76 bp, Homo sapiens
ccctaatttttgaactgtgtctgcccgtgaagtcctggagttccatggctgtgcctcaaggctactcaagaaaggg

SEQ ID NO: 6827579 - DNA, 74 bp, Homo sapiens
catggagtgtgtcattctgcccagtacacccagcacagaacacatggtgtctgaaacttatgatatactccatg

SEQ ID NO: 6827580 - DNA, 86 bp, Homo sapiens
tgttagaaatgattttttgttggtaatgatcagtagtaaaaatatgcagataaggaaaaatacttgcagaaacttcaattctgata

SEQ ID NO: 6827581 - DNA, 67 bp, Homo sapiens
gggcctgagctactaggtaggttagggcaataaaaggtgatctgtctgtcagcagtgggtcaggctt

SEQ ID NO: 6827582 - DNA, 82 bp, Homo sapiens
gatatactatttaactgtgcatatattttagagtttggttttaaatgactagaatatttgtatgcacatggataagtatgtt

SEQ ID NO: 6827583 - DNA, 95 bp, Homo sapiens
ttttattacttacagcagttaaaaggtatgctaccaatcatatgcaaaacaagaaaagattgcagagtacatttttttactgggtggtggtagaa

SEQ ID NO: 6827584 - DNA, 78 bp, Homo sapiens
cctttcaggatgtgcctgttaatttcagagaactacacatctatggcacctctgtagccatgggtatattctgacagg

SEQ ID NO: 6827585 - DNA, 64 bp, Homo sapiens
agactaggggtgatgtggcccacaggcagacagttcccaccctgggccactcttccctgggtct

SEQ ID NO: 6827586 - DNA, 84 bp, Homo sapiens
gacctcatgccacctgctgtagccactgggctcagccctggagctgagagcatcgctggagatagacgtggcagagaagaggtt

SEQ ID NO: 6827587 - DNA, 82 bp, Homo sapiens
tgaagaatagttttgggaagtttaatgacagactttggcaaggctaaaatggctgatgcaaacttcccaatagctctctaca

SEQ ID NO: 6827588 - DNA, 76 bp, Homo sapiens
tgggacattttggtaagagtcacaaatttagcttgttgcagaaggcaggactgaaaatgagttcttctaaatccca

SEQ ID NO: 6827589 - DNA, 70 bp, Homo sapiens
gagtgagttttggtagtttctgtctttagataattgatctatattatctaagattttgctaagatcattc

SEQ ID NO: 6827590 - DNA, 56 bp, Homo sapiens
gataaatttaacagagttctccatttttataatggtatacactggtaagatttgtc

SEQ ID NO: 6827591 - DNA, 58 bp, Homo sapiens
cttctgtgaggacttctcaaggacatcgtcgctggagaggtctgagtcctcggagaag

SEQ ID NO: 6827592 - DNA, 81 bp, Homo sapiens
caatgcccagtgcctgtggccactgcgtctgcaatctgtcttgtggaatgacatatgctgggcctcaggtgaatcacattg

SEQ ID NO: 6827593 - DNA, 78 bp, Homo sapiens
gagtctcactctgtggcccaggcagtggcacaatcattgctcactgcaacctccacctcctgggtccaagtgattctc

SEQ ID NO: 6827594 - DNA, 103 bp, Homo sapiens
aggggtaccatggtggtcccgcagagaacacgggcacaagcaggctggtggtatacgtaactttgctgcctttgtactctgatggaataaattatgctccctt

SEQ ID NO: 6827595 - DNA, 112 bp, Homo sapiens
ggagccgccgagccccccatttccagggccagggacacgctgtcaggctccaggtcatccacctcactggctgtgtccctgtccagagtaggggaggacggcacggtggccc

SEQ ID NO: 6827596 - DNA, 93 bp, Homo sapiens
agccccatccagggtgtggagagagctcttgaccacaggtggaggtgcccttccccacacctgatgagctctgtccacacttggagaccagct

SEQ ID NO: 6827597 - DNA, 61 bp, Homo sapiens
ggaaaggcagagtgctcagctggcatttagtcaaaagcctactgtagtagctgcttctttc

SEQ ID NO: 6827598 - DNA, 107 bp, Homo sapiens
gaaggggagttgagatacttgctgtcatgatgttgataaattactttaaaattcttcagaataaagtggaatatgaatgtatatagcaatgctttttacttctcttt

SEQ ID NO: 6827599 - DNA, 55 bp, Homo sapiens
cctcagctgagcctcagcgtctgtgctgagctgcataaggcctgggaagctgagg

SEQ ID NO: 6827600 - DNA, 60 bp, Homo sapiens
ggtggcagagttgagatttgaacccaggcaaacctggctctagagtccaggctcttcacc

SEQ ID NO: 6827601 - DNA, 57 bp, Homo sapiens
tgagcagggactttggagtctggtgacccagggttcaaatgttgtccctgattctca

SEQ ID NO: 6827602 - DNA, 86 bp, Homo sapiens
aggactgcatttttccattctctgttagtaaaatatctcagctgccttttgattctgctagctgcgagaatggcagaatggggcct

SEQ ID NO: 6827603 - DNA, 58 bp, Homo sapiens
gagtgggttagggccagcctgtggaggacctgggagccaggctgagttctatgcactt

SEQ ID NO: 6827604 - DNA, 63 bp, Homo sapiens
caatccatcaattacacaggctgcctcacccaaatctgctttgtcctggtttttgttggattg

SEQ ID NO: 6827605 - DNA, 62 bp, Homo sapiens
gcttctgcagggtcctcgctgtcaacgagtggtggttatctaataggggtccctgccgaagc

SEQ ID NO: 6827606 - DNA, 61 bp, Homo sapiens
gcttctgcaggttcattgtttattccaagttcccagagaaacaaatgtaaaatgcagatgc

SEQ ID NO: 6827607 - DNA, 86 bp, Homo sapiens
ggttttctgactcttactagaatttttgagatttgaagcaaaatatagatttagatgcttaagttttcagtgtacctaggaacacc

SEQ ID NO: 6827608 - DNA, 104 bp, Homo sapiens
tcctccccttccttccccaaccccgactgtgtggaatccaaatatttccacctcaacagcaaacaggagtggggtgctggggagatggaggagatgggggaggg

SEQ ID NO: 6827609 - DNA, 74 bp, Homo sapiens
atggagaaaggccagctcacagatgagactaaaatgaaacccaggtttcctctggcttctggctttatctccat

SEQ ID NO: 6827610 - DNA, 68 bp, Homo sapiens
tccctagtctatggtattctgttgtagcagcccaaacaggctaaaacatcatgatagccaacttggga

SEQ ID NO: 6827611 - DNA, 62 bp, Homo sapiens
tgttgacctctggagagtttggagtggtggtaatgagtactcttgactccatggtgttagca

SEQ ID NO: 6827612 - DNA, 57 bp, Homo sapiens
ctctctgagtctcagcttccttatctgtaagatagggacagtatccatctcacagag

SEQ ID NO: 6827613 - DNA, 77 bp, Homo sapiens
gtgcgttggggactgggagatcctcctggcatctagtggatagaagccaggggagctgctagatatctacagtgcac

SEQ ID NO: 6827614 - DNA, 61 bp, Homo sapiens
aggatataaaggttagaaaaattggcaaagggcacactttgtttcataacttttatatcct

SEQ ID NO: 6827615 - DNA, 76 bp, Homo sapiens
gacttgtttaataataccttagcaagtggtctatggctttctccaccattacatgcaagtgttcaaaaacaggctc

SEQ ID NO: 6827616 - DNA, 83 bp, Homo sapiens
ctgcaaggtctcaaggtgatcctaaattctactacatggcattaggcatagaaaggcaatcattcttggaaggactgtaacag

SEQ ID NO: 6827617 - DNA, 60 bp, Homo sapiens
gtcttcagccaagagaaggtacgacctactcctgagttcttggcttctctggcagaagat

SEQ ID NO: 6827618 - DNA, 106 bp, Homo sapiens
atgcctcaaacaccttcacagtcatcatctgccctcactggggatgcaagacacctggggacctcagtaaaggggaggtgatgggaatgggaggagtctggagtat

SEQ ID NO: 6827619 - DNA, 68 bp, Homo sapiens
gacaccagaatcatcatctgaagcctattcagggacatcccagaggttccgatgggatctggcatgtc

SEQ ID NO: 6827620 - DNA, 83 bp, Homo sapiens
ggttagtatgatttgtaattcaattagaatagtgcctggcatataataggcacttgattaatgtgaattcattatgactagct

SEQ ID NO: 6827621 - DNA, 77 bp, Homo sapiens
tagggacatgtggaagagcttctaggagacagtgtggacctttccatccctagaggtcttcacaagataaattccta

SEQ ID NO: 6827622 - DNA, 62 bp, Homo sapiens
tcccagtttggcagactccagagtccttgctctaaatcactccccagactgccatgctggga

SEQ ID NO: 6827623 - DNA, 74 bp, Homo sapiens
atgttgagtccttcgagggaatactggaatgtcttctaaagtgactagacattttgcattccctgaagcagcgt

SEQ ID NO: 6827624 - DNA, 126 bp, Homo sapiens
cattggaatcacctggggagatttaaaaattcctgctgccaggcctcatcccagccattaagtcagaatctctgggaatgggcctgggtaacagaaattgtcaaaccttcccaggtgattccaatg

SEQ ID NO: 6827625 - DNA, 85 bp, Homo sapiens
actcttttaagctacattgtactagaaattgtattcagaatgttttccgtgaacagatttttaatgcaaagggttttaagagggt

SEQ ID NO: 6827626 - DNA, 61 bp, Homo sapiens
tgcggggggaggaacatcttgcactcagaaatagcctcagtgcttgttctctgtccttgca

SEQ ID NO: 6827627 - DNA, 55 bp, Homo sapiens
gtttgcattgaatgcacatttttataaagtactgtgaaaatgaaatagtgcaaac

SEQ ID NO: 6827628 - DNA, 59 bp, Homo sapiens
cctgtttttagttcttttgatcgtttacttgatagactgttaaattccttaagagcagg

SEQ ID NO: 6827629 - DNA, 69 bp, Homo sapiens
actggattatggtcatggttgcacaatttggtaaatttaccaaaagtcactggatcatatgcatcgagt

SEQ ID NO: 6827630 - DNA, 67 bp, Homo sapiens
ggagacaatgtggactttattttagggaggacaatgttgattttaaatttaggtccaaaatgttttt

SEQ ID NO: 6827631 - DNA, 88 bp, Homo sapiens
ggcctgtatgttttacgcagctgctccaggaagctgttgtagaagccctctgcctgctccgtgggcattgctaggtggaaatcaggct

SEQ ID NO: 6827632 - DNA, 63 bp, Homo sapiens
tccctctgcaaggttcaggaaaccttttaagacaagtgtgaggggttttgcctagcgaaggga

SEQ ID NO: 6827633 - DNA, 68 bp, Homo sapiens
agggcaccaggactcctgctgggaatggctgggacaagcaggttttgaccaggagtgcttgtgatact

SEQ ID NO: 6827634 - DNA, 59 bp, Homo sapiens
tatgcccttacaatgagcacaagcccatattgctaaattgtgtatcattttaagggata

SEQ ID NO: 6827635 - DNA, 69 bp, Homo sapiens
cccttagagagtactgggctgcccttaatagctgtgtgatgttaggcaattcacccagactctcagggg

SEQ ID NO: 6827636 - DNA, 82 bp, Homo sapiens
gaatgaagtcgtgactttcaattgcaggcctgtgttctgcaatgagcttatgggtcccaatctgaaatgtcatgcttttgtc

SEQ ID NO: 6827637 - DNA, 81 bp, Homo sapiens
agttcattacattgttgcataggttttgaaaacattattaatattaaacaagtcaacccttgtgcaacagtgatgagaact

SEQ ID NO: 6827638 - DNA, 60 bp, Homo sapiens
tcatgagtggctgatgtcctctagtcttgcttactgaccaaaatatcagctacttcatgg

SEQ ID NO: 6827639 - DNA, 130 bp, Homo sapiens
ctaaaagttcaaggggaaaaggaaggcaaagaaggacgtttatatgattgagcatcttggtttgaaagaaattatatgtttaattatattattcccttgtccttccatgaaccctatgaagtattaatag

SEQ ID NO: 6827640 - DNA, 75 bp, Homo sapiens
gaatatatggaaagtgagtgagcaagagtcaaattgaagatagtttgactgttttcactccctttcagggtaatc

SEQ ID NO: 6827641 - DNA, 56 bp, Homo sapiens
acagctcagcttgtggtgatggtattagcttcacaactccaaacaagttaagctgt

SEQ ID NO: 6827642 - DNA, 62 bp, Homo sapiens
cggagactgagcaccgccgcatttccaagggcgtgatgggcgtcctcggtggtgcttctctg

SEQ ID NO: 6827643 - DNA, 130 bp, Homo sapiens
tcctgacctctaacaatcctcctgccttgtcctcccaaagtgctgaaattacaggggtgggcccctgtgccctgcctgacttgtgtattttacatttaccaggaaaccctggcatctgttgaggtggtga

SEQ ID NO: 6827644 - DNA, 60 bp, Homo sapiens
tttctggtcctgcaattgccagtttggagaagcagagtggcatagtgaggggcacagaga

SEQ ID NO: 6827645 - DNA, 67 bp, Homo sapiens
caggaaactattgttcactcagatatttggttagacagcaatctgggcaagcaggtagtaaaccctg

SEQ ID NO: 6827646 - DNA, 72 bp, Homo sapiens
cagacaagtgcccattattctttatttcttggacaagacttgactaggaaaatggcatttgcaaagcgtctg

SEQ ID NO: 6827647 - DNA, 76 bp, Homo sapiens
tggcaggaggcaggtgccctgtctgtaccgtgatgagccgtaagaagactgcatagacaaagcgcccctcctccca

SEQ ID NO: 6827648 - DNA, 57 bp, Homo sapiens
tcaactactcagcaagtggacatcttttacatgaagatttctgctcctgagagaaga

SEQ ID NO: 6827649 - DNA, 63 bp, Homo sapiens
ctcatgtcccagacttaatcagttacaatttatacagctaactgaaagaagttggacaatgag

SEQ ID NO: 6827650 - DNA, 76 bp, Homo sapiens
taatcttataggccatctaagtaattttggtaatttttaatgtagcaaaattactcaagttggctttatttggtta

SEQ ID NO: 6827651 - DNA, 61 bp, Homo sapiens
ggaaccccgttctgaggaaacaggggtgctggtcagcctctggctccatccttggggatcc

SEQ ID NO: 6827652 - DNA, 76 bp, Homo sapiens
ctgttttagagaagttaggaaataaaagtgttcacaacagccgaggtcatctttaacttttcacttttcaaagcag

SEQ ID NO: 6827653 - DNA, 82 bp, Homo sapiens
cattttggaaatacaaagatacaccactccttggaatgtcactggggattttccatagtggtatattagtgtttctgaagtg

SEQ ID NO: 6827654 - DNA, 67 bp, Homo sapiens
tttttagattatttgcagtgtggatcacccatacagtggaccttctatagtgtagataatttgaagg

SEQ ID NO: 6827655 - DNA, 87 bp, Homo sapiens
agaatcacttgaacctgagaggtggaggttgcagtgagcagagattgtgccactgcagcactccagcctgggcgacagagtgactct

SEQ ID NO: 6827656 - DNA, 100 bp, Homo sapiens
tgcattctagtaaaattggccactagtataattgccctaaccttctgagtgtctgctcacgggtgttaagcatttgtctgtaccatttttgattagtgca

SEQ ID NO: 6827657 - DNA, 76 bp, Homo sapiens
ggaatgattatatgtatatgtgaaagatgtttattaggtctccagatagtgtttagtacatatgcatataatttcc

SEQ ID NO: 6827658 - DNA, 58 bp, Homo sapiens
agttgcttccctattcttagcaggtgtgaacctttcctgaggtagaggaaatgtagct

SEQ ID NO: 6827659 - DNA, 100 bp, Homo sapiens
aagccctccaggagattctgatgcaggttaaagtttgagaatcattgctttaggatatttgagcctagactaagacttgctctggcctcctttgggactt

SEQ ID NO: 6827660 - DNA, 72 bp, Homo sapiens
acacatgacccacaggaatataagtttgagtttgccatatttgggaatttttgtgtttctgagtcaatatgt

SEQ ID NO: 6827661 - DNA, 64 bp, Homo sapiens
actacatttgcagagaagcaatatggctttatcttccaatcagggcttcatttgcaagtctagt

SEQ ID NO: 6827662 - DNA, 70 bp, Homo sapiens
ggaaagctatagagtgtaagatgataagggtttcagggatactcatatctctcacctctggtagcttact

SEQ ID NO: 6827663 - DNA, 83 bp, Homo sapiens
agtttttgcaaatcacaaattctacaatcatatgatacgtatatgacctatcatagatactgggaatttaggtttgcagagct

SEQ ID NO: 6827664 - DNA, 77 bp, Homo sapiens
ggctcgaagcaatctggctcccagccaggtaaacaacaacctcaccctgcctctgagaccccggtgttgcttctgcc

SEQ ID NO: 6827665 - DNA, 79 bp, Homo sapiens
tcacctcaaggcagtcatttaatccctgcatgccttaaatactctgcaaaacaggagagtaatgctgttgtgaagtcga

SEQ ID NO: 6827666 - DNA, 81 bp, Homo sapiens
ggtcagagtctggacatgcttgaataatatcttcatgtaaaagagagataggagtcaaaaagtattctaaagtttctggct

SEQ ID NO: 6827667 - DNA, 86 bp, Homo sapiens
gcgcagctggcatgactcagaaacaggattcaaaaccgggtaggctggttttagagtccaagttcttcactgacagactgtactgc

SEQ ID NO: 6827668 - DNA, 70 bp, Homo sapiens
ctttaatttttaaatcccagtaatgactgatgcttccaaacactttggatattgggattttaggttaaag

SEQ ID NO: 6827669 - DNA, 66 bp, Homo sapiens
agtgatgaggccttcaacggacacactatcaagaagctcaggatgtcctttttgaggcctcctcct

SEQ ID NO: 6827670 - DNA, 56 bp, Homo sapiens
ctctctttctgaatgaggactaaaggaaaccctttcagtgagtctagagaagagag

SEQ ID NO: 6827671 - DNA, 63 bp, Homo sapiens
cccgttcctccctgagtggggacagcttcagcatctgcagcatccactcactgggagaggggg

SEQ ID NO: 6827672 - DNA, 57 bp, Homo sapiens
tctcacacttcccaccctcctggctggaccttctgctcatggagaaacaaggtgaga

SEQ ID NO: 6827673 - DNA, 129 bp, Homo sapiens
aagcatcagaattacctggagggctgctgaaacacttctgggtcccacccccagagtttctgattcagtaagtctggtgtggggcctgagaatgtgcatttaacaatttcccaggtgatagagatgctt

SEQ ID NO: 6827674 - DNA, 81 bp, Homo sapiens
aggaatgagtaaactagttttgagatggaaatgcaggtcattatcagatttttagcatatcctataaaactactcattttt

SEQ ID NO: 6827675 - DNA, 60 bp, Homo sapiens
ccacagtggttctcaaccaggggtgattttgctggttgcattaactgagaggggctgtgg

SEQ ID NO: 6827676 - DNA, 119 bp, Homo sapiens
ggggccttgcccacttacacttgtctgtcagctgggttgacaagatggaaagagagcctcccccacctttccctgcccatcagctctgctgacaggtgcaagcaggcaagggactcccc

SEQ ID NO: 6827677 - DNA, 75 bp, Homo sapiens
agagcattcctaaggaaggctggcaaggcacacactaggcgcactctgtcttacggcagaacctaggaatgatct

SEQ ID NO: 6827678 - DNA, 61 bp, Homo sapiens
tgtctgcgcggtgttgggggaaccctgggtgccttggcccagccctctgccatagccagca

SEQ ID NO: 6827679 - DNA, 61 bp, Homo sapiens
ggctagaactttacactttgcataggcctccaatcttgagaacatgcattgtaggctagcc

SEQ ID NO: 6827680 - DNA, 125 bp, Homo sapiens
tggtgtccctgtgggaagtgcctcatgcatggcactgtctgcagtatgagctacccaggtgtccctgtcacctgctctggtccagctgttccagtgcctcaaggtcccttacaggccaaaagcca

SEQ ID NO: 6827681 - DNA, 86 bp, Homo sapiens
acagtgtagtaaaagtgtagagactttggaaccagacagatcttcatcggaatcccggttctgtctctacacttgctctgtgctgt

SEQ ID NO: 6827682 - DNA, 70 bp, Homo sapiens
gctgagtcaccacacggtgctgactcaccctcttcacgtgacagcccttcctgtgtgtggagaccacagt

SEQ ID NO: 6827683 - DNA, 71 bp, Homo sapiens
acattagcatattaaatagtcattgaagtcattcaataaattgttgaaatgcactacagaagtgctgatgt

SEQ ID NO: 6827684 - DNA, 78 bp, Homo sapiens
tattttttgcttcccatataactaatttctgacatataagatttatgtagacattattgggtgggacttctaggaatg

SEQ ID NO: 6827685 - DNA, 57 bp, Homo sapiens
gcttccttcctgtgtaactgtctgtggtgtgcttcatcagataaacgggaaagaagc

SEQ ID NO: 6827686 - DNA, 87 bp, Homo sapiens
ggaaaagcagttgaatatatttctcttacctttagcttattctaagatgaaggaaaataaggagaagtaattgaaatgtcagattcc

SEQ ID NO: 6827687 - DNA, 65 bp, Homo sapiens
tctgagggaggggacacactggatcttgaaaattttaaagtacagttgatgttaccttccttaga

SEQ ID NO: 6827688 - DNA, 95 bp, Homo sapiens
atatacattacacacacagtcacatatctatgtgtgtagatgtttatgtatgtgtgtatatatatacctgtgtgtgtgtgtgtgtgtgtgtgtat

SEQ ID NO: 6827689 - DNA, 105 bp, Homo sapiens
gagttgagctttgtcaagaaccaagggctgaagttctttttgttcagactatgtttctgttaccagtattgagggactaaggactttcaagcccttctcattctc

SEQ ID NO: 6827690 - DNA, 58 bp, Homo sapiens
cagtgactcacacctgtaatcccagcactttgggaggccgacgcaggtggatcacctg

SEQ ID NO: 6827691 - DNA, 57 bp, Homo sapiens
ggccatgcatccttggacttggcgcaggtttttgcttggcctctgagggtgtgtgct

SEQ ID NO: 6827692 - DNA, 55 bp, Homo sapiens
tggcacagactgggccaaggaaactccacatgaatccctggtccaggtggagcca

SEQ ID NO: 6827693 - DNA, 63 bp, Homo sapiens
actgtgcattccccaacctgtgtttaagctgagagcaaggttccttatggggatggctacagt

SEQ ID NO: 6827694 - DNA, 80 bp, Homo sapiens
tcctctgtaggctgcagtgctagggttggagtggggctgagggagcccaggccctgagcccaagctctgcctgctgggga

SEQ ID NO: 6827695 - DNA, 90 bp, Homo sapiens
gttccccttcctgtgtccatgtgttctcattgttcaattcccacctatgagtgagaactaatcatgcatggagtttatagcactttgaat

SEQ ID NO: 6827696 - DNA, 85 bp, Homo sapiens
ttttttgtgttacaaacattccaattgtacttgcttttattctcagggagtaaagaaagccattggagtgttttgagccaaggag

SEQ ID NO: 6827697 - DNA, 62 bp, Homo sapiens
aaaataaggcacacatagatagggttaagtgatttgcctgtgtcatgtagtagcttcttttt

SEQ ID NO: 6827698 - DNA, 66 bp, Homo sapiens
ttggaatggccagctagcacttgcattgtatagttaacattgtgctataagcgtggttctttctaa

SEQ ID NO: 6827699 - DNA, 57 bp, Homo sapiens
tttagggggttaccactgtgggcaactgagttttggtcctgctgggaaccctctgaa

SEQ ID NO: 6827700 - DNA, 60 bp, Homo sapiens
acttttaaatgagtttcagttgtagagttagaatgcaactgattcttgaagttgacaagt

SEQ ID NO: 6827701 - DNA, 103 bp, Homo sapiens
ataggggatgacagcttcatctgtgttattgtctctgaagaccttcaagtgggacaagatgtggagctggaagacagtgatattgatgaacttgattctttgt

SEQ ID NO: 6827702 - DNA, 55 bp, Homo sapiens
ccgaggctggagtgcagtggcgtgatctcgactcactgcaacctccgcctaccgg

SEQ ID NO: 6827703 - DNA, 64 bp, Homo sapiens
tggccaatgaagtaggactgaacttgggggaattttccttcaacagacccttctttctttccca

SEQ ID NO: 6827704 - DNA, 129 bp, Homo sapiens
aaagagaatgtgcaaagtatgatggcgagaaagcaaatgttatattcagggatacttgttctgtgaacttagtagtttgagattttcctaaatataatgtttacagtgtttttatattaatgatttttt

SEQ ID NO: 6827705 - DNA, 60 bp, Homo sapiens
gggctccttttgatgggccacagtcaagaaggcagttaagctctgtggccttctgagctt

SEQ ID NO: 6827706 - DNA, 69 bp, Homo sapiens
aaaggcaaatgtatttgatgtattagcctgggctctccaaggtggggtgttggatgtttatttgctttt

SEQ ID NO: 6827707 - DNA, 55 bp, Homo sapiens
ccccaggtgtgatttggcagtgtctggagacatttttggttttcacaactggagg

SEQ ID NO: 6827708 - DNA, 70 bp, Homo sapiens
ggtaatttgaaggcactgaactccttctggtatgtgagtaatttttagtgtgattttatgcctttttacc

SEQ ID NO: 6827709 - DNA, 121 bp, Homo sapiens
ttcacagatagaatgcatcttcaccagagacaagcaaataataacttattccctttatttgagcttgtgtccctttgatgactcttcctaaaatgactaagatgactcttccttcagttaa

SEQ ID NO: 6827710 - DNA, 67 bp, Homo sapiens
ttagttccccagccagccatcatttgatagtcaatgtcttggtcttatcacgtggctagctcactag

SEQ ID NO: 6827711 - DNA, 74 bp, Homo sapiens
gtgacaggcttctggaatccagtttctcctactgaataaaaggagagagtaggacttcagaatccttaagttac

SEQ ID NO: 6827712 - DNA, 76 bp, Homo sapiens
acacattcttgagttgatgttttaaaaatgcatgtattcagatggaaaatagcaaagatgtcaattccccctgtgt

SEQ ID NO: 6827713 - DNA, 71 bp, Homo sapiens
cagacaatggttggacagttatttgttagctaaaatcctactgaaattattgtttaatcaaacttgtcctg

SEQ ID NO: 6827714 - DNA, 81 bp, Homo sapiens
acacataatcacccaaagtccatagtttgcattacagttcacccctggtgttgtacattctatgggtttggacaaatgtgt

SEQ ID NO: 6827715 - DNA, 69 bp, Homo sapiens
cttgaacccagaagttggaggttgcagtgagccgatattgtgccattgcactccagcctgggccacaag

SEQ ID NO: 6827716 - DNA, 62 bp, Homo sapiens
ggtctcttgtccaaggtcacacacagctagggagctacagggccagaagttggaaaagagcc

SEQ ID NO: 6827717 - DNA, 71 bp, Homo sapiens
tgaagaaacgcagagaggtaggctgtttgaccatgggagagccacttcacccttctgaatcagttttttca

SEQ ID NO: 6827718 - DNA, 56 bp, Homo sapiens
attactgagaaagctgggtcagaagctcccttcagcctggcttggggctcagtggt

SEQ ID NO: 6827719 - DNA, 60 bp, Homo sapiens
gtttatggtgttaatttatattgtggtgtaacaaactaccacacatatagcagcataaac

SEQ ID NO: 6827720 - DNA, 111 bp, Homo sapiens
tcctgcagtgcctggcaggccgaggcatcctgggccaggtctgtgtcagctgggacactctgcacatggcgctggtcctgactgtgccagtgccttctgggttctgcaggg

SEQ ID NO: 6827721 - DNA, 76 bp, Homo sapiens
atgtcaggatttaccgtcatttagtcttttgctctgatttttgcaggagaaaagtgttggaagtttttaatgacat

SEQ ID NO: 6827722 - DNA, 78 bp, Homo sapiens
ggcttcaacaggtgtttgctgaattcatctcaggaacaaaagtagccacagatgaagtaaacaactctttgagaagct

SEQ ID NO: 6827723 - DNA, 78 bp, Homo sapiens
cttttccttcattctcatttcatagtgcttaatttgataagagttctagttgcattggctgctatgctgggggaaaag

SEQ ID NO: 6827724 - DNA, 111 bp, Homo sapiens
gtctaaacaagtgtcacaatatggtcttatgaggcctatcagaacagtatgtttctttaacaacttattttcagtgggcctgcctaagcagtatgtaacattgaacttgac

SEQ ID NO: 6827725 - DNA, 82 bp, Homo sapiens
gctcccgttatctttgcaatctgcaaagctgtggaggctggtacccaaccttccgcggcgcgggcgcaaggccgaggggagc

SEQ ID NO: 6827726 - DNA, 64 bp, Homo sapiens
ctgatgaggaaattgaggcctacgaagattaaggaagttgcccaaggtctgattccagaatcag

SEQ ID NO: 6827727 - DNA, 83 bp, Homo sapiens
agaatatatctcagagttttgggaagccataaggatacttaacatgccctttcatctggcttctggctggtgagaaatgttct

SEQ ID NO: 6827728 - DNA, 64 bp, Homo sapiens
aggcactaatccctactatgagggctctttcctcctaatgccaccaacttgggggttagtgttt

SEQ ID NO: 6827729 - DNA, 111 bp, Homo sapiens
gctacccttggggactgctgtggcttggttcagtaggcatgcctggggcacaggaggagcttacgggagaggcatctgaacagccagttgggggtctggttcttgggtagc

SEQ ID NO: 6827730 - DNA, 78 bp, Homo sapiens
gtcctggaggagtaattagtgtccagcttctgcttatcaaagctttgccaggaggcttggtccacatgattccaggat

SEQ ID NO: 6827731 - DNA, 68 bp, Homo sapiens
ggccaggaaggcctggatgccccctgcctactaagtccctggctcgggggaggaagagccgtcctgcc

SEQ ID NO: 6827732 - DNA, 56 bp, Homo sapiens
aaggaatcacttctttaaatgaaacctgggtggcatttgagagacatgtattcctt

SEQ ID NO: 6827733 - DNA, 76 bp, Homo sapiens
tgtgtgtgtgtgtgtgtatgtgtgtgttgatgtcataagaggtcagtatcttgcttatagacacattttccatata

SEQ ID NO: 6827734 - DNA, 72 bp, Homo sapiens
cattttccaggctccctgggcagtggcaggcttccggctagtttctaccaaggggagcgctgatgggagatg

SEQ ID NO: 6827735 - DNA, 89 bp, Homo sapiens
tcacctgggagcttttagaaatgcagtctctcagactccaccaaatttactgaatcaaaatctgcattttaagaaaatcctccaggtga

SEQ ID NO: 6827736 - DNA, 55 bp, Homo sapiens
agaggctttgttcccattaatggtgtgtaacgcatgaaggtagcacaaagcctct

SEQ ID NO: 6827737 - DNA, 81 bp, Homo sapiens
tagaggatatagagacatgcagttgttgtgaattacataaccatttccaaaaattctaataaagtgattctacttcctcta

SEQ ID NO: 6827738 - DNA, 77 bp, Homo sapiens
gcaatggataacaccggttctgtcctaatcaccacttgtgatctcaaggcctcctagggcagagctatgtctgttgc

SEQ ID NO: 6827739 - DNA, 60 bp, Homo sapiens
ctgccaggtgcaaactcccagcaggtttcacaactgtttctgctaggagtttgcattcag

SEQ ID NO: 6827740 - DNA, 60 bp, Homo sapiens
tctgtcaaggcaactgcattttctgtaattgagatgtgtatgtttgctttgcataacaga

SEQ ID NO: 6827741 - DNA, 84 bp, Homo sapiens
ccttgtgcacttgtcctcttcaactgccaggcagtctagctctggcaataggctctggacagtgaggagttttgtagcaggagg

SEQ ID NO: 6827742 - DNA, 80 bp, Homo sapiens
gcaaaggtaattttcatggatttcttcagagaagagttatttttgtgaatcttttctagcaaatccaggagtactggtgc

SEQ ID NO: 6827743 - DNA, 78 bp, Homo sapiens
cacatgggatgattgatttgcactgtcacacggctctgctgggtgtcataacttagtgacaaatcaaggattacagtg

SEQ ID NO: 6827744 - DNA, 65 bp, Homo sapiens
gctcgttgaacctgtccccgagggacactgggtcagaaagcacctttgggacaggttcacagggc

SEQ ID NO: 6827745 - DNA, 55 bp, Homo sapiens
gaaacatgtctgacaatttaccttttcatactagaaatggtggatgacatgtttc

SEQ ID NO: 6827746 - DNA, 59 bp, Homo sapiens
atacactgtggtaaactcaaagtatattgtctttgaacttagagtttagtatagtctgt

SEQ ID NO: 6827747 - DNA, 71 bp, Homo sapiens
tggagcagagttcagcggggagctgaagggatgtgcaaacacggacaagattcctgctgaggttttttcca

SEQ ID NO: 6827748 - DNA, 89 bp, Homo sapiens
ggatgtagagctggttgacactctgctttctcaaaccctgtgcttccctggtattaatggggtttagcagacagtgagcttctgccccc

SEQ ID NO: 6827749 - DNA, 76 bp, Homo sapiens
gaagacattttatgcatactctgtgcctgggcatttgacatttgaaagcctccctaaagagatgctaagagtcttt

SEQ ID NO: 6827750 - DNA, 57 bp, Homo sapiens
caacactgtgcttgcatcctgtggaaagtcacatttggggtcaagtgaatggtgttg

SEQ ID NO: 6827751 - DNA, 71 bp, Homo sapiens
tctttgaaacaccctaacctttcatagcaaacttcttttcctgcagcagaaaggtggagtgtcagtataga

SEQ ID NO: 6827752 - DNA, 78 bp, Homo sapiens
tgcttcaggaagaaacgccaggtacccagaagcaagtagaaaagtaatgaatattaatggtgtatttatcttggggcg

SEQ ID NO: 6827753 - DNA, 96 bp, Homo sapiens
cattcagtcgtgtgtgtgtccctgccacatggattcagtcttgtgtgtgtgtgtccctgccacattgattcagtcctgtgtgtgtgtatgtgtgtg

SEQ ID NO: 6827754 - DNA, 70 bp, Homo sapiens
ctactctgggcttgtgttagctgacaaggcacattggttttcccgtttactcacattaagccctgggtag

SEQ ID NO: 6827755 - DNA, 67 bp, Homo sapiens
gtcactttcagccaagaagactatatgatggcaaaatgccagctgtaagtctcttggttgagttgat

SEQ ID NO: 6827756 - DNA, 130 bp, Homo sapiens
tatttttcttatttttagtgtagattccaagaaatagaatttaaggaccaagcattttgattccaagtccagagttctttgagaccttaaattaggttattcagaatattaactaaaacagagagaagta

SEQ ID NO: 6827757 - DNA, 59 bp, Homo sapiens
gatgtcagcatgctctgagtttggcctatctgagccatgccccagagtctgtctgcatc

SEQ ID NO: 6827758 - DNA, 119 bp, Homo sapiens
gccaaatgttccttcagggttccctaggagttcagtgtgaattgcttgatgagtggacaaagtgggagctatttgaaggtaaattatattgatcaactagcccccatcaggtttttggc

SEQ ID NO: 6827759 - DNA, 98 bp, Homo sapiens
atgttgaatatatattggctgcagcttcctctgtatattttcttattctgggatctgaacagaagaagcagccctggtcaggaacacagtattctcat

SEQ ID NO: 6827760 - DNA, 59 bp, Homo sapiens
tatgcagcaccactcactgcagaagacttgtctcttcccgaagtgagtggtgctgcatg

SEQ ID NO: 6827761 - DNA, 65 bp, Homo sapiens
gggcatggaagtactaaggggtgccctggagaatccctgggttccaaacatagtcttccttgtcc

SEQ ID NO: 6827762 - DNA, 88 bp, Homo sapiens
cataataatcaccaaatacgtagttgttgatcacatgcatatctgaactctgttagatagatagtgaggtaatagcgtgatgaaaatg

SEQ ID NO: 6827763 - DNA, 57 bp, Homo sapiens
aagacagagtgcccaaggagtttggtccctccctggggttcctggctcttctgtttt

SEQ ID NO: 6827764 - DNA, 101 bp, Homo sapiens
tagaagccttaggctctttaagggtaaggaactcagatcagcctcctaccagacctaggaatctcctccacagagtccttgccaaagggcctcactgtcta

SEQ ID NO: 6827765 - DNA, 61 bp, Homo sapiens
tttttttcaggggcctccagagtactctctcaaatttacttcatgagagccctgaggaaaa

SEQ ID NO: 6827766 - DNA, 92 bp, Homo sapiens
tcattatataagaactagaacaaattaggaggcataatgagtgtggcaaagcaaaaattcaatatccttgctattttctatcttacaaatga

SEQ ID NO: 6827767 - DNA, 92 bp, Homo sapiens
catgcctttaacttcattgaagggaggaacaatgtgtgtctgagctagccactgaaggcacagcctcccttcacatgagaagttggggggtg

SEQ ID NO: 6827768 - DNA, 65 bp, Homo sapiens
atctacgttagctgcctggccttagtggggctcacactccgccaagagtttccagctgcaaggat

SEQ ID NO: 6827769 - DNA, 55 bp, Homo sapiens
gtgctcactgtgagacgtcctgccacaccccacaggagacggaggcagtgggcat

SEQ ID NO: 6827770 - DNA, 109 bp, Homo sapiens
cacatcatagcttacccaaaaactttgcctgttttttattcagacctatgtgcatgcaaatatatacacataggtctgaataaaaaacaggcaaagttaagcagaagtg

SEQ ID NO: 6827771 - DNA, 68 bp, Homo sapiens
tcttcagactgttgttcttttggagccacagtccaatggtcccagccacagaaacaacattctggaga

SEQ ID NO: 6827772 - DNA, 56 bp, Homo sapiens
tggggaaaatgcttgtagtcagtgatctgtgcacactgtcatgcaaccattctcca

SEQ ID NO: 6827773 - DNA, 82 bp, Homo sapiens
gctttgcttgaaactcttggcatctgttcctggaggataaaaatttaactattctggctcatatgctaagaagtagcagagt

SEQ ID NO: 6827774 - DNA, 82 bp, Homo sapiens
gtcctgagggttactgcttctgcttgagaagtcacatgccagaactcaatccaagtctcagccagaaagtgattttcaggac

SEQ ID NO: 6827775 - DNA, 59 bp, Homo sapiens
ggaccgatctcccccttctgtctgagtgacatcactgtggacaccactgggaggtctcc

SEQ ID NO: 6827776 - DNA, 88 bp, Homo sapiens
gtgaagaataaacaggttcatatatgtaaggtgcttaaaacaatactaaataaaggtgctggttgtgatactggtttatatcattcat

SEQ ID NO: 6827777 - DNA, 124 bp, Homo sapiens
gggcaacacagtgctccacacagagtgtgattctgtaaatgtttcctgagtgcaggtagagtgcagaggcctctgtccagctctcaggagacaatcaccagcacacctgagaagactgtggccc

SEQ ID NO: 6827778 - DNA, 80 bp, Homo sapiens
cttgtaaaattctttcacttagagccagatgcatagtaggtactattagctaatctgaatctgaaattgaatttggcaag

SEQ ID NO: 6827779 - DNA, 82 bp, Homo sapiens
tcaggacctggctctgtgcagtcagggctcagtcccaggcaggcctgggactggcctggggctgggcacagcaggtccatga

SEQ ID NO: 6827780 - DNA, 73 bp, Homo sapiens
ctgtatggtttataggacagctctgtagtttttcacttgattctcccaacagggctgtctatattttttgtag

SEQ ID NO: 6827781 - DNA, 57 bp, Homo sapiens
ccccacagccgccagcagggagctccctttcggctcggcctgcgcggtcgctggggg

SEQ ID NO: 6827782 - DNA, 102 bp, Homo sapiens
ctgtcgctgctgtctgcaaccccaccgggcctcccagagccgaggtgacagcctgggcctcggggaagcccgtgtctcatgggcggttgtccagctgctcag

SEQ ID NO: 6827783 - DNA, 59 bp, Homo sapiens
tcttgtgaacatattaaaagcctcagcctaaagtgatgtttcccaaattgttcacaggg

SEQ ID NO: 6827784 - DNA, 78 bp, Homo sapiens
ctgttgatgtaagattgtatttgattgtcatatcgtttgttgagatgatggccacttaaatatgctgcagatcaaggg

SEQ ID NO: 6827785 - DNA, 96 bp, Homo sapiens
gttattccctcggctgagtgggggccaacgagggcagcgcggcaaacctcacacctggcggctggctgtgggctccacgctcccttagggaataac

SEQ ID NO: 6827786 - DNA, 57 bp, Homo sapiens
actagttttcaggcatgtctggatctctgggttcaaacaatgtcatcaggacttggt

SEQ ID NO: 6827787 - DNA, 56 bp, Homo sapiens
cagcgggaatgtgggacccagatgtgatctgagtcgcatcgaggagcttcctgatg

SEQ ID NO: 6827788 - DNA, 74 bp, Homo sapiens
aggaatgggagactatgttcagcaggcatgacagcattttctaaatgttattactgttggcaaagtcttatctt

SEQ ID NO: 6827789 - DNA, 65 bp, Homo sapiens
ttctatggcagtgcaggatttatttagtgataatgcctggtttttggtcctgtactctcattgaa

SEQ ID NO: 6827790 - DNA, 70 bp, Homo sapiens
tcacagagcctagaaggtgaatgagggctgtggaatgcaagcatcacatctctcattgcctctgctgtga

SEQ ID NO: 6827791 - DNA, 76 bp, Homo sapiens
tacatagataaggattgtataatcagttactggaaatgcattcttaggattgtttgcataatttattttctatgta

SEQ ID NO: 6827792 - DNA, 57 bp, Homo sapiens
aggtggccaagactgtttgacatgtgacccaggtcccagaccctctagaggccacct

SEQ ID NO: 6827793 - DNA, 62 bp, Homo sapiens
ttgctctctttcctcagccacagtctagaggaactctaaggccctgaggagggaggtgtcaa

SEQ ID NO: 6827794 - DNA, 64 bp, Homo sapiens
gcccccatagccaccacatctgctgctaaagtgaacaatgatgcaatgtactgtttgtgggggc

SEQ ID NO: 6827795 - DNA, 62 bp, Homo sapiens
gattgttgggccccaccccgagagtttctgatttagtagctctggggtagggcccaacaatt

SEQ ID NO: 6827796 - DNA, 62 bp, Homo sapiens
ctgacttggagatacagaggacatttggattctgtactaaggtccatgaatatctaagccag

SEQ ID NO: 6827797 - DNA, 92 bp, Homo sapiens
gaagtctgagatgaaggtgcaggcaaggttggtttcttctgaggcctctctccctggcttgcagatggccaccttcatctcccagtgtcttc

SEQ ID NO: 6827798 - DNA, 97 bp, Homo sapiens
tgcgcaggcgccgggcgagaggctgcgcctgccctaccctggagcgcgcgtgcgcgcgagagccggaaggggcggtgcctggcgcggcgcctgcgca

SEQ ID NO: 6827799 - DNA, 99 bp, Homo sapiens
gagggacaagtggagctgaagtacagtcaccccaggagcctctgcggatccatgaggagctctggaggtgggagggactgtcctttggacttgttcctc

SEQ ID NO: 6827800 - DNA, 65 bp, Homo sapiens
attcttaagtgtttttgggctagtgcccattccattgtttttgcccagagaggctcaccaggaat

SEQ ID NO: 6827801 - DNA, 57 bp, Homo sapiens
ttcagttctctcatctgtaccaccaccctgccatacagggtggttgtgggaactgaa

SEQ ID NO: 6827802 - DNA, 70 bp, Homo sapiens
cctgcctcgcagtttccatcctcgcagagcctggataggatgccaggatataagagtgcgatttggcagg

SEQ ID NO: 6827803 - DNA, 70 bp, Homo sapiens
gctggtgtggaagacctcataattcacatgccatttggtagaatgctaaggagagttttgccacagcagt

SEQ ID NO: 6827804 - DNA, 79 bp, Homo sapiens
taaccctctaagctctgaagtagattcgttgcatcttgtttggataaatgacaacacctgcttttgacttggagtatta

SEQ ID NO: 6827805 - DNA, 68 bp, Homo sapiens
caggatgccatgccccaatccaggccaccttgcacaggcctcggtgggtcttgtggggcagcttcttg

SEQ ID NO: 6827806 - DNA, 62 bp, Homo sapiens
ctgttattgctatacatgtacactgacactgaacagtgaagtaaatggatggcagatggtgg

SEQ ID NO: 6827807 - DNA, 76 bp, Homo sapiens
tctactgtgttattcctgtgcaaaattacttcatattacaaagtggagcagtgtttaatcagaggaattatagaga

SEQ ID NO: 6827808 - DNA, 59 bp, Homo sapiens
cccagcccttccttctgtttatacatggtgcaaatgactaatgtaagggagaggcaggg

SEQ ID NO: 6827809 - DNA, 58 bp, Homo sapiens
acaaagagggaccagtgacttgacatatataactgtcactcgatggcacttctgttgt

SEQ ID NO: 6827810 - DNA, 66 bp, Homo sapiens
atctctgatgatgactttgtgaaaatgctcctaccacctggaaggataaacagagcacatcaagat

SEQ ID NO: 6827811 - DNA, 70 bp, Homo sapiens
gcacagccttgggttctctgggggggcccaggaaaccaccactctccccggagatccctggttccactgc

SEQ ID NO: 6827812 - DNA, 89 bp, Homo sapiens
taatgctagatccacatgcaatagtaattctagtctgtggttttatggacatttaaattattgttttgtctagatgggttcagtcatta

SEQ ID NO: 6827813 - DNA, 71 bp, Homo sapiens
aagcttgctaatcagaagttacattagggtgagattaaacatcactctaataataacttctgatgtaactt

SEQ ID NO: 6827814 - DNA, 57 bp, Homo sapiens
gcagtgttttacagaccagcatttctagagaaatatgggagttgttggaaatgctgt

SEQ ID NO: 6827815 - DNA, 111 bp, Homo sapiens
gaagcaaaactttgatgtgattttaatagcatgtaagtttaaaagacctggaggtaaaggttttagacttttcttgtctggaaagaaagtgacatcgacttgtttgcattc

SEQ ID NO: 6827816 - DNA, 80 bp, Homo sapiens
caaaggagtaactaacagtcattaaaagaactccttttgaggtgtgaattaaactgttgagtttttcttaaacttctgtg

SEQ ID NO: 6827817 - DNA, 82 bp, Homo sapiens
ccacattcaaaaagcatctgtcaccagtagccatggcaacagccatccctgaacaaatgtggagagatgtttttggaatagg

SEQ ID NO: 6827818 - DNA, 61 bp, Homo sapiens
ctcctgcttggtgaatctcttatagcacattgatgcgtctatatctgggaaccaaaggggg

SEQ ID NO: 6827819 - DNA, 63 bp, Homo sapiens
tcaccagacagtagcccagcagttgtctcttattagaagagctcagggcgatctgtctcggga

SEQ ID NO: 6827820 - DNA, 80 bp, Homo sapiens
agagactttgtataggtgccagcaactccgcagacactaacaaatgggttatttgcagttattgttcatgaaaggtcttt

SEQ ID NO: 6827821 - DNA, 91 bp, Homo sapiens
ggatcccaggatgttaggtctcagaaggatctagcaaatacagaaccagtggggcagggtccctcgttctgggatctgattcatggggtct

SEQ ID NO: 6827822 - DNA, 120 bp, Homo sapiens
cctggggcccttcatgccaggccccgcggctgtgtccgcaagcgcagatggtctcgggactcgggccaccctgacgccgcagacccagcacgctgcggaccgggcacgttggatctcggg

SEQ ID NO: 6827823 - DNA, 76 bp, Homo sapiens
ggaaagtattgtcctggtataattgtttaaaaatgaaaagcaatttaaaacagcatatgcaaggcagatatttacc

SEQ ID NO: 6827824 - DNA, 61 bp, Homo sapiens
gcctccttcagagctgctgccggaaaaggtgattgtttccactgcagcttctgatggaagc

SEQ ID NO: 6827825 - DNA, 67 bp, Homo sapiens
tagcaaagggaaagaagggcctggagggcattgtgtgccgaaggaggccagtttttcctgcttgctg

SEQ ID NO: 6827826 - DNA, 60 bp, Homo sapiens
tcagctttctctcgccatcaggtggatctcttgatatgacttgctggtgggtgagggtga

SEQ ID NO: 6827827 - DNA, 79 bp, Homo sapiens
cctgagcttcagcactgctgctgtacacacatgatctgttttttactgttttttggctctcagcagtgactggtgctgg

SEQ ID NO: 6827828 - DNA, 63 bp, Homo sapiens
cactcctgggaggaacatttacctatatccatatgtatgcatacctgtagcctctcagttgtg

SEQ ID NO: 6827829 - DNA, 55 bp, Homo sapiens
attgcaggatacccaggtagagaacactgatctctctgcatttctgggtggcaat

SEQ ID NO: 6827830 - DNA, 56 bp, Homo sapiens
agcacaatataaagtgaacgcacatttctcaatgtgcgttcactttttattgtgct

SEQ ID NO: 6827831 - DNA, 77 bp, Homo sapiens
ttgttgatacctcagagagcagctgagatggagacgcaagaagtcttcagctcaacgcacttctgaggtagtaacag

SEQ ID NO: 6827832 - DNA, 60 bp, Homo sapiens
gttgagactcctggtgtagaataattaaatagattgctctagctcataggactcatcaac

SEQ ID NO: 6827833 - DNA, 57 bp, Homo sapiens
cttcatgatgaccaactgccatgattccacatcattgtttggtagtacatcatgaag

SEQ ID NO: 6827834 - DNA, 124 bp, Homo sapiens
ggcctgggacctaggttcaaatcctggcatcaccacctacatctgtgtggcctccatagggtactttggtaataataaatattcaatgaggtcatataagctagtgttggcagaggcccagccc

SEQ ID NO: 6827835 - DNA, 72 bp, Homo sapiens
agtgtagcctcgctatgcttttgctctgtgtaaagaatcatacacagagaattcccatatgtgatatacact

SEQ ID NO: 6827836 - DNA, 102 bp, Homo sapiens
aatccagaagcagtcacagcaaggtctgtcaatagtggtatctaggtcaatgtccactgttcttgtggcatgagcttagctgtgtttttctgcttctagatt

SEQ ID NO: 6827837 - DNA, 78 bp, Homo sapiens
atgcttggaaccaaaagtattttggatctcagattttctcagatttgggaatgtgcattatacttacaggttaagcat

SEQ ID NO: 6827838 - DNA, 77 bp, Homo sapiens
taggttggtgcaaaagtaattgtggtttctgtcactaaaagtaatgacaaaactgcaattacttttgcaccaaccta

SEQ ID NO: 6827839 - DNA, 63 bp, Homo sapiens
gaggcagaaggcggctcctctggcgcctcttcttagggttcctgatcgttgtctctctacctc

SEQ ID NO: 6827840 - DNA, 67 bp, Homo sapiens
gttctgcctttgattgtttaaatgtggggcctggaaactcagaatttgttcacaatcagggcagggc

SEQ ID NO: 6827841 - DNA, 58 bp, Homo sapiens
gcccaggccggagagcagtgctgccatctcggctcactgcagcctccactttctgggc

SEQ ID NO: 6827842 - DNA, 75 bp, Homo sapiens
gtgttacggacaggaagctgagctgcactgcagaactagaaggctctcattgtgggcatcttcctgctataccac

SEQ ID NO: 6827843 - DNA, 61 bp, Homo sapiens
caggaatgctgtgggtattaaaaatgaatttagatgagttcagaaaactcaagtatctctg

SEQ ID NO: 6827844 - DNA, 64 bp, Homo sapiens
ttgattgagttcttgtctgccggtcactgttctaggcactggggattagggactcagtgatcaa

SEQ ID NO: 6827845 - DNA, 76 bp, Homo sapiens
atccttggctttaagaagactgacagctcagctcaaactccagttggcgttagagaagctttttagttagcagggt

SEQ ID NO: 6827846 - DNA, 81 bp, Homo sapiens
ggccagtgcggggtctgcggctgcccggcgaggttccggcttccccgggactggcagggggagccccgagaactgcaggcc

SEQ ID NO: 6827847 - DNA, 70 bp, Homo sapiens
ataaaatactgtatgcctgttaatgctagctagatagtaggcagttatcaaatagtgctatatattttgt

SEQ ID NO: 6827848 - DNA, 94 bp, Homo sapiens
aaaatatagacagagttccttcctccctttcataccccaaccctaactctaactaatagctgggatagggaggaaggaactccttctatatttt

SEQ ID NO: 6827849 - DNA, 66 bp, Homo sapiens
aagtaaaaagttcagattagactcaagagctctggtttgctcttgattcttctgtcacttctgctt

SEQ ID NO: 6827850 - DNA, 82 bp, Homo sapiens
gcggccctgctgctcccccaagtatggctcaccaaagctccagaggcggtctgtgtccaagctggacagcagcaaggaccgc

SEQ ID NO: 6827851 - DNA, 68 bp, Homo sapiens
attctaagagctgttcaggtacccatctgggtgagcagatgatttaaaactgaattagctttttgaat

SEQ ID NO: 6827852 - DNA, 58 bp, Homo sapiens
acccactccccacgtgctgtcagaactcatcacagagttggactgggaagtggtgggt

SEQ ID NO: 6827853 - DNA, 72 bp, Homo sapiens
acaagtgcttagcagaagcttcagcttcagatgagagtctgaacaaaaaatggtgcttctcctgtgcagtgt

SEQ ID NO: 6827854 - DNA, 65 bp, Homo sapiens
gtgagtgtgaagaggggtgtgtgtcaacccaaggctattcttagttgatcccttctcataagaac

SEQ ID NO: 6827855 - DNA, 82 bp, Homo sapiens
cgctgtgtcttctgtaagatgaggtcccctccattaccctgggccagggatctcaaaacggaaggccgccaaccagtcagcg

SEQ ID NO: 6827856 - DNA, 58 bp, Homo sapiens
acatttctttgctagacagcagaagaatctgcaagatgtttatctggcacactgatgt

SEQ ID NO: 6827857 - DNA, 106 bp, Homo sapiens
gctgtgtaggtggttttagagattctgatggcttacagacagttaggatgccaagatccaaactcaagttacaggccagataggttctgcaagacttctgcacagt

SEQ ID NO: 6827858 - DNA, 87 bp, Homo sapiens
tatgttggaagtgtctatcagtttgagtgctgtgtcaaagaactcacactggcttttcaacagctctcaaatgatcactcttttata

SEQ ID NO: 6827859 - DNA, 94 bp, Homo sapiens
acatggagacagggacttggcccacctgcctgctggtggtcacctgtcttgctggtgctcagaaggagggggcaagccctggagctttccctgt

SEQ ID NO: 6827860 - DNA, 65 bp, Homo sapiens
agggcccctggagaaaagaaccatgaggaagcatgctctcagaattctccacgctcagggtccct

SEQ ID NO: 6827861 - DNA, 86 bp, Homo sapiens
ggagtctcactgtctcccaggctggagtgcagtggcacgatctcggctcactgcaacctccgcctaccggattcaagtgactctcc

SEQ ID NO: 6827862 - DNA, 57 bp, Homo sapiens
gtatttcctggaatgactagtgggtgggataagcctaaaaggatttccaagaaatac

SEQ ID NO: 6827863 - DNA, 66 bp, Homo sapiens
ggagtctgatgttttcctggtgacttcatatcactgtatgacacataccgaaaatatttgggctcc

SEQ ID NO: 6827864 - DNA, 80 bp, Homo sapiens
tctctcctgcattcaggctgactcagggtcatgagtatctctcaggaacatggcagtgattcagcctttgtcggtgggga

SEQ ID NO: 6827865 - DNA, 62 bp, Homo sapiens
gacgtatcaaggccggacaagatggttcccgatcgtcagaattcctgtccgcgccttgcgtc

SEQ ID NO: 6827866 - DNA, 64 bp, Homo sapiens
atgttgcctccttttaaggaaatcatttttttctaatgaaatgatctctcttgggaggcaatat

SEQ ID NO: 6827867 - DNA, 85 bp, Homo sapiens
gttagcatgcatcagaaccagtggggacatttgtaaaaatgcagactgctactttccaccactagagtttctgattcatgaagac

SEQ ID NO: 6827868 - DNA, 95 bp, Homo sapiens
gtgtggtgagagaaatgaacggcgtacagctgtaactgataatgacagtcctcagaaatagctctaagctccttttcaaactcttttaccactac

SEQ ID NO: 6827869 - DNA, 83 bp, Homo sapiens
gttcttaatggcttatatattttcacttgccttggccacattctctggcattggtacatgatgtatgtaatgtctgtaagaat

SEQ ID NO: 6827870 - DNA, 62 bp, Homo sapiens
aggcagattacttgaggccaggagttcaagaccagcctggccaatatagggaaatcttgtct

SEQ ID NO: 6827871 - DNA, 58 bp, Homo sapiens
cagcccagtgcacgcccgtttccacgactttatgttggaatgagtgtgcatggggttg

SEQ ID NO: 6827872 - DNA, 71 bp, Homo sapiens
ggctcctgactgggcccaagtgcaatgcagtgatctattttctgtaaattattggtgcccaggtcatagcc

SEQ ID NO: 6827873 - DNA, 77 bp, Homo sapiens
gaatgtctacattctgaattcgtatccacaaaattttaagaaaattgaggaacaaaatgaaaagaatggagatattc

SEQ ID NO: 6827874 - DNA, 83 bp, Homo sapiens
ggtagtaaaatgggaatatgaatctagaaaatgatgctttaagagccttaaatgctagattcataccattgtattagggaacc

SEQ ID NO: 6827875 - DNA, 84 bp, Homo sapiens
tatgtttgagaagcacttggttttggaaagttaatagattcattgcggcagaacttcacagagcttttggtgtgttgatgcata

SEQ ID NO: 6827876 - DNA, 67 bp, Homo sapiens
aggcaagcaccgggggccttttcaggagggtgtgtctacctgtcatgaggctgtctgctgctggcct

SEQ ID NO: 6827877 - DNA, 94 bp, Homo sapiens
tatttgatggatgttggaactatactcatttgccagctagcataaccatatgctagctactgatgcaagagtttggccaagatcaactaaagta

SEQ ID NO: 6827878 - DNA, 71 bp, Homo sapiens
caccttacaaccccagaggtgccgttgacactgtggtctgtgccaacagcactgcctggagttgtgctgtg

SEQ ID NO: 6827879 - DNA, 109 bp, Homo sapiens
gtgtactaaagatcttagagatcttttgtgtggtaactctttgccctttcagctgatgaataactgaagatgtgcaatacaaagaaattactaaaagagaactgtgcac

SEQ ID NO: 6827880 - DNA, 67 bp, Homo sapiens
ttgtggagtggtggttctcagtctgtgtgatgtcgacatccagggctccccagaagtacccccatga

SEQ ID NO: 6827881 - DNA, 130 bp, Homo sapiens
gtggctttttgcatagtagacaattttgaggcatctgcagagttccacaaagccctatacacataacatcaaagcgttgggaagatttcccgtagctgtgcctcatgtaatctcaattgctttttgccat

SEQ ID NO: 6827882 - DNA, 86 bp, Homo sapiens
tgggtcgggtgtgggttctgcagaccaggtgcggattctgtgtaggttctgcaggcccagtgtagaggctcacacctgtaatccca

SEQ ID NO: 6827883 - DNA, 94 bp, Homo sapiens
acagcagggtgtggccgatgtgagctggcaggagaccataccctactgagaagatggtggtttgacctcccgctagggctcatcaccctgatgt

SEQ ID NO: 6827884 - DNA, 126 bp, Homo sapiens
aaggaatttaatatgagttgctggttcaaatcttgggccaatattctgggtagacaaaattattattcattactcagaggactttggaccaaagtttgatgcaatattggctgtgttagatttctt

SEQ ID NO: 6827885 - DNA, 92 bp, Homo sapiens
taaataatgttagtatgatttttcagtataaaatatatgagtttattataactgatgggtttccctctgaaattatagtgcaacattggtta

SEQ ID NO: 6827886 - DNA, 55 bp, Homo sapiens
tttatgttgaagagactgtgttactgaaaagttaaaacactgctcataacatgaa

SEQ ID NO: 6827887 - DNA, 95 bp, Homo sapiens
gtacttaggccctgattctggtagggcatagagatgttggcatttattcaagatgacttctgattgcttctatttaattcaggaagtttgggtgc

SEQ ID NO: 6827888 - DNA, 65 bp, Homo sapiens
ttgcagctctgatccagggaccatgggaaccacatgagaggcatatgaacctgggtacattgcag

SEQ ID NO: 6827889 - DNA, 74 bp, Homo sapiens
tcccctcacaccaaatttccccaagctgtccaaaccgaagtttgtacaatgctgcagggaaattaggatgggga

SEQ ID NO: 6827890 - DNA, 83 bp, Homo sapiens
gcaggctatgagtgtctttatgagcagcttgatttatttgtatcagattatataagctgtcaggaggttaccttttggtctgt

SEQ ID NO: 6827891 - DNA, 72 bp, Homo sapiens
ttttcagttgtgctctctagttagtttttttgggagtaaggacaaacctggaatagatagcaaaactgaaaa

SEQ ID NO: 6827892 - DNA, 100 bp, Homo sapiens
tggggtgaatgccaatggaatattatgatcgtgactcaaggattagtttccacagtggagtctgattcatagcctacatattccactaactggtaccgta

SEQ ID NO: 6827893 - DNA, 95 bp, Homo sapiens
gggtgacgattgtttaaccaccaccaaaatgggttctgagtccaactattaatatgaagatgacatccattgtggtcttgtacattttgttgcct

SEQ ID NO: 6827894 - DNA, 60 bp, Homo sapiens
tggatgctatggagtatttagatggaaagttcctcaaatgttatgaatttccagcatcca

SEQ ID NO: 6827895 - DNA, 60 bp, Homo sapiens
attgggaaactgaagcttgggccaagtggaggaacatggctccctcctagctttcccaat

SEQ ID NO: 6827896 - DNA, 56 bp, Homo sapiens
agaatgggagttggggaggggtttatattttttgtccttcttcagtagtttgttct

SEQ ID NO: 6827897 - DNA, 80 bp, Homo sapiens
cctcctttcagacaggtgacttgcattttcacactctctgagctgagtgtatatgcagcttatagtaattgggaaagagg

SEQ ID NO: 6827898 - DNA, 60 bp, Homo sapiens
gtttgatctccttgtgagtcaggcggtctgattaatcgtggcctgtggaggaggacggac

SEQ ID NO: 6827899 - DNA, 119 bp, Homo sapiens
gctgggtgtggtggtgcatgcttgtaatcccagatacttggaaagctgaggcaggagactcgcttgaacccaggggttggaggttgcagtgagcccagatcgcaccattgcactccagc

SEQ ID NO: 6827900 - DNA, 130 bp, Homo sapiens
gaggaacatttggaagaaattccatagaatcagtgctgttagtacaagtagaatgctacaagattgcaaaattagtagtaggtctgctgtgatacaaatagattggtagctgggtgcttccccatgcctt

SEQ ID NO: 6827901 - DNA, 71 bp, Homo sapiens
ggtcacggaagctctgggctttgtacttggccaggtgcctggacctcccgcgacgctcgggctccgatgcc

SEQ ID NO: 6827902 - DNA, 71 bp, Homo sapiens
gggccgtcacccttgtctagagccagcttatctgatgccaggtcagaaggcctcggcaggaaatgctgcct

SEQ ID NO: 6827903 - DNA, 129 bp, Homo sapiens
tgaatttcccagttcaagttctatattttctcaattccagaggaaagaaaatgactactacatgtgtgtgattttgtccctgggagcatctatgaaatatgcagcattctctttctagctgggaaatca

SEQ ID NO: 6827904 - DNA, 65 bp, Homo sapiens
ccagaagaacttaattcaaaactaatttattcctcaggtcaaaagttttggggtggttggtctgg

SEQ ID NO: 6827905 - DNA, 91 bp, Homo sapiens
tgaaagtatctataggactctatttcctcatctatgtaatggggttagtaagactcagttgctatgagaaataaatgaggtgatgccttca

SEQ ID NO: 6827906 - DNA, 62 bp, Homo sapiens
ggttgatggcaagaggcctttaggcacatacctaacaaggcctttaggctttcattgttacc

SEQ ID NO: 6827907 - DNA, 59 bp, Homo sapiens
cctgtctagaagggtgccgatcttagtcctggatcaggatcggcctttttttaagcagg

SEQ ID NO: 6827908 - DNA, 55 bp, Homo sapiens
gggcaggctgagcatgtcacctgcagcaggtgcagctgcagctcaagcctagccc

SEQ ID NO: 6827909 - DNA, 73 bp, Homo sapiens
gggccgactctgtggccagcaagtgctgcctctcccagggatctggctgatgggcagagctggtgggaggccc

SEQ ID NO: 6827910 - DNA, 76 bp, Homo sapiens
gattctcacagaagcacgaagcctattgtgaactgcgcatgcgaaggacctaggctgtgtgctccttatgagaatc

SEQ ID NO: 6827911 - DNA, 58 bp, Homo sapiens
cagttaaacagattgagtgttacagggcccagaacctataaatgcatctgttcaactg

SEQ ID NO: 6827912 - DNA, 79 bp, Homo sapiens
aggatatgtgaatacagcatgtgcttcttcgcatgtgcgtgctcatacaagtagatgcacatgcttattcacgtgtttt

SEQ ID NO: 6827913 - DNA, 83 bp, Homo sapiens
tagtacttaaacctctactgtaatagatgaatttgatgcctgagatgagagtcaattgtttacagtcatggagtgggtgacta

SEQ ID NO: 6827914 - DNA, 70 bp, Homo sapiens
cagactctcatgctcttctcttatgactatggaaggcactcatgtctgagtagagtgtgattttcttctg

SEQ ID NO: 6827915 - DNA, 83 bp, Homo sapiens
acctactatgtggcaggcattgtgacgagtgttctacaggggtgaagatgtgaaacagtcacagtcctgtcttcatagtatgt

SEQ ID NO: 6827916 - DNA, 59 bp, Homo sapiens
tcacaatactcactcaatggcttcccttcctggcagtgtggttttgtgtgtgtgtgtga

SEQ ID NO: 6827917 - DNA, 64 bp, Homo sapiens
tacatgagataataaatagctttcttatttaaggcaacttgaagcaaggattattgttcatgtg

SEQ ID NO: 6827918 - DNA, 86 bp, Homo sapiens
ctccattggctaccacagtgggccacaagaagttcagggttgataacaagaagcagggaccttggcccatgtagtagcagatgtag

SEQ ID NO: 6827919 - DNA, 64 bp, Homo sapiens
tccatgtggctttcatgattaagcagccactctggcctgtttagtatttaaggttttagcagga

SEQ ID NO: 6827920 - DNA, 59 bp, Homo sapiens
tgtacaagttgcctgctatctcaaaatccaaatttctgtaagaggcagcaacatgtata

SEQ ID NO: 6827921 - DNA, 76 bp, Homo sapiens
tcgcttgaagccgggaggcgaaggttgcagtgagccgagatcgcgccactgcactccagcctcggtgacagagtga

SEQ ID NO: 6827922 - DNA, 80 bp, Homo sapiens
attttaatgtcttagatttcaccgataatgaggaaattgtcctcgttttcatgggtagaggttcttaaaggttttaaaat

SEQ ID NO: 6827923 - DNA, 117 bp, Homo sapiens
agccctgcttagagggccagctgactgctctcccgtcctgcctgtctgccctggtagttgcccttcaagctgggtagtagctgtagatatcaggaggtgctgctgttctccagggct

SEQ ID NO: 6827924 - DNA, 94 bp, Homo sapiens
ttcacctctagccttttctgtaagaggactttaattgacttaagccaattggtatattccctctctgcagagatatttttggcccagagatgaa

SEQ ID NO: 6827925 - DNA, 55 bp, Homo sapiens
gaggccacttcctactggaggagaccctggaagtctccctggaggtggtggcgtc

SEQ ID NO: 6827926 - DNA, 80 bp, Homo sapiens
gatgcaggccggttggagtggacgtcattgccgggaacgagcgagtcgccgctgcagccctagtgactgcggcctgcatc

SEQ ID NO: 6827927 - DNA, 99 bp, Homo sapiens
cagggaatgggcatcggggctggaagaggacacacgaatcacctttctgatttctgcctttgctttttcctgagccttggttgctgctgcccagccctg

SEQ ID NO: 6827928 - DNA, 72 bp, Homo sapiens
gttttatgaaggcctctggtacatgccaggaaactcacaggagatggtgctgcctcagatgccttagaagac

SEQ ID NO: 6827929 - DNA, 77 bp, Homo sapiens
catcctgaacagatccatctctcagaaagagactcatattttctgagctcatgagactgatgtattaaattaggatg

SEQ ID NO: 6827930 - DNA, 65 bp, Homo sapiens
gacacagtgggtcataggtacaattttgctcctttcactccgggagtcttaggcacagctgtgtc

SEQ ID NO: 6827931 - DNA, 82 bp, Homo sapiens
gatgcagaattatttttgcaatatgttcctgaatatgtaatataagtgtattgggatcattttgcatccatagttttgtatc

SEQ ID NO: 6827932 - DNA, 112 bp, Homo sapiens
tctaggtttctctgggatgtacatgtgcacgtgtgactttgtgcctgtgcctgagtgtcatctgagtgcatatttctcttgcatcctgtgttgagtttaagcgggacctaga

SEQ ID NO: 6827933 - DNA, 56 bp, Homo sapiens
ggctgccttcagactccagcttcagcctcatctcttccctgggtctccaggctgcc

SEQ ID NO: 6827934 - DNA, 62 bp, Homo sapiens
ttacttgcctggactctgctggtatttcagcttgagatcccagaccagagccatgcaggtag

SEQ ID NO: 6827935 - DNA, 71 bp, Homo sapiens
ggtcctgccctctctctctggctgccagctgctacatccagctgtgcacagattcagaggttttgctgacc

SEQ ID NO: 6827936 - DNA, 77 bp, Homo sapiens
gtggtggggggcttcctgaggctaaagtgcagtggtgcaatcacagctcattgcagcttcaggtgttcacccactac

SEQ ID NO: 6827937 - DNA, 85 bp, Homo sapiens
tcttagagaccacttgcatacacttcaaatgagcatggttttgttctgttttatgtttgtttgtttgtttgcttgctttttaagg

SEQ ID NO: 6827938 - DNA, 91 bp, Homo sapiens
aagtgtttttattcgtggactctctcccaggcctcagaatatggagtaatttcctgtgttaaagggggtgctaggacagagtgtagcactt

SEQ ID NO: 6827939 - DNA, 55 bp, Homo sapiens
tccaacatttgagcatctactaagtgtaaagatatactaaatgccagatgtaggg

SEQ ID NO: 6827940 - DNA, 83 bp, Homo sapiens
gggtggactccagctcctagtgcacacctgtccacaaaacctccaggtcttgggtaggctgtgtgtgggaggtttctccaccc

SEQ ID NO: 6827941 - DNA, 68 bp, Homo sapiens
atttcaggcttagactacctggtctgtaatttaggatattaatgacctaggtggtttgagctctaggt

SEQ ID NO: 6827942 - DNA, 75 bp, Homo sapiens
gcaaatgttacatggagtgggatgagtcacaggaaaaccatgaaacacagttctcttcttgtaacttaactttgc

SEQ ID NO: 6827943 - DNA, 70 bp, Homo sapiens
atacactacagttcttaattaagtagtaacatagtagatacttgattatttgacttgagaacaggtgtat

SEQ ID NO: 6827944 - DNA, 107 bp, Homo sapiens
tgtggactccctgctgggatggcatcctgggccttgcaaagagaaatctaataaaattggtgtcaggggctccctgggtgccagttcccctgctgcctgaccccaca

SEQ ID NO: 6827945 - DNA, 55 bp, Homo sapiens
cctgcccggcggggacccggacgacggcgacgtgcccctggccctgctgcgcggg

SEQ ID NO: 6827946 - DNA, 67 bp, Homo sapiens
gttgggtccttcagggctgcatacaggagatatggaagcctgtcttttgcaagtagctggaccgaac

SEQ ID NO: 6827947 - DNA, 69 bp, Homo sapiens
gagcctataggggtttggaaagcagattttatgaaatttaggatgagatatatttcctgcccaaggctc

SEQ ID NO: 6827948 - DNA, 77 bp, Homo sapiens
gtaaattttcagagcactagagaagaatgagtctctccagctcatactgcctccttttcttctgtctttgtgtttgc

SEQ ID NO: 6827949 - DNA, 76 bp, Homo sapiens
gcaggactgctccactagtaattcttgtgctggactcccctgtgtcctgcccaagactttcttagtgctgccctgc

SEQ ID NO: 6827950 - DNA, 71 bp, Homo sapiens
tgggggctgctaaagctgttcagtgcagaaaggaaatcttttcctctgaacagactttaaatatgtcccca

SEQ ID NO: 6827951 - DNA, 73 bp, Homo sapiens
ccttaaacaacttgtagtttattagagaagttatgtatgagttaaactctagtagatacaagaacgtaatagg

SEQ ID NO: 6827952 - DNA, 59 bp, Homo sapiens
aggaagagggtggcagataatcacaagcaagtgctggctgaatattttagcctcttcct

SEQ ID NO: 6827953 - DNA, 65 bp, Homo sapiens
ttggtggtgtaggatggcttggttgtaaccaagggaaagaaccaagttattctgacactcatcaa

SEQ ID NO: 6827954 - DNA, 65 bp, Homo sapiens
gtgggcttgttttgatgagatcaatgagaagcaaaatctttagatctcacaagaaataagagcat

SEQ ID NO: 6827955 - DNA, 57 bp, Homo sapiens
agggtgatagtttagagagtcagcctgttagattggctgatttctcttctattcctt

SEQ ID NO: 6827956 - DNA, 68 bp, Homo sapiens
acatatagattaatgcataaagggatacgtagatagatctatttgctctagctgcagtgaatatatgt

SEQ ID NO: 6827957 - DNA, 100 bp, Homo sapiens
gtactcgggtgtggtgtcttagctgtattcctgcactgtatagaggttttgagggtgacttcttaatttgtgcagtgtctgagatgccgtgtctgggtgc

SEQ ID NO: 6827958 - DNA, 58 bp, Homo sapiens
cggaagggtttaagcaggagagtgctatgaggcagtctattttggaaagatccctctg

SEQ ID NO: 6827959 - DNA, 56 bp, Homo sapiens
cttggggtaatttcatgccgatgatcacaggatcatgacaactatattattccaag

SEQ ID NO: 6827960 - DNA, 78 bp, Homo sapiens
ggggagagtggaggccgaggggcccaggttcctggtaggggcttggcgggagatggggccgttcagagttattcccct

SEQ ID NO: 6827961 - DNA, 70 bp, Homo sapiens
gcaggctggcaggaggaggtgctgtaatgatggcagtaggttactgcagccaccacctctgctgaactgt

SEQ ID NO: 6827962 - DNA, 75 bp, Homo sapiens
atcttacaatagcagattggttaagcacattatggttctattcataatttatttaagcatctggtactgttggat

SEQ ID NO: 6827963 - DNA, 80 bp, Homo sapiens
tacaatactgggcaggagagtacaaatagacaatggataaatagaatcccaaatgtattcttccctgttcccattatgta

SEQ ID NO: 6827964 - DNA, 57 bp, Homo sapiens
tcagcatcctcttgataactgcatacttctttttatgcttgtcttcaggaatgctga

SEQ ID NO: 6827965 - DNA, 83 bp, Homo sapiens
cactgatggcaattgtaattttgtaaagatttatgagttgtaattttgtaaagatttatgaagttcaattagagccatcactg

SEQ ID NO: 6827966 - DNA, 78 bp, Homo sapiens
tttgtcagaaggaagaagcatgtggtgatggcactgggtaattggcgatgtcatttatgcttcttcagtgcttacaaa

SEQ ID NO: 6827967 - DNA, 68 bp, Homo sapiens
gcttctggcaggttatgcgggccacatcttccagaaaatgtgttccctatttcttgtcctcagatagc

SEQ ID NO: 6827968 - DNA, 70 bp, Homo sapiens
ctgggcctttttctttaaaggaactctgtttaccattcattagatagtccatttggagaaatatgtgcag

SEQ ID NO: 6827969 - DNA, 57 bp, Homo sapiens
accattcacctgcacatctctgtcacattcagagaggaggcctgtcaggtgaatggt

SEQ ID NO: 6827970 - DNA, 80 bp, Homo sapiens
ggagccttcgagaaggcagtaaatggctgtttttattgacaaaaggaaaacattttactgccatctcactgatggcatct

SEQ ID NO: 6827971 - DNA, 89 bp, Homo sapiens
gctggggtctaggaaatgtccctacagctatgtatgctgggctaccatatccattttctctctgtggggtcaaaatccagtgcctcagc

SEQ ID NO: 6827972 - DNA, 66 bp, Homo sapiens
gcatctgcaattgtttggaaaactgagcacatttgcttgtttgttcaatccagacaatagctgtgt

SEQ ID NO: 6827973 - DNA, 73 bp, Homo sapiens
tacctagtcttcacatcagtctaaagagttggtgttactatctccattctttaggaagatggagggccacgta

SEQ ID NO: 6827974 - DNA, 61 bp, Homo sapiens
tgcctctaggagaaagcataacattttagataatccatttaaaatgcttctgatagaagca

SEQ ID NO: 6827975 - DNA, 63 bp, Homo sapiens
tcttaggcctgaggcaggacagagaggagcagggttccttgacactgtcactcaggccagaga

SEQ ID NO: 6827976 - DNA, 56 bp, Homo sapiens
tttcattctttgaatctgaggtagtcatatgattgactttggccagttgaatgaaa

SEQ ID NO: 6827977 - DNA, 115 bp, Homo sapiens
ttcagattagtaatacataatttttttaagtataagtatgtcccaaatattgcatgtaaaatatcccatgtaatactgggaaatacttgggtaaaaaattacttgtttatctgaa

SEQ ID NO: 6827978 - DNA, 86 bp, Homo sapiens
gatgacaatcgcagtgataatgatactctaggtgatttacagtttagtttcatattatctgctacaaatacgctgggagtgtcatc

SEQ ID NO: 6827979 - DNA, 68 bp, Homo sapiens
tctttgcttccccttatattttctggtcttgctaaaatgatgatccaggaaatgttcttgaagcctga

SEQ ID NO: 6827980 - DNA, 60 bp, Homo sapiens
gaacactgctgttgggttctgagtgtttgtccctcacataggattccagcacactgcttc

SEQ ID NO: 6827981 - DNA, 96 bp, Homo sapiens
ttagtagcatcttggaatgtcatttgtagtgaataattcatatattcatgttatgcaggattatctactaccataaacaaaatgcagatgttctaa

SEQ ID NO: 6827982 - DNA, 70 bp, Homo sapiens
acatagcactggaaacctccttttttcaagaaatgacactattagaaaggctgggatttagcgctggtgt

SEQ ID NO: 6827983 - DNA, 100 bp, Homo sapiens
gaagaataaaatgagtgtatagggtggtaatctctgaaggctccaggagagatttcatttccttggccttgtcagcttccagaggccacttagattcttt

SEQ ID NO: 6827984 - DNA, 69 bp, Homo sapiens
ttgtaagagttggaatttattttgggaggctttataacccttacaagctaattgtttcagctaatacag

SEQ ID NO: 6827985 - DNA, 80 bp, Homo sapiens
gattaatctctctagggcatttgctcttaataaccatgaatcgttgtttcataagcttgaagccttggcgagattccatc

SEQ ID NO: 6827986 - DNA, 73 bp, Homo sapiens
ttcaggaccctctgtaatataattctgggcaaattttggaaaggccagaggatttactagcaaggattctgaa

SEQ ID NO: 6827987 - DNA, 57 bp, Homo sapiens
tatctcatcatgtttagatcctcagtcttgattctgagcatttatgctaatgggata

SEQ ID NO: 6827988 - DNA, 61 bp, Homo sapiens
ccaggggctacttgttatggaaaagttatgattggtgtagaactgtacaggttgcttctgg

SEQ ID NO: 6827989 - DNA, 81 bp, Homo sapiens
ttccaactgttattctcaataattcgtgtttctttggtacaaagagtactgtaaaatgcagttggtggggatatgctggag

SEQ ID NO: 6827990 - DNA, 62 bp, Homo sapiens
tattccaactgtcatagtcataacaaggccttcctaaaagtttaggctatgcatttggggta

SEQ ID NO: 6827991 - DNA, 69 bp, Homo sapiens
tcttgttaaaggttaaaggtgaaagtgaattttaatgactgtagttttgatttgaaacctttggcaaga

SEQ ID NO: 6827992 - DNA, 70 bp, Homo sapiens
aaggaaagcattgaaagcttgaatcctgttaacttgaaaagttgagttctggtcttttaaaagcttcctt

SEQ ID NO: 6827993 - DNA, 70 bp, Homo sapiens
ttgtgatttatctatgataaacggatggtgaagtgaatttcctcatttgattactaaagataattcagaa

SEQ ID NO: 6827994 - DNA, 68 bp, Homo sapiens
ctgagtcactgctttctaagacaacactctgattttccttggagtgtgtccattcaggcactgaccag

SEQ ID NO: 6827995 - DNA, 55 bp, Homo sapiens
gtttcattagctgtgcaacagttagggcctttatgtttactccagctgatggaac

SEQ ID NO: 6827996 - DNA, 129 bp, Homo sapiens
aggactgttgctcctagaaaatatcactaatctctttatgagaagaaggttagattgggttaccttctttctttgtttttcctctggttaaagagattaaatagacataaggcaactgattaataacct

SEQ ID NO: 6827997 - DNA, 81 bp, Homo sapiens
gccacttgttcctccaatgtcctagagtacattccactgctatcagtgctggctgttaggacagtggttagggcagatggc

SEQ ID NO: 6827998 - DNA, 75 bp, Homo sapiens
attcattctttagttattagtttagaagatgcttcatcttggaagccttctctgatcttgctagactgagtgaat

SEQ ID NO: 6827999 - DNA, 99 bp, Homo sapiens
gaggcaggagaatcgcttgaacccaggaggcagaagttgcagtgagccaagatcgtgccactgcactccagcctgggcgacagagcgatactccgtctc

SEQ ID NO: 6828000 - DNA, 57 bp, Homo sapiens
gcacagttagcctatcctggttcaactcctgaatgaaggatttactattaactgtgt

SEQ ID NO: 6828001 - DNA, 129 bp, Homo sapiens
acaccagtgtcattagcgtaaggacacagaggcaggagcaaagttcacagaagattccaattccacccaggtatgaataggaaattatctgtggaatggtctgcttccccttagttacacatgtggttt

SEQ ID NO: 6828002 - DNA, 70 bp, Homo sapiens
ggggaggcatgcactgcccgagtttgaagtgtaacatgggatttctctgcaggggaggcatgcactgccc

SEQ ID NO: 6828003 - DNA, 73 bp, Homo sapiens
gtgcatgtatacttccttactgacccatttcctgcagcccatggaagatttcatcaaaggaagtacgtgtcac

SEQ ID NO: 6828004 - DNA, 96 bp, Homo sapiens
ccttatcctcaaatgacagacagaagggatttttacaggcaatgaaagctgagaaatttataactttttaatatcagtgtgtccttagggaagagg

SEQ ID NO: 6828005 - DNA, 106 bp, Homo sapiens
gctgagatgggcacgccagtcttgagcagtggcagacagtagactttcaagcatcattccaaagaattgtttccattgcagactgtgtctaaatccataaggcagc

SEQ ID NO: 6828006 - DNA, 55 bp, Homo sapiens
ctggccaaaaaatcacttttataggcagctgaggtagagttgtgtgatttgccag

SEQ ID NO: 6828007 - DNA, 63 bp, Homo sapiens
cccacttgaacaagagctcttccagtgttctgcagtattgagggagttctgcgtttaaagggg

SEQ ID NO: 6828008 - DNA, 63 bp, Homo sapiens
atcctctgaggctcagctttctcttctgtaaagtggcctgatgtgatgctgccctctgagggt

SEQ ID NO: 6828009 - DNA, 84 bp, Homo sapiens
tggcttatagatgctgggacgtacttgttcattagttcaaaccacgttaaaagtgagcagtttgttccagaatcaagtatgtca

SEQ ID NO: 6828010 - DNA, 63 bp, Homo sapiens
gagtgtgtgcatgatctcttatttgtttttcttagcatttagtctcttatcaggcacacactt

SEQ ID NO: 6828011 - DNA, 61 bp, Homo sapiens
gtcctgtgacaccaatatttaattttctcactgaggatatttcccattgtgtcagcagagc

SEQ ID NO: 6828012 - DNA, 67 bp, Homo sapiens
gatggccaaggtgttctgatatgccaggcacactcagcacgaggcacgacaaagacactttgccatt

SEQ ID NO: 6828013 - DNA, 93 bp, Homo sapiens
gggtaggtgctgggcaagcggcaacctttatcgccatcattgtgcaataaatgcgccccgatgcgtggtagagcgcccccacccgttccaccc

SEQ ID NO: 6828014 - DNA, 95 bp, Homo sapiens
gagattttgacatttaaatgagatgtgtgtaaagtgctacagtaggccccagcgcctgccatttctcacatatgtatgtgaagtgggcatgtctc

SEQ ID NO: 6828015 - DNA, 57 bp, Homo sapiens
tctgctgtaaagaatttctgcccagggtctgggctcccctgaggagtttccagcaga

SEQ ID NO: 6828016 - DNA, 79 bp, Homo sapiens
agaatttgaatggatataacaacagtgtagactgacttgggttgcgagcactgagcattgttatttccagcaagtctct

SEQ ID NO: 6828017 - DNA, 68 bp, Homo sapiens
ccaggtcccgccccgggctgaccacagcagaccccagctttgcaggttgcacaaggggcccgacctgg

SEQ ID NO: 6828018 - DNA, 97 bp, Homo sapiens
tgtttactgagtccatagtatgtgccacacctaatcctgtgtactgaagctacaagagttcaaaggaaaggcagtgtcaactattgtgcagtttaca

SEQ ID NO: 6828019 - DNA, 83 bp, Homo sapiens
tacagtaaaagttacttatgcagattctagaagtgggctacttgggtttgaatctgagttccaccatttaggatctgtctgta

SEQ ID NO: 6828020 - DNA, 68 bp, Homo sapiens
tattttgtcatctgtgttttgctggagtttgactcagttatatttcagaagtcacagttgactgtgta

SEQ ID NO: 6828021 - DNA, 59 bp, Homo sapiens
gtcaatatagatcaatgcacagtatacaatagaatgaattgtattgatctaatattggc

SEQ ID NO: 6828022 - DNA, 130 bp, Homo sapiens
tgggtagacagacaggaagagatcaacatagtgggtttggcatactgactcaaatgtaacttttgcagactggctcagtgtcatcacttaatataaaatgatcttctttattgttctccaaccctttgca

SEQ ID NO: 6828023 - DNA, 72 bp, Homo sapiens
gagagaagagaggaatagatatgactccagtaaggtcattaagagttatacctatttctaactggaattttc

SEQ ID NO: 6828024 - DNA, 119 bp, Homo sapiens
ctggctctttcctttttaaatccgtctatagtcttggcatgccagtagccggcttgactttcacagttaaggttatcagagagtcactgttctgtcatgtcaagtcagccaggagccag

SEQ ID NO: 6828025 - DNA, 105 bp, Homo sapiens
ttgtaaaggatgtttgatgagattgtgaaatatttaaaatgtggtcagtaaagtctgtttcatataactggatattttcaaaattatattttctattttttttaa

SEQ ID NO: 6828026 - DNA, 78 bp, Homo sapiens
gtttgaagttgcacactttcgttaataaggatgagagaagcagggatctttattattaataaagtggcatagccaggc

SEQ ID NO: 6828027 - DNA, 100 bp, Homo sapiens
gtttttactggaatatagaggtattgattgtaaattgcgtcttggtggtcaaaccacaaaggcatgatgtaatcaatgataaaactatatatagtactac

SEQ ID NO: 6828028 - DNA, 69 bp, Homo sapiens
tcattaatctctgggaagtgtttcattggcaacatgattgtgacaacatcttgtccttagattaaatga

SEQ ID NO: 6828029 - DNA, 66 bp, Homo sapiens
tgggagcacttatgggccaacggggagtgtggagagaaaccctggccagcctttggactgctccca

SEQ ID NO: 6828030 - DNA, 79 bp, Homo sapiens
gggaatctttgggatcctgatttactctagaatacaactttggctaaattgagaagtaggtgcagtgactcgaagaccc

SEQ ID NO: 6828031 - DNA, 56 bp, Homo sapiens
ctgatgcttgtagtgtaatcactgttggtgacagtgcagtcatacaatgcatgcag

SEQ ID NO: 6828032 - DNA, 78 bp, Homo sapiens
tgtgatggacagttattgaggtgcttagctgggggctccactctagtcttaatctgagcagccctcaaggaaatcata

SEQ ID NO: 6828033 - DNA, 73 bp, Homo sapiens
agaggtaagcagtggcaagtgctgggcccagaaccaacacttggttgtcagctgcttagtccaagtatcctct

SEQ ID NO: 6828034 - DNA, 78 bp, Homo sapiens
tccctgcttttatttgtagcttcccaaagcttttgctggtaataaaaggattgtaaagttgacaaatataagcaggga

SEQ ID NO: 6828035 - DNA, 66 bp, Homo sapiens
cctagaagaaactgtcggggatattttgttgtgccggaatgtggttcccgtctagttttaaaaagg

SEQ ID NO: 6828036 - DNA, 55 bp, Homo sapiens
gcacgagtgtctcacggagtcacctgcagtgacagggctcagagacacctgttgc

SEQ ID NO: 6828037 - DNA, 72 bp, Homo sapiens
caggagtgttgattgctcaggaatgaaatcatagggagtcgaagctgtcttcttgagctgagtcagttcctg

SEQ ID NO: 6828038 - DNA, 57 bp, Homo sapiens
tggctgaccatggaggcaacatctgtgatgttttgttgctgatctgtgaatcagcca

SEQ ID NO: 6828039 - DNA, 82 bp, Homo sapiens
aatttttttcagctttattttgctctgtctttaaattataaattgaggtattacactgtgacaagaaagagctggtgaaatt

SEQ ID NO: 6828040 - DNA, 57 bp, Homo sapiens
tccctgtggatttcagtttgtgtcctgtgtctgaggacagcggactgaatacagtga

SEQ ID NO: 6828041 - DNA, 62 bp, Homo sapiens
ttagtatctctgaacctccgtttcctggcctacaagctgggtatatggaggcagagagctga

SEQ ID NO: 6828042 - DNA, 68 bp, Homo sapiens
ctttgacctttgcttagcatctactggagatggtatcatgccctttagagcagggaaatctgtcagag

SEQ ID NO: 6828043 - DNA, 63 bp, Homo sapiens
ctttagccctgttcctagctaggagtttcagcaagactctggcttgaggaccaggtcaaaaag

SEQ ID NO: 6828044 - DNA, 89 bp, Homo sapiens
ggagaatcgcttgaaccagggaggcagaggttgcaatgagctgcgattgtgtcattgcactcctgcctgggcaacaagtgcgagactcc

SEQ ID NO: 6828045 - DNA, 55 bp, Homo sapiens
cctctctctcctgcacacacacatgcatgtgcacaaatgtggtaacagagacagg

SEQ ID NO: 6828046 - DNA, 61 bp, Homo sapiens
gggactgagtggctggagcttccccactgacctggctgggctgaccccacccctcactccc

SEQ ID NO: 6828047 - DNA, 64 bp, Homo sapiens
gtcagtttcctggttttgatattgtgctacagctatataagatgtcaccaccggaagaaactgc

SEQ ID NO: 6828048 - DNA, 56 bp, Homo sapiens
tgcctagttcggtggtttagagaatatggagtgtttctgggctttcttataaggca

SEQ ID NO: 6828049 - DNA, 70 bp, Homo sapiens
agttctctatctgccactggccgcgtgtggctcagaacgcttgaaatgtggctagtgcagatgaataact

SEQ ID NO: 6828050 - DNA, 84 bp, Homo sapiens
ccacgcagcgctgcctgctggctgccttcctgccgggaattcaacttgcaggtgcaaatcagcccagtaccaagcagttggtgg

SEQ ID NO: 6828051 - DNA, 65 bp, Homo sapiens
gtcaaacttgtatgccgggactagctcatgacaagctttgtatgatctgcaaacaagttttagac

SEQ ID NO: 6828052 - DNA, 68 bp, Homo sapiens
cctgtatgagtgtgtgtgtgggtatgtgcatgtatgtgtgcacgtgtgagcattcacatgcatgttgg

SEQ ID NO: 6828053 - DNA, 73 bp, Homo sapiens
gtggggcccgtgcttgagaatctgcttaagaatcttacttttctgtgcaccttctaatgagtacttcatccac

SEQ ID NO: 6828054 - DNA, 64 bp, Homo sapiens
taggttttcccagagacttgagcatccatgacatgctgaaatatatactgggaaaaagaccctg

SEQ ID NO: 6828055 - DNA, 71 bp, Homo sapiens
gaggcatgccctgactatctttctcaaagtggtttggtagctactatggattgggtagtctaacatccctt

SEQ ID NO: 6828056 - DNA, 62 bp, Homo sapiens
gcagcctcacagactttagaaatcagaaggcccagacagattctaattgtaaatgaggctgt

SEQ ID NO: 6828057 - DNA, 57 bp, Homo sapiens
tttccccacccagcactgttactggcataaatatgtgagcaagtgactggtgagaga

SEQ ID NO: 6828058 - DNA, 96 bp, Homo sapiens
ggttaaaatctgaaagaaatattacattagacccactttcatgagaaaaagcaatatcttctctggatggccctggctgttttcccttcagtagcc

SEQ ID NO: 6828059 - DNA, 55 bp, Homo sapiens
aggagagaagcatctgcagccagaagccttgagcactggtccagcttcttctcct

SEQ ID NO: 6828060 - DNA, 60 bp, Homo sapiens
caagcccttccgggaacagttgtagatttttgctgccttcagcacgtcctcaagggtttg

SEQ ID NO: 6828061 - DNA, 96 bp, Homo sapiens
agccaggttcccacttgagtccaggagttggggcagcagtgaaccctgatcatgtcactgcactccatcctgggcaacagagtaaagatcctgtct

SEQ ID NO: 6828062 - DNA, 70 bp, Homo sapiens
catttgtttcagctattcagtaccttacacagaaaaatgtgttaatagtgtacatagttaggaacatctg

SEQ ID NO: 6828063 - DNA, 80 bp, Homo sapiens
ctgaaggcggcagttggtccccagctccagcccattgttgccaggtggagacacaggaccagactgcccagttccttggg

SEQ ID NO: 6828064 - DNA, 67 bp, Homo sapiens
tggagggaagtggctggcataggaacagaccatatccatgtggctttggactccagtcattccccca

SEQ ID NO: 6828065 - DNA, 56 bp, Homo sapiens
tcatgtttgccctaagaaaaagtaaaaaaaagtacttttgatttggggcaagctga

SEQ ID NO: 6828066 - DNA, 81 bp, Homo sapiens
gcatccctgaggtgtggctgcttagttttcgatacttaccttgttaccagatgtcagactttaaaggctaacagggaatgc

SEQ ID NO: 6828067 - DNA, 78 bp, Homo sapiens
ctgcgttttcaaggaaagcttggcaaactaaatggtgggcatgccatcgtttattttcacaagtgctcctgaatgcag

SEQ ID NO: 6828068 - DNA, 73 bp, Homo sapiens
gggcctagggactcaggaccccctgtggatgcagctgagctgcacctgagaggtctctgaggtggacaggccc

SEQ ID NO: 6828069 - DNA, 63 bp, Homo sapiens
acagaacttcctgctggagtggctcaaagctcaagggattcggtacttcagcagggttcctgt

SEQ ID NO: 6828070 - DNA, 71 bp, Homo sapiens
ccccttccactctgtcccctgtgggaccgccgacccctgggggttccgggaggaaagggagggatctgggg

SEQ ID NO: 6828071 - DNA, 59 bp, Homo sapiens
tgttaaccatgatgttttaaaagtgacttcagtagttcttagcaacatctggtctggca

SEQ ID NO: 6828072 - DNA, 57 bp, Homo sapiens
catacttactgtgtaccaggtgctatgtttgacaccgaagatacaacagtgagtatg

SEQ ID NO: 6828073 - DNA, 56 bp, Homo sapiens
ctcaggggatagcttaagtttctgctgtgaagtaggaggaaaagttatctgctgag

SEQ ID NO: 6828074 - DNA, 77 bp, Homo sapiens
ctggaaccacattccccagagttctctttcttgtatggttctgtatggccatgagagacattctgtgtgaaatccag

SEQ ID NO: 6828075 - DNA, 82 bp, Homo sapiens
cgctgtgcatgatttgtgcagttgagacaataggctggagaaatcttgcactacgtgtgtaactgtgtagtttgtcatagtg

SEQ ID NO: 6828076 - DNA, 58 bp, Homo sapiens
gaatcatcaactctcccagtttgccccagactgaagggtttctggggatgtgggactc

SEQ ID NO: 6828077 - DNA, 101 bp, Homo sapiens
ctttcaggattgcaggtgggactatgttttggaggcttgatggatttttcagttatttagttcattctttcaaggaatagttattgagagcctcctgggag

SEQ ID NO: 6828078 - DNA, 67 bp, Homo sapiens
gaagatatattcgacgtgaatgaggcttttcctccttgagtctctctcctgcactgaattatgtctc

SEQ ID NO: 6828079 - DNA, 83 bp, Homo sapiens
gatcccttatatgccctcttatttcttgcataaactcctttgtagtagttatctttgcaaagatatgagaagctgtaggattc

SEQ ID NO: 6828080 - DNA, 84 bp, Homo sapiens
gtcttctcagtgtctaggaaataaggagattcagtaggtactccttttgaagtttctattttcaaggacactaacctcgaggac

SEQ ID NO: 6828081 - DNA, 99 bp, Homo sapiens
aggctgtcataatttggaatggaatagagattgctaactcaatcttagctggcaatcctcttttatatcagtgacatgacaaaacaaaactttcagctt

SEQ ID NO: 6828082 - DNA, 60 bp, Homo sapiens
ctttcagtgaaatgcctgacagttttatgtgttccttcctgtttagcatggcagtgaaag

SEQ ID NO: 6828083 - DNA, 84 bp, Homo sapiens
tggttgggaaatttcccttaaagcaagttggaaaatttggaaattatatcaccacttgaaaatcagaggaaattttcccaagca

SEQ ID NO: 6828084 - DNA, 68 bp, Homo sapiens
gtttctatctgtcatgccacaggacttggaaaataatttcatactgtaacatgtatgggctaagaaac

SEQ ID NO: 6828085 - DNA, 64 bp, Homo sapiens
gttctcagttgtgcgcaaaaggagagatgtaagtattgatgccagtttaagtagaactgagaat

SEQ ID NO: 6828086 - DNA, 63 bp, Homo sapiens
cttgaggacttcaggcctggccaggggggcacctctggctcaggagctgtgttcagagtcaag

SEQ ID NO: 6828087 - DNA, 95 bp, Homo sapiens
tgcgtgttgggggaggtagaggctagggtggctaataggagaggcacagatgtaactcaccattttccttcctttcttttatgttcacacatgca

SEQ ID NO: 6828088 - DNA, 101 bp, Homo sapiens
tcactggagtaacatctgtgtcattggagtaatgtctgtgtcactggagtaacatctgtgtcactggaatactgtctgtgtcactggagtaacatctgtgg

SEQ ID NO: 6828089 - DNA, 97 bp, Homo sapiens
tgcatgaacagatcatggaggtgcaaaagggcatggcaagatcaggagaccaggcaagtgtctggcatgtgtgccatgctccctctttctgccagca

SEQ ID NO: 6828090 - DNA, 69 bp, Homo sapiens
tctgaaatagccaggagatgatgggggaattgtagacactatcacccacatcttttaggcactttcaga

SEQ ID NO: 6828091 - DNA, 62 bp, Homo sapiens
gagctcgccgatccatttcctgtcattcacttgagggtgacaaagcatgatggtgacagctc

SEQ ID NO: 6828092 - DNA, 81 bp, Homo sapiens
ccagagcatgtggagtctttgaggaatttcatagtcttggtacctttgaatatgttcctcacaagttctcagaatgtgtgg

SEQ ID NO: 6828093 - DNA, 95 bp, Homo sapiens
ggaggtcattaacaatatgacctgaggtttaggaatgagagccaagctaaagatttaggtttgagattccttagctcagaggtgttaatgaagcc

SEQ ID NO: 6828094 - DNA, 68 bp, Homo sapiens
gcttcattagaattgaagagagagaaagtggcccatcccgtcaccctcctctctcattgtaatgaagt

SEQ ID NO: 6828095 - DNA, 83 bp, Homo sapiens
ctagtaggttggtgcaaatgtaattgtgatttttgccattgaaagtaataacaaaaacaattatttttgtaccaacctaatag

SEQ ID NO: 6828096 - DNA, 80 bp, Homo sapiens
tggtttatgtttcatcagtaaggttttggtattcattttcaggagcttcagaaaagtttgatgagctattatataagcca

SEQ ID NO: 6828097 - DNA, 75 bp, Homo sapiens
atactgttgaaaattacagcttgtttaccagctatataacctcaagcaggcctgagctttaattttcttgtgtgt

SEQ ID NO: 6828098 - DNA, 60 bp, Homo sapiens
gaggggactgcagggaggccgggctgagtcagcgccactgccgctgctgcgtgtcccttt

SEQ ID NO: 6828099 - DNA, 106 bp, Homo sapiens
gagatcttggtgctgccttccatgggtctgggggctccaggtcattcctctcctctctggggtgccctgacctgtgtttgactgaagattggctccagctagactc

SEQ ID NO: 6828100 - DNA, 72 bp, Homo sapiens
tgtgattgctttgttcttcgtcttttatgttcttcctagatgggctcagaacatacaagaattaagtacaca

SEQ ID NO: 6828101 - DNA, 61 bp, Homo sapiens
tcttagtcacagaggtgagaaacttcatttagtttggtcttatgcctctgtcccactgtga

SEQ ID NO: 6828102 - DNA, 61 bp, Homo sapiens
gaggcgggcagatcacctgaggtcaggaccagcttggccaacaatggtgaaagcccgtctc

SEQ ID NO: 6828103 - DNA, 59 bp, Homo sapiens
atccttccaggtgtctcttaaggtcttagcgactgtcagtagaatcatcttgaagtgat

SEQ ID NO: 6828104 - DNA, 64 bp, Homo sapiens
ggctgcctggaaacagtgagcgaaggaaatgaggcttctacctccctgctgtttccatggggcc

SEQ ID NO: 6828105 - DNA, 70 bp, Homo sapiens
aggactcgtgacctctgtggtaccaaggcaccatctgaagagctggagtcagacccaggctcatggtcct

SEQ ID NO: 6828106 - DNA, 99 bp, Homo sapiens
gaacagagagactcattttgtcttatgttcattttatgaatccttttttttggatcaaggaatgactatatgaggaaattttgccagagtctcttgttc

SEQ ID NO: 6828107 - DNA, 65 bp, Homo sapiens
tgaaagccttctaccaccaaattagagttttaaacttacgttagctcttaggtgcgtggctctca

SEQ ID NO: 6828108 - DNA, 97 bp, Homo sapiens
gggtggggtcgctgagtcagcaggcaggctgcggtcggctctggtctccgctggggagccgaggcctctcccgcagccgccgctgtggccccagccc

SEQ ID NO: 6828109 - DNA, 70 bp, Homo sapiens
ggacacggctgaccttcccaggggctggaattgttactcattcacgtgtccccagggtctggtatggtcc

SEQ ID NO: 6828110 - DNA, 60 bp, Homo sapiens
gaccctgaaagaggaatgaattagctcttcaagggcctgctcagtcctctttctttggtc

SEQ ID NO: 6828111 - DNA, 68 bp, Homo sapiens
ggagcacttggaagcgagcacatggaggaactgtcgggtcctcttctttgagctttttcctaggctcc

SEQ ID NO: 6828112 - DNA, 67 bp, Homo sapiens
gctcacaagaactttggagggataaggtgagatgttttctctgtaactcagaaagtcttcattgagt

SEQ ID NO: 6828113 - DNA, 59 bp, Homo sapiens
aagcaatgtgtttgaaaggccaagcactaataatttgttgcccattcaaacaattgttt

SEQ ID NO: 6828114 - DNA, 59 bp, Homo sapiens
ttgactatactctggcggaaaaaggagacaatgtcttcaattcctcaggtgtgagttag

SEQ ID NO: 6828115 - DNA, 83 bp, Homo sapiens
acaatttcacagctcagtttgatgttttggcagatgttatgggagcattctgcaagatcattaaagcagagctgtggcagagt

SEQ ID NO: 6828116 - DNA, 74 bp, Homo sapiens
ttcataagtacacacagtagaatagagtgaggctctcatttggaccttaaactgctgctggtgtcactgctgga

SEQ ID NO: 6828117 - DNA, 55 bp, Homo sapiens
ggtcttagtgactcataagtggaggagaaatccacatatagcagccactaaggtc

SEQ ID NO: 6828118 - DNA, 98 bp, Homo sapiens
ttctcgtattttttctaccttttgcttattatgacactctattatccaagttgcccaagtgtgtccagtaatataaaaggagttgttgaaattcagaa

SEQ ID NO: 6828119 - DNA, 60 bp, Homo sapiens
cagtgtgttacaaggttcccaattcttatttataagacatggaatcagggtaatgtactg

SEQ ID NO: 6828120 - DNA, 60 bp, Homo sapiens
cctgggacaggcaggagttagcagaaccaaccaggtgggattccttggctctgtctcagg

SEQ ID NO: 6828121 - DNA, 89 bp, Homo sapiens
ggagacttgcttgaatccctgggggtggaggttgcagtgagctgagatggcatcactgcactccagcctgggcaacagagtgagactcc

SEQ ID NO: 6828122 - DNA, 98 bp, Homo sapiens
taactttgttctgaggtcttaacttagtttaggtaaacccagcagcagttagggctctggtgttttcatgtgcataaactgcacctcagaggaagtta

SEQ ID NO: 6828123 - DNA, 92 bp, Homo sapiens
gcttttctcaactagtaaattgccaagtgttttaaaatattgattgttcatatggaatacagcatttgggaatattatttcaggagtcttgc

SEQ ID NO: 6828124 - DNA, 78 bp, Homo sapiens
accagcctcagcctgcgtcatggtgacacacatctgctgactggacgcatcggtgcatcgtgctgtaggctgactggt

SEQ ID NO: 6828125 - DNA, 69 bp, Homo sapiens
tctacatgggtgttttagctactgaattaagaacgatttgatgacagtgagtaaccccaacattgtaga

SEQ ID NO: 6828126 - DNA, 73 bp, Homo sapiens
ctttacagattagtctaagatgctaggagttgcaaagagacttaacaggcttgaatggatataatctgtacag

SEQ ID NO: 6828127 - DNA, 84 bp, Homo sapiens
agtcccagtagaagggagatctgttttttcttagacagtgaaaattgttcctggaaaagaacaggattctcaatctctgatact

SEQ ID NO: 6828128 - DNA, 88 bp, Homo sapiens
ggattttgatgtcatcacactgtagccccagaagacagaacgctcaaaggtgtcaatgggcagaatttgtagatgacatacagcatcc

SEQ ID NO: 6828129 - DNA, 102 bp, Homo sapiens
atggccctgctattgctagatctcaatgcttttctcatacccgaggtttaggtttgggactgggctggcgtggagagtttagtcccccagcaaggagcacat

SEQ ID NO: 6828130 - DNA, 78 bp, Homo sapiens
ctctttcagcagaaatattaccatgccctctgcagtgtacaaaccggagtaacatgtgttaatctttctgcaaagcag

SEQ ID NO: 6828131 - DNA, 66 bp, Homo sapiens
tgtggttagtactgaatgtgcaggttgttccaaacaaaaagtgcctcaaatcatgtactgaccaca

SEQ ID NO: 6828132 - DNA, 57 bp, Homo sapiens
agcagggttggtttctcctcaggcccctcttcctggcttgcaaactaccaccttgct

SEQ ID NO: 6828133 - DNA, 75 bp, Homo sapiens
gatgtcttgcaaaaattgctggaatctttacaggagaaccacttccaagaagatgagcagtttctgggagccgtt

SEQ ID NO: 6828134 - DNA, 57 bp, Homo sapiens
gcgggagggtgggccccttctgtgccatctggaacagaggccacaccagcctcccgt

SEQ ID NO: 6828135 - DNA, 66 bp, Homo sapiens
cttttgatctcccattgtggtttcccattggttcaacccaatcacagttagtaagggagaaaagag

SEQ ID NO: 6828136 - DNA, 71 bp, Homo sapiens
gtttttccgggagctgaacgtcttgcgacagtggctgcactcatacgtaggtggctcagcacctggggtgc

SEQ ID NO: 6828137 - DNA, 58 bp, Homo sapiens
ggaactacagtaagaattgatgttcagaataatgacattaagatgtgctgtaggattc

SEQ ID NO: 6828138 - DNA, 55 bp, Homo sapiens
ggccaattcaggctttggcctcctgtgagaaccaggatttcaaagcagagtggcc

SEQ ID NO: 6828139 - DNA, 64 bp, Homo sapiens
aattgaaagctgtccactaggctgtgtcatcttgggatagcttgctagacagctttgtccagtt

SEQ ID NO: 6828140 - DNA, 62 bp, Homo sapiens
taggacataagtattctaacttctagaatgatggagaatgagaattggagacttaggtccta

SEQ ID NO: 6828141 - DNA, 65 bp, Homo sapiens
gccctccctggatccttccgtgtctgtccccattgacacagcatggcaaatatcgagggcagggc

SEQ ID NO: 6828142 - DNA, 94 bp, Homo sapiens
tcagttatagctctgttttttaagtggtgtaacacatttagtaattttaattttgcagaatgtagatcatcatcaaggaatagaataaagctga

SEQ ID NO: 6828143 - DNA, 85 bp, Homo sapiens
ctttcagccctagcagaaggccagggatgccagctcggctgagcacagccatgcatggcactggactggggctgggggatggaag

SEQ ID NO: 6828144 - DNA, 76 bp, Homo sapiens
tcgctctgttgcccaggctggagtgcagtggcgcaatcttgggtcactgcaacctccacctcccgggttcaagcga

SEQ ID NO: 6828145 - DNA, 90 bp, Homo sapiens
gtggggagacgagacacgaagggttgacaccacccaaccaatatcctggtgacttccgggtgtcaagccccagctgtcacgctcagaaac

SEQ ID NO: 6828146 - DNA, 63 bp, Homo sapiens
ctctggttttcttgtcatcacgtgcatccatttcctctgggtgtgttcctaaggaaaccagag

SEQ ID NO: 6828147 - DNA, 65 bp, Homo sapiens
aatgtacacagtaactcaaaaaacggcctgcctttggttgttgtttccaggatactgtgagcatt

SEQ ID NO: 6828148 - DNA, 57 bp, Homo sapiens
cctgggtgtgcctcccccattcttattcaaatgtcagtctaggtaggacaccccagg

SEQ ID NO: 6828149 - DNA, 78 bp, Homo sapiens
tgggtggcagaagagtaggatgggcacacgcatttttatcatatctgcttacctgactgccctttcttcttccatcta

SEQ ID NO: 6828150 - DNA, 61 bp, Homo sapiens
gctagtgagtgtttcctgaagccaaaggcaggtttcctataattagaagcaatttgctggc

SEQ ID NO: 6828151 - DNA, 86 bp, Homo sapiens
ctggtctgagctttgagattctgatgctggtggaggaagaaactcattcattcttttactcattagacatatttcctgagcaccag

SEQ ID NO: 6828152 - DNA, 79 bp, Homo sapiens
cttaaaggccctacctccaaatataatcacattggaagttagggcttcaaaatatgaatttggaggaggcctaattaag

SEQ ID NO: 6828153 - DNA, 59 bp, Homo sapiens
cctgaatttcagtttcccattaagtctgtttgtttgatccctggaaattgaaatgtagg

SEQ ID NO: 6828154 - DNA, 66 bp, Homo sapiens
ggaggcagagccaaaaccgtaacagccagagctagagactccggcctggggttctggctctgtccc

SEQ ID NO: 6828155 - DNA, 70 bp, Homo sapiens
ccttctaagagagtacaagcaatttaataagaaaactgtctccacggtgaagttgcttgaacctgggagg

SEQ ID NO: 6828156 - DNA, 62 bp, Homo sapiens
agcagctcacaggattcctgaagatgtaacaattggctctagggcgcctgtgcatgctgact

SEQ ID NO: 6828157 - DNA, 66 bp, Homo sapiens
tgcctttgccatattctgttgggtagaaataagttataagttctgcccacactcatggggaaggta

SEQ ID NO: 6828158 - DNA, 68 bp, Homo sapiens
gatccagactgatgcccaggtagtggctcagtgaggagcgggccagaagctggggcataggaggagtc

SEQ ID NO: 6828159 - DNA, 72 bp, Homo sapiens
aaaagcattatcaggaggaacatgataaatgaggtctcattagtctaagcttgttcccttctgtcacctttt

SEQ ID NO: 6828160 - DNA, 97 bp, Homo sapiens
atgccccaggccacatgccctgcccatggctgaggcagaagctttgtcagaagtgtctgcctggcctggagggcacaggggccatcatccagggcat

SEQ ID NO: 6828161 - DNA, 64 bp, Homo sapiens
gaaactgggaagtcccagatcaagccaccaacagtttcagtggtgagggtccacttcctgtttc

SEQ ID NO: 6828162 - DNA, 62 bp, Homo sapiens
ttggggttttatggcaaaaagactgggcatgtccaactggcttgtctgctataaaaatccag

SEQ ID NO: 6828163 - DNA, 68 bp, Homo sapiens
gcagggttgccatggtgatggggggtgtcagggacccgccctaaccacttcccctgtggcgagcctgc

SEQ ID NO: 6828164 - DNA, 104 bp, Homo sapiens
cggtccactaaaatccacactccctttccttggtataaagttgccactgagaagttacattttctagctttttgcaccaaggtgagaccaggtgactagtactg

SEQ ID NO: 6828165 - DNA, 81 bp, Homo sapiens
gattctgctgtgcatctgaatttgaaaatcttgagctttgaaataaaagcagactctgaaatctaggtgcaaggcatggtt

SEQ ID NO: 6828166 - DNA, 84 bp, Homo sapiens
cagggccctagggctcagcctcctcctcagcccacgaagccatgtgactgctgggctggggatcgaaggcagagcctggttctg

SEQ ID NO: 6828167 - DNA, 67 bp, Homo sapiens
gcgcggcgcgggcggaggaaggaagggcggctctaggggcgtcctggctagtcgtccgcgaccgcgc

SEQ ID NO: 6828168 - DNA, 84 bp, Homo sapiens
tatatacaagatacttgaatcagaggtataactctgttattgttatgagctggagattaggtatggtttaagtagatgtgtatg

SEQ ID NO: 6828169 - DNA, 63 bp, Homo sapiens
gaggagatggaaagctgtaccagtagtcataggtaaattaagtttgttttccatttgttcctc

SEQ ID NO: 6828170 - DNA, 80 bp, Homo sapiens
agggatgctgctgtgtttgagtaatacagatgctgccccattcccaactcagcagctgctatgacaacaccagcctctct

SEQ ID NO: 6828171 - DNA, 68 bp, Homo sapiens
gccaggccctgcgattaggtggcagggcctctgccctgctccaggccgcatgggtgtctgaacttggc

SEQ ID NO: 6828172 - DNA, 61 bp, Homo sapiens
gagagaagctctggacagtgaagaagagctcgttttggccacactcactagagcccctttc

SEQ ID NO: 6828173 - DNA, 101 bp, Homo sapiens
ttctaagtataggaactctgcgacctggatgataacagcaatattttttcttaagttttgttttgttttcctgggaagagtacgtctatgtaaacttagga

SEQ ID NO: 6828174 - DNA, 77 bp, Homo sapiens
tcttatctctaaaatggggcaaagtcaccctgccttacacttgagacagtggctcagccccagtcttgagatgcaga

SEQ ID NO: 6828175 - DNA, 57 bp, Homo sapiens
ctaatctctgcactctgccacaactcaaccaatttgtatggcagggagtgatattag

SEQ ID NO: 6828176 - DNA, 63 bp, Homo sapiens
cttgtcaggaaatgtcccaggttgtgggctaggccctagggccaggatgcaacagggaacaag

SEQ ID NO: 6828177 - DNA, 90 bp, Homo sapiens
ctctctgtctctttatgtatgtgtgagtgtgtgtgtatatacacacatgtacatacacatatgtaacgtgtttttaattagttcagagag

SEQ ID NO: 6828178 - DNA, 75 bp, Homo sapiens
ggccccatgctgcttcctcccaccagaaatgatttcccattatctagtggctggtgggtagagggcatcagggct

SEQ ID NO: 6828179 - DNA, 71 bp, Homo sapiens
caattcttctggtctggattgggcttggtaatttcatgcatctgcatcagcttcagatcagctagagattg

SEQ ID NO: 6828180 - DNA, 71 bp, Homo sapiens
ctggttaatgcttggcagctcatgtcagtgttttcaacactgctctagtgggtagagcattgatataccag

SEQ ID NO: 6828181 - DNA, 80 bp, Homo sapiens
cacctactctgcccagcccctatccctgggatttaactgtactcactcccagagtcagaggtggggcctgagaggaggtg

SEQ ID NO: 6828182 - DNA, 64 bp, Homo sapiens
cagctgttgatctcttaagccttgccttaagatgctagaaagcttcagagcatcacttcagctg

SEQ ID NO: 6828183 - DNA, 56 bp, Homo sapiens
cagggtctgtgcaagaacacgccttggtgatcatggtgtcatttctacaggccgtg

SEQ ID NO: 6828184 - DNA, 91 bp, Homo sapiens
ctaagtgttctcaggtaaagctgtcaaggcaggaggctgagtgaggacacaccagctttacctgccttggggcactcctgggattgattgg

SEQ ID NO: 6828185 - DNA, 64 bp, Homo sapiens
tctacctctgccattgtcattgccacttgtccaaggagaatgagacacgtgaagcagatgtgga

SEQ ID NO: 6828186 - DNA, 76 bp, Homo sapiens
atgatttagaagttagagtgcatagtgaaatctctgcgtttgcacattacactagctattcttatggataaattat

SEQ ID NO: 6828187 - DNA, 77 bp, Homo sapiens
aataccatgaataagaattgccagatttgaaatgctttgttaagctttttttaggcatgcagttctatttaagtatt

SEQ ID NO: 6828188 - DNA, 79 bp, Homo sapiens
tatccctcggttaggttcctcccgtccctgctccctgaggctgatggacaggcaggcgggacagcccgatcgatcgatg

SEQ ID NO: 6828189 - DNA, 74 bp, Homo sapiens
ggtccttgtctctaaaacaattcaaggttgaaggactaaccctcctctcaacagtggcaaagaggcacggggct

SEQ ID NO: 6828190 - DNA, 86 bp, Homo sapiens
tgtatcacaaaggtctcagagcacattaaagtcacacacacacacattaaagtcacagtatgctctgagacctttgtgcatctaca

SEQ ID NO: 6828191 - DNA, 130 bp, Homo sapiens
tattgagataaatgctacaggcttgggggaaaacctcatttaaagtaatttatatcaaattatgtggaaaatatttaggtgaatgatgttcaagctatgctcttgagtggaatctgaagctggtttcaaa

SEQ ID NO: 6828192 - DNA, 73 bp, Homo sapiens
ccccgtggttctgcttctcttattttcagctggaattcttcagctgaagaaatgggaagcattcaacactagg

SEQ ID NO: 6828193 - DNA, 64 bp, Homo sapiens
ggcgctggcccatggtgagctctgggagtgtcagctctgtcgtgagtgacaatgggtcattgcc

SEQ ID NO: 6828194 - DNA, 76 bp, Homo sapiens
ttcctatgtttgcctttgcaaagactcttgccttcatcaaataagagcaatggtaagttttgtataggcatgggaa

SEQ ID NO: 6828195 - DNA, 82 bp, Homo sapiens
gctagggagacttgtgtcatcatccacaaccttgtttctcacttcctggttgggctcatctctgaagaacaggtctcccagc

SEQ ID NO: 6828196 - DNA, 68 bp, Homo sapiens
cactgtaggcaccttgagagcaggagctgcatcttatgtatctctgcatccctcaaggttgcatagtg

SEQ ID NO: 6828197 - DNA, 61 bp, Homo sapiens
gcaatgggaaaagagtatgatttagctcccactttctggatcacatctactttttctatgc

SEQ ID NO: 6828198 - DNA, 101 bp, Homo sapiens
ggggcagctgctgtggctgcggggccaggaagagagcgcagcctccacagagccattccggaccgctgcctccgccggctccacagcccacgcgcgcactc

SEQ ID NO: 6828199 - DNA, 72 bp, Homo sapiens
tcagaacaggttgtactatgtcccccaaatcatactgtcttagagggacaatctagataatctgtctcctga

SEQ ID NO: 6828200 - DNA, 95 bp, Homo sapiens
atctcttacccctgctttcaaagaatgtatcagataaagcatgtggaaaagaaatctttccaagccagtgtgatatgaagtagaaggtgatggat

SEQ ID NO: 6828201 - DNA, 90 bp, Homo sapiens
tctttagcaccaatcttttcttctacagtgattaatagtaaaattgttgaatgaaaaattgttagttagtgtggggagatagcataaaga

SEQ ID NO: 6828202 - DNA, 59 bp, Homo sapiens
tggaacattcatgcaccttcctatccaccccactgggtaaagtgcatggttatgtgcta

SEQ ID NO: 6828203 - DNA, 84 bp, Homo sapiens
agtggtgtgattcctctgggaattctgagcaagcaaatatttttgttagacatgacagaattttccaggcatgttattatcact

SEQ ID NO: 6828204 - DNA, 72 bp, Homo sapiens
attgatttcaagtagtgacatgctgaagttgttgaatcatatagaaaagttaaagttctacttgagatgaat

SEQ ID NO: 6828205 - DNA, 83 bp, Homo sapiens
agagctttgccttagatcagtagttggtaagggtcataggatgtaatcccaggccaactggctgatctcaaagcctgtgctct

SEQ ID NO: 6828206 - DNA, 56 bp, Homo sapiens
tcatgtctctatgtgcctattacctaatctggtagtagttactgaataaaggctga

SEQ ID NO: 6828207 - DNA, 66 bp, Homo sapiens
tgtggattcactaggttgcaaaactgtggacatagcacagacttgttccctagtgagtgaaaaaca

SEQ ID NO: 6828208 - DNA, 62 bp, Homo sapiens
tgtccccgccacaatcagccttccacggtcacccacaaggcatggtttaagtggtggggata

SEQ ID NO: 6828209 - DNA, 73 bp, Homo sapiens
tccatacaggtggcataagaacactaaagatgagagtttgggggtggatttatgcacacaaactgtgttagga

SEQ ID NO: 6828210 - DNA, 57 bp, Homo sapiens
aggtaccgcggacctcgccccgggacagcgaggagctgagggaccctgtgagtacct

SEQ ID NO: 6828211 - DNA, 65 bp, Homo sapiens
cttatctccacattctattggctataactagatacaagctaagtgcaagggaaggtggaaataag

SEQ ID NO: 6828212 - DNA, 99 bp, Homo sapiens
ctgaggaagatgagagcaagtggtccaagggttgagtggaggtgctgggaacggaaacccaccttccatctccttggctagtgcacttggaggttgcag

SEQ ID NO: 6828213 - DNA, 129 bp, Homo sapiens
ctctgcctgctgttgctgggtgtagagcgtttaccctgtgagtagggactggtggaggaaggaagctctgaccacttggccatgctcaccaggaatgtagccgttgtagtttagagctggggggatgag

SEQ ID NO: 6828214 - DNA, 55 bp, Homo sapiens
ctagttctagatccctgaggaatcgcaacactgacttccacagtggttgaactag

SEQ ID NO: 6828215 - DNA, 56 bp, Homo sapiens
cctgccctagttaaggccttagttgggggctgccagctgccagggactgggcatgg

SEQ ID NO: 6828216 - DNA, 74 bp, Homo sapiens
ggacacagtggaagacagcttggagtaggaaaaggactgaagactgcagcagccaggtgaacttctattcgtcc

SEQ ID NO: 6828217 - DNA, 66 bp, Homo sapiens
ccacactttggtttccctgttcgtaaaatgattaaaattacgagctttgaggctcaaggtaagtgg

SEQ ID NO: 6828218 - DNA, 60 bp, Homo sapiens
actcagcttgcacacatcaatgacctttggggatattgttcacacctgtgcagtttgagt

SEQ ID NO: 6828219 - DNA, 63 bp, Homo sapiens
ggtgtcagaagtgggatattacaaaaaattggaaaacaaagctgttttttctactctgacatc

SEQ ID NO: 6828220 - DNA, 59 bp, Homo sapiens
gaagagtgaatctgaaaggcactatagttgacagaattgtacagcccagattcctcttc

SEQ ID NO: 6828221 - DNA, 92 bp, Homo sapiens
tcaacctgaggatataggagtcattttatgggaacagatttgaaggcttatcactgtttcccaaagtaagaggtacctgtgacctgtgttga

SEQ ID NO: 6828222 - DNA, 63 bp, Homo sapiens
ctgagaatcatggcaacagaatgaacttgtatcacatcaatgtcattacagtcatgattccag

SEQ ID NO: 6828223 - DNA, 86 bp, Homo sapiens
gaggggcaggtgctgggctctggggaggacccttcaagctgcagcagtgggggcagcacctccccggggccagagccttgtgcctc

SEQ ID NO: 6828224 - DNA, 67 bp, Homo sapiens
tattggttatgtgcaggctctggagtaggactatctggctttaatcctggctctgcacttgctaatg

SEQ ID NO: 6828225 - DNA, 83 bp, Homo sapiens
gggtttttctctgacagtggcatcattttgtgattgtcttatccaaacatttatggtagtcattgcaatttcagggatagcct

SEQ ID NO: 6828226 - DNA, 89 bp, Homo sapiens
tcaaaagtaatctcttaccttaaatggcatagaggtgaaggtaagaaaatctcttaccttaaatgccatagaggtgaaggatttggtga

SEQ ID NO: 6828227 - DNA, 70 bp, Homo sapiens
gattttaatattcttaattgctgagctgaatgtttatcacatttagcagcaaataagtagtgctaaaatc

SEQ ID NO: 6828228 - DNA, 57 bp, Homo sapiens
ggctgcctaaacagtccccaaattagtcttcgagtagtatggattgtgttaggagtc

SEQ ID NO: 6828229 - DNA, 129 bp, Homo sapiens
gcaagtaagactgtactttggtttggaactctaccaacagtagtcacaatttcagaaacacacttcactgacagcaacattactcttggtatttgagttgccagcacacctgtctctatctacacttgc

SEQ ID NO: 6828230 - DNA, 77 bp, Homo sapiens
caggtgtagagtgaggctgggcagaggggtgttgctgatgtctgcaccgccatgctcccagccacagtttccacctg

SEQ ID NO: 6828231 - DNA, 73 bp, Homo sapiens
ctggatgttgcggggcagaggcttggattaggaagccgtgtcgaggcctggtgtgccggatgcagcatctcag

SEQ ID NO: 6828232 - DNA, 62 bp, Homo sapiens
gttggctaaaaggctacaggcatcaaactcaaaaccatttagagcccactgtctttgccaac

SEQ ID NO: 6828233 - DNA, 64 bp, Homo sapiens
ctgagcctgttctggttggctgaccccctgggaaatccagggagtttccaatctgagagcttgg

SEQ ID NO: 6828234 - DNA, 96 bp, Homo sapiens
tagaggtgtatttcaggaaggatggcgaggtggagagggagcttttgtcactctgtctatcccattctgtgcattcttggaatgttacattttctg

SEQ ID NO: 6828235 - DNA, 79 bp, Homo sapiens
cagagctatacatccatttgctttatttgctgatcttttgaagatgttactagttgtggagaagtgatgtattgttttg

SEQ ID NO: 6828236 - DNA, 67 bp, Homo sapiens
tgtcaatttccaggtattaatactgtattatagttaagcatgatattaatactgggaaggctagata

SEQ ID NO: 6828237 - DNA, 105 bp, Homo sapiens
ggacaagggaatgtatggcattacaagtcagaataatgtttcttttgagaaaagaggattcaagagctgaacatttttgacatgtttatctattcatctatgttt

SEQ ID NO: 6828238 - DNA, 58 bp, Homo sapiens
ggttccctcaggctcaggttaggggccaagtgcttgcgcttggcgagctgtggggacc

SEQ ID NO: 6828239 - DNA, 73 bp, Homo sapiens
tcagtctcattaacactttatgttggtttttatgactttctgcatctggacagctttgtgttaatgggaagga

SEQ ID NO: 6828240 - DNA, 72 bp, Homo sapiens
gtttgtcaattatgagtaaaaccactatttacagataaatatctgtaaaggtttcaattcatttgggtaaat

SEQ ID NO: 6828241 - DNA, 123 bp, Homo sapiens
gttttcggtcagtctcttcctttggggtggaggaggcagttgttgctgagcagctgagaaagcactgccacatacgctgcccctccacacctagagcggtgcaggagagcactgagtgttggc

SEQ ID NO: 6828242 - DNA, 59 bp, Homo sapiens
ttgctttgtctgctttttggtctcttggtcacagcagggcatgaaatgggcagaagcaa

SEQ ID NO: 6828243 - DNA, 75 bp, Homo sapiens
ttgtctaagtcacatgttgtattccatatttagctgtagtgttgaaataataggaaaaacactgtgtcttggcag

SEQ ID NO: 6828244 - DNA, 126 bp, Homo sapiens
tgaagggagaaaaaatttgggcaagagacagagatggtttatgagattttggaggggaattttgctccataaatgaaatagaacgctctcattgaagccccacaaaactttcaacaaaaatcttca

SEQ ID NO: 6828245 - DNA, 89 bp, Homo sapiens
gaaaatggtgaagtgtaatttagcatagtatgaacaaacatcgatattgactacagctaatttgctcttatacctttccatgtattttc

SEQ ID NO: 6828246 - DNA, 55 bp, Homo sapiens
cctcaggatccgcaggtgcagtggccgcgctcccactgaacttgtgttctagagg

SEQ ID NO: 6828247 - DNA, 67 bp, Homo sapiens
ctttaaagtggttcttacatccgtggtcaaaaaacagaccatggtcaaagacagaccattaccgaag

SEQ ID NO: 6828248 - DNA, 78 bp, Homo sapiens
agagttgaaatgatcctgagttcctgcctctaaatgacaaatgtatttatatgaaagtgaccagtggacatcaactct

SEQ ID NO: 6828249 - DNA, 57 bp, Homo sapiens
aggagactggacaagaatatggttctgagaagggtgctagttcttgtcctgtctgtt

SEQ ID NO: 6828250 - DNA, 69 bp, Homo sapiens
gaggtccagaaattcccatttcagattctgccaaaacattctagcaggaaaggaaacaatttcaacctc

SEQ ID NO: 6828251 - DNA, 82 bp, Homo sapiens
gtcagccagctgcccttctcttgcccttggccactgcagcagaccttaggccaagggaaggctaagggcaacagcacctgac

SEQ ID NO: 6828252 - DNA, 71 bp, Homo sapiens
agttactattcagcatgaaaggatttgagtgcaatttgcatgtctctttcacattgttgttttagtaaact

SEQ ID NO: 6828253 - DNA, 62 bp, Homo sapiens
ctgttttgaatgtgttgtgttactccctcaatctcgattgttgggagacccaatacagacag

SEQ ID NO: 6828254 - DNA, 67 bp, Homo sapiens
tggcttaagatttatgcttttatggaatattagtcttgtccactgatgatagcaataaatcaagtca

SEQ ID NO: 6828255 - DNA, 68 bp, Homo sapiens
cactgtactgggttgaaggacgtcccccccaaaaatatgtgtcctgtatacaaaccctggtaccagtg

SEQ ID NO: 6828256 - DNA, 59 bp, Homo sapiens
gtgcaagtttttggaggttgggctctgaagcaataaagggcaagcctatgagatttcgc

SEQ ID NO: 6828257 - DNA, 75 bp, Homo sapiens
caggctccaagccctctgatgtacgccagcttccttggtgtaaaggacctcatcaggggtatctgcttggccctg

SEQ ID NO: 6828258 - DNA, 64 bp, Homo sapiens
cagagatgtctctccacatggctgaggcctgcaacccaggctctgagcagggagaaacaggctg

SEQ ID NO: 6828259 - DNA, 59 bp, Homo sapiens
cccacaggctaggggtagggcagttggaattgatccatgccttctagctagactgtggg

SEQ ID NO: 6828260 - DNA, 69 bp, Homo sapiens
ctacctgggaagggccatcttctagatagcttgttcccaagcagtgttcccagctggcccctcaggaag

SEQ ID NO: 6828261 - DNA, 109 bp, Homo sapiens
aaggaaaaggagagggcgggttgaggccaggactccaggtgtccaggactccaggtgtccaggactccaggtgtccaggcctccagggccgcaccctcatgacagcctt

SEQ ID NO: 6828262 - DNA, 57 bp, Homo sapiens
tctgactagttcttgctgaaataattaaatgtcttttcagcaaatggactgttcagg

SEQ ID NO: 6828263 - DNA, 55 bp, Homo sapiens
gttacaatagcacacttgtgagcattagtcatctaatgccaaagtgcttttgtgc

SEQ ID NO: 6828264 - DNA, 56 bp, Homo sapiens
gttttcatgccctcttgtaggttatctgtgtcattcctactttaggcactgagaat

SEQ ID NO: 6828265 - DNA, 64 bp, Homo sapiens
tccagatttaagactcagcactttctaagaaattatgtaccttgaaagtctgtttatctctgga

SEQ ID NO: 6828266 - DNA, 64 bp, Homo sapiens
tgtgagtgtgtctgctttggcaataagtggggtgatactcactttttcatgcaaacgcttcata

SEQ ID NO: 6828267 - DNA, 72 bp, Homo sapiens
gggcatccccagctccgaatgggacacgttttcccgagataaaagatcccttctgagctcacacgggagccc

SEQ ID NO: 6828268 - DNA, 130 bp, Homo sapiens
gtgtctctgtgtttgcaggtgtccagtgtgaggtgcagctggtggagtctgggggaggcttggtacagcctgggggatccctgagactctcctgtgcagcctctggattcaccttcagtaacagtgacat

SEQ ID NO: 6828269 - DNA, 60 bp, Homo sapiens
tagaaatgttagatgtattgagggatttgattctgaatctatcaaagcaagcatgttctg

SEQ ID NO: 6828270 - DNA, 72 bp, Homo sapiens
tgaagggacagggaaggctgttttctggggactctgagatcaattccatcttacaattgtccctgtctgtca

SEQ ID NO: 6828271 - DNA, 88 bp, Homo sapiens
gcagatgtaaagacagctaagggcacaggtcacctgcgagaagatgagcactcggtgtccttgctccttcagctttcgcagcatcttc

SEQ ID NO: 6828272 - DNA, 61 bp, Homo sapiens
tataatgtttatctcatacatttacctcacacattggatgatatgtgtgagaagcattata

SEQ ID NO: 6828273 - DNA, 65 bp, Homo sapiens
tgatggaaatttgggaagctttcttaaaattctgcttaccacagagcttttcttggtttccttcg

SEQ ID NO: 6828274 - DNA, 76 bp, Homo sapiens
tgggaggaggggcgctttgtctatgcagtcttcttacggctcatcacggtacagacagggcacctgcctcctgcca

SEQ ID NO: 6828275 - DNA, 56 bp, Homo sapiens
tcgtgcaaaggcccatgtgggtcaaagtctagaaacaactgtgggctggtgcatga

SEQ ID NO: 6828276 - DNA, 85 bp, Homo sapiens
aaataatgcaagacatatatttgcactatggtagatttcaggaatttcaaaagaaatctgatgtcagtgcaattatccgttattt

SEQ ID NO: 6828277 - DNA, 67 bp, Homo sapiens
gcttttattacccagagggagagcaactatagtgttgtgccatagaatagcactgccctgggaaggc

SEQ ID NO: 6828278 - DNA, 80 bp, Homo sapiens
ttcttgtctgtggctactattattctgtcatcagtactctactagttaggatgcacaggaagtgtccccatttgacagaa

SEQ ID NO: 6828279 - DNA, 98 bp, Homo sapiens
tgtcatcagagcatctaagactgtatcaagatcagcagctgttctcactagaatggtgcatctttcaatattcaggtcttcccaggggttctttgaca

SEQ ID NO: 6828280 - DNA, 107 bp, Homo sapiens
cagtgacattgctgcttcaactaagaaattctatatttaaattctaatgtatgcaacatactgaaggcattcagataacagagcactcagagggctgcaaaccactg

SEQ ID NO: 6828281 - DNA, 55 bp, Homo sapiens
cagggaagaatagttagcaaagcctccaattagagttttgtttatacttccactg

SEQ ID NO: 6828282 - DNA, 96 bp, Homo sapiens
ataaatacagtttctgcattgcaccacattgcatccctggggggctacagggatgttcattttgtggctgaaataggataaaagggttgtatttat

SEQ ID NO: 6828283 - DNA, 64 bp, Homo sapiens
tgttgaaagccgggactcaaaaagacatgtgtacacacatgttcatagcatcggtattcacaca

SEQ ID NO: 6828284 - DNA, 73 bp, Homo sapiens
tttagagaccctctgctatttttaaaatttccttccttgctttgttttagtcaacctagtagggggttctgaa

SEQ ID NO: 6828285 - DNA, 56 bp, Homo sapiens
ggaaggcagaggtgtcgtgggggctgcagacctgcgtccacagcctgctgtcttcc

SEQ ID NO: 6828286 - DNA, 73 bp, Homo sapiens
tgtgtgcgtatgtattctttgtgtgttgcatgtatgttatacatgtgaggtgtgagtgatacatgtgtatatg

SEQ ID NO: 6828287 - DNA, 84 bp, Homo sapiens
aaggtgcaactcagcaggctgctggcgttgaagtcgttcattcgatagagttcagtgtgtggtagaatctgaatgaggcacttt

SEQ ID NO: 6828288 - DNA, 62 bp, Homo sapiens
tagtcaaacctcagaatacccctgtgctatgcttatgggtgatctttttctgagatttacta

SEQ ID NO: 6828289 - DNA, 84 bp, Homo sapiens
cctcccctgagtcagggtcagtgatgagggagccccagtggctgagagctatgcagatgggctctcgattagaccctggggtgg

SEQ ID NO: 6828290 - DNA, 74 bp, Homo sapiens
ggaagctggacaggctttgagttcccctctaccctccctacccaaagatggatactcattcctgctgtgtttcc

SEQ ID NO: 6828291 - DNA, 56 bp, Homo sapiens
tagtcagttgggtctagtggcattaggcctgcccagctccagaacccaaactgcta

SEQ ID NO: 6828292 - DNA, 80 bp, Homo sapiens
ggacacacactactgagagaccaagcaagatgaaaagagaaagggaacatcagctggtgagcttagtagggtgaaaagcc

SEQ ID NO: 6828293 - DNA, 70 bp, Homo sapiens
tctcaaacaggccttggtcctgacctaacctatcctgttcagttaggtcaggaccaaggcctatttgaga

SEQ ID NO: 6828294 - DNA, 84 bp, Homo sapiens
gaaggctgggagtccaagaccaaggtgtcaccagagttagtttcttctgaggtctctcgccttggcttgtagatgaccatcttc

SEQ ID NO: 6828295 - DNA, 57 bp, Homo sapiens
tgatccagcggggctagaggaaggctgggttgacagtgtttttaatgggctggagca

SEQ ID NO: 6828296 - DNA, 63 bp, Homo sapiens
tcattcactttttatgtctaagtatagtcctaagacttactttggttaatgaaatgtgagtga

SEQ ID NO: 6828297 - DNA, 86 bp, Homo sapiens
gttatagctaaggaaagtaatgttcaaacaagttaatgccacatagctagtgtcagcatcaggttgtctgaattcacagctagagc

SEQ ID NO: 6828298 - DNA, 128 bp, Homo sapiens
ggctgaaacactgtaacatccaaggctgcttcattgcacgactccaggagctcctttcacatcataaactgtgtgaagggcactgtctggaattgtgcagtgcctagcctgtgcagctgtacatggcc

SEQ ID NO: 6828299 - DNA, 65 bp, Homo sapiens
cctctgggccatgctactgctcttgaatatactggaacgagacactaaaagctgcccagaaaagg

SEQ ID NO: 6828300 - DNA, 84 bp, Homo sapiens
acaatttgctttctttttctaagttttaggtttttctttctctcttaggaagtttagtgaaactctaggggttaggcaggttgt

SEQ ID NO: 6828301 - DNA, 63 bp, Homo sapiens
gagggtgggggcaagcaggggagctgggttccaaccagcttgttaaacagcctccactgcctc

SEQ ID NO: 6828302 - DNA, 64 bp, Homo sapiens
tctccactgctcagcatatccaaaaacctacctaattgtcatggtcagtgccttgcatgtggga

SEQ ID NO: 6828303 - DNA, 82 bp, Homo sapiens
ttggaatttaattaccttcaccagcgaatgtttggagaacctctctccatcaattgattctgaagtcagatttttattccga

SEQ ID NO: 6828304 - DNA, 113 bp, Homo sapiens
gcagaatcgtgcgggctgggccctggcagtgcctcccaggcacccctcattttgtgcctctttgggaaggacgtgtcagtggcatagtgtgggagacactggtgggttcatgc

SEQ ID NO: 6828305 - DNA, 60 bp, Homo sapiens
tcatggctgtgatgtacactggggtgacccacatgctgaaccccttcatctacagcctga

SEQ ID NO: 6828306 - DNA, 76 bp, Homo sapiens
gttaccagaaggaatatgaatgcatggaaaaaaatttggtgataaatttccatgatcgttatagaactctggtaat

SEQ ID NO: 6828307 - DNA, 80 bp, Homo sapiens
gtggtagaaggaacataggtgtcggagacaactggaagtcagttaatcatcccagaccacttattttccatcagtaccac

SEQ ID NO: 6828308 - DNA, 75 bp, Homo sapiens
cctcggctcttgcctgagtttcagagtcccgccggagttagagctggcagagtccaattgctcagagcgccgagg

SEQ ID NO: 6828309 - DNA, 59 bp, Homo sapiens
ccaagctttcgatcaaccagaagctccatggataatttgagttactgcagaaagtttgg

SEQ ID NO: 6828310 - DNA, 75 bp, Homo sapiens
gtgaggagggaggagggagggaggagggagggagggatcgcgtcccccctctccctcacttatcaatcaccccac

SEQ ID NO: 6828311 - DNA, 107 bp, Homo sapiens
gaggaagcagcaacggcagggaatgagcaagcgaggacaggggcatcaatcaccaccagcggtgacaccgtcccagttcctcctgtcagcagctgccttctctcctc

SEQ ID NO: 6828312 - DNA, 57 bp, Homo sapiens
gagctgctggatatgtggcctggctttgttgttttcagtatgtcacatccacagttt

SEQ ID NO: 6828313 - DNA, 115 bp, Homo sapiens
gcatcctttttattttgaattacataggggtagatatggcatcgtcaccttttcagtgcttggagccactgaacagcctgaggagtcaccctggcttcagaggtggaagggatgt

SEQ ID NO: 6828314 - DNA, 58 bp, Homo sapiens
agagcagctttgatctcactggcagtttgtttagaagcctgagatctggagtggcttt

SEQ ID NO: 6828315 - DNA, 83 bp, Homo sapiens
ggataatggccattggagttgcaaaagaagtgcctgttttcattatttatactctctggcactcccttatggctcctttattc

SEQ ID NO: 6828316 - DNA, 84 bp, Homo sapiens
cttaggaaatggtatataactaccaagggagagatttaatgtaaaattaatatacttcccatagtttgaataaaatttctagag

SEQ ID NO: 6828317 - DNA, 59 bp, Homo sapiens
tttctcagcttgagtggatgagctggtaaataccaccgtacatatcaaagctgtagaaa

SEQ ID NO: 6828318 - DNA, 67 bp, Homo sapiens
gctggatcagggaaggtgggcatggcccttgcagctcttgctgtttcatgcagcttttccattcagc

SEQ ID NO: 6828319 - DNA, 65 bp, Homo sapiens
gaattttagaatatgtgggcttttgtgattagcttctttcacttagcataacgtttccaaggttc

SEQ ID NO: 6828320 - DNA, 90 bp, Homo sapiens
ggctgccactcctactttagtactgtgtggtgagctgtctcctcctgggtttcagagggcacagctgctacccagtgccatggaggcgct

SEQ ID NO: 6828321 - DNA, 67 bp, Homo sapiens
aagatttgtcttggtctcatctgagtactataatgtcattgttagatggggtcaggatggaaatctt

SEQ ID NO: 6828322 - DNA, 70 bp, Homo sapiens
gggttctgagctgtactcctccccagggcaagattctgcttctgctgggaggcgctgcttctaggagctc

SEQ ID NO: 6828323 - DNA, 56 bp, Homo sapiens
gctggtcctggggttgcagcatccagctgggagcctctgtagctccaggatccagt

SEQ ID NO: 6828324 - DNA, 58 bp, Homo sapiens
taaatatgaagggataagggctcattttaaggaatgggacttatctatattctattta

SEQ ID NO: 6828325 - DNA, 55 bp, Homo sapiens
atcttagaagtttgataaaatcctagttctctgggattttttaaggttctatgat

SEQ ID NO: 6828326 - DNA, 97 bp, Homo sapiens
ttcttggggaaaatgttagacaagggatgaatgaagcacttatgttctgctaaggtaaatgtatgtgcatcatttacatttggaacataatcaagaa

SEQ ID NO: 6828327 - DNA, 60 bp, Homo sapiens
gaaaagactctggagtcagctaggattcaggtcaggactcagcccctccggagttacctc

SEQ ID NO: 6828328 - DNA, 100 bp, Homo sapiens
gctaaacttagagtgttaaatctgtttctcatagggtaggtgacagctaaaatatcaactactttagtttcagatggactatttagcatcttcattgagc

SEQ ID NO: 6828329 - DNA, 109 bp, Homo sapiens
ttctacttatagtcaaacaaaaagagctgagaagttttttttaaccatttccccacaatatttggcttaagaatacctctcagctctttttgttagactataactagaa

SEQ ID NO: 6828330 - DNA, 67 bp, Homo sapiens
cgtcagagaaggctgagtcacggctcctatcagctgactgtcggccaggctccaggccctcctgatg

SEQ ID NO: 6828331 - DNA, 60 bp, Homo sapiens
tgcctgggtgtaaagggccaacagtttactagtttactgggcccctaaaaatttagagca

SEQ ID NO: 6828332 - DNA, 76 bp, Homo sapiens
actggactgaagcaagatttgacttcgtggtttgacacatgtccaattactccacaacatttatgcctcagtaggt

SEQ ID NO: 6828333 - DNA, 60 bp, Homo sapiens
cagatttactccctgctgctgcccagtggcaataattgggtactgcagagggtgggtctg

SEQ ID NO: 6828334 - DNA, 56 bp, Homo sapiens
ggcatcttgtggggcttcaggaaacctttccgtgtgagcagcccactaggaatgcc

SEQ ID NO: 6828335 - DNA, 80 bp, Homo sapiens
cgcagcacgtgctcgcggcgcccgaagcccttgccacactcccagcaggcaaagggccgcgctcccgagtgcgtcttgcg

SEQ ID NO: 6828336 - DNA, 58 bp, Homo sapiens
gtgaaggttgtcatgaagtacaaaggacaattcctttcctggcaggtacaacttttac

SEQ ID NO: 6828337 - DNA, 78 bp, Homo sapiens
aatattggtctttttggaagagattttatggaaaacagagtctatgatgcccacgttcttctaaggagggccaccatt

SEQ ID NO: 6828338 - DNA, 60 bp, Homo sapiens
tcttagaaactgtatcgattagggttggattcccttgtgatcattttactgtttcaaaga

SEQ ID NO: 6828339 - DNA, 58 bp, Homo sapiens
atttggctagacatttcttcattcaacagatatttatgaagtctattctatgccaggt

SEQ ID NO: 6828340 - DNA, 59 bp, Homo sapiens
acttccagtgtctgctgctagcatatccagcaggtgaactagatacaacaactggaagt

SEQ ID NO: 6828341 - DNA, 65 bp, Homo sapiens
tgtctcccatagcattttaaatagtgccttactcatggtatctacgcagatgttgctggttggca

SEQ ID NO: 6828342 - DNA, 93 bp, Homo sapiens
ctgatatagttctgattacaatgggaaaaggttttagtgattgcgccaaagtaaaatatggaaagctctttttgattgcagactattcattag

SEQ ID NO: 6828343 - DNA, 64 bp, Homo sapiens
ttttggagtggacttcatgaggccacatttcagattagtgcctagaggagtcagtattctgaga

SEQ ID NO: 6828344 - DNA, 101 bp, Homo sapiens
gggagcttgttgaaacacaggttgctgggcctcacccccagagttcctgattcagtagttctcaggtgagggccaagaatttgtgtttcgaacaagttccc

SEQ ID NO: 6828345 - DNA, 68 bp, Homo sapiens
ttatgtacatgagcataaacacacataaatacagatatatatgtgtgtggtggtgtgtgtgtatataa

SEQ ID NO: 6828346 - DNA, 57 bp, Homo sapiens
tgttttctactttgtgtattgggacaggaacatgacagaattacaatgtagaaaaca

SEQ ID NO: 6828347 - DNA, 79 bp, Homo sapiens
gaggcctgctgcctgctgacattctttatatttcatagcggggtctggaggggtttagagggacacatgctcaggcttc

SEQ ID NO: 6828348 - DNA, 57 bp, Homo sapiens
ggaagcagacttttgcttatttggcctatttatttggcccagttgctgagttgctcc

SEQ ID NO: 6828349 - DNA, 62 bp, Homo sapiens
attgcttataacacttgcatttgtatgagacttgagtcttgtacaacaggttttatttcgat

SEQ ID NO: 6828350 - DNA, 61 bp, Homo sapiens
ttttgggtgttcttttgagtcctttggagtacaattaattcagactatgaacacgtcagga

SEQ ID NO: 6828351 - DNA, 65 bp, Homo sapiens
caggagagatatgagtccccacctgcagaatcactgaagcagctactctggggatatcttacctg

SEQ ID NO: 6828352 - DNA, 56 bp, Homo sapiens
ttaccttggaccgggtatcagagatggtgttcttgactacccggatagccaggtag

SEQ ID NO: 6828353 - DNA, 97 bp, Homo sapiens
ttttctattttctgaaatgattctattttttaagaagtagtcagctttgttctttgctaattaagtcttcaaaggtagtgtcattcaaagtggagaa

SEQ ID NO: 6828354 - DNA, 84 bp, Homo sapiens
gacatatttttacagctgagagacaatgagtcattgcaacctttctgcatgagtttcaagttttctcaaaatcaaaaatctgtt

SEQ ID NO: 6828355 - DNA, 69 bp, Homo sapiens
gctttgcaagttatgaagctggtcctgttggcatatatgacttccaatttcagctcaaacttgtgttgt

SEQ ID NO: 6828356 - DNA, 61 bp, Homo sapiens
tctccgtatctactttcatactgtccccttttcaaggataattggaggcaagacatggagg

SEQ ID NO: 6828357 - DNA, 66 bp, Homo sapiens
gctacagaaacctttttcatacaggcaaacagatgctctccttgtatgaaaatgtttttgtgttgc

SEQ ID NO: 6828358 - DNA, 71 bp, Homo sapiens
gagttcatgtcttattttgtcttgcttggcacactgctgagtgtagagtaggcatttaataaacatgagtc

SEQ ID NO: 6828359 - DNA, 95 bp, Homo sapiens
attagagtgtggttttactctataaatttactaaaaatgagtggattgtatacttacaactggtgaattttatggtatgcaaattacacttcaat

SEQ ID NO: 6828360 - DNA, 56 bp, Homo sapiens
ccaatgtggatgtctctagtatatatttttatttatttactaaacatgcatattgg

SEQ ID NO: 6828361 - DNA, 63 bp, Homo sapiens
gaagggcttatttaccctcactgcagcccaactatgctgctctgtaatctaaagaagctcttt

SEQ ID NO: 6828362 - DNA, 56 bp, Homo sapiens
gtagcagcttcagcccaaattaccatgctgcttggaaatggcttatagcatgctac

SEQ ID NO: 6828363 - DNA, 96 bp, Homo sapiens
tgcttaaaaaagacctgcacactgtgctctgtaagggtggtggtagtggtggtggctttatccgcttgacccttactgtgcaaaaggcctttggca

SEQ ID NO: 6828364 - DNA, 62 bp, Homo sapiens
aaccaggagattaaagaaaggtgccatagaatacctatttacctttcttgatctttctggtt

SEQ ID NO: 6828365 - DNA, 57 bp, Homo sapiens
tgaatgccgcaagaaccacagaataatattaaatgactgtgttttgcagggcattta

SEQ ID NO: 6828366 - DNA, 75 bp, Homo sapiens
catcttcccgtcttctcttggaaatgccctctctgatcagagacggatgaggtagtttggagaagagccaggatg

SEQ ID NO: 6828367 - DNA, 77 bp, Homo sapiens
tggacatgtcacactgaccacatctgtaagcatcttaagttgtaactgcagatggggatcagtggctcccattttca

SEQ ID NO: 6828368 - DNA, 76 bp, Homo sapiens
cattttcctttctccagggactgaggctggagtccctggatgggcccagcctggtgcactgtggggtaggaaggtg

SEQ ID NO: 6828369 - DNA, 72 bp, Homo sapiens
cacaatattaaaaggaggacatggttacagagaagtaaatgagttcttagtgattctcttttgaattttgtg

SEQ ID NO: 6828370 - DNA, 74 bp, Homo sapiens
tcatggcttttgttttcagtaatttgatttccattacatattgagatcagagatgctaaaagagctgccagtga

SEQ ID NO: 6828371 - DNA, 68 bp, Homo sapiens
ctggaggtatgggattgatacccgtccgtcaactctctggcaaagaaggaactataatcccatttcag

SEQ ID NO: 6828372 - DNA, 103 bp, Homo sapiens
cagttttcccagcaggagatggggcgtgatgtcttttatagtgaccacagagcagatggcgcacaatacatcatccccattgggctcctttggaaatgaactg

SEQ ID NO: 6828373 - DNA, 73 bp, Homo sapiens
aatggagagaactgacctgaaaggattttgatacaaggttgttgactgttcctaaggtaagattctctatatt

SEQ ID NO: 6828374 - DNA, 96 bp, Homo sapiens
ggatggccccaggctcgactcctgtctcagtgtatttgcagtcggcataggcttatcctgcagcagctggactggcagagtctgggagccttgtcc

SEQ ID NO: 6828375 - DNA, 64 bp, Homo sapiens
cactcttgactcaggctatattctaggctaatttcagtttataaggtgccctgtgtccagagtg

SEQ ID NO: 6828376 - DNA, 104 bp, Homo sapiens
gatgtgcctgagctgtataatggcttaattaattgttggtgtttatgaagtggaaatacacatagtacaatcagttaattagttttcttcacagcctgaacatt

SEQ ID NO: 6828377 - DNA, 91 bp, Homo sapiens
gatatggtgtctgtgtgtttatttttaacgctatgaccttgtttcaagaaagatttgaaggcagctttaaaaaagatgcatgtactatatc

SEQ ID NO: 6828378 - DNA, 77 bp, Homo sapiens
gtcagtggttcttaaccttctttggttgtggaccccactgaattttccacgaccaaaaaaggtttagaaccactgac

SEQ ID NO: 6828379 - DNA, 83 bp, Homo sapiens
gtatggagaccatgtttactaccaggagaatgtactcaccctaagacagtacagtaagtccagggtaaataaatctcccatgc

SEQ ID NO: 6828380 - DNA, 55 bp, Homo sapiens
ccggcccgctcagggcaggaagtttctgttcttctctgctctgctttgcaggtgg

SEQ ID NO: 6828381 - DNA, 123 bp, Homo sapiens
cgggtggctgagccggcgggcggggcggggcgtgcaccagggccgcgggcgactagcgctgtagcagttggcctcagggccccgccgcccgcgcgcccgcccgcccgcagggcggcgcacgcg

SEQ ID NO: 6828382 - DNA, 55 bp, Homo sapiens
atatttggcctgtttggatgcaaatttttctttcctatttgaaatggccaagtgt

SEQ ID NO: 6828383 - DNA, 83 bp, Homo sapiens
ctgccaccaatctcctcacctccgtgcacaagattataaaggtcagagctctgtgctggtacatgtgaggatgcatgtggcag

SEQ ID NO: 6828384 - DNA, 76 bp, Homo sapiens
tcctgtttttgtcatatagactattgtgatgaactattatattacagatactttgtaggcaagataaacaacagga

SEQ ID NO: 6828385 - DNA, 61 bp, Homo sapiens
agctacattgtacttacaaatagtggttatataccattacacctttgaaagtatgtgagtt

SEQ ID NO: 6828386 - DNA, 59 bp, Homo sapiens
agacactgaatgtttggtggtctttttgtgatactagcaaccactgacggtcattgtct

SEQ ID NO: 6828387 - DNA, 59 bp, Homo sapiens
tcagtaggaagcattatcatcactgacatctttatgatctcatgagttgctgccactga

SEQ ID NO: 6828388 - DNA, 78 bp, Homo sapiens
gagcaggagaggaaaggggccaagagatgagactgaggtcccttcctgggctctgtctggctgctcctttcaatgctc

SEQ ID NO: 6828389 - DNA, 97 bp, Homo sapiens
ttgtagggaagataacatttttgagatagtcttgtaagaatgggtagagttaccaaagtctgaagatattcttgcagggaaaatggaattaacgcaa

SEQ ID NO: 6828390 - DNA, 80 bp, Homo sapiens
gagtctaaacatcacacctttcttagatttctggtcagttgctaaagccatgaagactatttgaaggtgcctgcagactt

SEQ ID NO: 6828391 - DNA, 59 bp, Homo sapiens
gaaaggacctgatgggaaaggcgctcggccccgggccggggccagggtcaggaccggtc

SEQ ID NO: 6828392 - DNA, 56 bp, Homo sapiens
ttctatgcttctgatcttggttgattgtactgaggcagctaggagaaagcatggag

SEQ ID NO: 6828393 - DNA, 69 bp, Homo sapiens
ttatttgtccatgtagattgtgtatctgtgaattaaactagtatttaaatctacatagagatcaaatga

SEQ ID NO: 6828394 - DNA, 85 bp, Homo sapiens
ggatggtaggcctcttgagtatgttgtgcatgggaatttgctgtcatcactcatagcaacgtgtataaactcaaggatcccatcc

SEQ ID NO: 6828395 - DNA, 55 bp, Homo sapiens
ctagtttgcatgcagttgctggtatggcactgctcagcagcctgctgcagataag

SEQ ID NO: 6828396 - DNA, 86 bp, Homo sapiens
tttatatttgagtatcttattgccctgaggcactccatccattgaaataatggtttctgtgctttagggggaagaacagatatgaa

SEQ ID NO: 6828397 - DNA, 81 bp, Homo sapiens
accacgggaccctccattaaaacagacctataaggcctggaatgaacaaatgggtcttcactgaggagaggcttgcatggt

SEQ ID NO: 6828398 - DNA, 55 bp, Homo sapiens
cacaagtctgtggtctccaacataaacttcatgctctgaggaaacaggctctgtg

SEQ ID NO: 6828399 - DNA, 61 bp, Homo sapiens
cttggctcacttccgtggagaggtgggttggcagcctacttagacatctttagtggttagg

SEQ ID NO: 6828400 - DNA, 57 bp, Homo sapiens
acctgggaacgctttgtggaggacctggtcactggttttccgaaggccagcccaggt

SEQ ID NO: 6828401 - DNA, 94 bp, Homo sapiens
cccctttccctctcgggactcctctagaagttgaggcccatgtgcgtggcgagcatcagctatctgacgagtgggcactgggagggtgaggtgg

SEQ ID NO: 6828402 - DNA, 58 bp, Homo sapiens
ctgagacatggtttgactggcatatatctttattcccatagcggactcatgtcatcag

SEQ ID NO: 6828403 - DNA, 76 bp, Homo sapiens
aaatgtagattcttggatcccatttgcctgaggttctaattcaaaggtctggaataaggtccaggaatttgcattt

SEQ ID NO: 6828404 - DNA, 60 bp, Homo sapiens
tgcctgggactgtactaaatttggaaatatcgagacatacaagactagtatcctgaggca

SEQ ID NO: 6828405 - DNA, 57 bp, Homo sapiens
aattgtgaacctttacagttgtaacaatcattaaaaacaactgtgaaggtcatagtt

SEQ ID NO: 6828406 - DNA, 59 bp, Homo sapiens
gaggatggtatgaggcaagcaaatgcagtttagagtgttatttatctcaggctatcttt

SEQ ID NO: 6828407 - DNA, 72 bp, Homo sapiens
ttgagaataaatttgtgttggttgctaagtttacagtgatttgttatggcagcaatagaaatataatcttaa

SEQ ID NO: 6828408 - DNA, 59 bp, Homo sapiens
cccacagtctagctagaaggcatggatcaattccaactgccctacccctagcctgtggg

SEQ ID NO: 6828409 - DNA, 98 bp, Homo sapiens
gagctgtgattcatgttctcctgggtcctggagggaacctgcacctggttcagagcttggcacaggtggccagtactcaaggatattggtgacttctc

SEQ ID NO: 6828410 - DNA, 63 bp, Homo sapiens
gctgggaagtggcagagctggacacaaacccagggagcgtggctccaggtctgcactcctagc

SEQ ID NO: 6828411 - DNA, 129 bp, Homo sapiens
ttccctggtgaatttgtagaatttaaccactttaaataacagtatccccatttgcaagatgaagataatatttctgctttatgactgtttggggaggattaaatgagacaatatagattaaatattgaa

SEQ ID NO: 6828412 - DNA, 57 bp, Homo sapiens
gccacctgtaagccattaggcctggaatgaaaatcaagcctgaaagctgccagtggc

SEQ ID NO: 6828413 - DNA, 64 bp, Homo sapiens
gcaaggctctgggagcaccctgaagccctcacagcctgggcctcagtgtccggagcctgagtgc

SEQ ID NO: 6828414 - DNA, 70 bp, Homo sapiens
tagggaccaaaaggtggggcagctccaggcccaggctgtagtcttggctcctgttgtcatcagctcccta

SEQ ID NO: 6828415 - DNA, 58 bp, Homo sapiens
tacacatgtccaaggtgtcacctaggtgcatgaaaccaggttttgcattgactgtgtg

SEQ ID NO: 6828416 - DNA, 80 bp, Homo sapiens
atattcttaggatttctctcttcaggtctctatctgaatacctagagctatgatgacaagggagggtcctgctagaatat

SEQ ID NO: 6828417 - DNA, 61 bp, Homo sapiens
gcggaggggccccggcgcggagcggggttcacgcagccgctagcgcccaggcgcctctcgc

SEQ ID NO: 6828418 - DNA, 56 bp, Homo sapiens
gctgttttgctagtcccacctcatgaaaactaccataaggaaaggatcaaaatagc

SEQ ID NO: 6828419 - DNA, 86 bp, Homo sapiens
ggtgtattttttaaattccatatctgtgattattagcatttcattgagctaatgagatactccagaatgggacttggattgagacc

SEQ ID NO: 6828420 - DNA, 56 bp, Homo sapiens
gtgggttgctgaagaacctactagaggcattctgagaggtgaattcagcaaaccat

SEQ ID NO: 6828421 - DNA, 96 bp, Homo sapiens
ggctggagttgaggagtggtgccacataaatggagagagttcttctataaacggagatagttcctccatttacgtggcaacttctcatcgccagct

SEQ ID NO: 6828422 - DNA, 130 bp, Homo sapiens
tccatgactcagttcatgtttccatcacctgcaccgagctcctcatttggagggtggttttattccagtggtggagcaaacaacaatccaatgggagctgcgagaagatttggaagagaattgacgtggg

SEQ ID NO: 6828423 - DNA, 74 bp, Homo sapiens
cccaaggtgctgattctgcccgtgtgtaactggaaccccgagtgtccatccagatgggaggagaagcgtctggg

SEQ ID NO: 6828424 - DNA, 68 bp, Homo sapiens
gacttgagatgcgggagaatgtgaatgagcatggagtccgtgccacaggcaatccctgcacgcaagtt

SEQ ID NO: 6828425 - DNA, 58 bp, Homo sapiens
gagaaagcccaggagcagcactgttgagaggccagctcaggagtccctgtgctctctc

SEQ ID NO: 6828426 - DNA, 70 bp, Homo sapiens
cttgtctagttcctggtgatgttctaataatacaacatatttctgatgcatttgcaggaaactggaaaag

SEQ ID NO: 6828427 - DNA, 108 bp, Homo sapiens
gaggccgacctgaaagaggtggatccccaaagcagtgatccttaaaggaacatctcaaaagagacatccaactgggggttattgcttttagtatctttttcatacctc

SEQ ID NO: 6828428 - DNA, 59 bp, Homo sapiens
ggactctgccaggtggcttctgctcagggtctcctgttgagtgcagcaaggtagagtct

SEQ ID NO: 6828429 - DNA, 61 bp, Homo sapiens
aggtatgacaaagagaggcccatgcagtgttttctaaccttgcactctctttggtatatct

SEQ ID NO: 6828430 - DNA, 77 bp, Homo sapiens
ggccctctgtgggatcacatgagttatctaactttgttctccaaataagccagcccatgtgacccctcgcaggggcc

SEQ ID NO: 6828431 - DNA, 60 bp, Homo sapiens
gagtaatattctgtactggaggctgttaagaaacatagatgcaatagacagaatatattc

SEQ ID NO: 6828432 - DNA, 73 bp, Homo sapiens
ggctttcaccctcaggaagccccagcatggccttgggcccagcttagaggcttgtgggggtttgggtgtagcc

SEQ ID NO: 6828433 - DNA, 85 bp, Homo sapiens
tgtataaaatttgtattgtctttcattttttcagattttgaaatcggaagtagcatcaaggaggatccaacacagatagtatata

SEQ ID NO: 6828434 - DNA, 60 bp, Homo sapiens
ggctggagtgcagtggcatgatcatagctcgctgtcatcttaaactcctgggctccagcc

SEQ ID NO: 6828435 - DNA, 68 bp, Homo sapiens
ccatattttgtgcaacgttctaatatgttctgcatttcttgaggcatgtcggattgttgtattcctgg

SEQ ID NO: 6828436 - DNA, 69 bp, Homo sapiens
agagatggcaactcctgactctactcactgtgtgatttgaacagtgggagaagagagttagcacactct

SEQ ID NO: 6828437 - DNA, 73 bp, Homo sapiens
tgggagatgcaaagataaaacagacgcaggctgccctccaggagctcgtgctctgatctgtctgacatcccca

SEQ ID NO: 6828438 - DNA, 60 bp, Homo sapiens
ctttcagggcaacacttctttttgattcctatgttttcatgagaaggggttgccctaaag

SEQ ID NO: 6828439 - DNA, 84 bp, Homo sapiens
gctcttttggtgggtttggttaggtatctttggaatttgggtgctccaataacatctaaaaacttataaaaacttagaaagagt

SEQ ID NO: 6828440 - DNA, 59 bp, Homo sapiens
gtctcagagagctactctcttacagagaatagtgtgcgtaggttgtagctctaagagac

SEQ ID NO: 6828441 - DNA, 129 bp, Homo sapiens
tggtgattaaaagtggattaacaatttgagtttctttcttcagggttatgagttggattcttcagcggagtatttgagccatgccttgaggcacatacttcaagttgctgcatccagttttaaactcca

SEQ ID NO: 6828442 - DNA, 64 bp, Homo sapiens
ggaggatcctgccacaggtgataactgggggctgctcagttagattctggggtaggcttctttc

SEQ ID NO: 6828443 - DNA, 83 bp, Homo sapiens
gagggttggaagaacacacataagaaactacaaagagcatctgcgagacggcttgtgtgaactgatggtgtgggccaaccttc

SEQ ID NO: 6828444 - DNA, 58 bp, Homo sapiens
ccccgcaggtgccggcagatggggtagcgaatggtcctgtgcctccacctgctccggg

SEQ ID NO: 6828445 - DNA, 61 bp, Homo sapiens
ttatctctcacttttaaggacaatttttaaaaagattcatgttttttcaagtggggaatga

SEQ ID NO: 6828446 - DNA, 62 bp, Homo sapiens
gcttagttttaagcctagaactcaagagcctaggcatcttgagttctaggcttaaaactagc

SEQ ID NO: 6828447 - DNA, 72 bp, Homo sapiens
gggtcttcctggtgaggctagaagtgtccatacacatggtgcagcttcctggtctcagccaacaaggacacc

SEQ ID NO: 6828448 - DNA, 60 bp, Homo sapiens
ctggatggggctcaggctgtggagttttagtgtcaccccagcctctgggtcttcatccag

SEQ ID NO: 6828449 - DNA, 58 bp, Homo sapiens
ggttctgtccattcagtgcagtcataatttgcatactgcttcctggatggccagcatt

SEQ ID NO: 6828450 - DNA, 55 bp, Homo sapiens
tgagagttctctcttcaggtgggaagtataaagccttctccacctgcagctctca

SEQ ID NO: 6828451 - DNA, 56 bp, Homo sapiens
atgtgatgtgcaatatcagagatgaatcgaagtggattcattgattgtagttacat

SEQ ID NO: 6828452 - DNA, 66 bp, Homo sapiens
caggaaggcaggttggggcctggctacagtacccacatagtcagtggctccgagcctggttctctg

SEQ ID NO: 6828453 - DNA, 61 bp, Homo sapiens
gtcacccaggctggagtgcagtggcgccatctcggctcactgcaagctcagcctcccggat

SEQ ID NO: 6828454 - DNA, 80 bp, Homo sapiens
gttcctagagttgcccctcttgtactagacagttttgctaaaccacagactgcggatagataggcgggggtgtggggaac

SEQ ID NO: 6828455 - DNA, 55 bp, Homo sapiens
gcttcagatttatgtatcattgattgtaacttaatgacctacactggtctgaagt

SEQ ID NO: 6828456 - DNA, 65 bp, Homo sapiens
agaagttggggttatcacaccaggaatctgggaagagactccttggtgctggagctcagacttct

SEQ ID NO: 6828457 - DNA, 59 bp, Homo sapiens
tgcatcttttattcattatgcaaatgtttattcaacattgaagggaatgcaaagatgca

SEQ ID NO: 6828458 - DNA, 58 bp, Homo sapiens
ggtccaactgacctcagctgcagggcactgtgtctccagcaggaggtgagatgtgacc

SEQ ID NO: 6828459 - DNA, 58 bp, Homo sapiens
agtgcagcccagccccagaacctttctgggaaggacggacagagggcttgggctgcct

SEQ ID NO: 6828460 - DNA, 63 bp, Homo sapiens
tgggagtgtttcactcacaggattgtgctttcttctaagagccaggtctggtgaacactctca

SEQ ID NO: 6828461 - DNA, 79 bp, Homo sapiens
gttcattaataaacactttatatgtcatggaaacttttgctctctgcaggaacatactgtgtagactttgataatgaac

SEQ ID NO: 6828462 - DNA, 60 bp, Homo sapiens
gtgaggaaaaaataagaagcagttcctcaatggagactttataaatcttaatttcctcac

SEQ ID NO: 6828463 - DNA, 70 bp, Homo sapiens
gagattcagaaaagggaactgtcatactgagttggaagaattacagaatgcagttccttattaggaactc

SEQ ID NO: 6828464 - DNA, 66 bp, Homo sapiens
tgggtcttaacagtgtggaagagattttagggaaggactctaacttgaactcatgactgtgactta

SEQ ID NO: 6828465 - DNA, 55 bp, Homo sapiens
gtgctaggaattttccttgttgattttatagggccaggagatttttccatagcac

SEQ ID NO: 6828466 - DNA, 84 bp, Homo sapiens
gaagaacagcgttgtattcttcaatatcagagcgaagtgacttcgtaaaaattctatagatgttagaaatcgttgccattcttt

SEQ ID NO: 6828467 - DNA, 60 bp, Homo sapiens
aatgtttaagaaaaatagcagcagtttcactatgctgagtgcaatttagacttgaacatt

SEQ ID NO: 6828468 - DNA, 77 bp, Homo sapiens
tgatagatgaaggtgatgagatggtaagatatacattatgactaactcttacaataccacatcacctcattatgtca

SEQ ID NO: 6828469 - DNA, 55 bp, Homo sapiens
ttgcattctggtgaggttgcctctatataagtttgctaccatcactagactgcaa

SEQ ID NO: 6828470 - DNA, 86 bp, Homo sapiens
tgggaggcatccagttaaaagtgcccacattcaggtaagcccacagctttggcttcacaccaggtatttatatttagagcctccca

SEQ ID NO: 6828471 - DNA, 85 bp, Homo sapiens
tgaggtaacaccactttatgtccaccagactgcaaaaaagtaaaaaggagctattgcgggtggggatgtagcaaagtgtctctca

SEQ ID NO: 6828472 - DNA, 68 bp, Homo sapiens
tctcccagtggtgcagaaagcagtgaattacaaagtcagtgttctggggaagctaccaacttgggaga

SEQ ID NO: 6828473 - DNA, 72 bp, Homo sapiens
gaagtgagaagcattttgagcctctaagtgaagaccttacttcagcttcaaggttcaaggatgctctagttc

SEQ ID NO: 6828474 - DNA, 71 bp, Homo sapiens
atggttaataagaatacagttcagtaatggataggttgtacccaatccatccactgatgtttctgaatcat

SEQ ID NO: 6828475 - DNA, 61 bp, Homo sapiens
gggcgtggggtaggtagacatggaggggaaaaataatactctgtgcttaactactcacccc

SEQ ID NO: 6828476 - DNA, 77 bp, Homo sapiens
ttgtttatattggtttgaatcattacaatagataagtccagaaggataagttggtgcttgattgctagtctaaataa

SEQ ID NO: 6828477 - DNA, 63 bp, Homo sapiens
ggatccctaaaagtcagcttcgacacaataatttgtgtgtaaatagtttattataggtgattc

SEQ ID NO: 6828478 - DNA, 73 bp, Homo sapiens
gtggacaggccaggacatcgtcatcatggggagtggctccctgtctccttgtgtgtcctgcccgcgtgtctgc

SEQ ID NO: 6828479 - DNA, 78 bp, Homo sapiens
agctatgagccgagagctttcctgacggttgagtggtcctttgcaatcagcagtgttttcacccacagctcactggct

SEQ ID NO: 6828480 - DNA, 55 bp, Homo sapiens
ccaagagccatcctggtcaacaccgtgttggcaggtcaaaatatgtgctgcttgg

SEQ ID NO: 6828481 - DNA, 82 bp, Homo sapiens
gggaggtcggctgtccattccatatgagctaagaggcctccctggggtccttggcctgggtggggtctcagccgcatctccc

SEQ ID NO: 6828482 - DNA, 89 bp, Homo sapiens
ctaagagaagcctcgcttcagggcatgagggacacatcctgatacaaaatggtgttgtcctcttgccctgacatacatggtttccttgg

SEQ ID NO: 6828483 - DNA, 65 bp, Homo sapiens
cggggaaaatgatccttgttgtttaaccagtgggggtgctggaaaatcaggggacattgatactg

SEQ ID NO: 6828484 - DNA, 62 bp, Homo sapiens
caaaagtcttcctattctcttatcattccataccttggagccagagtagaggtagatttatg

SEQ ID NO: 6828485 - DNA, 56 bp, Homo sapiens
accaatctagagcatccactaggtgtaacaaggtgtctggttgtgcacgggttggt

SEQ ID NO: 6828486 - DNA, 57 bp, Homo sapiens
gacccaacactttagatattcccttctgttattagaggaaatttccaaggtgaggtc

SEQ ID NO: 6828487 - DNA, 95 bp, Homo sapiens
ttcaggctccaaagtccagctgtttccatgatgccaggctgcttcctaattagtatatttaggagataactgtattttagagataaagacctgag

SEQ ID NO: 6828488 - DNA, 57 bp, Homo sapiens
tagtagcaccagtcatatttgaagtgttaaacagccacatgtggcttgtagctactg

SEQ ID NO: 6828489 - DNA, 72 bp, Homo sapiens
agcgtggggggagcacagcagagcatggcttgggtttttactaccagtaattgcttgtgctgtccctgtcct

SEQ ID NO: 6828490 - DNA, 60 bp, Homo sapiens
tatgcattatcgtcttgatcctctatataaaactgtacaggcataatgatgataatgata

SEQ ID NO: 6828491 - DNA, 70 bp, Homo sapiens
tttaagggatttggagaccaaggcttcatacacatgcaatcagaggcttctggtgtcagtattctttgaa

SEQ ID NO: 6828492 - DNA, 72 bp, Homo sapiens
ctgggtgttttgtgttgtaatgtcagctatacctcaataactggtgttagtgcatataactagaataccaag

SEQ ID NO: 6828493 - DNA, 74 bp, Homo sapiens
tttgtggctttgaggatttaatactcataagccattgcaggggcttatgatctttggatctttgatgtcatgga

SEQ ID NO: 6828494 - DNA, 60 bp, Homo sapiens
ctctctatggatgcagtttttctctccattctacaaatgaggaaactgaagcccagagag

SEQ ID NO: 6828495 - DNA, 80 bp, Homo sapiens
tgaaagagtacataacaagaataccagatttttaaaaagagattgaatttcttgttctggttctgttagcaattgtttca

SEQ ID NO: 6828496 - DNA, 85 bp, Homo sapiens
tcagatcgtagggaacaaaagagcttggtgcacagtggttaatatcgtcaatgtatcatacaccaggctctgtctaatcgactga

SEQ ID NO: 6828497 - DNA, 59 bp, Homo sapiens
ggcagattccaagagcctgagaagcgctgttcctgcctctcaggctcttggaacctgtt

SEQ ID NO: 6828498 - DNA, 60 bp, Homo sapiens
ggctgacattccctgtgaaactttagaaagtttctgtaggttttgcagtagtgtttagtt

SEQ ID NO: 6828499 - DNA, 84 bp, Homo sapiens
tcctgagccactgtgctgggtccttcttttgagtttctgattagtctttcgaaggaggcactcagacatgcatctatgtcaggg

SEQ ID NO: 6828500 - DNA, 87 bp, Homo sapiens
aggtaaactgtgtggatagttttttagtatgagtctcatgcaatatttgggacatatttgtactagaaaattattctttgttcacct

SEQ ID NO: 6828501 - DNA, 84 bp, Homo sapiens
cacaggtgcccgccaccatgcctggctaatttttgtattttttgtagagacatatatattgcccaggctggtttctaacttgtg

SEQ ID NO: 6828502 - DNA, 70 bp, Homo sapiens
tggctgtttcatgctgtgtctacaacttaaggccatttcttccaggtagtagatgcaatatgtacagcca

SEQ ID NO: 6828503 - DNA, 67 bp, Homo sapiens
ctgcaggaatcagaggggaagcgggcgcctcgaaacctaccacttgctccccagggaccgtcctcag

SEQ ID NO: 6828504 - DNA, 77 bp, Homo sapiens
ggttattagttaagagagcaaaatctggggatagtctgtcttgttcaaatcccatctgcatttctaactagttgacc

SEQ ID NO: 6828505 - DNA, 72 bp, Homo sapiens
gtgtctaagctctttctgaatatttgacctcaccattgtgacattgtaggttaagcggaggtgtctggacac

SEQ ID NO: 6828506 - DNA, 59 bp, Homo sapiens
ctcaatggctagggcctttaacgagtattatatacttccaagaaggtgctagcagagag

SEQ ID NO: 6828507 - DNA, 85 bp, Homo sapiens
gggactggacaagaaatggataagcagcttttgagcagtaacatggctaatcaggaaaatactgcttatccatgagctagggccc

SEQ ID NO: 6828508 - DNA, 65 bp, Homo sapiens
atccactcttgcctgcaatgaggaccaaggcaaaaagagttggctgaatctgcagcaggaaggat

SEQ ID NO: 6828509 - DNA, 61 bp, Homo sapiens
gggcctctggcctaggccgggagagccctgattctcgcctgtccctgggccggagctgcct

SEQ ID NO: 6828510 - DNA, 71 bp, Homo sapiens
cccatgccctaaaggactggcagtatatgacataaacacaataatcttgcacacttcctttaggccatagg

SEQ ID NO: 6828511 - DNA, 76 bp, Homo sapiens
actacaaaaggctgagtaaaacagagaaccctgaaaaaagagttattgtccatttatttagcacagtttctgtggt

SEQ ID NO: 6828512 - DNA, 58 bp, Homo sapiens
ttcctgtgtacgtgtttcgctggagggaactgtcccagaatcaatatttgcataggaa

SEQ ID NO: 6828513 - DNA, 78 bp, Homo sapiens
gactctcacactttagtatgaagaggtaggccacttctgtaagcctgattcctgactttttgctgaagagactgagtt

SEQ ID NO: 6828514 - DNA, 61 bp, Homo sapiens
gatgaggctgtgtctgcacaagcatgggctcctccttcctttgccgaaatatgccgccatc

SEQ ID NO: 6828515 - DNA, 82 bp, Homo sapiens
ctgccaccattaatgaactaaatcagcctttgctattttatgatctgtctcattaaaatggagttgattttctctgtggtag

SEQ ID NO: 6828516 - DNA, 83 bp, Homo sapiens
tgagattcacgtgccagaagattctctatcagatgagggcctgctgcctggttcatagacaccatcttctcattgtaacctca

SEQ ID NO: 6828517 - DNA, 77 bp, Homo sapiens
tctctgctgtttaagtcaaccattgtgtggtatttttgctacagcagcataaactgactaagacaatgagcatgaga

SEQ ID NO: 6828518 - DNA, 64 bp, Homo sapiens
actgtcacccgggctggagtgcaatggctcgatctcggctcactgcaacctccacctccccagt

SEQ ID NO: 6828519 - DNA, 59 bp, Homo sapiens
tgctgggcctgcccctgtcagccaatctcctaggccctcgatctttgcaggtccatgta

SEQ ID NO: 6828520 - DNA, 67 bp, Homo sapiens
tcctggtcccagaattggttagcacaagacatgggaattctattggtttcaattcttgggactggga

SEQ ID NO: 6828521 - DNA, 115 bp, Homo sapiens
tgttttgtaatagtttattttttaaagaggtatgtaatatttgcatttcttttatatactttggagaaaaagaaatgacaaggacattcctgtagggaaaaaattatgcacaata

SEQ ID NO: 6828522 - DNA, 56 bp, Homo sapiens
tactgagtggcaaaggcaagaagactagccaagtatctgttcttggtactcacgtg

SEQ ID NO: 6828523 - DNA, 61 bp, Homo sapiens
agaaatgtgagccccttatcaagcagattgctgcccttgtcaagtaaggctgacatttgct

SEQ ID NO: 6828524 - DNA, 106 bp, Homo sapiens
atacatgtggtaagattgcttgatacccagtcaatctccattctccccttcctccttactaaaagaacctgattgttggtggtatcaatatatctgactaaagtat

SEQ ID NO: 6828525 - DNA, 59 bp, Homo sapiens
ccatttggtgggtctagttgggattacactcttcagctctcttccagatccacttgagg

SEQ ID NO: 6828526 - DNA, 68 bp, Homo sapiens
aaagtttgaggggtattttaccacttactcagtgttagctttcagagactaagatacccctctatttt

SEQ ID NO: 6828527 - DNA, 81 bp, Homo sapiens
tctgaaagattggctttatacataagaataaggactatatccatcaatttctttttcttatggtgaagcacaaatgtcaga

SEQ ID NO: 6828528 - DNA, 97 bp, Homo sapiens
gattgactccaattttaaagaagttctactgtgggtaaaatgttataaaatagcatgacgtgccacagagaaccttttatgaaagtaagagtcaatc

SEQ ID NO: 6828529 - DNA, 62 bp, Homo sapiens
atctggaggcattactctgtcttgctacatagcctttcaggactttctaatgctctgtagat

SEQ ID NO: 6828530 - DNA, 84 bp, Homo sapiens
tctttagctttcagtctctgaaggaacaaaatcaaaactgcttgaacaagtatcccggctggaggaaaaactggaggctgtgga

SEQ ID NO: 6828531 - DNA, 68 bp, Homo sapiens
ggccaaggatggtggctctggtaaatctcatactctagtaatggagctccccaggctacttcttggcc

SEQ ID NO: 6828532 - DNA, 63 bp, Homo sapiens
agctgataggtgtaggatacactcacaaccctaaagccaggtatcaaacagacactgtcagct

SEQ ID NO: 6828533 - DNA, 60 bp, Homo sapiens
agtccagatgtataatctcatccctgaacatttctgatggtgtgattatgacatgtgact

SEQ ID NO: 6828534 - DNA, 62 bp, Homo sapiens
ctaataattggctatcattctgaaattctctggagagcttttcaggctgatgtcgatgttag

SEQ ID NO: 6828535 - DNA, 81 bp, Homo sapiens
ctcagttatagcttactaacatttgtgtatgtcttggtggaaacatgagtcacaaataatgattagtttggaaagactgag

SEQ ID NO: 6828536 - DNA, 69 bp, Homo sapiens
gctggccgtgccacttacctgggaggagttgatttgagggacttctcttcataggtggcaatggcaagt

SEQ ID NO: 6828537 - DNA, 84 bp, Homo sapiens
gtaaggagatgatggttaattatgagaaagggaaaaggtaggcagatgcctggcttcctgctgataatcccctcttcttctcac

SEQ ID NO: 6828538 - DNA, 84 bp, Homo sapiens
tttggaccgggcaaggtggatcatgcctgtaatcctagcactttgagaggccgaggcaggcagatcacctgtcaggagttcaag

SEQ ID NO: 6828539 - DNA, 59 bp, Homo sapiens
tggtcattcacaagttcagggatgccagaaatggcatttagtgacctgaactgaaacca

SEQ ID NO: 6828540 - DNA, 62 bp, Homo sapiens
gaagtttgcaggcttccaattgcagggtcattttggggtgctttcttgcctgtactaatttt

SEQ ID NO: 6828541 - DNA, 88 bp, Homo sapiens
aatatcaagaggtggcactcactggtgccatcttgaaagctggctactaccttcaagatggccccagtgagccccacctcctgatatt

SEQ ID NO: 6828542 - DNA, 82 bp, Homo sapiens
gctggagacttggccaagatggctggaaggctagactcagctgggactgtctgctagaacatctatacgtggccattccagc

SEQ ID NO: 6828543 - DNA, 111 bp, Homo sapiens
attcttcaacagcttttcagtttggagttaggatttaataaaagaatagatgtacagctcttgacaatgtattctaaatacatcttacctttggttcagactttggaggat

SEQ ID NO: 6828544 - DNA, 67 bp, Homo sapiens
ttcacctcatcagtcagaacttaagcttgttacaattgcagcatgtttaagcccattgagagctgag

SEQ ID NO: 6828545 - DNA, 107 bp, Homo sapiens
gctgcggaccgccggccggccggccgcccgccccgctcgcgcgccgcggcccgggcgggggttctggctccgcggggcggcccggccggcagagcccgctcggcagc

SEQ ID NO: 6828546 - DNA, 63 bp, Homo sapiens
atgatccacatctggtccatagaaagcattcttacaccctctcactccagatgtgtaggtcgt

SEQ ID NO: 6828547 - DNA, 96 bp, Homo sapiens
ccctggccaagttctgcagcctctcggggcctggtcctgtgtctgtgaggcaggacacacccagctcacgggggtgctgtgggtgtgggggcgggg

SEQ ID NO: 6828548 - DNA, 83 bp, Homo sapiens
taagactcacattcccagggataaaccccagcagatgggatgctaatccatcacaaagggttttctctgagaaggagatttta

SEQ ID NO: 6828549 - DNA, 58 bp, Homo sapiens
taaaggagtgtgatgaaagggaccggataattcttttcctatttctgtgcctcttttg

SEQ ID NO: 6828550 - DNA, 80 bp, Homo sapiens
gataaaacatagttcagagcagcagacctctgaaaaaagagaactgtcacattgctttaaaagacttgaaatgtattatc

SEQ ID NO: 6828551 - DNA, 56 bp, Homo sapiens
ttgagtcttatttccttggcaatgatttttttgtccttggtaaggatgaagagcaa

SEQ ID NO: 6828552 - DNA, 62 bp, Homo sapiens
cagagatttcaggaatttatggccagaattcaatctggctagagaactttgaagtagctttg

SEQ ID NO: 6828553 - DNA, 56 bp, Homo sapiens
tcctccccaaagcccagcctggctggggtcacggtcaaatgctggcggtgggggga

SEQ ID NO: 6828554 - DNA, 83 bp, Homo sapiens
ctaatattcataaaatgcttactatgtgcaaggtgctgtgtaattcagttcacacaatgttaccttgaagtaagtattgttag

SEQ ID NO: 6828555 - DNA, 59 bp, Homo sapiens
cacacttttgtttgaagtctccacactagaacctgtgtgttggaatctgtaaatgtgtg

SEQ ID NO: 6828556 - DNA, 58 bp, Homo sapiens
gcctgggtgattccacagtacagtgaggctgagactcctggctctgttgtcacccggc

SEQ ID NO: 6828557 - DNA, 129 bp, Homo sapiens
gtttgagaggatgaaccctgcaggccatgtccacagttctgagaggccacctgcttttgcctttgttgactggtggtagaactccagttctgtggcaaggggcagccacaccatttctctctcattgac

SEQ ID NO: 6828558 - DNA, 55 bp, Homo sapiens
gaaccatgagaaattgctatttttaaagtgaaatagtagtaatttcctatggatc

SEQ ID NO: 6828559 - DNA, 64 bp, Homo sapiens
tcacttgaacccaggaagcagagccaaggtcgcaccattgcactctagtctgggtgacgagtga

SEQ ID NO: 6828560 - DNA, 67 bp, Homo sapiens
gtgagtttagtgataagaattatgaaaatgactttcattttcatattgtagtttgtcttacccttat

SEQ ID NO: 6828561 - DNA, 67 bp, Homo sapiens
ggtcagagtatggtcatataagtaccataacatataggttacagtacctgtatggccactgcagact

SEQ ID NO: 6828562 - DNA, 81 bp, Homo sapiens
gagccgggggtccgcggggagtggttgcctgtgatccccattgcccgggcaggcatggccactccctaggccccaggtctc

SEQ ID NO: 6828563 - DNA, 77 bp, Homo sapiens
gttgtcttctgcagtctagatgtttcctgttggattggcccaagtgggataggtaggcagggagcagagaggatagc

SEQ ID NO: 6828564 - DNA, 63 bp, Homo sapiens
tctcttcacattcctggcaaaccacatcagcacccaaattaggtttctgagttatgggagaga

SEQ ID NO: 6828565 - DNA, 114 bp, Homo sapiens
ggaggaataatatctagccacttggttaaaatttcaagtgtgcaaaatttcccactgtggaactgggaaatgttggacacttgaaattttaacctattggctagacattcttct

SEQ ID NO: 6828566 - DNA, 86 bp, Homo sapiens
tctcttggaagcgatggtgtctgagcaaaaacccggagggtaggaaagaatggggagctctctgggttcagaacagcaagcagaga

SEQ ID NO: 6828567 - DNA, 67 bp, Homo sapiens
tcactgatactatagagacctcaaaaagaatgaatgaccttcagtgagatctttgtagtatcaatga

SEQ ID NO: 6828568 - DNA, 66 bp, Homo sapiens
tgtaatcccagctactcgggaggctgagacaggagaatcgcttgaacccgggaagtggaggttgca

SEQ ID NO: 6828569 - DNA, 58 bp, Homo sapiens
cttcaagtcgccaaatgctgaattattctgcatcgaaagcgcagtagtggcactggag

SEQ ID NO: 6828570 - DNA, 64 bp, Homo sapiens
ctcatataagtggaattatatagtacttgtccttttgtaactggcttatttcacttagcatgag

SEQ ID NO: 6828571 - DNA, 93 bp, Homo sapiens
ctgcccggaccccagttgcgtaagacacggggaccttcacccatttgttcattcaacaaatggcaggctctttgctagttgctagggtggcag

SEQ ID NO: 6828572 - DNA, 98 bp, Homo sapiens
catcatttagttgaatgcaataaaaaatgcagctagtatgagaaagtcttgattcttgtgtggaactgcttttctaggtgctttaaaattgactgatg

SEQ ID NO: 6828573 - DNA, 93 bp, Homo sapiens
atttttctgcaatttgatagggttgttttgtaacttacggtcttaaaatttcttgagaatttttggcagaaacaaccttcagtgtataaaagt

SEQ ID NO: 6828574 - DNA, 83 bp, Homo sapiens
ggctacgggtatcttccaggaacagatgaaggttgcgaaataactgccaactgtcttctgctctggcagttatcccgttagcc

SEQ ID NO: 6828575 - DNA, 83 bp, Homo sapiens
ggggccgtgggctgtccatgaccttgtacaaccaggagattccccttggctgcagcccctatcgcggacaggtccacgttcct

SEQ ID NO: 6828576 - DNA, 55 bp, Homo sapiens
gagggcagagacagtgattcaccaacagcacaggtggatccctcctttaactctc

SEQ ID NO: 6828577 - DNA, 63 bp, Homo sapiens
accctctggctcatttcctagtttaggtcaactcttaggtggcaatgcttaagctctgagggt

SEQ ID NO: 6828578 - DNA, 88 bp, Homo sapiens
gcacagtgggaaggcggccattaagctttgttgcagcagcactggctgtgcttcaagttcttaatgtttttctcttgccatctgatgt

SEQ ID NO: 6828579 - DNA, 65 bp, Homo sapiens
ggtactgacatgtattagtacatatggtgctgataatacatcaaggtgctaataaatgtacaacc

SEQ ID NO: 6828580 - DNA, 59 bp, Homo sapiens
gtagtgtcccaggcagcgttctcccgtgtgcaaagggttaaatgtgcttgggagactgc

SEQ ID NO: 6828581 - DNA, 83 bp, Homo sapiens
aggtattgtgcatcaatttcccatgtgtcagagaaaggaacagtttagccttgacaccaagaggtctgcacacacaaatacct

SEQ ID NO: 6828582 - DNA, 56 bp, Homo sapiens
catgaattagcaatggtgtgcagggaaggaaccagtatcaccacagctcgttcatg

SEQ ID NO: 6828583 - DNA, 66 bp, Homo sapiens
tttgtgttgttttaagccactacatttttggtaatttattgtaggagcaatataaactaacacagg

SEQ ID NO: 6828584 - DNA, 96 bp, Homo sapiens
cttttacctcatcctcatatatctagaatattctaatggttaagtcctttctctttcccaagttaaagatccatgggaatgtttggcaggtgaaag

SEQ ID NO: 6828585 - DNA, 86 bp, Homo sapiens
caaacaggagccaccatgaggtcagggggagccggtattgaaagccccgagtgccaggcctctgctacgctcagtccttctgtttg

SEQ ID NO: 6828586 - DNA, 99 bp, Homo sapiens
catgtgtgagaagccctggcctagatggcaagggggcccatggtgtctgctatgttgactcaggtcaccctgctgtttgtccattccttctcccacttg

SEQ ID NO: 6828587 - DNA, 77 bp, Homo sapiens
ctccttgccttgattccagcaacccaggaattcagagttagtttcagagtttaggtttttgtggatcgggcaagtgg

SEQ ID NO: 6828588 - DNA, 78 bp, Homo sapiens
catgcagtagcttagaggtagcaacaggactagaatccatttctgatgcctgattcactgccatcccagctctgtgtg

SEQ ID NO: 6828589 - DNA, 61 bp, Homo sapiens
ggggcctttgagaggagagtaatacaggtcaattctcaagatctgttattgtcagagctcc

SEQ ID NO: 6828590 - DNA, 77 bp, Homo sapiens
attttaagaagaatcaggcaaatttctttttctctctcatctagaaaggaaaggattggcttctctgtcattaaaat

SEQ ID NO: 6828591 - DNA, 72 bp, Homo sapiens
cttgggacattgaagctggaaagggaattccaggccaggaagcccaaggtcccttgtacagagtgacccgag

SEQ ID NO: 6828592 - DNA, 67 bp, Homo sapiens
ctttaaatctctggcagaaataaacttttgaataatattaaagtttggtccctccacggatttaaag

SEQ ID NO: 6828593 - DNA, 87 bp, Homo sapiens
ggccagccgcagcttggctgggatggtatggtggtccataaggcctcgtgggctgtccagctccagccagccagcctcggtgaagcc

SEQ ID NO: 6828594 - DNA, 64 bp, Homo sapiens
agtccataacttcagagtgtcagcaacaggaatgcaagacagttgccacctagaagtatggatt

SEQ ID NO: 6828595 - DNA, 67 bp, Homo sapiens
ctgagaggggaccagggtgtttcttggcagtccctcctggaccctgcctgcccttgtctgccctcgg

SEQ ID NO: 6828596 - DNA, 58 bp, Homo sapiens
aacatttgtgaagtacttagattatgccagaacgtgctatatacttttcacagatgtt

SEQ ID NO: 6828597 - DNA, 110 bp, Homo sapiens
tgcatttagtagagccagaacttcagctgtaggccaatgcttttcaataccctcttggttgaaagcattagtctaaggtagagaagactagttttggtaggaatgaggca

SEQ ID NO: 6828598 - DNA, 71 bp, Homo sapiens
aggcttggctcagctgggactgttgagcaaagggcctgcacatggcctctccagcctagcagatcaaggct

SEQ ID NO: 6828599 - DNA, 71 bp, Homo sapiens
gcaagacaatctaggtttccagtgcggctggagtcccatgctgcagtctcaccagacctattttgagttgc

SEQ ID NO: 6828600 - DNA, 77 bp, Homo sapiens
ttctagtctctcaatgtaaatttgctgcccaatgtttataggtaaacacatgcaggtatacatgttccagagaagaa

SEQ ID NO: 6828601 - DNA, 57 bp, Homo sapiens
ttcttagaattttaatccagaaagcctccaaagatgtttaggatgggagtctaagaa

SEQ ID NO: 6828602 - DNA, 119 bp, Homo sapiens
tctcgccacccccagaggccatggggcagaaggcctcccagctcctgaagcttaagcatgctttctgcagggggctgaggctgttctgaggactcacattggcctcatccgtggcgagg

SEQ ID NO: 6828603 - DNA, 80 bp, Homo sapiens
gcttcctgaaacagggcaaggcagcccgctgaaccacatttgtggatgtgagggaggagctgccctgcgttttgggaggc

SEQ ID NO: 6828604 - DNA, 86 bp, Homo sapiens
atggtattacactgcctgagccgcggggcagtgctctgactgtagcttcctgcttctgacatgttcttggttggtagtgttgctgt

SEQ ID NO: 6828605 - DNA, 74 bp, Homo sapiens
gtgaggtgagggtgcacccagagcagattcgttcccgatgcaccagggcctgtgctgggtgttccgcacttgac

SEQ ID NO: 6828606 - DNA, 92 bp, Homo sapiens
ctggcctttatttttctggttgttcatactccaacagctagcaccgtacgttggggtccaatgaagcgagcagcagtagatggcatggccag

SEQ ID NO: 6828607 - DNA, 65 bp, Homo sapiens
tcgcggaccagagcgctctgacgtctccctatagctaaccggggcgctgggacgcccggtccgga

SEQ ID NO: 6828608 - DNA, 55 bp, Homo sapiens
tcatgatgtcacagagaagcacagttgattgtgctctacctcagtgtcattttga

SEQ ID NO: 6828609 - DNA, 73 bp, Homo sapiens
cccttagcaaactctgttagattctgctcattcacttgacactatctcccaccagagtatgagttattgaggg

SEQ ID NO: 6828610 - DNA, 127 bp, Homo sapiens
aagatgagagagaatctattttaaaatgtcaagcacattgcctggcacataggttttaacatttaaggcatgaatctaagtgtacaatatgtttgtgtcttttgaaatataaattatccatcatctt

SEQ ID NO: 6828611 - DNA, 59 bp, Homo sapiens
caggagcaaatccaaaagaattttagtaaaagacaaatctctttttctggttgcttctg

SEQ ID NO: 6828612 - DNA, 87 bp, Homo sapiens
aagtttctaatgtgttgtgtgccagttactaacacctttggctccatgtcggagttaaatgtcagtagcttaaccataagggaattt

SEQ ID NO: 6828613 - DNA, 129 bp, Homo sapiens
cagtaagtggcagaggaagcatgtaaacccaggtctttgactaatatgcttgctcctggtaaacgtccataagtattcagcgattagttcaataagggcccttatcttcctctgtgcctgtgagaactg

SEQ ID NO: 6828614 - DNA, 118 bp, Homo sapiens
tctgatctctggactttgaaaattaggttagtttcctatgccaggtccccaagccagggaacttggcttaaagtagtgatcgctatataataattttaagcggagtatgatgttcaga

SEQ ID NO: 6828615 - DNA, 69 bp, Homo sapiens
gagggggctctgtcaaccaggggacactagtggggacaggtgtgtagctcctggctgcagggcctcctc

SEQ ID NO: 6828616 - DNA, 75 bp, Homo sapiens
ggtgactgagggaagagggtttgaattcaggtcattgaaacctgcaatccagcatctttttcacaacctcatgcc

SEQ ID NO: 6828617 - DNA, 85 bp, Homo sapiens
ctcttggtacctgtggttgtgtcaagtgtatagcaggtgagttctaagctgctgtgcactaaccacacccacgggtatgcaaggg

SEQ ID NO: 6828618 - DNA, 112 bp, Homo sapiens
cagctcccaggccatgcctttccctctgtggttggttctgtccttcgtggcccccctcagtgcagggttcatggactgggctccaagagggagaggggagggcagggagctg

SEQ ID NO: 6828619 - DNA, 59 bp, Homo sapiens
gggaaaatggccagtggggttgagcaggacacaggtcctgctgtgtctagctggttccc

SEQ ID NO: 6828620 - DNA, 76 bp, Homo sapiens
gtgtgtgtgtgtgtgtgtgtgtgtgtgtgtgtgtgtgtttgcatgcacacatgtttacaagcatctaaaaacacat

SEQ ID NO: 6828621 - DNA, 77 bp, Homo sapiens
attttgaaatattgtcagaaaaataagtgggagccacattttggaggatattgcatttctgacagagtgctcagagt

SEQ ID NO: 6828622 - DNA, 55 bp, Homo sapiens
gggctccagttgtccccaggatccctcccccgacccgggggcccccttggtgcct

SEQ ID NO: 6828623 - DNA, 58 bp, Homo sapiens
ttgttagcaaagtcccacagcttcaggggaatcctgcctgtgggcccttggctggcaa

SEQ ID NO: 6828624 - DNA, 66 bp, Homo sapiens
ctttgttctctggactctcacttctatagggaagctcccaaaatgggaatgacatctagagcagag

SEQ ID NO: 6828625 - DNA, 72 bp, Homo sapiens
gctggctgggctgcggctgtacctgctgacttaactgtccagttattcccaggaccgcccaccccagctggc

SEQ ID NO: 6828626 - DNA, 72 bp, Homo sapiens
gtgggttattggggacagtctgatcaatccataaatacttattgaacatctgtgaactccgaaaattaccac

SEQ ID NO: 6828627 - DNA, 67 bp, Homo sapiens
aggggggcttctctgggagtcctggttggtcctgagacagggacaccctcccagtgaagccctacct

SEQ ID NO: 6828628 - DNA, 121 bp, Homo sapiens
agcacaggccacacctgcgtctgctcacagcaaggccctgcaacctgacttgggtcttttccccaagtgatagttggtgcagcctaattgtgatcagatggggggtttcacaggtctggct

SEQ ID NO: 6828629 - DNA, 55 bp, Homo sapiens
actgaacagcctttcaaacttagctttgacagaatggttttgaaaggatgtcagt

SEQ ID NO: 6828630 - DNA, 70 bp, Homo sapiens
gctctgaacctgtgtcttggccactaggagtgccacacctggcactgccccctgcccaggacttcacagc

SEQ ID NO: 6828631 - DNA, 62 bp, Homo sapiens
tatttctaccacctgacttcatctataaactccgtggatgtgtctttcaaggtatagaaata

SEQ ID NO: 6828632 - DNA, 80 bp, Homo sapiens
ggtcacagtggagttggggtagccctagaatgaaccaaatagaggttaaggggtcagtaccttatacattgatgttgacc

SEQ ID NO: 6828633 - DNA, 59 bp, Homo sapiens
ccaccctctctccaagggaaatcctagttccctaatttccaaattggtggaggtggtgg

SEQ ID NO: 6828634 - DNA, 97 bp, Homo sapiens
tttgggtttagtagtcctggaggagccaggagggaagtccaggtagtctgattccactgtctgtcctgctctccgtgaccttaaactgtctcccaaa

SEQ ID NO: 6828635 - DNA, 60 bp, Homo sapiens
gcactgcatctactggcaagtacagtctgtttctgactgacttcgtctatgatgctgtgt

SEQ ID NO: 6828636 - DNA, 126 bp, Homo sapiens
tggcacatttggcatctggtgagggagtctttctggttcatggatgggcccagctctgtcctcacatggtggaaggagctagctctccgtggtctcttttatgtgggtgctaatttcaacctccca

SEQ ID NO: 6828637 - DNA, 64 bp, Homo sapiens
gcttgagcccaggagtttgaggctgcagtgatctatgatcatgccactatactccagcctaggc

SEQ ID NO: 6828638 - DNA, 76 bp, Homo sapiens
gggttccaagagtaagtgtcccgagagagagccaggcggaagccactgcatctcttctgacctagccttggaagtc

SEQ ID NO: 6828639 - DNA, 76 bp, Homo sapiens
acaataacctaaactctgcattcttttaaaatgttgcttaagttattttgatttgttggagagtttattgtgttgt

SEQ ID NO: 6828640 - DNA, 61 bp, Homo sapiens
ttgcaaatatgttctcctattctgtgggttgtcttcacttacttgacgatatcatttgcaa

SEQ ID NO: 6828641 - DNA, 66 bp, Homo sapiens
cgggctgcagggctgtggtctggagtgcggacagtaccagctcccactgctgtcctgccatgcttg

SEQ ID NO: 6828642 - DNA, 95 bp, Homo sapiens
gaagtttcatagctttaatgagattcttgctgtggtctttgatctgtagatcaaaggcaaaattcttagcaggatccagaggctcaagaaacttt

SEQ ID NO: 6828643 - DNA, 95 bp, Homo sapiens
gtccaggggcagagctgagccagggttgcagggagccagcagaaggtggttcccagctgccctctccagccctgagctgagcccactctctggac

SEQ ID NO: 6828644 - DNA, 80 bp, Homo sapiens
agacatagggaggcatataaatattttgaccttcaatgataaaatgggtagctgatcttttaagtgtcatttttatgttt

SEQ ID NO: 6828645 - DNA, 85 bp, Homo sapiens
tgtgctgcccctttttcaacagaaaacagtttgcttgcaatctgcctgcaggctgccctcttgtgttgaaatagggaaatgcata

SEQ ID NO: 6828646 - DNA, 94 bp, Homo sapiens
agatctagtgcttatcctagaatcagcccttgctgcctatgatcttcttgatccagtccaggtagcggcagatgttggtatagacgccaggttt

SEQ ID NO: 6828647 - DNA, 72 bp, Homo sapiens
cttcgaccttgcaactcatggtcacataggtgttggaaaagaatgtgtttatgagttacgtaggggttgcag

SEQ ID NO: 6828648 - DNA, 72 bp, Homo sapiens
aagtgaattcttcccttgctacaggataaaatatacagacagtaatgattttaggtagcaaaggagttactt

SEQ ID NO: 6828649 - DNA, 98 bp, Homo sapiens
atgctgggagggactgagtgttgaatagacgctttgaggctctggagagggcagacgtttcccaggccctcagggctgccactcagccacctcggcat

SEQ ID NO: 6828650 - DNA, 90 bp, Homo sapiens
ctggtgttttattgtctatgaactgcttggggggtggtcagggagggagctcgcctaacaaatataacatttatagaatagtagaaccag

SEQ ID NO: 6828651 - DNA, 66 bp, Homo sapiens
ctagttacaattatgcatggaaaagcagctaggtgaagcttttcttcttgtgtctattgtaattag

SEQ ID NO: 6828652 - DNA, 82 bp, Homo sapiens
gctctgagcagatgctcgctctcccatccatcctcagaacaggtcagggctggggaggagagacgtccactgctcactcagc

SEQ ID NO: 6828653 - DNA, 63 bp, Homo sapiens
gttgggtcagagcagagctggaatctgcctccctggatctcgtgcttctctgctctacccggc

SEQ ID NO: 6828654 - DNA, 63 bp, Homo sapiens
ttcttaatgttttattgtaagaggactggaaacaagtgttctgataggcagaaggcataagaa

SEQ ID NO: 6828655 - DNA, 58 bp, Homo sapiens
tgcagtggaggccgtgagacagacatgggttctgtttgttcttatggacttcccttca

SEQ ID NO: 6828656 - DNA, 79 bp, Homo sapiens
gctgatgaagactgatgctaaatgggccgtgtgcttcctgtggctctaatggaaatcatggcgtgtttagcttaatggc

SEQ ID NO: 6828657 - DNA, 58 bp, Homo sapiens
ggcttgcattgtcagaatgactactgatttcccagtaaatgtttataaaatgcatgcc

SEQ ID NO: 6828658 - DNA, 66 bp, Homo sapiens
gacctctgtccattcagaatggccctggaactaggtcacaggagccattgcaggatggcagagctc

SEQ ID NO: 6828659 - DNA, 77 bp, Homo sapiens
aggaaagtagaatgaggagctgtagatcctctcacaggggacatctccagagatctccatgcccttataattctcct

SEQ ID NO: 6828660 - DNA, 55 bp, Homo sapiens
aggcaacatgggccaggcagaaatggaattctttgctttcaggtcccttttgtct

SEQ ID NO: 6828661 - DNA, 63 bp, Homo sapiens
tccagtttatttttggcagggtctataaacccaaatttcatttctttgctaaactggactgga

SEQ ID NO: 6828662 - DNA, 66 bp, Homo sapiens
atgatactctaggtgatttacagtttagtttcatattatctgctacaaatacgctgggagtgtcat

SEQ ID NO: 6828663 - DNA, 66 bp, Homo sapiens
ctgccagctcgccacaatgacacataatgatttttgcaaagtgtgtgtcaaatgtcctgagcttag

SEQ ID NO: 6828664 - DNA, 67 bp, Homo sapiens
ggttagtggtggcaagctctcttcccttcaacgatccctgaccaattctgagagctgctacctagct

SEQ ID NO: 6828665 - DNA, 55 bp, Homo sapiens
ggaatgcagtaagtgatttgaattaagccctgtattcaatctcttttctgcttcc

SEQ ID NO: 6828666 - DNA, 75 bp, Homo sapiens
tgcactccctcacagtagccatgtctcaagtactcagtagtttcatgtggctaatggctattgcatgggacagca

SEQ ID NO: 6828667 - DNA, 125 bp, Homo sapiens
gcatcatggttcagaagagggattacaaatgccatgtagtcagtgcaaatgctatgtggtcagtccccatagcaaaacccactgcattaccggatgagatccttgaggactgaaccagaggaagc

SEQ ID NO: 6828668 - DNA, 89 bp, Homo sapiens
agtatcctcctctgtggaattctgtagctcttcctctggtaactgctttcactaaaggtttgcatggaatttacctagacaagggccct

SEQ ID NO: 6828669 - DNA, 79 bp, Homo sapiens
ctttggacctggaaaatgatgtcttgattttgtgcattggcatcatggcaaaattaaacttagcatcatgtagccaaag

SEQ ID NO: 6828670 - DNA, 76 bp, Homo sapiens
agattgcaaagttgctaataaagtttttatgtggtaacaatgccacttgtagaacttgtattgtaacctcaaatct

SEQ ID NO: 6828671 - DNA, 86 bp, Homo sapiens
ctctgcagctcacactcccgcaggagcagctcgcagctccggaagctgtccctgagcaactcctgtttggaggctgagagcaagag

SEQ ID NO: 6828672 - DNA, 59 bp, Homo sapiens
ttcagcctgtttcaaagaagtcagtggatgttaacatctgattcattgaaatgggtgaa

SEQ ID NO: 6828673 - DNA, 80 bp, Homo sapiens
ttcttaggtttagcagtctccatatacatttacaaatcattaaataatttgtcatggtatttgtgagctgctccggtgaa

SEQ ID NO: 6828674 - DNA, 63 bp, Homo sapiens
atatgtacactgtgacaatcatgacagctccttaagctgatgaataaaaacagtagtatatat

SEQ ID NO: 6828675 - DNA, 62 bp, Homo sapiens
tgtttaatgcattgaccttgggctataagagtctgtccagtgctcagggtccacattaaaca

SEQ ID NO: 6828676 - DNA, 82 bp, Homo sapiens
tggttaggtgctgacatgtataagctttaagtaaatggaacgtccacttgtattttattgcttgtcacaaaccctcaaacca

SEQ ID NO: 6828677 - DNA, 89 bp, Homo sapiens
aggtattaggttggtgcaaaggcaattgcagtttttgccattgaaagtaatgccaagaccacaattgcttttgcaccaatctaatattt

SEQ ID NO: 6828678 - DNA, 63 bp, Homo sapiens
gagacagctgcccagctaggaagaaggtctaggagccagaccttccccgtgggcagccgtctt

SEQ ID NO: 6828679 - DNA, 94 bp, Homo sapiens
ctagaaaatcagaacctaaatcatctatggattttgatgttttttagatttaaaagatggaaaacattgagataccaaggggttcaatatttag

SEQ ID NO: 6828680 - DNA, 82 bp, Homo sapiens
atacacatgcaaaaatatatttatgattatctttctaaattaggaaagtaagctattcatattatggtgtttgtgtgtgtgt

SEQ ID NO: 6828681 - DNA, 103 bp, Homo sapiens
gtgaatttctacttcctctctgtgtatgacctgggagaggctgtcagtgacgattctctgctctcacatacagaaaagaggcagatacataatagagaagcac

SEQ ID NO: 6828682 - DNA, 58 bp, Homo sapiens
aattgttctggaccttttgggtctttctatattaagaccgaaggaaactggaaccgtt

SEQ ID NO: 6828683 - DNA, 83 bp, Homo sapiens
ccgccccgcgctgactcggctctcagagggcgactgggaggtcggacctgggcgcccagagctgggtgggcagcggggggcgg

SEQ ID NO: 6828684 - DNA, 130 bp, Homo sapiens
tgagaacatacaggaggctgaaaggattctttagggaggctttttagtggcctcattctctaatacctatggacagcaactggaagcttcaaagaagaaggatgaactttcaccttcctgttctgttcca

SEQ ID NO: 6828685 - DNA, 97 bp, Homo sapiens
tactgtgtagccctctgcccatccccagaaagaccgatgtacctctcactccacaggctgtgtccaggtgggggtgacgcagagaggaacgcttgta

SEQ ID NO: 6828686 - DNA, 58 bp, Homo sapiens
gggtgctggatgaaataactggaaaatctcctttttcttactatttttcttcagtccc

SEQ ID NO: 6828687 - DNA, 86 bp, Homo sapiens
cctacaggcttacctgtcctgagatagcatctgaggttcctgaaataagcctagtcctcctgtccagtgactttgggccatgtggg

SEQ ID NO: 6828688 - DNA, 58 bp, Homo sapiens
ctgtctttcatgaggccctgaggtctaggagggcctgagtcacatcaggagagtacag

SEQ ID NO: 6828689 - DNA, 83 bp, Homo sapiens
tgggaggttggattttggtcccagttctgtcatggctttgtgcaagtcactgaaccttcctgggccttagaatcctcctttca

SEQ ID NO: 6828690 - DNA, 58 bp, Homo sapiens
catggcggtcaggatgtaggtgctggtgaactgactattggcatccatggccgtgatg

SEQ ID NO: 6828691 - DNA, 64 bp, Homo sapiens
tcttcttttcttagttgttgggttcttcatccattgaaagttagaaacaagtaggaatggaaga

SEQ ID NO: 6828692 - DNA, 71 bp, Homo sapiens
ggaggtcaggtgttagggacactgctcatgagttcaagactggattgcatcattgttctcacctgaacttc

SEQ ID NO: 6828693 - DNA, 66 bp, Homo sapiens
tccaaacccagcaaagggagccatcctgcctgactgaagccagagtggggcccactgctgggtgga

SEQ ID NO: 6828694 - DNA, 129 bp, Homo sapiens
gaagaatgggccagggctgggagacaaagacccagatggcgaggccgggacaggctggagtccggcttctccggtccaggatgcccgcttttgctttttcaaaagtctcatgccctgtgctttttcctc

SEQ ID NO: 6828695 - DNA, 66 bp, Homo sapiens
agagattgctagctggctttaatagttgtcaaaagtaatagaactaatttttagctagcattttct

SEQ ID NO: 6828696 - DNA, 55 bp, Homo sapiens
gtgcagagtgctacattttatttgcatcttagcaatgaccgagtatctcttgcac

SEQ ID NO: 6828697 - DNA, 77 bp, Homo sapiens
gctggttgataaatctgtgggagggagaaatctcattgggaagagatgcactaccctgtatttagagatgcaccagc

SEQ ID NO: 6828698 - DNA, 83 bp, Homo sapiens
ctgctcctaagcatgtccaatagaagggagaagcggtgaattctaattactcagtttttcctccttattggctgctggagtag

SEQ ID NO: 6828699 - DNA, 55 bp, Homo sapiens
gggagtcctcagaagttcccggagatactccctcactggacagagtggggttccc

SEQ ID NO: 6828700 - DNA, 65 bp, Homo sapiens
gccttctaccatatctggcattttcaagtcctgatccctttgaggctctatgtggtagattaggt

SEQ ID NO: 6828701 - DNA, 74 bp, Homo sapiens
ccttcagcccacaccagaggttacctgcaaactcttccggtatgtggtggcagctctgagtctctgtctgaggg

SEQ ID NO: 6828702 - DNA, 58 bp, Homo sapiens
ctgctggggtttcctgcagatggagctgcagctcagggacaaggggagaccccggcag

SEQ ID NO: 6828703 - DNA, 103 bp, Homo sapiens
tagttggattgaaaaaggttcttcaattcccatcccggtcttctgtcttcattttgaggacttgggatttagggagttttatgagtatataatcaatcaactg

SEQ ID NO: 6828704 - DNA, 71 bp, Homo sapiens
cagcggcatatttccaaattcttctcagcatttttaaacagtaactgggagtgaagcaaataatgctggtg

SEQ ID NO: 6828705 - DNA, 89 bp, Homo sapiens
ttttgttttcctgtgttcacctgctgtctgcttgttcttagtggcagatggagggagagtagatatcaggtgtattatggagcacagaa

SEQ ID NO: 6828706 - DNA, 70 bp, Homo sapiens
tcaataaatatatttcagtgatcaattgctgagaagtgaaaaattgatgggcactgaaatattactttga

SEQ ID NO: 6828707 - DNA, 86 bp, Homo sapiens
gcaaaggaagatgcagatacagcaggaatcagagcatgtttgattttgcatgataatgaaaggtatttggattttattctaattgc

SEQ ID NO: 6828708 - DNA, 66 bp, Homo sapiens
actagaacttatttggcattatttcatttctgattcctaatgagcttggctacctgggttcctggt

SEQ ID NO: 6828709 - DNA, 77 bp, Homo sapiens
acacagcccaggacagagtgaacagtgggatgtgcagggctcgactggccaagctgaactgttttcttgggttgtgt

SEQ ID NO: 6828710 - DNA, 69 bp, Homo sapiens
gagcctagcatgggtcgcgtctctggatggaaggggtcagttccagtttggacagaccctgcttcactt

SEQ ID NO: 6828711 - DNA, 72 bp, Homo sapiens
gcccaggggcagctgggtggcctctcctcggggcgtttggggcccacggagagacatttactgtactcgggc

SEQ ID NO: 6828712 - DNA, 58 bp, Homo sapiens
gtccaggaagcaataaatagaattcattatgaaatctataattggaacttcactggat

SEQ ID NO: 6828713 - DNA, 58 bp, Homo sapiens
gcccagctggtgtcggaggacgtggacaaggacgtgctccttccccacccgctgaggt

SEQ ID NO: 6828714 - DNA, 77 bp, Homo sapiens
gaattgtagagggaacagaagcattcagaacctaacacttcagagtatctgttcctttctcatttaatagataattc

SEQ ID NO: 6828715 - DNA, 111 bp, Homo sapiens
aagtaactaactacccatcttcaggggctacatctgtaactactcagtcactagttcttagagaagtagcactctagaagcttagtttccaaatatttccaaacagtactt

SEQ ID NO: 6828716 - DNA, 58 bp, Homo sapiens
gtcctctgagggggctgcacgccctgcccgcaggctcggggaagccacctcagaggac

SEQ ID NO: 6828717 - DNA, 65 bp, Homo sapiens
ctccgtgcccacgtgggtgttagatgaggtgatgcgcaagcgccttgtgtccatggagcatggag

SEQ ID NO: 6828718 - DNA, 101 bp, Homo sapiens
tcctgacttttcttaagcattaaagtctctttgggtactttattttactagctgagaataataaaaagagcattttaaatgttaggcagtgaaaatcagga

SEQ ID NO: 6828719 - DNA, 69 bp, Homo sapiens
cactgtcacacctctgtggacaactcccagtgatgtcactgagcatggctcacagagagtggacttgtg

SEQ ID NO: 6828720 - DNA, 62 bp, Homo sapiens
tcattatttgctttagttatgttctataaagtcaccaagaacactgacttggtgaatactga

SEQ ID NO: 6828721 - DNA, 74 bp, Homo sapiens
gacttagagatcggcatgggaggccactgcctggaaagccagatctcagggctgtgcccatcttcccctgagtc

SEQ ID NO: 6828722 - DNA, 57 bp, Homo sapiens
gagctcagggggctccggggcgtgggttcccacaccatgggcttgctctctgagctc

SEQ ID NO: 6828723 - DNA, 94 bp, Homo sapiens
gacttgattttttccattttagtgacatttacgaatcttatccctttgtttaatggaaaggggaaatgggagcaagtgttacaattgtcaggtc

SEQ ID NO: 6828724 - DNA, 61 bp, Homo sapiens
gaatatttaaaacgaggccactggactgcttttctgcagttcacatatctgttttattttc

SEQ ID NO: 6828725 - DNA, 69 bp, Homo sapiens
gtgatcctaagccactcaaatcttgtggttggatgctaccacaggacaacctggcttattatgaatcat

SEQ ID NO: 6828726 - DNA, 66 bp, Homo sapiens
gttctgtagagagtgcaactttgctgttagtcaaactgcaaatgtggcttcctttctagcagctgc

SEQ ID NO: 6828727 - DNA, 64 bp, Homo sapiens
cagcagggagcactgcgagcggcagtgaggggccctctctgacggtgcagatgctttttggctg

SEQ ID NO: 6828728 - DNA, 61 bp, Homo sapiens
catactagtttgaaaatatctgattctaaaagagaatcagttttcctttcaagtggtaatg

SEQ ID NO: 6828729 - DNA, 70 bp, Homo sapiens
gttctccaacttgtttcttccattcaacagcatgtgaaagcaagcttagaagcaaaaagcaaaggagaac

SEQ ID NO: 6828730 - DNA, 57 bp, Homo sapiens
gccgggggcctgctgcaggttcaggatgctgtcgatggcgctctgcaggtgctcggt

SEQ ID NO: 6828731 - DNA, 78 bp, Homo sapiens
tctatctgcgcacattagaagtaactaatgtccacatctgcccttaagacatgtatccctaattgtgttaaagataga

SEQ ID NO: 6828732 - DNA, 93 bp, Homo sapiens
atgtttttttacatgttgatccccagaaaataggtgcctaaaaaaagttactttaggataatgatttcaggggagtagaaggtgaaaaatcat

SEQ ID NO: 6828733 - DNA, 55 bp, Homo sapiens
ccctggttcatataggcaagtttaagcagtgatttaaaactgcccctgacctggg

SEQ ID NO: 6828734 - DNA, 105 bp, Homo sapiens
acaggttggttgggcaatacttcaagattccatagggcattcatgccttcttcctggaagtatgtgtgtttcagtggaaatgttgatataattaattgacactgt

SEQ ID NO: 6828735 - DNA, 130 bp, Homo sapiens
ccactggccaggcactggggataggcaggggtggtgtgagaagtaggggctcaggtgcttcttagggacacatcagcctcagctttgggccaccttcctgagactggctgcctggttttggggcaagtgg

SEQ ID NO: 6828736 - DNA, 67 bp, Homo sapiens
tgacttggttatcattcaccctgctcaactgaaactacagtccccagggtgaccaatgtggccatca

SEQ ID NO: 6828737 - DNA, 80 bp, Homo sapiens
gctcctcccatggccagtggtcagtgggagggtgtgccctgcgcctgtctgcatggccactgggcatgtgtgttgggagc

SEQ ID NO: 6828738 - DNA, 71 bp, Homo sapiens
ccattatatgagacttgagggcctcaagtcccataaggcgggacttgcggtcctgatctttgatgataagg

SEQ ID NO: 6828739 - DNA, 64 bp, Homo sapiens
gggaatattcataggttgtgtttctcttcttttcagaaattgaaaccgatctgtgtttactctc

SEQ ID NO: 6828740 - DNA, 58 bp, Homo sapiens
aaagagtggcttctttgacatgcttcttttctttgagccatctcatcagcagctcttt

SEQ ID NO: 6828741 - DNA, 55 bp, Homo sapiens
gccggggattgaggtatgactcagaatccctgatgtccccttcttgatgcctggc

SEQ ID NO: 6828742 - DNA, 66 bp, Homo sapiens
aggttatgttttattttctgcttataacaagcaagcttatgagcagtcagacaagcatcactgcct

SEQ ID NO: 6828743 - DNA, 55 bp, Homo sapiens
gagagaggtaggggcatcctagtgaccttttgtctggaatgtacctccctctctt

SEQ ID NO: 6828744 - DNA, 59 bp, Homo sapiens
ttatcaactagtttaggtttgactcacaaatgtgaagaggactggttgcttgttggtaa

SEQ ID NO: 6828745 - DNA, 81 bp, Homo sapiens
gggaggcatttctatcacccattgcacaaagagggaaactgaggccagagagggcacttgcttcctctgtgcaatcctccc

SEQ ID NO: 6828746 - DNA, 62 bp, Homo sapiens
ggtttcacaactcagcaaggagagctattctctaaataagttcactttctgtagtggaagcc

SEQ ID NO: 6828747 - DNA, 77 bp, Homo sapiens
agtctttgagtcttgttgcatttgctttgataatgagtatcttctctattagggtaaatttgacatgcataaggatt

SEQ ID NO: 6828748 - DNA, 88 bp, Homo sapiens
ggagaatcacttgaacccaggagatggaggttgtggtgagccaagatcacgccatcgcactctagcctgggcaacaaagtgagactcc

SEQ ID NO: 6828749 - DNA, 83 bp, Homo sapiens
gtctgtccagccctcctgggatcacagtaagaagcccccagctcctattctgaggcccaagagatggcccttgaggcaatgac

SEQ ID NO: 6828750 - DNA, 64 bp, Homo sapiens
cgaaggtagtagggacttgggagtggtgactgaacctggtctggctcctccttacttcctcttg

SEQ ID NO: 6828751 - DNA, 77 bp, Homo sapiens
tgctattgtgaatagtgccgcagtaaacatatgtgtgcatgtgtctttatagcagcatgatttataatcctttggta

SEQ ID NO: 6828752 - DNA, 68 bp, Homo sapiens
tattttatgaccataagattactgttaacttttttatgtgtgataatagtattgtggttatgtctata

SEQ ID NO: 6828753 - DNA, 87 bp, Homo sapiens
gagacccagggcaactgaaaagattctacgcagactggctacagtgagcccctaaagcggttgtgtgtgttttcagggccctctctc

SEQ ID NO: 6828754 - DNA, 77 bp, Homo sapiens
cactgtgaatttgactgatgaacccacaagtactcgaaaaggattccaggatttggaggcccatcccttacacagtg

SEQ ID NO: 6828755 - DNA, 72 bp, Homo sapiens
tccagaaggctgccgtgcccatattgtgggtggggatctctacccgtgaagtgagcgtggggctttaacgga

SEQ ID NO: 6828756 - DNA, 92 bp, Homo sapiens
ttgtgcacacacatttttctggattgattgctctgtgaacttcaaactttgacttacatcagaatcacccaggaaggtttgtttaaacacag

SEQ ID NO: 6828757 - DNA, 69 bp, Homo sapiens
atgcagactcatcaactgttacaaatgtaccactctgatgagggatgttgatagtgatggaggctgtat

SEQ ID NO: 6828758 - DNA, 130 bp, Homo sapiens
acagaagtaattacaccatgacacctgctcctgcaagtcaggctggggtctggcaggctctgtgcggggctgctgatgtggagcccaccctcggctgagctggtggagctgcggtggaaagggctgctgt

SEQ ID NO: 6828759 - DNA, 80 bp, Homo sapiens
ttaatcttttagtaagtgtagttgaagccttcaacaatttaatataattgtgctgttatcacattttgtaaaatgattag

SEQ ID NO: 6828760 - DNA, 72 bp, Homo sapiens
cccaggcccatgggatctgttgcctcagagactgactcgcctttcctgagcattagacatccatcacctggg

SEQ ID NO: 6828761 - DNA, 89 bp, Homo sapiens
tctcggtttatcctgatgcgtaaacagaagctgtgtcaagtggagggcggggaggtccctctccattccctacagttttcatcctgagg

SEQ ID NO: 6828762 - DNA, 68 bp, Homo sapiens
caaagcgtttctttcatggctctgtggcttggtctagctgggtccagagaggcaggaggctacatttg

SEQ ID NO: 6828763 - DNA, 108 bp, Homo sapiens
gggctgggacttttgatttgtcatgtatgtaaagttgatatttatttgttgtgtctctggcttgttaatgcatattgcaagtctctaccaactgagagtcataagcct

SEQ ID NO: 6828764 - DNA, 57 bp, Homo sapiens
ctgatattattgaagctggagttgcacattcattttgctttggcttttttgtatcag

SEQ ID NO: 6828765 - DNA, 58 bp, Homo sapiens
tctcctggtcacctcagaagtccagggaaccttagggcatactgtatggatcagtagg

SEQ ID NO: 6828766 - DNA, 92 bp, Homo sapiens
cttagctagcttcaggagtacttttagagatgaagatgttgttgtcgaaagaggccaggcattctagaagtagtgtgtttgaggcagttgag

SEQ ID NO: 6828767 - DNA, 67 bp, Homo sapiens
catgtagttgggtagcttgtagtaaaatgctctataatgcatttgtttataagttccccagtcactg

SEQ ID NO: 6828768 - DNA, 103 bp, Homo sapiens
gatcattttggctcaagagactggaggagaacttgaggaaggaaccaaatcaattccttttccacaattttgttccaaaaatgtctcaagattgaaattgatt

SEQ ID NO: 6828769 - DNA, 129 bp, Homo sapiens
aatagcttcatatcattcccacatgtagacacatgcctagatctattagcaaactgccattttagtcctcctgaaattcatatggttttgagatagcttcctggagtgttttattgaaagaggagtatt

SEQ ID NO: 6828770 - DNA, 72 bp, Homo sapiens
tgacagagaggaaaacagttataaacagagtcacatcacagtgactgtgtgtatgtattgttgaatctgcca

SEQ ID NO: 6828771 - DNA, 104 bp, Homo sapiens
tttctaacaagataatgctgaatctccttttgcatgaatgtttgttgctcttaaaagttatctaatgatttggcaaaggaatccagtaatttacttgtcaggaa

SEQ ID NO: 6828772 - DNA, 88 bp, Homo sapiens
gctcctgggctcttgctggtgtcgtgccttcactggtgacacttcctgaacttaaccagtggatggacatgggcaagaggccagtggc

SEQ ID NO: 6828773 - DNA, 75 bp, Homo sapiens
aagtttatgttctttgaaggcagggtccgtatgattcatcttagtacctagattatgccttagagataaaggctt

SEQ ID NO: 6828774 - DNA, 69 bp, Homo sapiens
ggtgtgtcagagctcagagaagtaaggctgggaggcggggaggccacattaggctggactttgtaggcc

SEQ ID NO: 6828775 - DNA, 118 bp, Homo sapiens
ggagtttagggtgaaggatttgatggtaaagcagcttaaattagagcctgagaggagtccttaaacaaattctaattagagctggcaattttccaaaaataattttttctttaatttc

SEQ ID NO: 6828776 - DNA, 83 bp, Homo sapiens
agacagtactgatttggttagagggccagttcttacaatatttggtccctagaattgagctctatttacaaaaaagtcttttt

SEQ ID NO: 6828777 - DNA, 88 bp, Homo sapiens
ccatcaggttccctggcagtgctcctttagacatgcacccaccttggcaaaggcattgaggtctggatggctgcagggtccgggatgg

SEQ ID NO: 6828778 - DNA, 55 bp, Homo sapiens
ccaggcagaatgaaacccctgttgttggtgaggtgggggtcagcctccagcctgg

SEQ ID NO: 6828779 - DNA, 118 bp, Homo sapiens
gcctgcagcagaaagaccctgggccagaatgggttgtgccatctgtcaccagatattgccaaggtagatctggctgactttgtgggacagcttgtttctcaataatcactttgcaggc

SEQ ID NO: 6828780 - DNA, 63 bp, Homo sapiens
accagggatttctgggggccaggggtgctggaaggcaccaggctgaaccagaggggacctggt

SEQ ID NO: 6828781 - DNA, 95 bp, Homo sapiens
tggccaggctggtgtcaaactcctgacctcgtgatccacccgccttggcctcccaaagtgctgggattataggcatgagccaccgcgcctggcca

SEQ ID NO: 6828782 - DNA, 60 bp, Homo sapiens
ggcagatgacagaccagtatgtgaagtttctcttccaaatatccatctttgtcatcttcc

SEQ ID NO: 6828783 - DNA, 92 bp, Homo sapiens
acccaaaaccagtcactggaacagtgttggagcttgattttttgatctttgaatcaaagtattttaactgtatccacctgacctggctgggt

SEQ ID NO: 6828784 - DNA, 88 bp, Homo sapiens
tgaggaagggcctctacttccttcagagcctttaacaaagagccccagacaacctaaaggctctaacaaggagagagactggtcttta

SEQ ID NO: 6828785 - DNA, 74 bp, Homo sapiens
ttatctgtagacccctgattaaagacctgacgtactatgtggttcagtgtctcatatgaggtttcatgcaataa

SEQ ID NO: 6828786 - DNA, 78 bp, Homo sapiens
agtgtcttgatactgtttttgagaatagtaatgcttcaaatatttggagcaccatttctctaaagcactcaaaacgct

SEQ ID NO: 6828787 - DNA, 83 bp, Homo sapiens
ttgggaaataagactttaagtcctatctgtgcgactttaaatgagtgatgctagtcttgggggcttaagtagcttatttacaa

SEQ ID NO: 6828788 - DNA, 100 bp, Homo sapiens
gccctgcccaccggagggctggcgccccagatcctaggtgagttgtagccttgacttcagcagcactctgcgggtccccggcgctcctctgggccagggc

SEQ ID NO: 6828789 - DNA, 94 bp, Homo sapiens
ggcaatcctttaaattggtgggagtgagggcatgccaggctggacagtgcatcttaactgctgccccattccatacctagcacagggatgggcc

SEQ ID NO: 6828790 - DNA, 58 bp, Homo sapiens
gcccaggctggagtgcagtggcgcaatcttggctcactgcaagctctgccacctgggt

SEQ ID NO: 6828791 - DNA, 64 bp, Homo sapiens
tgcagggttagagtggcttaaataatacttttgaaatttttaagcctctcaaagaaaccctgta

SEQ ID NO: 6828792 - DNA, 72 bp, Homo sapiens
tgccaattgcctgcttcagtcctatgggcaggtggctctgaggtcatcctgtctgaagtagccagtttggca

SEQ ID NO: 6828793 - DNA, 66 bp, Homo sapiens
tgaatcagaagatctagagcaaactgggagtcctttctcccatttgcccaaggattgtctttttca

SEQ ID NO: 6828794 - DNA, 66 bp, Homo sapiens
gaaacatgttccttaagcatatttgtcagctgggagcacctgacaagttctaataagaaatgtttt

SEQ ID NO: 6828795 - DNA, 63 bp, Homo sapiens
tagtgtgctttcctgccaacgcagcatgacttcttgtcaagtcagcactccaggaagccacta

SEQ ID NO: 6828796 - DNA, 77 bp, Homo sapiens
gggagcttgttggaaatgcagagtctcagacagcagatccactgaatcagaacatggcatgttccatccaggctccc

SEQ ID NO: 6828797 - DNA, 56 bp, Homo sapiens
agatggctgattaactccatggataatctccctatggactgattgtccagccatct

SEQ ID NO: 6828798 - DNA, 61 bp, Homo sapiens
gagcctatgtgtctttagaagtggggaaaataacctaccgcatgaggtctacatgggcatc

SEQ ID NO: 6828799 - DNA, 81 bp, Homo sapiens
cactggattaggagttggtgagcaccaggcttttccacagactagatggagaccctgggcacaccatttcccctcactgtg

SEQ ID NO: 6828800 - DNA, 58 bp, Homo sapiens
cagtttcatttcttagtaccagtgactagtcttactggtacaatgggatgtgagaatg

SEQ ID NO: 6828801 - DNA, 65 bp, Homo sapiens
ctgtgtttccagttcagaaagcaaggatcatcatttttccattgctcacttgctaggaaatgtgg

SEQ ID NO: 6828802 - DNA, 79 bp, Homo sapiens
gaggcacaggtccaacccatccagtgtccctgctagtcacacacagcactcagggtacaatggagggcttctgtgcttt

SEQ ID NO: 6828803 - DNA, 66 bp, Homo sapiens
cctagacagcatttcccggaaccgcataggccattgacattatgctgtttccccatgtgctgaagg

SEQ ID NO: 6828804 - DNA, 64 bp, Homo sapiens
gagccactgtgtgcactgaaggcttctccaatagccctccatgagacacagtgtaataaagctt

SEQ ID NO: 6828805 - DNA, 55 bp, Homo sapiens
cgactcaggaggacaaggaggttctgaaaacctcgaatgccttcctgaggcctcg

SEQ ID NO: 6828806 - DNA, 59 bp, Homo sapiens
catgtgtagtgaaataagcagtgtctttaaatgatacctgtttgttttcatagcatgtg

SEQ ID NO: 6828807 - DNA, 63 bp, Homo sapiens
attgtttttggagagggcttggcactaggtagaaatttaataaaagttttctccaaatacagt

SEQ ID NO: 6828808 - DNA, 82 bp, Homo sapiens
gggaggatagagggtcttacctaagcagggttcattgctggcagtgcctgtcttgctgtgcttgggaagaatctctgcaccc

SEQ ID NO: 6828809 - DNA, 125 bp, Homo sapiens
tcagaggacagaggtgctgacagctgagaggaggtggtgagcatgcgtcaggggcaagtgccacctgctcacccctggctatttttacgcaaggtctcttagctgctggtgtcactgagctttga

SEQ ID NO: 6828810 - DNA, 106 bp, Homo sapiens
tggcagtgttagcatgatcccagggtggagttttcagccctctgacattaaaaggtgaagcagaggacatgaaaactcgctctgtgcatcctctgtacgctggcca

SEQ ID NO: 6828811 - DNA, 79 bp, Homo sapiens
ggttaggcaaattgggctgactcaaggtttgggggctgtcacccccatcatcttgatcagatcacagtttccaatgacc

SEQ ID NO: 6828812 - DNA, 97 bp, Homo sapiens
gtataacctaaggagatggttaaaatgcagattatgactcagtaggtctggattgaggccagaaagtctgcatttctaacaagctctcacgtaatgc

SEQ ID NO: 6828813 - DNA, 95 bp, Homo sapiens
aggactctgtgacttcaggagccctggtgggtggacagaagctccctgctcccccagcctgtctacccagcagcgctttggccagtcccattcct

SEQ ID NO: 6828814 - DNA, 63 bp, Homo sapiens
ttgggtctgtagggctgtccaatgatagttaggcttaaacattaaacaaccttacagaactaa

SEQ ID NO: 6828815 - DNA, 64 bp, Homo sapiens
ctggaagtccatgagtgacttgtctcatagcacccaaaacaccttatttcacatggacttccag

SEQ ID NO: 6828816 - DNA, 64 bp, Homo sapiens
gctgatgacctggttatgggtctctcagcttggggactgggagacccccaatgccaggtctcgc

SEQ ID NO: 6828817 - DNA, 68 bp, Homo sapiens
gcccaaagggtggcacaggtgcagagggtcgcgggcccgccaaggacagctgcacctggccgcctggc

SEQ ID NO: 6828818 - DNA, 83 bp, Homo sapiens
tggaggaagcattaagagagactgaactgcaaaaattctttcccactgagatactagttcagagattctctgctttcaaacca

SEQ ID NO: 6828819 - DNA, 65 bp, Homo sapiens
accagtggttctcaaatataatctgggacccctgaaggtccttgaagccatttcagggcattggt

SEQ ID NO: 6828820 - DNA, 70 bp, Homo sapiens
ttcccgtgtctgctctccgcagccctcctgggagggtttgaagagacagctgagagcggccagctgggaa

SEQ ID NO: 6828821 - DNA, 76 bp, Homo sapiens
gtcccctgagtactttacttcttacagtttatgttgctacatctcagaaaaggtaggggaaagagtacagggtggc

SEQ ID NO: 6828822 - DNA, 74 bp, Homo sapiens
tctgaggatggtctctggagaccatgactgtgtacagttcacatggtaaccagaagactatgacatacttcaga

SEQ ID NO: 6828823 - DNA, 69 bp, Homo sapiens
gacagtataaaattaaaccttaggttagcagggccaaatgctggcagggcctgaatcttatactcagtt

SEQ ID NO: 6828824 - DNA, 63 bp, Homo sapiens
ttttagaaagatccctggcaggcaatatggagagtgatttagagcccagggagcttattagga

SEQ ID NO: 6828825 - DNA, 111 bp, Homo sapiens
catattaactttttttgttgctatgtgttcagcttatatcttagttttaggtttcctttattcctttagcagatatttgttgagcacttgctatgtaataggccaaatgtg

SEQ ID NO: 6828826 - DNA, 68 bp, Homo sapiens
tgtgcttatgtgggagggagaggtggtgtgtgtctgttctcatacctctttctgcagccgcaggcata

SEQ ID NO: 6828827 - DNA, 93 bp, Homo sapiens
tttagaagatggtttgggttattttggttgtctaaggctgagaaagccttccagatcttgacttacaggttaacaaaaagtatccattctaga

SEQ ID NO: 6828828 - DNA, 107 bp, Homo sapiens
ctgaggcaggagaattgcttttaaaaacccagggggcagaggttgcagtgagccaaaatcatgccactgcacttcagcctgggcgacagagcaagactccatctcgg

SEQ ID NO: 6828829 - DNA, 69 bp, Homo sapiens
gtgtggtgaggggcctgtgcacacaggagctgacctgggtgctgactggggcctgaaaatctcccacat

SEQ ID NO: 6828830 - DNA, 59 bp, Homo sapiens
agtgcaaagcagcctgtacaccatcctctcgggcaacgagggacaggcctgcttgcact

SEQ ID NO: 6828831 - DNA, 63 bp, Homo sapiens
tgtttgtacatatataaaatctgtgtacaacatatgcagacagagtttatgtgtgtacaaata

SEQ ID NO: 6828832 - DNA, 56 bp, Homo sapiens
tagaaaccaggctgtgggcctccaataaatgtaataggcccagcctctcctttcta

SEQ ID NO: 6828833 - DNA, 59 bp, Homo sapiens
ttcacctgaaagtctggagtccagctgactgctgctgaatccaggcccactcagctgaa

SEQ ID NO: 6828834 - DNA, 61 bp, Homo sapiens
gctcatgtcatgggtaattttagttcataaaatgtattgaactgttgcttgtaatatgtgc

SEQ ID NO: 6828835 - DNA, 70 bp, Homo sapiens
gcacataagaattctctagtgcaaattgtttgattctaacaataggtcatgcctaggagattttttttgc

SEQ ID NO: 6828836 - DNA, 67 bp, Homo sapiens
tctagacttgatgaactttgcaaattcctccttgtttttattctttgcagacttagaaaagtctaga

SEQ ID NO: 6828837 - DNA, 84 bp, Homo sapiens
gtgttttatagcatttatcatctctgaatttctcaacgtgtataaaaaaggattcagcatgggtgtgataaatgtataaaacac

SEQ ID NO: 6828838 - DNA, 76 bp, Homo sapiens
tgttaacaatgtcagaattacagttgatttttacttcctcctttggaattttctgtgtttctgaagttgtcagaca

SEQ ID NO: 6828839 - DNA, 90 bp, Homo sapiens
gccccacactgcaggcactggtcagcatgtttcgcagcatgtccttatttgtaggcagaagtgaccccagtggagcctctagggtggggc

SEQ ID NO: 6828840 - DNA, 55 bp, Homo sapiens
ggggtgagcggctagggatgtggggaatcccctgcctctgaagctgctcagatcc

SEQ ID NO: 6828841 - DNA, 68 bp, Homo sapiens
gacggaaagtgtttacttaaagtcatggccaaatggctagggagagttaagataaatcataagctgtc

SEQ ID NO: 6828842 - DNA, 71 bp, Homo sapiens
ggaagatagtgccctgagcttatgcattctttaacccaaacaatccatattagggacacatatggccttcc

SEQ ID NO: 6828843 - DNA, 87 bp, Homo sapiens
cccagtttatttctcagatatttactgagcatttactgtgtgtcatgtaaacttctagatgctgtagtggatagtgagaatattggg

SEQ ID NO: 6828844 - DNA, 60 bp, Homo sapiens
tcactgtttcttcccagcagagctaagagacttctagagcctcttgtggatggtcagcga

SEQ ID NO: 6828845 - DNA, 89 bp, Homo sapiens
ggagaatcgcttgaacctggaaggcggaggttgcagtgagctgagatcatgccactgcactccagcctgggcaacaaaagtgaaactcc

SEQ ID NO: 6828846 - DNA, 61 bp, Homo sapiens
accgtccataaatgtctgtttttttgagaccttggcaaagaggaggattgatgtgggaggt

SEQ ID NO: 6828847 - DNA, 107 bp, Homo sapiens
gtctattacctcactcctccttgttctctgcctttcccaggctactgtggttatgatttgtggcagaagttgggaaggcagaaaaggagagaaggagggaaaaggac

SEQ ID NO: 6828848 - DNA, 64 bp, Homo sapiens
ggattctggtggtcttggctctccacagggagaccaggaaagagcttagtctactcagacatcc

SEQ ID NO: 6828849 - DNA, 56 bp, Homo sapiens
tgccgtgtcccattgtgctctggctgtgagttggagctagttttagagcataggca

SEQ ID NO: 6828850 - DNA, 105 bp, Homo sapiens
tatcagaactgatagtataaagtcatgagttttttagttcatgcagaatgtggatcatgtctgagataaaaattcataagatttttgaatatcctggggctgatg

SEQ ID NO: 6828851 - DNA, 75 bp, Homo sapiens
tcattgctcccaaccccagtgcacttagtgagtactcaaattttcattaagtaaggcaggtggtttcagttttga

SEQ ID NO: 6828852 - DNA, 77 bp, Homo sapiens
ggccttctgctgctgttcatggttgtacctgcacaggatgcctgaaaaggagtaaccgtggggtcagaagaggagcc

SEQ ID NO: 6828853 - DNA, 61 bp, Homo sapiens
ggtggagaggtgaatggctgctctagatagaatgtttacacgtcattctcctctctttgcc

SEQ ID NO: 6828854 - DNA, 69 bp, Homo sapiens
ggctcagcatgttatctgtaagtggcagtgtacgctcagactcatgatatgctgttagaaatgttagct

SEQ ID NO: 6828855 - DNA, 85 bp, Homo sapiens
ggtccacagaccccatgatgcggaggggatggcagtgccccagtctgaacgcagcctctctctgcatctggagggcacggggact

SEQ ID NO: 6828856 - DNA, 60 bp, Homo sapiens
gttgaagaagcagcaggaagaggcagccatgaacttgctcctaacgctggttctatcaac

SEQ ID NO: 6828857 - DNA, 55 bp, Homo sapiens
ggccttggaagtatttcagttcggaaccccaattctaaccttagcttctcaggcc

SEQ ID NO: 6828858 - DNA, 76 bp, Homo sapiens
gggcgtgaggctcactgcctgggagagggcagccagcaccgactgctctgccagcccaaggcgcagccgtccgctc

SEQ ID NO: 6828859 - DNA, 59 bp, Homo sapiens
gtcacacagagccctgtgctcaggtggaccctgagcttggattaatgctctgctgtcac

SEQ ID NO: 6828860 - DNA, 67 bp, Homo sapiens
cttctcttttaatctcagtttctagtgtggtataattgactttggaatcctgagatgagaattgaag

SEQ ID NO: 6828861 - DNA, 68 bp, Homo sapiens
tgccaagcccatcttttcaatgttcttcaaagtataattttatagatcatagaaggtggtactaggca

SEQ ID NO: 6828862 - DNA, 81 bp, Homo sapiens
gtgagcccaagtagaggagatggctttgagatgcagaaaaatatctctttctcaagaccccatttattttagacggttcgc

SEQ ID NO: 6828863 - DNA, 92 bp, Homo sapiens
gggggtctcctcagggctgctggccgtgccctctagaccttggttgtttcctcactaaaatgagggcactggccttgagatcagaggcctcc

SEQ ID NO: 6828864 - DNA, 62 bp, Homo sapiens
cgcgtggctccgcaggctccattctccacacagtcgtctaggggggcgccaggagccccgcg

SEQ ID NO: 6828865 - DNA, 73 bp, Homo sapiens
gccccggaagaagacccagacgtgtgacacctctgtgcagatagaacccgtccacactgaggccttctccagc

SEQ ID NO: 6828866 - DNA, 75 bp, Homo sapiens
tgtggaataattgcttggaagtgtagaagggcttctcattttgagaagctgatcatccttccaggttgagccaca

SEQ ID NO: 6828867 - DNA, 77 bp, Homo sapiens
tcatagacattaatttctttggtaatttaaaactagtaaatcctagtaattatcagggtaaggagattaagatgtga

SEQ ID NO: 6828868 - DNA, 61 bp, Homo sapiens
acttagactaacctgtagatgagtttggtatgcatcaggatacctcacagttggtctcagt

SEQ ID NO: 6828869 - DNA, 57 bp, Homo sapiens
ttcctcagctgtttgggctcattaggagactctgacttagacatgacggcaggggaa

SEQ ID NO: 6828870 - DNA, 75 bp, Homo sapiens
gagattaaatgtgctaagtgttgctttcagagtggactttgtgttcacaggtgagcattaggccgtgcaaatctc

SEQ ID NO: 6828871 - DNA, 62 bp, Homo sapiens
tcttgatttgaattgcagttgtaaatggcgaattgaaggggcaattgcagttgcaaaaaggg

SEQ ID NO: 6828872 - DNA, 61 bp, Homo sapiens
ctgtgtgccaggtgggtgtatgaatgcaaagaaagtctctgccttgtaacccgccttacag

SEQ ID NO: 6828873 - DNA, 57 bp, Homo sapiens
agcacattttatttaagaaaatgtgatgagttaatgtcactttttttgaaatgtgct

SEQ ID NO: 6828874 - DNA, 86 bp, Homo sapiens
agaatcccttgatcccaggaggctgaggttgcagtgagctgagatcacgccactgtactccagcctgggtgatggagtgagattct

SEQ ID NO: 6828875 - DNA, 80 bp, Homo sapiens
tggatctcagttgtcccatggcttttgttgttgttgttgttgtcagtcaggtactccgagggcatgggtaattgataaca

SEQ ID NO: 6828876 - DNA, 62 bp, Homo sapiens
tttgggcagtcctggaatttgtggactttgatgaagtcaaacagaatctcaggctacccaga

SEQ ID NO: 6828877 - DNA, 58 bp, Homo sapiens
cagtcgcagcaccggagcatcgacccaacttcgggtctccatcaggcgctgtggtctg

SEQ ID NO: 6828878 - DNA, 63 bp, Homo sapiens
tatcttatttggggaggtctctgtagaattttctactgatgacacctttgccagatcaagatg

SEQ ID NO: 6828879 - DNA, 98 bp, Homo sapiens
agaatacactaagtatgtttttaagagaatgcattagcagagctacaccattaaaatattagcaaagtgtatttcccttgaattacttaatgtgttct

SEQ ID NO: 6828880 - DNA, 62 bp, Homo sapiens
accacagtctctccacactgcagggcgccaagcttgcctttagcccaagggagggacttggt

SEQ ID NO: 6828881 - DNA, 76 bp, Homo sapiens
atgtaatttagcagtatatttaaagccacatgttatgtgctcacatgttggttaatttactgttggaggtgaatat

SEQ ID NO: 6828882 - DNA, 74 bp, Homo sapiens
agaagactaggagctggtggtggggttgggagaatgtatacctgagttctaatcccacttcccttatagtttct

SEQ ID NO: 6828883 - DNA, 96 bp, Homo sapiens
ccgtgaaatgtgggttgatggaggtgtcagcatgtggccttctgcgcccacccacctccttctcacaccatccttaactccagctttttcctatgg

SEQ ID NO: 6828884 - DNA, 82 bp, Homo sapiens
agccatacaattgccatttcgtaagccgggagccaggccatgctaggccctacggaatatatgaagttggatgagtggggct

SEQ ID NO: 6828885 - DNA, 82 bp, Homo sapiens
ctcagagcaggaagcttgacaaggatgagtaaagtggtatctcagaaaaatacttggtctttgtccctccttgatcactgag

SEQ ID NO: 6828886 - DNA, 79 bp, Homo sapiens
ggcttagactggggcaccctgagtgggcctgtgttagtttgggggcgtggcttagagtggggtaccgtgggactgggcc

SEQ ID NO: 6828887 - DNA, 81 bp, Homo sapiens
gccagcagtcccctgccagctctcgtttttgtctttggggtctgaggggctggatcagaacgtgatggctgtgactgcggc

SEQ ID NO: 6828888 - DNA, 82 bp, Homo sapiens
gaaagagaatgtttgcctgactagagtggcctgagcagccagagtgaggaagtcatcagcaggcactaagggattttctttc

SEQ ID NO: 6828889 - DNA, 94 bp, Homo sapiens
ggggtgatcaaggtaaccagaactggtgcatactcagtcttcacggagactgcttctccaatgaattagattctgtgttcttgccttgcaccct

SEQ ID NO: 6828890 - DNA, 79 bp, Homo sapiens
ggtccttagtaacagaaagtcatgctcatttggtggtgactcatgtcaaatggggatgtcattttcgtatagtaggacc

SEQ ID NO: 6828891 - DNA, 71 bp, Homo sapiens
tatattacatccatttgacataatttcagccaaacatatattttgctggaaatgattaaatggtgagtgtg

SEQ ID NO: 6828892 - DNA, 78 bp, Homo sapiens
cactgaagacagcatgatacatgatgctcttggccgcttgtacaggaagtggcgtgtggacatgatgcaagttcagtg

SEQ ID NO: 6828893 - DNA, 62 bp, Homo sapiens
cattcctctgcctgtgccaccgcctcatttctctcaggagatggaagggcactggcggaatg

SEQ ID NO: 6828894 - DNA, 62 bp, Homo sapiens
gcagaaactaaggtgctgtggactgatttgggagcagttttgtccatttatcatggttgtgc

SEQ ID NO: 6828895 - DNA, 78 bp, Homo sapiens
caagtgtgattttcattttctaagcttttaatgctgtgtttttaggtgttttagagtttctaaatggaattataactg

SEQ ID NO: 6828896 - DNA, 76 bp, Homo sapiens
cctagaattataaacttattagaataagcttcatatgccttgaggaatgcgtttaataggtagtactgtatttagg

SEQ ID NO: 6828897 - DNA, 65 bp, Homo sapiens
ggctccatcctggcctcgctgtccaccttccagcagatgtggatcagcaggcaggaatacgagtc

SEQ ID NO: 6828898 - DNA, 82 bp, Homo sapiens
gtgtgtggacatgtgttccctgccctgctgtgtgtgcatgcgtgtatgcatacatgggtgcagggacatgcagacccaccac

SEQ ID NO: 6828899 - DNA, 91 bp, Homo sapiens
ggccacgcatctccttcttaatcccttatatatttgcttcctgcatgtaaatataaaggattgcagccggggaggtaaaaatagcgcggct

SEQ ID NO: 6828900 - DNA, 60 bp, Homo sapiens
tgtggaaaagaataagggagattattttaatctaagtggcctcacttacctttttctata

SEQ ID NO: 6828901 - DNA, 63 bp, Homo sapiens
agggcccttctcagagcatggccctttgccgctgcataggtcatgtgtccaggaggtagccct

SEQ ID NO: 6828902 - DNA, 67 bp, Homo sapiens
tccaggcattgccattcctccagagagaattctatagctatgtctctgaatgtcaacagtccctgga

SEQ ID NO: 6828903 - DNA, 92 bp, Homo sapiens
ttgacgttccctagcatgcaaagtaagtcatgcatgaacggtgcacaataattcttgttttgctttgatgtgttagttcttaaggatatcaa

SEQ ID NO: 6828904 - DNA, 113 bp, Homo sapiens
ctctatctcttttttaactgctttattgaggtatagttgacaatttaaaattacatatatttaagatgtacaaccacttctcttgaagacagagtgaaaaggtcctgaaagag

SEQ ID NO: 6828905 - DNA, 69 bp, Homo sapiens
tgcctaataatttgatttatttgtagcatttgcatctagagaatgctttaagtctcagtttgttagcca

SEQ ID NO: 6828906 - DNA, 71 bp, Homo sapiens
cattcagatagtatgattttcttccttagtggttacatttgactgccaggattaaagtatatttttgagtg

SEQ ID NO: 6828907 - DNA, 125 bp, Homo sapiens
tctcatctgcaggtggtttaagtgtgaaggtttactgaagatttaaagagtgttatcacagttgggatgatttaaactaacagtacacgttgcattttaagaaaataattaatcctcagaggaga

SEQ ID NO: 6828908 - DNA, 130 bp, Homo sapiens
tgacatgtaaaatccagtcatagcttgggtttcccggaagcagtccctgagacagagattttagtgcaacagtttatttgggaggcgatcctgggaaacaccagaagggaagtggaaaattgaaatgtcg

SEQ ID NO: 6828909 - DNA, 73 bp, Homo sapiens
ggcttagggcggtctctgcaggcgtgttggacttcagtgcgctccgacacccagcttttgaatgccctgctcc

SEQ ID NO: 6828910 - DNA, 78 bp, Homo sapiens
gttttgtttgtgtccactgcagtgataattatgaaggtaatttagacccatggaaaattgtgtggaaaaaagtagaat

SEQ ID NO: 6828911 - DNA, 63 bp, Homo sapiens
aaagctgactagcatttagtgctgtaaacattttcaaaagcataaagctagaaccttagcttt

SEQ ID NO: 6828912 - DNA, 80 bp, Homo sapiens
gttttatctatatccttcaggtaattttggagttgggcatataagctgctagaatacctacctggaggaggagatgaaat

SEQ ID NO: 6828913 - DNA, 62 bp, Homo sapiens
aaatattcattgaaaaacgttgactgagtgcctacgctgggccagactttcaatgtctgttt

SEQ ID NO: 6828914 - DNA, 68 bp, Homo sapiens
aattacctttgaagttgtgtggggttttttcgtctcccttagatgacccacagttaaccaaaggaatt

SEQ ID NO: 6828915 - DNA, 70 bp, Homo sapiens
taaaatgaaacgtgtttgaaggtcagagattaattgtgtttggtcctatgagcaagtttcttacatttta

SEQ ID NO: 6828916 - DNA, 62 bp, Homo sapiens
gggtagcaaatggctgtcaagtagccaagagggctgagagttgacaaggagccattgcatct

SEQ ID NO: 6828917 - DNA, 65 bp, Homo sapiens
cggctgtggcggcagcagctggtgcctgtcagtaatcacgcataatgctgccgccgccgccgccg

SEQ ID NO: 6828918 - DNA, 65 bp, Homo sapiens
cagtctgtgagtgatgtacctgcctcccccagggtaacccagtgcaagtacaaacgcatcggctg

SEQ ID NO: 6828919 - DNA, 59 bp, Homo sapiens
ccatcttacttggagagccattacgagatgcctaggagggtttcctctgagtgagctgg

SEQ ID NO: 6828920 - DNA, 73 bp, Homo sapiens
gttgaatagaattgaacttgatctttagctagaaatcttccttctagctcgattggtttcatttgtgtttcac

SEQ ID NO: 6828921 - DNA, 92 bp, Homo sapiens
taactctgccttttccaggcgggctagggccctgctggagaggaccctatgacttgccttctctgttctttagcctgcttgaggcaaagttg

SEQ ID NO: 6828922 - DNA, 90 bp, Homo sapiens
acagcgtagttaaattttagtggatatttggttttttaaaaatgttatttccaatatgtcgctacatcattagattttaaacaatgttgt

SEQ ID NO: 6828923 - DNA, 65 bp, Homo sapiens
gagcttcgcagatggaaagtgcttgagggggtgctgaatgcctaggtaatggtctatttcgtctc

SEQ ID NO: 6828924 - DNA, 79 bp, Homo sapiens
tacatatacctttaccttgaccaaataggggaaaaggtgagcagaaaggtcagatgtttggcaagaagaggagtaagta

SEQ ID NO: 6828925 - DNA, 61 bp, Homo sapiens
ggagcaggctctgtggtttccacacatagttcccagcactgcaattaacccagagccttcc

SEQ ID NO: 6828926 - DNA, 77 bp, Homo sapiens
ttttggtgactagttttttaacttgtggaaaattaataattagtattatggtcatttgttagtgcttttcaccaaaa

SEQ ID NO: 6828927 - DNA, 57 bp, Homo sapiens
ccactgtattttggaagcagataacttatcttttagcttcacagaatcaatagttgg

SEQ ID NO: 6828928 - DNA, 95 bp, Homo sapiens
tcaaatatctttccactgtgcttactatggaggatgtgtcctcccagcaggagagacatttgttcctctaagtgacattttaaaaaagtatttga

SEQ ID NO: 6828929 - DNA, 55 bp, Homo sapiens
ctgggcctggcgttccaggctggtcacagcttctccagcctggctgccaacccag

SEQ ID NO: 6828930 - DNA, 88 bp, Homo sapiens
aatattgcaaggaagaaagacatttattttgaggctcatgctttgaaactgcttattgaatttgtctttccttttctccctagatatt

SEQ ID NO: 6828931 - DNA, 71 bp, Homo sapiens
caagaataacttaatgggtcatgctctggactcgattaaagggccaaagctcaagttctttaagattcttg

SEQ ID NO: 6828932 - DNA, 57 bp, Homo sapiens
gctcttccatttctcttgaacttctggagcaggagagtcacatcatgggatttgagc

SEQ ID NO: 6828933 - DNA, 105 bp, Homo sapiens
accgagaatatagaaagctgcctttgacttacagtgaaaggcccatttggtgaataagaaaccttcaactaacttttcataagggcaaatttatatgttcttagt

SEQ ID NO: 6828934 - DNA, 70 bp, Homo sapiens
ccagaacctttctttccttggtctgagctcccgacccaccccctgtctggactggagagaggaagtctgg

SEQ ID NO: 6828935 - DNA, 64 bp, Homo sapiens
acatctgacatgatcttcagtaaaaagtaacataagtcatcactgaaggactctcatgagatgt

SEQ ID NO: 6828936 - DNA, 60 bp, Homo sapiens
gtgggagtggagctcagcatgtcaaaagaagaattgatcgagtgatgatgccactccaac

SEQ ID NO: 6828937 - DNA, 64 bp, Homo sapiens
cgttgtcaatggtgggatgaaagtcaggcgaggggtctgcagccagcccagcccattgacagtg

SEQ ID NO: 6828938 - DNA, 93 bp, Homo sapiens
ttctcagcctccagaactgtaagaaataaaattctgttatttataaggtatccagtttatttatttgttatagcagcctggacagactgagaa

SEQ ID NO: 6828939 - DNA, 76 bp, Homo sapiens
tcttaattttttcacttccaattttgaaatttcaagttataggaaagttgttaagaatggaatgaggaatttagga

SEQ ID NO: 6828940 - DNA, 93 bp, Homo sapiens
agccatgcaaggtatgggattgaaggagagaaaggcaattctggcttcatggactttcaaatgcatgtctttcctcaggccttgaacgtggct

SEQ ID NO: 6828941 - DNA, 101 bp, Homo sapiens
actgattttcaagtgggtttatgtttcctgagcttacaccagtggtcacgtaagaggcattctggtggctgaggaaaagtaggctgagagtgaatgttagt

SEQ ID NO: 6828942 - DNA, 62 bp, Homo sapiens
cctttatctgtggaagtgtttactcatgagataaacgtctattaacatctttccagtagagg

SEQ ID NO: 6828943 - DNA, 113 bp, Homo sapiens
tttattcccaactggttttcatttaaccctcccagacttattgcaactcctaaatagagaacatttctatgttagtatgggtctccgagaagcagatgccaagatgggataaa

SEQ ID NO: 6828944 - DNA, 95 bp, Homo sapiens
tgcctctgcagttgtgtttgctgagttttctcctaagagaaatgtttcttggcaagaagcttcagctaaacaaattatgccatggaagagaggca

SEQ ID NO: 6828945 - DNA, 57 bp, Homo sapiens
gcctcagtaaccttaggggataaataacccatgttttccagatgtcgatactggggc

SEQ ID NO: 6828946 - DNA, 67 bp, Homo sapiens
actgtgtaaagttctactagaatcaacatagaattcttgagattctttccagaactttgaatgcagt

SEQ ID NO: 6828947 - DNA, 73 bp, Homo sapiens
ttacggctcagggcctccccggcagtctttcgtgactgagctcaagaaggctgcatggaggctgtggctgtga

SEQ ID NO: 6828948 - DNA, 55 bp, Homo sapiens
gtcatggaggattgtgagtggttgagaaccactgccataccccatctctcatgat

SEQ ID NO: 6828949 - DNA, 79 bp, Homo sapiens
ggtaagggtaagtggggcagaggccaagcagtacttctcaaactcaagcgtgcaattctgtccacgcgaggcccttgct

SEQ ID NO: 6828950 - DNA, 104 bp, Homo sapiens
gctctgagaaacgaggcagcgggcactggggcagccacatagacaacatctaaatttttgttgctttcctgggtcttgccctgtccttactgtttcccttgggc

SEQ ID NO: 6828951 - DNA, 87 bp, Homo sapiens
tatgttaaattacttgtttgttctttatatttagggattcatgtagaagataatgacctgaaatttgtggtagaacaggcagacata

SEQ ID NO: 6828952 - DNA, 64 bp, Homo sapiens
gtgacttgctgtcaatggaccccccggtgagaaggggaggagccaaggatgacagtacagtcac

SEQ ID NO: 6828953 - DNA, 87 bp, Homo sapiens
tcccatgctgtgaccctctagagggaagcactttctgttgtctgaaagaaaccaaagcgcttccctttggagcgttacggtttgaga

SEQ ID NO: 6828954 - DNA, 58 bp, Homo sapiens
ggcagaagaatatggatgtccttgctcaagacaagagagaatctgtcctttctctgcc

SEQ ID NO: 6828955 - DNA, 68 bp, Homo sapiens
tgtgccagtgctgtcttctccagggttatctctgctactttttttcctggagtgcaacactaggtata

SEQ ID NO: 6828956 - DNA, 73 bp, Homo sapiens
ctccacaggcccctctgctgggagcgcatacacaaaagtgaggctccttgaaagggggactctgtctgtgcag

SEQ ID NO: 6828957 - DNA, 66 bp, Homo sapiens
gtcactggatgcaagattgccttaaaaagtgtgactttaggcagggttagtctttgcagctaggac

SEQ ID NO: 6828958 - DNA, 62 bp, Homo sapiens
ttgagttttgcaacctccttctttgatagattgtctcaaaggaccaggttcccaaaagtcaa

SEQ ID NO: 6828959 - DNA, 64 bp, Homo sapiens
gctctctgctgtgcttgtggccacccgatgttggatactgggtgatactgcagagcaacggagc

SEQ ID NO: 6828960 - DNA, 79 bp, Homo sapiens
tgggacgaggccgccagtggttgcttgcatggctccaaaagttgacacttgggacaagcacttcacagcctccatccta

SEQ ID NO: 6828961 - DNA, 60 bp, Homo sapiens
gggaggagaggggctgccaagtgccgggctggaggggctgaggcatctccactcctaccc

SEQ ID NO: 6828962 - DNA, 57 bp, Homo sapiens
taacactttctattattatggtttgtttattgggagccaagagggatgagagtgtta

SEQ ID NO: 6828963 - DNA, 56 bp, Homo sapiens
ccctgcgcctcagacctcaccagtgtttccatcagacacagtaactgggcgcaggg

SEQ ID NO: 6828964 - DNA, 58 bp, Homo sapiens
tcacttggcaggtcaggggatattgcagagggtgtagattaaactgggctgtcaagga

SEQ ID NO: 6828965 - DNA, 82 bp, Homo sapiens
gagttatgaggtagctgtggctggctgggttttgatgaagtacccataatttcatatcagctgccacaggactttctgactt

SEQ ID NO: 6828966 - DNA, 72 bp, Homo sapiens
tacttgtcactgttttacatgttatttaataatttacagttatttaaaagtggtaagattccaaggcaagta

SEQ ID NO: 6828967 - DNA, 98 bp, Homo sapiens
cttatctcatttgaacctcatgaggcaggcagggtagaggaatgtctgactatccaacagccttcatgaaatattttgttctagatgaatttgatgag

SEQ ID NO: 6828968 - DNA, 61 bp, Homo sapiens
gggccagctgtaagctgctgaatttttccaaattgaattattcgatattctcagctgatcc

SEQ ID NO: 6828969 - DNA, 100 bp, Homo sapiens
tttcaaactatattttctggattcttttggtagttctttcccagagtaagtccctaatacttagaacctgccaaagagagtaagaatgtgtattttggaa

SEQ ID NO: 6828970 - DNA, 87 bp, Homo sapiens
tcagagacacctctcatttctcctcaatgccactgcactgatgtcaactgacttagggcaggcatgagagaactgaggtttacatgg

SEQ ID NO: 6828971 - DNA, 76 bp, Homo sapiens
tttcttagtaggtgtgcatgtggaagcatgtatgtgagtcttctatattctgcttttgatgcattcatactggaaa

SEQ ID NO: 6828972 - DNA, 72 bp, Homo sapiens
tctagcttcggggccagtgcctctcttcccctgctgggatgggacagggctggctggtccctggatactgga

SEQ ID NO: 6828973 - DNA, 82 bp, Homo sapiens
ggctgatagatttcaggttttgtctctgtctacatgatctcaccatgatagaaaatgaagacgagataaaatggtgtcagcc

SEQ ID NO: 6828974 - DNA, 73 bp, Homo sapiens
aggacattctgagctactaattaggcatctggtgtgaggggaggtggctgccaagcaggtcagagaagttcct

SEQ ID NO: 6828975 - DNA, 85 bp, Homo sapiens
atgttgttaaagggtacaaactttcagttataacatgaaagtacaaactttcagttgtaagttctgagggtctaccgtacagcat

SEQ ID NO: 6828976 - DNA, 88 bp, Homo sapiens
cattgatcttgctactattccacggaaagtcaccctaaggaatatgcatgtgctcctatgactctcttgtgtagagatcagatcattg

SEQ ID NO: 6828977 - DNA, 101 bp, Homo sapiens
tctttgtcttagttggagttctctcaaatggatttctggcccctcctgtgaggtgggactggcagataccttttgttggaatttcccatgagcttagaaga

SEQ ID NO: 6828978 - DNA, 73 bp, Homo sapiens
agatgaatttgacaaatacccattagaccagccaacggcttgctcagtgactcctatttgcttgaatttattt

SEQ ID NO: 6828979 - DNA, 56 bp, Homo sapiens
gatggttacatgtatgtttggtataaaattgtctttataccgattatgtaaacatt

SEQ ID NO: 6828980 - DNA, 89 bp, Homo sapiens
ttcaaagctgagtaacttcagattacacactcaagtcctgttatttgttaacagcatttgaatgagtaacttgctcccattgctttgaa

SEQ ID NO: 6828981 - DNA, 111 bp, Homo sapiens
ggctcttcttcagtcacttcccatctccccagccttgcctctgcttactggagtgttactctgagggttgtagagagggacggagtgagggggaagtgattgttggtggtc

SEQ ID NO: 6828982 - DNA, 66 bp, Homo sapiens
tagctttttcttctctagccaattagaactgttcagctgggggaggctaaggaagaaggatcgtta

SEQ ID NO: 6828983 - DNA, 91 bp, Homo sapiens
tggatgaagaaagcctgcataaggagatatcatgaatcattacatggatatttattgagcctttcctatgtgccagatgctctattagaca

SEQ ID NO: 6828984 - DNA, 71 bp, Homo sapiens
ggactatttttgctccacaactttgaagtgaccactcaaatgtcattgtttaaaatgtagcaagaaaagcc

SEQ ID NO: 6828985 - DNA, 70 bp, Homo sapiens
tgcctttccattggattctctatccttgcttatgcgagtcccaagcagcaagtggaatcatggaaaagta

SEQ ID NO: 6828986 - DNA, 74 bp, Homo sapiens
cagaggtgactcagaggccctgctcacacagcccagctgctgctgtggcaggaagagcttctgagctacacctg

SEQ ID NO: 6828987 - DNA, 67 bp, Homo sapiens
ggatgaaatgtctatctggcatattccaccttgggtcaggaatagccggcatcagtcacatgcatcc

SEQ ID NO: 6828988 - DNA, 62 bp, Homo sapiens
gttgtactgtctttgagctggaggaggagaatacatcctccctcagaatgaagaaaggcaac

SEQ ID NO: 6828989 - DNA, 56 bp, Homo sapiens
ttcttctccctgcctctgttctgtgctctgggggcactgccaggcagggtggggaa

SEQ ID NO: 6828990 - DNA, 78 bp, Homo sapiens
ataagtagaaaatatggtgctaatgactagtatttggtataagtagataaatgttttgtatcacatttgcatgcttat

SEQ ID NO: 6828991 - DNA, 69 bp, Homo sapiens
gatgagtctggagatcatgtggggtggattattttcttatttttgcactgtacatatttcccacttgtc

SEQ ID NO: 6828992 - DNA, 59 bp, Homo sapiens
tttgattcctggggcagggctgacacctgtgaggaagcagagggccccaggtaatcaaa

SEQ ID NO: 6828993 - DNA, 60 bp, Homo sapiens
gggactctcctgtgtggacccagccctgacgaggaagggaaaggccagagggagggtccc

SEQ ID NO: 6828994 - DNA, 78 bp, Homo sapiens
aacacagaaaggcaccttctggccagacacagtgcaggaaatttgcctttcatggctcaggagggatctttgcttgtt

SEQ ID NO: 6828995 - DNA, 64 bp, Homo sapiens
ggcccagaaaaaggcttagaatgtgtttctggaagtggtataaaggaagcctttctttagggcc

SEQ ID NO: 6828996 - DNA, 71 bp, Homo sapiens
aggcctgtccagcctgcctggctatcaggagcttatgtctcagcctctagctgggccaggtggtcagacct

SEQ ID NO: 6828997 - DNA, 102 bp, Homo sapiens
tacaaaaacttagccaggcatggttgtccaagctacttaggagtctgaggtgtgaagatcacttgggctcaggagtttgagaccagcctggccaacactgtg

SEQ ID NO: 6828998 - DNA, 83 bp, Homo sapiens
ctggcctctatgcctttggccttccagtactctaccagaatacctgaatagaaaggctgctgccaacccagcctggaggccag

SEQ ID NO: 6828999 - DNA, 82 bp, Homo sapiens
ttagcttctgcagacttgataaccactgggagatacacctgtgtatagggcggttgtgattgaagtctgcagctctagctaa

SEQ ID NO: 6829000 - DNA, 84 bp, Homo sapiens
gaccgagcagcctgagctcaagaaggtgaccagacggaggcagagccctacacagtgatcgccttcttcctcgggatcttggtc

SEQ ID NO: 6829001 - DNA, 80 bp, Homo sapiens
caggaagcttctttatcatcacattacctcttggggactattatttacttccaagtctaaagtgatggttttctgccctg

SEQ ID NO: 6829002 - DNA, 78 bp, Homo sapiens
tcaaggacaattttgttgggagaaacattattttatttcattgaaaatgagtgtatctgcgacaatgtttgtttttga

SEQ ID NO: 6829003 - DNA, 89 bp, Homo sapiens
ctttgctctcagatacttgaggagatcaccacataaattcttagagttctgggtttagctgtagtgtttagtctagtgtcgaagcagag

SEQ ID NO: 6829004 - DNA, 71 bp, Homo sapiens
aaagttgaccgaaagattttgaaaatccttaccagttgtttgtcatatgttaaagtcttatggttaatttt

SEQ ID NO: 6829005 - DNA, 80 bp, Homo sapiens
gcaggggttaaagatggagatgacctaggacagcacctggcccacaggggacactcttagttagctcccttcttctctgc

SEQ ID NO: 6829006 - DNA, 69 bp, Homo sapiens
agagacgaaggtaaacacatgaatgtctgtatttccgcacacatcatgccaagtttcacctgcctttct

SEQ ID NO: 6829007 - DNA, 85 bp, Homo sapiens
aagtctacacaattacatttaagagttctgaatttgagtgtctcacctctttaatattcaaagtctagatgtagtgttgaaactt

SEQ ID NO: 6829008 - DNA, 61 bp, Homo sapiens
gatgtgatgtgagcaaatgcttgaaatgtacttgcttagttaggcttgtgctttgtcactc

SEQ ID NO: 6829009 - DNA, 65 bp, Homo sapiens
gcgtgtgtcagcctcctccaccccagagtcggctgcagactcaggggcagggggtggctcactgc

SEQ ID NO: 6829010 - DNA, 62 bp, Homo sapiens
ctcgctcattactgcctggccctgcacgaggaacaagggatacaggtgtacagtgagctgag

SEQ ID NO: 6829011 - DNA, 64 bp, Homo sapiens
gtaatcccagctacttgggaggctgaggcatgagaatcgcttgaacccaggaagcggaggttgc

SEQ ID NO: 6829012 - DNA, 74 bp, Homo sapiens
gcatgggttcatctttggacatgttgaggttgcagtgcctgtcaactgggaatgtcaagagaacgattgtatgt

SEQ ID NO: 6829013 - DNA, 64 bp, Homo sapiens
gatgggagagcagagcagtctggagatccagcaatagctggggtttcaggtggtctgcaccatc

SEQ ID NO: 6829014 - DNA, 66 bp, Homo sapiens
tgattatgtgaggttcagctttatctcttgaaaaacaagtgtgataatctccatctcatatgttca

SEQ ID NO: 6829015 - DNA, 59 bp, Homo sapiens
ctgtgagtcttcagcaagtgttgggggtaacacacccaaaacagtgaatgaggccagag

SEQ ID NO: 6829016 - DNA, 73 bp, Homo sapiens
ggccttggagtcagccttgagcgggcaggagaccacaatgaagccgacgaacttgaggctgcactccagggcc

SEQ ID NO: 6829017 - DNA, 65 bp, Homo sapiens
atccaacattcctattatgtccctagtgttatgccaggcacagagattacagaggagattgagat

SEQ ID NO: 6829018 - DNA, 60 bp, Homo sapiens
cccatggtataagctggggagatttacaggaccatgtgtcctgggcccaggctgccaggg

SEQ ID NO: 6829019 - DNA, 55 bp, Homo sapiens
gacacccctttcaacttggtgggaacaatctaaggacttgaataaggtggtagtc

SEQ ID NO: 6829020 - DNA, 128 bp, Homo sapiens
cacaatatatggaatatttgttaatatatcatctgtgtatctgtgcttagatgctgatacccagttgctctgaaataactgatgccagatcatgtcatgtaattatctagtaggggccatatggagtg

SEQ ID NO: 6829021 - DNA, 81 bp, Homo sapiens
agggaccaattagtgtcaactgtgatgtcaacacttgcctgtcaagtcctgcatccagttacatcttcctaatgaagccct

SEQ ID NO: 6829022 - DNA, 129 bp, Homo sapiens
tattagttattcttcagatattttaattatatagctttcataatggctctaaaatgacatacaagtttaggatcaatgagaaagtctatggtagttctgtttcctaaaattaatgattgataactcatg

SEQ ID NO: 6829023 - DNA, 72 bp, Homo sapiens
gaggaacacaggcaagagtgcaggtctgagctgcttagaaggctcagagatgtgtgtctgtgtttgaccctc

SEQ ID NO: 6829024 - DNA, 79 bp, Homo sapiens
tctccacaacaccctgtgtggccgccacttggggcaggccctgtgggccccacccagcctggctgaggggcggtggaga

SEQ ID NO: 6829025 - DNA, 63 bp, Homo sapiens
tgacgtggggctgtgatctgccgactgttccttgaggagtccacagctcatagttttttgtta

SEQ ID NO: 6829026 - DNA, 84 bp, Homo sapiens
tttaacttttgccaatctggtgggtgcaaatggcatctcattattgttttaatttgcatttctcggattgataatgaggttaag

SEQ ID NO: 6829027 - DNA, 62 bp, Homo sapiens
acagtagattggtatgatgtcagagaaggaattcctggatgactcgggactacatttactgt

SEQ ID NO: 6829028 - DNA, 82 bp, Homo sapiens
caagttaaaactgctctgtcttctgtagctaataattcttggcactgggattatgtttcaggatggcagaacagtctgcatg

SEQ ID NO: 6829029 - DNA, 62 bp, Homo sapiens
actgattacacgagttctgactcctactacctgcttgtctgtcagtaacctcctggatcagt

SEQ ID NO: 6829030 - DNA, 58 bp, Homo sapiens
cccctcacccagacagaaataatttccatttacaaggaattctgtaagggagagaggg

SEQ ID NO: 6829031 - DNA, 61 bp, Homo sapiens
ggggtcagcaaaatttggtctgtgggtgaaatccagcctactgcctgtttggcatggcccc

SEQ ID NO: 6829032 - DNA, 63 bp, Homo sapiens
cacaaggcctgaacatgaggagatgggaatcttagaatctgtctaacataccaggtctatgtg

SEQ ID NO: 6829033 - DNA, 56 bp, Homo sapiens
atttgtctgagcagggagtgacgaaatgacagtcatgccagtttgtgcaggcagat

SEQ ID NO: 6829034 - DNA, 58 bp, Homo sapiens
tcacttgggtgttgagtgtggagactattgcgtgtggagactaaactgcacctaatga

SEQ ID NO: 6829035 - DNA, 75 bp, Homo sapiens
taagtgatttgaagcagtgcctgatattcatgcaagaagctagaaatgtcagttgctgcttgaggtaaacatttg

SEQ ID NO: 6829036 - DNA, 86 bp, Homo sapiens
actagtgaattttctgctgattcttaaatgtggttgtgatacaactaaatgatgacagttagatataaccccaggaaatgtatggt

SEQ ID NO: 6829037 - DNA, 68 bp, Homo sapiens
ctgtaatcccagctactcgggaggctgaggcaggagaattgcttgatcctgggaggcggaggttgcag

SEQ ID NO: 6829038 - DNA, 81 bp, Homo sapiens
tctctagtggcatccctgcttgcttgttgtgccatgtgaacataggccatttgagggccaggtttgggctgcagctgtgga

SEQ ID NO: 6829039 - DNA, 73 bp, Homo sapiens
gcttcctcatctgttcttcaaaatattacataaattaattcatagatgtaaaggttttagagcagagattggc

SEQ ID NO: 6829040 - DNA, 61 bp, Homo sapiens
agtagaatgagaatgaactcttttggaccacaagggccagaggtgtagtgtctcatctact

SEQ ID NO: 6829041 - DNA, 60 bp, Homo sapiens
tgtaagttttgtgaaacaaacatacaaagaaatttgatttgtttgttagagaagcttcca

SEQ ID NO: 6829042 - DNA, 75 bp, Homo sapiens
gtgatttcatcaacccatgttggaagcttatcagacactgctggtatggggcaaaaactggggagatgaaaccat

SEQ ID NO: 6829043 - DNA, 83 bp, Homo sapiens
cctcctcgggcagcagcaggcgctcggccgtctggatctccctggaggtgatggtcgagcgcttgttgtaatgcgccaggcgg

SEQ ID NO: 6829044 - DNA, 61 bp, Homo sapiens
aggcatcagggctttgcactctcaggggtccttccgcctggatgtccttcccctgaagctt

SEQ ID NO: 6829045 - DNA, 85 bp, Homo sapiens
cacatttttaggaaataagcatgtactcaagcaaatgtttatttataaatatgctgattgtagtattgcttataaccagaatgtg

SEQ ID NO: 6829046 - DNA, 76 bp, Homo sapiens
aggatgatctttcctaactgaatattctttcaccaacaacagaggaaggagatcagcttagggaaggtttattcct

SEQ ID NO: 6829047 - DNA, 95 bp, Homo sapiens
ccgttttgggagggggcggaagtgccaggacagcaggagcggtcagtggtggccagtgtgtgctgccggctcccacgtggcccccctcggtttgg

SEQ ID NO: 6829048 - DNA, 55 bp, Homo sapiens
gtttgagagtttcggcatgcagtgatagaaaacactgagggctttgaatccagac

SEQ ID NO: 6829049 - DNA, 79 bp, Homo sapiens
atctagattggcaggagtattacattttcagactgaatattttcatggaaagccagtgttccatcagccattttaagat

SEQ ID NO: 6829050 - DNA, 75 bp, Homo sapiens
gctgggagcagagtttgtatttttgctaacttttcctgcttctgacaggacagcagtgcccattctgccccctgt

SEQ ID NO: 6829051 - DNA, 65 bp, Homo sapiens
ggcagacacagtgagtttctttcccaagcagagtggcatctgggtggagacggcgctgtgtggcc

SEQ ID NO: 6829052 - DNA, 66 bp, Homo sapiens
gaacaaattggagaaatcaggattgattacgttatgtgctctctttgtcttcctccgggtttgttc

SEQ ID NO: 6829053 - DNA, 62 bp, Homo sapiens
gctgaccttgagataatgcagaacctggaggcccaccaggttccacggtgtttggaggcagt

SEQ ID NO: 6829054 - DNA, 64 bp, Homo sapiens
cagggattgtgtgaggtatggaaagtggttgacattgaattccaggctgcacagttgggacttg

SEQ ID NO: 6829055 - DNA, 76 bp, Homo sapiens
gtgtgtgtagtcagtagatccaaacttttgagaaatgaatgaatcaaggggcaagttttgttgactgaattcacac

SEQ ID NO: 6829056 - DNA, 84 bp, Homo sapiens
atgcggagggtgttttctaggaggaactttggaaggagctattttcagagtcagctcctctctataaagccagaccaatcgtat

SEQ ID NO: 6829057 - DNA, 76 bp, Homo sapiens
gccaccctgggccaccctggaccaccctgggctgtgatgacacagagtctgggtatagggtgtgccttggtttggt

SEQ ID NO: 6829058 - DNA, 87 bp, Homo sapiens
gtataaaacgaaagctcaatgtgtatatataaaatccaccaagaggcctgataatgcacctttgagtatggctgcttttgtttttgc

SEQ ID NO: 6829059 - DNA, 56 bp, Homo sapiens
cctgccatgcctggtgcagaacctccaccttagaagtggggactgggcggggcagg

SEQ ID NO: 6829060 - DNA, 59 bp, Homo sapiens
agtttatagcatcataaataagatgcattcgttgcctttacatttgagagctataagct

SEQ ID NO: 6829061 - DNA, 59 bp, Homo sapiens
ttcatgtgttgtctcatttaatccttgcagtaatgtgatgggtgtgagctgactgtgaa

SEQ ID NO: 6829062 - DNA, 82 bp, Homo sapiens
ggggcaacagtgataccatccctgcactcctgggtcctgctcttccaatgcccaaggcatggcatggtggcagctgtgcccc

SEQ ID NO: 6829063 - DNA, 57 bp, Homo sapiens
gttgtcaagaaggggactgtcacacctgctaagcaggttaagcttgtttttgaaagc

SEQ ID NO: 6829064 - DNA, 55 bp, Homo sapiens
ttcctacaggtgcaaaccctcctagtatcacccgcaggctcctgtacctgaggaa

SEQ ID NO: 6829065 - DNA, 80 bp, Homo sapiens
gggcctccccaaagtgacaaggttagggagtgcttagcggttttgtgttcagccttagctttgtttatagagggaggttc

SEQ ID NO: 6829066 - DNA, 100 bp, Homo sapiens
aagtatgtttattttgccatgcattttaagtttactgttgatatttagtctacatatggtatatggacttaaaatttgatgtgggcataaaaatatattt

SEQ ID NO: 6829067 - DNA, 97 bp, Homo sapiens
gctaaataccagatggagaagggtgctgcagatatgatgctccacattttccttttatgcttcgtctccaaggccctactctatttattgctgtggc

SEQ ID NO: 6829068 - DNA, 55 bp, Homo sapiens
cagtctctggcagctgctggcctgacctttgtttccccagcctttccagtgattg

SEQ ID NO: 6829069 - DNA, 64 bp, Homo sapiens
ggatggtgacccagggtttctgcacagggtctgcctccctgcttgtcacccctgggtcctctct

SEQ ID NO: 6829070 - DNA, 89 bp, Homo sapiens
gttttgaaatttctagatagcacttttgagcttttgtgcaagaaggcaagcagaaaagagttcagttctatgtggcaagtaacataaac

SEQ ID NO: 6829071 - DNA, 59 bp, Homo sapiens
ctggtggttcatgcctataatcccaccactttgggaggccgaggcaggcggatcacaag

SEQ ID NO: 6829072 - DNA, 73 bp, Homo sapiens
cttgcaaagctgtaatgcatgctttcttttatctctcaaagtaatagaaatgagattagagcttttctgcagg

SEQ ID NO: 6829073 - DNA, 57 bp, Homo sapiens
tgatctttttggtcatttgggttagtttgcacttctcccaggagaagaaaagatgca

SEQ ID NO: 6829074 - DNA, 79 bp, Homo sapiens
gtctgtgtttcatgtacttttttgatagacagcatttttttgtggagcattttgttgttagagtatgtgaaatgttgat

SEQ ID NO: 6829075 - DNA, 60 bp, Homo sapiens
tctgccagtgcctctgcttcctcactgctgccgcctgctcaggcagagcgcacttttaga

SEQ ID NO: 6829076 - DNA, 62 bp, Homo sapiens
ttcacaagagggcagccaactgatcctactaaaacttagatcatttcagtcctctgtgtgag

SEQ ID NO: 6829077 - DNA, 73 bp, Homo sapiens
ctgaaatgacggtttggggcaatgtgtggtctcatcacctcggtgcccaaagctccagtgaccatcgttttag

SEQ ID NO: 6829078 - DNA, 57 bp, Homo sapiens
gaggggaggatcagggctgcgactcccagagcactgcagcagggtggtctacttctc

SEQ ID NO: 6829079 - DNA, 76 bp, Homo sapiens
gattgtgctaagcccaggagggagatatgatggtaaaatgatagacattgttcctaacctcatggactttacaatt

SEQ ID NO: 6829080 - DNA, 57 bp, Homo sapiens
tagagccagtgtgtccttagcaatgatctcttttcattcctgataaatgctgctctg

SEQ ID NO: 6829081 - DNA, 81 bp, Homo sapiens
cttccacctctgaggctgagccatgaggcctcttgccccaggggacagtaggacagttctgcctccagcaaaggtgtgatg

SEQ ID NO: 6829082 - DNA, 56 bp, Homo sapiens
aaaggggatcgatgcactctggggccagagaccctgagctgcaccttgacctgttt

SEQ ID NO: 6829083 - DNA, 98 bp, Homo sapiens
caaatgctaagatctgagaaaaaaatgaatcacattcaggcttggaataaatccacatgaatatgtatttcttatttacttggaaagtcttgtatttg

SEQ ID NO: 6829084 - DNA, 68 bp, Homo sapiens
ggagctttaggtggcgtgtgtgcctacttcgtgggagtgttcaaggttctttgctacctttgggctcc

SEQ ID NO: 6829085 - DNA, 101 bp, Homo sapiens
tcatctgtaggaccccaaaaaatgccacctcctctagtgaaacttccgcagtttccttagacagaggtggtcattcattagggtcttccacatcctgatga

SEQ ID NO: 6829086 - DNA, 58 bp, Homo sapiens
cctttgcaatgaattgttattgtcccttaatttagcatggtgcagttcactgcagtgg

SEQ ID NO: 6829087 - DNA, 62 bp, Homo sapiens
atttgagatgctgctcttactgtatattaaatttctgtgtgcagttgggtctgtttttgaat

SEQ ID NO: 6829088 - DNA, 86 bp, Homo sapiens
gaaggccttggttaaaacatttcagcacctgattcctggacagcaccagagccatggaacaggctcagagatgctgcctggccttc

SEQ ID NO: 6829089 - DNA, 64 bp, Homo sapiens
aagcacacagcaaaggggagctgggccataccagctaaatcctacttttgtatttgatgagctt

SEQ ID NO: 6829090 - DNA, 71 bp, Homo sapiens
tttaaaggtcatgcagtattcaggacagttcttccttgtaaggactgcctatgcagtgcaagatatctaaa

SEQ ID NO: 6829091 - DNA, 82 bp, Homo sapiens
gaggataaggttattcttgttagtggacactgcctcttatgtagaaatttcctaaccacagggtgaatgtgacattatcttc

SEQ ID NO: 6829092 - DNA, 72 bp, Homo sapiens
ccttccaggactgtgagtgcctagaaagtggaaacctcattctattcatcttcatagtcacagtgcttgtgg

SEQ ID NO: 6829093 - DNA, 98 bp, Homo sapiens
tgattaaagctttttagaaaccaaatgttacacataggcataaatggagcaaaatattttaatgcgtgtttggcaggttcagaaacactttatagtca

SEQ ID NO: 6829094 - DNA, 67 bp, Homo sapiens
agacaagttacacctgtgcttgattttaggttcatattttatatgtcaaacaggtgtaataatgtct

SEQ ID NO: 6829095 - DNA, 56 bp, Homo sapiens
cagtgccttggaaaatcaactctggaagtccatagcagttgaatcctaaggtattg

SEQ ID NO: 6829096 - DNA, 75 bp, Homo sapiens
ttgcagtgatttgcactctgcctttcagcagatgaacaaaagtgacagacatggaagccagagttgtggctgcaa

SEQ ID NO: 6829097 - DNA, 62 bp, Homo sapiens
ttcctctgtagttgctgatgaatagaggctgctgtttgtggtgctcagtactgcagagagaa

SEQ ID NO: 6829098 - DNA, 88 bp, Homo sapiens
gttcgcgtctctgactgctgtcccatccctgctcccagagaagtgcctggcatgtagcagggctgcagtgtgtctttgtggatggaac

SEQ ID NO: 6829099 - DNA, 56 bp, Homo sapiens
agcccaggtttgagtttctgggaacatcccagagccctctgcaatgcctcagggct

SEQ ID NO: 6829100 - DNA, 83 bp, Homo sapiens
agcttaagtgcttttgattgagtaaagaaagagggataaggattgtttattctttaccactactcttccaaagattttaagct

SEQ ID NO: 6829101 - DNA, 82 bp, Homo sapiens
tcaaaaattgcgtggctgcgaggacccagccagggctgccactagtatatgctgtgtagttcgcagggcgcatgaattttga

SEQ ID NO: 6829102 - DNA, 82 bp, Homo sapiens
aatcctctgctggtccccatctctctcattgtaaaagccgaaatttttacaagggtttctggggcccagcacatcctggatt

SEQ ID NO: 6829103 - DNA, 69 bp, Homo sapiens
tctgtccagtgcaatttggggagtgtgggggtggctccattactttgtactgttgaaattgctggaaga

SEQ ID NO: 6829104 - DNA, 77 bp, Homo sapiens
catttctgatgactggatggccccactggatccatgactcttgactcaactggtcctatggccactactcagaagtg

SEQ ID NO: 6829105 - DNA, 57 bp, Homo sapiens
tgggttctttcacttctcagtttcatggtagattttggtccaaaaggaaagaaccta

SEQ ID NO: 6829106 - DNA, 88 bp, Homo sapiens
cagttacttcaggccatctgggcatatatgtgcaagtcacaggggatgcgatggcttggcttgggctcagaggcctgacacagtgctg

SEQ ID NO: 6829107 - DNA, 86 bp, Homo sapiens
ttaggcatgaacaggattcattgaaatatatgtagcctgcaacatctatacagtgccggagattaatgttcttgtttatgacttaa

SEQ ID NO: 6829108 - DNA, 60 bp, Homo sapiens
tacagtgtgctgtgatgtagtatacaataatagagtgtaatatagcattgtatgactgtg

SEQ ID NO: 6829109 - DNA, 75 bp, Homo sapiens
agggcgttcactatgtgcacagagactgtagcagagacaagatgcttctggtgctggtaactgtggtggcacctt

SEQ ID NO: 6829110 - DNA, 93 bp, Homo sapiens
ccactgtccctcctgtgttcacttcaccttatcacagttctcaggagggcctggggtaatgaacaggtggcagagacagcaggaagagtctgg

SEQ ID NO: 6829111 - DNA, 71 bp, Homo sapiens
cagtgacttgtagataggatttgagtgttcacattcctgaatttttacaatttctctttatatctcacatg

SEQ ID NO: 6829112 - DNA, 68 bp, Homo sapiens
ggaaagttttatgaataaccagtgttttgaatattgttttagataacaatgtctgttcataaaatacc

SEQ ID NO: 6829113 - DNA, 58 bp, Homo sapiens
caggcagtgatatttaatttgtatagtgatgtattccaagtgtctatatcagtgcttg

SEQ ID NO: 6829114 - DNA, 63 bp, Homo sapiens
aagccaggtgttgggagaagagataaagagcagcttcagtcttagaacctaacaaccttgctt

SEQ ID NO: 6829115 - DNA, 56 bp, Homo sapiens
cggaagacagtccgctctttcaatgctgtggctatcttggagagctgctgcttccg

SEQ ID NO: 6829116 - DNA, 64 bp, Homo sapiens
gtatgtgtgtgtgtatgtgtatgtattttttccaatgtatgtgtatacatgtgcacacacatgc

SEQ ID NO: 6829117 - DNA, 59 bp, Homo sapiens
agaggaggatagatggaagactcaaatcctttgtcaagttctttccaatgtcctcctct

SEQ ID NO: 6829118 - DNA, 62 bp, Homo sapiens
cacatgtgcagttacatgaattagaaacatgcatctaggattatgagatgtctgttcatgtg

SEQ ID NO: 6829119 - DNA, 78 bp, Homo sapiens
tacctttgaaaagaaccatcgccttatgccataatcttcctcttgctatttggctgtggttattttttaggattggta

SEQ ID NO: 6829120 - DNA, 60 bp, Homo sapiens
ccaaattaccagtaatagtatgtgagatgatactatccagcagatattttggtgaactgg

SEQ ID NO: 6829121 - DNA, 59 bp, Homo sapiens
ttacacaggcacttaaaatgcagtttaatgccacaaccactgccaaagcccctgtgtga

SEQ ID NO: 6829122 - DNA, 71 bp, Homo sapiens
atatatgggtatatagaagtaaatacagatgtaaaatgtacacatgtatatgcttgtgtgtgtgtatgtgt

SEQ ID NO: 6829123 - DNA, 86 bp, Homo sapiens
ccattgatagttttcatgaatcgtggaatgatttatcttttcagaaacagataaatggttccgtgattcatgaaaactaccagtgg

SEQ ID NO: 6829124 - DNA, 76 bp, Homo sapiens
ccacccagagattaaaagcagcagtcctttgtgtaatttaaaatactgaataatattggagctgtaagtcttgtgg

SEQ ID NO: 6829125 - DNA, 57 bp, Homo sapiens
tggtgccaccctccttcagctgattaatcatctcttctgctgggggcgtggtcacta

SEQ ID NO: 6829126 - DNA, 56 bp, Homo sapiens
cagagcagcagagcttccatggacagccaagacacccctgcaggcactgctgcctg

SEQ ID NO: 6829127 - DNA, 118 bp, Homo sapiens
ggtgtgccttttaccagcccaagctacttagaaagcacagttggtgcatgatttatctccctgttcatgcccatgcttagcattgtgctttgtatttggctagtgctgaagaaatacc

SEQ ID NO: 6829128 - DNA, 55 bp, Homo sapiens
ttgcagccctgtgcacatcccctctcgggagggccagagtacatcagggctgggg

SEQ ID NO: 6829129 - DNA, 67 bp, Homo sapiens
tttctgctagtatatatatgtctgaagacaaaatttgacagtctccagcatgtttgtgctgctgaaa

SEQ ID NO: 6829130 - DNA, 72 bp, Homo sapiens
tggggaattcaaaaatgggcactaatgacttttgagcagtgctttccaggaggtcaaaggcctgtttcctca

SEQ ID NO: 6829131 - DNA, 62 bp, Homo sapiens
aagtctcatccgtgtagctccacgtgtaataaatgtgagtcgagtgaacgaatgaaagattt

SEQ ID NO: 6829132 - DNA, 76 bp, Homo sapiens
gctggaccatggtcatttgagcatggccagtcccttggctccaggctttggccaattccagaggatcatgtccagc

SEQ ID NO: 6829133 - DNA, 94 bp, Homo sapiens
gttttgagatcctcaaatacaggattctgtaatctgtgaaatttaaaaattgatttttttaagattgcaggattatatcaaggggattcaaggc

SEQ ID NO: 6829134 - DNA, 85 bp, Homo sapiens
tggatgctggaaaaagattgtgtttttcagcatctgcagcctgggctgttttccacaggaataaatacagttttttccagctcca

SEQ ID NO: 6829135 - DNA, 55 bp, Homo sapiens
tgctggggtatgggtgtggcctggtgggggctcaggggccatctctgccccagca

SEQ ID NO: 6829136 - DNA, 129 bp, Homo sapiens
cccctggcagtgagggctcaggcatgtcttctccttggtcatttgtatgttcctccttaggactttgaatcttgaatgaggcatgcaaaggggaagggacagcttagaatcctcctgtgacagacgtgg

SEQ ID NO: 6829137 - DNA, 79 bp, Homo sapiens
gaactgcatttattggcatgtagtaggtagtagagaagtggaaattattagacttattattgtcagtagcatgcggttc

SEQ ID NO: 6829138 - DNA, 76 bp, Homo sapiens
tcttattcaatttgtatacaatatgattctgtcacatagataccttcatttatattgtgtaataagtgaagtggga

SEQ ID NO: 6829139 - DNA, 67 bp, Homo sapiens
gttagggttacaccagcctcctggcatgaagatgtgtttttcaactcagagctgtccaaaccctgac

SEQ ID NO: 6829140 - DNA, 89 bp, Homo sapiens
gccatggagaagcaggctcagcccaaggtggagaggccattaaggaggctggggagcccctccatttctgggcatgatcctgccaaggc

SEQ ID NO: 6829141 - DNA, 91 bp, Homo sapiens
agtgtcaggagagggagaaggatgctgctgtcacggccccttggttctctgttgcaggggctgacagcacgccttctgttactctggtact

SEQ ID NO: 6829142 - DNA, 66 bp, Homo sapiens
agagggaggtgatactgaacgtaacacacttcgagttttgtgttacatttgggggtaccacctttt

SEQ ID NO: 6829143 - DNA, 75 bp, Homo sapiens
agggctataattcaggttttctggcacagtggttttgatcctgaatgtgtttgagggcctgggtcacagagctct

SEQ ID NO: 6829144 - DNA, 55 bp, Homo sapiens
gcataagggcatattgacgggtgagtggggggtccacacagtggagtgcccttgc

SEQ ID NO: 6829145 - DNA, 79 bp, Homo sapiens
gccatcatattttagcccacacaaatcatggggagaaatcgtttctctttcaattttgttgggaagaagtctttgaggt

SEQ ID NO: 6829146 - DNA, 58 bp, Homo sapiens
gtctctctgactggtccacaccaaaggagaaagaagtttgagacaaggctggagagac

SEQ ID NO: 6829147 - DNA, 63 bp, Homo sapiens
cagccctcagaggagagaaaaccaattctccaacaaacaggtctctccaacatggtggtgctg

SEQ ID NO: 6829148 - DNA, 129 bp, Homo sapiens
cctttggggcctggtcagagctgcacggtgctgcctttggggcctggtcagagctgcacggtgctgcctttggggcctggtcagagctgcacggtgctgcctttggggcctggtcagagctgcacggtg

SEQ ID NO: 6829149 - DNA, 58 bp, Homo sapiens
cacagctgtattcaagttgcaaggcttgtcaactttgctatttttctgtgcagctctg

SEQ ID NO: 6829150 - DNA, 83 bp, Homo sapiens
atataatctccttcccatgagtgtgggcaggatccatgaatgtgatggagttatgctacattatatggcaaaggagattttat

SEQ ID NO: 6829151 - DNA, 130 bp, Homo sapiens
cagaagagaagctaagccctgtggacggcaaatggacccaaggacacgggcagggacagagctgcttccactgagccagctgttaggtgcttgtgttcttggccccctggccggggttgtctttgatatg

SEQ ID NO: 6829152 - DNA, 62 bp, Homo sapiens
gcctcctgccgctgctgaccactcatcatccaatgtgtcctggatgaggtagcagctggtgc

SEQ ID NO: 6829153 - DNA, 61 bp, Homo sapiens
taggtgccctctgagatgattcactgcacccgtgggtgggatcctcagctcagagcacctg

SEQ ID NO: 6829154 - DNA, 81 bp, Homo sapiens
atttgaatatataggcaaggagatttctaagcaaaatgttgaaggtgctgcctggtttcttcttgctccgtatagtaaaat

SEQ ID NO: 6829155 - DNA, 100 bp, Homo sapiens
caggacactaaggttgtattattaacacaaagaactggatatttggactctcaaagagttcaggagaaagttcagtactttcactgtaatgattgtcgtg

SEQ ID NO: 6829156 - DNA, 73 bp, Homo sapiens
ccttcttgttgctgggtgctattatgaacagtagaagcagcagctgtaataatgaggcatccagccatggagg

SEQ ID NO: 6829157 - DNA, 67 bp, Homo sapiens
gccgagactgtggccagtgttctgtagctgagctgtcctgtccagttgtttgcctggcaccgtcggc

SEQ ID NO: 6829158 - DNA, 83 bp, Homo sapiens
agattacatggttatcagtggagtaacaagttcaacccattttggtcagacaagagaacacttgctcctgattctcagtatct

SEQ ID NO: 6829159 - DNA, 129 bp, Homo sapiens
aaatgtcctgctgcttaaatgttctgctggcctagctccatgtgctctaacctagacttcttttctgaagttttagcaaactttggagtttgttcggtactgaattctccagcctctggcatggtattt

SEQ ID NO: 6829160 - DNA, 83 bp, Homo sapiens
taaaatctcattaccttatgtgtaatgctgataaatatgagaccatttgaacagagttattgtgaggaataagtgagatatta

SEQ ID NO: 6829161 - DNA, 65 bp, Homo sapiens
ttccctggatatatgtagatccaggcacatattccaggtttcttttaaaatatgtagacagggaa

SEQ ID NO: 6829162 - DNA, 99 bp, Homo sapiens
gaaaaactttgggagaattaacacaagttaccaaaaaagattcagggacagtctctgaagcaatgatcttttggtggctcagattcttcaatttttttc

SEQ ID NO: 6829163 - DNA, 56 bp, Homo sapiens
agttcaagacaagatctaagcatgctgatcacagctgggaggatttgttttgttct

SEQ ID NO: 6829164 - DNA, 69 bp, Homo sapiens
aggatcagggatttgtctaagacccaggcccagaacacaggtcctcttgactctaaatcccgcgatcct

SEQ ID NO: 6829165 - DNA, 79 bp, Homo sapiens
gggctttcctcaggctggttcaagatgggaaaggactttcttctgttttctcccaaagtgcaaccacagtggaaagccc

SEQ ID NO: 6829166 - DNA, 78 bp, Homo sapiens
gactagttgtcttagacaacagacacttattttctccagaggctctcagaagtctcagatgaggttggcagcatggtc

SEQ ID NO: 6829167 - DNA, 91 bp, Homo sapiens
atttcttttcagtctgaaaaacttagatgtttttagagttctggtctggtagctactaagtctttaggtttattttcaggaaaaaaaaaat

SEQ ID NO: 6829168 - DNA, 66 bp, Homo sapiens
gaacgtctcagaaatctgaaatcatattgaatagtatttacaaaggatgagttttctgtgatgttc

SEQ ID NO: 6829169 - DNA, 57 bp, Homo sapiens
ttctagaacactgaatttttggctgccaagaagtcagctcagcagattcttctagaa

SEQ ID NO: 6829170 - DNA, 56 bp, Homo sapiens
ttaatctaagtaatggatgctgttggtgccccagtcagattcgttcactgggttgg

SEQ ID NO: 6829171 - DNA, 56 bp, Homo sapiens
tctggagcaacagagcaggacagatagagagttttacatttgctcatagttccaga

SEQ ID NO: 6829172 - DNA, 75 bp, Homo sapiens
gtggctttggctttcatggcgctgttctctccctgtgtctctcaatatggaatctcagtttcatgggccatctac

SEQ ID NO: 6829173 - DNA, 68 bp, Homo sapiens
ttttttttggtttgtttaccaactagattttgctctggttaagaccgcatggtacaaaccaagagaga

SEQ ID NO: 6829174 - DNA, 60 bp, Homo sapiens
cattagctgagtcagattgcagtcttgtgtccacaagagagttctttgattagtgaagtg

SEQ ID NO: 6829175 - DNA, 100 bp, Homo sapiens
ttgccctgtacagccagaatggggagaatattgcctttaagtcagggtcatcagcatcatggctttttagcatattcaataatcattctctgtggggcaa

SEQ ID NO: 6829176 - DNA, 81 bp, Homo sapiens
gcagttctgagacttcattcagtaaaagctgcagacatatttgaaccagctggtcaactgaatgaacatgagctcaactgt

SEQ ID NO: 6829177 - DNA, 89 bp, Homo sapiens
gggcactgaggcctctggaattaaggaagcctgtaattcttccaactactacagcccttatctcctaagagagcttttcctcagtgcct

SEQ ID NO: 6829178 - DNA, 61 bp, Homo sapiens
gctcagaggccactgttggaaatgaagctgacagctgtaggttaatgaggaggccctgggc

SEQ ID NO: 6829179 - DNA, 100 bp, Homo sapiens
gttatgcaactgtatatgttttcaaaattcatagaactgtacgctgaaatactcttttcagtgtacagttctatgaatttcactctgtgtaagttatagc

SEQ ID NO: 6829180 - DNA, 80 bp, Homo sapiens
ggaagacggagacttcgtggttcagatgtcttgagtctcaggggctcaggggacagccagctggaggtttgtgctcattc

SEQ ID NO: 6829181 - DNA, 65 bp, Homo sapiens
gctgggggcttggcagaggccgaggtgaagattaacttcttcactgctgcgctcccaaccccagc

SEQ ID NO: 6829182 - DNA, 58 bp, Homo sapiens
tgaaacagggtctcactctgtagcccaggctggaatgcagtggtgagatcttggctca

SEQ ID NO: 6829183 - DNA, 97 bp, Homo sapiens
gggctccaggttcacttccccagctcaggcctctgtctcctcaagaggcaagcccactctatgtaggagagagcttgactgagtaccctggcagccc

SEQ ID NO: 6829184 - DNA, 70 bp, Homo sapiens
gtgcctacatgtgctgggttcttggccaggctgcagtgtgtcatggtgaacaggtgggtgtggtaagcac

SEQ ID NO: 6829185 - DNA, 71 bp, Homo sapiens
atacaatagaatatacaacaccaacagtgtaccctactgtacactatgggctttgtgtaataatgatgtgt

SEQ ID NO: 6829186 - DNA, 95 bp, Homo sapiens
gttagtgttgctgtgcatatgtcttgaggtctcatctgaagtaagtttgtgtatgatcgaagatttcaatggatattgcaaggtaactaattaac

SEQ ID NO: 6829187 - DNA, 57 bp, Homo sapiens
actctcaattatctggactgaaggcactgttctcactatggccagatgaatgggagt

SEQ ID NO: 6829188 - DNA, 76 bp, Homo sapiens
tctttcaaataggccttgataaattagtaagccattgggtaaataggcttgcttcttgtccaggaatcctgagaga

SEQ ID NO: 6829189 - DNA, 63 bp, Homo sapiens
ttgtgcttttctagggatgaggaaacgtcaaccttcactcagtttcacgtctctaaggcccaa

SEQ ID NO: 6829190 - DNA, 55 bp, Homo sapiens
tccatgggaatgctgtggccacacctggggcgttggctacagacattcctaggga

SEQ ID NO: 6829191 - DNA, 74 bp, Homo sapiens
ctgaggagaccatcaactaatttggacctgtgagttttttagaaaaggagtggggtggtcgtggtctccttcag

SEQ ID NO: 6829192 - DNA, 56 bp, Homo sapiens
cttgtccaggtgggtgccattcattgaaaccccttggtggcaatgtcctggagaag

SEQ ID NO: 6829193 - DNA, 76 bp, Homo sapiens
tactttgtggtgtctatatttttattcgtggagatctgtcttcaaactgaaaatttagaatgaacatttcaaagta

SEQ ID NO: 6829194 - DNA, 86 bp, Homo sapiens
agcggaaagatgttaaattgggggcattttatgcttcttgtgaaatggcacgaatgatgttctcattttaaaacaaagttcctgct

SEQ ID NO: 6829195 - DNA, 55 bp, Homo sapiens
ggctctgtgcagggtgcttttgtgaacatggcctcatggcatctgcacagcagcc

SEQ ID NO: 6829196 - DNA, 78 bp, Homo sapiens
gttgttgttattttgagatggagtcttgctctgtcgtccaggctggagtgcggtggcaccatctcagctcactgcaac

SEQ ID NO: 6829197 - DNA, 76 bp, Homo sapiens
atgacttagctgggtggtgcttgttcaaggtctctcatgaggctgcaggcagggtatccactggggctacagtcat

SEQ ID NO: 6829198 - DNA, 69 bp, Homo sapiens
tagctttaattgtgacatgagggccacagtgcctccccactctggcctatttctgtcagatccaagtta

SEQ ID NO: 6829199 - DNA, 61 bp, Homo sapiens
ggctggcagcatgtcccggcctcagtgcctctgctgtgaactggcacaggctgcccctgcc

SEQ ID NO: 6829200 - DNA, 58 bp, Homo sapiens
ccctgggctgtatttttgcaatagactgaatttggatgttcattctgtgcagcaaggg

SEQ ID NO: 6829201 - DNA, 69 bp, Homo sapiens
tgtttaggaggctttcccaagttttaccaaaaaaggctggtagtttctgggttggcttctaccaaaaca

SEQ ID NO: 6829202 - DNA, 58 bp, Homo sapiens
agttttgatactttctcttcatgttcttaaattctagactagggagggtgttaatact

SEQ ID NO: 6829203 - DNA, 66 bp, Homo sapiens
tgcgctctattctgggtaccaaacttcaagaaaaataattcatttgaagatacagaaaagagggca

SEQ ID NO: 6829204 - DNA, 78 bp, Homo sapiens
ggtgggggctctgtagcccaagcctggctggcgatgtcgctgcgtgtccatgtccaggtgggccctggggcctcctcc

SEQ ID NO: 6829205 - DNA, 68 bp, Homo sapiens
ggctgtggtggctcatgcctgtaattccagcactttgggaggctgaggcaggcagatcacttgaggcc

SEQ ID NO: 6829206 - DNA, 69 bp, Homo sapiens
ggtaccctggcacagcctccatgtcgtccctctgcagagagaggaggactcaggtctggccatggtgct

SEQ ID NO: 6829207 - DNA, 86 bp, Homo sapiens
tcatcttttgctcccttaggactttttcacttaaaaacttgatggtgtttggggtaaaatgtcgtaagagacattctagcacatga

SEQ ID NO: 6829208 - DNA, 60 bp, Homo sapiens
ggtcatcataagggccaaaggtgtgaaagtaaaagacaacatttggaactttttgatgcc

SEQ ID NO: 6829209 - DNA, 55 bp, Homo sapiens
tgctgatgtcctagttctggtctcttacttcatagatctagacttgggcccagta

SEQ ID NO: 6829210 - DNA, 77 bp, Homo sapiens
aggctcagcctgggcctagagctggtgacctcaaatctcggcctttgttggctcccctaggactgtaggctgcgctt

SEQ ID NO: 6829211 - DNA, 92 bp, Homo sapiens
ccacatcaatgataaagaacatttcttccttgacttaaattgttccctaccatagcagtgtggaacactcatggaagagtttttgtttgtgg

SEQ ID NO: 6829212 - DNA, 72 bp, Homo sapiens
ttggaatcttgtatcttggaactgtaacattggatgtgtcccaagcacagtcattagatacaatgtctccaa

SEQ ID NO: 6829213 - DNA, 57 bp, Homo sapiens
ctctgggaagtagatttggccttacaaagaaaagttttctatcatacttgcccagag

SEQ ID NO: 6829214 - DNA, 90 bp, Homo sapiens
tgtagcatgtggttgtattaatgaacgttacaggagagctttataatcatttataaatctgtaacattcaataaagaaacacatgttgca

SEQ ID NO: 6829215 - DNA, 80 bp, Homo sapiens
tcctttagcagtcctcatcctttagcagtctccatgccccacagaagatggaacttaatgatctatgacaacttagagga

SEQ ID NO: 6829216 - DNA, 61 bp, Homo sapiens
gctagtgggtcccaggacttagtctcttgtctacatatactcatcttctggtatccacagt

SEQ ID NO: 6829217 - DNA, 75 bp, Homo sapiens
atgggacacacaaggaagtaaagcaaaggaaacatttaatgggttatatttgtatacttgccttatttgttccat

SEQ ID NO: 6829218 - DNA, 71 bp, Homo sapiens
ttttcagcaaagttaaggtttctctttttatgctagaaagactaacattgagactctaactttgaagagaa

SEQ ID NO: 6829219 - DNA, 58 bp, Homo sapiens
gtgtatgcatgtgtgtacgtgtgtacatgtatgtgtgtacgtgtgtgcatgtttatat

SEQ ID NO: 6829220 - DNA, 108 bp, Homo sapiens
gtctaactggtacgatgtaatttactttggattttcaatatcttttgcttacttcatctcctaaaaggataactttgaaagtaaattgcaaaagcgaccatattagac

SEQ ID NO: 6829221 - DNA, 55 bp, Homo sapiens
ctttgtttcttggctgggatcttaagctggtaggatggacagcctggaaggaaag

SEQ ID NO: 6829222 - DNA, 63 bp, Homo sapiens
gaggaagaaagcatggtggaactcaggtttgtctgattccaaattcacatgctttcatgtctc

SEQ ID NO: 6829223 - DNA, 78 bp, Homo sapiens
gggagcaggagggaggaggaggatggtgtgcgttctgattgtagggggcaggcagtttgcttttccctcctgacgcct

SEQ ID NO: 6829224 - DNA, 59 bp, Homo sapiens
ttgcaggtatatttacttttccaggtcactgaaagaacattgagtgaatgtggctgtaa

SEQ ID NO: 6829225 - DNA, 55 bp, Homo sapiens
atttcagtagtccttacttgtaccctacttggtcttgagtaagtgctgctggagt

SEQ ID NO: 6829226 - DNA, 82 bp, Homo sapiens
atagagcctttgggttcaatctcggtctggtatgagccagctgggtgttcttgggcctaatttgtaaaataaaggcatctat

SEQ ID NO: 6829227 - DNA, 71 bp, Homo sapiens
ggtcagagcagcattttacaggatgataaattaccctcgtttagctgaatcctagaagtgcatgtctgacc

SEQ ID NO: 6829228 - DNA, 57 bp, Homo sapiens
ttgtgagactcgtaagagaagggcttcggtcagctgccttctccacagggtctccgg

SEQ ID NO: 6829229 - DNA, 130 bp, Homo sapiens
cactagactgtaatttatagtatggtagtggatgtaggaaaagtatacaaatacattatgttgtcttcatgtgccgtttactcttgctacacaactgtgccagatttgagaattaattgttgtctcagtg

SEQ ID NO: 6829230 - DNA, 80 bp, Homo sapiens
gctcccagcacacgcttggggtgagaccttggctggcagcacagggcctggtcttttctgctgcaggttgtgaagggggc

SEQ ID NO: 6829231 - DNA, 75 bp, Homo sapiens
acccagcatttgggcattttatttcttcggattccagatcatcagaagttatgtcaatggtcatgctggctgggt

SEQ ID NO: 6829232 - DNA, 82 bp, Homo sapiens
tggcctgggctgccctccaggcctcctgtgagtggaccctggtggtcccaggctgcgggctggtgggcctggccgaggcaca

SEQ ID NO: 6829233 - DNA, 56 bp, Homo sapiens
gccttgagctgcacggccaggtgcaggctgcgcgcccgccgctgatagctctgggc

SEQ ID NO: 6829234 - DNA, 68 bp, Homo sapiens
gaaagttctggaaagatttgcgtgtaagaaatctgattttgtttaactaaaattttccagacactttt

SEQ ID NO: 6829235 - DNA, 114 bp, Homo sapiens
atggcaagtcactttctgaaactgggctgtagctctagacaaatgattgtatgaagttttaaataaacatacaacatttacgttaggctgtttcttgaaatgatttattgtcat

SEQ ID NO: 6829236 - DNA, 61 bp, Homo sapiens
gagatatgttagaaagctattgaacaggtcacaaaactgaagtgctgaaaaagcatgtctc

SEQ ID NO: 6829237 - DNA, 75 bp, Homo sapiens
gcagctgccatgacatgtcctgctggccagcctcagaaaggtcttgggtgaggacagggctgacttggcagctgc

SEQ ID NO: 6829238 - DNA, 78 bp, Homo sapiens
tcctcctcagagtcagggccacatttagctggttctgtaagaagggcctgatggctgtctgggcctgaaacaggagga

SEQ ID NO: 6829239 - DNA, 76 bp, Homo sapiens
agaagcagtagattcctactcattcctgactcttttagccacttgtcgtatggcatgagcaggtgtcttaacttct

SEQ ID NO: 6829240 - DNA, 75 bp, Homo sapiens
gctgttgcagattgactgtagctaatgtacttgcctaaatgaagaagtatacatttattacaggtcttcaaccgc

SEQ ID NO: 6829241 - DNA, 77 bp, Homo sapiens
ttaagtagagactggatttcaccatgttggtcaggctggtctcaaactcctgacctcaggtgatccacctgccttgg

SEQ ID NO: 6829242 - DNA, 84 bp, Homo sapiens
tactcccttaccactgctccctgcctgtgaactgatcattccacaccctctagtctaggactttatgcagatggcaagggggtg

SEQ ID NO: 6829243 - DNA, 56 bp, Homo sapiens
atacagccagcttcctgaccttgtacattatcagaggcccaggtagttcactgtgt

SEQ ID NO: 6829244 - DNA, 67 bp, Homo sapiens
ccggctggggcgaggaatgcaggcgcctagagccttggagctcctgaaacgttcctgccgcctccgg

SEQ ID NO: 6829245 - DNA, 76 bp, Homo sapiens
ggtctaaggcttgtagatttgggctttaattccctgtagaaggaaagggagcttaatttctacgaggcctaggact

SEQ ID NO: 6829246 - DNA, 63 bp, Homo sapiens
agcatgctcagttgtctcaatcattttaagtaggtgatttagtgagaggcagctgagcaagct

SEQ ID NO: 6829247 - DNA, 65 bp, Homo sapiens
gctggccgcaagctcgcaaagacgctggctctaggtagccggttttcgcgagtttgtggcacagt

SEQ ID NO: 6829248 - DNA, 76 bp, Homo sapiens
taaagataaagatggtgctgtagtagatatttaggctagttcctgacaccttgctaaatggcaccctcctccttta

SEQ ID NO: 6829249 - DNA, 55 bp, Homo sapiens
gtttggtgagcagcttgggtatcacagcactgtcccaagactctttttaccaagc

SEQ ID NO: 6829250 - DNA, 57 bp, Homo sapiens
acaggtaggcagccggtctctggcctccgcccggctgtacacaaactgcctgcctgt

SEQ ID NO: 6829251 - DNA, 72 bp, Homo sapiens
tgctgaatttgtatggtttatagttgttagagtttgaggtgttaattctaattatctatttcaaatttagca

SEQ ID NO: 6829252 - DNA, 62 bp, Homo sapiens
gcccagcctccaagctccaaggccctctcccccagtcagcaggggagcttggtggctgtggc

SEQ ID NO: 6829253 - DNA, 72 bp, Homo sapiens
tctccctacccagggcttttctgatgcattacggagatgaggtgcagccaggaggtccagggcgaggtgaga

SEQ ID NO: 6829254 - DNA, 81 bp, Homo sapiens
gattttctaagcttggagtttggcgtattaatcaaagtatcatctttgctgtaccaaagattcctgaggttccagaaactc

SEQ ID NO: 6829255 - DNA, 57 bp, Homo sapiens
ggaggatcacttgaggtcaggagttcgagacgagcctggccaacgtggtgaaacccc

SEQ ID NO: 6829256 - DNA, 56 bp, Homo sapiens
cactgtgtgtgtacttacaaagggcatgctttggagtgcagaatagacatgcagtg

SEQ ID NO: 6829257 - DNA, 76 bp, Homo sapiens
gcacctctgaggagtcactgaggagggtactcagcaatgactactggctacagtgagctatgacctctcagagggc

SEQ ID NO: 6829258 - DNA, 73 bp, Homo sapiens
ggccaggatcctagcacaggttctgacgcacagaggtgctcagaagatatttgatgctgggtgaatcaatgtc

SEQ ID NO: 6829259 - DNA, 81 bp, Homo sapiens
cccccaccatcccaagttgctctgtcccaaggcccacaaggaaccctgaggggagaagcagcagcctgggattggtgctgg

SEQ ID NO: 6829260 - DNA, 81 bp, Homo sapiens
atgggaagtggataaagcatcttgacattacttgtgattcaaataatattgtcaaaatgactttactacagtttttttcat

SEQ ID NO: 6829261 - DNA, 60 bp, Homo sapiens
ggattgggcctcattttcaccctgaaggaaactgaggctgagagttgctgaggcctgccc

SEQ ID NO: 6829262 - DNA, 73 bp, Homo sapiens
cctttatcaccttgggaaacagattagcatctgcttatttttctgtgctcatctgactgtaaggtaatgttgg

SEQ ID NO: 6829263 - DNA, 59 bp, Homo sapiens
cccccagccagcagtgctcagctaaccttctggagcaagcagtggggttggtgtggggg

SEQ ID NO: 6829264 - DNA, 63 bp, Homo sapiens
ggaggggcaagaagttggcctctcggttgacattccagagaaatggccagacttgcccctacc

SEQ ID NO: 6829265 - DNA, 83 bp, Homo sapiens
gcacaggctcagaaaggtcaagaaacttgctcacggtctcacagctggtgagtaggttgtcagactccaaagatgtgtgctgc

SEQ ID NO: 6829266 - DNA, 64 bp, Homo sapiens
ggcagaagtggaacttggctgcagggagtctggccctggagcctgcagttttcacttttactcc

SEQ ID NO: 6829267 - DNA, 83 bp, Homo sapiens
ctccagtgaaggcacgtgggtggatactggccacagctttgccttgggccttaaggtaaccaccccatgggcctgactgagag

SEQ ID NO: 6829268 - DNA, 74 bp, Homo sapiens
tcatgcttggatttcctaaggcgcagctgagtcatctgcgtgactgtgccgtgcccctaggacataaggtgcga

SEQ ID NO: 6829269 - DNA, 118 bp, Homo sapiens
atcactgttattatggtgaataccgaatgacttcacaataatgtgacacttaaaatgctagtgcaatttattgttaagaaggacattttttagtttgttcactaatgcctacggtggt

SEQ ID NO: 6829270 - DNA, 91 bp, Homo sapiens
ctcacatttccaccccagatacatgaagatgaatgtatggcatgattgaactagaacatgttatctcagcttatgtctgattggatctgag

SEQ ID NO: 6829271 - DNA, 77 bp, Homo sapiens
taatgtggacttcatagaatgagcttggaagtattcctcttcaatttttgggaagagttttatgaagattggcatta

SEQ ID NO: 6829272 - DNA, 106 bp, Homo sapiens
taaagaaagagggtctcagaaaccttagctgtatttttatttcttttcctatattactactctgaggtaaaggtacgaagtgagggattgacacccttttttgtta

SEQ ID NO: 6829273 - DNA, 66 bp, Homo sapiens
cccattcattgtctccaattctatatattactattatataaacgttatagaaagatgatgggtggg

SEQ ID NO: 6829274 - DNA, 57 bp, Homo sapiens
cttggcagcaggacctggcccagagcaagagctcaagcattgttggctgctgctagg

SEQ ID NO: 6829275 - DNA, 80 bp, Homo sapiens
agagatgtgtctgagcttctttatttggccagaaaatattttttctcttctaggctttggagttgcagaaaaacatccct

SEQ ID NO: 6829276 - DNA, 92 bp, Homo sapiens
tttctattcttttcttttaatgctttatatttcttatgtaagtgacccaggtcggggagagaaatgtaggcatataaggaaaaggggggaag

SEQ ID NO: 6829277 - DNA, 72 bp, Homo sapiens
acttaataatgttgacgatagtcttaatcacttggttgagatagtgtttgtcagatttatccattataaagt

SEQ ID NO: 6829278 - DNA, 76 bp, Homo sapiens
taaacatagaattgttatattttctgtatttccttgataagtagaagggttgaacatgtatcagttcttttgtttg

SEQ ID NO: 6829279 - DNA, 65 bp, Homo sapiens
gcttcttgcctgtgtagagaatctcatggaaaacctgggtactaacgttctttcatagtaagagc

SEQ ID NO: 6829280 - DNA, 76 bp, Homo sapiens
tcgcttgaacccaggaggcagaggttgcagtgagctgagatcatgccactgcactccagcctaggtgacagagcga

SEQ ID NO: 6829281 - DNA, 61 bp, Homo sapiens
ggtccagtcagatattcatgcaaggcattttatgatgtacgtgattttgttgactggggcc

SEQ ID NO: 6829282 - DNA, 65 bp, Homo sapiens
ctccatacaccctatgcccaaatctggaaatccaagtttccaaatattatgattataggatggag

SEQ ID NO: 6829283 - DNA, 58 bp, Homo sapiens
gtcttcttaggccttgagtgttaataagtcatttctacactccaggtggcatgaggac

SEQ ID NO: 6829284 - DNA, 85 bp, Homo sapiens
ctgaaatcatgcttctcagaaatgctggctgttatgagacaatggagtaaatgccttcaagtatctgaggaaaagtgattttcag

SEQ ID NO: 6829285 - DNA, 67 bp, Homo sapiens
gtgtacatgctgactatagatcttttctagaacctggaggaatattctcaagtggtcgtgtgtgtgt

SEQ ID NO: 6829286 - DNA, 81 bp, Homo sapiens
ttcttatcccttcaataattcaacattaatggtttattaaacagagccttcctaatgggctgttattgacctgatgcagag

SEQ ID NO: 6829287 - DNA, 72 bp, Homo sapiens
ggggggcacacagagaggcttgtctccaaggctgaaatagcacttggaggacatgggcttttagaactttcc

SEQ ID NO: 6829288 - DNA, 77 bp, Homo sapiens
gtgattaaatcaacagttgcactggagaggtcagcgaggattatcagagggaccctgagtgcaacggtgaggattat

SEQ ID NO: 6829289 - DNA, 60 bp, Homo sapiens
tagttgaaagggattattgtgggagaaattatccttccaggtagttttcctttgtaactg

SEQ ID NO: 6829290 - DNA, 78 bp, Homo sapiens
ggtacagacgcctcggagatgctggctgagatcttgcagctgcagtagatctaggtggacatcatcctggtgaagacc

SEQ ID NO: 6829291 - DNA, 81 bp, Homo sapiens
ggaatacggtgttcgaggtgtgacctgagtggtgcaggaatcatgctgctgtcacctccctccatctggacactatatttc

SEQ ID NO: 6829292 - DNA, 63 bp, Homo sapiens
tgagtgtgtatgtgtcagtgtagcttaaacagttcattgtatgctgccctggctcagcattca

SEQ ID NO: 6829293 - DNA, 58 bp, Homo sapiens
catttaatttggtcccatattagttaagcctcaggcttgactagcacccaggtaaatg

SEQ ID NO: 6829294 - DNA, 60 bp, Homo sapiens
gggatgggcctccaattccagcgggatgagtgtgccgttgtggaggactcccagcatccc

SEQ ID NO: 6829295 - DNA, 67 bp, Homo sapiens
aaaactgggaaattgacactgataaaatgccagtaactatagcatttacttggatttccccagtttt

SEQ ID NO: 6829296 - DNA, 76 bp, Homo sapiens
taaaaagagggcctctaccatccaaggttagggaatcaactctggcctttacactaatggagggctttaattttta

SEQ ID NO: 6829297 - DNA, 95 bp, Homo sapiens
atagctgctgtcacgctccctgtgtcttcttgcctttgtgtccatccaactggacagggaactccatgaggccagagagtgtctcccagcattat

SEQ ID NO: 6829298 - DNA, 89 bp, Homo sapiens
ccaccactctcattttgcatttccagagtagcagactgttgtgccagagggtttgttgatgttgaaaatatagtcagaatcagtggcgg

SEQ ID NO: 6829299 - DNA, 59 bp, Homo sapiens
gagctctatgtggctggcatgtctgcctcgctcgggggacattgctgttcagtgggctc

SEQ ID NO: 6829300 - DNA, 79 bp, Homo sapiens
acctgtgttcccgcagtttccacctaacagtctcttcactgtgcagtggcagcgtgtgggtgtgcatacaaacacaggt

SEQ ID NO: 6829301 - DNA, 65 bp, Homo sapiens
cctgtaagccaccggtcaacctgcagattgccttattaggcagactgcggaggctggtggctggg

SEQ ID NO: 6829302 - DNA, 66 bp, Homo sapiens
aaccagacatggaaatttagtgttacgagctaaattgtgacctcccaaaattcctatgttgacgtt

SEQ ID NO: 6829303 - DNA, 58 bp, Homo sapiens
cacagcagagggagccattgaaagttgagtgatctgtttggatgcaccttctgaagtg

SEQ ID NO: 6829304 - DNA, 58 bp, Homo sapiens
gcgcgcctctgcccggtgttccccctgcccgggcggggaggctggagagagcgcgcgc

SEQ ID NO: 6829305 - DNA, 64 bp, Homo sapiens
gccccgttgtctccaggtggtactgtatcatgatctcttgtatctgttccaatggagtcagggc

SEQ ID NO: 6829306 - DNA, 59 bp, Homo sapiens
ttgagtcctagccctggatccatcatttaagaactgaatgattctggcaagtgacttaa

SEQ ID NO: 6829307 - DNA, 56 bp, Homo sapiens
actgaatgtatgtgtatatgtgtgcgcattcacatgtatgcagcaaaacaattagt

SEQ ID NO: 6829308 - DNA, 58 bp, Homo sapiens
gcagaagaggaccctgcttagagcaagcacactgcctgaatgctggttcctctcctgc

SEQ ID NO: 6829309 - DNA, 59 bp, Homo sapiens
tattccatgccagagtttattgctcctttatactgcaagaaacttgatggcatagaata

SEQ ID NO: 6829310 - DNA, 58 bp, Homo sapiens
ttctgtaggtcacaaagttcttaggaaaaattctaaagaaacattgagacctggggga

SEQ ID NO: 6829311 - DNA, 59 bp, Homo sapiens
gggaggctctgacgtcacacgtggccccagccaatcggagctgcccgttcggagccccc

SEQ ID NO: 6829312 - DNA, 71 bp, Homo sapiens
attccaggggagtggcagagggacagccagcacgagacattttcaaggttgtttttcccaccctttagaat

SEQ ID NO: 6829313 - DNA, 87 bp, Homo sapiens
ggtgtggggacaggagccctcaccgcctgaccaggtgcccagcgccatccaggctgtgggtgagctcccaggcctctgccccacctc

SEQ ID NO: 6829314 - DNA, 56 bp, Homo sapiens
agagtgtggaaatgttcagagtacttcggaaggggtgaaagactttctacgactct

SEQ ID NO: 6829315 - DNA, 84 bp, Homo sapiens
ccaaaggaatctgaacagggaagttctgcaacaggaggggattctgatcctggagccacggagctttcaacagacacttcctgg

SEQ ID NO: 6829316 - DNA, 79 bp, Homo sapiens
cagttgccagaaggatgtcatgtgctaactggtatagatcaaggcttttcaatagcagtaacactgacattttggactg

SEQ ID NO: 6829317 - DNA, 79 bp, Homo sapiens
acactatggcaaagaatctcatttttagtttaggtgcagtccaggcccagtaactgcaagtgagagacatgccatttgt

SEQ ID NO: 6829318 - DNA, 103 bp, Homo sapiens
agtgcccacgcctagattgtaagttcctggaaggcaaggatttgtgtcccacacttgttttgtaccctccaggatcttgcacagcacttggcgaatgggtatt

SEQ ID NO: 6829319 - DNA, 67 bp, Homo sapiens
acagttgcctgtttccttgtgtgtctctcccactcaaatgtgagatattccaggacaggtgtgctgt

SEQ ID NO: 6829320 - DNA, 63 bp, Homo sapiens
gtgtgtttcttgtcagctcggatggttctgttcccatggcttcccaccctgctaagaatacac

SEQ ID NO: 6829321 - DNA, 58 bp, Homo sapiens
gcttggagttcttgttctatgcaaggccctggccctggccctgaagagagctccatgc

SEQ ID NO: 6829322 - DNA, 82 bp, Homo sapiens
gagaccagatgctgtcgaaaccaaacatcttttcctttgctctatgggaacattttagggtttgttttgcacagctggtttc

SEQ ID NO: 6829323 - DNA, 84 bp, Homo sapiens
gaggtaatgagagctaacattgattcagtgcctgctatgttttgcactgttaggtactttacatgttatctcatgtaatacctc

SEQ ID NO: 6829324 - DNA, 83 bp, Homo sapiens
atagtatgatagggatgatttcagtgtctgccaaaagggaattggttaagtaaactgaggtacatccaaatgatgcatactgt

SEQ ID NO: 6829325 - DNA, 68 bp, Homo sapiens
cgtgcagccatcttgggccatgatgccatccttgaggatgcaaaccatgcactaaggatgatggcacg

SEQ ID NO: 6829326 - DNA, 99 bp, Homo sapiens
gctgagtggggtctccaagccgagccgaggggccgcctgctaatggagctgcggcagcttcttcaaagcaggaggcccagggctgggcgagctccatgc

SEQ ID NO: 6829327 - DNA, 58 bp, Homo sapiens
tcccctgttcctcctccaacccaggctgggacccctgatggcaggaggcagcagtgga

SEQ ID NO: 6829328 - DNA, 72 bp, Homo sapiens
gccaggctctgctgatctcagctgggctcactcttgcatctgagccagctggtgggtcagctgggggctggc

SEQ ID NO: 6829329 - DNA, 66 bp, Homo sapiens
ccccgtgctcccctagcccgttgggaggtggacagtgagacatcttcccaggctggggagaggagg

SEQ ID NO: 6829330 - DNA, 78 bp, Homo sapiens
ggaaattatcaacccttctctttcactcactatttgtagagcaagtgagtgggtggggagaggaaagtggggcattcc

SEQ ID NO: 6829331 - DNA, 63 bp, Homo sapiens
cctgctcctgcttccctcccctctggtctggctgagaaaaaggtccagagttggcagagcagg

SEQ ID NO: 6829332 - DNA, 58 bp, Homo sapiens
cctccccgagagaggttgtccgcgctgccaggcgctgggcagcaggctctccgggtgg

SEQ ID NO: 6829333 - DNA, 66 bp, Homo sapiens
atgatattttagtaaagtgatattttattactaatgtaggtattactaaagattactgaagatcat

SEQ ID NO: 6829334 - DNA, 55 bp, Homo sapiens
ggtccttcccccgggctcccttttttcatgcagaatggagtcaggggaatgggcc

SEQ ID NO: 6829335 - DNA, 76 bp, Homo sapiens
agcatattgtgaaaatgttgggaaatttaggttattttaatgatggctgagaatttgtgaacttttctcatatgct

SEQ ID NO: 6829336 - DNA, 59 bp, Homo sapiens
aggttgctgtgctgctaggcagaggagttgtgaagtgaaacagagcacagcatgcacct

SEQ ID NO: 6829337 - DNA, 86 bp, Homo sapiens
ctaggataagaacacttggaacttagtaatatgacatgcttttcatttggttgttttgttttaatttccacagatctgctttttag

SEQ ID NO: 6829338 - DNA, 63 bp, Homo sapiens
gctagagagtgtctcaaggcaggaaagtgtttacaggacaaacaccggcagagtgcttctagc

SEQ ID NO: 6829339 - DNA, 60 bp, Homo sapiens
ctgggcctgagctctgaagagtacaggtcggctcctctctcaacccaggactcagcccag

SEQ ID NO: 6829340 - DNA, 91 bp, Homo sapiens
gccaggaaggtcttgatctcctgacctcgtgatccgcctgctttggcctcccaaagtgctgggattacaggcatgagccaccgcgcccggc

SEQ ID NO: 6829341 - DNA, 67 bp, Homo sapiens
agttaagggggttcatctgtaagagacatttgtctattatctcttatagcaataatatcctttaatt

SEQ ID NO: 6829342 - DNA, 89 bp, Homo sapiens
agaaacagaagagtgggtttgcatggaagacagtgagttcagtttggaattcattgagcacttactatgtatagtccaagaactgctct

SEQ ID NO: 6829343 - DNA, 72 bp, Homo sapiens
ctgtgcgatgctgtaggagtgtggtaaacatctcataaatcttcatggcactgctcgctgcagcatggccag

SEQ ID NO: 6829344 - DNA, 74 bp, Homo sapiens
gttggagggtttagcttttatgtaaatttcttcttgcttttctgcatttaaattaagttctgatccctatcaac

SEQ ID NO: 6829345 - DNA, 81 bp, Homo sapiens
aggcctttaactaatttagacttagtatgcagtaacttattttgtaatttgtgaaagtcaaattaattgaacgattggcct

SEQ ID NO: 6829346 - DNA, 69 bp, Homo sapiens
atgagtaattttttggtttaagtatgtctccactgcttcatgggacatactttttaaaagattgcttat

SEQ ID NO: 6829347 - DNA, 57 bp, Homo sapiens
caggaggcccggccacagcccaggtgctgctcctgaggaagcggctgacgtctcctg

SEQ ID NO: 6829348 - DNA, 107 bp, Homo sapiens
agaaatgctgacctggtatctcctcgattgcagttccttcatggacaaatgttgaatctgttttaagccattagaagatgtaatagagagttatctaaactatttct

SEQ ID NO: 6829349 - DNA, 116 bp, Homo sapiens
cagcgggactgggaagatttaggctgaccaggtcttcttcagcacttggaaggcacaaaacttcgtaaaggccttaagaagcctgctctgggcagaaacctttctggttgttgttg

SEQ ID NO: 6829350 - DNA, 56 bp, Homo sapiens
atggcagcctgtggacagtcaagggtaccggggccagggcttataggacctgccat

SEQ ID NO: 6829351 - DNA, 79 bp, Homo sapiens
cacctcatgctgaaacaagtatgttctactgacctacttgacccaaaggtgagcagggcagcttttttcagaagtggtg

SEQ ID NO: 6829352 - DNA, 62 bp, Homo sapiens
tgaaagtgtgtgtgtgggtgagggggatggggaagcccccctactcaccacacatctttaca

SEQ ID NO: 6829353 - DNA, 77 bp, Homo sapiens
ggttaaatactggactctcactatttaagaatagaataagaataatcaaatagaggtgagacttcagtgacatgtcc

SEQ ID NO: 6829354 - DNA, 59 bp, Homo sapiens
cctggcacatataataatttttgagtattgcctcagagtgatgggttgtgctgaccagg

SEQ ID NO: 6829355 - DNA, 63 bp, Homo sapiens
atggattcaagaaccaagggagagtaaaattggtccatctcaccctaactctaaaggatccat

SEQ ID NO: 6829356 - DNA, 77 bp, Homo sapiens
caggcagttgagaggccacatagcttgcatgtagctcagccccttgcaggcggtgtggctgccatgtaaattgcttg

SEQ ID NO: 6829357 - DNA, 74 bp, Homo sapiens
gccacctgacaggtctgaaagcctcagtcacacatagaccactggactgtgtgacttttctgatatgcgatggc

SEQ ID NO: 6829358 - DNA, 61 bp, Homo sapiens
gggtggctcttgcatggggtctctcctgcagttgcagctggagtcccagcaaagccttccc

SEQ ID NO: 6829359 - DNA, 68 bp, Homo sapiens
ctgtatgcagacatcacctcagtgctatatagtcatactgtaagctctattttagatgctgggtacag

SEQ ID NO: 6829360 - DNA, 59 bp, Homo sapiens
tgtgaccatttgccacaatggtcaacatcttaaatggtcactggaggcaaattgtcaca

SEQ ID NO: 6829361 - DNA, 66 bp, Homo sapiens
ggagacattagagcatatttgtcttcatctactccttcatgagaacacataagcctaatcatctcc

SEQ ID NO: 6829362 - DNA, 112 bp, Homo sapiens
atgggaatagaagtaatttaaaatgttcaagacatattaaatgtgcgactgtggctccaaattgccatttagtatgcttgtattataggatatagaaactactgcaccccat

SEQ ID NO: 6829363 - DNA, 65 bp, Homo sapiens
gggcaggaagcattaaaacgattctgctgcaatacggttgtttgatttctttgtgcttcatgtcc

SEQ ID NO: 6829364 - DNA, 70 bp, Homo sapiens
tggaattatatatattttttgccatcatctgctgtagactatggctcccaaagaatcatgggtaatttca

SEQ ID NO: 6829365 - DNA, 85 bp, Homo sapiens
gcagtgactcgggatgggcaggcaaggtggcgagtcccctgtgatggtggctttcactggtgtctgcgttcagcctgtaacatgc

SEQ ID NO: 6829366 - DNA, 72 bp, Homo sapiens
cttcaagtcccacctgctctgggagaggccgccctcacgtgctgcacccatcggcaaggtaggtgattaaag

SEQ ID NO: 6829367 - DNA, 76 bp, Homo sapiens
gatgatgaggccagaccactctgcatggatccacagcaggtacgcaatggaatgaatgtggctggctgccattatt

SEQ ID NO: 6829368 - DNA, 81 bp, Homo sapiens
ggagaagacaaatcaacatatttttatgtaggtcatatttttatgatatggcaaaattatatggaaaatgttaatttctcc

SEQ ID NO: 6829369 - DNA, 79 bp, Homo sapiens
gcttccctccagggcctgttctgattggcagatgtgctatgaccagtctgcacagctggaatgtggccactcaggaagc

SEQ ID NO: 6829370 - DNA, 59 bp, Homo sapiens
cctaaaccatgtttgcaggcacagaatgggtggcaaattggccttgaacatggtttagg

SEQ ID NO: 6829371 - DNA, 56 bp, Homo sapiens
acattcattgagcaacaacaattatggattatctatttgtgcagctcagagagtgt

SEQ ID NO: 6829372 - DNA, 92 bp, Homo sapiens
ctagtatttctccattgcttcattttcccagtacggtcttcatcctcctgaattcctacttagcaaaatggcatctggagaagttgtgctgg

SEQ ID NO: 6829373 - DNA, 62 bp, Homo sapiens
ccctttccatgtgagatacggcttggaccctttcaaaatttcacatttcacatgggaggagg

SEQ ID NO: 6829374 - DNA, 63 bp, Homo sapiens
ccttggctataatctctgaatgtatcatactcctatacatttcatgagttattatagtggggg

SEQ ID NO: 6829375 - DNA, 73 bp, Homo sapiens
agcaataattacataccaatttatacccacaagattgaaaaaatttggaatgatggatatgtaaagtgttgct

SEQ ID NO: 6829376 - DNA, 126 bp, Homo sapiens
ggtggggctgggggacaaggaccttccctccctctcagatttggggctcaccagggctgagatggcgtctcccctcagactctgggctccctggggtaggggcagggtcccgccctcagaatcagc

SEQ ID NO: 6829377 - DNA, 78 bp, Homo sapiens
ctttgcttttcatagagaaggagtgtccccaaggaacctgcctccatgccatggcacagccctctctgtggacatgag

SEQ ID NO: 6829378 - DNA, 70 bp, Homo sapiens
aacagacagtgattcttcacatttctgggactaaatgaccctttgataatctgatgaataactgaatgtt

SEQ ID NO: 6829379 - DNA, 73 bp, Homo sapiens
gagctaaggtcacaagaagcaggatcttcatttgctctgctatgaaaaactctgtgaccttaaacaaacgctt

SEQ ID NO: 6829380 - DNA, 84 bp, Homo sapiens
gcagagaagtttcagtagtgttagcaatgttaaaatgtacaaggtacacttaattaacagttgatactgactgatgactgatgt

SEQ ID NO: 6829381 - DNA, 57 bp, Homo sapiens
cactctgcactgcagagatctgttatatattccgcagttgttctgcatgtgaagatg

SEQ ID NO: 6829382 - DNA, 79 bp, Homo sapiens
accagcgcccaggggtgcgggtgagcacctcctggtgacacccagccgccggtgccagccgcaccccaggagagctggt

SEQ ID NO: 6829383 - DNA, 94 bp, Homo sapiens
ggctgccgggggcccaccgccgcccaggcaaggccgccctgccttgggcgcagcgctgccatggctgggggccgtggggcccccgggcgcggcc

SEQ ID NO: 6829384 - DNA, 61 bp, Homo sapiens
ttccgggtgtaacgtactacccagccaggccctttcccttgctgtgctttggaacctggaa

SEQ ID NO: 6829385 - DNA, 68 bp, Homo sapiens
agtccgctttgatggaagcagcctcatctggagagccagctgctgtgtgcctcccattagggtgtatt

SEQ ID NO: 6829386 - DNA, 60 bp, Homo sapiens
cctagcagcacctttctaatctgacgtcaatagggtgagttgaggataggtgtttctggg

SEQ ID NO: 6829387 - DNA, 59 bp, Homo sapiens
tagtggacagagctagaaaatgtgtatctctcatacactcctctctctctgtcttgctg

SEQ ID NO: 6829388 - DNA, 109 bp, Homo sapiens
tgtcattggagtaatgctaggctctgtatactgatcaaactgaggttcatagttatttttaatatttcagcaatgacagcctatataataatctagctatctgtagaca

SEQ ID NO: 6829389 - DNA, 84 bp, Homo sapiens
tcagcatcctggaaagtctttgcaatttatgtggaatttctcatgtggagctctacacatttgtaaaggcatttgtagtcctga

SEQ ID NO: 6829390 - DNA, 55 bp, Homo sapiens
gggagcacacagaggtgccctttggggaaagaggggcatcttgcacttgtctccc

SEQ ID NO: 6829391 - DNA, 94 bp, Homo sapiens
attgtcaatacttactagaatgttcaaaagcatcagtgaagctctatctaaagctataaaatgatatttgaagccatctgaagatattggcaat

SEQ ID NO: 6829392 - DNA, 70 bp, Homo sapiens
tgaggaatggggtggcagaggaaccaaagtttagagtcagaaaaccttggccttgtcacttcattactca

SEQ ID NO: 6829393 - DNA, 83 bp, Homo sapiens
catttatgacttgagcctgggttcatttatgaatttagtctggattaacttctttggtgttacccagctcattcctttaagtg

SEQ ID NO: 6829394 - DNA, 75 bp, Homo sapiens
caaccacacaatttcagttgcatgcaaccataagtatttgtttctggctcatgtacctgtaggttggcagggctg

SEQ ID NO: 6829395 - DNA, 68 bp, Homo sapiens
atttttgtattattataatcagggcacagtgtttccaaggctgtgcataagtataataaaccaaagat

SEQ ID NO: 6829396 - DNA, 66 bp, Homo sapiens
acgtagagctacagcctgatgaacattccttatacaaaggaatgtacatctcagtgtagtactcgt

SEQ ID NO: 6829397 - DNA, 60 bp, Homo sapiens
ttctaggcaggtgggagtgattcctttaacttaatgaagaagacttccatttgctaagag

SEQ ID NO: 6829398 - DNA, 61 bp, Homo sapiens
gtcaatgagtatgttctctccgaagtttgttagcttagggaattgggaggatgccactgat

SEQ ID NO: 6829399 - DNA, 61 bp, Homo sapiens
gctagcctagttctagccaccaatgtaatgttaatacaagatggtaaggcagctggcaggc

SEQ ID NO: 6829400 - DNA, 60 bp, Homo sapiens
ggctccagcaccttcctgcaaaggtctttaaaagcacctgtttggaggaggtgttaggcc

SEQ ID NO: 6829401 - DNA, 60 bp, Homo sapiens
gtctgagaggcagaccttcctaagagacgataattttacagaagtgaaggcctttaagat

SEQ ID NO: 6829402 - DNA, 129 bp, Homo sapiens
ctatgactacaacttctgcggtaggtaacagagaggccacctcagcagcatgcagtaaagcagttctcacaatgtttgttgagtcaatgattcctttttctaccatattcacagaatctccaatcatag

SEQ ID NO: 6829403 - DNA, 97 bp, Homo sapiens
tatggaaatgtgtagaagtaaaatgtttcctttattacttaaaaacatttagactataaggtgatagattacaatattgtactctgattagtccatg

SEQ ID NO: 6829404 - DNA, 71 bp, Homo sapiens
ccgagacctgaagatacaaatgtgggctttcttgaactgttttgagaagagcactgctgtattttccttgg

SEQ ID NO: 6829405 - DNA, 105 bp, Homo sapiens
aagatctatttgaatctgtaaacaagtagagattacagtgtgcaaaaagtaatcctttttggcacctctagtaagctctgcttcttgcagatctcggaggatctt

SEQ ID NO: 6829406 - DNA, 74 bp, Homo sapiens
agggctttgagcatcttatagaaagagctcatttactgatattagctcttattctcctagagctcagtggcctt

SEQ ID NO: 6829407 - DNA, 65 bp, Homo sapiens
cagaacgcattgacagtatagctttacctatgaatatcatttcaatagtgctgctcaatgttctg

SEQ ID NO: 6829408 - DNA, 97 bp, Homo sapiens
tgtggaaatgcatgagtttggagagttaatttttagttggatattacatgtgagcatgtcccaagatacagctagagaaactaccaccatgttcaca

SEQ ID NO: 6829409 - DNA, 62 bp, Homo sapiens
aacagcagggggacctgctggtcaccagatttgtccacccccgtgcaggtgccactgctgtt

SEQ ID NO: 6829410 - DNA, 68 bp, Homo sapiens
tagtggcaggggcgggctgttccgggtatcataggatgcttcgcagcatatccgacctctgcccacta

SEQ ID NO: 6829411 - DNA, 67 bp, Homo sapiens
cctcctggtgggcgcttctggccttccctccctccccaaaggcaagaggcccccttaccacctgagg

SEQ ID NO: 6829412 - DNA, 63 bp, Homo sapiens
tgcgtgtgtgttttgtgtgtgtgtgtgtgtgtgcacgcatgtgttcttgaaaggccacatgta

SEQ ID NO: 6829413 - DNA, 59 bp, Homo sapiens
gaggctcaaacctggacagagctggtagccaaattaaccgtgaacccagtttgagcttc

SEQ ID NO: 6829414 - DNA, 63 bp, Homo sapiens
aagagcctttccccaccctctgacctagagaaaatagaaggcattatgtgggaaaatgttctt

SEQ ID NO: 6829415 - DNA, 83 bp, Homo sapiens
agcctattctcaggctctggtgcagctgtaactgaaagcctcataacagctcttaaacaccataaagagttaagacataggct

SEQ ID NO: 6829416 - DNA, 66 bp, Homo sapiens
cctctgaccggtggtggctcaagtctccactccaagtcccttggggacaggccgcctcggtggggg

SEQ ID NO: 6829417 - DNA, 77 bp, Homo sapiens
cggaacccggatcccacgaccccggccctacctttctccgtgccgctgggctgcgtcggggaagccacggggttccg

SEQ ID NO: 6829418 - DNA, 58 bp, Homo sapiens
ggtggaagtaacattacttttcatgacccagctttggaagtcatatgttacttctacc

SEQ ID NO: 6829419 - DNA, 55 bp, Homo sapiens
gggatggcttggagacagggcctgtttataattacagggattttccaggctaccc

SEQ ID NO: 6829420 - DNA, 97 bp, Homo sapiens
gccagggactcaggagtattttgctgtagaaggccaaggatcaggtgcctcccagctgcctgtatttgcttccttctgcaattccagatgttttggc

SEQ ID NO: 6829421 - DNA, 77 bp, Homo sapiens
tgggatgtttgttctcaataggtgtacttatccctgcaattttcagttcacctgtcaagtccagcgcaacagtccca

SEQ ID NO: 6829422 - DNA, 89 bp, Homo sapiens
attttagctgtctcttgagtaacgtaatttgtggaaggggtagggctccctctatgcctacctccaaaatatatactcccagtaaaaat

SEQ ID NO: 6829423 - DNA, 58 bp, Homo sapiens
gtcagggaaattataggactggttagattctagttcagcaacctataaatcccaggac

SEQ ID NO: 6829424 - DNA, 100 bp, Homo sapiens
taagacttaacagtccttcaagaaatctggaaactagagaactcctgcaacatggactcccaatttttctagatattccttgaagtgagtgagcctcttg

SEQ ID NO: 6829425 - DNA, 61 bp, Homo sapiens
ccaggcttgaagggaagaatggtttgagcaccgaggacaagaattaattccccaggcctgg

SEQ ID NO: 6829426 - DNA, 56 bp, Homo sapiens
taggctgcaagcatagaacaaagcacatgatagtactttgcagtgactgcagccta

SEQ ID NO: 6829427 - DNA, 82 bp, Homo sapiens
catcaaccaggtggttctgaaaggcctgggagtactgggacaggccaatgtcattcagccaggccttggccacccagtgatg

SEQ ID NO: 6829428 - DNA, 96 bp, Homo sapiens
gtcctgcctgctggaacttggtgtatctcttagatactgtatctaatgctatcaagagtctctacattaatcttagcttctccagtcaggttagat

SEQ ID NO: 6829429 - DNA, 94 bp, Homo sapiens
ttgtgggatctagtgtggccttggcccagaggccctgagccatgatatggcaaagcgtggactgctgggcaaggtaggcacatggtgatcacag

SEQ ID NO: 6829430 - DNA, 56 bp, Homo sapiens
gcggagggagataggccttgctatacctgtggtgtctgccaaagcttcctcctggc

SEQ ID NO: 6829431 - DNA, 69 bp, Homo sapiens
agttagggtctcaggccccatacagcatctgtgtttagcacagtgtgggcatggtgcctgctcctggct

SEQ ID NO: 6829432 - DNA, 128 bp, Homo sapiens
accatctgttgggcacatcacagcgttatctcatttaattccctctgctggtaaaggagacactgattttacagagtagggaattgaagttctgagagtgcatgtaaattgctcaagatctcactggt

SEQ ID NO: 6829433 - DNA, 68 bp, Homo sapiens
gggatggaactaggctgtcgctcacttgctccataatgttgggaaagttattcagcctctctgatcct

SEQ ID NO: 6829434 - DNA, 61 bp, Homo sapiens
gagagtggtcccagaagcctctccaaatgctccatccagagagtcttctggggccactttc

SEQ ID NO: 6829435 - DNA, 67 bp, Homo sapiens
gcttctggggttctggcatgctcattacttcccttctgaccatcttccctatggaccccaggcctgc

SEQ ID NO: 6829436 - DNA, 63 bp, Homo sapiens
gtgatcagcagcggtgtgggccttcctcacagcacttctcacacacatttgctgtctgattac

SEQ ID NO: 6829437 - DNA, 92 bp, Homo sapiens
gaggacttactgctcaatatttagaaacttggtatggatgggtttctgcggcaacacagcaaagcagatttcatttaaacctttctgtcctc

SEQ ID NO: 6829438 - DNA, 70 bp, Homo sapiens
ggattggctgtgagtcaagctggttgatgaagcttcattttgctaaatctccagaatggcttgttaatcc

SEQ ID NO: 6829439 - DNA, 95 bp, Homo sapiens
gccagggaaagcttctcaaggagggtgacctattagcagaaatttgaataataagaaagagtcagcttcagaaatttgggaagagcattccaggc

SEQ ID NO: 6829440 - DNA, 130 bp, Homo sapiens
tgcccttagcagtgggggcagcagagccacttggagcgccggctcaggccacaggacggcagcccgaaacctgcccggccgctggtgctggtcagtgcgacagtgttgccgcccccactggcagtcagca

SEQ ID NO: 6829441 - DNA, 97 bp, Homo sapiens
gggtctcgccatgccaccttgcttgccctgcagcggtgagtggtgaggagcactgaaggcccagggcaggtggaaggggcagcccgagcacttaccc

SEQ ID NO: 6829442 - DNA, 78 bp, Homo sapiens
ctgtaccccttgttctactccaagtgcaagaaaaatctaagctttttacccacatgagtgtaggaagagggaagacag

SEQ ID NO: 6829443 - DNA, 65 bp, Homo sapiens
tgtccttgttcctaatgtaaaaggtgcttaactgcttcttggttctattgggtagcattgggata

SEQ ID NO: 6829444 - DNA, 71 bp, Homo sapiens
tgccagccaacaccattgcatagtttgtgcactgcccaaggtactcacagaataggcatgatgggctggca

SEQ ID NO: 6829445 - DNA, 97 bp, Homo sapiens
ttggaaaactaaagtagaatatatggttagtattgcctataaatgccaaaacactcatatggggtagtagatcatacttttctctcaagtattttga

SEQ ID NO: 6829446 - DNA, 78 bp, Homo sapiens
cccagatactcagacatgccttttacttcacgtcatcatgatgtttcctgaggtcacaggcatgtgaggcatctgtgg

SEQ ID NO: 6829447 - DNA, 62 bp, Homo sapiens
cctgtatctgtgttggatgagtttgtatattaaacatctgtagccacttgacacagatgagg

SEQ ID NO: 6829448 - DNA, 113 bp, Homo sapiens
agtaaaaaactgtgtttttctgaaagggggctcagagttaattggatgggttcagatatgggaacctctggaacttgatttgaaacccctgtcacagaaatgacctttttact

SEQ ID NO: 6829449 - DNA, 86 bp, Homo sapiens
aaatggagacataagacaataatcaaggaggtaattttcattagcacagttattgcctgtcattattgaatcatatgtgcctattt

SEQ ID NO: 6829450 - DNA, 75 bp, Homo sapiens
tccttgttcctaggctgcatagagttgctggaaaaaaaattatagaatgtgctcaaagcaccctggaataagaga

SEQ ID NO: 6829451 - DNA, 59 bp, Homo sapiens
ggaatgtagtttgtgcactgtaaagttttgtgaagtgcaggttgtacaggcttattact

SEQ ID NO: 6829452 - DNA, 55 bp, Homo sapiens
ttgagatggagtctcgcactgtcgcccaggctggagtgcattggcactatctcgg

SEQ ID NO: 6829453 - DNA, 83 bp, Homo sapiens
tttatctatgtttggcctggcaatttcagctccaggaaattttaagaaaacagttcagattgttggagccaaacagtcatgag

SEQ ID NO: 6829454 - DNA, 79 bp, Homo sapiens
cagcagccccgttaccactgctcgggccagtagagctgcccaactgcccagcgagcagaggtggacgaaggtcctgcag

SEQ ID NO: 6829455 - DNA, 56 bp, Homo sapiens
ctctgcagttgtgcgccaatataggtcgattacccagggcatccacgaatgcagag

SEQ ID NO: 6829456 - DNA, 55 bp, Homo sapiens
aggctggcggctttaattatcacttgtgagaacttagtcaagaaagtgctagcct

SEQ ID NO: 6829457 - DNA, 60 bp, Homo sapiens
gtggacctgcgtaggtgctgggccgcggttcccgttctgcccgcccggggcgcagggcgc

SEQ ID NO: 6829458 - DNA, 69 bp, Homo sapiens
ccagagggcgtcctcagtttgtaggggctgctgaaatctattcctgggtcctgggaagccctgccctgg

SEQ ID NO: 6829459 - DNA, 55 bp, Homo sapiens
tcacactttccatggctgttaaaatcctcatatgacagcaatattcaaagtgtga

SEQ ID NO: 6829460 - DNA, 76 bp, Homo sapiens
aagggcaggagaaggcagcagaagatggatgtcctagctcaagcagagacagtaaatttgcccttcctctgccttt

SEQ ID NO: 6829461 - DNA, 130 bp, Homo sapiens
ggatctgtggagagggaaggacttcatatgcttccgtaatcatctttaaaggggagacacccataattaggctagctctaagggtgtcttctctaaggatgtggctatgtaaatctctccccacaattcc

SEQ ID NO: 6829462 - DNA, 70 bp, Homo sapiens
taaggaaccagtgatgaatgaaccacaggtaagtatcattgctggcccagtcattcagtcattgaactta

SEQ ID NO: 6829463 - DNA, 66 bp, Homo sapiens
gttgcttttctccatcacatggagagatcttggctctgtggggatagcaatggtggggaggacagc

SEQ ID NO: 6829464 - DNA, 83 bp, Homo sapiens
aggaagaaatatcgcatttgttaaagcatgttggcactgcattcaacatcattgattagtaaattgtgatcattttctctcct

SEQ ID NO: 6829465 - DNA, 61 bp, Homo sapiens
ccaggaagcctcagatgctgagcttcccacattcctgctcccagctccctgatcttcctgg

SEQ ID NO: 6829466 - DNA, 62 bp, Homo sapiens
gggtgaaggatccctcttggcctggaggcgactggcctgaggcaagaacgggttgttcaccc

SEQ ID NO: 6829467 - DNA, 90 bp, Homo sapiens
gtcccagttgcaggaggtgttctgaagagaggctggaattctgcatatgtggatgagatttccgttctctcttcagtcttcagtatggac

SEQ ID NO: 6829468 - DNA, 58 bp, Homo sapiens
tatttccaaaagcctattatgaatacttagaaaatctcatagcaggcaattggaaatg

SEQ ID NO: 6829469 - DNA, 57 bp, Homo sapiens
ttctgaagctcccttttgtagttaagagttaaaagtcccgaggcgagctcttcagaa

SEQ ID NO: 6829470 - DNA, 78 bp, Homo sapiens
agatcaaggacaaattgggtatgagctaagaaggccgtgggtgatctcagcaaatacctagtttggcctctgtggtct

SEQ ID NO: 6829471 - DNA, 61 bp, Homo sapiens
gggtggacgttaggattgtgtagagtcactgttgaatcattttatcactaatgtcacattc

SEQ ID NO: 6829472 - DNA, 66 bp, Homo sapiens
ctgtttgaatgtgctggtaactgctttgcttcttgagtagagccaccaccaccatagcccagccag

SEQ ID NO: 6829473 - DNA, 115 bp, Homo sapiens
taaaatatagaactacatttgaagaaggaaaaaatggcttaataggcaataagtacaatactttttttctgaagcagttttactacctaaatcctgagtgttggattatatttta

SEQ ID NO: 6829474 - DNA, 68 bp, Homo sapiens
aaaggggaagccagcggccactgtgtctggacattcccatggccacacagttcgttgttttctacttt

SEQ ID NO: 6829475 - DNA, 94 bp, Homo sapiens
ggagcaagccggcctgtgagagggcgagtgtagactccgggacagcctgcccggttcatctcacagctctgctgcatgctggttcattagctcc

SEQ ID NO: 6829476 - DNA, 67 bp, Homo sapiens
gtcactcttaaagcctcatcactccgtgtccattgtatttttcaccatggggaagagctttgatgac

SEQ ID NO: 6829477 - DNA, 128 bp, Homo sapiens
ttaaagaatgagtgaatgagtttacaaaacacaagaggcagggtacagttattccaaaatgataggaaacaacattgtgcctttgcttttgtttgaagagaaataaactgtttccattcaagttttaa

SEQ ID NO: 6829478 - DNA, 66 bp, Homo sapiens
agggagatgccagaccatccagttgggacttgctgagaatggtccctcactggttctgcatcccct

SEQ ID NO: 6829479 - DNA, 80 bp, Homo sapiens
tggcttgcctttgggtcctgtgtgctttctttaggttctaattagaagcctggagttggtacaatggggcaggcaaggca

SEQ ID NO: 6829480 - DNA, 86 bp, Homo sapiens
gtgggtcctctatgggttgccctggctctgcccagcttctccagagggcagcagttgcttgtagggtccgggtatttgggacccac

SEQ ID NO: 6829481 - DNA, 102 bp, Homo sapiens
gtgaagaagtaaagcccaaagccctgggcgttactgggatgcttttgttggtaataataatgtccctgtgtgctcccagggactgagaggtgcttttctcac

SEQ ID NO: 6829482 - DNA, 81 bp, Homo sapiens
catctgtgatactccttatactactttgtggtatgtggatacttcttatacatcatttatggaataaggtgatcatacatg

SEQ ID NO: 6829483 - DNA, 77 bp, Homo sapiens
ggcagagctgataccctggactcgcccatgcaactctctgacactgaaggctctgcatgcttcaggctggctctgcc

SEQ ID NO: 6829484 - DNA, 105 bp, Homo sapiens
gcagaggttaagtaacacgctgaggacacaggcttcagagaggggtgaagctggcctttgaagctaggttgtccatctctagaagccacacccttaagcctctgc

SEQ ID NO: 6829485 - DNA, 69 bp, Homo sapiens
ggcccactgagcgacaagtagcttttgatgtagacatcactcccccagagagctatttgtttggaggct

SEQ ID NO: 6829486 - DNA, 130 bp, Homo sapiens
gaaatctgttactagagtggaagttgcttctgcctgtaatatttggagaagctgcaaaatagatttacaaatttaaagcttctccaaatactacaggcagaagcaacttccactctagtaacaaggtagc

SEQ ID NO: 6829487 - DNA, 81 bp, Homo sapiens
taccttccagtctacacaatgatttggttcaaaaataggcctcccatttctgatataccacattagatgtgttggatggta

SEQ ID NO: 6829488 - DNA, 126 bp, Homo sapiens
gattgcataccactgctctctgacctgggtgacatagcaagatcgtgtctctaaaataaaatatatatatatttttgagatgttgttttgctcttgtctcccaggctggagtacaatggtgcgatc

SEQ ID NO: 6829489 - DNA, 63 bp, Homo sapiens
gctcacatttttctgcagttttccagtggacctgcctatggaatactgtaaagaaaaatctgc

SEQ ID NO: 6829490 - DNA, 59 bp, Homo sapiens
tgctcaacagcaatagtaccagaataaaagaaaagttattatgttctgggctgtgagca

SEQ ID NO: 6829491 - DNA, 111 bp, Homo sapiens
gggttatatagggaaatctttcacattactcgcagtaagaaagtcaagcagttgatctttcacaatggcatgtaattctggctgaaagaaatgagggcctattttttgcct

SEQ ID NO: 6829492 - DNA, 62 bp, Homo sapiens
atgcagttccacaggcgcatgggccacgtttccagtgcttggtggccatgtggggctgacgt

SEQ ID NO: 6829493 - DNA, 57 bp, Homo sapiens
gggaactgtggggttcctggtacttgtctgcccagtagcactgccaccctacctccc

SEQ ID NO: 6829494 - DNA, 76 bp, Homo sapiens
gctgagagattcaaacaggccaattgacctggtaccaagtgaaaaggcaattagtcttttgttattccatcttggc

SEQ ID NO: 6829495 - DNA, 65 bp, Homo sapiens
agtcttaactatgcaagtactatgtattccaatacacatagacacatcaagtatagttaaggact

SEQ ID NO: 6829496 - DNA, 56 bp, Homo sapiens
acagtttatgcctctgagcctgcagactcaaagatgcagtttacaacataaattgt

SEQ ID NO: 6829497 - DNA, 59 bp, Homo sapiens
gggccataactggctggacagtgttgaatcattgcattgtgcagtgttgaattatgccc

SEQ ID NO: 6829498 - DNA, 65 bp, Homo sapiens
atggtctgcagatccctttagtgaggaaggcattatcccctcacagcaaggatttcagtgaccgt

SEQ ID NO: 6829499 - DNA, 55 bp, Homo sapiens
aatgcacaaaaattgtatgtaaacatgtgtgtgtatgcatgcttgtgtgtgtgtt

SEQ ID NO: 6829500 - DNA, 75 bp, Homo sapiens
agagagctgcagtgatatatgttgccagagaggacaccatcagtcatgacctctgtggtaaaatagcagtattct

SEQ ID NO: 6829501 - DNA, 81 bp, Homo sapiens
tgtttctcaatcctgttggcagttatattgcaatgaaaattaattaactcattcaataaatatgctacatggtggggatca

SEQ ID NO: 6829502 - DNA, 73 bp, Homo sapiens
gtacaatggctggtcacatggtaggtctgtgtataacattgcaagaaattaccgaaatgatcacacaatgtac

SEQ ID NO: 6829503 - DNA, 63 bp, Homo sapiens
agctgagctagtagttccagtgcctagcactacacccaaaggcgcaaaccactcgctctagtt

SEQ ID NO: 6829504 - DNA, 57 bp, Homo sapiens
ctcaccttgtgatccacccgccttggcctcccaaagtgctgggattacaggtgtgag

SEQ ID NO: 6829505 - DNA, 80 bp, Homo sapiens
gtgaaagtgactgacaagtagatgatctttctgcatagactctatgccaaataagaaggtctacagtcataaacatttat

SEQ ID NO: 6829506 - DNA, 65 bp, Homo sapiens
tcagcagaccctgaagacttgcttttaaacaaagaaaatcctgggcacttctgcagggctgctgg

SEQ ID NO: 6829507 - DNA, 62 bp, Homo sapiens
tctagagtagagtttccttaggaaagcactggagcttttctggaaggatgtttctatctaga

SEQ ID NO: 6829508 - DNA, 65 bp, Homo sapiens
ctttggtattttgagatataatgtgatggaaagagtgtaatttccatgatctcattcaactaggg

SEQ ID NO: 6829509 - DNA, 70 bp, Homo sapiens
tttgctgtctaggagaggacaaatagaaaggggttgacatgcatccaactgcctcttctctggcagcaga

SEQ ID NO: 6829510 - DNA, 59 bp, Homo sapiens
gctcactcacacaggttgaacccgggtttcccctcacctttttcaccagtgtgatgggt

SEQ ID NO: 6829511 - DNA, 90 bp, Homo sapiens
tccaagggcaaggcaacatatgattttgtatataaagttcacattttgcatttaaatggtgtgtttacttttttagccttgtcaactgga

SEQ ID NO: 6829512 - DNA, 63 bp, Homo sapiens
aggcaaactgatgaaagattttgagtgtcagacacacttctgtagtagaatctgttattgcct

SEQ ID NO: 6829513 - DNA, 102 bp, Homo sapiens
gcatcatttccccactttggacctggacaaaatctgttatattcctgtttggtgttaacatggaccatgagttttctctgggagtggggaagttgaaattgc

SEQ ID NO: 6829514 - DNA, 113 bp, Homo sapiens
tctgtattttaaatttttaggcagtttcttctaaggtgaacaatggtatttaccttttgggtagaacatgacttatttttggaagtattgcttgagtaatattaagaattagg

SEQ ID NO: 6829515 - DNA, 91 bp, Homo sapiens
gtgtcagaacttttgggcattcattagaatagatatgtactcagtttctctgggtatttgtggtagtcagtgctaataaaagggctcttac

SEQ ID NO: 6829516 - DNA, 80 bp, Homo sapiens
gggagcatgaggccctctgggctggtcctgctgccctcaccctcacctcaagcaggtccctcagaggcctcaccgagccc

SEQ ID NO: 6829517 - DNA, 126 bp, Homo sapiens
cttccaaattttagacatgtgtgtgtgcttctaattattcccttgtcccaagtccttcaaatgtaaggaataggcctggtatagataagtgagtaattatgaagcaatatgatgaaattatgggag

SEQ ID NO: 6829518 - DNA, 90 bp, Homo sapiens
aataaaaaaacagcaagtcagtgagtagaagattgatacctctgtgatagtgtgtctgtttctctctatttatttgtcttgtattttatt

SEQ ID NO: 6829519 - DNA, 76 bp, Homo sapiens
ccagagtctggtgttctcacactagttggcacatagctgaagctcctattatgtgtgtggatacacagagagctgg

SEQ ID NO: 6829520 - DNA, 76 bp, Homo sapiens
ctggacctgggatgcagagccctgagggtgcaggggatgggccaagggctccctgagggctcagcccccagcccag

SEQ ID NO: 6829521 - DNA, 68 bp, Homo sapiens
cgttactcccgatccctgagccatggaagattgtcccaggcagatggctcagtcatggatgagtaatg

SEQ ID NO: 6829522 - DNA, 60 bp, Homo sapiens
gcttcctgatcccccacatcccagcaggccttcccactgccatcgaggggagcagtaggc

SEQ ID NO: 6829523 - DNA, 92 bp, Homo sapiens
gcagaccttgtgctgggtgggagttgggctgcagaaacagtgaggggttttctgtgctgcagggtcagcaccctcctaggcaccagccctgc

SEQ ID NO: 6829524 - DNA, 72 bp, Homo sapiens
ttaatgtgctttccaatgctgtaggttctaaaatttactcaaaaatcttcagctttagggaaagaacattaa

SEQ ID NO: 6829525 - DNA, 74 bp, Homo sapiens
tctctacttcactgagtttcatccaggtgcaaaaatgaaaaattataacctgccaagcatcagtggcagagtga

SEQ ID NO: 6829526 - DNA, 71 bp, Homo sapiens
ctcacagtttctataggtcagaatttgatagcagcttagttgagtgattctggcttaaggtgtctgatgag

SEQ ID NO: 6829527 - DNA, 120 bp, Homo sapiens
gaattgggaatgtgcatagactttggatggaagtatggaatttggaactagatttttaaattccaatctcactggttctacagttcctattacttacaaactctctgttatgtctaattc

SEQ ID NO: 6829528 - DNA, 88 bp, Homo sapiens
tcttagtaagggggcccagcactaagttggcgcgtaatcaatgtttgtctaatacaatggagttgggccccgttttttacagataaga

SEQ ID NO: 6829529 - DNA, 80 bp, Homo sapiens
caaagcagcatctcctgtgcagagggactgtttggaagatatagtgaggagtgctcagcgtcacaggggagtgctctttg

SEQ ID NO: 6829530 - DNA, 78 bp, Homo sapiens
gtgccaaggtgtcaccatgccagcttctgcctgttgaaagggatgctggcggaagtcatggtggctgagtcctggcac

SEQ ID NO: 6829531 - DNA, 88 bp, Homo sapiens
ggagtctcgctctgtcacccaggctggagtgcagtggcacgatctcggctcactgcaagctctgcctccagggttcatgccattctcc

SEQ ID NO: 6829532 - DNA, 69 bp, Homo sapiens
cagatttggcccatgggccacagttcaccaatccctgctttaggaatttcctttgtggccccaaatttg

SEQ ID NO: 6829533 - DNA, 98 bp, Homo sapiens
cagccagaaccagataaaactactttgggccatttgtttactgacattaaagtggatttatggagaccgaaagtctttctattgtcccttctgggctg

SEQ ID NO: 6829534 - DNA, 68 bp, Homo sapiens
gctgaggcatgatgattgcttgagaccaggagatctgggctgcagtaacgatcatggtgcctgtaagt

SEQ ID NO: 6829535 - DNA, 78 bp, Homo sapiens
gtaactcatgacattttaaaaagaacatcatgtttgtcattcacataatgttcttgttcaaatgtcagttgaggtgac

SEQ ID NO: 6829536 - DNA, 57 bp, Homo sapiens
ctgaccttgtgatccacctgccttggcctcccaaagtgctgagattacaagcgtgag

SEQ ID NO: 6829537 - DNA, 68 bp, Homo sapiens
aaggtgacgttcagggggctgcagtagactgtgttagctgcttctcctccctggggatgatcacactt

SEQ ID NO: 6829538 - DNA, 78 bp, Homo sapiens
gccatctacgcgtctgcccatctccgggcggggcgccggccttggctcgcgcgcggcagggggcgggcgcgaggtggc

SEQ ID NO: 6829539 - DNA, 68 bp, Homo sapiens
gaatgctggaagggcctgagccccagcgcaccacagcacctgactcccctgggccccatccagccttc

SEQ ID NO: 6829540 - DNA, 62 bp, Homo sapiens
ggccctggtgaaggtgttgagtgaatggatgtgtgagctgtgggcagcatcttcattaggcc

SEQ ID NO: 6829541 - DNA, 57 bp, Homo sapiens
gggaaagtgatctggattgacatctctttaaattgtgtcttccagagacattttccc

SEQ ID NO: 6829542 - DNA, 72 bp, Homo sapiens
cagtaggtctaaggcaccgaggcaggagcgtcccccgcggcctcgctccctgctctctgggccccaccgctg

SEQ ID NO: 6829543 - DNA, 74 bp, Homo sapiens
gatctgtcccaggctgaagtacagtggcacgatcatagctcactgcagcctcaaaggcctgggctcaacggatc

SEQ ID NO: 6829544 - DNA, 89 bp, Homo sapiens
ggaatactttcattgaagattctgacatcagaaaccatgacggcaagggtcaaatgccttctgatgtcattctgggatgaataaattct

SEQ ID NO: 6829545 - DNA, 59 bp, Homo sapiens
gttaagtaaactatgatttatccgtctaatggaacactgtgaatcatagtttgctttac

SEQ ID NO: 6829546 - DNA, 117 bp, Homo sapiens
ggcatttttttttctttttgggaacttgacagtacttctggaagtggaatttttgtagaaaatatattaaagttgtcattctcaggttcttcaggttgaaaagtaaaaattgaggct

SEQ ID NO: 6829547 - DNA, 66 bp, Homo sapiens
ggaagtgactgatggcagggtaggggtcaaggcaccttcacatcccacatcccatctccacattcc

SEQ ID NO: 6829548 - DNA, 92 bp, Homo sapiens
ccccgatcaatgaatacatctgaaggctatgaatactataacaaaaagcaggagatgacatatgacctaagatgtgtgccaaatgtttgggg

SEQ ID NO: 6829549 - DNA, 92 bp, Homo sapiens
aaccaggcctggagttgtgagcaatttggtattaattttatttacaaaacattaaagcttgatcactcaatgttcttatctttgctttggtt

SEQ ID NO: 6829550 - DNA, 65 bp, Homo sapiens
tcatagcaaatattagcacatatgtcttatgaggcaatgacttttaaaagctggtacttgcatga

SEQ ID NO: 6829551 - DNA, 64 bp, Homo sapiens
gatatgaacatatcctccggatagcgtgagacacgtttcagtgatctaagggtatggccatgtc

SEQ ID NO: 6829552 - DNA, 72 bp, Homo sapiens
ataattgtgggcttgcctggctcttggcagcctctcccctccaagacccttaatagccttgcagacgattgt

SEQ ID NO: 6829553 - DNA, 63 bp, Homo sapiens
gttgtcaagtgattagccataatgtttcttgcacttcaggcttgcattataaatcacgacaat

SEQ ID NO: 6829554 - DNA, 92 bp, Homo sapiens
cagcctcaccacggcagtgcctgggacccggctgtgtgtatcccacctggccaggctccaagtactgttcagatgactgtggcatgaggctg

SEQ ID NO: 6829555 - DNA, 55 bp, Homo sapiens
gatgtcacttaatttgtgtggtaaactctcaccaagcaagcttattagtgatatt

SEQ ID NO: 6829556 - DNA, 73 bp, Homo sapiens
cctttggtggttttcagagatccagagcgaccatgtcaggaatgttgagatatatctttgaaaccagaaaagg

SEQ ID NO: 6829557 - DNA, 57 bp, Homo sapiens
agtggtgatgaggataacatttatccaataaataaatgtgtaaacctccattaccct

SEQ ID NO: 6829558 - DNA, 62 bp, Homo sapiens
gtctcttggcttttgctcccagatcatcagaaagatgactcaatgagccagagctctttgat

SEQ ID NO: 6829559 - DNA, 109 bp, Homo sapiens
cccaagacaaaaccgcaaagccccagaatgaggaatgtgacaaaaccaaggagccctgcagcttgcctttgaaagcatttctcctctggccgttttgtgggctcctggg

SEQ ID NO: 6829560 - DNA, 80 bp, Homo sapiens
cacactctcctggatggaccttctcttatttctccaatccaaaatccagtaagccagatcaaagtgtccaggggggtgtg

SEQ ID NO: 6829561 - DNA, 87 bp, Homo sapiens
tggactacaactcccagaagactttggtggagctccccactatcttcatgctctattaccctgaagcttcctgggagttgtagtcca

SEQ ID NO: 6829562 - DNA, 61 bp, Homo sapiens
cccttcatcagctggcttactgttcacttcaaggtcaagacattggctgtctgatgcaggg

SEQ ID NO: 6829563 - DNA, 92 bp, Homo sapiens
agatctaagagactaaggcaggaagagacgcagcagcttgtctttgattctgccaagcttctgcatcttttcttccctagcccttagcgtct

SEQ ID NO: 6829564 - DNA, 89 bp, Homo sapiens
accctcacagcctctctggccgagagtccctgggcgctcacttgccgggatgcacaggcacgcctctggccaggccgggctgcgggggt

SEQ ID NO: 6829565 - DNA, 91 bp, Homo sapiens
tcatctgtcctcatttcccaaaccctacggcttccagatcaagtgccaggaactggaaaccttcatgctgagaagctgaatggggcagtga

SEQ ID NO: 6829566 - DNA, 67 bp, Homo sapiens
tcgtcctgggctgcaggctctgcaggaattgctgaaacccagccagtttgggctgctcccgggatga

SEQ ID NO: 6829567 - DNA, 77 bp, Homo sapiens
tgtctgccaggcccaaatgcaaccttcttgtgaaaggagacgggagggaaggctagggtttagagagaaggcagata

SEQ ID NO: 6829568 - DNA, 70 bp, Homo sapiens
cacagacattcatatcctcggtattcattcatttgctaaaacagagtcacccaggatattgaagtcagtg

SEQ ID NO: 6829569 - DNA, 89 bp, Homo sapiens
gttctgcatggaaaactaatggagtcatgatggctgctgatgctgatgaagtagtaccagccagcctgatttcataacttccatagaat

SEQ ID NO: 6829570 - DNA, 65 bp, Homo sapiens
gagcagcaggctgggatgagtctgggtggagacctctagaaggcacagaatccagtctgctgctc

SEQ ID NO: 6829571 - DNA, 76 bp, Homo sapiens
acctcactaaaatttcgtatctgatacaacagaataacatttgcagaatgtaatattgtagtgacagtactgaggt

SEQ ID NO: 6829572 - DNA, 64 bp, Homo sapiens
gaaaggcttcttaagcttcactttcaggttgggaagagtctattttggagatgagaagcctttt

SEQ ID NO: 6829573 - DNA, 65 bp, Homo sapiens
aggtcgagtttcggggctactttgaaaaccacatgaaatttggtttgtagtactctgagtgacct

SEQ ID NO: 6829574 - DNA, 78 bp, Homo sapiens
ggtggcctctggtgtcctttagaatttaagctcagcatttactttggacacatgatttttgaaggacatggaggtgcc

SEQ ID NO: 6829575 - DNA, 59 bp, Homo sapiens
atcacttccagctgccctgtgtgctggctaggagatgcatcagcattagctggaaggat

SEQ ID NO: 6829576 - DNA, 70 bp, Homo sapiens
ctggagctgccagacgggcacaggcgagggcacctcacccttgaggcggccttcctggcagtggctccag

SEQ ID NO: 6829577 - DNA, 98 bp, Homo sapiens
gatgtgtacctgtttgtatgtgcacacacatgtgtgtttatatgtgcacatgtatgcgtatatgtatgtgcagtcatgcacacatctgtgtatacatc

SEQ ID NO: 6829578 - DNA, 70 bp, Homo sapiens
tgctgctagccatgtcagtttcattttaagtcatgtttctctcatggcaatgggatggctgctggtagca

SEQ ID NO: 6829579 - DNA, 84 bp, Homo sapiens
ccagcagcaaacatttttcagaggggcattacctagggccttgctccatcctgtgtgccaccactgacaggattctgtggctgg

SEQ ID NO: 6829580 - DNA, 68 bp, Homo sapiens
tctccctcattcctgcttccataggtacctcatattaccaatttctgagtttaggggatagagggaga

SEQ ID NO: 6829581 - DNA, 63 bp, Homo sapiens
gttcattaggagagctgagtttgttcacaccaacaaatctcaactaagcctaactttttgaac

SEQ ID NO: 6829582 - DNA, 56 bp, Homo sapiens
gcatttgacacaggaaagttgtaacttctcagaagttaacctttcgactgtcatgc

SEQ ID NO: 6829583 - DNA, 70 bp, Homo sapiens
ggtgaccttttagctgagtccccaaggatgaaaaagaatagccagatgggggagtggataaggggttgtc

SEQ ID NO: 6829584 - DNA, 58 bp, Homo sapiens
agtaaactgtagctacttaactaaatgatttcgtgtggctgagatcctactgtttgct

SEQ ID NO: 6829585 - DNA, 67 bp, Homo sapiens
gcagtttcaggattctgtgtctgacaatgttagccaaggctatttggtagaagaatatgagtattgc

SEQ ID NO: 6829586 - DNA, 74 bp, Homo sapiens
cctgcctcacaagcagaaggtggggtcttatcttagcacttgcgctaggtcccagcatcttctgagcaggcagg

SEQ ID NO: 6829587 - DNA, 67 bp, Homo sapiens
tggggcagtgagctcttgtccctaggggaaatctcttttcctccacgtgacaggagccagtgctcca

SEQ ID NO: 6829588 - DNA, 73 bp, Homo sapiens
gtattttctctttagtttcattagtattctaatattgatattagtggtaaggatgaaatttcagggtaaatat

SEQ ID NO: 6829589 - DNA, 84 bp, Homo sapiens
cctctaaccagttggcctcagtttgggtttccacctattgatggaatgacctggaatgtatgggaacccaaatccaaccagggg

SEQ ID NO: 6829590 - DNA, 91 bp, Homo sapiens
gaactatagagcaacctgcatataaagtcgttcagccaagagcatgggcagaatgaagccctgctgagcatttgtgcagcttctcaagttc

SEQ ID NO: 6829591 - DNA, 66 bp, Homo sapiens
tgtagcttctcctttcattccctgtagaatctgtcttgttctcatggagtcaggagcagaaataca

SEQ ID NO: 6829592 - DNA, 106 bp, Homo sapiens
tttatctaataaagcaaattccatttaattacaaaacacataggttggccaaactgaagtcaacaaatgtgttttgtaattaaagataattgtgttattagataaa

SEQ ID NO: 6829593 - DNA, 121 bp, Homo sapiens
tactcaatgctgtgcttctgaatattcagaaaataaattggattattggtttagtatcaaaaaagttcttctgctctgataatctgatttgctttcaatgtgtatgtactaaattgtggta

SEQ ID NO: 6829594 - DNA, 58 bp, Homo sapiens
gaatccaagagtttggtaaagcaggaatacaagtttgctctgctgagtcctaggattc

SEQ ID NO: 6829595 - DNA, 74 bp, Homo sapiens
ctttcagctctgagtgagactagatttaggaaacttacgtgttccccacctaaaggcagccactgagctcaagg

SEQ ID NO: 6829596 - DNA, 72 bp, Homo sapiens
ggtcccttaatccaggaggcttcgtccgtggagttggctgactcaacagactctgccatcccttaggggtcc

SEQ ID NO: 6829597 - DNA, 81 bp, Homo sapiens
gccacattggagggactggtgtacaatagttaagagtgatgatgtcctttcagtgcttctgtttaccggtttttctgtggc

SEQ ID NO: 6829598 - DNA, 84 bp, Homo sapiens
tagggtgaccaagtgtcctgatttgcctgggacttttctgggaattgctcggtcctgggcaaagaggggcagtggatcacccta

SEQ ID NO: 6829599 - DNA, 77 bp, Homo sapiens
tggtcttagtcctgagctgtcttaatggttggagaagccacctctcaccagctgaactgcagcccagggatgatcca

SEQ ID NO: 6829600 - DNA, 74 bp, Homo sapiens
caatagcagacctagaaagcaaccatctttcttctctcctaaggattcctggtgcttatctgtccctgcagttg

SEQ ID NO: 6829601 - DNA, 123 bp, Homo sapiens
gcttagaatcatgaattagctccttctttggctttgccacacccaatgacagccacacacctctccccagcttatttgaggtggaacagaaccaaagaaagagccagttccatgatcctaagc

SEQ ID NO: 6829602 - DNA, 82 bp, Homo sapiens
ggctggcatgagcacgaagtggtacccataggccactcacatctggaaggctgcaatggtaccaccaattcagctgccagct

SEQ ID NO: 6829603 - DNA, 63 bp, Homo sapiens
tttgtgtcgtcactgtcttctcaaatcatgtgtaagagtttggagatgtcatggcggcacaaa

SEQ ID NO: 6829604 - DNA, 55 bp, Homo sapiens
gcatctttttgggtgttatttgctcagaaactgtaaataaactactgagagatgt

SEQ ID NO: 6829605 - DNA, 97 bp, Homo sapiens
ccctgctggcagctgggggcgcagcagcccagggctctcagagtggccttccaacactcggggctcagaagctgctccgcggagcctgccagcaggg

SEQ ID NO: 6829606 - DNA, 103 bp, Homo sapiens
tcaagaactaatcacacttcattctgtattttttattcttcttatggtcaacacgtatgaagcagttaaggtgcatgataatcgaagtgctgtttgtggttga

SEQ ID NO: 6829607 - DNA, 129 bp, Homo sapiens
gtcccaaaagaattaatgtgacattacagaatgtgccatttggtcgtcatcttgtttcccattattggattggacttgtggtatcacttctgtttacatcaaccctagaattcaaataatgaggaaagc

SEQ ID NO: 6829608 - DNA, 59 bp, Homo sapiens
cctggcaacatttcaaggtctttactcaaacacctgtcaggtgccttgtatgtgccagg

SEQ ID NO: 6829609 - DNA, 80 bp, Homo sapiens
atgggaatgaggtgaggatgctgataggaggggggtagggtaagatgtccatactaacagcatttatcataggatcccgt

SEQ ID NO: 6829610 - DNA, 61 bp, Homo sapiens
agggcttggactgcctttgctcttgacatatttgcttgtgacatgaccagttccatgccct

SEQ ID NO: 6829611 - DNA, 58 bp, Homo sapiens
ccacagtgcctggaattctgcatttagaaatttgctctttggattaaagacactgtgg

SEQ ID NO: 6829612 - DNA, 67 bp, Homo sapiens
agcttctttaaaatgatattttgaattctttgtcaggaaattcatagatctcaattttgagggggtt

SEQ ID NO: 6829613 - DNA, 56 bp, Homo sapiens
gcagaaagctccttgcgatctgaaagcacatcacacagagcaaggaagttctttgc

SEQ ID NO: 6829614 - DNA, 78 bp, Homo sapiens
ggttagtgtggttttttagagcaatgcttggcggtcataaagcaaatgcattaagtcagaacaataggtacattgatc

SEQ ID NO: 6829615 - DNA, 71 bp, Homo sapiens
ggcccagcacagaggctcaaagccaggtgcagctggaagagcagctccccacagtctctgttgctgggacc

SEQ ID NO: 6829616 - DNA, 60 bp, Homo sapiens
ggttaagcttcagaacgcaatgatgccttgctttcctggcgtctccactgggggttaacc

SEQ ID NO: 6829617 - DNA, 56 bp, Homo sapiens
ggaatgtagaatctctggtctcagcttagagctaccgaaatcagaatctgcatttt

SEQ ID NO: 6829618 - DNA, 78 bp, Homo sapiens
gagttaggggtgtggagagagtgtggagagttcagggtctcacagcaacatctcacatttctcattctcccctaactc

SEQ ID NO: 6829619 - DNA, 67 bp, Homo sapiens
cagatgctatagtgctgccataaacattcttgttcaggtttttgggggacatatatatggctttctg

SEQ ID NO: 6829620 - DNA, 72 bp, Homo sapiens
gggaggggtttgtgggctggctctgtctagaaaggcctcaggccctaggctatccccagtcccttccttcct

SEQ ID NO: 6829621 - DNA, 69 bp, Homo sapiens
ggaaaccagatggtgcggcaggacagaaaccaatccaagccttctgcttccatgcccaacatctgtgcc

SEQ ID NO: 6829622 - DNA, 62 bp, Homo sapiens
ctgtgacttagagtgagtagagaggcaattagggcacatgcttcgatcattttgagtgacag

SEQ ID NO: 6829623 - DNA, 57 bp, Homo sapiens
cctgtatcttctctgttgaagtatctgttcagatcttttgtgaggacaaggtacggg

SEQ ID NO: 6829624 - DNA, 57 bp, Homo sapiens
gagcaactgcccacagtgaatggttggctggcaggcagcaccacctgggggcagctc

SEQ ID NO: 6829625 - DNA, 116 bp, Homo sapiens
gcttttctgatttcaaacacagtgttacattagccggggccattgtcatgtctggccaggcaattcaaagcacctggcttcctgttagtgtcttgctactgtttgcttttaaaagt

SEQ ID NO: 6829626 - DNA, 85 bp, Homo sapiens
tcagtgggcgtggcgcccgaggtggccctggtggatgtcaacgtgtacctgatcatcgccatctgcgcggtgtccagcttgctgg

SEQ ID NO: 6829627 - DNA, 69 bp, Homo sapiens
ggagatggggtctggcatatggtagataatcaatgttggttgactaaataaaagccaaacttcatctcc

SEQ ID NO: 6829628 - DNA, 71 bp, Homo sapiens
gaggaccccccttggtgatcttgctccgcccctttttgaagcttggggtcctctcacttggaggggtcctc

SEQ ID NO: 6829629 - DNA, 103 bp, Homo sapiens
aactgaggcttcagaaggttaaataaattgctgagagtcacctagtgagtaaatggtagagctcagctttgatctcaggcaatctacctccaaagtccatgtt

SEQ ID NO: 6829630 - DNA, 105 bp, Homo sapiens
gcaggcagcaccactgcctgttctcttttcagtgctgtcttgtggcctttgctcccacagagtcattcactgatgaagtaaatagcagcagtggtgtttttctgc

SEQ ID NO: 6829631 - DNA, 55 bp, Homo sapiens
actggagttattatttgcagctcttgttaactagggcgtgaaaatgcataccagt

SEQ ID NO: 6829632 - DNA, 108 bp, Homo sapiens
gctgaggctcacctctggggcctctgttggaccttcctggctcctggggtccagaggtgggccgaggcagggagaggtgtgccgaggcagggagaggtgtgccgaggc

SEQ ID NO: 6829633 - DNA, 85 bp, Homo sapiens
gtagtgtttaatgtaacaggaagaacagaatcctagctgatcggtggactactgggagttctccatgtccctatattaaaattgc

SEQ ID NO: 6829634 - DNA, 118 bp, Homo sapiens
agaggtctcagacagagctgccttgccctttccaccatgtgagtacccagtgagaaggtgtcatttatgaggaagtgggccttcaccagacactaaatctcttgtcaccttgatcttt

SEQ ID NO: 6829635 - DNA, 61 bp, Homo sapiens
tcctggttcctaccttcagctgtgccagaagaagatgggcagccaagaactgaacccggga

SEQ ID NO: 6829636 - DNA, 104 bp, Homo sapiens
gccctctagattacaaataggtttggccaatgggaatggccagtagctgcagtgctcctcctctattgccccagttcctattggacagaccttttttctttggc

SEQ ID NO: 6829637 - DNA, 130 bp, Homo sapiens
aattatctctttctgtctctaaaactatgatgatgtttagagttagctatgtaacaagtatctctctgttcttcggaacacagagtatcttttgcctagttttcaagatcctaatgttttgcccgacatt

SEQ ID NO: 6829638 - DNA, 78 bp, Homo sapiens
ctgctttgcgtgtgacttttctagtttcagcactgaaagtcctgcatccttgaagcccctaagtcccaggcaaaccag

SEQ ID NO: 6829639 - DNA, 62 bp, Homo sapiens
ggagtttgagaccagcctggccaaaatggcgaaaccagactggccaacatggtctcatctct

SEQ ID NO: 6829640 - DNA, 59 bp, Homo sapiens
cagtgtttcaagtgatgctttggcagttgtaaaaatctagtctattatttgagacattg

SEQ ID NO: 6829641 - DNA, 75 bp, Homo sapiens
gcaggccgccctgagcaccctctggaaaatgggccccaacccgcccctacttcctggggctgcagtgaggcctgt

SEQ ID NO: 6829642 - DNA, 64 bp, Homo sapiens
aagatgatgttgtgttttcactttgttggtgtgaatagttgagtgaaaatatccaactcatttt

SEQ ID NO: 6829643 - DNA, 61 bp, Homo sapiens
gtaatgctagaggattttgagtttacatgccttacatgtaaactcacattttcttcattac

SEQ ID NO: 6829644 - DNA, 70 bp, Homo sapiens
ggcggtcgctgaggtcaccccactggctgtgacactcatgttagtaggcagggtcacttcggccacagcc

SEQ ID NO: 6829645 - DNA, 56 bp, Homo sapiens
ggtctggcacgaggcctagagaggggccaaagccaagggaggcctctgccggtgcc

SEQ ID NO: 6829646 - DNA, 78 bp, Homo sapiens
ggtgctcttttagttattgcacagaattagtaccaaaaaaccctcaatatattaattttccaacagctgaattgtacc

SEQ ID NO: 6829647 - DNA, 56 bp, Homo sapiens
ggttctaggattaggaggcccagtattccattttgggtgaactgctatgaagaacc

SEQ ID NO: 6829648 - DNA, 60 bp, Homo sapiens
ctatcataattattgaagggctatgaatggtacgagaaccatggccagtagtgatgatag

SEQ ID NO: 6829649 - DNA, 114 bp, Homo sapiens
tggggctgataacagcacttactttccagggttgttgtgaggaatcagtgagctactaccttcaaagagcttagtgcttggcacacaatacactctttgctgttattattacca

SEQ ID NO: 6829650 - DNA, 130 bp, Homo sapiens
ttttaagggttgtgggttccggcctctacccgttcctgggactggagcagcccaggaggccctctcctgaggctgagactctgtgtccttccggacggaacctgaggacgctggaccctacagtttaaag

SEQ ID NO: 6829651 - DNA, 71 bp, Homo sapiens
gctttccaagtctggatttagaggtgggccttgtctagaaagccaggtctaccttttttcaggcaaaaagt

SEQ ID NO: 6829652 - DNA, 55 bp, Homo sapiens
cctgcttcagactcttggacgtgctcttaaatgcagatcctggcagtcagagagg

SEQ ID NO: 6829653 - DNA, 67 bp, Homo sapiens
gcttgggctggccggacaggccagaggctctgggcccggggcctgctggacattggccggcctcagc

SEQ ID NO: 6829654 - DNA, 64 bp, Homo sapiens
ctgtctccgccctcttggtaggccctgtgggatcaagtgtctccgaggcggcgggctgagacgg

SEQ ID NO: 6829655 - DNA, 56 bp, Homo sapiens
cagccctgcagctggatctcacacatcccaggaagtgagtctcccgctgagagctg

SEQ ID NO: 6829656 - DNA, 60 bp, Homo sapiens
gttttggtaagaatagtcatccttccctgtaaagggtccactggctaattttatagaggc

SEQ ID NO: 6829657 - DNA, 57 bp, Homo sapiens
tgaaggaagctgctaagaaacaatggtgaattgctataatctgggaagtttcctaca

SEQ ID NO: 6829658 - DNA, 56 bp, Homo sapiens
tttcgcagccagtgagcagaggagctagtgcttgtgctgagcttctagctgtggga

SEQ ID NO: 6829659 - DNA, 57 bp, Homo sapiens
aagaacttgggctgagtgaaagtcccaaatgggaccttcatttctgcctagtttctt

SEQ ID NO: 6829660 - DNA, 67 bp, Homo sapiens
gtctcttccacctggctggtgttcctgaggccagggggccttccagagcctgcaggttggatgggat

SEQ ID NO: 6829661 - DNA, 63 bp, Homo sapiens
tgtgcatatcctttgtgtaggcaatttcaatcatagaaattagttttaagaaggatttgttca

SEQ ID NO: 6829662 - DNA, 66 bp, Homo sapiens
agctgttctctggcggtggctgttcctgattctggtggtttctaagcagcaggctagggaactgct

SEQ ID NO: 6829663 - DNA, 86 bp, Homo sapiens
gccgggatgcggccggtacccgctccccgccgggaacaacctctccactcttcctgcagggagctggtgccagccgacagccgcgc

SEQ ID NO: 6829664 - DNA, 62 bp, Homo sapiens
aggctgattgagatattcaagaggaccaaatctttatttggtcatttttatttcagttgctt

SEQ ID NO: 6829665 - DNA, 64 bp, Homo sapiens
gaatatcccaaagatgaaataactgcttagagaaacagcaagttctctgtcactgggggtattc

SEQ ID NO: 6829666 - DNA, 74 bp, Homo sapiens
cctttttctcgttatataggaatttagcagttcattctgaatgttggctgctggctatttaaagaagaaagtgg

SEQ ID NO: 6829667 - DNA, 78 bp, Homo sapiens
gtgaattagggtggtccttgacctactgtctctttaaaccagtggccttttttccaaggaatcccatttctaactcac

SEQ ID NO: 6829668 - DNA, 66 bp, Homo sapiens
ttgtggggcccgagtggccaccttgtgggaaggctcccattatgagctaagttgtggccccctcaa

SEQ ID NO: 6829669 - DNA, 83 bp, Homo sapiens
gaatgtcatggtagttactcaaggctgatataaggcagctcttgttggtttaattgttgggagccttgaagtaccttccattc

SEQ ID NO: 6829670 - DNA, 83 bp, Homo sapiens
gaatgtatactattagataatctctaggcttcatgtagtctaaaaaacactatagttggagttggaggttatggataacgttt

SEQ ID NO: 6829671 - DNA, 117 bp, Homo sapiens
aatacttagttttctgatgagattggtagataatgaaatgttgacatatgattttttgggataatgaaatgtgctgtcaacatttcgaagatctttataactaagggaaccagtatt

SEQ ID NO: 6829672 - DNA, 87 bp, Homo sapiens
gagaaagtcttgctttgtcacccaggctggagtgcagtggtgctgtattggctcattgcaacctcctcctgggttcaagcgattctc

SEQ ID NO: 6829673 - DNA, 56 bp, Homo sapiens
tgcttaaaaccctttcatgactcctcatagcccatggcatgcataaagggtgagca

SEQ ID NO: 6829674 - DNA, 104 bp, Homo sapiens
acagaaaattccatttgtagtagtgagtctttataaatagctttataattgtttccagtttatatttgtaaaaagcctccactagaataaagagaattatttgt

SEQ ID NO: 6829675 - DNA, 68 bp, Homo sapiens
caggagaaacataattttctggggggagaatccaggaaggcatcccagaggaagtgatgttttatctg

SEQ ID NO: 6829676 - DNA, 82 bp, Homo sapiens
ggagtgggtgggggtgagaggctggctgagcgcagcacccagtcatgctcctcagtgtcttctctttcctaccttcccttcc

SEQ ID NO: 6829677 - DNA, 105 bp, Homo sapiens
ggttttgatctgttttctccatatttatagatctggcatttattgtaaaatactggggaaaaagaatgcaaatatatggatcagtgggaaaatctgattaaaacc

SEQ ID NO: 6829678 - DNA, 73 bp, Homo sapiens
ctgtgtctttagcatctcaacctcctgaaagtaagaagctggggagttgggggtagctagagggagagaccag

SEQ ID NO: 6829679 - DNA, 59 bp, Homo sapiens
actgctggcatctgaattatgtattaataaaagttagattcatgcagtatgctagtagt

SEQ ID NO: 6829680 - DNA, 117 bp, Homo sapiens
gtttgggttttttgttgctgttgcttgtttatttgtttgttgtgtttaagacgttttacttgtccctgaaatgtttgtcatcacacagatacacgctcaggataagaactaccagac

SEQ ID NO: 6829681 - DNA, 124 bp, Homo sapiens
ggattgcagatacacatagcaggagttgctttagattgttttgggggcgaaagtaatatttttttcagtattcaaatatgtcttacgtagttatttctgataaggaagaaacatttgttaatcc

SEQ ID NO: 6829682 - DNA, 105 bp, Homo sapiens
gtatgtgaataatttctattagttctataagcagatagagtatgacctactggtattacctgtactgctttatggggcaaacctctagatcaaacctctacgtat

SEQ ID NO: 6829683 - DNA, 66 bp, Homo sapiens
tgttctaaattgctagctggaacatagtaaatactttaagagttatgtctctggcagttcagagca

SEQ ID NO: 6829684 - DNA, 89 bp, Homo sapiens
cagcatgtgtctgaatcgcttcctagagggcttatgaaaacacacattcccgggcaccaccttcaggggttctgatttagttcgtgttg

SEQ ID NO: 6829685 - DNA, 70 bp, Homo sapiens
gttcctcatctgtgtggcccattctcaaagtgttccttctgacactcatctgagccaaacgatgaagagc

SEQ ID NO: 6829686 - DNA, 67 bp, Homo sapiens
caagaacggtactgttagtcctgctcacagctgcagccccagcacttaggacagcagctgccacttg

SEQ ID NO: 6829687 - DNA, 73 bp, Homo sapiens
gagaccttctagctcaaaattccgttttagtacaattgaaaaactgaatttcaaagaggttaagaggtgtttc

SEQ ID NO: 6829688 - DNA, 58 bp, Homo sapiens
ggcagaattggcaagtatgtatttgtggcatccttcggagaaacagcacaattctgtt

SEQ ID NO: 6829689 - DNA, 93 bp, Homo sapiens
tctggaaatgaagccctgtgataggtccagattcctatgatatcaaagacactactaggcttggaagatctaacagaggcatcatagactgga

SEQ ID NO: 6829690 - DNA, 77 bp, Homo sapiens
tagcttaaggaagagtctagaacaggcaactctcttaactggttgttagccttagttcagattcagcctcaaggcta

SEQ ID NO: 6829691 - DNA, 81 bp, Homo sapiens
tgagtgtgtgttcttttgcttcacagaaaatattctgccagttttcagaaccaagagagacatcaatttatttagcattca

SEQ ID NO: 6829692 - DNA, 60 bp, Homo sapiens
ctcccataattctcatatgtcatgggaggaacccagtgggaggtgattaaattatggggg

SEQ ID NO: 6829693 - DNA, 66 bp, Homo sapiens
cacctgagtcccggaggttgaggctgcagtgagccacgattgtgccactgcgctccagcctgggtg

SEQ ID NO: 6829694 - DNA, 90 bp, Homo sapiens
tatcatattctatattgtctacatttagccacaggtgttaacaaaatgataagcacctggaaagtagacaatctaaaaattgtaatggta

SEQ ID NO: 6829695 - DNA, 77 bp, Homo sapiens
ttaaaatatgctcagcagatctcaggagatctcaggagaagggatcctcagagtatttgttgaagtcaaacttttaa

SEQ ID NO: 6829696 - DNA, 72 bp, Homo sapiens
ccgggtgcagtggttcacgcctgtaatcccagctactcgggaggctgagacaggagaatcacttgaacccgg

SEQ ID NO: 6829697 - DNA, 87 bp, Homo sapiens
tctcatagattgtacctgtacataactacatatcactccccccctttttggcgtatacataggatatgtacgtgcatacatattaga

SEQ ID NO: 6829698 - DNA, 68 bp, Homo sapiens
tgtacatgcataacatgtacatataaatgcatatataaatgagttatgtgtacatgtgtgatagtata

SEQ ID NO: 6829699 - DNA, 67 bp, Homo sapiens
cccttgttttattcaatttccagtagggaagccctgggagggagggaagtttggaagaaagcaaggg

SEQ ID NO: 6829700 - DNA, 81 bp, Homo sapiens
actggctcagctagcagggattgggcactgggataaagcctcccattttctgctttctttgctattcttctctgagttggt

SEQ ID NO: 6829701 - DNA, 98 bp, Homo sapiens
caggttagaaggttaaggatatgaatatttgtggggggccattctgttaactaccttcatgaaattctcgtgtacctcattgtgccatctgtttcctg

SEQ ID NO: 6829702 - DNA, 77 bp, Homo sapiens
gaaacaatcacaatagctgaaagttatggtaggagccatgcctcctgctttgaaaataaacttgtcagctttgcttc

SEQ ID NO: 6829703 - DNA, 115 bp, Homo sapiens
gaataggagtgtttcaaacttgattaatgtgctgagggttgatttatgttttaaaagcctgtgagcaggtcgaaaatgaagagtcaattaaagctaatccggtctcctcctactc

SEQ ID NO: 6829704 - DNA, 80 bp, Homo sapiens
atttgaatgttggattgacttagtaaaagccaatgtgcacaattagagttggcaactctaagcaatatagccttctgagt

SEQ ID NO: 6829705 - DNA, 59 bp, Homo sapiens
gtatttggtcactggagtgtgtggatgagagattatgttgcacttcagtggctaaattc

SEQ ID NO: 6829706 - DNA, 70 bp, Homo sapiens
ggccatgttgtatttagggtacttgtgagacctccaggaggaaatatcaagtgcaccagatatacaggtc

SEQ ID NO: 6829707 - DNA, 73 bp, Homo sapiens
ttttactggaggcagaagatggtatttgataagttattctaatcaacagaattgctgctgccaatgtgtgaga

SEQ ID NO: 6829708 - DNA, 61 bp, Homo sapiens
ggctgtctcatagttagagacacagagacaagtatattctctgtgtcctgaaatgaaggcc

SEQ ID NO: 6829709 - DNA, 70 bp, Homo sapiens
gtgaaataattcagaattgtgggcagtacattatatagtgtactgctgtcatttctgctaattcgtttgc

SEQ ID NO: 6829710 - DNA, 81 bp, Homo sapiens
cctctgggatgtcttgggagggaaggagctgaggaaggagcacagatttctgtccagctgacattcccttccccacagggg

SEQ ID NO: 6829711 - DNA, 78 bp, Homo sapiens
atctaaaacatatactgttggctttggtgatgggagtgattggtagctaaagaggcagtgaaacaatgattagtagat

SEQ ID NO: 6829712 - DNA, 57 bp, Homo sapiens
gggtgggcagggttctggagactggcatcgagccacgctccctgatccctgcttccc

SEQ ID NO: 6829713 - DNA, 59 bp, Homo sapiens
attctaaccaaaactgaatgctagtagcaggaactggtatgaagattgcggtctggaat

SEQ ID NO: 6829714 - DNA, 56 bp, Homo sapiens
gttaaatgcattttccaagcactcacagataggaagtggggctggtggcatttaac

SEQ ID NO: 6829715 - DNA, 56 bp, Homo sapiens
tttttcactgctagctctcttcaactttttgttgagatggttatctaagtgaaaaa

SEQ ID NO: 6829716 - DNA, 58 bp, Homo sapiens
cttgtactaggggcatagtgtcaaccttgagaggaggaaatgaatgtggtagtgcaag

SEQ ID NO: 6829717 - DNA, 68 bp, Homo sapiens
ctgctggcaaataaacagatcttcgggaaactgtacttgtcttccagagaaaaggtttatttcagtag

SEQ ID NO: 6829718 - DNA, 76 bp, Homo sapiens
gaggtgtagcccctgcctttgaacctggagatcctgaccatgatctcctggtgctgctatcaggggtagattcttc

SEQ ID NO: 6829719 - DNA, 130 bp, Homo sapiens
ccctgttttctcattgctgaaaaatggtatgctgccttttgcaaagtctttattttgtatctttatcttaaagtggaagataaagactttgaaaaagacagcatatctttaaagagaatggaaacaaggg

SEQ ID NO: 6829720 - DNA, 55 bp, Homo sapiens
gctcctccagcaaccaaactttatgtcataatacagaagtgtggagttgggaagc

SEQ ID NO: 6829721 - DNA, 80 bp, Homo sapiens
tgattggtaggatggtttgaaaaattgtaggctttggacccgagtctcaaggtaaaatttgtcacattctaattcattca

SEQ ID NO: 6829722 - DNA, 62 bp, Homo sapiens
gagccacagcctgacttaactgtccttttcctctccagagtacagtcagtgctctgtggctc

SEQ ID NO: 6829723 - DNA, 57 bp, Homo sapiens
atgtgacatgggtcatcaaaagtgtctgttcagggacagcagatccaaaagtcacat

SEQ ID NO: 6829724 - DNA, 71 bp, Homo sapiens
gcataaggttatgattcaggatatggattctggagcctgaatccagtctggtatgaatcctagctctaagt

SEQ ID NO: 6829725 - DNA, 107 bp, Homo sapiens
gggtattaagctgagaggctagctttgtgtattaggcttagttttgttgaaaggtaggaccagaccgaactagctaattttagtctgaactattccatttagtgccc

SEQ ID NO: 6829726 - DNA, 105 bp, Homo sapiens
ctctgaacacttaggatgatggtgctggtgggggcaggaaggtagcacagtgctgatggtggccagtctgctcccacaagttcccagtcaccaaggctggcaggg

SEQ ID NO: 6829727 - DNA, 69 bp, Homo sapiens
accctgggcttggtagcagagactccgttgggtagcccttatgaagtctatttacctaagcttcggagt

SEQ ID NO: 6829728 - DNA, 75 bp, Homo sapiens
tatttttgtctgaactgcatttgctccttaaatgaagatcaccctgaaggaggcaactgagatttagaaaaaata

SEQ ID NO: 6829729 - DNA, 77 bp, Homo sapiens
gacaaaagattaaaggggactgagctctggatgcatccacttatgctttgccagacagttcccttccttgttttgtt

SEQ ID NO: 6829730 - DNA, 56 bp, Homo sapiens
aagttctcattgcaggcacaagtacaccgccactttgtgcaaggtaaagagggctt

SEQ ID NO: 6829731 - DNA, 78 bp, Homo sapiens
tggaatacacgtagattgtttaaactggtttaaagccctttcgcatttacactgcttgaacaatctctctgtgtttca

SEQ ID NO: 6829732 - DNA, 94 bp, Homo sapiens
tggccagttcgtttcttaaacatctattttaaaaggactgggtgttgatacagtttttccagggttagatgtttatgactttatggatttgtcg

SEQ ID NO: 6829733 - DNA, 78 bp, Homo sapiens
atggccagcctggtacttggcactcaggagatactcactaaatttaaatgtaaactccataagtaaccagatggttat

SEQ ID NO: 6829734 - DNA, 67 bp, Homo sapiens
aatagaagaagtagatagtgctacggagttttaagggaggtccagggcttatctgctatatctcatt

SEQ ID NO: 6829735 - DNA, 78 bp, Homo sapiens
ccagcagcctctgctcccagccagctgtggtgtgagtatcaacccctggctgccctgggaggcaagggtgagggctgg

SEQ ID NO: 6829736 - DNA, 93 bp, Homo sapiens
aatttgaaatattaactgggcatggtggtacacatctgtagtctcagctactcaggaggctgagatgtgaagatcacatgaacccagcagatt

SEQ ID NO: 6829737 - DNA, 63 bp, Homo sapiens
gtgcaaatactgtactgaacactgtatgcacatgctgttcaaaagccacagttacttttgcac

SEQ ID NO: 6829738 - DNA, 82 bp, Homo sapiens
aagacgcatgtaaggatgaaatgaggtgatgcccgctcagcacatgtgaaatctctttctcattcataccctacatgctctt

SEQ ID NO: 6829739 - DNA, 104 bp, Homo sapiens
tgagcatggtggtgcttgcctgtagttccaggtactcagggggctgaggcagtaagaacacttgagcccaggaggcctgggtgacagagtaagaccctgtctca

SEQ ID NO: 6829740 - DNA, 76 bp, Homo sapiens
aaagcaaggggtttagacaagatgacagaggtctttccagctctgacattctatttcatcatgtctagtgtgcttt

SEQ ID NO: 6829741 - DNA, 111 bp, Homo sapiens
gtggtgccacacacgtgttatagccccatcggcaggaagagtcttttgcttggcatctgggctgaggatgccttcattgcatggcctgtgacatctcttatatggcaccat

SEQ ID NO: 6829742 - DNA, 65 bp, Homo sapiens
aatttctcccacagactgtaaatgttaacactttaatagatgatttacagctgtgtgagcaagtt

SEQ ID NO: 6829743 - DNA, 57 bp, Homo sapiens
cattaggcagatggtgaacctgagagacatgctcagttgttagtattttgccttatg

SEQ ID NO: 6829744 - DNA, 61 bp, Homo sapiens
gccagtgtgcaagaaaacagaaaatagcataaatcacaatccgtacaacttgcatattggc

SEQ ID NO: 6829745 - DNA, 72 bp, Homo sapiens
gatattgggtaaaggattaatcaggtttacttccactttaatgaaagtggctgaatatattttactaatgtc

SEQ ID NO: 6829746 - DNA, 59 bp, Homo sapiens
ttagtctccagctggacaatagtccctaggtggatacctaggccccaggtggacactag

SEQ ID NO: 6829747 - DNA, 79 bp, Homo sapiens
gggggtcacgtgcaggatttatagcccagcttttctaaaggtaggcactgtataaatctagcaagtaaatattacctcc

SEQ ID NO: 6829748 - DNA, 62 bp, Homo sapiens
gacatcatgtagagataaaaaggagttaagactatttaactcaactatctctgggtaatgtt

SEQ ID NO: 6829749 - DNA, 56 bp, Homo sapiens
gctccagaaatgccgtgatcctaggaaatcatccagggccacccaagcatctgggc

SEQ ID NO: 6829750 - DNA, 67 bp, Homo sapiens
gtgtgttcaacaatcccctctcccagatgtgctgctctgtgcagccagctgctcgggggaaacagac

SEQ ID NO: 6829751 - DNA, 75 bp, Homo sapiens
ttgttttgttttgagatggagtcttgctctgtcgcccaggctggagtgcagtggcgccatctcagctcacagcaa

SEQ ID NO: 6829752 - DNA, 67 bp, Homo sapiens
gtatgaagttggactgtataaatttggcctacaaaaaacggcaattttgtatggttgaacttgatac

SEQ ID NO: 6829753 - DNA, 62 bp, Homo sapiens
cctgactaatgagcccaggtgactcatacacccggggcctggatgagtctgactgggtcagg

SEQ ID NO: 6829754 - DNA, 76 bp, Homo sapiens
tcccagactatggagcctgggtccttccctgggaacacatggttccagaggtgaacacccaggcaagagaggggga

SEQ ID NO: 6829755 - DNA, 64 bp, Homo sapiens
tgaagagagagggggaagggagggaactgtgatcacatccattctttttacctctcagaggtca

SEQ ID NO: 6829756 - DNA, 109 bp, Homo sapiens
ggaggcggctgccgtctggctccgctgggcccccggacaggcattcatccgatatctggatctcccagacgggtggtctgcgaggcctgagtgccaaatggtcccctcc

SEQ ID NO: 6829757 - DNA, 85 bp, Homo sapiens
gtttactcaccagatgatacatagttgtgtgtgcatgttgtgtgtagacatgtgttcatgtatgtatacatatgtgttagtaaat

SEQ ID NO: 6829758 - DNA, 62 bp, Homo sapiens
aagtgactcgttgctgacacatggcatttcttgagcagccattaattagcaaaatagcactt

SEQ ID NO: 6829759 - DNA, 88 bp, Homo sapiens
gtgtagcagaagtacacaaaaagctagaatagaagcctctgttatgtgtttctaactctgttatgtgtttctaacttactgcttatat

SEQ ID NO: 6829760 - DNA, 69 bp, Homo sapiens
gtggactcctgaccttgtgacccacccaccttggcctcccaaagtgctgggattacaagtgtgagccac

SEQ ID NO: 6829761 - DNA, 128 bp, Homo sapiens
tctagttgttcaaagcagcagaaaactttaaattttccttaattttgaaagtgtgattaatggaatattgttacaatgccattgatttatatactttgaggatagttaacttctttatgtttattaga

SEQ ID NO: 6829762 - DNA, 61 bp, Homo sapiens
agctttgctctgtgaataaaagaggttgttcctcatgctgctttattcacagagaagagtt

SEQ ID NO: 6829763 - DNA, 62 bp, Homo sapiens
ggctttatgcagggcatcctgaaaagaagcacttatttcagacactgatcttgcatctcgcc

SEQ ID NO: 6829764 - DNA, 55 bp, Homo sapiens
aggagcgtctgtctgtgtctctgggtcctgccctgggcatgtgaggggcctgcct

SEQ ID NO: 6829765 - DNA, 72 bp, Homo sapiens
ctcttgagcccaggaagtggaggctgcagtgagctgtcactgcaccactgcattccagcctgggtgacagag

SEQ ID NO: 6829766 - DNA, 63 bp, Homo sapiens
tagtctctctggacttgagtatcagccatgttcttatgttgatgccaagctcctgggtgatta

SEQ ID NO: 6829767 - DNA, 55 bp, Homo sapiens
ggggttcctcgaaggacctgaggccaggctggggccaggaaccaaagaggactcc

SEQ ID NO: 6829768 - DNA, 64 bp, Homo sapiens
ttttctgaaagtgacataccttacatatgtttgttgaggttgcaagcataggatgtccagaaaa

SEQ ID NO: 6829769 - DNA, 86 bp, Homo sapiens
ggcctaaagtattagattaactttaatgtctacaagatcacccctgtctgggacacacaagttatctaatgaattaataataggcc

SEQ ID NO: 6829770 - DNA, 101 bp, Homo sapiens
ggaactggtattcaacatccatgtgttttcctgtccacaataaattgtaataattgtgcctgaaaagagagaatatattggcaattttgatttcatgtttc

SEQ ID NO: 6829771 - DNA, 62 bp, Homo sapiens
gcatgttgactgggctggctctgctccacgactcactctgggccagtccacctgagacatgt

SEQ ID NO: 6829772 - DNA, 59 bp, Homo sapiens
aggaggtactggctggtgcattgtaggatattttgcagcattcttggccactactcact

SEQ ID NO: 6829773 - DNA, 57 bp, Homo sapiens
tggaagaggccacgaaggatcctctactggggcttcagagggagagtggcccttcca

SEQ ID NO: 6829774 - DNA, 65 bp, Homo sapiens
ggggaagctgggaactagcgggggaaagtggtctcctgccactctgccccgagttctgggaaccc

SEQ ID NO: 6829775 - DNA, 58 bp, Homo sapiens
ggacgccagatagctctcaagggaaccacccagatggcttcccttcctgtcgggctcc

SEQ ID NO: 6829776 - DNA, 66 bp, Homo sapiens
tcagaagttgagatattcagggacaggcaatcttgccttaggaccaagaatgtctcctacttctga

SEQ ID NO: 6829777 - DNA, 60 bp, Homo sapiens
ggcgggctcctcagcgcaagagtgggagagttctccacccctgggtgcagggagcgagcc

SEQ ID NO: 6829778 - DNA, 95 bp, Homo sapiens
tgtaaagatagctactgtgttaagaaattaatcaaggctgcaagacagtgatgattcaactttcataacaaaaggtaaagctgaatatctttcca

SEQ ID NO: 6829779 - DNA, 59 bp, Homo sapiens
gtgattcacatctcagatgggcaaaaagaaagctgtctgcatctgagtgtcgaatacac

SEQ ID NO: 6829780 - DNA, 82 bp, Homo sapiens
tttctatacctgagaatttcccagaggccatgaggagctaatcctcccaaggcttttgggaattttcaaccctgtgtggaaa

SEQ ID NO: 6829781 - DNA, 88 bp, Homo sapiens
ggagaatcgcttgaacccggaaggtggaggttgcagtgagctgagatcacgccactgcactccagcctgggtgacagagcaagactcc

SEQ ID NO: 6829782 - DNA, 62 bp, Homo sapiens
cagcaacccgggggacctttcttctccttgttggccttgaccccaagtgttcccgggtgctg

SEQ ID NO: 6829783 - DNA, 67 bp, Homo sapiens
ccccctctactactgcaggagcttcttgtttgccaggacagggctatattcctcagagctgaggagg

SEQ ID NO: 6829784 - DNA, 57 bp, Homo sapiens
gtgtgttccatggggacaacagtcttctttactggtctgtctccagtggtggcacac

SEQ ID NO: 6829785 - DNA, 61 bp, Homo sapiens
cattccctagaactgttcctgacacatagtaaatgcttagtcaacatgttctgggtgaatg

SEQ ID NO: 6829786 - DNA, 90 bp, Homo sapiens
gtaaagaatgctgggttccatgtagccaagagtactttggggactctgcagcgtgaattcatattcttctcctcctcctctccctcctgc

SEQ ID NO: 6829787 - DNA, 68 bp, Homo sapiens
ctgtaatcccagctacctgggagactgaggcatgaaaatctcttgaacccgggagctggaggttgcag

SEQ ID NO: 6829788 - DNA, 61 bp, Homo sapiens
gcccagtgccactgtagccgctggggcaactagagctgtcctggggctctggcatctgggt

SEQ ID NO: 6829789 - DNA, 97 bp, Homo sapiens
gaggaaaatgaagaaatggtgaagaagaagaagatgatgttgaataagttggttctagcacagtttcttttccttgtctataaagcatttaaccctc

SEQ ID NO: 6829790 - DNA, 82 bp, Homo sapiens
ctccacttttgatatgtttctcttggacctgacatagcaagagagagttccaggttcagcaggaggcatcccaagggtgtgg

SEQ ID NO: 6829791 - DNA, 125 bp, Homo sapiens
tgacacatctctgaggttagggcttcctggctgttgtgttcaagagggtataaattatcagtgacactagtgacactttgttgaagaatatgttaggggattctgtgctgatagagaagagtgca

SEQ ID NO: 6829792 - DNA, 71 bp, Homo sapiens
gcttagtggggaattaaaaatatatgtaggttagcaatttaacatacatatgagttcgttctatgctaagt

SEQ ID NO: 6829793 - DNA, 66 bp, Homo sapiens
gtcgtatgcaaatgaaatgtttgaggacactgtaatatgcttactcactcatttccagcatctgat

SEQ ID NO: 6829794 - DNA, 86 bp, Homo sapiens
gggagagaagccgagctgggagagaagcgaagctgggcagcccaagggtctgagtccttgcttctattccctgctacttcttttcc

SEQ ID NO: 6829795 - DNA, 74 bp, Homo sapiens
ggcttctgcctctctaacccatgcccaagccacctcctgacccctggctgcaaaagatgggaggggcagaagcc

SEQ ID NO: 6829796 - DNA, 70 bp, Homo sapiens
tcttttatacaatccagtctctcccagatccctgacctgaggcatcgaggagagttggtttgtttttaga

SEQ ID NO: 6829797 - DNA, 59 bp, Homo sapiens
tataccaaaaccaagccattatcttcaatctgaggagaagggaactgagtttttgtgtg

SEQ ID NO: 6829798 - DNA, 89 bp, Homo sapiens
ttgaggacttctcagcttgcctgtttcctagggctgtctagtaaatcctgaagcctttgccagtagccaggaagctgagatcacctcgg

SEQ ID NO: 6829799 - DNA, 102 bp, Homo sapiens
ggcgttggtgggcgctgtgggtcccgatgctgcgctggtggatgtcaacgtatacctgatcattgccatctgcgcggtgtccagccttttggtgctcacgct

SEQ ID NO: 6829800 - DNA, 67 bp, Homo sapiens
ccagaaagagccaaggctgagagctatttctccccagaaatgtgattccacagtcttggtttcctgg

SEQ ID NO: 6829801 - DNA, 63 bp, Homo sapiens
tcttggctactttcctgtctgctaattcatttcaactctagcacttttgggtagtggccagga

SEQ ID NO: 6829802 - DNA, 73 bp, Homo sapiens
acatgttctcaagagctgggtggcaagctagccaagaggtgaggttcagccagtcagctttcaggaggagtgt

SEQ ID NO: 6829803 - DNA, 83 bp, Homo sapiens
gaaatgtcagtagatttcaggagacaaaatggaaaggagccattgctccaccaccttttcctggaagtcttactctatatttt

SEQ ID NO: 6829804 - DNA, 82 bp, Homo sapiens
gaagctcttggcatgtgagtaatgttcataagtagtagccactattgctatgagcattgttcttgtcctgaccttgagcttc

SEQ ID NO: 6829805 - DNA, 64 bp, Homo sapiens
cctgctctccggcttccgtggcctgccctgtaagtgaggcaggaaaatcgagtctggaggcagg

SEQ ID NO: 6829806 - DNA, 79 bp, Homo sapiens
aggggtcagaaggttccacaagatagaactttctattttaagtgactgttatttgggatcttttttaaaaaatgccctt

SEQ ID NO: 6829807 - DNA, 89 bp, Homo sapiens
cctggggcggcgttccaggggcgggagtcggctgtgtgggctgcgcgtccgggcgggggctctcgtcacctgggaagtcctggctcagg

SEQ ID NO: 6829808 - DNA, 63 bp, Homo sapiens
tccttagcagctctgattctgggcccaatttgtagatttggggggtttctgagcagctaatga

SEQ ID NO: 6829809 - DNA, 57 bp, Homo sapiens
gctgccctcccagggcaagcttgctgcttcccaggaggtatgtcccccgagtgcagc

SEQ ID NO: 6829810 - DNA, 77 bp, Homo sapiens
ctcatttgtgcccttattagatgtcatcaagagtcttgtgtgcctcctgctgccacatttaaagaggggagagagag

SEQ ID NO: 6829811 - DNA, 57 bp, Homo sapiens
ggtcacgtgaccgcacctgcctcgctccctcgggaggtttggtcccgtcacgtgact

SEQ ID NO: 6829812 - DNA, 130 bp, Homo sapiens
gcagacaatattaaagcagtatccattttcagagcctttgattagcacatgaggaaacaagggtatatgggaagctatgtaatttgcctcatgttggtttgttggtctgaagagtacaactttgatatgc

SEQ ID NO: 6829813 - DNA, 59 bp, Homo sapiens
ttttttgttagatacacgaaaaaacttccagaacatctgggagaatatttaatggaaaa

SEQ ID NO: 6829814 - DNA, 74 bp, Homo sapiens
gtctttgtctttgtgttgttggtgtatttgcctcttttcctgtgccagatacaaagctactcgagggcagggat

SEQ ID NO: 6829815 - DNA, 67 bp, Homo sapiens
tggggatgccatctctgcaatgcctgggaggtttccttttatgcacacttagacatggctgggccta

SEQ ID NO: 6829816 - DNA, 94 bp, Homo sapiens
tggcattattttcttatttgaaaagaaggttacgttaatgaaatgttagttgattgttacattgttttcagataacatgacttttgtaatgtta

SEQ ID NO: 6829817 - DNA, 61 bp, Homo sapiens
gggctcactgccatgctcgccatctgcggctccttcttggcctgagtgtggcactgggccc

SEQ ID NO: 6829818 - DNA, 69 bp, Homo sapiens
gccatggtgccttatacataattagtgcttatacttactaagcattaattatgcaaaaggccccatggc

SEQ ID NO: 6829819 - DNA, 57 bp, Homo sapiens
ttattttggtggcagcattttctagttttcctgccagaatgtctgccttcacaatga

SEQ ID NO: 6829820 - DNA, 55 bp, Homo sapiens
tccactgttcagtgtagttgaacaagcacttgagcaattactatgaaccagttga

SEQ ID NO: 6829821 - DNA, 63 bp, Homo sapiens
tgagatttgggaggggccagggactgaatgatatggtttgtctgtgtctccacccaaatctca

SEQ ID NO: 6829822 - DNA, 76 bp, Homo sapiens
tcttggtcttccttgagtcatggattggcaagaaaacattcattcttaataaaggctcagggaaccagatccagga

SEQ ID NO: 6829823 - DNA, 93 bp, Homo sapiens
tctggacccatggactgccttccaaccccagactccacacaacccacaacccttgagtgggagtagaagcgggtgagggccctggggtccagg

SEQ ID NO: 6829824 - DNA, 124 bp, Homo sapiens
ctggatcattctctctttttgaccagcctgactatggctgcaggtgtttttcttcctcccctgtatatgataatctcacctgggcagtcatggatgggtacattcaatttgggtagaaatccag

SEQ ID NO: 6829825 - DNA, 122 bp, Homo sapiens
ccgggcgtggtgtcagacgcctgtaatcccagctactcaggaggctgaggcaggagaattgcttgaacctgggaggcggaggttgcagtgagctgagatcacaccactgcactccagcctgg

SEQ ID NO: 6829826 - DNA, 65 bp, Homo sapiens
tctttattcaggctctctttggctagatttctgagtgtctgctacatatctgcctgtagtgcaga

SEQ ID NO: 6829827 - DNA, 62 bp, Homo sapiens
gatgcttccctgctctgcacacctcagtaaccaaggctgtgactacgcagggaagattcatc

SEQ ID NO: 6829828 - DNA, 72 bp, Homo sapiens
gagttgggggttgagcattttattttcctagagactccttggtttctagacaaatgtgttcattccctactt

SEQ ID NO: 6829829 - DNA, 57 bp, Homo sapiens
tgaaggaggaatgtggcctccagcttgtcatagattggtggaactgcatctccttta

SEQ ID NO: 6829830 - DNA, 57 bp, Homo sapiens
acatttacttggattttctgatgttggtcccaactaagccgtaagataagtaaatgt

SEQ ID NO: 6829831 - DNA, 119 bp, Homo sapiens
gggctttgaagagaaactaagagttttccagagggacaagagcttatttgaggaaagagggggaagtttttcccaattgagaggttctgtgtcatcttccaacttctctgcctagaccc

SEQ ID NO: 6829832 - DNA, 67 bp, Homo sapiens
ggtaaagcatctcacctgcccccacgttagcaactgttgccagggaagtagttgtgagagcacagcc

SEQ ID NO: 6829833 - DNA, 65 bp, Homo sapiens
gaatgataccgccaatattaccatattacttatggtgatatgcatggcagtataatcatacattc

SEQ ID NO: 6829834 - DNA, 89 bp, Homo sapiens
gaggatctagcaaagaccaaagctagttgaatgtttgaaaatatgtttaggaaacaactgatttggaaagtttgttatcaagggacctc

SEQ ID NO: 6829835 - DNA, 55 bp, Homo sapiens
gctccggctccggctcaggtgcgggccgccggccgggaggagctggtgccggagc

SEQ ID NO: 6829836 - DNA, 76 bp, Homo sapiens
ctgagggaggacctgaacttggatgtggcctggcttgggcccggaggccagcatgcagttctaaggctctgctcag

SEQ ID NO: 6829837 - DNA, 97 bp, Homo sapiens
ttttttgaaacaggacagggtacaaataaatagaaaaacacagctctaaaaggttagatgttttgatatttgctgaaccttgtgctgatgtaagaaa

SEQ ID NO: 6829838 - DNA, 57 bp, Homo sapiens
ctgcacccaggcctggtcccaggttgcctagcaaccgggggctgctctgggatgcag

SEQ ID NO: 6829839 - DNA, 59 bp, Homo sapiens
aggctaggccttgagcttaaaactcttcaccaactgtttataccctccatacctggcct

SEQ ID NO: 6829840 - DNA, 66 bp, Homo sapiens
aagagaaaggaagggaggagtttattgtttttcaatgaattatgagcaaccccttccattctgctt

SEQ ID NO: 6829841 - DNA, 58 bp, Homo sapiens
ccttagtgtgaggggataccccaggccttaactggtctctgaaatcccccaactgagg

SEQ ID NO: 6829842 - DNA, 127 bp, Homo sapiens
gatgcaggcacagtattggctacagagacatagcaggtggtaatcagtagttgttcaggcatcaagggacagacatttattgaacacctagcaagagtcttacctgttgaactgactgcccctgatc

SEQ ID NO: 6829843 - DNA, 77 bp, Homo sapiens
ctgccaggtccagtatggctaaagtcattttatcctttgttagggagccacaggactctggaccatatatttggcag

SEQ ID NO: 6829844 - DNA, 76 bp, Homo sapiens
gcttctgacactggatttctagaaatgtgtgtgctttaaattcatatttaaatttgtttagttgtcgcccagaagc

SEQ ID NO: 6829845 - DNA, 118 bp, Homo sapiens
tccacaccggcactccagagtgttggcacatctccagcaatggggagctctttccacctggagcggcccctgcccttggaggacagtgccaactcttgtaaacttccccctttgtgga

SEQ ID NO: 6829846 - DNA, 76 bp, Homo sapiens
gagccacaggtgggctctgggaaataggagtagcttggttctgtcatttacctttccctgagccacaggtgggctc

SEQ ID NO: 6829847 - DNA, 62 bp, Homo sapiens
ggcacttatttagaaggtcctcaggaaatggtattattattccaaggtctttctagattgcc

SEQ ID NO: 6829848 - DNA, 76 bp, Homo sapiens
taagtgtattgatggctttttggcagagctttattattgtgaatctctcacttgaaaagcgtatttccgacatttg

SEQ ID NO: 6829849 - DNA, 58 bp, Homo sapiens
ttcacaggttgaagcctaatcctacaatgtaactgtatttggaaacagggcctgtgag

SEQ ID NO: 6829850 - DNA, 56 bp, Homo sapiens
gggaatgtgtctgatggaaagaatattcttttgttcaaatccatcagcaaattcct

SEQ ID NO: 6829851 - DNA, 60 bp, Homo sapiens
gtgcttctgccaactaattaacacctcctttgcaagctgtaaattggacggcagatgcgc

SEQ ID NO: 6829852 - DNA, 68 bp, Homo sapiens
tgcaggctggggtagccccacttggagacactccactcctctcaaagtccgcataaacccagccagta

SEQ ID NO: 6829853 - DNA, 77 bp, Homo sapiens
tgccctagcatgagtaactatccactgggtaggttcactgtgaatcacgtggtttgagagtacgcgtgctttgggca

SEQ ID NO: 6829854 - DNA, 73 bp, Homo sapiens
ggtcacatagctggtgagcaaaggagaaggatgcctactgggaatctggcttcgcagctcccagccataaacc

SEQ ID NO: 6829855 - DNA, 79 bp, Homo sapiens
agtccccacagagccgtctgcaaagcatgagaactggagcattcatttacttagcatgcagtgttctgcccagggttct

SEQ ID NO: 6829856 - DNA, 74 bp, Homo sapiens
gtcagggccgctgggttcgatgagtggagtgtgggcgccacctcctggctgctcatggaaccacagggctggac

SEQ ID NO: 6829857 - DNA, 78 bp, Homo sapiens
agttgtgaatatattattcagcttttcactcatggtttataaatatgttgaatatgcatttgggtaatgtatataact

SEQ ID NO: 6829858 - DNA, 58 bp, Homo sapiens
ctgggctccacaaattacgtagctgggcctgctcagcagctctggttcctgggcccag

SEQ ID NO: 6829859 - DNA, 88 bp, Homo sapiens
ggagaatcgcttgaacccaggaggcagaagttgcagtgagttgagatagcactactgcactccatcctgggcaacaaagtgagacttc

SEQ ID NO: 6829860 - DNA, 68 bp, Homo sapiens
tgcacagatacagaagacccctccgtcatgcagcatctgccatgagcatcggcctcctgtgctgtgca

SEQ ID NO: 6829861 - DNA, 78 bp, Homo sapiens
ctgtcgttcgccgtcagtcattatgggagttaatcctgtgctaggaaatgagacggatgactctacaggtgaattcag

SEQ ID NO: 6829862 - DNA, 55 bp, Homo sapiens
gggtaatgttgctcttcttatttgactataaactcagtgaatagagacattgccc

SEQ ID NO: 6829863 - DNA, 68 bp, Homo sapiens
gggcaccagctccagcatcaccggcagcagacactcccaggcctgccatggtccaggacctggtgtcc

SEQ ID NO: 6829864 - DNA, 61 bp, Homo sapiens
agttcctagaataaatcagttgctgcagttaaatgttttagttctgagcatctaggcagct

SEQ ID NO: 6829865 - DNA, 57 bp, Homo sapiens
gacatgtagagttccaggccctgcaccccagacctgctggctaagaatctgcatttt

SEQ ID NO: 6829866 - DNA, 73 bp, Homo sapiens
caggcctcactgcagccccaggaagtaggggcgggttggggcccattttccagagggtgctcagggcggcctg

SEQ ID NO: 6829867 - DNA, 64 bp, Homo sapiens
ttatatctaagtgtatgtaagagggtgaagggaagtgggtgcatctttttacaagtaggtgtga

SEQ ID NO: 6829868 - DNA, 57 bp, Homo sapiens
gcatcttcacacaaagccagtggcatttattgagcacctgctatgtatgaggattgc

SEQ ID NO: 6829869 - DNA, 86 bp, Homo sapiens
tggttagagaaaagcagggatcaggaatcctattagcagatgagggctttcacggatcttggttccctttcacctctatttctcca

SEQ ID NO: 6829870 - DNA, 55 bp, Homo sapiens
gtgtggaaagagtggcctctcaatcgatggttctgaggctattgaatttccatat

SEQ ID NO: 6829871 - DNA, 74 bp, Homo sapiens
ggacaaacaaagggatggagcccagctgttctccagcctccctgaggacaaagggttcctcctgtgaactgtcc

SEQ ID NO: 6829872 - DNA, 89 bp, Homo sapiens
ggcctgggttcagcagttcaaccccgtcagagctttgtctatctttcatgcattctgcctcagggttgcaatatggttgccccagtgcc

SEQ ID NO: 6829873 - DNA, 82 bp, Homo sapiens
gactgatggcagcagggcttgattatgttactttctaatacttcctgaaatgcatggtatttttcctgtttgcccattggtt

SEQ ID NO: 6829874 - DNA, 67 bp, Homo sapiens
tcttaagggcaaatggatccatgttttggttcacaccattatgtccagagaacatttgctttatgga

SEQ ID NO: 6829875 - DNA, 56 bp, Homo sapiens
ggtcgcctccctgagtcacccaagcactggcctgagtgctgcacagtggggtgacc

SEQ ID NO: 6829876 - DNA, 77 bp, Homo sapiens
ggctagggcatgcctgcttactccaggtgctgtgaggctccaggaccttcttgagtgagcaggaacagcttgtagtc

SEQ ID NO: 6829877 - DNA, 72 bp, Homo sapiens
gcctgtgctgctgtcacggtgctaaggggcctggcaagcacggggtctttcttgctggacggaggcacaggt

SEQ ID NO: 6829878 - DNA, 64 bp, Homo sapiens
tattcctgcattggtcaacccatccacttatactgaatccggatggtctcctagttcaggaatg

SEQ ID NO: 6829879 - DNA, 68 bp, Homo sapiens
agccctttcttcttctggactggaacagagggcaccccctgcattgctgtacaggtgaggagggggct

SEQ ID NO: 6829880 - DNA, 82 bp, Homo sapiens
gtgaaagggcattgagctgtagtgctttgggattagatagatttgctcttcaatccagtttctgtcagctactctctgttac

SEQ ID NO: 6829881 - DNA, 88 bp, Homo sapiens
ctcctgaggaatgttccacagtgctcaaacacaagtgcaggacactactctcttaatgccactgtagagtatggacaagcttgaggag

SEQ ID NO: 6829882 - DNA, 117 bp, Homo sapiens
gagcatttaagcaaatgaacgacacagggacagctttgggcaatgctatgagtgggtctccagcacccctttctcttcattagtgttctcaagctgatctctggttgcttagagctc

SEQ ID NO: 6829883 - DNA, 64 bp, Homo sapiens
ctggctcatctctgcatcctctatggtgtgcctggcacactggagggtccagggatgtttctag

SEQ ID NO: 6829884 - DNA, 61 bp, Homo sapiens
ggaaagtcagaggaggctaagggaagctggctgagattcactttgaattccttgattttcc

SEQ ID NO: 6829885 - DNA, 61 bp, Homo sapiens
cttttgttggaagctgaagtgcggcagctcaccttgggagcattacagcagttcaacttgg

SEQ ID NO: 6829886 - DNA, 70 bp, Homo sapiens
caacgcactgtgctgacttccttgtgaaacgggttgtttctgagtgtgcagggaagtggcgggaggcttg

SEQ ID NO: 6829887 - DNA, 87 bp, Homo sapiens
tcacagcacctcatctctttctcagatggtggagaagcaaacggttcctggcgtctcgctgtggacagggagaatgaggtgctctga

SEQ ID NO: 6829888 - DNA, 75 bp, Homo sapiens
cagatgtcctatttccatactgtataaaaggtagccattgtctactgagcactgcagatgtggctagtataactg

SEQ ID NO: 6829889 - DNA, 94 bp, Homo sapiens
ccctggacccttattttcttgagtgatgtttaagactacgctgaccagtcttaaagcatggtgtagttaattctttaagaacaaggaaccaggg

SEQ ID NO: 6829890 - DNA, 74 bp, Homo sapiens
gatgggtaagggtgtttggttagggtgacaataatcctgatttctaaaccctacatcagaacatttaccctatc

SEQ ID NO: 6829891 - DNA, 84 bp, Homo sapiens
gtcttcccaggaggctctgagtctggtgtctgctgttgaagacattggcagatcccttggggcccagagcactcctgggcctgc

SEQ ID NO: 6829892 - DNA, 72 bp, Homo sapiens
ccttctttcacccagttaaatcctctctgggcttagaaaggctcaggaacccccgctgggtgaaactccagg

SEQ ID NO: 6829893 - DNA, 69 bp, Homo sapiens
ttgaagtgtcaaattaaataatctgggcctcaagagaagactactctgattaggagtttgagactttga

SEQ ID NO: 6829894 - DNA, 55 bp, Homo sapiens
ggctgtctgtggtggagcgttgtgcaccctcaggatgataccatcactggcagtc

SEQ ID NO: 6829895 - DNA, 61 bp, Homo sapiens
gcagtgttcttgttgcttttatggagaagaagatttttggaagtaatattgggattactgc

SEQ ID NO: 6829896 - DNA, 56 bp, Homo sapiens
cggtcgtctggtcttctgctggcatctccacaaacatgcccaggggcccgatgctg

SEQ ID NO: 6829897 - DNA, 99 bp, Homo sapiens
cagtgaagtaacttaaattgtgtgtgtgtgtgcatgattctagggccatacctaatttatgtcttaagtatgctaattctaaagttatattttcaactg

SEQ ID NO: 6829898 - DNA, 68 bp, Homo sapiens
ggctctggggcagatggaacagagcacactgagaggatgagcctggattgtatttgtttccccaggcc

SEQ ID NO: 6829899 - DNA, 114 bp, Homo sapiens
gaaacattttcacattctcttgctcattcagatgatagtttcaaaggaactattgcaaaaatagtttaggaaacaattaccttaattaggcactggagttaactagtatgtttc

SEQ ID NO: 6829900 - DNA, 58 bp, Homo sapiens
gttgtttgctcactccctttgtttaactagatagcttaaaaggaggcaggtgaacagc

SEQ ID NO: 6829901 - DNA, 68 bp, Homo sapiens
ttggccaacaaaaacagctgcttcagtacttgaacccatggttttggctccgtagctcttttagtcaa

SEQ ID NO: 6829902 - DNA, 100 bp, Homo sapiens
gacggtaaagctggatcactaagcatgagccagtgcaacacagtgcaagcctctagtttgactgttaagacttggctctgccgtggcctagctgttcatc

SEQ ID NO: 6829903 - DNA, 56 bp, Homo sapiens
gatatattaacacccacttgcctcatgtaattgtgaggattaaatgttagtgtgtt

SEQ ID NO: 6829904 - DNA, 71 bp, Homo sapiens
ggatgcaggcacagctaagactggccataacctatggagagtcctggccaatcagctgtgacctgctgtcc

SEQ ID NO: 6829905 - DNA, 74 bp, Homo sapiens
tcatctttatgattcacctctatgattaggaacaagttccaatcagcagttggaattagataaattagagatga

SEQ ID NO: 6829906 - DNA, 89 bp, Homo sapiens
cacctctgctgccaagagctggagaggcagtctatcattcaagaagaatgactctatgcttccttattagccctaggctggcagaggtg

SEQ ID NO: 6829907 - DNA, 62 bp, Homo sapiens
gagaccagcttcttgaaatagcttgaacaacctctcagctctcaggtacaaagctgtgtctc

SEQ ID NO: 6829908 - DNA, 60 bp, Homo sapiens
ttgaatgattaaagtcatctgatgaaaggtgactgaagtgtgatgtatttaattatttaa

SEQ ID NO: 6829909 - DNA, 76 bp, Homo sapiens
atctctttctcttggcagctgcctgaacagcagtttgtggaaaggactgctgtcagttggcaggatgagggtgggt

SEQ ID NO: 6829910 - DNA, 76 bp, Homo sapiens
ggagctgggtttccagcaggcaggagaggaggtaagcgctctccgcagtgtcctgctgtgtttggaaaccccatcc

SEQ ID NO: 6829911 - DNA, 67 bp, Homo sapiens
ctgtgggtgttatgactgcagacagaaacaaaagaagtattttgtaattggtcatagcttttcacag

SEQ ID NO: 6829912 - DNA, 59 bp, Homo sapiens
cccatttccctgggggcaggaggatcacttgcggtgctctaagaactctaggaattggg

SEQ ID NO: 6829913 - DNA, 87 bp, Homo sapiens
tttgggaacaggtatttgcattatttaatgagactctaacagctatggccagagttggaagggatagtcttagtttttgtttccaaa

SEQ ID NO: 6829914 - DNA, 67 bp, Homo sapiens
gtttatgttagataatatttcccagaggtaacactgctgggtagaagtattagtctaacctttagac

SEQ ID NO: 6829915 - DNA, 61 bp, Homo sapiens
cctgaggcatgggaagttgggtgtcttctcaaaggtcgttcactttgctccctgcttctgg

SEQ ID NO: 6829916 - DNA, 65 bp, Homo sapiens
attgaactctgcaggagctgcctttgtttctctgccttaacatgtatttgttcctgcagattagt

SEQ ID NO: 6829917 - DNA, 130 bp, Homo sapiens
atggagcgatcgcttctccactagtccgcaaatgggggccaccgttagagccaggtgcgaggaacagcgagtttattgcaggttccaaccgggaacctggcacccacggctggttgggaagggacgccct

SEQ ID NO: 6829918 - DNA, 105 bp, Homo sapiens
gaacatcaggaagtaatgtttgactacatgaccttaaggttacttcttctgcacttgcaggggtctgagcttgttagggcagtggtcgcagatctgactttgttc

SEQ ID NO: 6829919 - DNA, 71 bp, Homo sapiens
tagaagagacatagcctgtggttatgtaaaattattcaacctatattgaactatagactgagtttgttcta

SEQ ID NO: 6829920 - DNA, 93 bp, Homo sapiens
ccgtaaccatagtatgtcatccctacccaatgttttaattgccactgtttgtctggctgcagaacaatgaggtatggatggatctaggactgg

SEQ ID NO: 6829921 - DNA, 102 bp, Homo sapiens
ttttttgttgatttttctggattgtgtgtattatctaatttgttctactgaattctgaaccctctttaaatgatgcatatcatttagaaggacaatggaaga

SEQ ID NO: 6829922 - DNA, 66 bp, Homo sapiens
acagtccataaggttgaaaactgtacacttttgtgagttacacaagttctttaacctatgacctgt

SEQ ID NO: 6829923 - DNA, 57 bp, Homo sapiens
aggtactgtgagttagcctgttgggaataccctttaggccataggacacacggttct

SEQ ID NO: 6829924 - DNA, 77 bp, Homo sapiens
gtgaatcttctcctgcagtttcattgactcacttctgagagttcctttacaagttttcatgaaattgaggaggacac

SEQ ID NO: 6829925 - DNA, 90 bp, Homo sapiens
ccagcaggatgtctgcaagtggttgaagaaacattgtccgaatcagtatcagatctacagtgagtcattcaaacagcatgacataactgg

SEQ ID NO: 6829926 - DNA, 86 bp, Homo sapiens
gctcaaacctgctgagacttccaagggagcctgggactctgctctcctactcctttcctcccttgtgtttgggcactcggctgagc

SEQ ID NO: 6829927 - DNA, 101 bp, Homo sapiens
tgaggcaggagaatcacttgaacccgggaggtggaggttgcagtgagccgagatctcaccactgcactccatcctgggcaacagagcgagattctgtctca

SEQ ID NO: 6829928 - DNA, 82 bp, Homo sapiens
tcctgggtgacagtcaatagctgggattaattttatttgttcttgcacagatatttgtatcttgctattgtaaacctcagga

SEQ ID NO: 6829929 - DNA, 59 bp, Homo sapiens
atggaaggggtccacgtatactcgagcttttgcttgggataaatctcagcttcttccat

SEQ ID NO: 6829930 - DNA, 82 bp, Homo sapiens
taccttggatcaaagagagaaagcccctgcatccctccatcagattgatagtgtgagacactttttctcttgattatgggta

SEQ ID NO: 6829931 - DNA, 83 bp, Homo sapiens
tgctcagcctggtgtgttcccgtttccttcactgggtcctggagtttgtcccactgaatgaggagccccagagtgtctgagca

SEQ ID NO: 6829932 - DNA, 64 bp, Homo sapiens
attgacaggagagcttggagtgaaagcgagggcttctgatgcaccattccactttcctgtcagt

SEQ ID NO: 6829933 - DNA, 96 bp, Homo sapiens
ggtagtccttaagtcttatctactgtgtccttggatctgttctaggcactaagacagatacagggacttggtatttacagaatgtatagttatacc

SEQ ID NO: 6829934 - DNA, 90 bp, Homo sapiens
accttggcaagatcacgttcattgaggaagggaggaagcccagattgcagtgttgacagggaaagacttctcttcccagggacacagggt

SEQ ID NO: 6829935 - DNA, 113 bp, Homo sapiens
atttgtgtgatggtatttcaggtagtattctgttttctaatctgtgtactggaacacactttcataactggcacacagattaggaaacagaatactacctgaatcccacaaat

SEQ ID NO: 6829936 - DNA, 64 bp, Homo sapiens
tgacttagaagttctgggtgcccaaacaaaacctccaagtgcattcaagattaattctatgtca

SEQ ID NO: 6829937 - DNA, 95 bp, Homo sapiens
accttggaatatgtagaaatgcagattcttaggccccacctcacaaaactctgggatggagtctagcaatctgtgttttaataagtttttcaggt

SEQ ID NO: 6829938 - DNA, 77 bp, Homo sapiens
ttacttttataccttcagacatcaactatctccaccagccccatggtttgggggatgagagtagggtgtgaaagtag

SEQ ID NO: 6829939 - DNA, 57 bp, Homo sapiens
gaggtgatggttgcacaatgctgttagtgtacaaaatgccatgcgatcatacacttc

SEQ ID NO: 6829940 - DNA, 75 bp, Homo sapiens
cggtgactttgcattgtgctggagacagtcagggtagtgtttgctggctgtggctctcacaagcaaatgtcactg

SEQ ID NO: 6829941 - DNA, 64 bp, Homo sapiens
gccaatgtttttccttccttaataaagtgttccaaaacagtatgctagatggaaaaatattggc

SEQ ID NO: 6829942 - DNA, 62 bp, Homo sapiens
gtgagttggcatatggcttttaaattgtttacttagttataggtcatgctatgtcaaatcgc

SEQ ID NO: 6829943 - DNA, 59 bp, Homo sapiens
gcattccatttaaatcaaggcaggcacaagacctgctgctttgcattgtgatgggatgc

SEQ ID NO: 6829944 - DNA, 57 bp, Homo sapiens
gcacaggctccggaggagagctgtattggaattctgactcactcctcgtagctgtgt

SEQ ID NO: 6829945 - DNA, 61 bp, Homo sapiens
tgctccaggagcactttccattcatactctaggccctggtaaaatggatgcacctagagca

SEQ ID NO: 6829946 - DNA, 60 bp, Homo sapiens
ggcctgactaatcaggatgaatgctggctttgctgttcatctctgtcaaagtcagaaacc

SEQ ID NO: 6829947 - DNA, 74 bp, Homo sapiens
gctcctggaaggcctgtggctgctgagggctgcctggtccccctcaggacggccgggggagcctctccagaagc

SEQ ID NO: 6829948 - DNA, 58 bp, Homo sapiens
ctggctcatcatttttagcgcgcaaaagtttcaaaactttccgcctagtgagaggcgg

SEQ ID NO: 6829949 - DNA, 72 bp, Homo sapiens
cctgatggatgtttggatgtttcctgtttttaggtaatatgaataaggctgctataaacattcccgtacagg

SEQ ID NO: 6829950 - DNA, 120 bp, Homo sapiens
ggcccaggttttatttaattcttttctctgggctgttctgggaaatatctttttctccctagaaacatgataaccaggctgccgaggaaagaaagaaaagatagaaactcttcctgggct

SEQ ID NO: 6829951 - DNA, 106 bp, Homo sapiens
atattttattgtgtgataaaaatagaaattgtgctattgttgaccactttgttcccagagatgacaggtagacagaggaagcatatagcacaaacggtaagagcat

SEQ ID NO: 6829952 - DNA, 84 bp, Homo sapiens
agcatggcacatttttaaatctgctcttaaatgtcactctattatcaagagcagcatttcatgtagattgagaacagttgtgct

SEQ ID NO: 6829953 - DNA, 109 bp, Homo sapiens
tgcaagttaacatcttggttttgtgttattgcaagatgatgacagcatgtgtatgctacattacaacaatctgccatggcattaatagctttggtgtgtgataaatgca

SEQ ID NO: 6829954 - DNA, 62 bp, Homo sapiens
tgcagtgtggatttagttgtgcttttttcttgctgggagagcacggccaccatttacaagca

SEQ ID NO: 6829955 - DNA, 64 bp, Homo sapiens
aaactgctggttgctggccagccaatgtattaattgtccttggtcaaatgccaatctgtagttt

SEQ ID NO: 6829956 - DNA, 68 bp, Homo sapiens
ctgtccgtggctgcctgcctccaagccgggctcctctgcagcctgagctccagtagcagccaggccag

SEQ ID NO: 6829957 - DNA, 121 bp, Homo sapiens
agggggaaaatgcaaataattggaaataaatgttcggtgctctaaattcaggagaggcttcttccaccacttaattgtgcccgtgacatttcatttcgaatgcagaatttattttctctct

SEQ ID NO: 6829958 - DNA, 56 bp, Homo sapiens
tgacaggcactgctgtagtgctgattgctttctcattctatttccagtctctgtca

SEQ ID NO: 6829959 - DNA, 58 bp, Homo sapiens
gcatgctgagcccacgcctgggcgtgcgcaatcagcccttggagttggttgaggatgc

SEQ ID NO: 6829960 - DNA, 127 bp, Homo sapiens
tggaatcatttggggagctttcaaaagttctaatgtctagatcagacctcgagcaggattctggtttaattgatttggggcatggcctgggcatcaggattcttaggcacttctccaggcaattcta

SEQ ID NO: 6829961 - DNA, 64 bp, Homo sapiens
gtgggattgggtactccaaactcagggtcatcctgcctgccctgagccgctgctccaacctcac

SEQ ID NO: 6829962 - DNA, 95 bp, Homo sapiens
ggaggacctgggtcaggtcatctgtctctgggctttctccggcacaaagggggggctggaccaggtgacctcgtaggaccctttctgggtcctct

SEQ ID NO: 6829963 - DNA, 81 bp, Homo sapiens
ctcgcactccacctctgaaggtttctgttactgtcttttcaagagaatctagtttcagactttgagttctgtggctgtggg

SEQ ID NO: 6829964 - DNA, 69 bp, Homo sapiens
ggcagcagagccagaccattgccgtgcactccaggaggtgcaggcaccattctgcctctcagccctgcc

SEQ ID NO: 6829965 - DNA, 90 bp, Homo sapiens
gaaagagacccctgccccgtgcagggcctgcagagaaaggttgaggataagggccactgaggaaagctgcagcggtacgggggctcattc

SEQ ID NO: 6829966 - DNA, 81 bp, Homo sapiens
cttgagtgttgtcatcaccgttgttatcatcattgtcatcatgtatttagtgtggaacctggtgatgtacaagtactctag

SEQ ID NO: 6829967 - DNA, 113 bp, Homo sapiens
acactgatagtttttatctagagaccctttcagaccctttagtatgcatttgcatatgagtatacataaagcactgaatagttatgtctttaggagtctgtttatttaagtgt

SEQ ID NO: 6829968 - DNA, 71 bp, Homo sapiens
gacagacaaattctgggccccatcccagaccattgcatcagaagctgtaggtcaaggcccagaaatctgtt

SEQ ID NO: 6829969 - DNA, 62 bp, Homo sapiens
gggtgatggaagtcttgttccgggggcccacttgttcccattcatcctcgcttccttcacct

SEQ ID NO: 6829970 - DNA, 88 bp, Homo sapiens
ttttctatcactcaattattttttggcacagtgttgcagccaaacttgaaatactatgtagccaaaataatgtggagtaggatgaaga

SEQ ID NO: 6829971 - DNA, 98 bp, Homo sapiens
tattaaaaggcatataaagtacttgatgctacagagtatctagaaatatgcgttgtgcttattcatttgtgacaataggtattttggcatttttaata

SEQ ID NO: 6829972 - DNA, 62 bp, Homo sapiens
cagtcccacaagatctccacaattctggaaactctgcctccagaggagggctttggggactg

SEQ ID NO: 6829973 - DNA, 56 bp, Homo sapiens
gtatgcatgcatgtgtatgtacgcatgtgtgtgcatgtgtatttgtatgtgtgtac

SEQ ID NO: 6829974 - DNA, 66 bp, Homo sapiens
tgatagtttattcatcaccatcttctgttacttggcagagctcagaaacttttgatgagtgtatca

SEQ ID NO: 6829975 - DNA, 68 bp, Homo sapiens
tggacagagcgggaccctgagggagcatagaattggccaccacgagcccccagtgtccagccttgcca

SEQ ID NO: 6829976 - DNA, 72 bp, Homo sapiens
ctgttcttatcgtcttaatatctgatacgtcctccatctgaggacaacatattaaatggattttgggagcag

SEQ ID NO: 6829977 - DNA, 86 bp, Homo sapiens
tgcatcagtgtttttggttcctaagaccaaaggatgactctaatccttcaaaagttgagagagccatgttgttaggcattggtgca

SEQ ID NO: 6829978 - DNA, 81 bp, Homo sapiens
gagtcagctgagtcagatgaactaggctgcacttggctgagcaactgcgcttcaagtcctaggtctgattgaacttggctc

SEQ ID NO: 6829979 - DNA, 90 bp, Homo sapiens
tcaggaagaaagacagaagtggtgggagattgtcgtgggttccagttcatcatcattctcccccacttcacatccatctttttttcctga

SEQ ID NO: 6829980 - DNA, 59 bp, Homo sapiens
gttgtaacgctagtatcaccaggctaagttcctagccaggtcacactgtgtgttaaagc

SEQ ID NO: 6829981 - DNA, 84 bp, Homo sapiens
cagtgggaagctggttgggagctggaagcaaggcctgaacaggacagttgggcttaaacacagctctcagacggaatccctgtg

SEQ ID NO: 6829982 - DNA, 57 bp, Homo sapiens
gcagttcctcaaaggttaaatgtaaagttacatatttacatatgacccagcaactgc

SEQ ID NO: 6829983 - DNA, 63 bp, Homo sapiens
ccctgacatctgtcaccctgctgactgtgaagcctgcagagctaggatagatgatgtcttggg

SEQ ID NO: 6829984 - DNA, 82 bp, Homo sapiens
gcaaagccaggcctgggcagtcctgggcgctacagccccgtgcacgggagccagctccgcaggatggcgcgcctggctgagc

SEQ ID NO: 6829985 - DNA, 55 bp, Homo sapiens
tatatgtaagctatgtaagagttgaatttagttgctcttgattggttaacatatg

SEQ ID NO: 6829986 - DNA, 129 bp, Homo sapiens
ccagttaaactggaatttcagataaatcacaaataatgtttcagtactgtctgtcccattcttttaatatttgggacacacttttgctaaaaattgtttgtggtttatctgaaattcaaatttaactgg

SEQ ID NO: 6829987 - DNA, 95 bp, Homo sapiens
gcaaaaattatatatatggctaaccatatatcaagacaactcatcttatgacttgattcatggacaggccaggtgtatggagatacaattttagc

SEQ ID NO: 6829988 - DNA, 73 bp, Homo sapiens
ggtcctaagcagtcaggcaggtacaaccctggcagtaggtcccaagggtgcatctgtctgagtgcttaggacc

SEQ ID NO: 6829989 - DNA, 60 bp, Homo sapiens
gccctgctcatttcacgtgtttcctggcccagtgaaagtgtgtggtatgaattcaggagc

SEQ ID NO: 6829990 - DNA, 68 bp, Homo sapiens
cattttctacttctcctgaatgtcttaataggattaaatcagaaaagggaaggaagaagagggaaatg

SEQ ID NO: 6829991 - DNA, 89 bp, Homo sapiens
ttgattatatcagctgagctagggatatctcctgagaatgtctcctccctattctcaggaaaaatccctagcttggttgatgtcatcag

SEQ ID NO: 6829992 - DNA, 84 bp, Homo sapiens
gcacgccaagcggggctggggtgcatcctgggcaggggactgaaatgtacctgtcagggtttgcctcagaagtgcctggtgagc

SEQ ID NO: 6829993 - DNA, 77 bp, Homo sapiens
gagagttgttgtacaaactaaatgagttaatatatgtaatcgattagaatgcaatttagtttctagtagtggctctt

SEQ ID NO: 6829994 - DNA, 58 bp, Homo sapiens
gagaaaggcattcctatgcaaaatattaaattttatttccccaataggggccattctc

SEQ ID NO: 6829995 - DNA, 78 bp, Homo sapiens
tgttcctgttaactgtctcctcatcatgcctggttgctagccctctagtgcccagggtgtggtgggacaggtggaata

SEQ ID NO: 6829996 - DNA, 75 bp, Homo sapiens
cttgcattatactactgtctcatcagtgttatttggaaaccagggaatagcagaagactagtagacaaaagcaag

SEQ ID NO: 6829997 - DNA, 68 bp, Homo sapiens
gctgccagcctccccggcctgtgaagtggagcagatgcagagtctgccaggccgggtgagcaggcagc

SEQ ID NO: 6829998 - DNA, 80 bp, Homo sapiens
ctgctaacagctctgtgtggctgtaatctggtttatgcaaatccagtcactttgcagcccacagggaaagctggaaggag

SEQ ID NO: 6829999 - DNA, 106 bp, Homo sapiens
tcttggaaacccagacacacgcctggcctctccgagtaacctgattattaacttgcatgctttaacttaccaccagaggctcagtgcgaggtctgggcaggcaaga

SEQ ID NO: 6830000 - DNA, 58 bp, Homo sapiens
ttgcagggttgacactgcctgcctgaaaacgaaggagcgccggttctcaacccggcaa

SEQ ID NO: 6830001 - DNA, 57 bp, Homo sapiens
agaattgggagtgtcctgatatcccgatatcttgagaacagaagcattcctaatttt

SEQ ID NO: 6830002 - DNA, 85 bp, Homo sapiens
atggcacctagagagatagtttattttactgactaattaaaatccaccaattgagtatgaatacagattttctctctattgtcat

SEQ ID NO: 6830003 - DNA, 82 bp, Homo sapiens
ggcttttactttaatccacaatagagattatctgcactttaagtccttgttagagtatttgattgtgaatcgaatgagagtc

SEQ ID NO: 6830004 - DNA, 56 bp, Homo sapiens
ctctccactcagcgtcatgtcctattttcagatgcatggcagacactcgtggaggg

SEQ ID NO: 6830005 - DNA, 65 bp, Homo sapiens
tttccttttcctccttcgtattgttgcttacaaacataagacaataactgctgaggagaagcaaa

SEQ ID NO: 6830006 - DNA, 62 bp, Homo sapiens
ccagctcagggtgcagcacagttcctggagctgcaggagaacggcaccccatgggctacagg

SEQ ID NO: 6830007 - DNA, 90 bp, Homo sapiens
acagccagttggaaggagtctttaacacccatgaccttgatggtcaacaaattggagttttagtgcatacttctaccacaaattaactgt

SEQ ID NO: 6830008 - DNA, 67 bp, Homo sapiens
atattagggataatggtctcaaaggcagtcgttttatctgctttgttcactgatgtatcccaagtgt

SEQ ID NO: 6830009 - DNA, 78 bp, Homo sapiens
gtttggggaagaatcatctgaactttgaggactgcagagtagacccttaaagtggcagaattagacgagctcccagac

SEQ ID NO: 6830010 - DNA, 66 bp, Homo sapiens
tgtgagttacatttggtgacacttcaaactaattttgaagattcactgagtataatcaagatcata

SEQ ID NO: 6830011 - DNA, 81 bp, Homo sapiens
tctactacagaagctcgggtaagctccattttgtcatgctgcagactggatgacctcttgagtttctgtgcatctcgtaga

SEQ ID NO: 6830012 - DNA, 96 bp, Homo sapiens
tcatttgggggacctgtcttgtctgtgagggcattggagtttgtgacccctgctccatgtgtaaggctcacaggcaggtcttaagtctgtaagtgg

SEQ ID NO: 6830013 - DNA, 65 bp, Homo sapiens
caggtggctaacggcctcatagtgtaagcatctgataaaagaggttgttgagggtgtgggctctg

SEQ ID NO: 6830014 - DNA, 57 bp, Homo sapiens
tctctccttatcattgtgtttagtgtcttagaaataagccagttactgagtgagaga

SEQ ID NO: 6830015 - DNA, 59 bp, Homo sapiens
tggctcccgcagaccctgtgctgtctatgctgagccaagtacctcctctgtgagagtca

SEQ ID NO: 6830016 - DNA, 57 bp, Homo sapiens
tacagctttgtcagtaggtgtgctgacttccccggcccattattgtaatcagctgta

SEQ ID NO: 6830017 - DNA, 63 bp, Homo sapiens
gtttgctgtgacacaggaatcctcagagattcatcattacccaggatttctgtcatttcagat

SEQ ID NO: 6830018 - DNA, 104 bp, Homo sapiens
ttcaatcttctcagcattttgtcagtctctcatgaatgaactcaaactaatgtaattttaaaagactgatataactgctgcaggagcaaatgctatctattgag

SEQ ID NO: 6830019 - DNA, 56 bp, Homo sapiens
ctcactgcctccttggagacacactgctttacgtgtggaccgggaagtgaagtggg

SEQ ID NO: 6830020 - DNA, 72 bp, Homo sapiens
tttctcactgtgatgatgaagcatggttacattggcgaatttgaaatcattgatgatcacagagctgggaaa

SEQ ID NO: 6830021 - DNA, 64 bp, Homo sapiens
ggccaatttggatggcaaggagaacaaatcagtgcttgatttgtctagtggtattcacgtggct

SEQ ID NO: 6830022 - DNA, 100 bp, Homo sapiens
gaggcaggagaattgcttgagctcaggaggcagaggttgcagtgagccgagattgcaccgttgcactccagagtggacaacaagggcaaaactccgtctc

SEQ ID NO: 6830023 - DNA, 59 bp, Homo sapiens
tggttttcaacaagggcagcgataacctggcacactatcgcatgagatggagaagacta

SEQ ID NO: 6830024 - DNA, 65 bp, Homo sapiens
gactgaagcattgtttgaataccataatttcttacctcagaaaatggtttacaatgttttcagtt

SEQ ID NO: 6830025 - DNA, 106 bp, Homo sapiens
gtttaatattatttacagccatttgaaaagctggctaatgatcttagagtaagtttctgaactgctattttagcagcttttaaatggttcttttgagtagtaaagc

SEQ ID NO: 6830026 - DNA, 58 bp, Homo sapiens
atcaacatgtgagagcaccagtttcaccctgactctgctagtgttattatttgttgat

SEQ ID NO: 6830027 - DNA, 82 bp, Homo sapiens
tatgtgtaagaattatattttgcaattgtgttggtataaaaactaatatgttaatgtgatataaagtattttctttgacgta

SEQ ID NO: 6830028 - DNA, 101 bp, Homo sapiens
ggaagtgctgggactcagaggtggggggccccagagtagaagaaggctcaaaccttcattttgttgacctctcccacctttaacagtttatagctacctct

SEQ ID NO: 6830029 - DNA, 55 bp, Homo sapiens
actgttatagttcacttttcccttgtttatgaggactagtgttatctgtagcagt

SEQ ID NO: 6830030 - DNA, 63 bp, Homo sapiens
catggcagtagcagcctagatgccatggcacacatcatggagttcttagctgttatcagcatg

SEQ ID NO: 6830031 - DNA, 57 bp, Homo sapiens
attgagatttgggcctgaggagagggtttccaactccagggctggccagacctcggt

SEQ ID NO: 6830032 - DNA, 86 bp, Homo sapiens
ctagggtaggacacctctgggcagcacctttgtaccctgccatctttaaggtacaccccatgttgtttaggctttgccatccttag

SEQ ID NO: 6830033 - DNA, 62 bp, Homo sapiens
aagtgctttataaacaatgaagcataatgctaatagtgtaacagattgttaatagagtactt

SEQ ID NO: 6830034 - DNA, 84 bp, Homo sapiens
gagccaacagctgcaaatgccgtgagagcaggcactcttggagatctgatttcttacagcattttggcacctctggttcggctc

SEQ ID NO: 6830035 - DNA, 57 bp, Homo sapiens
agctcagtgagatattgactccacttttccagtgaggaaattgaggctcacagagct

SEQ ID NO: 6830036 - DNA, 129 bp, Homo sapiens
agttttgaatctgctatggatctaggtctggcccctcgttcttgagcttcactcttaatttcccctgggtggaacaatatcgaagagaggaggatgttagccacttccattcccaagttggtgagaatt

SEQ ID NO: 6830037 - DNA, 57 bp, Homo sapiens
gacagacatgggacttcatactgacaccattaatcatgatggggccctgtggctgtc

SEQ ID NO: 6830038 - DNA, 66 bp, Homo sapiens
gctgatggggagtggttgatggtgaaaatctgtctccaagatcaccatgaagcggctcccacttgc

SEQ ID NO: 6830039 - DNA, 129 bp, Homo sapiens
aggggctagtggcctctggagagggtataggtggcaggaggtcagagaaaatttttgagaggctgaatctgcagcaaacgtttgtccggcccctgctctgtaccttcctgggtgctggaactagtccct

SEQ ID NO: 6830040 - DNA, 68 bp, Homo sapiens
tggtgtggtgtgtgagatgaggattctcagagatttcctcacaattttaatacacagtcaatatacca

SEQ ID NO: 6830041 - DNA, 69 bp, Homo sapiens
ttatttaattttctcactcagaggacacctgctggcaaggagtaaactgatttgagcagaataaaatag

SEQ ID NO: 6830042 - DNA, 78 bp, Homo sapiens
agaaatagaatgtaagagtctaagattgtagagttattggcttaatgttatttaaatcaaacttttgcttctgtttct

SEQ ID NO: 6830043 - DNA, 66 bp, Homo sapiens
catgtgtaccagctgttctttgcccagcttccttgggctagaaacatattcagtgagtaatacatg

SEQ ID NO: 6830044 - DNA, 68 bp, Homo sapiens
gggcctagcagggtccaatgtgaggcagcattaccctgtgcttgcaacacattgcccctgctctgccc

SEQ ID NO: 6830045 - DNA, 92 bp, Homo sapiens
tgtcaggttatccacctcgggcagctcgtcaggctgcggcgccctgttcagtctgttgcagctgagatcgagcactctgagcttggctggca

SEQ ID NO: 6830046 - DNA, 88 bp, Homo sapiens
ggtcccactgttcttcccaaacctgggcattcctctgctctctcctccccaaccagaaaggcaggtgcccagagagcacgatgggtct

SEQ ID NO: 6830047 - DNA, 98 bp, Homo sapiens
tgtctaccttccagtcatttatctagtctctagttgaggactgagcagcgaacgtgcgttgtctgtctggcagggaccaaggactgcagggcgtgata

SEQ ID NO: 6830048 - DNA, 71 bp, Homo sapiens
gcctgtcaggatggggctgtgggcaaagcctgctgacttaggcaccagctcagaccccaccctggcagagc

SEQ ID NO: 6830049 - DNA, 57 bp, Homo sapiens
attcccagatttatattgatagggactagatttctggaaaaccatatcactgggaat

SEQ ID NO: 6830050 - DNA, 64 bp, Homo sapiens
aggcaaggtgtggtatgaagatggtagctctttatcgagtgtttattgtgtgccacacactcct

SEQ ID NO: 6830051 - DNA, 59 bp, Homo sapiens
gtaagctggacagggctgaatacaattgtatgattcctaattagagctctttcagctac

SEQ ID NO: 6830052 - DNA, 57 bp, Homo sapiens
tcctctgcttgtccccaaactgtctgactacaccagcaaatagacatggctagagga

SEQ ID NO: 6830053 - DNA, 65 bp, Homo sapiens
ggtcagagggcgtactgaagtaggaagaggagggcttgcctgccagctgcttcaggcgccttgcc

SEQ ID NO: 6830054 - DNA, 110 bp, Homo sapiens
cctcaccctccacattgtctctcatcctccaggacactaacccaggcttctacacatggtgggagcagcgttccaggtgatgagatcagcagctgggagacctggtgagg

SEQ ID NO: 6830055 - DNA, 80 bp, Homo sapiens
gacgtgatcccacagggtaactcaagtgcctcctttgtggtggcctttgtggtggcccagtgtggacggatctcattgtc

SEQ ID NO: 6830056 - DNA, 70 bp, Homo sapiens
tgcaaatattgacttaggcattctgataagggatttacatgctgtacctattagaatgctttcagctgca

SEQ ID NO: 6830057 - DNA, 88 bp, Homo sapiens
tccctagtatcatgccaggtacatattaaaggtctataaataaatgattgtttattagtgcataatgtgtaaggcattgtgctaaaga

SEQ ID NO: 6830058 - DNA, 123 bp, Homo sapiens
gttgcagagccaggaagtctgattttgaacccagttctgtctgacaccgaagtttatgtcctttccgggcaagatggggcagaagaaagagggtagcttgagaaacttcctggagctggaggc

SEQ ID NO: 6830059 - DNA, 82 bp, Homo sapiens
acctaaccagtctgcggggcaggctcattcccatggcctttctcccacgggaaccacccctctgccctgaagttgcccaggt

SEQ ID NO: 6830060 - DNA, 55 bp, Homo sapiens
cactgattaagtctgctagagggctaacagaggtcactgataggctttatcattg

SEQ ID NO: 6830061 - DNA, 85 bp, Homo sapiens
cattcttgtggtaagcagagccctctttattagtgacctaggctaacaggtgtctggagggtttgcttgaaatatccacataatg

SEQ ID NO: 6830062 - DNA, 78 bp, Homo sapiens
ttaatatggtttataaagctgtattttaagtatttgttcattttgaaaaatcttagcacagctatataagttagttga

SEQ ID NO: 6830063 - DNA, 72 bp, Homo sapiens
gcttgttttaggggcatgaaattcttatagataacaacatttctgagaacatcatttcctacaacgacaagc

SEQ ID NO: 6830064 - DNA, 58 bp, Homo sapiens
gagctggacagagattcgggagcaatgcacgaggtagctggccgacccctctgtgctc

SEQ ID NO: 6830065 - DNA, 56 bp, Homo sapiens
gcttatgttttgccattgaagagacaatgagcttttcttctatggctgtcaaaggc

SEQ ID NO: 6830066 - DNA, 70 bp, Homo sapiens
ctaacttccctgtgggcaggtagtgggtggcagagctggattccaactactggtgctcaggaaatcttag

SEQ ID NO: 6830067 - DNA, 82 bp, Homo sapiens
cctccctgtgcagaaggggtgacatcagtaaccgtggttgacaacggagcctagggttctgatgtcacttctgcccgggtgg

SEQ ID NO: 6830068 - DNA, 70 bp, Homo sapiens
gtgatttgctcaaatagaactgatctataatatagttaagtgttgtatcagttagctattgctgcataac

SEQ ID NO: 6830069 - DNA, 83 bp, Homo sapiens
gactaagcctgatatcaagtcgggcatcactgagtcatggaaggtcaggaaaacccgggttgactctgctactaggcttggtc

SEQ ID NO: 6830070 - DNA, 93 bp, Homo sapiens
atagcataaaaggagtcttaccttggatttcacccttatcttttctgaagtgtaggggtatttcaaagtaacgtattctcctgtgtatgatat

SEQ ID NO: 6830071 - DNA, 62 bp, Homo sapiens
gccacagggcgagcggaggccagggacaggactcaggaccttggagaggccgcccgtgtggc

SEQ ID NO: 6830072 - DNA, 91 bp, Homo sapiens
cagacaaaataaaatgcccagtgtttaggaataaaatgtaactgtgcatatccctggattaactgaagctattttgatttgaaaaaatctg

SEQ ID NO: 6830073 - DNA, 99 bp, Homo sapiens
ggactaatgaggagccttaggacaagataaaacacaagatgtataactaagcccatgagcagcttatgtttccatgttctgaaggtttccatgttctcc

SEQ ID NO: 6830074 - DNA, 88 bp, Homo sapiens
atctccacattgctgttctgcaccagacttcagcacctgctagttacaatgaagtttttgctgctgggcaaaaccaaagtttggagat

SEQ ID NO: 6830075 - DNA, 92 bp, Homo sapiens
aattgggttttgattctttaccacctgtatcacatttttcctttccatttcaaggaaaactcgcaaagtggttaggaaatcaggaagcaatt

SEQ ID NO: 6830076 - DNA, 59 bp, Homo sapiens
gagaatggcttcacatggcatacatgctgtaaaatgcacgtgccctgtgggctattttc

SEQ ID NO: 6830077 - DNA, 65 bp, Homo sapiens
ccagctccagccgctgatgggtttcggcgggtcccccaggagacccttcagacggctagagccgg

SEQ ID NO: 6830078 - DNA, 61 bp, Homo sapiens
agcccctgtatttgcaaatcaagagaccagttgtctgcttgaggacaatttacatggtgtt

SEQ ID NO: 6830079 - DNA, 95 bp, Homo sapiens
acattttaaaagttaatattgtaaaataggaataataggagctaacatttctatgttagccattaatgtcctgtgcacaattgcatttgagatgt

SEQ ID NO: 6830080 - DNA, 55 bp, Homo sapiens
cagtttctgggaggaaaggaagaaaaaagccatacttcacaactcttagaagctg

SEQ ID NO: 6830081 - DNA, 79 bp, Homo sapiens
ccttgagagggttcaagagctgaggaggatgagggccagccctaggccattccttctcttgatcatttccctcgtaagg

SEQ ID NO: 6830082 - DNA, 75 bp, Homo sapiens
atcaccagtacttttggagtagcaagtattttattgtcatttgtaataaaggcaacaccagggtatgaaggtggt

SEQ ID NO: 6830083 - DNA, 67 bp, Homo sapiens
agacgcacagggccttatatccagaaggacatcacctttgggttttaatgctctgcacttgctgtct

SEQ ID NO: 6830084 - DNA, 67 bp, Homo sapiens
gccccaagtgacagtttgaaagccaggatacactaagaagcctggccatccctttgtgacttttggc

SEQ ID NO: 6830085 - DNA, 72 bp, Homo sapiens
ggtaaatccccaaagccaaagtgggcatgcctcagtgtccccactgtgctcagtctttggctgggagcagcc

SEQ ID NO: 6830086 - DNA, 64 bp, Homo sapiens
cttgtttcttagcgatgcttgataaatggctgttgcttatttgatgtgcagattgagagagaag

SEQ ID NO: 6830087 - DNA, 59 bp, Homo sapiens
tgtattggctcatttatttgcaaagttagaggattgcaaaatgctatgtgcccaatgca

SEQ ID NO: 6830088 - DNA, 86 bp, Homo sapiens
ggcatgtatggtcattatcctagtatcttgaatgggcagagcatgtaattcataccctgtagaatagaatggtgaccaaacagacc

SEQ ID NO: 6830089 - DNA, 64 bp, Homo sapiens
ttccctgccctccacgcttcaccacttggaggatcatcaaaggcagagcgcagagggcagggga

SEQ ID NO: 6830090 - DNA, 77 bp, Homo sapiens
ggtacagagagagctgactttggagtcagaaggtcctgtttcaaattctggctccattactcagcatctgattgacc

SEQ ID NO: 6830091 - DNA, 90 bp, Homo sapiens
ttttttgtatcctggtctggaatatagcaagctcttactaatatgattatttattggaaggatatttgtgtctaggcatcttgcagaaag

SEQ ID NO: 6830092 - DNA, 67 bp, Homo sapiens
ctgaaaaccccaacacaggaaatatctgcagaatgaattgagaatttatgggtgtttgggtgtttag

SEQ ID NO: 6830093 - DNA, 57 bp, Homo sapiens
atgacacccaaaaccagtgcagagcatagttgtgtattataaggaatgggtagtcat

SEQ ID NO: 6830094 - DNA, 58 bp, Homo sapiens
agtcaggaagctggagctggggcgcaaggccaccaggaggaaagaccagcccatgact

SEQ ID NO: 6830095 - DNA, 77 bp, Homo sapiens
ggattgtgtccagattgtttttgctggggtgaagagtgaatatcttctagggaaaggatttacagtttgatatagcc

SEQ ID NO: 6830096 - DNA, 89 bp, Homo sapiens
cagtgtaaaaatcctcattcacattcttcttactgttatattcattttctgggttcaggcaccggggtggagtgtgaggagaggcagtg

SEQ ID NO: 6830097 - DNA, 100 bp, Homo sapiens
ggattattccccagacagatggcagtgaggttcctagcctgctattaggtccctgctatcaggctaggaacctcactgccatctgtctggtgagtaatcc

SEQ ID NO: 6830098 - DNA, 70 bp, Homo sapiens
gtggagaaggggcagggtctccaaggggcatggctgcatgggcactttggaccctgcacaccagctctac

SEQ ID NO: 6830099 - DNA, 60 bp, Homo sapiens
gcagagagtctcgaaggtgatgacctccaaggcctccatcatccctaaggacagctctgc

SEQ ID NO: 6830100 - DNA, 77 bp, Homo sapiens
tgagagagctgcatattcattagttaaaacctggggatttcttcttagaataagttgatgatatatgtggcaatcca

SEQ ID NO: 6830101 - DNA, 105 bp, Homo sapiens
cctactcacagaaagcacacacctgttctgtcctccacactgtaagttgttgaggggcagctcctacaagaggaggctagttcagtgctacctgtgatcaagagg

SEQ ID NO: 6830102 - DNA, 83 bp, Homo sapiens
ggtggtgccaaggtgctaagggcatgaaccctcatcttcctaggccagtttgcatgtatcttaattgctttggagacactatc

SEQ ID NO: 6830103 - DNA, 130 bp, Homo sapiens
atagttgaatcacttgggaagctctgaaaagtcctgatgtgcacttgcacctcacaccaataaattagaactttggaggcctaggagccaggcatcagtgttttttaaagtctctaaggaattccagcat

SEQ ID NO: 6830104 - DNA, 128 bp, Homo sapiens
cccacctcgccctcccaaaagtgctgggattacaggcgtgagcttgcctagttttttaaacctgctgttcttgtgcaggcatggtggctcatgtctgtaatcccagcaccttgggagggcgaagcagg

SEQ ID NO: 6830105 - DNA, 87 bp, Homo sapiens
gcttgattttctgattaggttgccaggtttaataattgagcgctaaatgtagcacaatttattaatcaggtcctagtcattattagc

SEQ ID NO: 6830106 - DNA, 101 bp, Homo sapiens
ctcttgctatatagtcacaagaaagcctttgtctcaggctctgctttggggaacacttgacctaagtcagacatgggtcttatttggattgagaagcagag

SEQ ID NO: 6830107 - DNA, 82 bp, Homo sapiens
agggaagtgaaggttttcacaggggcatttcatacaaatctttaccctgctgagattacaaatcctctgtgtttcctttcct

SEQ ID NO: 6830108 - DNA, 84 bp, Homo sapiens
cgcgtggaggtctttctcgcaagcctggccagcggcttgggtttgctgcacgcacagccccagcgcggcggggtcctccgggcg

SEQ ID NO: 6830109 - DNA, 81 bp, Homo sapiens
gaatagggaccttagaattgtatgtatgtttctaggctaatatttgcaagacatgtctaaggtttaaagtttttcctattc

SEQ ID NO: 6830110 - DNA, 79 bp, Homo sapiens
agaaacttacattcactttttcctggtccattttggttcctaagaatagataggccattaagaaggatattaggtttct

SEQ ID NO: 6830111 - DNA, 70 bp, Homo sapiens
gttgccccctccttgctttttcccttccacagagctaagtgggaatgagtggctgagtaagaggggagac

SEQ ID NO: 6830112 - DNA, 92 bp, Homo sapiens
catgggagctcactgctgccttttgctcctcccaccttccccccagggaggtggggagggagtgaggcagcacgtaagtgccacctcccatg

SEQ ID NO: 6830113 - DNA, 96 bp, Homo sapiens
tattgattttgtaggtaatgggctatctgttgagactcagttattctggctatttcctgagtcttgaatatcaatctgtcacctgcaaaggcaata

SEQ ID NO: 6830114 - DNA, 86 bp, Homo sapiens
tacacacttctaaacacatagacgtttgatatcagtgattgaatttttcacttttgatccagatgtttttgtgttaattagttgta

SEQ ID NO: 6830115 - DNA, 71 bp, Homo sapiens
cacctatgccaggtatgaggacactgacagcagaattgaatcagctgtcagtttgtcttgctgacaaggtg

SEQ ID NO: 6830116 - DNA, 59 bp, Homo sapiens
caggctcttttggtggcaaggaacagagactcatccaaacttgctacaggagaaggctg

SEQ ID NO: 6830117 - DNA, 64 bp, Homo sapiens
ggttgtacactgaagtgtcttggtataatagtttataatgaaaatatcttcagtgaatgcaacc

SEQ ID NO: 6830118 - DNA, 57 bp, Homo sapiens
tagtctctgctttgcccttggctagctaggtggtgtgccaagtggggagagaagcta

SEQ ID NO: 6830119 - DNA, 67 bp, Homo sapiens
ctgtggatgggattggcctttcacgatgcttataaaggaaggacttccaaacctcccaaatctacag

SEQ ID NO: 6830120 - DNA, 67 bp, Homo sapiens
ttcctcattactgtattgtatagaatagtttcactgccataaatatgccctgtgcagaaatgtggaa

SEQ ID NO: 6830121 - DNA, 77 bp, Homo sapiens
gggagccaccatgtccatgagccagctctaagcaaattacatcctccaagttaattagagctgatgttcatattccc

SEQ ID NO: 6830122 - DNA, 88 bp, Homo sapiens
cctagtcaatggtacagctgagagcctgcctctggtgagactgcacttcccagagtcccttgcagctcagtgtggcccagtgactagg

SEQ ID NO: 6830123 - DNA, 113 bp, Homo sapiens
tgtgagtacacgtgctaacattcacatcctgggcagtgtgtcactctgctgttcgtctcagccagaatctatgccagagtcacactgtgtgagtgttgacagtgctgttcaca

SEQ ID NO: 6830124 - DNA, 102 bp, Homo sapiens
gccacctggggcctggccaggccgcataccctctggtgaggcttccaacttctggggcatacagagaggatgtggcatccagtcagaagccctggttaaggc

SEQ ID NO: 6830125 - DNA, 106 bp, Homo sapiens
gctgcaattcatagcctgttagtagctgtgtcttcaatgtactgggaaatttatctttgtacaggaaggcactgtttcaagacccagagctgtgttcctcaatagt

SEQ ID NO: 6830126 - DNA, 115 bp, Homo sapiens
cttttctccttgtgcactccttataaccccaggggtaggaggatggtggtataaaacatactcactgtccatgcttgctaacccatggtaaaaggcagtgtggtatagaggaagg

SEQ ID NO: 6830127 - DNA, 60 bp, Homo sapiens
tattgattttgttgctacctgggctgaaagatacagccacaggcagaaatcaagacggta

SEQ ID NO: 6830128 - DNA, 69 bp, Homo sapiens
tgaagaaagcgagtccatggaaaactgataatcaagaagctttattacttccaggattgcttattttta

SEQ ID NO: 6830129 - DNA, 74 bp, Homo sapiens
tggggattgggccaaggggttagtagagatgacatccattatttggtgatttagtggccaaatcatttgaccca

SEQ ID NO: 6830130 - DNA, 100 bp, Homo sapiens
ggcatctatgagcccctctgtgcactgggcttcctggcactaccctccctgtggaacctggccggctgccaggagaagctcagtgggcatcatgggtgct

SEQ ID NO: 6830131 - DNA, 64 bp, Homo sapiens
ccattaaagcaccactgtaataattgtttctggcaagatccatcagtggttgctgaattagtgg

SEQ ID NO: 6830132 - DNA, 84 bp, Homo sapiens
gcaatcagacaaaagaaagaaatagatggcatttaaattagtaaagaagtcaaactgtcactgtttactgatgcgtatgattgt

SEQ ID NO: 6830133 - DNA, 71 bp, Homo sapiens
ggtttaaaaacaagggggagatttagggtaatttctagattattgtgagatttgactctgatgtttaggct

SEQ ID NO: 6830134 - DNA, 74 bp, Homo sapiens
gacttgcactgactccatgatgatcaactctgcccaggaagttgtctcagagggtcaccaggaagtgcacggtc

SEQ ID NO: 6830135 - DNA, 78 bp, Homo sapiens
gtgaaaaagtagactgctcagagtaagtatggaggatcatacttctgcatacactgaatgtagttgtttcttttccac

SEQ ID NO: 6830136 - DNA, 80 bp, Homo sapiens
ttgctcttgaatatggctcaaaggagatgactaagttaatccaactttacaatatcctgtgacttttttcattggagcaa

SEQ ID NO: 6830137 - DNA, 79 bp, Homo sapiens
tgggacattatcacacatttgaaggcctgtcaaaggtaagcactattagatttgtctccagagtgtgggacttggccca

SEQ ID NO: 6830138 - DNA, 83 bp, Homo sapiens
cctcaaagcgttcactccagaaattcaacagcaaatttacttcatttcagagatttgtgtctctttcagtgaaacatttgggg

SEQ ID NO: 6830139 - DNA, 112 bp, Homo sapiens
aggagggtggtcttggttggaaccgcccagcccactcttgcttataacttgggtcagcaagaagctgtgggcttccaggggtggaatcctagaggagacctcctacaggcct

SEQ ID NO: 6830140 - DNA, 58 bp, Homo sapiens
cccgggctacaggtagcccaggccacccccagagggctgtggctgcctctggccctgg

SEQ ID NO: 6830141 - DNA, 101 bp, Homo sapiens
ttgcctgtgagcagagaggttctgacttgtgcattgctgttagatatggagaggaacaagcacagccactgagtgagaaccccacaaatgctgatagacaa

SEQ ID NO: 6830142 - DNA, 81 bp, Homo sapiens
ctgctaatctgtgttctaatggctgagggatgtgttgtatattcagcatcacacctacctcattatggacaccacaggcag

SEQ ID NO: 6830143 - DNA, 62 bp, Homo sapiens
cttcttttctgtttctttcacccagtaagtttcattttatcaagggagaaacaggaggagag

SEQ ID NO: 6830144 - DNA, 70 bp, Homo sapiens
ccttgctcggtcatgctgtccccagcctagctcagtgggaggggagtgggacaggtgattcagagcaggg

SEQ ID NO: 6830145 - DNA, 114 bp, Homo sapiens
aggaaataacttggaggatactggtgggggctatacgtttggtgaaatccatcagtgatattcaagccaagcaaataatcacccactaatttgtgttttccacttaaaattctt

SEQ ID NO: 6830146 - DNA, 80 bp, Homo sapiens
tcctgtctggctttggcagcctcagctgcagggcacaaacaactagggctgctgggctggagctgccagggccaggagga

SEQ ID NO: 6830147 - DNA, 57 bp, Homo sapiens
ctatttgtacagcattagtaatttttgctcaatcaaaagactatgctgaataaatgg

SEQ ID NO: 6830148 - DNA, 74 bp, Homo sapiens
agggaaatccgcagcgtgcatcttacccttcaacatggaaaccccaccagttagaggaggtaaagatgctccct

SEQ ID NO: 6830149 - DNA, 58 bp, Homo sapiens
acatgtacgtgctgctctctgtgtgtccttgaacattcatagaagtattatgtaatgt

SEQ ID NO: 6830150 - DNA, 70 bp, Homo sapiens
ttcccaagacttctttcacaatgtttctagggaatgggagtctgaaacacacagagaagggagaagggag

SEQ ID NO: 6830151 - DNA, 70 bp, Homo sapiens
ggctggcggggctttgccatgctgtttctatctgggtggagacatacgcaccttgaggtccccgcgtgcc

SEQ ID NO: 6830152 - DNA, 60 bp, Homo sapiens
cctcaagatgcactgaacatatgttgacagtcaagcactgatgtgtcttagagcatcagg

SEQ ID NO: 6830153 - DNA, 61 bp, Homo sapiens
tgacatcattggccattggggatagactcaacctcagtacctctccccttccaggaagtca

SEQ ID NO: 6830154 - DNA, 63 bp, Homo sapiens
aaataagagcatgtaattggatttctgaaaagcattgtcagtcctctggagtatgccttattt

SEQ ID NO: 6830155 - DNA, 71 bp, Homo sapiens
atacagcagccccaacactgacaaatccaaattctatgagtacagggagtttgttgtgttcactgctgtat

SEQ ID NO: 6830156 - DNA, 59 bp, Homo sapiens
gatttcacactttgttggccagtcttaggaactcttgtcaggtcattagaggtgacttc

SEQ ID NO: 6830157 - DNA, 65 bp, Homo sapiens
ctgcaactctagtccagggctgtctccactgtgaaacagcttcctgatgcaagagggctttgcag

SEQ ID NO: 6830158 - DNA, 76 bp, Homo sapiens
gtctcatttgcctcatctataaacggaaacaatgctggtactgacctcatagtattttgtagggcttaaatgagat

SEQ ID NO: 6830159 - DNA, 57 bp, Homo sapiens
tcacaatgtctggtaggccactttgggttctagaggtagcatattccagacttgtga

SEQ ID NO: 6830160 - DNA, 71 bp, Homo sapiens
accaagagactggtttctattacaagctatcttctttttggataagatctttagtgaagctaaatctgggt

SEQ ID NO: 6830161 - DNA, 83 bp, Homo sapiens
ttttaggttgaaaaatatgaagttgtcagtatgattgttcttcttgacctataaaacagcaattcatatggtttagcctagag

SEQ ID NO: 6830162 - DNA, 65 bp, Homo sapiens
ttgctttgtgtggattattgtcctttgggaattaaggaatagatctgtgtgcacatttggagcag

SEQ ID NO: 6830163 - DNA, 60 bp, Homo sapiens
tgagttgtgcttcctccttaaactgtcatgttgtgagagttgatgagaggagcaatttca

SEQ ID NO: 6830164 - DNA, 74 bp, Homo sapiens
tgggaagtctcatgaactctcaagtcaggccacaacgtgcaagggccattcttgatgaggtatgaacctctcca

SEQ ID NO: 6830165 - DNA, 110 bp, Homo sapiens
gcggcgcaaggcctgaggcccagcacaggtgggttccgcggcggcccggccccagcacttgccggcacctgcagcccgcctagacccggcgctcgggcgtcccgcgctgc

SEQ ID NO: 6830166 - DNA, 85 bp, Homo sapiens
gaggatgagagtagataatctgtgtaccttcatcggaggacactccctacctagacatgaacacagatgtcccactcataccctc

SEQ ID NO: 6830167 - DNA, 104 bp, Homo sapiens
cacttacttatccatgagcccaggtcttcacatctgtgaaatggggttaatattgtttgacagagttgtgaggatttaatgaatggctcattgttagtcaagtg

SEQ ID NO: 6830168 - DNA, 56 bp, Homo sapiens
ggacagggatcattatctgagcacatctggccatggatagtactgtttccctgtcc

SEQ ID NO: 6830169 - DNA, 109 bp, Homo sapiens
ggtgcctaaggcagcaaggtgaatctgggccccaaagttctcggctcaagtcctggtctaccactgacttgcctgggacttcaggtacatcactttctgtcttggcatt

SEQ ID NO: 6830170 - DNA, 69 bp, Homo sapiens
gagacagaaccttcggtttggctgccataaggcctgtgggagaggtgggcagagccagggttttgtttt

SEQ ID NO: 6830171 - DNA, 60 bp, Homo sapiens
agggctctggggcctcctcccttgggcagcccaggggatacttggctgccccatggccct

SEQ ID NO: 6830172 - DNA, 66 bp, Homo sapiens
cctgtcctttgtgttgatgaagatctaaaactcatggagtcaattcaaacagctacaagggggtgg

SEQ ID NO: 6830173 - DNA, 70 bp, Homo sapiens
ggagagaggacatgtgcctggggcaccaggcccaggacagggcactgactgtgcagcgcaccctgtctcc

SEQ ID NO: 6830174 - DNA, 64 bp, Homo sapiens
aggtggcagaccatcctccctattggccgatcaatttggtcaacagaggtaatggtaaccacct

SEQ ID NO: 6830175 - DNA, 83 bp, Homo sapiens
cctgaccacacgctcacagggccctgtgggccccactcctggtaccaagtccctcggttccccaggtgcccggcgtgctcagg

SEQ ID NO: 6830176 - DNA, 71 bp, Homo sapiens
tgaagcagagaggaatctagcattacaaaaactgttaagtcagatgagctctaagatcccctcaagcttta

SEQ ID NO: 6830177 - DNA, 62 bp, Homo sapiens
gtaccacagaggacaactaggcgctcagcccacttatgcagctgagtctttcccttgcgtac

SEQ ID NO: 6830178 - DNA, 65 bp, Homo sapiens
attctatggggaatttggatgctgatatggtttgtctgtgtccccacccaaatctcatcttgaat

SEQ ID NO: 6830179 - DNA, 73 bp, Homo sapiens
cctgctcgttgtcatgtggctggattcttttaacatgttagatgtcagctcacatgccaccgttctgggcagg

SEQ ID NO: 6830180 - DNA, 59 bp, Homo sapiens
tcacaagacagaaaacatttagaagatagctattatctcataagttttatgtgttgtga

SEQ ID NO: 6830181 - DNA, 57 bp, Homo sapiens
gccagtgtgtcctctcagtttctcttcatcaagaatatgagttccatgacacttggc

SEQ ID NO: 6830182 - DNA, 116 bp, Homo sapiens
ttattacaaatcattatgcacattttctgttcaagactgaggtgacactggtgtcaaatgaaatcatgtcactgttggtcttatggagattaagttactaagtaaagattaaataa

SEQ ID NO: 6830183 - DNA, 93 bp, Homo sapiens
ttggctgagtcaatgccgaatagtatatatggtggttgatggggtgttgacattctttctaacagcaaatgtttatctggtgttgctggctga

SEQ ID NO: 6830184 - DNA, 112 bp, Homo sapiens
gaatgtagaagaatgtgaaaatgtatgtaattagtcacttctgcctgtttggtagaatattggggccagatgggaagaagcatgacttctccatgctttgctgactacaatc

SEQ ID NO: 6830185 - DNA, 76 bp, Homo sapiens
gactggaatatgagtgtccctgaggtcagtacattccttccctgtaccaggctacagggtacaccacatcttagtc

SEQ ID NO: 6830186 - DNA, 106 bp, Homo sapiens
ggatggaattaggaattcagtttattgtgtgtgtttttttagacgtttgtaaccaccagattaggaagttttaacaagtacttactatagggtgaatcttccgtcc

SEQ ID NO: 6830187 - DNA, 75 bp, Homo sapiens
gaggttgtgtcagagcgctcattttctactgctgcgtaaaaaattgccacaaatgtagtagcttaaaacaacttc

SEQ ID NO: 6830188 - DNA, 83 bp, Homo sapiens
tagaaattgtttacatttcccccttggaggctgctaagcccttagagagcctcagaggaggggcagtgtgaaaataaaggcta

SEQ ID NO: 6830189 - DNA, 84 bp, Homo sapiens
tcaagtattttagttgagattgtcacattttaagataagctttgacaaataagcaaaatgttgaggatatcagaaaatatttga

SEQ ID NO: 6830190 - DNA, 79 bp, Homo sapiens
ttagaaggaaaaaaattaatgtgagtcaaatttggaacattgctaaattggattaaaatatctttttttttttttttga

SEQ ID NO: 6830191 - DNA, 76 bp, Homo sapiens
aactcaaactgtccaagaatctggtggatttaaagtttcaaagaaaaactaaaaccttcaggtttggagtttggtt

SEQ ID NO: 6830192 - DNA, 95 bp, Homo sapiens
cagagggctgaaggcatttgggttacttgtatgagcacttagggtagagaatgtatctgtcagttctcatttcacaggcagtgctcagccctttg

SEQ ID NO: 6830193 - DNA, 63 bp, Homo sapiens
gaggaagctgcgtggcatttcagagatacttattttaaaactgctggtggccatgtcttcttt

SEQ ID NO: 6830194 - DNA, 56 bp, Homo sapiens
ctcctgatgtggtgccttttgggaattaaccctctcccctaggaacgcagcaggag

SEQ ID NO: 6830195 - DNA, 60 bp, Homo sapiens
cagctgccatgtgtgaaaggggaggtcagaaggccttcagcccactcatatatggctctg

SEQ ID NO: 6830196 - DNA, 65 bp, Homo sapiens
ctctgtaaactaggtcatttttaaaaatcagactttctactgttagagtatgtctggtagcagag

SEQ ID NO: 6830197 - DNA, 74 bp, Homo sapiens
tcacaaaagcactgcagagtaagcactgaaaaaacactgttaggagctattacttttggagtgtgggattgtgg

SEQ ID NO: 6830198 - DNA, 61 bp, Homo sapiens
gtcacttataagcaggtttgtgtctcccttttcataagcgtctcgccctgctataaatgac

SEQ ID NO: 6830199 - DNA, 76 bp, Homo sapiens
cagctcttacacactagatggtaggtgcggggctctcccaccccacctgttcattacccatcccaggtctgtgctg

SEQ ID NO: 6830200 - DNA, 128 bp, Homo sapiens
taaggtgagcagctgggaacctctgattataaaattctgtatgccaatgggttttttgtagtaaaaaagagttatttgttagaaatgcattagcacatataggtattcgattcaaaagctgtgattta

SEQ ID NO: 6830201 - DNA, 124 bp, Homo sapiens
agggctggtcaaggggcagcgctctgtcgtgggggcctccatggtagtcggtaagcccaggtagcggtggactggggctccagccaggtgtccccactcagtcccgcgtgtcctgcctagccct

SEQ ID NO: 6830202 - DNA, 62 bp, Homo sapiens
cccgtgagttacagagtgagattttaaaaggtaaaatgaaattccattatgataatttcggg

SEQ ID NO: 6830203 - DNA, 65 bp, Homo sapiens
tgttatttagttgttattgtctttttcctcccctaggatataaatcagaacagctttttgtgaca

SEQ ID NO: 6830204 - DNA, 61 bp, Homo sapiens
gggcaaatgacttcacctctgtgaagcagcagtatcctcttctgtgaagtgaggttagccc

SEQ ID NO: 6830205 - DNA, 79 bp, Homo sapiens
acaccagaatcagtttcttcaattcagacactgtcttttctgttgcgagtgtttaaactgaagtgatgaatcctggtgt

SEQ ID NO: 6830206 - DNA, 105 bp, Homo sapiens
ctgggggagggcggagttaaggtggcgctggagctggtcccgctcgtgtatggcatcctggagccggctctgtgtggccgccaaggtctcctgactctcccgaag

SEQ ID NO: 6830207 - DNA, 58 bp, Homo sapiens
tggtgaacgagatggacaaaacctgtctgttaaccactttgtccacctgtgttcacca

SEQ ID NO: 6830208 - DNA, 68 bp, Homo sapiens
ggctccatttcctacagccatgggataagggttgcatgtaaacaataatatcctgtgctgtttgggcc

SEQ ID NO: 6830209 - DNA, 85 bp, Homo sapiens
tcaggaccagcagaggggcggagtgcagaagctctgtgtccctgagctctgagctgctctctccacccccttgctgcttagctga

SEQ ID NO: 6830210 - DNA, 98 bp, Homo sapiens
ctagggctcatctactgaaagtaatgtcatattttagcgttggagctatcgtgaagtatatgctaaaaacttgatcattatagtagggttggctttgg

SEQ ID NO: 6830211 - DNA, 61 bp, Homo sapiens
cagagtgcatggtgctgttcatttgagcttaaagttgcctgtgtgcatggccatgtgtctg

SEQ ID NO: 6830212 - DNA, 77 bp, Homo sapiens
caggagccagccccccaaacttgggcacttggatagcatcaggtgtctggacttgtgaagcagggggctgggttctg

SEQ ID NO: 6830213 - DNA, 76 bp, Homo sapiens
ggtgatcagtcacatttcgacataactagatgtcaaaagaagtttaagttgtatgacgaactgtgatgcagtcact

SEQ ID NO: 6830214 - DNA, 64 bp, Homo sapiens
gaattcctctgagctaggagatttaggagatcatgagcaaccacatttctttttcagagaattc

SEQ ID NO: 6830215 - DNA, 57 bp, Homo sapiens
gttgttgggcttggggatctgcctttttagtaagcagcccagataaagctcaggaac

SEQ ID NO: 6830216 - DNA, 88 bp, Homo sapiens
ggctggtctcgaactcctgacctcgtgatctgccagccttggcctcccaaagtgctgagactacaggcatgagccaccgtgcccggcc

SEQ ID NO: 6830217 - DNA, 69 bp, Homo sapiens
ccccatcttcccaggaggctcttgtccctggtgccaccggtgtgcaccatgcctctctgggcgtgcggg

SEQ ID NO: 6830218 - DNA, 78 bp, Homo sapiens
aaagggcatatatatttactctggctggaatacaacatttctgaatatgtttatcagtgccaagagtcagaacccttt

SEQ ID NO: 6830219 - DNA, 105 bp, Homo sapiens
tcttcatgaacatttgcccagccttcccttagagaatgagctgtttgaaaactcaccttgttctgttcttctggaaggggatttttgggaagataaaaatgaggg

SEQ ID NO: 6830220 - DNA, 81 bp, Homo sapiens
cttttgtctcgggctcgtttttcattgcttactcagtgtgggctgaatgagcaattaacagagtctaaaatgaggcttagg

SEQ ID NO: 6830221 - DNA, 73 bp, Homo sapiens
agtagagtgaccaacttaccctgattttaaaactgaaagtcccaggcaaatcagagtggttggtcatcctact

SEQ ID NO: 6830222 - DNA, 55 bp, Homo sapiens
cggggaggaactggatttggagccagaagaactggttctaatatctacttccctg

SEQ ID NO: 6830223 - DNA, 69 bp, Homo sapiens
ggaggtggaagccttcagaacagcatccctgggaatttgcatgctgctgttgacggctgtccagcctcc

SEQ ID NO: 6830224 - DNA, 57 bp, Homo sapiens
gggatcattgagtagtaggaaaataactgaattattcaggtcctagtcaatggttct

SEQ ID NO: 6830225 - DNA, 61 bp, Homo sapiens
agtcagaagttgcttccaggctgattctaaataaatctaccagggaaaatcaacttctact

SEQ ID NO: 6830226 - DNA, 79 bp, Homo sapiens
tgattcttccataattctgcataatttcctggcagtaatttctttacttcttgctttatttaggagatggaatcagtca

SEQ ID NO: 6830227 - DNA, 87 bp, Homo sapiens
tcattccgtgcttggcctctacagactgttggcctactgagcaatatatgctctgttcatcagtttgttgggagagtttggcagtga

SEQ ID NO: 6830228 - DNA, 55 bp, Homo sapiens
gggaaggcataatagtcaggtgacctggtgtcactttaagagtatatgacttccc

SEQ ID NO: 6830229 - DNA, 88 bp, Homo sapiens
aatactaaatggtctgctgagtcatgaggcctaagggacaaaatttctgtaaccactgtcttaatatgactcagagcccttttgtgtt

SEQ ID NO: 6830230 - DNA, 111 bp, Homo sapiens
gaaagagtcaatgcattaatttccagcatttacaggttaagtgacacttaataaatcattgaagagtcgcttaacctgtgaatgagacccgtaaatgaaaccatctcattc

SEQ ID NO: 6830231 - DNA, 72 bp, Homo sapiens
ggtctctgctgaatatagagcaagaagttatggagcttatgagagtgcttatactctgtgtctagcaaggcc

SEQ ID NO: 6830232 - DNA, 63 bp, Homo sapiens
ccttatttggaaataggttgctgtagacttaattagctaaagtacagccacatccaagtaggg

SEQ ID NO: 6830233 - DNA, 64 bp, Homo sapiens
gaagatgggtataacatagccatgtttgcctgcagaacttgaatatgagatatacttattcttt

SEQ ID NO: 6830234 - DNA, 85 bp, Homo sapiens
gctgtttcttactaaagtagaggcattgatcaggtaatcagtagagttgatcagatccataatgacctgtggagtgagaaacagt

SEQ ID NO: 6830235 - DNA, 95 bp, Homo sapiens
tctcagcaccaggtattaagtgttttacatacattattatgttgtgataattaaatgaggtaatgcacatagaagtacttagtacagtgtctgga

SEQ ID NO: 6830236 - DNA, 80 bp, Homo sapiens
ccagggcttcggctggatgttcaatttcccatcctcttttttactttgcggaaacttcaagattcaagcctggagcctgg

SEQ ID NO: 6830237 - DNA, 83 bp, Homo sapiens
gtctgaaaccactgatggtaccaagtcccatacaggtgaagtatcccttatctgaaacgtttgggaccagaagtgtttcagat

SEQ ID NO: 6830238 - DNA, 89 bp, Homo sapiens
atggcattgataagaggaattacagaagaggcaaactttgcacctgtcttggcttctgtatttcctgttgagagtaaagaaaatgctat

SEQ ID NO: 6830239 - DNA, 68 bp, Homo sapiens
ccagcctattgccgtggaaggggccaggcctcaaggaggcccagggtagacagcggtagtgggtgtgg

SEQ ID NO: 6830240 - DNA, 77 bp, Homo sapiens
taaaatgcagattcctggaccattcccagacgggttgactcagaatccctgcagtgtgtccagaaatctgtatttta

SEQ ID NO: 6830241 - DNA, 87 bp, Homo sapiens
tgagaacctgtaaatggggcttaaattgctcaaagcctaaagacaatgaaaagtggcagaatgtgaagacccggtttgttggtttca

SEQ ID NO: 6830242 - DNA, 83 bp, Homo sapiens
gggtaggacacgttcaggcacggctggatctaggtgctcaaacaatgcctctgggagctggctttgcctcagctgtgcctcct

SEQ ID NO: 6830243 - DNA, 113 bp, Homo sapiens
tcttgtctttacattcagccttcagccttcatccttccttcactggtttaggaaataaagtagggaaggagactaaggccagatatgcaagaattgtgaatgtatggataaga

SEQ ID NO: 6830244 - DNA, 73 bp, Homo sapiens
tggcacagttcttgatcaaccacttgttcccaactcttgaggaacaggaaacaagttgttaggatacctgtca

SEQ ID NO: 6830245 - DNA, 55 bp, Homo sapiens
gtgtttgtgagctaggtgacatgacgcaggctctgccacttgctccacgatacac

SEQ ID NO: 6830246 - DNA, 79 bp, Homo sapiens
ggatatgtatgttctgttttgttgcttgtttgctttttcagaaatagaagcaagtacaatagcaagtaccagcatttcc

SEQ ID NO: 6830247 - DNA, 61 bp, Homo sapiens
gcatatggggtggaatacttacttgactcagagcccctgagagagcaggccacacatgtgt

SEQ ID NO: 6830248 - DNA, 58 bp, Homo sapiens
ggttccagggttggatgagtcacttagtaaatctgagtgacctaactccccctcttcc

SEQ ID NO: 6830249 - DNA, 81 bp, Homo sapiens
gcagtgctgcttacatggtcccagtcaggcacaagaaagtcctgacggtatttagggagcagcgtttcagagcatcattgc

SEQ ID NO: 6830250 - DNA, 71 bp, Homo sapiens
gttgaaacattctacagttaaccattagcatgctagttgtcctaatggaaatttttgaagagtttttcaat

SEQ ID NO: 6830251 - DNA, 61 bp, Homo sapiens
tccaagcccacagaatgtacagcatcaagagtgagcccagatatgaactgtggactttgga

SEQ ID NO: 6830252 - DNA, 64 bp, Homo sapiens
ccaacctgaggcaggctgcagcaaggctgatggtaattttgtagacctggcttcagagtgttgg

SEQ ID NO: 6830253 - DNA, 58 bp, Homo sapiens
agggatggatcttggccctggaagctcctggatttaagcttctgccctgccattcact

SEQ ID NO: 6830254 - DNA, 76 bp, Homo sapiens
ggtatctatgggctatcaaatggaggtatccagaagaaactggatacattagaatctggtactcaggagaaatatc

SEQ ID NO: 6830255 - DNA, 93 bp, Homo sapiens
caggtcctcagtttccccatgtctgcagggagggtttcggtggtggtcttctcactgtgctcctgtagctctggggttcctaagaggtgcctg

SEQ ID NO: 6830256 - DNA, 100 bp, Homo sapiens
gccacttaacttgcagttccttttttttactatagtccagccctttttctgttgagaaagggctattttgaggtagaagcaattgcaattgtttattggc

SEQ ID NO: 6830257 - DNA, 57 bp, Homo sapiens
tgtgtgcaagtgacattagaaaagcaaaagctcaggataaactgtgacttgtggaca

SEQ ID NO: 6830258 - DNA, 77 bp, Homo sapiens
agaaaattttcttacagaagcagagtttatgaatgaagggtgaaagctgaatcattccacactgcaggaaatattct

SEQ ID NO: 6830259 - DNA, 76 bp, Homo sapiens
gagggcccggcgcctagaggccgcttatctgctcccaagcacgtgacccgatccctgggaccaatcgccgggcctc

SEQ ID NO: 6830260 - DNA, 128 bp, Homo sapiens
actagtggtacatttgattgaatcagaaaaataaacaaatctttcctgtgggagaaaacaaagtctctcagggaatgtgatacaggaagagtgatttggtttgtggtcatggttgaagtgccacaggt

SEQ ID NO: 6830261 - DNA, 64 bp, Homo sapiens
tttggagatgtacaagtaaaatatgtgtgttcttcattgcacacatctatattgcatctgcaga

SEQ ID NO: 6830262 - DNA, 76 bp, Homo sapiens
gttgttgtttttgagatggagtcttgctctgttgcccaggctggagggcagtggcaccatctcagctcactacagc

SEQ ID NO: 6830263 - DNA, 68 bp, Homo sapiens
cctttttctagagattttgtgaagtatcagaggccatcatatgcttctaattttttacagaataaagg

SEQ ID NO: 6830264 - DNA, 69 bp, Homo sapiens
gtcgcttgaacccaggaggcagaggttgcagtgagccgagatcgcgccactgaactccggcctggcgac

SEQ ID NO: 6830265 - DNA, 103 bp, Homo sapiens
tgggtatgattttcctggaaatgcatgtaacagtgttatgaactcattcttaaaagagttcatgccttttgatgtaataattttacttctaggaatatattca

SEQ ID NO: 6830266 - DNA, 74 bp, Homo sapiens
ggtgtggtaatcttttatgagcgttctgacagcatccttctgtcatatgttgatgaaagagacaaagaaacacc

SEQ ID NO: 6830267 - DNA, 70 bp, Homo sapiens
gaagctttaactattatgaatgcctgggtaccattctgatgtaatgggcctgggttgtaactagtgcatc

SEQ ID NO: 6830268 - DNA, 64 bp, Homo sapiens
cagagcactgcttggaggatttgcagcttactcatctgtttatcagttcttcagtagtgtgctg

SEQ ID NO: 6830269 - DNA, 77 bp, Homo sapiens
acctaattgggcaggctggcagactgctgttcaaagacagatgaattacagcagctatcattttgtcccttttaggt

SEQ ID NO: 6830270 - DNA, 88 bp, Homo sapiens
cacttgcctgtgcagtggcacaatcatgaagttgagttccatggaaaaaggaagggtacttggtatcatgttgtgcacacagtgagtg

SEQ ID NO: 6830271 - DNA, 72 bp, Homo sapiens
gcctgtcactgcgctgcttcgtgatgcagttgtaactggagcacagcctcatgatttttagcccattgcggc

SEQ ID NO: 6830272 - DNA, 57 bp, Homo sapiens
aatttcatgtatttatcatgtaaatgtgccttatttgcaaaagaaaagcatgggatt

SEQ ID NO: 6830273 - DNA, 100 bp, Homo sapiens
tgtaaacattttccaaaacaagtggtttgcatttattagtcttctgaaggagtattttagaagtcatgaaactatttgttccttgaagtaaatttttata

SEQ ID NO: 6830274 - DNA, 57 bp, Homo sapiens
gccagccagagcgtggaattggtagcgcctcctagtcccaggatgtttatggctggt

SEQ ID NO: 6830275 - DNA, 69 bp, Homo sapiens
caggcccacgaggcacacagaggcccatgaggtggcctttgatgaactcatgcttctgtgtagggcctg

SEQ ID NO: 6830276 - DNA, 77 bp, Homo sapiens
aactcaatttccctacttgtaactggaaacaagaataacagctgtttcgtagagttgtagttagggtaaaatgagtt

SEQ ID NO: 6830277 - DNA, 97 bp, Homo sapiens
gtacctttatctgtacttatggcaagtttgtgaggttaatccctttgttgaaattaaagtgaaatagacacagactgcccgttcatgataagagtac

SEQ ID NO: 6830278 - DNA, 64 bp, Homo sapiens
gtacaggcatatttctcaaagtacaggcatatttatgcttgtatttatattgaatagcttatgc

SEQ ID NO: 6830279 - DNA, 65 bp, Homo sapiens
cctgggatgtttaagcccaggctgactgatgcacagaagtcaggcttgcgatggaagtcaccagg

SEQ ID NO: 6830280 - DNA, 106 bp, Homo sapiens
tgggaggctgaggcaggaggatcacttgagcccaggagttcaagaccagcctgggcaacatagtgaaaccccctggctcaaaaaaaaaaaaaaaaaaagactctca

SEQ ID NO: 6830281 - DNA, 76 bp, Homo sapiens
tcctgctagttgggtgggagcaggcaggggcagcactcagacctggtgacccctaaacccgctgggctggctagga

SEQ ID NO: 6830282 - DNA, 75 bp, Homo sapiens
ggcccactgcaggctgtgtttataacttgaaaattatgagcaggtattgggagccacagactgtatttgggaacc

SEQ ID NO: 6830283 - DNA, 63 bp, Homo sapiens
tcatgatgagggtccctggggatgcactaagaatgcaatgccacctgagactcctcaccatga

SEQ ID NO: 6830284 - DNA, 77 bp, Homo sapiens
cacagatacctagtgaaacatataaattatctgaaatgacccaagaggaggcagatatgtttacactgactactgtg

SEQ ID NO: 6830285 - DNA, 69 bp, Homo sapiens
ggcaacgctggggctttttgcttgagatacatagccagttttctccaggactgagctccagccacagcc

SEQ ID NO: 6830286 - DNA, 105 bp, Homo sapiens
tttcaggaggcatgactggattcaggggctcaaatgaagtccaaagggcttaaattttatcccttagcttcattttcctgttttgttttgttttgttttctggaa

SEQ ID NO: 6830287 - DNA, 85 bp, Homo sapiens
gaccaactgataactgcacagcagagcctggatctgctcccatactgcttccaatggggcctctctgtcagatagtcagttagtt

SEQ ID NO: 6830288 - DNA, 62 bp, Homo sapiens
tcagcaggtctgggttaagtcctgataatttgcattactaacaagttcccagatggtgctga

SEQ ID NO: 6830289 - DNA, 78 bp, Homo sapiens
gttaggggctctgtcctgcaggctcataggctcctgcactgggcagtgggcactgggcatgtgggcacagccctgggc

SEQ ID NO: 6830290 - DNA, 130 bp, Homo sapiens
ccaaggacagatctccaagaattcaggagggaaaagcgatccctcttctttccagcccccttgggggtattcccctgggggtcttgaaagggagaggggtacctcagatgttggggataaggctctttgg

SEQ ID NO: 6830291 - DNA, 58 bp, Homo sapiens
gatgcgctgtggactggtgaggtgtccaggacctccctctttcagtcccacagttttc

SEQ ID NO: 6830292 - DNA, 80 bp, Homo sapiens
ggcttggttatggaggagatcacctgggaagatctttgaagcttatgaagcgatcttcccaggtaccaaatcaataagcc

SEQ ID NO: 6830293 - DNA, 77 bp, Homo sapiens
ttggccattttttgcatcctgtgtgtgaaagttggagaacttggactcagtcataaaaggatgtagcagagagccaa

SEQ ID NO: 6830294 - DNA, 66 bp, Homo sapiens
gccttgggacagccagcttcagacaggagtgaatttgatgctcattctctgggattgacccaaggc

SEQ ID NO: 6830295 - DNA, 101 bp, Homo sapiens
gtccacgtgctggatcctgccgtgcctttcttgatgtaccaacttgggagactctctattgactcctggccatgcaagatgaggagctggccagcttggac

SEQ ID NO: 6830296 - DNA, 69 bp, Homo sapiens
aatacatctagccttacaattattttggcttgtaaatgggtttcagtaagaagtgaggcaagatatgtt

SEQ ID NO: 6830297 - DNA, 103 bp, Homo sapiens
ttgcttttggctgctggaagctgtagcttttcaaaacgttcacacatttcaatgtatcgtcgatgtttttaaatagacttacagggagggtggcacacagcaa

SEQ ID NO: 6830298 - DNA, 63 bp, Homo sapiens
ccctaactttatttgctaagtagagcctagcttaggtaaatctaatgcaattagaaattaggg

SEQ ID NO: 6830299 - DNA, 56 bp, Homo sapiens
ttgtgcgagagagcaagagtgacccctcctctcactccccagtctcttcttgccaa

SEQ ID NO: 6830300 - DNA, 75 bp, Homo sapiens
agacttagatttcagagaggcttcaaatcttgctaaccgtagaggagatcatggcttctgctgataaatatgtct

SEQ ID NO: 6830301 - DNA, 96 bp, Homo sapiens
ggctctggtgacaccttgatttcagacttcagaactgataccataaatttctgttgttctaagtcactcagattttggtactttgttacggtagcc

SEQ ID NO: 6830302 - DNA, 56 bp, Homo sapiens
taccttagatagcaagagaatgcattaatgtgtttccattgtcctatctataggta

SEQ ID NO: 6830303 - DNA, 59 bp, Homo sapiens
aaatgaaaggttttaggacagcaatttaacactcagcaattcccaggaaccttttattt

SEQ ID NO: 6830304 - DNA, 60 bp, Homo sapiens
ggtgacctcagctgcccggctggccccaactccaccgcacaacgcagactgcgggtcccc

SEQ ID NO: 6830305 - DNA, 63 bp, Homo sapiens
ggtgtttcccaacagtctctctcaaaggaactgccctttgagaagctgtcttgggctcgagcc

SEQ ID NO: 6830306 - DNA, 80 bp, Homo sapiens
tagaatatatcttccatattttgaagcaggaaaatttctatttttaaagtggtcatttctgtttcagtaggtgtattcta

SEQ ID NO: 6830307 - DNA, 76 bp, Homo sapiens
gggtgtggcagccacagaggctgggatagcttggcactggggtcagggctcagccagcctgtgtgccttcacacct

SEQ ID NO: 6830308 - DNA, 59 bp, Homo sapiens
tccagctccagagagtccagctctggggtcatctatcctgggcagcctctctggaagga

SEQ ID NO: 6830309 - DNA, 70 bp, Homo sapiens
ccagatagaatgtgattagaattcagaattactttggagtagtggtgaaattcaaaacacatttgtctgg

SEQ ID NO: 6830310 - DNA, 77 bp, Homo sapiens
gggattgtggtggtgatggtgccagtagtttgtttagtatcctgagacaatgcaccagcatcttcaccagctgttcc

SEQ ID NO: 6830311 - DNA, 55 bp, Homo sapiens
ttggtcctcagtttccctatctgtgagaggacactttggggatgctgatgaccaa

SEQ ID NO: 6830312 - DNA, 58 bp, Homo sapiens
agaggccagtggctgtgctgtcatatcctaagaggcagccacgcagtcttgggtctct

SEQ ID NO: 6830313 - DNA, 80 bp, Homo sapiens
tgggatgtttccacgattatctcaaccatcaggagctcataatggttatgaagtggtagagagtggtggtggggatccca

SEQ ID NO: 6830314 - DNA, 68 bp, Homo sapiens
tgagccatatgaaagtgttaatatttggtcatttctgacctgccaaaatgacagtttcatatggttca

SEQ ID NO: 6830315 - DNA, 127 bp, Homo sapiens
ctggcgacccgcactccagcgctctctgcttccagtctggccacagcaggggcagatggcctgtcaggtctgaggaacctgctggcacgtgactgggaagtaacgggaggcgagtgcaagttgccag

SEQ ID NO: 6830316 - DNA, 104 bp, Homo sapiens
tgtacaaagcactatattggccatcctatttccgagaaggcacggaagcaagtttatgtactttcctgggaatgttaaaatgtcagctaggagtgctttctaca

SEQ ID NO: 6830317 - DNA, 57 bp, Homo sapiens
taattgtcaggttttagtatcaaggttatattcacctggtgaaagacttgagagtta

SEQ ID NO: 6830318 - DNA, 55 bp, Homo sapiens
ttcattttataaaccctgctgaaagtcaggttagcaacatggtatgtaaaatgag

SEQ ID NO: 6830319 - DNA, 128 bp, Homo sapiens
acagtcggtgacaatgtgcacatctggtatttcctgtgtgagagcaaaactgcaggactcagtgagtggtttctgtggtttgcacttgtgtatctgggtgtatgggagtgtgtagccctgctgactgt

SEQ ID NO: 6830320 - DNA, 75 bp, Homo sapiens
ataggccttaacatatggtagtgtaactgctttagctgctccaaataggttttgtgctcccaaatgtaggtctat

SEQ ID NO: 6830321 - DNA, 74 bp, Homo sapiens
tctttgcaatggcctcctgtgtgccaggcactgttacaaagcaggggctaaggacacagagagaaactgaagga

SEQ ID NO: 6830322 - DNA, 89 bp, Homo sapiens
cttgcttggtctgctgtgtgcttacttgggttttggactaagtcaaaactgcaaaatctcaggccataacacagaggagcttaagccag

SEQ ID NO: 6830323 - DNA, 56 bp, Homo sapiens
ctgtatgaaattaagtaaacagtgcttacctgtacggactgcttaggctcttgcag

SEQ ID NO: 6830324 - DNA, 66 bp, Homo sapiens
tctttttattccaaacttaccccagaggaatggagttcatcatcatctttagtttggaatgagaga

SEQ ID NO: 6830325 - DNA, 65 bp, Homo sapiens
tagtataagtacaggtgcgggtaacctcagataaatcaaggtgttatgcagctgtctctatatta

SEQ ID NO: 6830326 - DNA, 85 bp, Homo sapiens
gctggtctagcaagctcttctgtggatttgagtcctgaggcatggagttgtgtccaagggagagcagagggctacagagcacagc

SEQ ID NO: 6830327 - DNA, 129 bp, Homo sapiens
tttattcacttaatgagcttctattggcagactactgtgtcgttgaacagagaggataaagacaagaaactttttctttgtaaagccacagtccttgtctcacgacccatggttcatggtggaagcata

SEQ ID NO: 6830328 - DNA, 72 bp, Homo sapiens
gcccatgctgtgcctagagagcacccaaaaggctgacttggctactgtctctgccctagtgcgcagtggggc

SEQ ID NO: 6830329 - DNA, 67 bp, Homo sapiens
gtgtgaaaatgtgcacaatatggttcaattgatggaagtatgttgtataatcatgttttggtcacac

SEQ ID NO: 6830330 - DNA, 83 bp, Homo sapiens
aagcacagctttggtcattgtttgctggctcttctgtctgatatatttgggggaaggaagtcacaaatagtgactgctggctt

SEQ ID NO: 6830331 - DNA, 67 bp, Homo sapiens
caggaaagggcagatgctggaggagctattatagaaccttccatcactccctacacgaatcttcctg

SEQ ID NO: 6830332 - DNA, 72 bp, Homo sapiens
tgagaggccatggctgtgcagtggtgaactacttagccaaccatctctccgctggtttgccgtggcctttca

SEQ ID NO: 6830333 - DNA, 66 bp, Homo sapiens
tgtgttactgacacatttttgtccccaataagtctttttcttatagattagtgtttcagttgcata

SEQ ID NO: 6830334 - DNA, 61 bp, Homo sapiens
agagacaagaaggcagtgaggcccgtgcaggtgctgctgggcccccagtgaccttctctct

SEQ ID NO: 6830335 - DNA, 78 bp, Homo sapiens
gtggaggaggagacagcgggggctcccaagacccaggcctgcctcttgctcctgagccctgctgggacctcctgctac

SEQ ID NO: 6830336 - DNA, 62 bp, Homo sapiens
aaggagggttcccaggtcctggaggcaccagtggcccctgcagctcctgggatctcattctt

SEQ ID NO: 6830337 - DNA, 69 bp, Homo sapiens
ctgttaatctgcttgcatgatgaataaatgaataaacatgtatgtgaaatcatggtaagcaatagacag

SEQ ID NO: 6830338 - DNA, 65 bp, Homo sapiens
gagggctaagataatggctgggtaaagtaccttcttatttctagtcagccatatctagtgttctc

SEQ ID NO: 6830339 - DNA, 76 bp, Homo sapiens
atgcatgcaaagtgtctgctttgaaagagggaggattggatcaggcccatccagcagagcagtgttttgcatgtat

SEQ ID NO: 6830340 - DNA, 61 bp, Homo sapiens
cttgttcctccagtcatatgggcttgtttggggctgccacagtcaggacggggagagccag

SEQ ID NO: 6830341 - DNA, 95 bp, Homo sapiens
tctgttttgaacatatgaaaaccatctgagtcaagatgtattacatggtgattacagtctgacagatgttttgaagttgtaatgtgttcatcaga

SEQ ID NO: 6830342 - DNA, 62 bp, Homo sapiens
gctgctgtaacactaagtgcagagttatttattcagttgttgcatattagttcctcagtagt

SEQ ID NO: 6830343 - DNA, 59 bp, Homo sapiens
tgttctgcagagaagggatcagggccctaaggaaccccaggatcctggctgcatggacg

SEQ ID NO: 6830344 - DNA, 85 bp, Homo sapiens
gtttgtatatgctgataaagaagtgccattcattagtcggtagcttgtccatttgctaatgtaaagcatttgttcagttgcaaat

SEQ ID NO: 6830345 - DNA, 75 bp, Homo sapiens
aaggggatagagtatgagagattaagatcaggctgtggagtgtttgtcagttaatcaatgtggtctaaaccactt

SEQ ID NO: 6830346 - DNA, 83 bp, Homo sapiens
gtgtgtgtgtatctgtatacaagtttgcgaaactctgtagacaacatattcttctattaaatttgtgacatgtattaacatac

SEQ ID NO: 6830347 - DNA, 83 bp, Homo sapiens
gatggccaaggtcaggggctcctttgaccacttagaatcagatctggtctcagctggagtccttggtccctcctctgaccatc

SEQ ID NO: 6830348 - DNA, 65 bp, Homo sapiens
gttcatggcagttgtatgggctgtatgtgcacatagacagcctcaaagataatcatgcatagaac

SEQ ID NO: 6830349 - DNA, 84 bp, Homo sapiens
gttgctgaattcagttccctgcagctgtaggccggcggtccccatttctctgttggctgttagctaggggccaccgttagcaac

SEQ ID NO: 6830350 - DNA, 72 bp, Homo sapiens
tgaaagtggtgggcgaactcatcaattagaaggaagttagtgtaaaatttatggtcttgcctcccaccgttg

SEQ ID NO: 6830351 - DNA, 70 bp, Homo sapiens
atcaagagagcactggcatctaagggtggtaggtttgccaccattttgactgtgccagggctcaatagat

SEQ ID NO: 6830352 - DNA, 57 bp, Homo sapiens
ccagcagacacacaggcgtgggcagccttgattatccagcctgaggccaactgctgg

SEQ ID NO: 6830353 - DNA, 121 bp, Homo sapiens
tcacgaatgaagggctgtggctggatttggccaaagggttgtagtttgctgatccctgacactggcaaatcagcatctttaacaattacccctcatatctgttacagttcctgtcacgtga

SEQ ID NO: 6830354 - DNA, 67 bp, Homo sapiens
tgacatgtctgggagctagtgagctggagctacaacccaggatttgacagaccttcccagacagtca

SEQ ID NO: 6830355 - DNA, 94 bp, Homo sapiens
tctcacttccacaattacttgttagctgactgtgtagtaggtgaggattgattacttatttatcaccagttagctgactgtgcagtaggtgagg

SEQ ID NO: 6830356 - DNA, 65 bp, Homo sapiens
ctccgcggggcgagcagacggcggcaagcgcgccagcctcgccgccgcctctgccgccagcagag

SEQ ID NO: 6830357 - DNA, 67 bp, Homo sapiens
ctctttcaggtctggggctgaaacctgtcttgtttccccatcagaggcagtcccaggcccgaaagag

SEQ ID NO: 6830358 - DNA, 79 bp, Homo sapiens
gacctctgggaagccagtcctgcttccccccatgtccacccttcagaggtgctggttggctggactgcctcccagagtc

SEQ ID NO: 6830359 - DNA, 70 bp, Homo sapiens
gccactgaaggagccgacattaagaagttgggtaatttaacttcagagctgtgtggtttgacggtgatgc

SEQ ID NO: 6830360 - DNA, 87 bp, Homo sapiens
gcttctgctgagtagagatagctaagaaggtgatttttcttctcaggaaaagtacatcaaatgtttggctataaatggtcaggaagc

SEQ ID NO: 6830361 - DNA, 63 bp, Homo sapiens
tcttgcctccagaactcagtttcggagctccagagactataaaaagagagtgaggagggagga

SEQ ID NO: 6830362 - DNA, 84 bp, Homo sapiens
gtgggcagagcttgaaagtctctgcatgtaggaaaaggggaaatccacagttgctcagcacagaccaggccaggatctgcccac

SEQ ID NO: 6830363 - DNA, 111 bp, Homo sapiens
aacaatatttgctattgtttgattgcttttagagctgtatcaaagagccttaaccattgtgtgttattttttgctttatagcctctaacctaagcgtcaatatatattgtt

SEQ ID NO: 6830364 - DNA, 129 bp, Homo sapiens
ccctattgagaataaaaactagagatgagtcataaagtacagcggtaaagtcagagcttttattaatgacagtctacaaatcaccttgtccttttgttattcacttctgtctgttttataattctgatg

SEQ ID NO: 6830365 - DNA, 58 bp, Homo sapiens
gatgatgacaggcagggttaagtggtggattcagtacaaccagcgcattgtcaatgtt

SEQ ID NO: 6830366 - DNA, 86 bp, Homo sapiens
atttctatatctgtaaaacggggataatagaatccttatcccactggattgtaatgaggattaactgttgtcataggtgttgaagt

SEQ ID NO: 6830367 - DNA, 64 bp, Homo sapiens
gggcaatgctatgtattccttagccgcttcatactgaagcatgtttatatatgtattattgctt

SEQ ID NO: 6830368 - DNA, 129 bp, Homo sapiens
ttcttgtccatgtccgaccgggcccctgtgctcaccccccgcgccaggcccaggcagtgcggcgctgcttccggtctgggccaggcgagccgagggcgggagcggggcccgcgaggcccctctcgagaa

SEQ ID NO: 6830369 - DNA, 57 bp, Homo sapiens
ggctgtctgcatcccttggctgatggtcactttccatcttcaaaggcagtaacagcc

SEQ ID NO: 6830370 - DNA, 75 bp, Homo sapiens
gcctcctcctgggagctcggcgccctcaggtgctccctgagatgccagcacctgaacgacctgctccagggaggc

SEQ ID NO: 6830371 - DNA, 84 bp, Homo sapiens
cctgggaaagtgcagaccattccctggaagaatatgtaggacttgcaggttatcttggggaatgcccaggtgcgcttttcctgg

SEQ ID NO: 6830372 - DNA, 63 bp, Homo sapiens
gggagcaggctctagagctctggatgaacacctgcctatgtcttggctctgaaacttgcacct

SEQ ID NO: 6830373 - DNA, 60 bp, Homo sapiens
gcattctctgttgatgtttacctttgaaattttgaacaaagcattgtaagcagaagatgc

SEQ ID NO: 6830374 - DNA, 56 bp, Homo sapiens
cctgcctctataggagtccaccagaagacatatccttctgtgcccctagaggcagg

SEQ ID NO: 6830375 - DNA, 99 bp, Homo sapiens
ttctaaagacagatttaatattgttcgccttggttctggaacctaggtattaactgctgggacacaaaagtgaataaaataggatccttgccttgagga

SEQ ID NO: 6830376 - DNA, 78 bp, Homo sapiens
aacccctgccttccacaaacacatcctgagcactgtgtttggacagtgcttaggacgcatttgtggaaggcaggggtt

SEQ ID NO: 6830377 - DNA, 57 bp, Homo sapiens
gcatggtcagggcaccctggccccacacagagcctgcctggggccgctctgccaggc

SEQ ID NO: 6830378 - DNA, 65 bp, Homo sapiens
gcagcacagtgattcgagtcattgttttcccttcttcatctgaattttactttggtcctgtgctc

SEQ ID NO: 6830379 - DNA, 75 bp, Homo sapiens
ttttgactttgacagacacaattgatccatgaaattatatgtctttgagggtttgtttgtttgtttgagacagga

SEQ ID NO: 6830380 - DNA, 81 bp, Homo sapiens
tgactgtggtggctgctgggttttggaggctgtagttcaatatacggaaccttacctaccagtggaggcaggccaaggtca

SEQ ID NO: 6830381 - DNA, 79 bp, Homo sapiens
gacaccaccttgtcagccttgctttagcggttacatgtaaactagcttagacaggactgatgtaattcagggtggagtc

SEQ ID NO: 6830382 - DNA, 115 bp, Homo sapiens
ttttttattttcctttctactttgtagttacttgcattgttgggcagtgatttttaagtcaaactgcctaggaagcagaattcagtgactgcttttagctctatgtgatgaaaaa

SEQ ID NO: 6830383 - DNA, 60 bp, Homo sapiens
accttcgcactgtattcatgctttgggacttactgctgtaatgatgtcagtggcggaggt

SEQ ID NO: 6830384 - DNA, 81 bp, Homo sapiens
gtgctggggaggggctgttgcctagcagtaggccgcggggtccctgcaggctccctaagtcagcagccccctcacccacac

SEQ ID NO: 6830385 - DNA, 63 bp, Homo sapiens
tagaatcttagcatcgatgtgattgtctgagtggatttcaaatgcaatggcgtgctagttctg

SEQ ID NO: 6830386 - DNA, 69 bp, Homo sapiens
tgctttcctgattcagtggcaggctggaccccagtggcagggcaagtgtctgtggtgagcaggagagta

SEQ ID NO: 6830387 - DNA, 55 bp, Homo sapiens
tccaagaatcagtctcttttgggggaaaataatccaacagaggcagatacttgga

SEQ ID NO: 6830388 - DNA, 89 bp, Homo sapiens
ggcattcacaggagcgtatgtttcccaagctacatttctgtaagtttcaaaactttaaagcagaatggctatggtaatatcctaatgcc

SEQ ID NO: 6830389 - DNA, 86 bp, Homo sapiens
ttattttctgatttgatagtgtaaaatttccatctgctttcactttggagcagtttggaaaatactagaaaaaaattaggaggtaa

SEQ ID NO: 6830390 - DNA, 109 bp, Homo sapiens
gctgagtagttaaagaagacatttggtttttggtgttcacagaggccatttcattgtgcctatgagaaataaaatcagttgttggaaagttttacacaaaccactcagt

SEQ ID NO: 6830391 - DNA, 55 bp, Homo sapiens
ttacacttttgacaaacctgagcattaagctaagggaagattatgtcaagtgtgg

SEQ ID NO: 6830392 - DNA, 71 bp, Homo sapiens
ccctgagaaagaggaggagacggggcggggcccaggacgggatccttgcccgctgcctctgagtttgtggg

SEQ ID NO: 6830393 - DNA, 84 bp, Homo sapiens
gtagagaacctcatcatgagatttgagaatagctttagagttactcttgggatagtgtctcatggccctgtgagggaactctac

SEQ ID NO: 6830394 - DNA, 96 bp, Homo sapiens
tcatttaactgagaaagttgtgcatgcagatttgctgagataatctgggtgaattagctcagcaaatctgcattcacaacttcctgacataaatga

SEQ ID NO: 6830395 - DNA, 74 bp, Homo sapiens
agccagaagttcaagatcaaggttccagcagggttggtttcttctgaggcctctttccttggctttagatggct

SEQ ID NO: 6830396 - DNA, 68 bp, Homo sapiens
cttctctctaggcagtttcctcagtttggtgtattaaattgcctgtcaggaagctgcccagatagtag

SEQ ID NO: 6830397 - DNA, 72 bp, Homo sapiens
gcaaatgcaaacaagctgcctgaagattctttcaagattctttagtccagctctgtgctccttgcattttgc

SEQ ID NO: 6830398 - DNA, 56 bp, Homo sapiens
atggcctggggagcatgggaagaaggctcagctcttccagctaagaccccagacat

SEQ ID NO: 6830399 - DNA, 64 bp, Homo sapiens
tgcctgggcttttctggaaactgctggggcaggcccaccagaagtttgaatgagagcctgagca

SEQ ID NO: 6830400 - DNA, 81 bp, Homo sapiens
tgccaccatgtcacctaaccaggggccagcagacagtggcttccactttggtctctgcccctggtgttggcagaggtggca

SEQ ID NO: 6830401 - DNA, 62 bp, Homo sapiens
agttcacagaatagtgccccacacttagtaagcactacctaggggtagctattgctggaatt

SEQ ID NO: 6830402 - DNA, 66 bp, Homo sapiens
gtgcctggggttggcaaactgctcagagaagtatgtttgtgacctgagcaaccatccccagggcat

SEQ ID NO: 6830403 - DNA, 103 bp, Homo sapiens
agaggagtaataaataatatcagtgttgtgtatgataatagctgatgtgcatgtgccagtcactggattaagcattgacatatattatttcatttaatcttct

SEQ ID NO: 6830404 - DNA, 123 bp, Homo sapiens
cccaggccaatgaaaaaatccagctttgtattccccattcaccctcaagcccaatcaaactgaatcgagatgtggcaggtgtgagctgtaaaggaacagaccctggtgcccagctggtctggg

SEQ ID NO: 6830405 - DNA, 58 bp, Homo sapiens
ggttggcaagaaatgaggagagctgagactggcttggaatccctcagtctgccaggcc

SEQ ID NO: 6830406 - DNA, 129 bp, Homo sapiens
tatttttttattgctggctggatcttaggcaaaataagcctctcctgtttccccagttgaggacaattgagaaaggcttatgtttgccaaagaatatctcatgctagcaacaaaacttttaaggaaata

SEQ ID NO: 6830407 - DNA, 95 bp, Homo sapiens
gagactaatgtgtgtgtgtgtgtgagagtgtgtgtgtgtgtgtgtgtatatatacacatctttttaaatattataccagctaagcgcagtggctc

SEQ ID NO: 6830408 - DNA, 79 bp, Homo sapiens
gttgccgctgcaagtactcgcagctgttggcgctggctggccgcagccgggacagcaggtgggctttgcggatggtgat

SEQ ID NO: 6830409 - DNA, 91 bp, Homo sapiens
attcctattttattcagcttagaatgtgagcccttctgcacaggccatgccggtctgagcacatcacacagctcagaataacgtaaggaat

SEQ ID NO: 6830410 - DNA, 87 bp, Homo sapiens
ccagctcctggacagaggtggcaaggcggggggactcaaaggtctttgagggactcccggccctgccagccacgtttcaggccctgg

SEQ ID NO: 6830411 - DNA, 75 bp, Homo sapiens
aaatatgtagatattaagtcttttgctgtcataggtgtttaaaatatatgtgtatgtagatgtatctgtatattt

SEQ ID NO: 6830412 - DNA, 76 bp, Homo sapiens
ttgaggggattctaaagtggtggcagggtttggtttcttgaccaatattactgatattcattatggagctccttaa

SEQ ID NO: 6830413 - DNA, 65 bp, Homo sapiens
agagaagtgttccatgtttgaggtagttggcaaatgctaagctacctatgtggtgacagttgtct

SEQ ID NO: 6830414 - DNA, 88 bp, Homo sapiens
aaggacgagaattcagtcaggactgaggaacttgaggcagggactcatacagcaccagaatgttctctccagtcctggattctgcttt

SEQ ID NO: 6830415 - DNA, 69 bp, Homo sapiens
ttactcaacatttaacagtgaaaaagtggaaaaatccagctttcatagctgaaaatgttgaatatgtaa

SEQ ID NO: 6830416 - DNA, 68 bp, Homo sapiens
ctcggtggacatttcagaggtgtgtccatactttatgtattttatcactgtttgaaatggccaaagag

SEQ ID NO: 6830417 - DNA, 63 bp, Homo sapiens
ctgaatggctacttcagaggacaaatccttaaggaggtgatgagtcactgcaggtgctggcag

SEQ ID NO: 6830418 - DNA, 65 bp, Homo sapiens
ggctgctgtttcagagactgtttatttgacttagaacaaagctcaccattctcaacagcactgcc

SEQ ID NO: 6830419 - DNA, 106 bp, Homo sapiens
gatctctgattggttgtgggccagtgtggccaggtgctggtacttgtgctccaggtccttgtacttgctggccagctgcagcatgtcggctgtctggttcaggatc

SEQ ID NO: 6830420 - DNA, 65 bp, Homo sapiens
tgtagatgtagagatagaggtactcttacagatatatgaattcctcattatctcatacaattata

SEQ ID NO: 6830421 - DNA, 60 bp, Homo sapiens
gctttgcctgccatatggggtctgttacataacttaactctgctattgcagtgcaaaagc

SEQ ID NO: 6830422 - DNA, 59 bp, Homo sapiens
gtctttactcgtgacaatgtccttgagttgatttttctcagaacatgtttgagtaagac

SEQ ID NO: 6830423 - DNA, 59 bp, Homo sapiens
actaaggaattggagcatgtgttcatttaaaggaagaacatagcattccattcattagt

SEQ ID NO: 6830424 - DNA, 74 bp, Homo sapiens
gtgcacgtgggtgcacagatgcatgtctgtgtgcgtgcgtacatccatgcatgtctgtgcacgtgtacgtgcat

SEQ ID NO: 6830425 - DNA, 107 bp, Homo sapiens
tttaaatctgcatgtggggactactttatctcagtgtacaggatgataaaatggaaattggtgtcacattctgatgtgaggtgagaaaccataatgtggaatttgaa

SEQ ID NO: 6830426 - DNA, 67 bp, Homo sapiens
gagcagctctgggtgacccagttaggaagtcagcaggtgtgtgacctggctcatccaggtgttgctc

SEQ ID NO: 6830427 - DNA, 64 bp, Homo sapiens
gacagcatctctttttgcattcctcctattctggagaaatggagaagagatagttcttcatgtc

SEQ ID NO: 6830428 - DNA, 57 bp, Homo sapiens
gctgtggtgagctctttttctaggttctagctgagccttggatgagctttatcatgc

SEQ ID NO: 6830429 - DNA, 120 bp, Homo sapiens
tcacaatgaaatgtttctactttgcaccctttgggttcagttgttcaaccagttacaattagttagattagtaactggttgaacaactgtaatcaaagagcacagattgacttgttgtgg

SEQ ID NO: 6830430 - DNA, 65 bp, Homo sapiens
ttaggcagtcgtgtgtgtgtccgtgtgcgaatgtgtatttgtgtgcacatggcctgagtgcctga

SEQ ID NO: 6830431 - DNA, 66 bp, Homo sapiens
ctcttcctatgttcattttaagagccctcatttgtctctattccagctacagtgaaccaggaggag

SEQ ID NO: 6830432 - DNA, 113 bp, Homo sapiens
cctcactccctggctgctcctgtgcctgcactccctctagttgcattctgttcctgacaagtctaacatttatagggagtatagagagcagagtaggtcctgggagtttgagg

SEQ ID NO: 6830433 - DNA, 116 bp, Homo sapiens
ttcagcctgctgcctaaacagctgttgatggatagctttctccctgcagcactgctccaaaagctggtagcagagatggctgatctattcccagctgtctggattttaaggctgag

SEQ ID NO: 6830434 - DNA, 77 bp, Homo sapiens
gatgtagagggaagattttaaacatcaagagcaacactgatttgcacaaacctgtgtagatcttcctcttctgcatc

SEQ ID NO: 6830435 - DNA, 60 bp, Homo sapiens
ttgtggtttgagttaagcaacttggtaaaataagtatgtgacatttaacttaagccacag

SEQ ID NO: 6830436 - DNA, 96 bp, Homo sapiens
gtgatgaataggctgtggtatatgtaaaactgtctaatggtatattgtgtgtcaacatatgtacatttgtagtaatatcacaggcatttttattgc

SEQ ID NO: 6830437 - DNA, 57 bp, Homo sapiens
ggtttggtgaattggaaattgtggctattaactaatatttaccaactcaccagtatc

SEQ ID NO: 6830438 - DNA, 58 bp, Homo sapiens
tcaccgtgctcacctgtgttttgacaaaatgtgacatagggcaaaagagtagggatga

SEQ ID NO: 6830439 - DNA, 57 bp, Homo sapiens
gcagagggcaggggtgtttgttcctttccataactagacaccactgcacttcagagc

SEQ ID NO: 6830440 - DNA, 127 bp, Homo sapiens
ttctgttaatgttacttttcagctttaggggattctaagttgggatgatttgaacttattcaaataaatccaaatcatcccaactgagaatcccctaaaggtgaaatgttgaatgtgacattcagag

SEQ ID NO: 6830441 - DNA, 55 bp, Homo sapiens
ttctagtgagttcccaggggatgttcatgctgctcttctcaggaccacactagga

SEQ ID NO: 6830442 - DNA, 65 bp, Homo sapiens
gtggaactggtgagagttcacgggaggaggtcagaagctctccaggtgatgatctgaccggccgc

SEQ ID NO: 6830443 - DNA, 82 bp, Homo sapiens
ttcagtgttctggaaatctgactgtcactaactaagtctagttccactcacagacacagtcagtttcacagtctgcattgaa

SEQ ID NO: 6830444 - DNA, 68 bp, Homo sapiens
gagaggctgtgtgccattgttgctagaggattgaaaagtatttcacacaggctgcgcataagcttctc

SEQ ID NO: 6830445 - DNA, 63 bp, Homo sapiens
tggaagaacttgtgaaatgccagataatcttaaaggagggcatcaggtattttatgcttacca

SEQ ID NO: 6830446 - DNA, 62 bp, Homo sapiens
gttttttgctctttaatacattttcaagtaggtatttgtaaatatgtctgagggcaaagaat

SEQ ID NO: 6830447 - DNA, 56 bp, Homo sapiens
cctagggatgtgttagccagatgggcctgggaggtctcgggttggcttatcccagg

SEQ ID NO: 6830448 - DNA, 78 bp, Homo sapiens
ctacccgcaccggggaccccagtctgaaatcctggcatttatttaaggatgcagctggtatcccatggattcgaatgg

SEQ ID NO: 6830449 - DNA, 78 bp, Homo sapiens
gggcatgagcccccacctgtttgttgtattgtgagtctcttcgcaaagacaatttgaatagcttgggtcgtttttccc

SEQ ID NO: 6830450 - DNA, 70 bp, Homo sapiens
ggggagtggtaggagggatcagagtccagatctagactctgcctgaacctcctgcaagcctttcaccccc

SEQ ID NO: 6830451 - DNA, 56 bp, Homo sapiens
tcttcaccataatgcaaagtgggatttagtgggattttgctttaagatggagagga

SEQ ID NO: 6830452 - DNA, 68 bp, Homo sapiens
cattgccactattttcccacctttctctttacacccctttaaggagtatcatggccagatgtggcgtg

SEQ ID NO: 6830453 - DNA, 80 bp, Homo sapiens
gtctcattgagtgctgagcccacttccttgcacactcctccgtggtcccaggaaggattcggcatttctaaactggagac

SEQ ID NO: 6830454 - DNA, 60 bp, Homo sapiens
cttggtcgatgggctggtgcattgaacacatgcatgtgcttggtgccagcctgtcccagg

SEQ ID NO: 6830455 - DNA, 70 bp, Homo sapiens
gcccaagctgagccagacaggtaagcagagactttcactgcagtgatgcttctggctcagccccaggagc

SEQ ID NO: 6830456 - DNA, 101 bp, Homo sapiens
gatctggaaaatagcaggaagataagagggaggtgcctcagtcccgtgggcagttggtgactcaggcaccttcctcttatctgcctgtgggcacccaggtc

SEQ ID NO: 6830457 - DNA, 58 bp, Homo sapiens
tttcctttatgacatcaccactctgcaggaaggggctgaggtggggtaagagaggaga

SEQ ID NO: 6830458 - DNA, 57 bp, Homo sapiens
attgtatattcaagcctaatctatgccatacagtgttctaggggctggagatacagt

SEQ ID NO: 6830459 - DNA, 129 bp, Homo sapiens
gcagctgctactccatcccctgctgcactaaattgacacttgggcaagcaatggctctcgtcagtcactccgaagctgctacttccagaagtgtcgatttagtgcagcgggggatgaggtgccagctgc

SEQ ID NO: 6830460 - DNA, 71 bp, Homo sapiens
agctagaaagatcatgcaggtttctcctttctgaatgaacagagtgagagaatctgatgcatccattagct

SEQ ID NO: 6830461 - DNA, 68 bp, Homo sapiens
gcccctggcctggaggaagttcctgctggatcctttacttcccagaaactgctcccctggtaggcggt

SEQ ID NO: 6830462 - DNA, 57 bp, Homo sapiens
gactattgcacacttctctcaccccgctcgtgggtcttagaagggctggcaggagtt

SEQ ID NO: 6830463 - DNA, 86 bp, Homo sapiens
catgtgggaatcaggatcatgctgggtgggaaaaacaaccttctcatttgtgttatccctgtgcctatatgtgctgattctccatg

SEQ ID NO: 6830464 - DNA, 72 bp, Homo sapiens
ccaaaatcattgattaaacaggcatattcaacattaaagtgtgtgtgtgtgtttaattaaaattgattttgg

SEQ ID NO: 6830465 - DNA, 82 bp, Homo sapiens
ttagaagtagttgcaggctgatgagtttggtttttgttaacaaagaacaagagctagactttgtcaggaggcagccacctaa

SEQ ID NO: 6830466 - DNA, 71 bp, Homo sapiens
ttcaaatacatataatttttggttagctcaatagtatttatattattgatacccaagtgttatgggttgaa

SEQ ID NO: 6830467 - DNA, 75 bp, Homo sapiens
cttggccaccagccatgcacaaaccatgagagtagaagagatgtcttatggcaattcaggcttaaagtggttagg

SEQ ID NO: 6830468 - DNA, 55 bp, Homo sapiens
tgaaagcagcaccaataccattgcggccgcctgagtgcctgagtgcttgccttca

SEQ ID NO: 6830469 - DNA, 68 bp, Homo sapiens
tgtaaattcagaagcacaaaacctagagttcaccaagactcttagagtgacatgttgctgaatggaca

SEQ ID NO: 6830470 - DNA, 62 bp, Homo sapiens
tctagggctctggtgggctctgttttcactcactctgttgatagaattctcagagcccagga

SEQ ID NO: 6830471 - DNA, 89 bp, Homo sapiens
ggagaattgcttggttggaggcggaagttgcagtgagccaagattgcgccactgcacctcagcctgggcgaccgagcgagactatctcc

SEQ ID NO: 6830472 - DNA, 62 bp, Homo sapiens
tttgttgcgtgaggaaatgagtgggaccttaaataaaggcatgcattcctccatccaacagg

SEQ ID NO: 6830473 - DNA, 78 bp, Homo sapiens
aggcaggaaggtggggaggagcaaacactgtgttcagggacccctgagtacaagcagtgctttctccccacctcccct

SEQ ID NO: 6830474 - DNA, 72 bp, Homo sapiens
gagaaggtttaatgagacagcttgtcagtgaccagcaccgggtaggtccccagcagtggctgcttccttctc

SEQ ID NO: 6830475 - DNA, 98 bp, Homo sapiens
atttgctgggaggctggaaaccctagttctgtcattggctggctagatgaccttgaacctagctgtgggcctgggagagctgttagcctctggcaaat

SEQ ID NO: 6830476 - DNA, 89 bp, Homo sapiens
ccctaatacccagaaaaatacttgacactggcaagtggcagtcggcactcaatgaatgtctacaccgtatgttgttgttttctgaaggg

SEQ ID NO: 6830477 - DNA, 81 bp, Homo sapiens
ggcaccaggccaggccaggcctcggccactgcttccactacaggcagcagggaggcccagggcactggccgaggccctgcc

SEQ ID NO: 6830478 - DNA, 81 bp, Homo sapiens
ggtgggtcctgggttggctctgcagcagtgtgcgtgctcattataggtaagacctgcctgcagggctggaggggatttgct

SEQ ID NO: 6830479 - DNA, 115 bp, Homo sapiens
gggagggcgctgtgaccagcgcactcaggcaccaagtgtcggcatggctcactgtgctgggtgaaggcctccccgagcattaggtcctccacggggctgtgtcaaatgccctccc

SEQ ID NO: 6830480 - DNA, 83 bp, Homo sapiens
gcaaaagtctgatcttgagttgtcaaagtctacatctgttaacagagctaggaatgaccactctcccttggacagactcatgc

SEQ ID NO: 6830481 - DNA, 56 bp, Homo sapiens
ggagccagctacatggtctgcaaatgggcacatctttgagtccaggtactggttct

SEQ ID NO: 6830482 - DNA, 80 bp, Homo sapiens
aggtttgaagagctgtatgccatatgattgcatatgatgccacagggatgccaatcatatggcatagagctctgcatcct

SEQ ID NO: 6830483 - DNA, 109 bp, Homo sapiens
gtgagagggaaaataagattttcttgtaggggaaggatggtaagacataaccttcacgttatgcttcctcccttccactcaaaatggcccatttttattttccacttac

SEQ ID NO: 6830484 - DNA, 63 bp, Homo sapiens
tgttagacatgcagaatctcaggcaccatccagaactgctgagtctgaatctgcattttcaca

SEQ ID NO: 6830485 - DNA, 61 bp, Homo sapiens
atcatttgtaagcatggcgttggaagaaaagtttgtccaaattagccgtggttatagaggt

SEQ ID NO: 6830486 - DNA, 55 bp, Homo sapiens
ccgccgggcactgctgaagctgcttcgtcacagccaatggtgagtgtccaggtgg

SEQ ID NO: 6830487 - DNA, 71 bp, Homo sapiens
cagaaggggtctgtctgagccagaccagggaaagctcagatccatgcgatggcgtagacaaatccctcttg

SEQ ID NO: 6830488 - DNA, 66 bp, Homo sapiens
ttctgtgaatcatggataaatagcttaactttggttgctattgtttcccatgatttaactttagaa

SEQ ID NO: 6830489 - DNA, 75 bp, Homo sapiens
gatgtttagttatacagttttgggtctgctatgttgatggctcctctttttaaaactgtatacataagtaatatc

SEQ ID NO: 6830490 - DNA, 92 bp, Homo sapiens
aaaaagcagcatgtacttggataagacaaacctagggcttccttcgagttaaggaacagtcttggaagtcttgttatagttaatggtttttt

SEQ ID NO: 6830491 - DNA, 60 bp, Homo sapiens
agagccaattcatgatggtggtgagttctgcctcatggcagcaagaatcaggaaggctct

SEQ ID NO: 6830492 - DNA, 68 bp, Homo sapiens
aatggagaaaccaaatcggactgtgcctctacactgtacactgtagaaggcccattcatttgttcatt

SEQ ID NO: 6830493 - DNA, 112 bp, Homo sapiens
cagatctagctccattctccttcattccctaaagacaataggaaagttgttgtacacagcagattttactgagggttttgatgatggaggagagtgccattatcctagtctg

SEQ ID NO: 6830494 - DNA, 55 bp, Homo sapiens
gcttagcaaacatctgtagtccaattactgtcaacagtttacaggtgttgagagc

SEQ ID NO: 6830495 - DNA, 71 bp, Homo sapiens
gctctgtcaccaggctggagtgcagtggtgcgatctcggctcactgcaacctccgcctgctgtgttcaagt

SEQ ID NO: 6830496 - DNA, 77 bp, Homo sapiens
gggtgaaggagggttggggcctggggatgggttctgggcaaagacccatagtctctgggcccagaccttccttattc

SEQ ID NO: 6830497 - DNA, 110 bp, Homo sapiens
ccccacaatatcttctttctatcttttggatgtctgcatatgatatggcttggaaccgtgtccccaccaagtcttctgtcaaactgtgacttctaatgctggaggtgggg

SEQ ID NO: 6830498 - DNA, 77 bp, Homo sapiens
tgccagatcaatgcttcaggctccttatagtcaaacctgttttcctgattataaggtagaccctgaggcttttagca

SEQ ID NO: 6830499 - DNA, 58 bp, Homo sapiens
gatttctcaaaggaatagagtgatgtgaaagctcacggtctattcgttggagagtttc

SEQ ID NO: 6830500 - DNA, 75 bp, Homo sapiens
agggcccaagcaacattctctgtggcattagtgcctgaaacggcagcaagtaaaagcaggtgtgctgggcgccct

SEQ ID NO: 6830501 - DNA, 57 bp, Homo sapiens
cacttggagtttttacttgtatttaaaatttaaagcagcaagtgaaaactatgggtg

SEQ ID NO: 6830502 - DNA, 61 bp, Homo sapiens
caggaggagacatactataggaatatagttattaaattacccttcagacttgtcttccctg

SEQ ID NO: 6830503 - DNA, 98 bp, Homo sapiens
cttaattttgattgagaattctagtgcaaagaagtctggtaagtgtagattttttagctcaccagtgtctgtggtatagaaaggcagtttagagggag

SEQ ID NO: 6830504 - DNA, 57 bp, Homo sapiens
gttcattctgaaaagcagcttgctgacaggggtgtgtgctagctgcaatagaggaac

SEQ ID NO: 6830505 - DNA, 57 bp, Homo sapiens
gggtctttggctcccacctcttggtgaatctctaggatctgtgagtgctgcagactc

SEQ ID NO: 6830506 - DNA, 55 bp, Homo sapiens
atgcctggactgacatgcactgctcacaagctgaagcactgtcttcttcagggat

SEQ ID NO: 6830507 - DNA, 95 bp, Homo sapiens
agaccctctggctccttcgaggcctgcaggggcattttcaccttccctaatggcaggggtgctcctggcggcctctttggtggcaggagcagtct

SEQ ID NO: 6830508 - DNA, 67 bp, Homo sapiens
cagtgccaagccacagatcactgctaattccaaggcagagcttacttgatttgtgcccatggcattg

SEQ ID NO: 6830509 - DNA, 65 bp, Homo sapiens
tgacagagtctcattccagccctgttcacatgctcggtggttgtggaaatacagactccaagtca

SEQ ID NO: 6830510 - DNA, 117 bp, Homo sapiens
ccctgcagtgtcttcacatcagtgttcaggcaggcagagggcaaatgcaggacagcaaagctgcatttcagaaggttcgtctgctgcctccagtggacagaaagcacatgagcaggg

SEQ ID NO: 6830511 - DNA, 67 bp, Homo sapiens
tttagatgtttaatccggctgttttaaatactattcccattttgttacagtatattagatatttgaa

SEQ ID NO: 6830512 - DNA, 58 bp, Homo sapiens
ggtttgtgcaagagggccaccttaggtctccttgaggacatttatcttggcgcagatc

SEQ ID NO: 6830513 - DNA, 62 bp, Homo sapiens
gtttagatgaaagtttgtttcaactatttttgacaattagagtgggactgacccatctgagc

SEQ ID NO: 6830514 - DNA, 75 bp, Homo sapiens
ccaggttagagatatttgaggctctttaagcatgaaaatgcccctcattaacacaatgtcatttcttagccatgg

SEQ ID NO: 6830515 - DNA, 66 bp, Homo sapiens
gtctgttcagggacccgcacaggtagcatgcctggtagcacacctttaggtgggtcccatggtgac

SEQ ID NO: 6830516 - DNA, 57 bp, Homo sapiens
gcctctaccagataacaagccagaccacccatcactggcttgtcatgtatctgaggc

SEQ ID NO: 6830517 - DNA, 83 bp, Homo sapiens
cagctgagttatgtcatttctctgagcctcagtttcccatctgggaagctgggggtagtgagaaataaggaagatgacttctg

SEQ ID NO: 6830518 - DNA, 72 bp, Homo sapiens
tctctagagtatgccacagggcccttagatccttttacccttaaaaattagaagggccttggggtctgggga

SEQ ID NO: 6830519 - DNA, 75 bp, Homo sapiens
gtgtggaagccgggacactttgcactgtgcagcatcttgggcagcattgcagttccctctcatgggcaatcacac

SEQ ID NO: 6830520 - DNA, 63 bp, Homo sapiens
cttctctggctcctcagcgcccaggacctccctgatgccggggtggggaaggggccggggaag

SEQ ID NO: 6830521 - DNA, 66 bp, Homo sapiens
gaggctgggcatccatccatgagacagattctcctgtttggttggaaggatggatagctcagggtc

SEQ ID NO: 6830522 - DNA, 64 bp, Homo sapiens
gcctctggttagcctgtgaccttggggaagtcagtaaggtctgtgaggctgtttgtccaggtgt

SEQ ID NO: 6830523 - DNA, 85 bp, Homo sapiens
tggttttcacccttggttttgcagagctgtagaggcctgtgaaagtgccacagcagccctccagaaaaagggggaaagaggacca

SEQ ID NO: 6830524 - DNA, 67 bp, Homo sapiens
ggtggatcagtcatatccaaattagcagctttctattatcctgcagggaatctgtggctggactacc

SEQ ID NO: 6830525 - DNA, 124 bp, Homo sapiens
gtgggggcagctctgatatgtgggggagccctgggtgtgggggcagctctgatatgtgggggagtcctgggtgtgggggcagctctgatatgggggagccgtgggtgtgagggctgtgcctcac

SEQ ID NO: 6830526 - DNA, 65 bp, Homo sapiens
tcatcattgtgttagggtgttcaataagcctaaatttgaagggaggacattgtaattaatgatga

SEQ ID NO: 6830527 - DNA, 86 bp, Homo sapiens
gtgacgtacctatgatctgcaggtagttgtagaattagtacattgctgtttattaaaacatacattgcctcattggtaagggtcac

SEQ ID NO: 6830528 - DNA, 63 bp, Homo sapiens
tcctgattctgttagctctcaggctggccttgagaaggaaagagagagccagacagcatagga

SEQ ID NO: 6830529 - DNA, 83 bp, Homo sapiens
ttacacattcgtgtgggcatgcctgcgcagtgcatgtatgtttacatgtagtgtatatggggtgcaaaagcaattatgtgtgg

SEQ ID NO: 6830530 - DNA, 78 bp, Homo sapiens
cactggcaactcccagatctgattgccttgatgtagcctggagctacgagaggtccttagaatctgttcttgccagtg

SEQ ID NO: 6830531 - DNA, 59 bp, Homo sapiens
gcttccacttaaggttgtacgagtggcatattagtgcatttcacaactctaggggaggt

SEQ ID NO: 6830532 - DNA, 55 bp, Homo sapiens
gcaaagacaaattagaactccttttctcaaggagacttctggttattgtatttgt

SEQ ID NO: 6830533 - DNA, 82 bp, Homo sapiens
gcggaacttggccagcttcggcaagcagactttgcgttgcagtgtagtcagcttgcccagaggccgcgagccaaaggactgt

SEQ ID NO: 6830534 - DNA, 65 bp, Homo sapiens
gcaggtgcacagtggcccccacattcatccccttgggatgtgctggaagccagctgggcacctgc

SEQ ID NO: 6830535 - DNA, 72 bp, Homo sapiens
cagcctgggtgggactgaagtctgaggggtctgtttctgacccttccctcctctcacccattctctcggctg

SEQ ID NO: 6830536 - DNA, 55 bp, Homo sapiens
tattagcgtcaggaggtgagtattagtttaaatattgacctctgttatgttaata

SEQ ID NO: 6830537 - DNA, 87 bp, Homo sapiens
acttgagttctaagtaggtcactctgccaaaggatagtaaaattaccatgttcctctgagtacagtgatggatttggaaaatcaagt

SEQ ID NO: 6830538 - DNA, 81 bp, Homo sapiens
ggtaagtcatgactgttattttgttgaagtgattttttagaatttttaaaggtttattcaacaaaatagagttatcttact

SEQ ID NO: 6830539 - DNA, 129 bp, Homo sapiens
agagtgctttgccaggctaaactcagtagtatgtggaaagagtacacaggtctaaagcctcacagaactaggttggactcttggaccttctctaactagctgggtgaccttggcaagtcaccaaaccct

SEQ ID NO: 6830540 - DNA, 82 bp, Homo sapiens
agcacaactgttatttctgaatgccatccacgtggctcagccactgagatgaagcaccattcagaagaagcaaatgtgtgct

SEQ ID NO: 6830541 - DNA, 68 bp, Homo sapiens
gagaaggaaattctcatctcatgaaaccagagaaatccctgcagacatgggagtgagaatgccagctc

SEQ ID NO: 6830542 - DNA, 83 bp, Homo sapiens
gtagagaggaatgaagtagggtgggcagttcttggggaagaaggattggcttcctttggctggtcaccttcaaagctttctat

SEQ ID NO: 6830543 - DNA, 71 bp, Homo sapiens
ttacaaggcaacacatcattgttaagcacaaatcttctgcttttgaccatggcacatgtttgcctatgtaa

SEQ ID NO: 6830544 - DNA, 66 bp, Homo sapiens
gcaatacttggttatatataatcaggggttttgtaatgaatctgtggaaaggtaaccagtaattgc

SEQ ID NO: 6830545 - DNA, 74 bp, Homo sapiens
ctacactagagatagctgcagccacctaggggctcacccctggtcgggagcgagcagctatttgctagttgtag

SEQ ID NO: 6830546 - DNA, 77 bp, Homo sapiens
ggaggttactcaagcctgccttctcctagcagaagccataattccacttctgagtaaggtatgtttgtgtagtgttc

SEQ ID NO: 6830547 - DNA, 85 bp, Homo sapiens
ttgggggaaaaaatgatctgtggaaatttcctgaggcaaactatgaagttgtttcttgatttacagacttgtctttcctagtcaa

SEQ ID NO: 6830548 - DNA, 90 bp, Homo sapiens
gggatcaggcgtcagctgtgctgtggtcatctgggggctcagctacactggatgctctaggtggctcacagatggcaggcactggatgcc

SEQ ID NO: 6830549 - DNA, 77 bp, Homo sapiens
ctctatgccctggatttcatagactgccatctaatccagttaggagaggaagtagaagtaatgaaatcaagggagag

SEQ ID NO: 6830550 - DNA, 61 bp, Homo sapiens
ctgctcagccccagactcaagagaacccctctgcacatttctggagtcattttctgagtag

SEQ ID NO: 6830551 - DNA, 64 bp, Homo sapiens
cctcctgttgtcaccaggcgtggatgcccgcatcatgaaattcatgcctgggaaggcgtggagg

SEQ ID NO: 6830552 - DNA, 56 bp, Homo sapiens
ggagcgagcaagccactgaggttaatgcacagtgagtgaccctggcatgctcttcc

SEQ ID NO: 6830553 - DNA, 83 bp, Homo sapiens
ccaggtggctctgctgatcagggcaaagcaaagcttatcagctgggctgttaatatgtctggatcagctatgaactgacctgg

SEQ ID NO: 6830554 - DNA, 99 bp, Homo sapiens
gtcccagctactcgggaggctgaggtggaaggatcctttgaacctgggatgtgaaggttgcagagagccatgatcataccactgcactccagcttgggc

SEQ ID NO: 6830555 - DNA, 56 bp, Homo sapiens
gatgagatagttaaatagcatgtttatttaataagcatgtacaatgagtgtctctc

SEQ ID NO: 6830556 - DNA, 71 bp, Homo sapiens
gatgctgaccagctgtttcctttctccggtaagtaccgactctgaggataaacaggaaaactgttaggatc

SEQ ID NO: 6830557 - DNA, 61 bp, Homo sapiens
tcaagatttcatttcagtggcacagaagatgaagcacatcctttgtgtcctagtgttttga

SEQ ID NO: 6830558 - DNA, 71 bp, Homo sapiens
agggacataagtgcacaataaatattgagtgaattaataaatactcatagctcaattgcatttgtttcctt

SEQ ID NO: 6830559 - DNA, 115 bp, Homo sapiens
tcttgaccctcgttctccctgctccagaaatccttgcggacggaatggctaagcccagagctagggccaagtcaggcagggcttctgcattggaaggggcttgagagggttgggg

SEQ ID NO: 6830560 - DNA, 67 bp, Homo sapiens
ttctgccagggcggggcaggcaggcctgggggcagaggcgggcctggcctctccccacctggcagaa

SEQ ID NO: 6830561 - DNA, 69 bp, Homo sapiens
gagtctccaatccatgcctgtcagccactctagatgacctgaagtagacaggtaagggttgggagaatc

SEQ ID NO: 6830562 - DNA, 127 bp, Homo sapiens
tggctaaggtgaatatggaggctgggcttcagacagcaagattattttagatcccatgtgctggaaggacaaagtctctaataatcttctgggcttgtagtctagacccagtgactacatcaggcta

SEQ ID NO: 6830563 - DNA, 99 bp, Homo sapiens
gcctctggcagctggggtaatttaaggcttcactggagtgggacaggtcaccgcaggttgagctataaaagctgcctccagtgtaactttgctcggggt

SEQ ID NO: 6830564 - DNA, 68 bp, Homo sapiens
gaggagcctggccccacatccagctcattcacctttaactcaggcttttcatggggctgggctgcctc

SEQ ID NO: 6830565 - DNA, 70 bp, Homo sapiens
catcagttggatgacttggaggctaggggttagatttatcttcagctgactcactcactcacaattgatg

SEQ ID NO: 6830566 - DNA, 59 bp, Homo sapiens
tgttatagtagaatcattacaactatgatcacatgcagtaatggtttcctgctatttca

SEQ ID NO: 6830567 - DNA, 58 bp, Homo sapiens
ggacagagagggcaggcttcagggtggctcatgttgccttgtcacttcctcactgacc

SEQ ID NO: 6830568 - DNA, 85 bp, Homo sapiens
attaaaaaaagcacagtaaggaatgaatcaggcaagtcctcctgcacagttgccttatttccttgctgttgttgagaaatttaat

SEQ ID NO: 6830569 - DNA, 86 bp, Homo sapiens
atcaagaaaaaggcacaaaagcagggtgaccatacattcagtttgactggaatagtcttggattgatcctgctgtcctggcttgat

SEQ ID NO: 6830570 - DNA, 94 bp, Homo sapiens
gaccaggctggcgggggagtcaggaagggaggctgcagctcagtgctcctgcagccacctcctgctctgctcactggttctgaacaacctggtc

SEQ ID NO: 6830571 - DNA, 96 bp, Homo sapiens
caagggtagaacgcacactgagatggtttctctgaactctacgaccctgagattaaggtttggggaaagaaggcgtcttaaatgttattacttttg

SEQ ID NO: 6830572 - DNA, 57 bp, Homo sapiens
gccttggccttcctaggcctgacctgttctaggcctcttagctgggaaggtcagggc

SEQ ID NO: 6830573 - DNA, 76 bp, Homo sapiens
ggctgaggcgggcgggtcgcttgaggccaggagttggagaccagcttggccaacatggtgaaaccctgtctctact

SEQ ID NO: 6830574 - DNA, 80 bp, Homo sapiens
tccaggttgacagattggtcaagagtatgaaatcggtttctcaaactgagtatcacttcttattttctgtgtgatcttga

SEQ ID NO: 6830575 - DNA, 130 bp, Homo sapiens
gggtaggatgactggaatagctctgggagtatttagttgtggacataggtctgtcccttagggccacttggagggcccaagggagtgcctggtcaacttgtgcaatccctttgctgtggctggcatgacc

SEQ ID NO: 6830576 - DNA, 72 bp, Homo sapiens
ctgaaagctttttccaaggatgtgtctctctatagaacttctttagaataatatcactgtggaacctatcag

SEQ ID NO: 6830577 - DNA, 89 bp, Homo sapiens
cagagacacatgcctgaacaccgtgtgtgtgtgcgcgtgtgtgtgtgcacacacacacgtgctcaacacgctccatgcagaatactttg

SEQ ID NO: 6830578 - DNA, 129 bp, Homo sapiens
atacttcagtgagattggaaactccgaagggatagggacttttattcctctctggccccacattatctaggaggaaagaaccccagtcaatacctgttcccatcatggtcaatttcaaaccatcatcgt

SEQ ID NO: 6830579 - DNA, 78 bp, Homo sapiens
cagacaggccagacaaattgggacattgtgttacaactcctcttgagaacaccatgcctccaaagtctggttcttctg

SEQ ID NO: 6830580 - DNA, 56 bp, Homo sapiens
tgcttgccataccccattgacttactttgaaggtaagagacaataaatgggaagca

SEQ ID NO: 6830581 - DNA, 75 bp, Homo sapiens
ttgcttgagcccaggaagttgagactgcagtgagctgtgatcatgcactgcactccagcttaggcaacagagcga

SEQ ID NO: 6830582 - DNA, 76 bp, Homo sapiens
ccactgtggtctcctgtcttggccttcccaaacgggacaggttgtgtctgaaggcaagaagagaaccatcggttgg

SEQ ID NO: 6830583 - DNA, 108 bp, Homo sapiens
cctccagggagaagccatgaaggtagcttgcttcctgagtaaacagaaattcttctggaaaagtgtgcttaggaaaggcaaggcctccatttaaaatcttccgacagg

SEQ ID NO: 6830584 - DNA, 91 bp, Homo sapiens
ggctttgaagtagagccaatgagcttaacttggcctgtggggaatgcctggcagctgtctgtggggtctctggcctgctttcaaaatagcc

SEQ ID NO: 6830585 - DNA, 55 bp, Homo sapiens
cctgagagcttttctaaaagtgattagcaaactgattcttggcttagctctctgg

SEQ ID NO: 6830586 - DNA, 59 bp, Homo sapiens
ggcagttcttgagtcagactattttggatttgaatccagcacggctacttaagaactct

SEQ ID NO: 6830587 - DNA, 66 bp, Homo sapiens
gatacccagcaaaatgcaggagagttgccttccactttctgatacccatattttgctgggattatc

SEQ ID NO: 6830588 - DNA, 119 bp, Homo sapiens
ggtctagttcatgagtaaggttttggtctctggaatgatgtgtggctagcccaaaacactggctatgttagctttaaacatgatcattcttcttcccaccacaatctgtcaaacccgcc

SEQ ID NO: 6830589 - DNA, 58 bp, Homo sapiens
gcccaggctagcgtagagtgcagcattcatagcttactataacttcgaagtcctgggc

SEQ ID NO: 6830590 - DNA, 60 bp, Homo sapiens
ccatatgttaagtatgaaaggtgaccttgttatttggacagtttttactcttaactgtgg

SEQ ID NO: 6830591 - DNA, 88 bp, Homo sapiens
gcagaagtcattggtgccagcactggcccattcctgtctggctgttgctcagcctggacaaagagtgggtatagtgaacgcctcctgc

SEQ ID NO: 6830592 - DNA, 126 bp, Homo sapiens
gcaattgacagatcactagataaaagagtttctgatgctgtgtcctagtgaaagaatcaggttttttcagttgatattcggcaagtcagtgaactaacgggttatctgaattgcccttgcaattgc

SEQ ID NO: 6830593 - DNA, 59 bp, Homo sapiens
tgagtacctgcataaggggtaatagcagaaatgctattatccaacacccagttacatca

SEQ ID NO: 6830594 - DNA, 83 bp, Homo sapiens
ccttgtttttcaaagtggctgggggtttaaatgatcatttgtgggtttgtacccatgctactaatgtcttgtttctaacaagg

SEQ ID NO: 6830595 - DNA, 117 bp, Homo sapiens
gacagcattttgtgtaactctttgcacaggggagttttatgcaacagacagaaactttctgagttgttctgattgcctgaagatgccctgttttagaggagcaaaattttccctgtt

SEQ ID NO: 6830596 - DNA, 63 bp, Homo sapiens
cgtggcctttgagtgagctcccatccctggctcctaggacgggacagctaacacagagctccg

SEQ ID NO: 6830597 - DNA, 80 bp, Homo sapiens
acaaacagtaggtgggatgggtggtaagcttaaatatctctgacgcgccatttaaaccatccatcccacctgtgggttgt

SEQ ID NO: 6830598 - DNA, 113 bp, Homo sapiens
aggatgtgggtgtgctggggaacctgagttcccactgtggattcatctgccaagtggcagggtttgaacgcaggtccacatggctcagagctttcctccacgccacaatgcct

SEQ ID NO: 6830599 - DNA, 82 bp, Homo sapiens
tattatgagcagtgtcccaatctacttttccctccaaatggaaggaatattctctgattgggactagatgattgctatagta

SEQ ID NO: 6830600 - DNA, 78 bp, Homo sapiens
tctttccccttgggcttgggcatagctttagggtcttcagcacagtcttccaaacagctagtaccaatccactaaaga

SEQ ID NO: 6830601 - DNA, 60 bp, Homo sapiens
ttctcctgagtgtgttaaaacaaaactctattacctttgtcaacaaaactttcaggagaa

SEQ ID NO: 6830602 - DNA, 70 bp, Homo sapiens
gatggacgcagccccaacaaatgggacaaggaccacatccggtgtcccatgagtggcggtcatgatcttc

SEQ ID NO: 6830603 - DNA, 58 bp, Homo sapiens
ggagacgttcccagtgatccctgttgaacttgaatgcggaacattgttaatagtctct

SEQ ID NO: 6830604 - DNA, 56 bp, Homo sapiens
cagggctgaagaaattcaaaagatatgagaaaatctttgatgaatttcagactctg

SEQ ID NO: 6830605 - DNA, 56 bp, Homo sapiens
cttctattcttctgtcaaattcaggtatgtccacagactgaacagatgagttgaag

SEQ ID NO: 6830606 - DNA, 63 bp, Homo sapiens
gatcatgcagagtttattaccatctaaacgaatatggcgagttggtagaactttgcaattgtc

SEQ ID NO: 6830607 - DNA, 77 bp, Homo sapiens
gcgcttagaagattctgaaattaacagactggactgaatattttcattttagtcctaaatttagattttcttagtac

SEQ ID NO: 6830608 - DNA, 60 bp, Homo sapiens
agcccagctttttgaggcaggcaggcggggccccacttgctcgccttcaggacttgggct

SEQ ID NO: 6830609 - DNA, 67 bp, Homo sapiens
ctgtggctgctggagagaactagcccagttattggaaaagcgttctctgtagcacacaaaggcccag

SEQ ID NO: 6830610 - DNA, 81 bp, Homo sapiens
gtctgtttctacaaagcaaaagaggcctaggtcctctgctgaaaacatcacaaggtctcttgttgggtatatgaaatagac

SEQ ID NO: 6830611 - DNA, 85 bp, Homo sapiens
tcttaaaagcatgaaggagggaaggagtcaggggagcctcctcagctcctcagactttccttgtccgtggtctttctgtgtaaga

SEQ ID NO: 6830612 - DNA, 59 bp, Homo sapiens
ttcttctccttcctggttttcaggcatgtgtgtatgctgagggaggaggaggaggaggg

SEQ ID NO: 6830613 - DNA, 66 bp, Homo sapiens
ttctgtcatgtttccattacatgtctttacatagttttggattacatgtaggaaacatagatggaa

SEQ ID NO: 6830614 - DNA, 88 bp, Homo sapiens
ggagaatcgcttgaacctgggaggcggaggttgtagtgagccaagattgcaccactgcattccagcctcggcgacagagtgagactcc

SEQ ID NO: 6830615 - DNA, 77 bp, Homo sapiens
agggtttcctggacccctgctggccactgctccacctcacatgcagaggtgaggcccagtagggcctggtctgcctt

SEQ ID NO: 6830616 - DNA, 61 bp, Homo sapiens
cccgagcgggccctggggtgaccgaggcacctatttttagccaagcctgagggcccccggg

SEQ ID NO: 6830617 - DNA, 75 bp, Homo sapiens
ggctggtaatgttcattaagggtagaatgtataaatccattgtggtgcattcatacaatgggatattatgaagcc

SEQ ID NO: 6830618 - DNA, 64 bp, Homo sapiens
tcttgagtttggcaacagcacacttaattacattgacaatgtgtagctgtgtcatttcttagga

SEQ ID NO: 6830619 - DNA, 65 bp, Homo sapiens
ctacctgaaaaggttgtggtgaaaattaaatgatataatgtataccaagtacttatttagcgtgg

SEQ ID NO: 6830620 - DNA, 63 bp, Homo sapiens
gtacctttctctgtgtgtgtgacagcatttataatagtgtgactacattacaagagttggaac

SEQ ID NO: 6830621 - DNA, 57 bp, Homo sapiens
ttcctaggtgtttacattcaacattttgtattgtgaagtatgtgagcatctatagaa

SEQ ID NO: 6830622 - DNA, 58 bp, Homo sapiens
acaacagagctggactgagaggccctgctgaaggtcactcagcctgtcccctgtctgt

SEQ ID NO: 6830623 - DNA, 59 bp, Homo sapiens
gacttattggtcttggaaggttttgtgtgtattcttgccaggaaatgaggcaatgggtt

SEQ ID NO: 6830624 - DNA, 72 bp, Homo sapiens
gttcattcttttgtggatgaagaaatggagccttcgaaagcccgtccctttctcccacaggttgatatgagc

SEQ ID NO: 6830625 - DNA, 63 bp, Homo sapiens
gagctttcttctcctttgccatgtgttttcatttctgccagacactggcactggggaagcctc

SEQ ID NO: 6830626 - DNA, 80 bp, Homo sapiens
ctgaccaagtttcttcagaagaaaagcagtgtgtgtgcttctgttcctgtaagcacactgccctttggaggtttggtcag

SEQ ID NO: 6830627 - DNA, 88 bp, Homo sapiens
tccaataagatttaaaacactcacttgcagtattcatgtggcacatcctttggagtgcacagcctgctgcagaatgggtcatattgga

SEQ ID NO: 6830628 - DNA, 90 bp, Homo sapiens
gctaagagatctgtgaatggagagaaaataaagcttcatcttcggtgacttctccgtcatctccagtggcttcacagagctgttactagc

SEQ ID NO: 6830629 - DNA, 59 bp, Homo sapiens
ccacaggtctgtattaacagagggttgggaaactcctgatcatcttgacagatgctggg

SEQ ID NO: 6830630 - DNA, 84 bp, Homo sapiens
ttgtatgacagataagaggcatttggctgtcatttgtagtttttgattactagtaaggtcaaaatgcttttgtatgttaaatag

SEQ ID NO: 6830631 - DNA, 62 bp, Homo sapiens
gctttcggggatggtgtctgagggagcatgattgttctgggcacacaggccctggttgaagt

SEQ ID NO: 6830632 - DNA, 64 bp, Homo sapiens
acagaggaccagaaatcaacacagaatgtttatggggcagtgaggaagctgtctggacctctgt

SEQ ID NO: 6830633 - DNA, 60 bp, Homo sapiens
accagtctctgcatgcctgctgtgcctggaaaaggcaatcctgcatgttagggatggggt

SEQ ID NO: 6830634 - DNA, 81 bp, Homo sapiens
ggccctggtggctgcatcctcccggtgctgctggcttttgcaacggggccggctgttggttgggaggaagcagccagggcc

SEQ ID NO: 6830635 - DNA, 63 bp, Homo sapiens
gtctcctggctcatagagcagctccaacaacacgtgcttggatgccaagtgtgccatggagac

SEQ ID NO: 6830636 - DNA, 90 bp, Homo sapiens
ccacagggaagggggctggctttctcgtgtgggtcagagaatagtttccaaggacaccacagagagtgtcagcctttgcaggccttttgg

SEQ ID NO: 6830637 - DNA, 68 bp, Homo sapiens
atggccaaagagggaatgtgattgcaccatttaaatgtatatcaggaaggtgtgagacatcctgccat

SEQ ID NO: 6830638 - DNA, 58 bp, Homo sapiens
cagccctcatctcagcttctttggcaaacctctagcagggttgctgaaacagggactg

SEQ ID NO: 6830639 - DNA, 66 bp, Homo sapiens
caggattttttaaagtccctagactggtgacctgaaccactaattagagatgattaaaaaatcttg

SEQ ID NO: 6830640 - DNA, 60 bp, Homo sapiens
gaaagtgcatgtgcccaccattagtttagcagatggaaatgtatttgggcatgccctttc

SEQ ID NO: 6830641 - DNA, 64 bp, Homo sapiens
ggtctagtgaatgtttgctgttactgttttttgttagcagcagcagccgtagccttattactcc

SEQ ID NO: 6830642 - DNA, 74 bp, Homo sapiens
ggcccatggtgtttgatgctaacccctagggcaaaagctgatcttttaggttaatcaacaaacattttttggcc

SEQ ID NO: 6830643 - DNA, 83 bp, Homo sapiens
ttaaggaaagcaaatgcctgggctccatcctcagagagtctcattcactgggtcaggatagagcccaggaatctttaccttaa

SEQ ID NO: 6830644 - DNA, 59 bp, Homo sapiens
agtaaacttgttctcatgttgcagaaatgccatgcatatcttaatagaaacaggtttct

SEQ ID NO: 6830645 - DNA, 82 bp, Homo sapiens
tcctccagcctcctatctgctttatctgagacaagtcaagtgtgtgtggcagttggggatgaagtgaggagagttgagggga

SEQ ID NO: 6830646 - DNA, 78 bp, Homo sapiens
gagtgcttctggttctaagcagtttttcttgtattaatttcgagttaattaggttagattactgtgaggtaggcactc

SEQ ID NO: 6830647 - DNA, 58 bp, Homo sapiens
ttcagccatcattacgaaatcaaaaaccactttttaagatggttgtagatggactgaa

SEQ ID NO: 6830648 - DNA, 62 bp, Homo sapiens
ggtggaggctttgactgggtaccaaggaggttctctcatttggtggctacagagtaaccacc

SEQ ID NO: 6830649 - DNA, 86 bp, Homo sapiens
tcttaagatactgaaatagtatcaacgtgttgagtattaaaaagtgacacaattgagtggtactatgccacttcagtgtactgagg

SEQ ID NO: 6830650 - DNA, 73 bp, Homo sapiens
tttcacccatgggatgctgcttgtttgctgataccactaagcaaatgaacagttgcattctctgagagggaaa

SEQ ID NO: 6830651 - DNA, 85 bp, Homo sapiens
gcgccttctatctagggatcgctcagtgtgtgaagaccctctcaggatcttcgatgtagttgacttggagatagaaaggtggcgt

SEQ ID NO: 6830652 - DNA, 60 bp, Homo sapiens
tgtgtcctaggcactaaatgtgagtcagcactgctgaagcaaaacgtgctctaggaggca

SEQ ID NO: 6830653 - DNA, 70 bp, Homo sapiens
gtcagctttgccggcctataggtgcaaacatctggaaggcaggtgtttgattttgtgggtgccagaggac

SEQ ID NO: 6830654 - DNA, 73 bp, Homo sapiens
cctttaaatgcaaggcacattccttttcttagaacagagatcaggaaactttttgtgtgattttgtgtaaagg

SEQ ID NO: 6830655 - DNA, 59 bp, Homo sapiens
ccacgttctgccttccacctgtaacccaatcattgcagctgattaaagggcagacgtgg

SEQ ID NO: 6830656 - DNA, 62 bp, Homo sapiens
tctcttcaatagattgttgagggacaaagctctatctaaatgtccctatctaactgaagaga

SEQ ID NO: 6830657 - DNA, 61 bp, Homo sapiens
gcattacacatagacattcgttcaatatccttttcctgtgtgtgtgtgtgtgtgtgtgtgt

SEQ ID NO: 6830658 - DNA, 69 bp, Homo sapiens
tttctacccgttgagagaatgcttcgattttcatgcaacaatggagcaaacttcaaaaatgggaaggga

SEQ ID NO: 6830659 - DNA, 73 bp, Homo sapiens
tgacgtcctgggactttcaaggctaggtcataacaagtcttacagtgtctgcctgaatctcttagaacactca

SEQ ID NO: 6830660 - DNA, 98 bp, Homo sapiens
gaggctgaggcactgagtgtttgagtcacttcctccatggtcacaatcttggttggttggagccagaatttgaactcaggcaatcagtctttagagtc

SEQ ID NO: 6830661 - DNA, 88 bp, Homo sapiens
gggccatgctctctgagccgccaggatattgtggcttttgctaattaaggagcggatgtgtcctgccagcgcaattagaggctggccc

SEQ ID NO: 6830662 - DNA, 90 bp, Homo sapiens
cccgcagctgctgctccagcttcgtgcggctctcatggatctcggcaatgcgggacttgagccgctcggagttcagcaggatcctgtggg

SEQ ID NO: 6830663 - DNA, 80 bp, Homo sapiens
tcttcgtgatatgctggctggaggagggaggttgtgagaacaaattgctaactgtcagactagaatcatgtctatggaga

SEQ ID NO: 6830664 - DNA, 90 bp, Homo sapiens
agctgccacttccaggccagggtattctggacagatgggagaagaaagccaaaactctgcacagagacccttgccagaaactgggtagct

SEQ ID NO: 6830665 - DNA, 56 bp, Homo sapiens
gaggcttttggctaataactgttaaatacttaatgactcttaaaagcctgagtctc

SEQ ID NO: 6830666 - DNA, 97 bp, Homo sapiens
gaggctgaagatacaggagcatggatgattgatggagcacatccctaagggagcaggaggggatgaaatccagatcacaggtggtgggattagcctt

SEQ ID NO: 6830667 - DNA, 71 bp, Homo sapiens
tgagatctgtaacaggcaatacaactctcttaatgtgatgcttcagagagtgaatgccttttatagattca

SEQ ID NO: 6830668 - DNA, 103 bp, Homo sapiens
tgcaatagttttcattctggtacatgcaaacatgtttcctctaaggtgcaatgccagaaacctagaggaaaatgtgtcttggttttatctgagaaaactggca

SEQ ID NO: 6830669 - DNA, 62 bp, Homo sapiens
agcttctccatgcagaaggctgaggtgtgctcctgttccaggcctgtgttgtgtggagggct

SEQ ID NO: 6830670 - DNA, 82 bp, Homo sapiens
gagagaatctttcggtgaccagtgatgctgaggagtgtgactaatttaaactcatgcatctgagctggctcctgcctctctc

SEQ ID NO: 6830671 - DNA, 60 bp, Homo sapiens
tggcgtctctcataagtatgtgccttttgcaggtccacaaacatatgaatgatagagcca

SEQ ID NO: 6830672 - DNA, 56 bp, Homo sapiens
tccagccctcagccaagtggaatggatggtgcttgctcatgttgggtgagggtgga

SEQ ID NO: 6830673 - DNA, 93 bp, Homo sapiens
gcaggtgtccttaagtagggagaggcaggcaaccacctgggaagatgttaaatgcacacatccccgggttctgtctgcccttggagattctgc

SEQ ID NO: 6830674 - DNA, 87 bp, Homo sapiens
gagacctattaaagctggaatcttctttggttactatgctcattaaactaaagatacatatttgttctagtgcaattgatgcttctc

SEQ ID NO: 6830675 - DNA, 67 bp, Homo sapiens
tgcaagcacagttttaggttatgcaaaatttttctttgcaatgaaaagaaatcaagagctggctgta

SEQ ID NO: 6830676 - DNA, 119 bp, Homo sapiens
gatggatcaaccagagaaccaggcgatgtaaagatcacgtcccaggactcggtggctgggcctgagccaaggggacagtgacacatttcttcactgctgcactggccttgggatctgtc

SEQ ID NO: 6830677 - DNA, 73 bp, Homo sapiens
ggcaccttggacatactgagatgggagtcctggtataaatgggcttcctcagaaaatactgtccaaccatgcc

SEQ ID NO: 6830678 - DNA, 129 bp, Homo sapiens
ccaaatacagctctggcttagcaagagttccattctgcgatcctcaagcacataagcggcatgtaaacgctaatgactctgggcctacctcgctgtccctactctcatccggggcctaccctgtgttgg

SEQ ID NO: 6830679 - DNA, 66 bp, Homo sapiens
tagttcaaagtctgtcaaaggaattaagcatctctggattgctcttatgaaaagcacttagaacta

SEQ ID NO: 6830680 - DNA, 58 bp, Homo sapiens
gccctacctccgtgtggccaacggctccagccttgtggtccctcaaggaggccagggc

SEQ ID NO: 6830681 - DNA, 74 bp, Homo sapiens
gagagacaggcaagcaaggggtcttgaaatgaaagtttgtttaacttcatggcaacttgttaactctttctctc

SEQ ID NO: 6830682 - DNA, 75 bp, Homo sapiens
gaactctgagacgcagtgttggggaacagtgggagctcccagctcagcacccagcactcagcaggctcatagttc

SEQ ID NO: 6830683 - DNA, 57 bp, Homo sapiens
gcagatctgcaccatgggccaagtttctcagaaaatacatggcttcctgcgggctgc

SEQ ID NO: 6830684 - DNA, 57 bp, Homo sapiens
gggaggctgctctcctgtctggggccagaggtccctgcatttgggagagtgtctttc

SEQ ID NO: 6830685 - DNA, 77 bp, Homo sapiens
ggctgagagtatttgtacctgtgaattcctcagcaggatttattccttgagctgtaggaatgacatgtaccttagtt

SEQ ID NO: 6830686 - DNA, 127 bp, Homo sapiens
gcggacggctgctgggaagccaatcagcgcgctcgagcctgcagcccctctgcagtagttatgccagagcgccctgtgtagagcggctgcgagcgggcagctgggctcggctgccgggagccaccgc

SEQ ID NO: 6830687 - DNA, 87 bp, Homo sapiens
gcaagtctgctcagaaagtgatgaactctgtgacctggagattaatttaaaatacagtttagtcatttattgagcaccactgtatgc

SEQ ID NO: 6830688 - DNA, 88 bp, Homo sapiens
aatattaattgctagtcaccaagtctttttgaatctataacttggctaatgcagttacatataagaagacagactgagaattaatgtt

SEQ ID NO: 6830689 - DNA, 58 bp, Homo sapiens
gccaccctggaatagccccgggaggagacatggccctcagaggcctgtccagggtggt

SEQ ID NO: 6830690 - DNA, 79 bp, Homo sapiens
gcgccttgccaccggcccgcgggcgccccacattcctgagcgggccgggagttagggccccgcggccgtgtcctggcgc

SEQ ID NO: 6830691 - DNA, 65 bp, Homo sapiens
gctggctgcgtcatcacagggctgccacttgcacctcctcagtcactgatgttacagcagccagt

SEQ ID NO: 6830692 - DNA, 69 bp, Homo sapiens
cctgcccccccgcagcagtggcccacagaagcgctggcggccttgggcacactttgctggggaggctgg

SEQ ID NO: 6830693 - DNA, 73 bp, Homo sapiens
tattttttagtgtggggcggtagtttgatgattaaactgtatctgaactttacactgctttacatgaaattta

SEQ ID NO: 6830694 - DNA, 55 bp, Homo sapiens
ggctgtgttccaagtgtcaggatcaagtggatccaatgacctattcagcaaagcc

SEQ ID NO: 6830695 - DNA, 57 bp, Homo sapiens
gtcagggtgtctggcacaaaccagtagatctccgactggtagtctttgtcccctggc

SEQ ID NO: 6830696 - DNA, 58 bp, Homo sapiens
ctttggaaatggatctgatgagtcttttaatagaagaaaatcatcattatttcccaag

SEQ ID NO: 6830697 - DNA, 73 bp, Homo sapiens
cccaggagagaggggataaagcacagaaggctccaactcactctcctaccttcttctttcctcttctcttggg

SEQ ID NO: 6830698 - DNA, 94 bp, Homo sapiens
tgcctacagtgaatccctagtggtcagagggcttatgatatattgtgagagccatgtcataagccttttggccactagggattcaatgtatgca

SEQ ID NO: 6830699 - DNA, 69 bp, Homo sapiens
gccgagtggggctgcttaggctgcgcagcaagaggttggtggcttggaagacagcctcggagtgagggc

SEQ ID NO: 6830700 - DNA, 64 bp, Homo sapiens
gctgggcacagaatagatggcccattaatactcactgatgggtttattgatttgtgtgtccagt

SEQ ID NO: 6830701 - DNA, 87 bp, Homo sapiens
tgcacgggtgtgtgtactgcatgggtgcatgctgcttgggtgtgtgtgggcagcattgcctttgcagtgagtgcagacctctgtgta

SEQ ID NO: 6830702 - DNA, 69 bp, Homo sapiens
ggcttttgagcagaggagtgacgtaggtaacttgttttgcacaattaatctggctgctgtgcttaagct

SEQ ID NO: 6830703 - DNA, 81 bp, Homo sapiens
cttcctgtcccatgtggtccccagaggaatatgagattgccacaaacatggcagctttctttggggaggtgggagagggag

SEQ ID NO: 6830704 - DNA, 66 bp, Homo sapiens
gtctctcaggaatgcatcaggcataaaaaggaaccaaaagtattgcctgctgtgttattgtagaac

SEQ ID NO: 6830705 - DNA, 79 bp, Homo sapiens
ggcaagtccctacagctgagggccattcccggctgggaaatatcagcagctggcagtcccatcagctgggaagggtgtc

SEQ ID NO: 6830706 - DNA, 59 bp, Homo sapiens
tgggttggggccgtcctgggccctgcagggtgctgagcagagtccatggcctccaccca

SEQ ID NO: 6830707 - DNA, 59 bp, Homo sapiens
tcccctgctcctttgaatgtccaggctgctggaattgatatacagaggggaacaggaga

SEQ ID NO: 6830708 - DNA, 127 bp, Homo sapiens
tctgtgttcctaccaccttcctgctggcatggtcttggcagcacggggaacgtctgtgcccggcccagaacatccccactgctacctcgtagccaggatgccactgttaggtcagtgaggaaccgga

SEQ ID NO: 6830709 - DNA, 67 bp, Homo sapiens
gatcctggacggctgcgtggaggaggcagtgttcaagcagaggtcccagggcagctgtccagaagtc

SEQ ID NO: 6830710 - DNA, 100 bp, Homo sapiens
cctcagatgggccacgtgccctcgtgggaccctcattgtcaccgtgagctctttccaaggggacgccaccagtgggggcctgggcaggaggcagctgagg

SEQ ID NO: 6830711 - DNA, 62 bp, Homo sapiens
acccaacactcacctccggattaatgagctgatatttgctaagtaacttgtgattgctgggt

SEQ ID NO: 6830712 - DNA, 61 bp, Homo sapiens
gcttgaagtgaattgataatattaaataagtaccttggatattttcagtctcctttcaagc

SEQ ID NO: 6830713 - DNA, 77 bp, Homo sapiens
gttcacctctctcttgcccacatgccacagttaaaaattaaattaagcattcagggctagagatttagaggagggac

SEQ ID NO: 6830714 - DNA, 61 bp, Homo sapiens
gccagggcttactggaggctgctttggcaaacagaggccagctagtccaggaagtctgagc

SEQ ID NO: 6830715 - DNA, 123 bp, Homo sapiens
ttcatcagcccaccagacctgggcctgctgggccccacagtcccctgggagagttgcccctacccacaacccatgggacttgggaaggcccaagccagaggtaggtgggaagctgctggtgaa

SEQ ID NO: 6830716 - DNA, 90 bp, Homo sapiens
gacagaatgaaaggttgcaggttagagacctgtggaaagtgttaattgttcacgtgtgtctggcctgtatagtatctgattaggcctgtc

SEQ ID NO: 6830717 - DNA, 97 bp, Homo sapiens
cagtgaaatgtatagggttggtacaacagtaatcaaggtttttgcccaagtaatggcaaaaacctcaattgcttttgcaccaaccaatattaagatg

SEQ ID NO: 6830718 - DNA, 55 bp, Homo sapiens
ttttcttgaatgtatgtatgttgcttcaagtcattcatgcacacattgaagagga

SEQ ID NO: 6830719 - DNA, 57 bp, Homo sapiens
accttttatgtaaatatatgttgacttgctggtttgtgtatgcattgcatgtaaggt

SEQ ID NO: 6830720 - DNA, 61 bp, Homo sapiens
cacttgaggaaatggaagccaagagacttgatcaaggtcacacagctcctttccttagttg

SEQ ID NO: 6830721 - DNA, 67 bp, Homo sapiens
ttgaactgtgtcttcctgtcctacctctgtgtacctttttagaggtgtgaagagttgacacattcag

SEQ ID NO: 6830722 - DNA, 61 bp, Homo sapiens
gtttggctatttattctcagtgaagagggaaacccttatgggagtaaatgagtggccaaac

SEQ ID NO: 6830723 - DNA, 62 bp, Homo sapiens
gcagccccagtcttgtatattctgggacgacttcttcccaggatgatcgagagtgggaatgt

SEQ ID NO: 6830724 - DNA, 130 bp, Homo sapiens
agttgtgtttgattcccaagcccaagatattgccgtctgtcaacattatcatgcttctttactttaataagagtaaacaggcatgatagtgttgaatgacaaagctccctagtggcttccttacacccct

SEQ ID NO: 6830725 - DNA, 77 bp, Homo sapiens
catgctcatgcacacatttggaggaggcttgggcctgcgttcccagtagtaggtttctcctttaaagcatgggtgtg

SEQ ID NO: 6830726 - DNA, 57 bp, Homo sapiens
gaatgcagtgacggaggcttacagtcttacatcgagatgcctcaaatcagtgcattt

SEQ ID NO: 6830727 - DNA, 93 bp, Homo sapiens
agagtgactggtaacacagaagatctcttaatgctgcaaagtattattagttgtccagctgcaaagatgatttgttgtatttacctttattct

SEQ ID NO: 6830728 - DNA, 73 bp, Homo sapiens
tcatcttccccctagttccaaagtcagtaactggagatccagacctctgactgtgagagcaggaatgggatga

SEQ ID NO: 6830729 - DNA, 129 bp, Homo sapiens
cagggaggaagtgaggcaaggctttgtgggaattatttgagccttaaagaaatttagaaggtttggaagttaaataaggttcaagttggttcttattgtgaatgtctaaactgtttttcccttccttgg

SEQ ID NO: 6830730 - DNA, 55 bp, Homo sapiens
aagtttgagagcctttagtatagtggttaggatagtaatctttggctccaaactt

SEQ ID NO: 6830731 - DNA, 86 bp, Homo sapiens
gagaaatgagcctactttaattttctgcagagacagactgtaatttgtaacatctctgatcagaaattgaggcggcatatggactc

SEQ ID NO: 6830732 - DNA, 64 bp, Homo sapiens
ctgccctgcaggttgagcagccaggttgagctgaaagcctgcacctgaccaacctgctggatgg

SEQ ID NO: 6830733 - DNA, 96 bp, Homo sapiens
aagattgttggaataaaagttatagatagtcacttgttgctaataaaagacattccttggcaacagccacatccagctaacttttgcaagaatttt

SEQ ID NO: 6830734 - DNA, 99 bp, Homo sapiens
gttggtagagatgcctctgggggctagttgtcctggtagtgaagctatatgtgttgcaggtcttcattcttgggatcagagagtcagggaggtgctaac

SEQ ID NO: 6830735 - DNA, 63 bp, Homo sapiens
tgttctccactgtcagcactctactacagataccccatctggtgcggtctgatatggataata

SEQ ID NO: 6830736 - DNA, 77 bp, Homo sapiens
gagtggccttgggcacatccctggtattttcctataaaataaagatggtgggcattaaatggccataagagttgctc

SEQ ID NO: 6830737 - DNA, 87 bp, Homo sapiens
ccaatgcctggtttgttatcattgtcgcagtctaatttattttcatgtaaatgaagcttagaagatgactggcaaacatgttcctgg

SEQ ID NO: 6830738 - DNA, 96 bp, Homo sapiens
cttcatacttagcacatttattgttgtataagaagttggcagataaagcaaaactttggttagagtcttgacacaaaaggagtttcttagatgaag

SEQ ID NO: 6830739 - DNA, 101 bp, Homo sapiens
gtgttgggtcagccctcacagatgtagtagctttattgcacattttagattgtttgtaggctaggtctactacacatatttggaaggcagtatcccaatac

SEQ ID NO: 6830740 - DNA, 62 bp, Homo sapiens
aggagaagggctgaaagaccttgggcaacatagctaacctgtctaagcctcagtctttccct

SEQ ID NO: 6830741 - DNA, 62 bp, Homo sapiens
ggcagctactgggattttgagcaagtccgtgtttgctggtcttgccagatcacagtggctct

SEQ ID NO: 6830742 - DNA, 73 bp, Homo sapiens
gacgtctgacaatacgtctgaatgcattctcatgtttaataatgagtgctgatcgaggctgttttcagaagtc

SEQ ID NO: 6830743 - DNA, 71 bp, Homo sapiens
tgagttgttctaacattttaaagtcaagggattgaagttcctggcagtaatttgatgttgctgataactca

SEQ ID NO: 6830744 - DNA, 86 bp, Homo sapiens
tctcttagctcagtaaatgaatgaatatatgcatgaatgaatacatgcgtgaatgaatgggtttgcttaacatgctaagcactaga

SEQ ID NO: 6830745 - DNA, 60 bp, Homo sapiens
cagtggtggaagagatagtgatgtgagctcatatgtaattactcagtctcccatacattg

SEQ ID NO: 6830746 - DNA, 61 bp, Homo sapiens
gtcccaaggccaggcatctagaaaagctctctccttgttttatctggcagaactttgggac

SEQ ID NO: 6830747 - DNA, 117 bp, Homo sapiens
ctgcgtggtcagttttgcatctcgcccttttctccagctttcttccttctgtctgtgctacaagtaatggacggggaagaaaagcaaagaaagaattgcagagcttggaaaattcag

SEQ ID NO: 6830748 - DNA, 72 bp, Homo sapiens
ttcaaggaatgatgacttgtcttcaattttggagttaaactcacatatttaagaaagttaaaatgttttgaa

SEQ ID NO: 6830749 - DNA, 78 bp, Homo sapiens
cttggcaggcatctctgtagccagggtcctgatgccacaacaccatgctagtcccctgggcatagagcctacaccaag

SEQ ID NO: 6830750 - DNA, 87 bp, Homo sapiens
ttctatggttaaagctttgcaatgcttcattattatccttctttattatccttggtatataatgcagcttttcaatggcccatagga

SEQ ID NO: 6830751 - DNA, 76 bp, Homo sapiens
ggcttgtggttcccttttctaacggtatggtgatttccattgtctttccccctgtcattagagaaggaccactccc

SEQ ID NO: 6830752 - DNA, 63 bp, Homo sapiens
aggccacagaggaagcagacacatcttgctggtcgattccttgcaagcttcttatagtggcct

SEQ ID NO: 6830753 - DNA, 57 bp, Homo sapiens
tgctggagtcagacaattgagttcaagtctcacttgcaagctctgtgaccttgagca

SEQ ID NO: 6830754 - DNA, 61 bp, Homo sapiens
ggaaagtccttctaaagccagagctcaggaatgagtggggccactggtgtgaagactttcc

SEQ ID NO: 6830755 - DNA, 62 bp, Homo sapiens
gattcagtgtgaagcttctgaaagccgtaatttaaggttccagaagcctccatattactttc

SEQ ID NO: 6830756 - DNA, 75 bp, Homo sapiens
gatgtcatgtatttgacagtgagttgtggatggtgctcatgtttattcacgatatgcctgtcactacattttgtt

SEQ ID NO: 6830757 - DNA, 70 bp, Homo sapiens
tccctgagctgagctcaacagcctaaggacatggatcaaaagagtcctctgctggctaaggctcaggtga

SEQ ID NO: 6830758 - DNA, 64 bp, Homo sapiens
tcagatttgtcctactaggcactacagggtaatcactccttatctgcttggagggaccttttgg

SEQ ID NO: 6830759 - DNA, 55 bp, Homo sapiens
ctgtcacctgttcactgcagcacctcgttaggtgagtagcaggccagggtgacag

SEQ ID NO: 6830760 - DNA, 114 bp, Homo sapiens
cttttaaatgtttagctgttgtaatggatgagatatggttgcttagttgttttttaaggacattttaaagaattttccagcatgtcagtcaatgccagctcagacactgaaaag

SEQ ID NO: 6830761 - DNA, 105 bp, Homo sapiens
tagaagaagttgacagtgttgtcggagcaggccagcttcctgacatcctgatggagacaataggaatgagagagtaggcttttcctacaatatgtcaaccttgta

SEQ ID NO: 6830762 - DNA, 82 bp, Homo sapiens
tattggaattttattctaaatgcttttttcatcatgcagatattacagcagtaggaaaactgtgattagaatgcctccaata

SEQ ID NO: 6830763 - DNA, 98 bp, Homo sapiens
ttgtctctaaaactagtttcatgatggcaagggccgtgacagttagaaatttgtctacaagccccactcatctttgtgaagtggttcctttaagacaa

SEQ ID NO: 6830764 - DNA, 85 bp, Homo sapiens
tggggaattgtctggaatgtttaataccatccagatgacatcatcataacctggtagtattaaatgtgactctggcactttccca

SEQ ID NO: 6830765 - DNA, 62 bp, Homo sapiens
agtcactgtttaatctagctaaacacagtgactaaagtttagctggattaatcacagtgact

SEQ ID NO: 6830766 - DNA, 78 bp, Homo sapiens
gaggtaacccgaactagggccaggaagctaaggtatttctccacagcaccctgtttatcctgagttcagggatacttc

SEQ ID NO: 6830767 - DNA, 60 bp, Homo sapiens
gggggcaagctatttgaccagttcctctgtggttagaggcactgaaggaagcttgcgctt

SEQ ID NO: 6830768 - DNA, 76 bp, Homo sapiens
cgccagcccagcctactctgccatagcagggctgacctagaatctctggacagagtgtatgagggctgggaaggtg

SEQ ID NO: 6830769 - DNA, 93 bp, Homo sapiens
acaccatatgttcatgcagcagtttttttctggtttccaagcaccattagctggaggagagagggactgtctgcacttagatattccttgtgt

SEQ ID NO: 6830770 - DNA, 129 bp, Homo sapiens
aaaactggtttaaattcatatttggcccaatgggaagggacagatgttatcatttttatgtgcagttacttctcacagtgaaaataatatcttcaatttagctttggtgcagtttttggatcccatttt

SEQ ID NO: 6830771 - DNA, 73 bp, Homo sapiens
ggagccagcgctgtagccatgaacgctttcaggaaggaaaggaagagcagtcaggcctcagagccgtggctct

SEQ ID NO: 6830772 - DNA, 69 bp, Homo sapiens
gcataaggagttctgggaaagctatctgaaagatgtaagtcaagatggttctcagaaactcaacattgc

SEQ ID NO: 6830773 - DNA, 88 bp, Homo sapiens
tatatgtttaggtttggggggaaaagggttgtctttcttagaaacacaataaatttatcctttgaatccctcctgaatcaaccatatg

SEQ ID NO: 6830774 - DNA, 75 bp, Homo sapiens
tagatgcctgtgacagtctctgtcatataaataagaatatgctgcaatttatatgaactggactttaggaatctg

SEQ ID NO: 6830775 - DNA, 77 bp, Homo sapiens
atttggtaggcattgcttcgcacaatcccatgatgccagcttgctagcatggatatgcccagggcaccctaccagat

SEQ ID NO: 6830776 - DNA, 98 bp, Homo sapiens
gctgcaggaggaaaaatcacatatgttccaaaggcaaatagaaaggtcttttgattttccaatgtcttggattatctgtgcaactttctttcagtagt

SEQ ID NO: 6830777 - DNA, 106 bp, Homo sapiens
gcactgctcccggaggtactcattcaggaaatggaattcttgtgttcataaaaatgaaggcacaggaatcttcattttttaaccagccctcccaggtgacagatgc

SEQ ID NO: 6830778 - DNA, 58 bp, Homo sapiens
agctctatcacctgtcagttgccattgctaataaaaatagcatctgcatgatggggtt

SEQ ID NO: 6830779 - DNA, 106 bp, Homo sapiens
gagcaaaagtctctgtggtggtcttctgtaagagcttagctaaggatgtgctgcatagtatgcctaaagacaggactctctgaagcttaccacagagtgattgctt

SEQ ID NO: 6830780 - DNA, 68 bp, Homo sapiens
gaccacagatcaattccttgatgaatgttcattaattatgtgtaacgaaggaagtgactttagtggtt

SEQ ID NO: 6830781 - DNA, 92 bp, Homo sapiens
gaaccaagtacctagcttgtgtctttagaaacttttcttcatgaaaaaaaatcattaataaacatttcagaagacttgcaggaacaggattc

SEQ ID NO: 6830782 - DNA, 84 bp, Homo sapiens
caagccagcagctcttccatttccttcagcctgagatcaaatgattaagctttagaaatgtaggagatactgttgagaagcttg

SEQ ID NO: 6830783 - DNA, 101 bp, Homo sapiens
ggacagctgacacagcagcctgtctgtgcttgcagcccacaatgggatgtagcccaagaggctgaaaggtagtagtaggctgccaggtcctgtgcctgtct

SEQ ID NO: 6830784 - DNA, 74 bp, Homo sapiens
aggcagtcacaaagtggttttaagaggttccttataaggcacattaaaagtagccaacaccctttccattgctt

SEQ ID NO: 6830785 - DNA, 60 bp, Homo sapiens
cattggggttgctttcagaatgttgcctttatcagcagtgatgaaatgagcatccttgtg

SEQ ID NO: 6830786 - DNA, 73 bp, Homo sapiens
taggctgtattttagatatgtttttgctaatgcagtcatcacactgcatggtaactatttgtttaaaagtctg

SEQ ID NO: 6830787 - DNA, 57 bp, Homo sapiens
gtcacttctctgataatctcagtttcccaggacatagctgagaaccaagaggaaggc

SEQ ID NO: 6830788 - DNA, 66 bp, Homo sapiens
ggtgatggctcccatgggcatatgtcatcatttgatctatggttctcattggagtcataaatcacc

SEQ ID NO: 6830789 - DNA, 66 bp, Homo sapiens
tgggggccacagacctgagtgaagtctcatgcagcggcaaaatgatcttcttcaggcttaacccca

SEQ ID NO: 6830790 - DNA, 57 bp, Homo sapiens
gggctgggaggtgagtctggggtgaaggccccaatcacccccacacctccttagttc

SEQ ID NO: 6830791 - DNA, 96 bp, Homo sapiens
gagtgaaaaagagttgggaaggaggttacattttgagcttcaacaaaatgtcctgttaaattttcccaaaatccctattaaattttttattcgctc

SEQ ID NO: 6830792 - DNA, 81 bp, Homo sapiens
ggggcaaagcttggttttgggatgtacaaaggggtcagagatgcctcattttctgctttcaaggcttcatagttttgcctc

SEQ ID NO: 6830793 - DNA, 77 bp, Homo sapiens
tcagacaggactccccagttggtcttcccttggagcaacttctctgaccttgcttcctaagcaccggctgtgtttga

SEQ ID NO: 6830794 - DNA, 63 bp, Homo sapiens
gccaggctccccggatccctggaccacctccactccagaccagacaatggggaagctgctggt

SEQ ID NO: 6830795 - DNA, 56 bp, Homo sapiens
acctagcatggttctaatatttaggaacataactgtctctacaaattatgttaggt

SEQ ID NO: 6830796 - DNA, 56 bp, Homo sapiens
gaagaagcctctgtggatctgaccatcttcttgctccacttggcaggtgtttcttc

SEQ ID NO: 6830797 - DNA, 63 bp, Homo sapiens
gacagacacagggccatgattgccatgccttccatgcacaactccaggtcctttgaatctgtc

SEQ ID NO: 6830798 - DNA, 55 bp, Homo sapiens
tgtatttcttgtgttcccatcctgatcattaaaggaaaggaatatatgaagtata

SEQ ID NO: 6830799 - DNA, 57 bp, Homo sapiens
gtggtccctgtgtggagaagctgtggggtcaagatgcccgggctaggcaaggaccac

SEQ ID NO: 6830800 - DNA, 78 bp, Homo sapiens
ttatgatttccagcaaactctaataacaaaattcaaattgctcttgcagatgagaatttttagagtgctgggacataa

SEQ ID NO: 6830801 - DNA, 69 bp, Homo sapiens
tcctgctctgttttatgagccatataaccttgtgatgcaattatggctaacgtacagactcaggcagga

SEQ ID NO: 6830802 - DNA, 63 bp, Homo sapiens
ccactctggccctcctgctgccagtcctctccctgtgggatgaggcatcagcagggccgaggg

SEQ ID NO: 6830803 - DNA, 69 bp, Homo sapiens
gcttctccccttctcaaactgagactgtctaagcccaggtttgaagcatctggtctgagaattagtagc

SEQ ID NO: 6830804 - DNA, 73 bp, Homo sapiens
tctcctatggatctcagccaaccagtgtcagggacctggccagtgatattgacttggagatctcatatgaaga

SEQ ID NO: 6830805 - DNA, 60 bp, Homo sapiens
aaggaggtatcttgataaattggagcccagcaaggttacaaagtttgagaatgctttctt

SEQ ID NO: 6830806 - DNA, 61 bp, Homo sapiens
ccagcactcctgtctcaagtctacattgtctacattggtgtttgagattaggagagcctgg

SEQ ID NO: 6830807 - DNA, 67 bp, Homo sapiens
cccttctagtccattcttcacaccctctgctctttatacagaggatggaagacaggcatggaagtgg

SEQ ID NO: 6830808 - DNA, 79 bp, Homo sapiens
gtgattctcatctgtctccagcattgaacatcaaggcagtttcctccatgttgagagctgagatcagcctgtgatccac

SEQ ID NO: 6830809 - DNA, 56 bp, Homo sapiens
caaatccatagaatgtataacgctaaaagtgcatcctaatgcaagctatggatttg

SEQ ID NO: 6830810 - DNA, 84 bp, Homo sapiens
gcgcgttccagcccttgaggtctgtccatctcaataaggaagataaagcctttatggaacagtcctagagcacggaatgatcgc

SEQ ID NO: 6830811 - DNA, 77 bp, Homo sapiens
tttcaaaggttcatgcttattgcatatttggagagatcgttccaggcataagccttgagtgtaatgagcttttgaag

SEQ ID NO: 6830812 - DNA, 60 bp, Homo sapiens
ctgcctttgtcctgagagcctgggctgggctccggggactgcagactctcaggcaggcag

SEQ ID NO: 6830813 - DNA, 76 bp, Homo sapiens
cttcagggctgccgggcagaccgtgggcatggccatgagtgtccccacaagaactgtcatgccaggagcttggaag

SEQ ID NO: 6830814 - DNA, 64 bp, Homo sapiens
ttctgacactccatcccttctcactctgcaggggaatcttgctggaaggtggctggaatcagga

SEQ ID NO: 6830815 - DNA, 71 bp, Homo sapiens
gcaccactgtacagcagatatagtgtttttaatgtcatggatattgtacctgaaagtaagtgaagaagtgt

SEQ ID NO: 6830816 - DNA, 73 bp, Homo sapiens
actttggaagcttcttgaaagtgcagattctcaggctctacccccagagagtctgatttggtaagaccaaggt

SEQ ID NO: 6830817 - DNA, 115 bp, Homo sapiens
ggcagtcacaagcgaggggacagaactagcctcaggcttacgggcaatggacagccattcctcaggctccatagccacagaccggatgctgggatctgattggcgcttgggggcc

SEQ ID NO: 6830818 - DNA, 59 bp, Homo sapiens
catatccaagcccctttgtttctatctacagaagagataatgacattggcttaggtatg

SEQ ID NO: 6830819 - DNA, 71 bp, Homo sapiens
gttctactcttgatagcatttacctttttggggagtctcccaggctccaaaggataaaagcagagtagaat

SEQ ID NO: 6830820 - DNA, 55 bp, Homo sapiens
gccgtccccgaggccggagggagcctggctgcttcctgcgggcttgggggctggc

SEQ ID NO: 6830821 - DNA, 73 bp, Homo sapiens
gatctcttacaaactggttttcagggaccgttaacacctgctcactggaagaactccagttctgtgtgagatc

SEQ ID NO: 6830822 - DNA, 66 bp, Homo sapiens
taacactgtaaacctagatgttgctatggtagctccaaactgaattgtctagctttgacagtgttg

SEQ ID NO: 6830823 - DNA, 58 bp, Homo sapiens
gtgcagggcaggtgtccttccaggtccaagggaggccagggcagggccgttgcctcac

SEQ ID NO: 6830824 - DNA, 90 bp, Homo sapiens
cagttgctcagaagcctgggatttgcgccagaccttgtttgagtggggaaggactggcacatgcggatgccagagctgagggagaatctg

SEQ ID NO: 6830825 - DNA, 93 bp, Homo sapiens
tcctcacccaccctctctaagcctgtgtcctctgcagagtgggagggaatctgtcctggagagccgcatgcagagtattaagtgggatgttga

SEQ ID NO: 6830826 - DNA, 60 bp, Homo sapiens
ctgcttccagttcctcaccacatatatgttgtgttagctatgtaggagttattggaacag

SEQ ID NO: 6830827 - DNA, 75 bp, Homo sapiens
ggtccagagcagggttttaacgaacagaagctggcatgtcaccactctctgtccctaggagccttgccttttgcc

SEQ ID NO: 6830828 - DNA, 57 bp, Homo sapiens
ctgtccattttgaattttcagtccttggccacacataaaggaagtttggaatggtag

SEQ ID NO: 6830829 - DNA, 78 bp, Homo sapiens
tgggatgttctttcttctgagatcagggagaattggaacatagatatttggccttagtccagaagaagcaacatctta

SEQ ID NO: 6830830 - DNA, 67 bp, Homo sapiens
gagtggctgggggtgaaagtctggacagtagtgggacttgctcccagctttgtaccttcacccactc

SEQ ID NO: 6830831 - DNA, 81 bp, Homo sapiens
aagcaacttcccaaaaaagatgaactgagcctattcataatcattgtagaaacaagcttcttctattttggggccatgttt

SEQ ID NO: 6830832 - DNA, 97 bp, Homo sapiens
tcttaagtaggagggcagccattgagggattctaagtaggcgagtaccataaacaaaaggagagtgtcttgggatggctgccctccatccttcaaga

SEQ ID NO: 6830833 - DNA, 55 bp, Homo sapiens
ctttgggaagattgaacttgctacctttctcacggctgttcatctttttctaaag

SEQ ID NO: 6830834 - DNA, 72 bp, Homo sapiens
gcttggaaggctgtgcagtgtttgcattctaagggctgcggagacagctggagatctgctcagcccaccagc

SEQ ID NO: 6830835 - DNA, 98 bp, Homo sapiens
cacctaatttagatgactgagatgatgagatttggaacttttgagctaatgagactgtgagcttttaatcttatgttaatgttatgatggatagagtg

SEQ ID NO: 6830836 - DNA, 79 bp, Homo sapiens
tctccttccatcctgaatggtgtaataggtttaagataactacctctaaaattaactatcacttttgtgaggaaggtga

SEQ ID NO: 6830837 - DNA, 59 bp, Homo sapiens
gttcgggctgttcccctgattaataaagtcgtaaacacagtcaggagcagcttctgaac

SEQ ID NO: 6830838 - DNA, 85 bp, Homo sapiens
ccttattacataactttaaaatgccgtaatacctctttagaccacatttttctctatcagagatggtgtcaggttggtagtaagg

SEQ ID NO: 6830839 - DNA, 78 bp, Homo sapiens
ggggccggttccatagccatctttagcttccaggttaaagaacctggttagtttggtgattggctctgtaatggctcc

SEQ ID NO: 6830840 - DNA, 61 bp, Homo sapiens
gtaattttgatgtatctttgtagctgcggttgtttccttagttattttacgttaatgttat

SEQ ID NO: 6830841 - DNA, 61 bp, Homo sapiens
ccactcagacacagcaattctgtgttggcatctcaggaatgatacagattgtgtgtgatgg

SEQ ID NO: 6830842 - DNA, 84 bp, Homo sapiens
ggtagagaaattgcaaagtaaaaatagattctgagcatatatgaaattagtttagtcatgtttttagtttaacagcttactacc

SEQ ID NO: 6830843 - DNA, 74 bp, Homo sapiens
tgtgtgttctattctgattcgtgtggatttgttcaagtaaataataactttgataagaatcagggaggccacca

SEQ ID NO: 6830844 - DNA, 57 bp, Homo sapiens
ggtcgcggtggtctcgtccatgcacccaagggattgcgtacggctgccagtgtgact

SEQ ID NO: 6830845 - DNA, 129 bp, Homo sapiens
ctaaatagcagtgatgtgtgtaatctttctttgtttcaggctgtgtctttaaacaataaaattactttcaggccaagttggggggaattgtttaagtagcctgttaagtatgcattaagcctattatag

SEQ ID NO: 6830846 - DNA, 66 bp, Homo sapiens
gagggcagagctggtgtgtcctggcatgggggcccgtgtgcacagagctccagtgtttttgccctc

SEQ ID NO: 6830847 - DNA, 75 bp, Homo sapiens
gtagtagaattcattctgggcaaacactgaaaaaagtgccttacagtatttctgctcatgaaagagtttcactat

SEQ ID NO: 6830848 - DNA, 99 bp, Homo sapiens
ccagcccatatcacagtcccttgtatagagtctattgctggggaaacaaacacatagtttgtttactagccaacatggagagtcaaggggctgtgctgg

SEQ ID NO: 6830849 - DNA, 77 bp, Homo sapiens
gttaatatatgtaaatgcatcagtgcttagagcagtgcctggcacatagtaagttctgagtaaatactgttattaat

SEQ ID NO: 6830850 - DNA, 55 bp, Homo sapiens
tcttattttagagccccgagcctcactaactttgtgtgctgttctcaaggtaaga

SEQ ID NO: 6830851 - DNA, 75 bp, Homo sapiens
gggagtctatggctggtctttagcaggggtatgacatgaaccatcctaggttttcaaaagaccactctggctcct

SEQ ID NO: 6830852 - DNA, 64 bp, Homo sapiens
ggtcccagaaccctgccaggtcctgggctgtggggcgtgggttggcatcagggttctgtgggcc

SEQ ID NO: 6830853 - DNA, 103 bp, Homo sapiens
attttttctagcattagtgagacaacagagcataatgtctagcacacagcaggtgttcactagacattatttgtactatcatctaagccatgttgctaaaagt

SEQ ID NO: 6830854 - DNA, 81 bp, Homo sapiens
ggcaaggagtccgagtcttggctatgcatagagctcagtcccgtatccgagtcttcgtcgttgccaggaccgctcttggcc

SEQ ID NO: 6830855 - DNA, 69 bp, Homo sapiens
gtatttaattctgtgcttctaggtgtttcgaatactgaatagagcttggcactagaaggcattaaatat

SEQ ID NO: 6830856 - DNA, 120 bp, Homo sapiens
atcttttaaattttgggcagtggtatcttgtgcagatgtatatgcataaaaagtacatgtattcaacaattacttatgtagtacctcttatgtgcaaggcattgttttaaagaccaggat

SEQ ID NO: 6830857 - DNA, 77 bp, Homo sapiens
ggacatttagtttcattgggcagtttctgagtacagcttctttccagcttatatctgctctgaaatcttatatgtcc

SEQ ID NO: 6830858 - DNA, 62 bp, Homo sapiens
aacttgaaactgttccagaaaaagagggcatgtcccattctggcgaaacagtttgatgagtt

SEQ ID NO: 6830859 - DNA, 88 bp, Homo sapiens
aagcctctgaagtggtctgtagcaagtgtgagttcattttagttcacaaggctgagaaatcatgcttggtatggatgttgtggggctt

SEQ ID NO: 6830860 - DNA, 91 bp, Homo sapiens
ggataggagaggagaccacagttaagaatagtttttcctttgcattataaaggcaggaaaaaagtctgtgattataaggttctctgcttcc

SEQ ID NO: 6830861 - DNA, 77 bp, Homo sapiens
ggaggaagctggtaggaagtgctcctgcctctctctcttccaagctggtaggaagtgcccctgcctctctctcttcc

SEQ ID NO: 6830862 - DNA, 74 bp, Homo sapiens
cctgtcctaagggatgctggtcagtgtaccagaagtaaaacaaattggcttctatggctgcacaccaggacagg

SEQ ID NO: 6830863 - DNA, 57 bp, Homo sapiens
agtgggacagtgtagagcgtcaggccagagaggcagaaactatactctgtccccact

SEQ ID NO: 6830864 - DNA, 57 bp, Homo sapiens
cagctcttcagtgcctgagataatgatgagattgagggccaaaaagatgaagagctg

SEQ ID NO: 6830865 - DNA, 76 bp, Homo sapiens
agcagggagccccaggagtcacctgcccaaagtcaccctggggtgattggcaagggcagggactgggctgcttgct

SEQ ID NO: 6830866 - DNA, 55 bp, Homo sapiens
ctcctggatgcaggctgtctgccaccttcctgcagcatccgcctgcttcctgggg

SEQ ID NO: 6830867 - DNA, 107 bp, Homo sapiens
gttaagtgtcaggaggtatgggtgccttcttttgaagggcgttgtgtgacctgacaggtgtaagccaagctctttaaaggccaaaaggatgccatcccctgtttgac

SEQ ID NO: 6830868 - DNA, 128 bp, Homo sapiens
ctgactcatgtttctcatctgaagtactggggaggctggattaggattcgtggtttcaaattaatctctgtggtgccctggagatttcttcaagctttctttacggaatatctgatgggtagtgaggg

SEQ ID NO: 6830869 - DNA, 99 bp, Homo sapiens
ttttccttctgttttgttttgatgtgtgtctatgtatgtgtgtgaaatatttatttatttcaatcaccatcaggacattagtattcagaggaaggaaaa

SEQ ID NO: 6830870 - DNA, 77 bp, Homo sapiens
tcacttgagcccaggaggcagatgttgcagtgagcggagatggggctactgcactccagcctgggacacaagagtga

SEQ ID NO: 6830871 - DNA, 109 bp, Homo sapiens
cacattagcattagttggatgtgattagctcacagagtatatatctcatttttagtggtatgtaccctgggaactttgtatgtctgtcatcacattaactacaaatgtg

SEQ ID NO: 6830872 - DNA, 101 bp, Homo sapiens
ggatgctaattgttggatacagagatgaattagacagggtctctgccctcagggagtttcacagtctgtcattgtttgtattgtaatagttaagttactcc

SEQ ID NO: 6830873 - DNA, 75 bp, Homo sapiens
ttccattgggagatagggtaatttagcattcttactgggaatgcaagactctttctttttctcccttttttggaa

SEQ ID NO: 6830874 - DNA, 65 bp, Homo sapiens
agaagtagaaagcctcgtaaatattttgtctgctaatcatgtgtttacagggtgattttacctct

SEQ ID NO: 6830875 - DNA, 70 bp, Homo sapiens
ttaatttatacataatcacagggatactgaaagcaaggattctcagaaatctgtgaatgtgctagattga

SEQ ID NO: 6830876 - DNA, 106 bp, Homo sapiens
aaggtgcctacctaggtcctggggagtggtggtcaggccatggctgaaaaattggtcttggtttgagggccaccacatttttctaagggtttgtgtcatcaacctt

SEQ ID NO: 6830877 - DNA, 99 bp, Homo sapiens
gctgaacactgtttcctcctcttctttcactttcacctgtacctctgcccgagaggctgtgcagagtagtgaggggacagaggtacagacagaaccagc

SEQ ID NO: 6830878 - DNA, 76 bp, Homo sapiens
tactttcctttgactgtcttcaaatgaatatatttcttgtccaaagaattatgtgagggttagtcgactagaagta

SEQ ID NO: 6830879 - DNA, 111 bp, Homo sapiens
ccatgtctatccagggggcttttaactcttcattgttgaacctcagctagagtcctacatgctgaggatatagcaggaacaaagcaaagtccctgttttcatagaacatgg

SEQ ID NO: 6830880 - DNA, 67 bp, Homo sapiens
cccagcttagctctccctccccagattcctgtgtggcatggactgagggatagaggtgcttcctggg

SEQ ID NO: 6830881 - DNA, 129 bp, Homo sapiens
ggccgatcgggcgcgccgaggtcgtcagagcagccggccgagcccccagtccccgcgggtccgtggggctgtcccggtttggcgagctccggctgccgagatgcgccaaacgcggaacccgggttggcc

SEQ ID NO: 6830882 - DNA, 81 bp, Homo sapiens
gcctttcagcccccattccgctccccttccttgcgctgcgtcgggaaagggaatgggatccctaggggtgcaaatacaggc

SEQ ID NO: 6830883 - DNA, 63 bp, Homo sapiens
gctccaggtatttgcccttttagatgatctgatcactccctgtttgaatggcacatttggggc

SEQ ID NO: 6830884 - DNA, 63 bp, Homo sapiens
cttcctgtgtggttctaaactcttacgtagttggaagttgctggagcacaggactaagggagg

SEQ ID NO: 6830885 - DNA, 56 bp, Homo sapiens
ccccatcccacctgagtgtcactgtgacaaagggcacagcggggaagggatgtggg

SEQ ID NO: 6830886 - DNA, 75 bp, Homo sapiens
ggtcgtcaccctgggctgggcctgttaagtatttcctcattaaagctctggcagctcagttcaggtctgcaagcc

SEQ ID NO: 6830887 - DNA, 74 bp, Homo sapiens
aaaggagacagtcttacctggaccctttaaaggcttccttgtgccaaataaaccaggaaatggcttgcttcttt

SEQ ID NO: 6830888 - DNA, 121 bp, Homo sapiens
ttgcctactaccagaggaagataaagcttagtggtgatgtctctattattgtctgtacaattacaaagcgattacattacacactaggtgctcaacctgtgttatgatgagtagagggcag

SEQ ID NO: 6830889 - DNA, 56 bp, Homo sapiens
tgtaagaaaagtaaatagtgacccagaagaatttgggtcacggtctgattcataca

SEQ ID NO: 6830890 - DNA, 69 bp, Homo sapiens
acttctttgcagctaggactctgtacatgatctagcttctgcttggcacagtcctagctgcaaagaagt

SEQ ID NO: 6830891 - DNA, 81 bp, Homo sapiens
gcttctaatattcttgtttattaagatataaagattgtcctaaaaagctttgaatttgttagtgaagaagagtagtaaagt

SEQ ID NO: 6830892 - DNA, 62 bp, Homo sapiens
agggaatggatgatggcaggtttgtcaatattttacacttatgaacctgcctgttcttctct

SEQ ID NO: 6830893 - DNA, 56 bp, Homo sapiens
ttagctcactatttcaggcttttatgccagtaacataagagtctttactgagctaa

SEQ ID NO: 6830894 - DNA, 78 bp, Homo sapiens
atgaagcacagtcctgcaggagcaaactgcagtgtggacaaagtttacttcaatagtttgatcctgactgtgactcat

SEQ ID NO: 6830895 - DNA, 66 bp, Homo sapiens
gcgggaggccctgcaggaagcaggatgttgacccggagcctccctgcgctcctgcggcggccccgc

SEQ ID NO: 6830896 - DNA, 72 bp, Homo sapiens
actttgagagagtcagtgttagcactcctggcctttgccttcttcgttaagcagctctgtctttcttaaagt

SEQ ID NO: 6830897 - DNA, 78 bp, Homo sapiens
tttactcatgtaatatatgattgacactggcaccctggttattttgcaagtagatgctcatgtaatgcatgaagtaaa

SEQ ID NO: 6830898 - DNA, 99 bp, Homo sapiens
aaaagagatatgtgctttcctcagctttggtttactcatcaaaaatcacaccacccctcattgaaagagtaaaattagtgagttagaacagtctttttt

SEQ ID NO: 6830899 - DNA, 124 bp, Homo sapiens
ggagatagatgtgaagctcttaatctggttccttctagcatggggagcagaaagtcagaagccaagatgccctggctgatctgttcttctgtcttgaggaaagagtatacgttaaactatttcc

SEQ ID NO: 6830900 - DNA, 77 bp, Homo sapiens
cacctagaattccttcacagattatactgtaaatccaaactacaggactttctgaaatgcaggcaatttgctaggtg

SEQ ID NO: 6830901 - DNA, 75 bp, Homo sapiens
ggctgaaagctcagtcagtggtgtatgcttcctggcacactatggtgttcatgtgccacctggctagctctggcc

SEQ ID NO: 6830902 - DNA, 64 bp, Homo sapiens
accccctacctaggaacgtattcaccaacacagatggtcacagtgtcgtccttgggtgttaagt

SEQ ID NO: 6830903 - DNA, 77 bp, Homo sapiens
ttttactattcaggaacagtttatattgcatggggattatctgttccttgaaagtttgaactgacttgataataaaa

SEQ ID NO: 6830904 - DNA, 86 bp, Homo sapiens
tgaatgctctgatctggagagatcttcacaaaaacccacaggcacctgctgttctttgtgaagacctctccagatcagagcattca

SEQ ID NO: 6830905 - DNA, 64 bp, Homo sapiens
tacaattggcataggttaaacagcggttgcacaaaattgtttactaagaacctggtcatctgta

SEQ ID NO: 6830906 - DNA, 56 bp, Homo sapiens
ggcctgcagctgcttccacacacctactgcaaatgccggtgctgtgggcagtggcc

SEQ ID NO: 6830907 - DNA, 75 bp, Homo sapiens
gcagtttaaccattgcatatccataggcataaattaaaatagccaagagagtatgggtattattggtaagaatgc

SEQ ID NO: 6830908 - DNA, 57 bp, Homo sapiens
cctctggacagatgtattttatgtaagttcaagcactagaaatattgagttcagagg

SEQ ID NO: 6830909 - DNA, 68 bp, Homo sapiens
ttgaaggtgggaattcaccaggtatccacccctttctgtccaggaacctgtctgcctcccaccatcaa

SEQ ID NO: 6830910 - DNA, 55 bp, Homo sapiens
tgtgccttccctctgctgatttgatccggaggatggcagcaagaatgaaggcata

SEQ ID NO: 6830911 - DNA, 114 bp, Homo sapiens
gtacaatcatttacatctcttggtggcagtcagtttggagatggataactacattattgtttctgaatgaagattgttgtaaagcaaggagtatgtgtaagtggcctgttgtgc

SEQ ID NO: 6830912 - DNA, 71 bp, Homo sapiens
tcccactgaactttttctccaattcacatactagccggacttggattttctggaaagatttcagttgagga

SEQ ID NO: 6830913 - DNA, 100 bp, Homo sapiens
tccagagttcttggttcagcaggtctgggttgggttcctggaatttgcatttccaacaagtccccaggggatgcccacgctgctggcctgagaacttgga

SEQ ID NO: 6830914 - DNA, 58 bp, Homo sapiens
catgaaactgcctacaaagctagtcccaaatactggctgtgaaatggcagtgtctatg

SEQ ID NO: 6830915 - DNA, 63 bp, Homo sapiens
tttattcttttctgtatttaggacaggtggaggagtttcacactgatgtgcagaaatagtgag

SEQ ID NO: 6830916 - DNA, 84 bp, Homo sapiens
tacacttcttcaaatagcagggagtcaaccaagtaaagtaattaaaatatgtaaatgaatcattttgctgtttgaacaagtgta

SEQ ID NO: 6830917 - DNA, 83 bp, Homo sapiens
gtgggaactccagcaggaaggtgagaaacctgggttccagcccttgatttttactttcctgttccgggcttcagttttcccac

SEQ ID NO: 6830918 - DNA, 70 bp, Homo sapiens
tcatgctttcttagtaatttgttcttaaatgcttcaatcagagatttactgagaactgattacagcatga

SEQ ID NO: 6830919 - DNA, 65 bp, Homo sapiens
tgtcaccttacagtcagataagcacagaaaaataagcagatgctaatctgtttcccaaggtgata

SEQ ID NO: 6830920 - DNA, 75 bp, Homo sapiens
aagtctcttttatgagaggtttcgtcagaggaagagctcaagtgattctatctgacggcttctttttctaggctt

SEQ ID NO: 6830921 - DNA, 56 bp, Homo sapiens
gttccagagacagaaaatggatctagatctctccagatttccttttgtctcttaac

SEQ ID NO: 6830922 - DNA, 97 bp, Homo sapiens
gtggcccccgccccacgcccgcctagccgcgcttacctcgccgtgggccgcccgcggagccggagggcagcggcgcgggtcccggggcggtggccgc

SEQ ID NO: 6830923 - DNA, 57 bp, Homo sapiens
ggattgctggtagtcagtgtccctgggctgccaggcacacaggcatccagtatagcc

SEQ ID NO: 6830924 - DNA, 59 bp, Homo sapiens
gtcctgcctaggaactggttgtgggtgtctcctacctcacccagtcacctaggtggcac

SEQ ID NO: 6830925 - DNA, 74 bp, Homo sapiens
gataggttcagctttcatcctgaaaagttgtttaaacacttttaatttgtttcaagtgatgaaatgaatttatc

SEQ ID NO: 6830926 - DNA, 101 bp, Homo sapiens
gtttcctaagcctcaatattctgatttattcattgttcactaaattgtccattgtatactaggcactgtggataagtcagagatgtatgaggattgctaac

SEQ ID NO: 6830927 - DNA, 58 bp, Homo sapiens
gctgaccagtgatgagccatttaggtgaactctctgaacaggctaagtatttggtagc

SEQ ID NO: 6830928 - DNA, 74 bp, Homo sapiens
cttgcccaagttgcttcaccactctgaccctgggatcctctttcctcatagggtggttagaaggagtatgcgag

SEQ ID NO: 6830929 - DNA, 101 bp, Homo sapiens
ttgagatggagtctcgctgtcgcccaggctggagtgcagtggggcgatctccgctcactgcaggctccgcctcccgggttcaagccattctcctgcctcag

SEQ ID NO: 6830930 - DNA, 55 bp, Homo sapiens
ccacttgtcagagtttctctgctttgtgggaggagagggtggtatgaacaggtgg

SEQ ID NO: 6830931 - DNA, 83 bp, Homo sapiens
tgtaaatagtgactgcagtgtcaatgccaacagtatatagggcacttgccatgtgccaggcattacattaggtaactgagaca

SEQ ID NO: 6830932 - DNA, 100 bp, Homo sapiens
ctcccacttcccccaacccttcctaaatgggataggcttgggctgatgctcgagttagaccactctgtctggtagtgaggggtaggggcaggcatggggg

SEQ ID NO: 6830933 - DNA, 69 bp, Homo sapiens
gggtaggagaggtgtctgtgtgtgtgtgtgtgtgtgtgtgtgtgtgtgcaacagatgcttttgctgccc

SEQ ID NO: 6830934 - DNA, 110 bp, Homo sapiens
cctctccatgatctgttactaggcaaaactcagatgtttggctaccttgggctgcaactgtcccactcttgcccaggcttgctggagttggggttatccacagtcagagg

SEQ ID NO: 6830935 - DNA, 65 bp, Homo sapiens
gccaccgccctgtctcctcgctgcttcctgcctgaatgcagaagcggagtccggctgggggtggc

SEQ ID NO: 6830936 - DNA, 89 bp, Homo sapiens
gcttaaagggtggatttctgagctctatccagggtcataaaaaaggtttccaggaagagatagagctaagtaagtagagctaagtaagt

SEQ ID NO: 6830937 - DNA, 58 bp, Homo sapiens
ttatgcacttagctccaagctacaatagatgagggtacagtggagcaggtaggcatga

SEQ ID NO: 6830938 - DNA, 56 bp, Homo sapiens
gacccttggctgcagcatcacatttaaccctccttggaatgctacaggcaggtgtc

SEQ ID NO: 6830939 - DNA, 72 bp, Homo sapiens
gctgagtttcttaagtgggaagaattgggtgattctagttattctgttcttgtccccacttcagtcctctgt

SEQ ID NO: 6830940 - DNA, 71 bp, Homo sapiens
aggtctgacaggctgagatccctggtaattgaggacagcagacagccagtgacctcccagtctcagttcct

SEQ ID NO: 6830941 - DNA, 59 bp, Homo sapiens
tcttggagataatgacctgtgactagtaactaactacacaggagaaaagatctcccaga

SEQ ID NO: 6830942 - DNA, 90 bp, Homo sapiens
ccaggcttgatcgagaaatgagaaacccattttacaggtgaactaaaatgagataggtatttcatttacccttttacaaaggccaaatgg

SEQ ID NO: 6830943 - DNA, 68 bp, Homo sapiens
gactttactcaatgaagtagcctggttaaaagggcaatgccagccgggctatatttctttgtctagtt

SEQ ID NO: 6830944 - DNA, 64 bp, Homo sapiens
gctgctgtctcatgcgatgcggaggtgaagtggagtcccccgacattgctcatggactggcagc

SEQ ID NO: 6830945 - DNA, 65 bp, Homo sapiens
gggcagcatggagtgggggaagcacttgaacctttttctactgtgtggctctcctcctgctgccc

SEQ ID NO: 6830946 - DNA, 90 bp, Homo sapiens
tcctaatccccataacttttgaatatgtatgcttatgtggtaaaaacgacattgcagatgtgtttaatgttaacaatcttgagataagga

SEQ ID NO: 6830947 - DNA, 72 bp, Homo sapiens
tgctaactgtgagtacttcaggattttaaaaccaaatacctcctaaagaccactgctcacaatatgttggca

SEQ ID NO: 6830948 - DNA, 75 bp, Homo sapiens
ctggaaggatggaagggaagtagtgctcctcatatctagggagagattgaagattaaatgcttccttccttctag

SEQ ID NO: 6830949 - DNA, 82 bp, Homo sapiens
ttgttttctatatttttatttgacagaaagtagttcaaaagcaaatgaactactttgtggagattaaaaatatagtgagcaa

SEQ ID NO: 6830950 - DNA, 56 bp, Homo sapiens
atccccgtcatgggtgaaagctttagcaactgctgctctctttccatgtggaggat

SEQ ID NO: 6830951 - DNA, 71 bp, Homo sapiens
tagcctctgggccgtcagagatcctgttcctgtttttatgaaggttctgacagagaaggctcagcaggctg

SEQ ID NO: 6830952 - DNA, 61 bp, Homo sapiens
actttgggacccagccaaccctttgaataaaaaatcattatgtttttttgagtcctagggt

SEQ ID NO: 6830953 - DNA, 91 bp, Homo sapiens
cattcttggcaaaacagaaagcttatgggaaatattcattgacttcttcttgtagcaatgttatttctgcatagtagtcaggctaaggatg

SEQ ID NO: 6830954 - DNA, 62 bp, Homo sapiens
tcataaatgcaacaggctgcttttttttaaatcatcactagaggcagttgagcatgttatga

SEQ ID NO: 6830955 - DNA, 67 bp, Homo sapiens
ggagttattattggattggtacagagtttggaatgataaaagaattctgaaaatagatagtggctcc

SEQ ID NO: 6830956 - DNA, 56 bp, Homo sapiens
catttgtacagaacagctttatagtaattttacctatagagtctgtagtatagatg

SEQ ID NO: 6830957 - DNA, 74 bp, Homo sapiens
agaacaagtgtcacaggcccagctcttcaccagaagctttgatgatggcctgggctttgaatacgtgatgttct

SEQ ID NO: 6830958 - DNA, 78 bp, Homo sapiens
ataagtagaagttaggaaataggaatatttacttggtgtaaaacagtattcatgttgtcctttgcgtttctgtcttgt

SEQ ID NO: 6830959 - DNA, 98 bp, Homo sapiens
accctagttcctgtgagtgtggctttatttggaaatagggtctttatacgtataattaagttgagaatctccagatgaagtcctcctggatttagggt

SEQ ID NO: 6830960 - DNA, 66 bp, Homo sapiens
gcccccggccccgtggcaggtaacggtggttttgcagtgtggcgtgctgtgggggccggcaggggc

SEQ ID NO: 6830961 - DNA, 108 bp, Homo sapiens
ggtcatgtgtgtgcatgtgcttatgtgtgcatgtatgtgcgtgtgtgcatgcctgtgtattaatatgtgtgtgcatgtatgtgtgtgcatatgtgtgtgtgtgtggtc

SEQ ID NO: 6830962 - DNA, 57 bp, Homo sapiens
gtattttatggcatgcagtggcatcttgactaattgtgactaattgtgataaagtgc

SEQ ID NO: 6830963 - DNA, 109 bp, Homo sapiens
ttttgttccttactatattcactttttaatagggcccaatgagactgattaaaattatgagttattttatgcgggctttattttaggtaattcacagcaggatacaaaa

SEQ ID NO: 6830964 - DNA, 89 bp, Homo sapiens
ccacttatggcctctaagaaagtaaaaatgcaaggccgggcatggtggctcatgcctgtaattccagcattttgggaggccaaagcagg

SEQ ID NO: 6830965 - DNA, 59 bp, Homo sapiens
tttgtgttgttgtttgaagccaccatgttcatggtaatttgttacagcagcaacaggaa

SEQ ID NO: 6830966 - DNA, 57 bp, Homo sapiens
gttacatttggtgatttggtgcacacaactgtctgtggtcatgcactttgatgtaac

SEQ ID NO: 6830967 - DNA, 77 bp, Homo sapiens
ctgggcagctctgaaattactggccctggagctggcagaactccagaagtccaggttcattagttctgtctgcccag

SEQ ID NO: 6830968 - DNA, 76 bp, Homo sapiens
tacctatgaatgtgaccttatttgaaaatagagattttgtagatctaatcagtttaagatgaggtcatactgggta

SEQ ID NO: 6830969 - DNA, 124 bp, Homo sapiens
taacttctgcctccacttctacagatgagcacactggcattgggaagctgggggtgtaccctaacttaatgattcaccaatagttcctaatttagtattgccgctggtggagagtagttagttg

SEQ ID NO: 6830970 - DNA, 56 bp, Homo sapiens
agatggcttccttctcactgtgtcctcacatggcagaagagacaaggcagctctct

SEQ ID NO: 6830971 - DNA, 79 bp, Homo sapiens
atgtattttgtggcttggttgctcttgattctatgctattaatgctttgcaggcccatcaagtcatcagcaaaatacat

SEQ ID NO: 6830972 - DNA, 63 bp, Homo sapiens
ctctattagctgaataatgcattgttgggagagaaatagtccagtaaaacagctaacgtagag

SEQ ID NO: 6830973 - DNA, 85 bp, Homo sapiens
caaacatcagcagggtttgacttctaatgttcacagtcttttctatggacttaacccaatgtaagatcacctctgctgctgtttg

SEQ ID NO: 6830974 - DNA, 71 bp, Homo sapiens
ttccagtctgagagcactggccacctaactctattcccagaaagtggagtccggcccagagctccctggaa

SEQ ID NO: 6830975 - DNA, 62 bp, Homo sapiens
gtttttagccaagccataggtctgattaagtacagtcagattccttgagcaggttacaaagc

SEQ ID NO: 6830976 - DNA, 59 bp, Homo sapiens
accatgctggagtccctagctgtcagtcaccaaaacagacagccatgataccagctggt

SEQ ID NO: 6830977 - DNA, 59 bp, Homo sapiens
tcccgataggcagggctctggctctcatctgggagcacggcagaagctgttgtctggga

SEQ ID NO: 6830978 - DNA, 129 bp, Homo sapiens
cttagtatattagatttgagacttaaagtttgaggattgaaattcatctagttagaattcttgacaggtggcttccattttctaaaagtatctaaacattgggttttaagctcttttttcatacttctg

SEQ ID NO: 6830979 - DNA, 75 bp, Homo sapiens
ggcatactggttaatgcttaacagctggcttttcagaaggagaaaagctcatatttgtagcatttgccaatttcc

SEQ ID NO: 6830980 - DNA, 71 bp, Homo sapiens
agagattagttgagatagtcaaagttctttctgttccaggaagtgctttcatatagtcttaatgatgcttt

SEQ ID NO: 6830981 - DNA, 65 bp, Homo sapiens
gctagcatggtgcaggagagaaggcagggttctgtctttgcccgaactcatcggctcatcttggc

SEQ ID NO: 6830982 - DNA, 67 bp, Homo sapiens
ctcattcagtttctaaatgctcctctcaatgaaaccccaaagggagaggcactgaaacaggcatggg

SEQ ID NO: 6830983 - DNA, 116 bp, Homo sapiens
tgagctctttgcctgtaggccaagaggtttgttgaaacccatcctgtccgcagtcttggggaagtgggaagctgtggtgttttcaagccctggcttactgagcgccaagaaactca

SEQ ID NO: 6830984 - DNA, 64 bp, Homo sapiens
cctatattcagggaactgaccccatacagccatgtcagaggctacagaactccttgaagatggg

SEQ ID NO: 6830985 - DNA, 66 bp, Homo sapiens
tagatatttaaataaagagcagtgtagttgttcttcaggtaggtgtctgctcttatttaacatctg

SEQ ID NO: 6830986 - DNA, 75 bp, Homo sapiens
cagcctcccaaagtgctgggattacaggtgtgaaccaccgcgcctggcctaattccagcatttaaaaacaatctg

SEQ ID NO: 6830987 - DNA, 73 bp, Homo sapiens
agagatggcttgtgagatgaacaaggtcaaggaatttttaagtgcacagattttgtttctttctcccatcttt

SEQ ID NO: 6830988 - DNA, 75 bp, Homo sapiens
gcagggagcaggaaggccagaagggtcaaaattggtaaattaatggaagggccctgggccctctagcttgttagc

SEQ ID NO: 6830989 - DNA, 82 bp, Homo sapiens
gtgcttagaaccattcagttaccactgatggccttcacacaaggccacaagtggtcctgagtcctcacaaggatcagagcac

SEQ ID NO: 6830990 - DNA, 98 bp, Homo sapiens
gtgatgcttccagggtgtgcctgggcctggacaaggccactaggggactgccctagcctgactctttggtcctaaggtatccatctgtttagcattac

SEQ ID NO: 6830991 - DNA, 63 bp, Homo sapiens
actagaccctctggtttgcccttgggtgctgcagtacttgtctagtctaccagagactccagt

SEQ ID NO: 6830992 - DNA, 87 bp, Homo sapiens
gggtccaactaaatgttctgccacttgctttgtatctaatgtgtatattttaaattgatataaagaaggcacagcaagacagggccc

SEQ ID NO: 6830993 - DNA, 100 bp, Homo sapiens
ggctgggggccaggcgggcagaacagggccagggccacctcctaatgtcctgatgttctgggcagtggtggcccttcccttcccctggggtccccctgcc

SEQ ID NO: 6830994 - DNA, 66 bp, Homo sapiens
agtgaggtgatttccttttgcaaagtcagatattgtgctctgagtgctttgagaaatcacctgatt

SEQ ID NO: 6830995 - DNA, 62 bp, Homo sapiens
tgtaagaaaggggccgctagagaatgtgctgtccacgctctccagctacccctttagctaca

SEQ ID NO: 6830996 - DNA, 78 bp, Homo sapiens
agggaatggcacttccatttctttagtgataattgtatttctgttacataactgagaggaagtaagccagctttccct

SEQ ID NO: 6830997 - DNA, 76 bp, Homo sapiens
ggtaatcagcagaatgttggtagcaggagttctaaagtcttagaggtttcctgttagccattattagctatacacc

SEQ ID NO: 6830998 - DNA, 58 bp, Homo sapiens
tcaatttcagacctttccttggatgtcctcgaagcttcccaggaatgtctgaaagtga

SEQ ID NO: 6830999 - DNA, 89 bp, Homo sapiens
attctgagtagtaatgtcctttaagtaatcagcatggttatcaacctaccaaccacagctctaactattaagaggtcatggcttagaat

SEQ ID NO: 6831000 - DNA, 109 bp, Homo sapiens
tctgcctccgatagttggctcagagtttatgaagcttgaggtgagagctgccgaggaataaaggcactgctcaggtctcagcttaatttatcctggtctgtctgacaga

SEQ ID NO: 6831001 - DNA, 66 bp, Homo sapiens
ggagagctgtttatcttcttcaaagcaatttttgttgctacgttgtgcaagtgtagatggttttct

SEQ ID NO: 6831002 - DNA, 57 bp, Homo sapiens
ctctctcagtgtaatacaggattgttgtgaagatcaaagtaattaacactgagaaag

SEQ ID NO: 6831003 - DNA, 84 bp, Homo sapiens
ggtgactgattttgactctgctaggaaaatctcaggatggaaatttcctgagctgacagtaggtcatgctgaattagagacatc

SEQ ID NO: 6831004 - DNA, 58 bp, Homo sapiens
tccctgagggcagctcaagtcctcacccccaggacccaagacacgtgtcctcagcggg

SEQ ID NO: 6831005 - DNA, 74 bp, Homo sapiens
aggtctaacaatagttgtgaatcaggactagacaataccagttttgaagtacctggttctgactccaaagacct

SEQ ID NO: 6831006 - DNA, 64 bp, Homo sapiens
acagctttagagaagaaaggttgctgttggattcaagggcagctttgagtcttagagtacttgt

SEQ ID NO: 6831007 - DNA, 66 bp, Homo sapiens
tccctatcccccaggagcttgttttagagacggttgtcttatgagccactccctggatggaaggga

SEQ ID NO: 6831008 - DNA, 81 bp, Homo sapiens
ctcgaggtggaggtgttgggtgaggtgcctgcagctggcagcagttccctccgccagcacttctttgttacccgcttcgag

SEQ ID NO: 6831009 - DNA, 79 bp, Homo sapiens
cccagctggccagagacagagacaggagttggccggggctgcctggcttcaaaacctatctttgatcatctgtgctggg

SEQ ID NO: 6831010 - DNA, 119 bp, Homo sapiens
tgtctattacagcacttagcatagggtggagtgggggaaggagtgttatttagcagagtggaccaagcacagcttgcattccagtccccactgtgtcctaagctgtgtgattttggaca

SEQ ID NO: 6831011 - DNA, 59 bp, Homo sapiens
gagctgttcaaggacaggcacgggtctgatttacttccgtgtcccctagatcccagctc

SEQ ID NO: 6831012 - DNA, 84 bp, Homo sapiens
gcacccggaacttgatcctgctgggtactactgtatgaggcgtgattcagaggtgtcccagcagaggggcgagggagctggggt

SEQ ID NO: 6831013 - DNA, 70 bp, Homo sapiens
atgaacagcattgaaatccagccacaggaatttaacatcataatcctattgcatattttagtgctgtcat

SEQ ID NO: 6831014 - DNA, 76 bp, Homo sapiens
ggcaggttggtgtcctggttacaaggactttgggatcagatagatccaggcttgagaccaggctctggcagttgcc

SEQ ID NO: 6831015 - DNA, 128 bp, Homo sapiens
ccttcttttagatatgctggcaaataattactgtagatatggctggaatactgaaaggctgtactctggtcatttcagattgcctgaggagtaaccacccagtctgctgcagcatgaattcaggacgg

SEQ ID NO: 6831016 - DNA, 67 bp, Homo sapiens
tcagaatacctgggcagtgctggagttgaagagtttcctttttaagaagctgtccaggtgcagctga

SEQ ID NO: 6831017 - DNA, 65 bp, Homo sapiens
gcctggcagtgatgtcttttggatctcagagcctttatctggttgtaaaattatcatgctcaggc

SEQ ID NO: 6831018 - DNA, 72 bp, Homo sapiens
gagtagcctcagctgggtgagtgttctgcaactatagtgcttgcaaacgactttcacctaagttacctactc

SEQ ID NO: 6831019 - DNA, 123 bp, Homo sapiens
gcacaatgttaaagcaacaataattggttcctcctggcttttcccattgaaggaaattgaaattcaattgactttcaatggaatagccatggagttccaattgtcattgctccgactttgtgc

SEQ ID NO: 6831020 - DNA, 57 bp, Homo sapiens
agtggtccatgttcccagaagacaggacctttggcctgcttacttgcttggaccact

SEQ ID NO: 6831021 - DNA, 63 bp, Homo sapiens
taatgcctactacaaagacttgtcagtgaagattaactgagaatagttttataggtgggatta

SEQ ID NO: 6831022 - DNA, 82 bp, Homo sapiens
agaggttggctgtgtttcatttaggaactttgaatttttccactattagttttgattccttgaaatatccttgcccatttct

SEQ ID NO: 6831023 - DNA, 73 bp, Homo sapiens
gtaccctggtaaacaataccagccttgatctgagaggaaggggaggcagggtgttgattacagagatgggtgc

SEQ ID NO: 6831024 - DNA, 64 bp, Homo sapiens
cgtgaattttccgtcgctaactgcatatgaaatgcacgttctggtaaggatggatagtatcatg

SEQ ID NO: 6831025 - DNA, 114 bp, Homo sapiens
tctgtgatttgagtcccttggctcggtgttaatattgagtgtttgatggcagcagaagatgttcagtaagcacttctagagctgaagatagctgtgcaagtctgtagtaatagg

SEQ ID NO: 6831026 - DNA, 68 bp, Homo sapiens
cagatcgagtgaaactcccgttccattggtattaccatgcttgtggggttggcagttctttaagtctg

SEQ ID NO: 6831027 - DNA, 62 bp, Homo sapiens
ggctccaggaagggaaatctccatgtcttgcatgcaaagctgggctctctcacctggaggct

SEQ ID NO: 6831028 - DNA, 84 bp, Homo sapiens
actttgaaatggaagtgaaaattctaccttgtaagataaaagagattaggatgaggagatgttttctaattctatatttttagt

SEQ ID NO: 6831029 - DNA, 75 bp, Homo sapiens
gcagctgtgggcctcggagagcgcattgtacacacagatgttgggtttcagctctccggctctcgccagctccgc

SEQ ID NO: 6831030 - DNA, 73 bp, Homo sapiens
gactgtatctggcctgtgccaccagcttgctcctgctctctatcttgcaagaacactgccagaatacactgtc

SEQ ID NO: 6831031 - DNA, 59 bp, Homo sapiens
ggccaggtaagagtgcagccgccgcccacccgacgccaggcctcgctccccgcctggcc

SEQ ID NO: 6831032 - DNA, 105 bp, Homo sapiens
tcatattctttgtgtccatcagtctctcattgcagtatgttgtatatcatgtaaaaatgatgcctatgaattgtaatgtgaaattgcaaatatttcaagagttga

SEQ ID NO: 6831033 - DNA, 61 bp, Homo sapiens
ctgacctgtagcttccaagaccaggggcctggtgccctggtaggagggaaatgcgggttgg

SEQ ID NO: 6831034 - DNA, 68 bp, Homo sapiens
ttctacttggcaaagagatgcataaggactcttttcattatgagtctgttcatgtctttttaagtgag

SEQ ID NO: 6831035 - DNA, 71 bp, Homo sapiens
ggttgagtggagtgagcaccggactaggagtcctcaggagaaaggagtctggtgctcgctctgcttctacc

SEQ ID NO: 6831036 - DNA, 75 bp, Homo sapiens
ggtaatgtatttaaagttactcacagaaatatgctggatgtgttgactggtaactttaaacatgtttatattgct

SEQ ID NO: 6831037 - DNA, 80 bp, Homo sapiens
tgctggtggtgctggagctctgtgtgttcctgagccgctgtctgctcggtgttttcaggcggagctctgggccccatgta

SEQ ID NO: 6831038 - DNA, 56 bp, Homo sapiens
ttgaaggcaactgacagggtttgcatcaaacctttgtgtgtctgtgcctgtatcaa

SEQ ID NO: 6831039 - DNA, 69 bp, Homo sapiens
ctgctcctggccctgagctcccaggtgccatgcaatggctcgcctggggcagctgtggggcttgaacag

SEQ ID NO: 6831040 - DNA, 61 bp, Homo sapiens
gttggcgaaggacctggaggagtcgcagggcggcaagtcctctgaggtcctctcggccacc

SEQ ID NO: 6831041 - DNA, 84 bp, Homo sapiens
gcagggtaggcttcctctgagggctgtcaggaaaggctctgttccaggcctctctccctgccttgcagatagccacccccatgc

SEQ ID NO: 6831042 - DNA, 76 bp, Homo sapiens
tttttgtgaaaggctatgagtttggtataatactctaatgagataagtgtataaaaacatagctatcatacaaaaa

SEQ ID NO: 6831043 - DNA, 128 bp, Homo sapiens
tttaagaaaccacttttcttgctatgccctgataatcttgcctcttgaataactcatttccatcaagagcaggacagaatcagaacagcatggacaaggataatctctaaaatgtggtttcaaatgga

SEQ ID NO: 6831044 - DNA, 56 bp, Homo sapiens
agggacacgaggtcctgctggggcaccagttcagccaaggacctacttgtgtgcct

SEQ ID NO: 6831045 - DNA, 57 bp, Homo sapiens
tgtttctttttctatttctattgcaaaggtaaaagtgagaagtgggaaaagcaagca

SEQ ID NO: 6831046 - DNA, 69 bp, Homo sapiens
tcccagcttctcctgtcagagggtgtcagccaacatcttggagaatggcagagaagcaagctcttggga

SEQ ID NO: 6831047 - DNA, 67 bp, Homo sapiens
agtatctgtttcagtccctgtgttcaataattttggttatacaccttggagtggaattgtcggtatt

SEQ ID NO: 6831048 - DNA, 71 bp, Homo sapiens
gcagcctccggcggccggcctgagcccgggatgcctcctcctcggcctcctccagctgccgcttcagctgc

SEQ ID NO: 6831049 - DNA, 62 bp, Homo sapiens
ctgattttgtttccccctggagtcaggctctttctcagccgttccaagggcagcagaatcag

SEQ ID NO: 6831050 - DNA, 65 bp, Homo sapiens
agtaaagcagtcaggacctgtgattttatgaaacaatatcctcatgattctgctgctatatgact

SEQ ID NO: 6831051 - DNA, 78 bp, Homo sapiens
tgttttaaaagaatttgacatttcataggtgctcaatgaatgctggagtctatgaaatgtcagattctgcaataggca

SEQ ID NO: 6831052 - DNA, 76 bp, Homo sapiens
ggttgagctcatggaaaagtactgaaatacattggaggggaagttggtcagtgtgattaggctatctgagttcact

SEQ ID NO: 6831053 - DNA, 57 bp, Homo sapiens
ttccaggagacccagaatgttgctgtggtctaccaggcagagtagggacttgtggaa

SEQ ID NO: 6831054 - DNA, 64 bp, Homo sapiens
acccacattttggggtggcagaaagctcattgagaaagaaagcagctgtcccttaacatcaggt

SEQ ID NO: 6831055 - DNA, 55 bp, Homo sapiens
aagttcactgtggttcctatggcctttcctggggttctctatcattagtgaattt

SEQ ID NO: 6831056 - DNA, 74 bp, Homo sapiens
gatttgccaaaacacagggttttctggaagattatccacactcgcaataggaagctctttgttttgtgaaagtc

SEQ ID NO: 6831057 - DNA, 129 bp, Homo sapiens
ttctttacttctaataacatgaagcaagggaatgatcttatctctgttttatgaagccaatctagcaatgaatctcaagttgttccagttggtcaaggacagaggttcagtcattccagaagtagagga

SEQ ID NO: 6831058 - DNA, 67 bp, Homo sapiens
gaccccagagggctgaggatatgaacagtgatctggttttgttctgttctttgtccccttggttgtc

SEQ ID NO: 6831059 - DNA, 72 bp, Homo sapiens
gagccttcaggaatcctggaaagcctaggactcaagcagactttgagcacctggaccagattctggatgttt

SEQ ID NO: 6831060 - DNA, 61 bp, Homo sapiens
tcctataagaacatctgtccccagatttagggctctctctaaatccagaatgatcttggga

SEQ ID NO: 6831061 - DNA, 69 bp, Homo sapiens
attgcttgaacccaggaggcagaggttgcagtgagctgagatcatgccactgcactccagcctggcaat

SEQ ID NO: 6831062 - DNA, 119 bp, Homo sapiens
agaaggtccaaaatttgtgtgtctttttagtggaattgttattgtttgttgtgtcacaacaaacaaatgataccagttctcaaatattaagattatattgcttcaaatagtgactttct

SEQ ID NO: 6831063 - DNA, 91 bp, Homo sapiens
ttttcttgtctcccaacaatgaaattgagatccagagaaataattttttcaagtcattctataatatcgtggtgggactggaataagaaaa

SEQ ID NO: 6831064 - DNA, 68 bp, Homo sapiens
tctatattctcctcccaattgccaagtgctgctctgtcagtgacctgggagtgggagggagtattgga

SEQ ID NO: 6831065 - DNA, 75 bp, Homo sapiens
caggccccacgatgttttgggagagtgtttagcacaggaaaatgcgcagaatacatgcacgacacgggggcactg

SEQ ID NO: 6831066 - DNA, 56 bp, Homo sapiens
ggcggacgcgcacggccggcttggcccgggcctcgggcgcgccgtcgggtccagcc

SEQ ID NO: 6831067 - DNA, 56 bp, Homo sapiens
ctgcctaatatccattgggagcaaatggtatgccaaacatcataatgggtgttcag

SEQ ID NO: 6831068 - DNA, 63 bp, Homo sapiens
gtgagctggaatagtggagaaaatttccttgaattgcaaggtattgtcttctatttagttcat

SEQ ID NO: 6831069 - DNA, 73 bp, Homo sapiens
tgagctttaccatcatgttaaatatttcaatctatttgggtaggtggaaatggactatggaaatgtgagctca

SEQ ID NO: 6831070 - DNA, 57 bp, Homo sapiens
cccaccccacagctctgtgctcagttacaatcagcaaagaacagacttggggtgagg

SEQ ID NO: 6831071 - DNA, 95 bp, Homo sapiens
gttgtgcatgctcagaagacagagcacttctcttgtcagtcacaatggcttgggtaggactaagtgctgttctgtgtgttcttggagtgtgcagc

SEQ ID NO: 6831072 - DNA, 76 bp, Homo sapiens
cccactcccctccgtagatcccagaaagcagcagtgtggggcatgatacttgacatttgcgatcaaggggagaggg

SEQ ID NO: 6831073 - DNA, 71 bp, Homo sapiens
gtgagtgggacctgcgtgtgtcatcccttccctcagcttggaggtgtttgacctcacaggtcccatctgat

SEQ ID NO: 6831074 - DNA, 67 bp, Homo sapiens
ctgcaagccaaggagagaggcctcagaggaaaccaagcctgctgataccttgaccttggacttccag

SEQ ID NO: 6831075 - DNA, 62 bp, Homo sapiens
ttttcctgttgtatgtcttaattttaaaaataaagaactaaggcatgctagcagtatgaaaa

SEQ ID NO: 6831076 - DNA, 90 bp, Homo sapiens
tttcaatatctcattttattgcaaatgtggattttaggaccatgatgattaaataagcaagtgaatgaggttgagattataaggttgaaa

SEQ ID NO: 6831077 - DNA, 55 bp, Homo sapiens
atgcagtccaagctctagagttttacattaaaataatagaactgaggacttgcat

SEQ ID NO: 6831078 - DNA, 101 bp, Homo sapiens
tcagaataaacctctccatggtgtctgaaaagtgttgcacccattatatgaaaaaatattgtaatggtcagggcttttgtaggtcttatgatggtttttga

SEQ ID NO: 6831079 - DNA, 60 bp, Homo sapiens
ttttccactcttgcaagctgcacaagtaccatacttagtgttctgggctgagaggggaga

SEQ ID NO: 6831080 - DNA, 55 bp, Homo sapiens
gctcatctgccccaggagatcccattaagctgcggtgctctgggcagcagagggc

SEQ ID NO: 6831081 - DNA, 61 bp, Homo sapiens
caccatctactgacagaataaacggaaagtgttactgttatcttcatgtttgtagatggtg

SEQ ID NO: 6831082 - DNA, 69 bp, Homo sapiens
tgttacccagtctggagtgcagtgacaccatctcggctcactgtaacctccgccttatgggttcaaaca

SEQ ID NO: 6831083 - DNA, 128 bp, Homo sapiens
aagtgtgagctcctgtggtcatgcaagtctttcttcagccccagggccctggacagctacagtctggagggctgtctttgtagtccagagccctgtttctggaggaaggttccatggagctcacactt

SEQ ID NO: 6831084 - DNA, 70 bp, Homo sapiens
ctggaatgtatgtatcttaagatgctttcttgaaagacaggtaaaatgaccttagggacatgaattctag

SEQ ID NO: 6831085 - DNA, 68 bp, Homo sapiens
ccaaagttccttttgtcactgataagataattagggttaatagtttcagtgcaaaaataggattttgg

SEQ ID NO: 6831086 - DNA, 63 bp, Homo sapiens
catgatttaaactaccacctgaggagtaattctttttcctgagattggctagtatgagttttg

SEQ ID NO: 6831087 - DNA, 56 bp, Homo sapiens
catggaacaaggaagatgtttgcaatagtatggccagcatctatcctcattctctg

SEQ ID NO: 6831088 - DNA, 65 bp, Homo sapiens
ttggattggccaggtgtaggtcacacctctcatcagaggtaccagaggagcacatggccaaccag

SEQ ID NO: 6831089 - DNA, 84 bp, Homo sapiens
tttcctggttttagaaaagagagctcagctaagttgacacacagttaaattagtcaagcttctctgtgttcaaaaatcagggaa

SEQ ID NO: 6831090 - DNA, 69 bp, Homo sapiens
gatgttcgagcagaagaccagggtcagtacacctgcaaatatgaagaccttgaaacttcagcagaactc

SEQ ID NO: 6831091 - DNA, 60 bp, Homo sapiens
gcataagtgacattgtgtccttctcaatcatcccatcgggggcataaaatgtcaatgtgt

SEQ ID NO: 6831092 - DNA, 95 bp, Homo sapiens
aagcagagagaaatgcttttcccttctgggtccaggaaggcagctccataacccgtttctgactccagagaggaataagaataaactcactgctt

SEQ ID NO: 6831093 - DNA, 83 bp, Homo sapiens
tgaggctcagaaaagtaacttgctggaatttgaactacatccaaagggttttaaaatctaaagcagttgtcttttttacctca

SEQ ID NO: 6831094 - DNA, 69 bp, Homo sapiens
ctcctgtacaatcaggataataatagtgcctatttcacagggttttgtgagcctggtatacagtaagag

SEQ ID NO: 6831095 - DNA, 71 bp, Homo sapiens
gaatttgcaaaattattcccagcatgacagactgttttcaggtctgaatgtgactatttgattttcaaatc

SEQ ID NO: 6831096 - DNA, 61 bp, Homo sapiens
gtagagtctcagcactgtgatgctgaaaggtcaccctgtgtgtgtctgctgatgactctat

SEQ ID NO: 6831097 - DNA, 55 bp, Homo sapiens
tctgtgaacatcacattgacagtctttatcgtgagatgtccagtgatgtcaagga

SEQ ID NO: 6831098 - DNA, 79 bp, Homo sapiens
ctgctctcaaggagctcacagatgaatcagtagtaataattataccaacggctgacatttactgagcacttactagcag

SEQ ID NO: 6831099 - DNA, 114 bp, Homo sapiens
tcacacagggaacctgctagaaatgcagtttcctggtccctgctgcactgcagacatctttaatgacctaggagggacctaggaatattgcgttttcagcaggccccctggtga

SEQ ID NO: 6831100 - DNA, 65 bp, Homo sapiens
accttaggatctcatccatgccacaggaaaacaaaagtggctcaagattgatgagtcttagtggt

SEQ ID NO: 6831101 - DNA, 125 bp, Homo sapiens
agtattgtttcgaaatgcattgtaaacatgttagattcctgatgaatttaaaattgtgtgatgcttctaatcattgtgatcgtcatggagtaagtaactgcaatgtttattttaaacaacttgct

SEQ ID NO: 6831102 - DNA, 67 bp, Homo sapiens
gaactgcaaccccaggacaagttctgacctgacccagtctggcccaggctcctggggcaccatgttc

SEQ ID NO: 6831103 - DNA, 102 bp, Homo sapiens
gattgtgtcccacgccactgagtctctgggacactgggtcagttgtctagtctggcacaattggcaggaatcccaagaaacagtgtgagtgaggggacagtc

SEQ ID NO: 6831104 - DNA, 130 bp, Homo sapiens
ggattagattaggttcagatactggtccaggctgaacaatctgttcgatagaaaattagagatggcctggttgttctatgaataattagtaaaaagttggaaatcagatttctcatgacctaatcacccc

SEQ ID NO: 6831105 - DNA, 68 bp, Homo sapiens
aacttctttgaatcagaggaagtcaacggatctttccaggtcttagttttctcctttgagaagtggtt

SEQ ID NO: 6831106 - DNA, 62 bp, Homo sapiens
aggaatttaagggctcagagagatggagtgactttgcttcagtcttttaactttaagttcct

SEQ ID NO: 6831107 - DNA, 106 bp, Homo sapiens
tttgcagatggaattaaggttacaaattagctcactttaagataggaaaaatactctcaattataaagttggggctgaagtaatcacatgaacccttaaaagcaga

SEQ ID NO: 6831108 - DNA, 60 bp, Homo sapiens
tgtacttctggtgactttatagatcaaataacattttgaataaagttttacaggaatgca

SEQ ID NO: 6831109 - DNA, 77 bp, Homo sapiens
catacacagacactgtgctagttgtttttgcaataatattagaaatcacagaaactcagacacagtatctgtttatg

SEQ ID NO: 6831110 - DNA, 63 bp, Homo sapiens
agggagagaacaagtcatatttttattagtctatgtggagaatctggctgatgttttttctct

SEQ ID NO: 6831111 - DNA, 85 bp, Homo sapiens
tagggttttaagggagagctatttatgaaagtaggggcgcttcaagcttcaagcttgtcataaacagctcctccttaaaacttta

SEQ ID NO: 6831112 - DNA, 59 bp, Homo sapiens
agagctggccagggatcactctgtccaccatcctataccagctgttcctgaccagctct

SEQ ID NO: 6831113 - DNA, 60 bp, Homo sapiens
gaggagtagaagggcaggaggggggactccgtgtgccccagaactgtctgctgcttcctc

SEQ ID NO: 6831114 - DNA, 91 bp, Homo sapiens
aggtgtttggaatgaagaatgctattcattaagcctactttgtgtgaggcattaagtaggctttttagatacattcttattgaatttgcct

SEQ ID NO: 6831115 - DNA, 62 bp, Homo sapiens
tcaaaggttaactctgttgttccatttcaaaagaaaatatcaacaggaaagttgaagtttga

SEQ ID NO: 6831116 - DNA, 74 bp, Homo sapiens
ttcagagaagaaagggtatgtagtcaaccttaggacattgatgacagtttccaggaggctacacctgagctgag

SEQ ID NO: 6831117 - DNA, 83 bp, Homo sapiens
gatgtgctagcagtgtctaggtaggccatcattcgtttagtaaaactctatatggatttgcttatacacatgtgcagaatatc

SEQ ID NO: 6831118 - DNA, 58 bp, Homo sapiens
aagtgagtccttctggctggcaggattcttgtgatcactgggcaggtagggctggctt

SEQ ID NO: 6831119 - DNA, 61 bp, Homo sapiens
gggggagggaggctgtttgctttaggataagcctggctcctctggcccagctgcctctgcc

SEQ ID NO: 6831120 - DNA, 94 bp, Homo sapiens
tgacacatttgctagtttacacagtagcagggattattttaggtaaggtacttatatattttaaaaaatcctgtattagattgcaagagtgtca

SEQ ID NO: 6831121 - DNA, 89 bp, Homo sapiens
ggcaaccagagctgatgaaagttacagattgggagcagagctatttctagtattgtttggaggctggaacagatcataactctgctgcc

SEQ ID NO: 6831122 - DNA, 91 bp, Homo sapiens
ttgtgggggctgtcctatgcattgttgaatatttcatagcatccgtggtctctacccactagagatatcagcagcatgctcagccccccag

SEQ ID NO: 6831123 - DNA, 74 bp, Homo sapiens
gccttgcctgtgtgctctaatgcctagtactctgttagcacagagaaggtgcttagtaagagatatgtgttggc

SEQ ID NO: 6831124 - DNA, 71 bp, Homo sapiens
tttactaggtggtgaatataagtaaacaaaacagacatattctgtctacttggagttcataatctggtaga

SEQ ID NO: 6831125 - DNA, 84 bp, Homo sapiens
cgagaggtatgcagcagtcgctgatgcgccccctgagggctttctcaccctcagggacagggtgctgctgcgtaaggaatcttg

SEQ ID NO: 6831126 - DNA, 74 bp, Homo sapiens
agataattcatgacgttttattcccatgcagcatttgatgacaaatgaggcacagagatgttaatggcttgtct

SEQ ID NO: 6831127 - DNA, 81 bp, Homo sapiens
acttattgcgattactcacaacttagtcctctatttatagaactgcacagaggattaagttgtgaataatccagtcacagt

SEQ ID NO: 6831128 - DNA, 83 bp, Homo sapiens
gacaggtgctgttcagttcataatttggcttcctagatgtagaagtctccggcttctgagccaaaaagcgagcgggccctgtc

SEQ ID NO: 6831129 - DNA, 60 bp, Homo sapiens
ctatgccattagcttctgaagcccttgaatcaagatttaagaggagtagctgtggcacag

SEQ ID NO: 6831130 - DNA, 87 bp, Homo sapiens
gttctactgtctcatagggcatcaagcagagcactgacatgagtctgaaactgttacctgccttgtacaagacatgttcccaggagc

SEQ ID NO: 6831131 - DNA, 89 bp, Homo sapiens
aaccctccagccagtttagattaggtttccaaattagttaggatttttgttaataaatactaggaaactaaatcaagctggctttggtt

SEQ ID NO: 6831132 - DNA, 56 bp, Homo sapiens
cccgggaggaggaagttgcagtgagctgagatggcacaactgcactcctgcctggg

SEQ ID NO: 6831133 - DNA, 55 bp, Homo sapiens
ggagcagctcagaggactagtgttccatggagaacactgtgacaaaggctgttct

SEQ ID NO: 6831134 - DNA, 61 bp, Homo sapiens
tctgcacagattctctgagaatgtatccagaacatatctagttacagagaattagtacaga

SEQ ID NO: 6831135 - DNA, 106 bp, Homo sapiens
aagtctcatttgatgtttttcctctcaaggaatttagtttagtaaagcacaaatactttgcgatattgtttttcttcagagggtaaatgagtaaataatgaggctt

SEQ ID NO: 6831136 - DNA, 61 bp, Homo sapiens
ggggagctctgaggcataacctgttctgctttgaaatcagtggcaggcttctttgctccct

SEQ ID NO: 6831137 - DNA, 60 bp, Homo sapiens
gagcctctggatctgagtttcttgtttttctttcatgccgaggtggctcttcctgggctt

SEQ ID NO: 6831138 - DNA, 59 bp, Homo sapiens
aagggccattgctgagagcagtctcccatgccaaaatggaagctgttggtaaggtgttt

SEQ ID NO: 6831139 - DNA, 62 bp, Homo sapiens
gtggaaccaaggaaaggcatttgctcccagcccgggcagcacttatgctcaccttgttctac

SEQ ID NO: 6831140 - DNA, 55 bp, Homo sapiens
gaggctttggttataaaagatcaaagacatacactttgatcttcactagaacctt

SEQ ID NO: 6831141 - DNA, 64 bp, Homo sapiens
aattcagtcaaaccactggtcattcggtcacacattcagatcaaatggtttctttgactgaatt

SEQ ID NO: 6831142 - DNA, 82 bp, Homo sapiens
atttctctaagcatccgtttgctcatctacattggatgatggatcatccaatgtagatgagcaaacggatgcttagagaaat

SEQ ID NO: 6831143 - DNA, 90 bp, Homo sapiens
tgcatcaaggaaacactgtttattaccaatacagcacacctgtatcagtcagctcttatagctgttgtattcacagtgcttccgtaggca

SEQ ID NO: 6831144 - DNA, 97 bp, Homo sapiens
ggggggcggggggcagggggtggagagaagactatggactgagtataggtggctcagtctccatctgcttgtctttcttctctgtttcctgcccttt

SEQ ID NO: 6831145 - DNA, 63 bp, Homo sapiens
ggccatgtggaagctgtgggtctctggaaatcagtgtctcctcagaccctgtgtcctgtggcc

SEQ ID NO: 6831146 - DNA, 62 bp, Homo sapiens
tggaagctctggccagacctctgagctgcctgtaatactcaaggaggttttcagagtttcca

SEQ ID NO: 6831147 - DNA, 94 bp, Homo sapiens
atgagtactgagcacagagctttgggttccagccacttctgttatgtagacaagtggcatcaaatcaaggtttggcatcatttctagtgctcat

SEQ ID NO: 6831148 - DNA, 81 bp, Homo sapiens
agtctgggaggctaacctggcagcttcctttgcatctgtcttttgtgcagattgcacgggggctgttgtgtctcttttgct

SEQ ID NO: 6831149 - DNA, 77 bp, Homo sapiens
ccaggcaaaatcaaatcaggatagaacctcacgtgtgataacattcatcctcaccatgactttcatcctgagcctgg

SEQ ID NO: 6831150 - DNA, 61 bp, Homo sapiens
gggaagcatctgagggtccacttgaactccagtgaaaatggctccaggattagatgcactc

SEQ ID NO: 6831151 - DNA, 129 bp, Homo sapiens
aaaggtggcaaaatgggtgcagggggagtcaggctcaccatggcctccctgctctccgggtcctctgggacactcggcatgggccgaggtgcctcctccccctcactgtccagatgttctcctccgtgt

SEQ ID NO: 6831152 - DNA, 55 bp, Homo sapiens
aaggtgaaggtgggaggggagaagtttcctccccttctcctttctccctcatctt

SEQ ID NO: 6831153 - DNA, 84 bp, Homo sapiens
cagtccacaccagatggcagcgtgggagagggacatcagctctagaccttccctcacttctagttataagcctttgggggactg

SEQ ID NO: 6831154 - DNA, 75 bp, Homo sapiens
tgtactttgcaaatgaagctctgaggaggtaactaccttcttcaaagtaatagagactatattaatgcagatata

SEQ ID NO: 6831155 - DNA, 66 bp, Homo sapiens
tccttcagtgtcccgctcaggtgcagcctcctccctaaagctcatctcagcttttgatctgaatga

SEQ ID NO: 6831156 - DNA, 62 bp, Homo sapiens
gggcgtgccatttgacagagcaggagcctcgatctggctctgctccctcaaatgacatgctc

SEQ ID NO: 6831157 - DNA, 60 bp, Homo sapiens
tcatgaatattgaatgcttcatgaatactgaatgcctcatgaatattgaatgtcttatga

SEQ ID NO: 6831158 - DNA, 75 bp, Homo sapiens
gcctcaaaggcttcatcttcggatggccactaagtgtctcctagacattaggcttcctcaagaggagtaggaggc

SEQ ID NO: 6831159 - DNA, 92 bp, Homo sapiens
ggtgggcggcccctgctttgtgtgggacagctttccgttgaggtggggcagtggccgcctcttgcgctgttcctaccattgcgtctccctcc

SEQ ID NO: 6831160 - DNA, 62 bp, Homo sapiens
agctgagtattctgatatacatgacaagataatgattttgcagagaggttaggaactcagtt

SEQ ID NO: 6831161 - DNA, 78 bp, Homo sapiens
tttactcaaatgttttgcttcctagttgggtaataagtattgtgcttacacgtcggagaggatgcaagaacgagtaaa

SEQ ID NO: 6831162 - DNA, 109 bp, Homo sapiens
tattggacaagggagaggctggtgattctgaggcagctgcttgctaatcctggaagcagaggggaacaagatttagctcccttatctctctgccttctcctttccgatg

SEQ ID NO: 6831163 - DNA, 63 bp, Homo sapiens
cagctataccttttactcattatccatgtaaaattccacagggatcagcagagggtgtggttg

SEQ ID NO: 6831164 - DNA, 59 bp, Homo sapiens
cgggaagtattttcagttttaaaacccagtcattattgactggctggctgagtttcctg

SEQ ID NO: 6831165 - DNA, 104 bp, Homo sapiens
ccctgaccttctccctggtgcccctttagcccctgcagagacttctgcctttccctaggatacatggttgctgggggtggcagagctagaaccagggtggtggg

SEQ ID NO: 6831166 - DNA, 99 bp, Homo sapiens
atgtgatatatagatacatgtcaagagacttatcgtagggaatttactaacccaattataagggctggctatgaagtcttcacatgactgtttccacat

SEQ ID NO: 6831167 - DNA, 61 bp, Homo sapiens
gcataggatgtttctctgtggttcctagagatggagttcactgaagagaagcattttctgc

SEQ ID NO: 6831168 - DNA, 72 bp, Homo sapiens
agggaagaagttaaataaatggaccaggagtggtttttcatggtaccatgttgctttgatttgcacttctct

SEQ ID NO: 6831169 - DNA, 55 bp, Homo sapiens
ttaggtttaagtgactggaatcattcctacatgattcctggcggcagaaacgtga

SEQ ID NO: 6831170 - DNA, 65 bp, Homo sapiens
ggagaggcagggaagggtatgggcaggaagcacttggctgtttgttccctctctttcctgactcc

SEQ ID NO: 6831171 - DNA, 71 bp, Homo sapiens
actgctttcagtgctggaggggtgcttgcaggagcattgtgtaattctaatccagagctggtgagagcggt

SEQ ID NO: 6831172 - DNA, 68 bp, Homo sapiens
tcatgattcagtgtagggcagacccctggtgcataggctaccactttcttatcccatactgcattaga

SEQ ID NO: 6831173 - DNA, 73 bp, Homo sapiens
atctgtttttttggtggagggaactatttccaggctgagaacaacttgaaaatgtctcccccaccgtgcagat

SEQ ID NO: 6831174 - DNA, 86 bp, Homo sapiens
ccagaagactgacaagtaaaattggcaaagtgtaggtcattgcaggtcattggccttactgagggcaattttgatggagtctctgg

SEQ ID NO: 6831175 - DNA, 75 bp, Homo sapiens
ttgtatctgtgtcgttctgtgctctggcagctagaccagctctcacttacagcaacggaggcgacataaaagcag

SEQ ID NO: 6831176 - DNA, 76 bp, Homo sapiens
agaatagttgtatcattggtgggaagactgactgggaaagggcaggaggaattttccaaggtgatgaaactgttct

SEQ ID NO: 6831177 - DNA, 73 bp, Homo sapiens
aacacgtttcccaagaggtgtttgtttacttatttctattattggaataaattaccctttagggaattgtgtt

SEQ ID NO: 6831178 - DNA, 62 bp, Homo sapiens
cctgggctggtgaggctgccctgcagggcttctcactatgtagcaccagtcaccagcccagg

SEQ ID NO: 6831179 - DNA, 77 bp, Homo sapiens
tagtttactgagaatgatgatttccaatttcatccatgtccctacaaaggaaatgaactcatcattttttatggctg

SEQ ID NO: 6831180 - DNA, 81 bp, Homo sapiens
gctgtggtgtgtattttaaggccttgagggaaattttaaaaacttaaaactgagatttcctgcactgcctttgatcacagc

SEQ ID NO: 6831181 - DNA, 60 bp, Homo sapiens
tctggagataagacagacagatgacaaagattcatgacattcagactgttcctctctaga

SEQ ID NO: 6831182 - DNA, 101 bp, Homo sapiens
ctgaatgtcactgtaaagaaacgaaaaacaggaggcgacgtgtgctgggcagatgggacatggctttctgtgtttccgtaggtaattgcaacagcattaag

SEQ ID NO: 6831183 - DNA, 60 bp, Homo sapiens
tggtacagcattacaactacttgtgagaggagctcctacaagagcagtaagcttgtccca

SEQ ID NO: 6831184 - DNA, 61 bp, Homo sapiens
agtcccagatctccattcggtcatttctgaaaccacctcagggagaaggggatgtgtgact

SEQ ID NO: 6831185 - DNA, 109 bp, Homo sapiens
ttctctgttgagccttataagctcttctgtttcaagactgctactttcaaaaataggtatgagctgctctgggaaacagaagttgtttgttgtttgtcacttcagagaa

SEQ ID NO: 6831186 - DNA, 61 bp, Homo sapiens
taccgatttcattatgctcatgcttaattttgttagcatcaagacgatgtgaaatcgagta

SEQ ID NO: 6831187 - DNA, 85 bp, Homo sapiens
tacatttctactgttcaagccactgtttgtgtaattcgttatggcagccataggaaactaatacagtctggaacatagagatgtg

SEQ ID NO: 6831188 - DNA, 60 bp, Homo sapiens
taggagggaagcttttaatttaaaaaaattatttgatatttaagccagcttcttctccta

SEQ ID NO: 6831189 - DNA, 71 bp, Homo sapiens
gggccagccgcactgggcctcattcctggagggccctgtctctcggcagtgttgctaggtgcggtgagccc

SEQ ID NO: 6831190 - DNA, 63 bp, Homo sapiens
ctttgctgatgcatgccatgtgccagttgccaagcaacatacataacacattcatcagcagag

SEQ ID NO: 6831191 - DNA, 88 bp, Homo sapiens
ttgtgatagttcactgagaatgatgatttccaatttcatccatgtccctaaaaaggacatgaactcatcgttttttatggctgcatag

SEQ ID NO: 6831192 - DNA, 62 bp, Homo sapiens
gctggcaggaaggcatttagacactcaacatgtattgatttgtttttagactttctgcagac

SEQ ID NO: 6831193 - DNA, 60 bp, Homo sapiens
ggggaagtactatttttctatacttgagaaaagtgaggtggagagattagtaattcaccc

SEQ ID NO: 6831194 - DNA, 129 bp, Homo sapiens
atgtagtaaaaatcatttgtattctctgattatatatgtcagattcctaaatatcttgatcatgttattttgctaaagatattctgatggtggatctgtatatgatttacataaatgaggcatttgcat

SEQ ID NO: 6831195 - DNA, 89 bp, Homo sapiens
acttttgtgctactacacatcaggacttttgaagcatccaataaatccatttaataagtatgagcatgtgtctgagtggacaagaaagt

SEQ ID NO: 6831196 - DNA, 77 bp, Homo sapiens
tttgtgttttgaggtcttgcaatgtttttgtgtttctgatgctaataactaaagtttgtaagactgtagaatgcaaa

SEQ ID NO: 6831197 - DNA, 73 bp, Homo sapiens
gtgagctgtctatgtctttagtatcttttggaagactcaatgtattccacagattaaaaacatacttagccac

SEQ ID NO: 6831198 - DNA, 121 bp, Homo sapiens
cacaggacagatgctacaagtaaagtagaaaacagaagcaatctatgaatggttcatatgtgtaaatgcatttgtttaagctatttggaaaacttggttagtattttcacttagttctgtg

SEQ ID NO: 6831199 - DNA, 82 bp, Homo sapiens
gcatattcttttaaagcagggtttctccacctgaacattaccgacattttgggctggataagtctttgttatgaggagctgt

SEQ ID NO: 6831200 - DNA, 59 bp, Homo sapiens
actctaaatagcctcttaaacaccaaaggaatacagggacagaggttaacacttagagt

SEQ ID NO: 6831201 - DNA, 78 bp, Homo sapiens
ttttccttatccctattgctggaacagaatgccaagacatgacatgtatggcttcccaggaaaggagaagtgggaaaa

SEQ ID NO: 6831202 - DNA, 61 bp, Homo sapiens
gggatgtgaaacaccctccaatgcacagggcaggccctgctgcagagaatgttttggcccc

SEQ ID NO: 6831203 - DNA, 58 bp, Homo sapiens
attaatagcctcattttgcaagtttcatggcaacattagagcaagttaaggcattaat

SEQ ID NO: 6831204 - DNA, 84 bp, Homo sapiens
ggagagagagaaaattaattaatggaggctggaagtctgagatcaaggtgccggcagggttggttttctctgaggcctctctcc

SEQ ID NO: 6831205 - DNA, 56 bp, Homo sapiens
ccagccctgggggtccttcccactgtttcacaacagccagtcctcccacagggtgg

SEQ ID NO: 6831206 - DNA, 57 bp, Homo sapiens
ggccctgtgtgaaaggaacacttgctcaggattcctggatttagttcttcacaggcc

SEQ ID NO: 6831207 - DNA, 72 bp, Homo sapiens
cctctgaggtccttcccagctctgacaatccctgagtagtctgtgcagtggcttgggctggggccctagggg

SEQ ID NO: 6831208 - DNA, 69 bp, Homo sapiens
ggccacactctggtagaggtgaagtgcaaactcagtcttcagcaatgtcattccttcacggaggtggcc

SEQ ID NO: 6831209 - DNA, 61 bp, Homo sapiens
gttagatgaagaccaagggcaaattcacacctctggggcttgctctggtgttttatttaac

SEQ ID NO: 6831210 - DNA, 74 bp, Homo sapiens
tgagtctggacccgaggcctagggaagctagagtaaaaccaaacttattggccaactgccttggagccatttca

SEQ ID NO: 6831211 - DNA, 83 bp, Homo sapiens
ggctgtaatgtatttgttcagaagagttagcccaaaaactcctaagtagattctttagccagcaggtatatatccaatcagtc

SEQ ID NO: 6831212 - DNA, 63 bp, Homo sapiens
gaaagaggaagctgatgcccacggttcaactaaaaaggaaaatgtattaggtgttcctctttc

SEQ ID NO: 6831213 - DNA, 67 bp, Homo sapiens
gtgtccctccccaaaattcatctgttaaaatcctaatccccaaggtgatggtattaggaggtgaggc

SEQ ID NO: 6831214 - DNA, 78 bp, Homo sapiens
cacagtggctttggccaggtctggaaacagtgtacatcacttctgcccacttcctcttggccagaattcagtcacgtg

SEQ ID NO: 6831215 - DNA, 66 bp, Homo sapiens
cagatctctgtgtagttcagtcttcttgctcctttctgaggacattttcattccacagggaatctg

SEQ ID NO: 6831216 - DNA, 76 bp, Homo sapiens
agtgacctatgtgggcaatccctgcttcagcacccccttcagctccagtaatttgattgcccagaatattctcatt

SEQ ID NO: 6831217 - DNA, 61 bp, Homo sapiens
atttggctcgatggactttgaatcctttgtatttgaaattcactctccattgagtataaat

SEQ ID NO: 6831218 - DNA, 85 bp, Homo sapiens
cagataacttcattttaatgcaggtaacttttcagtttaatgatcggctttataaacccaggttatctgcagctgctgatatctg

SEQ ID NO: 6831219 - DNA, 76 bp, Homo sapiens
aagttcattgcatcatgatcatatgggttgcttaattattactctttagtggtgatgatgctattcacatggactt

SEQ ID NO: 6831220 - DNA, 84 bp, Homo sapiens
tctctctctttctccttaccttgcctattgttcttacatgttcttttagcaacaggaatattatggcaattttgaagagagtgg

SEQ ID NO: 6831221 - DNA, 96 bp, Homo sapiens
gcacagcagcagccgagtctggagcagcagtattggtgacaagatgtcaccagagcccatctgctcctaggcatgactttgactaaactgttgtgc

SEQ ID NO: 6831222 - DNA, 58 bp, Homo sapiens
ctggctggtaatggaacgacagagttgagaaggattttaaatccaggaccagactcag

SEQ ID NO: 6831223 - DNA, 80 bp, Homo sapiens
agtgggcttggaaggtggtgatcatcttgaaggctgttaaattcaccctgaagatggttgatccccttgaaggctatcct

SEQ ID NO: 6831224 - DNA, 62 bp, Homo sapiens
ctggattcttacttctgcagggttcaaggatttacattaggaaaccctgagaggtggtctgg

SEQ ID NO: 6831225 - DNA, 84 bp, Homo sapiens
caggtccttctcaaggaaaagtgatggcatactgattagatgtatgatgccgatgccatcacttttccttttgtaggcatactg

SEQ ID NO: 6831226 - DNA, 69 bp, Homo sapiens
ggagattagaggaaagactgggactaaggtttgggtatttattccccatcttcctctggttgtgtctcc

SEQ ID NO: 6831227 - DNA, 72 bp, Homo sapiens
ggtttgcatgtgatgttgggcaacaggtttatttggctacattcatgcccacatccactagacatgcacact

SEQ ID NO: 6831228 - DNA, 70 bp, Homo sapiens
ctgaggcccagcctggtcttggggggcgctggaggaacacagctgctctccccaggccagtctgacccag

SEQ ID NO: 6831229 - DNA, 86 bp, Homo sapiens
agtttgtctcaggacaacctcaggttgctgcagtgtctctctatctccctgtagtgtctactgggcgttgtacctttggacaggct

SEQ ID NO: 6831230 - DNA, 112 bp, Homo sapiens
cagcaatggttaagtgttggaacaaagtaatacagctttacattaacatggtttattcactagaattaatgacctagagcagtaattgcattttcaaaacttcagcttgctg

SEQ ID NO: 6831231 - DNA, 85 bp, Homo sapiens
ctgcagaaatgtctagtctctgttcccacaatgcctagtgcctctgctggaacatgcaatgacaggggactggaatcatctgcag

SEQ ID NO: 6831232 - DNA, 62 bp, Homo sapiens
gtgctgtttcacctcccagcgatctgcatgcccgcagccaggctctgttggaggtgcggcac

SEQ ID NO: 6831233 - DNA, 65 bp, Homo sapiens
ccttcctcctcatgcggcagcagcacgaggctgcggccctgaacgctgtgcagaggatggagtgg

SEQ ID NO: 6831234 - DNA, 85 bp, Homo sapiens
gacattatgtttcagatacagatcaaattagggctggtttgtgtaaatgttttgctttatttgctgtaatctgaagcacaatttt

SEQ ID NO: 6831235 - DNA, 73 bp, Homo sapiens
gaaattggccatggtgggagtatttacaccacaggaattggcaaatgctacatacacatcagggctttatttc

SEQ ID NO: 6831236 - DNA, 65 bp, Homo sapiens
agctggactttaattctttcctaagctctgactcttggtctgctagacagatttaaactcctgct

SEQ ID NO: 6831237 - DNA, 65 bp, Homo sapiens
ttctgctgcagttggataaagatacttcagctcataccactgaagttggtagccaggtgccagaa

SEQ ID NO: 6831238 - DNA, 108 bp, Homo sapiens
ctgtgcacagcaccaagagttgactgagcccggacttgcttctgagctgcaactgggtctgaagcaagcccaggctcagtcaactcttactggttccacttctagcag

SEQ ID NO: 6831239 - DNA, 78 bp, Homo sapiens
cttccttctcgttgtggagagaatgatatcttgatttctgttttggcatcaagcatctctctcccaatgtgaaggaag

SEQ ID NO: 6831240 - DNA, 112 bp, Homo sapiens
tgggtccaacattgttttctttgaagatcacatgttgctcttctctttttggtggacgccagagtcttccgggggacagtgacttcaagtgacttagagacaatcagatcca

SEQ ID NO: 6831241 - DNA, 77 bp, Homo sapiens
ccggggcctgctccaggctggggtgcaggttggctggctggctgtactgacgaggaagcctggagggagagctctgg

SEQ ID NO: 6831242 - DNA, 64 bp, Homo sapiens
ttctgttacatggggcacagtgaatcagctctctgatcagccctgacattgtctcctagcagaa

SEQ ID NO: 6831243 - DNA, 71 bp, Homo sapiens
ctcagcaaaacagccgttgcctgggggaagaggtgagtttaatatccaggttcttcgttgcttttgtggag

SEQ ID NO: 6831244 - DNA, 72 bp, Homo sapiens
tatattaagatccattgccatatcttaacaaatggcttagcataagctgggcatttgatagggcataatata

SEQ ID NO: 6831245 - DNA, 99 bp, Homo sapiens
gaggaggctttctggaggaggtgacaatgctcagagtcccttccctcgtggtggcgcgtttccccgcggggcgtgggctcttacctgctcctcctcctc

SEQ ID NO: 6831246 - DNA, 78 bp, Homo sapiens
atgaagctctgaggttttgatgggtgtagatatagacatccaaagctgtcatttcacactagtcagaataccagtcat

SEQ ID NO: 6831247 - DNA, 64 bp, Homo sapiens
ggaaacctgtcaaatccctaaaacaaaggaccttctggggggttctgggacattgcaggtattc

SEQ ID NO: 6831248 - DNA, 80 bp, Homo sapiens
atggaggataagggagggtggggcttctggtttcatttagatttgcttagaagtaatttaccttctcctatattttttat

SEQ ID NO: 6831249 - DNA, 59 bp, Homo sapiens
cttcccaatatgcagtcattttaccaactcttggagtgatttactaccatattgggcag

SEQ ID NO: 6831250 - DNA, 94 bp, Homo sapiens
ggggagagtttcatctctgcttcctggagggagagagctgagccccagtgacagctgttgtgatttccaggaggcacagggctggggactcccc

SEQ ID NO: 6831251 - DNA, 62 bp, Homo sapiens
gtgtggcaaagaccatttctttcacccaatatgattgtaggaagaataagtctttgtaccac

SEQ ID NO: 6831252 - DNA, 62 bp, Homo sapiens
cctctggggcatcagacaaaggtacaactatagaaagccttaatcctgagagtcctatgagg

SEQ ID NO: 6831253 - DNA, 59 bp, Homo sapiens
gtccactgcactggattcttgccctgagtacacagaggttagaggtcagtgcagtcgat

SEQ ID NO: 6831254 - DNA, 127 bp, Homo sapiens
tttatccattgatctgttgttggatatttagttcatttctacatcttggctattgtgtatagtgctgcaatgaacatgggagtactaatatctcttcaagatcctcatttcaattcttttggataaa

SEQ ID NO: 6831255 - DNA, 72 bp, Homo sapiens
aaggggtgagcagaggcttcgcttaacttccttaaggctctcaatggaagaaccgcaagtgtctgtcccctt

SEQ ID NO: 6831256 - DNA, 63 bp, Homo sapiens
tgggatgcaggagggctaaagtaggcccagtaaggatgggcttcctgtatcctcctgtaccca

SEQ ID NO: 6831257 - DNA, 55 bp, Homo sapiens
aactccagtgtcagctgcaatgtacattagcaccagcatcttgagactgtgagtt

SEQ ID NO: 6831258 - DNA, 59 bp, Homo sapiens
ttgaagttctaagccccagtacctcaaaatgtaactgtatttggggatagagtcttcaa

SEQ ID NO: 6831259 - DNA, 74 bp, Homo sapiens
tctgattggccaaactggtgtcactgagggctgggaagattatccccacccaagaacacacagggacagacaga

SEQ ID NO: 6831260 - DNA, 83 bp, Homo sapiens
gaggcccagattctaattcagagactcattctggagctcaagcttttaacaatgattttctgaaacctgtcttacctggcctt

SEQ ID NO: 6831261 - DNA, 68 bp, Homo sapiens
ctttccaggaactaagcacattatctgataattgtaaatttttttgtcagtgctttagttcaggatgg

SEQ ID NO: 6831262 - DNA, 105 bp, Homo sapiens
agcttcgtggagctgtggatactatgggagattcattgctttaggcattgtagaaatgcactgctttaaggctgagtaactcattctatagactctaccacagct

SEQ ID NO: 6831263 - DNA, 69 bp, Homo sapiens
ctacatcaagtaatcttcaaaaagtgctgaaattggacagtgctggcttgatcatttcttggactgtgg

SEQ ID NO: 6831264 - DNA, 58 bp, Homo sapiens
cgtacagactgttcaagtgataatggaaaactccatcacctagtcccagctctgtatg

SEQ ID NO: 6831265 - DNA, 77 bp, Homo sapiens
ctccaactgcagtgtgctcttgttctcattgttctggacagagagaaacaatcagcagccacccactgcagctggag

SEQ ID NO: 6831266 - DNA, 110 bp, Homo sapiens
catactgaagatcaaatatcataatgtagaaatttgggaaataattaatgtgaagtcaggtcttgatcactctgtaaattctctatctgtgagtattgtttcgttgtatg

SEQ ID NO: 6831267 - DNA, 78 bp, Homo sapiens
tgtcacaagaacattagagaagcttggagatgtgcaagaaaaagcatttttacaataaattctcaagtatatgtgata

SEQ ID NO: 6831268 - DNA, 73 bp, Homo sapiens
ttgtccagcaggtgtttgccaacttgaagagctacctactatcacagacctataaaagtacgcctgtggacag

SEQ ID NO: 6831269 - DNA, 62 bp, Homo sapiens
aggaatagctggcagctcccatggaggactagctctatgcagcagttcttggagttgttcct

SEQ ID NO: 6831270 - DNA, 77 bp, Homo sapiens
gcaagtgtctttaaaagtgcaagttgtgactgatggatacccaggcagtacagaatctattcctgcaagatacccgc

SEQ ID NO: 6831271 - DNA, 100 bp, Homo sapiens
gtatccattttcagagcctttgattagcacctgaggaaaaaagggtacatggaaagctatgtaatttgccctcaagttaatttgttggtctgaagagtac

SEQ ID NO: 6831272 - DNA, 58 bp, Homo sapiens
tttgagtctcagttttcctgcttattatgtgcatagtagtaaacccatgaggcttaaa

SEQ ID NO: 6831273 - DNA, 69 bp, Homo sapiens
tgcactctgaggagtgactagaggtgagcttgaaagggaggcctcgtgtgtcctccggtggaacgtgca

SEQ ID NO: 6831274 - DNA, 64 bp, Homo sapiens
ctccctgtgtcatcagctgtggctacaaggacaggcttgtgcagcagaatatggctgcagggag

SEQ ID NO: 6831275 - DNA, 78 bp, Homo sapiens
tgaaactcttgaattctgatttatttatacattggggcaaaataacacctcagttgaggttagaatgtaagagtttca

SEQ ID NO: 6831276 - DNA, 56 bp, Homo sapiens
aagtgattaagtaacctaatatgatagagaaatttatatttggggattgattactt

SEQ ID NO: 6831277 - DNA, 71 bp, Homo sapiens
aaaggctccctcttctcgagtgttgctctactcaaccatcaatactcagctcaacactcagggaagtcttt

SEQ ID NO: 6831278 - DNA, 65 bp, Homo sapiens
ctgggcagtgcagctatagaacattttcatcattgcagactttctattgggcagcattgcttcag

SEQ ID NO: 6831279 - DNA, 84 bp, Homo sapiens
gaggaagcagaatagattcatggttaagagcacagatcctggaaccagaatgcctgaaatcaaatcctagttctgtcactcctt

SEQ ID NO: 6831280 - DNA, 63 bp, Homo sapiens
actctgggaagtggagacttcagtggcaggacttttgtggcatgatatttatcttccctgggt

SEQ ID NO: 6831281 - DNA, 56 bp, Homo sapiens
tttccagctggacctgccctagctcctgaggactatgagggaggtagcattggaaa

SEQ ID NO: 6831282 - DNA, 63 bp, Homo sapiens
gaggtagcgtgcagggcccgaagtgcgctgtttcgtaaggtaccctccctgcaccctactctc

SEQ ID NO: 6831283 - DNA, 85 bp, Homo sapiens
attaactatggcttttaactttgatggcaaagacatagattgtttagctacccctttgccatcaaagttaaaagccagagttaat

SEQ ID NO: 6831284 - DNA, 85 bp, Homo sapiens
ctcgagggctgctggaaaaatgcaggcacccagtgggctgggcctaaagatgtacatttttctcccagtgatagcagctcttggg

SEQ ID NO: 6831285 - DNA, 86 bp, Homo sapiens
atttgtcatacttcttaaaagtatgccaattggagaacaagacacttgcttccaaaatgagaatacctttgtgaaaattgacaaat

SEQ ID NO: 6831286 - DNA, 56 bp, Homo sapiens
ctgcaggctcccagggagggattcccagtcagaagcccaccttgttagtcctgtgg

SEQ ID NO: 6831287 - DNA, 62 bp, Homo sapiens
cccaagcctttcaaaactcagactgcctaattgtcagggctctgttttgaagaggctctggg

SEQ ID NO: 6831288 - DNA, 93 bp, Homo sapiens
ataatttaaaagaccagtagtatggattatgaaaacacgagcccaccacagggaaagttaaagtctatgtactacacttgttttttaagctat

SEQ ID NO: 6831289 - DNA, 60 bp, Homo sapiens
ggaggctgagaagtccaagatcatagcaccaacatctggtaaggacttcttacagtgtcc

SEQ ID NO: 6831290 - DNA, 63 bp, Homo sapiens
cctccgtagcctgtggcagtgacggctgctcaagggccttaactgccaggatggcactagagg

SEQ ID NO: 6831291 - DNA, 79 bp, Homo sapiens
ttcagcttttgacactaattgagtgcatgatctttgacaagtcacttagggtatttatgcctcaatttcttcatgtgaa

SEQ ID NO: 6831292 - DNA, 57 bp, Homo sapiens
taaaaggaggaagaggagaaggagataaggaagaacttctctgtaaatcttctttta

SEQ ID NO: 6831293 - DNA, 97 bp, Homo sapiens
gctgcgctagccatcctgggcttccagtcctgtgtcccttggtgggttccctccaggaaccaaggggcggctctcactccaggtggcagcaggtagc

SEQ ID NO: 6831294 - DNA, 61 bp, Homo sapiens
ggaggacgcagatctgggcaggcggcatctggccgggtgagcctgtggagctgcctcctcc

SEQ ID NO: 6831295 - DNA, 67 bp, Homo sapiens
ggccccagcaccacatcaggcccacgaggcccagctcatgtggccctgacacgtggtactggaggct

SEQ ID NO: 6831296 - DNA, 73 bp, Homo sapiens
cattacttaacagaggacgtttctgtcaagagtttgtttagtctctccagaggctttctctgcttaggcagtg

SEQ ID NO: 6831297 - DNA, 70 bp, Homo sapiens
tgcttctcttggagggccataactgtcagtggaaattattttagttatgtcagctctgcagaggaaagta

SEQ ID NO: 6831298 - DNA, 63 bp, Homo sapiens
aactctgacttctgtacttgccttaggctcctattaaaggtcaaacaagtatagaattaggtt

SEQ ID NO: 6831299 - DNA, 58 bp, Homo sapiens
ccattctgaagtgcaggctaagccacagattggtttgaacctgtcagttcagagctgg

SEQ ID NO: 6831300 - DNA, 58 bp, Homo sapiens
tgcaaattgcatgatgtgtatcatttacaaacatagttctatacatatgcaatttgca

SEQ ID NO: 6831301 - DNA, 90 bp, Homo sapiens
gggcgggcggctacttaaggtcggcgacccgaggccgcggctgccgactgggtcccctgccgctgtcgccaccatggctccgcaccgccc

SEQ ID NO: 6831302 - DNA, 77 bp, Homo sapiens
tcacttgaacccaggagacggagtttgtggtgagccgagatcacaccattgcactccagcctgggcaacaacagtga

SEQ ID NO: 6831303 - DNA, 69 bp, Homo sapiens
agagacgtgttgagacagggaacagtggacaggaagactgcattctccctgttcctcgacaccgaatct

SEQ ID NO: 6831304 - DNA, 98 bp, Homo sapiens
cctgctgtggtcttggtgctggaggaagcgccttcctcctctttgttcggcatgagagatgaagggcattccccaggccagagcatcccatagactgg

SEQ ID NO: 6831305 - DNA, 72 bp, Homo sapiens
acagcacattatgctactaccaaatgtgttcagatagctgctattcatttattagttagttcgatgttctgt

SEQ ID NO: 6831306 - DNA, 93 bp, Homo sapiens
tcatagtttgtgtctttggttgtgcatgtaccttattctggacactcttctcagaactttatatgtatcatccatgcttacaacaccttatga

SEQ ID NO: 6831307 - DNA, 69 bp, Homo sapiens
tcccaaagtgctaggattacaggtgtgagccactgcacctggtctgattctccactttctatataggga

SEQ ID NO: 6831308 - DNA, 119 bp, Homo sapiens
ttttagcactgaataatattccacagtctggatgcaccaaagttgttgtctttttttcctccattcacctactaaaggacatcttggttgcttccaagttttggcaattaggactaaag

SEQ ID NO: 6831309 - DNA, 130 bp, Homo sapiens
cctctggatcactagttcaaatgcaaaaggccataaaaagctgttatcttctggcggactcagtgaaagtttccaggcgatatcagctgccacaaatggcgctcgcgtgacaaatgctcggtgcacaggg

SEQ ID NO: 6831310 - DNA, 59 bp, Homo sapiens
gcccagggctctgtccattccttcataggctgctatgattgagaggagagcctgagggt

SEQ ID NO: 6831311 - DNA, 74 bp, Homo sapiens
ggggttcactaaggtctttaacaggtctttttctaattatagccaagaagagcctggggaccatggccgacttc

SEQ ID NO: 6831312 - DNA, 68 bp, Homo sapiens
gctgcctcctgggttcaagcgattctctggcctcaggctccagagtagctgggactacaggtgcatgc

SEQ ID NO: 6831313 - DNA, 89 bp, Homo sapiens
caagagctgaggctggataccaggagacagggggccacagagccctcctgtgcatgcatctccctagtgttccatcggcccagctcttg

SEQ ID NO: 6831314 - DNA, 120 bp, Homo sapiens
tttgtatatagatagatagaatctttagctcagtgttcattttgaagtacttcaaggtttagcctgggagagaattttaggggaagatgctgctgttgatgtatctgctctatatatgga

SEQ ID NO: 6831315 - DNA, 79 bp, Homo sapiens
gatgggctgggctggaaggccaaggcaggcttctttcaatgtctggtgccttggtgcttcttcatgtggcccttccttc

SEQ ID NO: 6831316 - DNA, 94 bp, Homo sapiens
ttcttgcctgaattaattacagtgaagattgcaaagggattatgttctaattctgtaatccctttttcatttaatagatagcattttgcaagaa

SEQ ID NO: 6831317 - DNA, 106 bp, Homo sapiens
aaaagcacaagagatagacgtcaccctggagagtgctgtagtaatccctaaatgccttataggattactgaaccctacttttacaggttctttctgttgttctttt

SEQ ID NO: 6831318 - DNA, 76 bp, Homo sapiens
ggagttgcagcactggacaggagtgaaattaacaatatttaattttcttgccttgtctgagtgtgctgtatgtacc

SEQ ID NO: 6831319 - DNA, 58 bp, Homo sapiens
gtcacctcgctgtcttcctgagttcaattaaagaaaacagtaacagcaagaggctgac

SEQ ID NO: 6831320 - DNA, 58 bp, Homo sapiens
tgtgttctggaaagctcactgaatcttgaaggagacaggggagccaggctaggaagca

SEQ ID NO: 6831321 - DNA, 65 bp, Homo sapiens
ccaggagcagggctggctgcactggtctgcaaaagcaaagtgtcagccagacgccctgcacctgg

SEQ ID NO: 6831322 - DNA, 79 bp, Homo sapiens
acttctgtgtggtttcaggagctggtgtcgcaccttctcagacattcttggactcggttccactggctactacagacgt

SEQ ID NO: 6831323 - DNA, 55 bp, Homo sapiens
ggagggggactgacactgatttttcatttgaaatcagccacttaaatctctttcc

SEQ ID NO: 6831324 - DNA, 85 bp, Homo sapiens
ccttttcccactgtgggcctgatgttcttctctatttcgctgggatattttggggacaatattcaggcccactcttttgagttgg

SEQ ID NO: 6831325 - DNA, 66 bp, Homo sapiens
aaagacgatgctcaactatatgaattttgaaaaattatgaatgtcagaatgcagagtgtggtcttt

SEQ ID NO: 6831326 - DNA, 85 bp, Homo sapiens
gtgctatctggagctactgtgataggaactgtgtgtaaagaagactgcttacagcactgtgcatagtggttcagactatggacac

SEQ ID NO: 6831327 - DNA, 79 bp, Homo sapiens
gacccagctgagtcccagtggaagataggctctgggaggttggtgaccttatcttcaactaggattcatttgttttgtc

SEQ ID NO: 6831328 - DNA, 125 bp, Homo sapiens
tgtagacgtttctgtgtgtggtgtgcgtacatgtctgtcatatgtatgatctctgtacatgtcaatatgtgtatatgtgatgtacatgtacatgcctgtgtgatgagcatacacgtctgtctgca

SEQ ID NO: 6831329 - DNA, 57 bp, Homo sapiens
cacccttaaggctcctgaaatacaatcatgtattttagactaattcctaaagggctg

SEQ ID NO: 6831330 - DNA, 104 bp, Homo sapiens
gtccacatttttagatatttgttatagcaacaccccaattttctagtactagtttctgttttagtccatttgtcctgctatataaaagtgcctgagactgggtc

SEQ ID NO: 6831331 - DNA, 75 bp, Homo sapiens
tcctgaactgaaagcgacctctaatctagtgcctgttttcaggactgaccagttggttgtttataagagcagaga

SEQ ID NO: 6831332 - DNA, 70 bp, Homo sapiens
agtccagagggcagcagctcctcctagctggaccagaatccagcttcctggcttcctgcccttcctggct

SEQ ID NO: 6831333 - DNA, 57 bp, Homo sapiens
gcaacacaatatcccagtacatcataaggttggatgctgaagggaaagttgtgctgt

SEQ ID NO: 6831334 - DNA, 58 bp, Homo sapiens
atgcagtcttgcaggaactgaaggatgtttgatgtagctacaggaatcaagactgcat

SEQ ID NO: 6831335 - DNA, 68 bp, Homo sapiens
tgcagagttcagccctacccattccctgggcagggcccctggctggctgggtgggcagagtctcttca

SEQ ID NO: 6831336 - DNA, 114 bp, Homo sapiens
acaaagttccctcagtgtgtgggtttttctgtgagcggtaaaggtcttgggggaggctgtggtgtccaggtctcagtacttgcacagaagaacttgctatactgcagattttgt

SEQ ID NO: 6831337 - DNA, 55 bp, Homo sapiens
gtagaaaaagcagtaagtctcagtcatctggtatttggactattgctctttttgc

SEQ ID NO: 6831338 - DNA, 56 bp, Homo sapiens
ggaccaaggccctgtttcagcccttcccaacctgcactagctggggcctctggtcc

SEQ ID NO: 6831339 - DNA, 64 bp, Homo sapiens
ttgcatctcatcaagcctagacctatgtcccagtttacaggaggttcaggagatggaggaacaa

SEQ ID NO: 6831340 - DNA, 72 bp, Homo sapiens
atttatttgctagtgaggccagtgacatatattaagttaacttactatatataggacctcagtgaagtgaat

SEQ ID NO: 6831341 - DNA, 59 bp, Homo sapiens
gctgggtgctgcctggggagcctggaagtccgtccgcatccagggcgcaggatctgagc

SEQ ID NO: 6831342 - DNA, 65 bp, Homo sapiens
tgtcagagggacatgaggatgatctagaaggggtatgtaccacttccactcgtattctgttggca

SEQ ID NO: 6831343 - DNA, 57 bp, Homo sapiens
gacatgtgtctgcaagttgatctatagagcaagatcaattattgcatcatagatgtt

SEQ ID NO: 6831344 - DNA, 60 bp, Homo sapiens
atctggtaagcatattgcagaggaactaaaatgaacccctttctagtgtgaccaccagat

SEQ ID NO: 6831345 - DNA, 75 bp, Homo sapiens
tggtattgaattatatggtattgaacatgcagtcttatagtcactcatgttcctttaaaatatagattggcatca

SEQ ID NO: 6831346 - DNA, 92 bp, Homo sapiens
gtggatggatgcatgtggtcccttaggaagtgtgtccagaagcggccactttgcttctgtttcattgatcttagctacatgcctgcacccac

SEQ ID NO: 6831347 - DNA, 67 bp, Homo sapiens
ggcatggatttaatgaaaggtctgctggaagccacatcaaacagcagcacgagtccacaaatccgct

SEQ ID NO: 6831348 - DNA, 66 bp, Homo sapiens
tttgccctttctgagcctcatcacagttgcctccatggacgacaccaaggcccagagaggtgtaga

SEQ ID NO: 6831349 - DNA, 67 bp, Homo sapiens
acccctatgagctgccttggggaaggatggcaggaaggcctctgagttctgcccaaggtctgggggt

SEQ ID NO: 6831350 - DNA, 93 bp, Homo sapiens
gtcatagcagctgctgatggcctgacagacagtttccgcagcgctacatgaggccctttggtgtctctgtcaggagattggcagctgaatgac

SEQ ID NO: 6831351 - DNA, 71 bp, Homo sapiens
ggaggcccccggcgccccccggtgtccccgcgaggggtccagggcggggtctgccggccctgcgggccgcc

SEQ ID NO: 6831352 - DNA, 106 bp, Homo sapiens
ccataaatatagaatagaaaagctatattatatttgtgtttggtgaaatgaagtgttacccaaactcagatgtggtgaagaccttttgtgttctctatatttatgg

SEQ ID NO: 6831353 - DNA, 97 bp, Homo sapiens
ggttgaggcaggaaggcaggaggaagcgtgggtctggctggagcctcacaatcaaagcctctgttcagttgtaccttcccctcttccctcctccacc

SEQ ID NO: 6831354 - DNA, 100 bp, Homo sapiens
gagaagctagtatagaatgatctggtaaagtggttggtgatgataaaaatataaagacattacacaaacacattccagatatctaaatctaatgcatctt

SEQ ID NO: 6831355 - DNA, 62 bp, Homo sapiens
gctgatggatgtttgaagttgcatgtgatatgtgtcatgttttataataaacatcaagtagc

SEQ ID NO: 6831356 - DNA, 129 bp, Homo sapiens
gtgctagcacagggctgacgctgacgggcagtcttctagtgcttgagtctctccgtacccctgagggaggggtgtgctctgaccaggaacgagatcagacagctgtgagagtcccgaccagggctgagc

SEQ ID NO: 6831357 - DNA, 58 bp, Homo sapiens
aaaatcatagaggctaaaattatttggcttaattgcacaaagagggctctatgatttt

SEQ ID NO: 6831358 - DNA, 67 bp, Homo sapiens
ccttgactcaagtgcaagccctgcatgacacggtgcatgcaggctccaggtgcacatatgagcgtgg

SEQ ID NO: 6831359 - DNA, 55 bp, Homo sapiens
tataaagacatccatagcaggctttatccagccagcttctttgggattctttata

SEQ ID NO: 6831360 - DNA, 74 bp, Homo sapiens
tgtttggccattgtttgtaactttagaattgatcctaaaataggtctcagatagggaggttacatggtcaaata

SEQ ID NO: 6831361 - DNA, 58 bp, Homo sapiens
caaattttgtgtgttctctagtgcccttcagggccttaaaggacaggaacaaagtatg

SEQ ID NO: 6831362 - DNA, 66 bp, Homo sapiens
gagagttacatagtgggactggaggctttgcaccaaatcttttatcactcccactgctgtagtctc

SEQ ID NO: 6831363 - DNA, 58 bp, Homo sapiens
catttgcctatgaagtgggatgtgagtatatcagtgcatcccggctttgaggcagatg

SEQ ID NO: 6831364 - DNA, 60 bp, Homo sapiens
cttgtagctgcttcttctgaaggctgggtcccctcacggcttcagggtggcagccacagg

SEQ ID NO: 6831365 - DNA, 103 bp, Homo sapiens
gagccttccctaggttgtgtggtggtgcttcaagaacgtatttattttggcgctcttatctacgtaaataattggaatcactcacataagtctttggtcactc

SEQ ID NO: 6831366 - DNA, 63 bp, Homo sapiens
ctcaggtcgctatttctcttaccccaatttgggacaactttgagggacatggtggcttctgag

SEQ ID NO: 6831367 - DNA, 89 bp, Homo sapiens
ttattgatgctgttaaggccagaggtggtacatagcttctcagttctgagattttagtatcatttttggcatagaatagatttcaataa

SEQ ID NO: 6831368 - DNA, 68 bp, Homo sapiens
gcactggatggcagcatattgacagcatcttttatttcaggactgtgatgcagttgccatccagaagc

SEQ ID NO: 6831369 - DNA, 60 bp, Homo sapiens
ggcttactagtttaaaaagcagaaatatgcattaatggaatgctgtaagattagagagct

SEQ ID NO: 6831370 - DNA, 72 bp, Homo sapiens
ttggcaatttgtatcttctaatattatctccttctaaccatactggggataattctagcagatacaggctaa

SEQ ID NO: 6831371 - DNA, 58 bp, Homo sapiens
aacactaatgggagaacaaccctaataaggtcaacaaaaatgttcttgtaatagtgtt

SEQ ID NO: 6831372 - DNA, 76 bp, Homo sapiens
tgttctttttggcaattatatttttggctgatagtatttcagtgtactcagttgctaacataatagccaaagaaca

SEQ ID NO: 6831373 - DNA, 69 bp, Homo sapiens
tttaaaggtcctagtaagaatgctggctttcaatctgaatgacatgcgaatgtactggagagttttgaa

SEQ ID NO: 6831374 - DNA, 87 bp, Homo sapiens
gagcttccattactcattcgccttgcccaaggcctcagcaaccgacgttcgaaagccaggagaaaaggcgaatgataaagggcgctc

SEQ ID NO: 6831375 - DNA, 112 bp, Homo sapiens
tggaggcttagagaggctgggtaacttttctgaggtcataaagcaacttttgggagaaaaagaccagatgtaggtttgtgtgactctgaagcacaggttcttaaaaactcca

SEQ ID NO: 6831376 - DNA, 100 bp, Homo sapiens
gctggagtgagcaaaacaaagagcgagtgtgggccgcggtgacttcatgcctcaccaatgtcccgcccacgctgctccgagctgttactgctgctcctgc

SEQ ID NO: 6831377 - DNA, 57 bp, Homo sapiens
ttctggctgggcagacagaatgctttcaatttagaccatggagctcccagctcagga

SEQ ID NO: 6831378 - DNA, 78 bp, Homo sapiens
ggagccaggctggagagagagtgcctagctctgcaggggagccggtctggggaagctgggatctctctcccgccctcc

SEQ ID NO: 6831379 - DNA, 113 bp, Homo sapiens
gggaaaatgctccaggcttttgcagatgctaagcagtagggccaacttgcaggaaaaccaaagagacatcctgttggtcctgtctgtgctgctgaaagacactggctcatccc

SEQ ID NO: 6831380 - DNA, 55 bp, Homo sapiens
gtccaccttcttggtcaggcccctgaggcatgcatttctaccaaggaatatggac

SEQ ID NO: 6831381 - DNA, 55 bp, Homo sapiens
tgtactgcttgtgaatatgaatttaaatgttatgtccagggcacacagcagtgca

SEQ ID NO: 6831382 - DNA, 63 bp, Homo sapiens
tggcggcttgggggtcttcacaggctcaagtttctgtgtctgcactgagctctcccagcccca

SEQ ID NO: 6831383 - DNA, 71 bp, Homo sapiens
gagtcagtggtgccacgcaaaaagtagccaaacaaaaggctagacttgcagcgtcaccattcggatgtctc

SEQ ID NO: 6831384 - DNA, 68 bp, Homo sapiens
aaactttggtatgtagcaaaactgctgggtttaataaaacagattactcagctctactgccagagttt

SEQ ID NO: 6831385 - DNA, 60 bp, Homo sapiens
tggcaggtggctctggcattctgtgcaaatcaaacagaattaacctcataacccttgcca

SEQ ID NO: 6831386 - DNA, 56 bp, Homo sapiens
tgccagtcggcactttatctggccggacattggtccctcaggaggtcgacctggca

SEQ ID NO: 6831387 - DNA, 70 bp, Homo sapiens
acttaatggatgtgctaattggatcaaagacttatttctttttcagatttcaaaagtagatccatcaggt

SEQ ID NO: 6831388 - DNA, 110 bp, Homo sapiens
gccccctcttctgtggctgcagcgtcccctccagagcaggcagcctcccgttctccttggccaggggcgggtggcgaggcttctcggggcgcggccagcaggacgggggc

SEQ ID NO: 6831389 - DNA, 66 bp, Homo sapiens
tcatgtttttgccatatgactctactttcctgactgtagatgtcttgcctgggggcaaatacatga

SEQ ID NO: 6831390 - DNA, 56 bp, Homo sapiens
attcatgttcggggccacgttgttgtatgtattgatgtacagccttgaatgtgaat

SEQ ID NO: 6831391 - DNA, 57 bp, Homo sapiens
tggtgcaagtctctgaggagggtgggcagagggtacctctcgttagaaactgcagta

SEQ ID NO: 6831392 - DNA, 69 bp, Homo sapiens
ttagaagcagatctcaagcactcacgatggccatcagggatgaggtggtccagcttgattctcttctgg

SEQ ID NO: 6831393 - DNA, 86 bp, Homo sapiens
aaaggctttctgggaaagtaaatgtaaaggagttgataaaaataatgtcaaacaatctttgcattcatttcattcctgtagctttt

SEQ ID NO: 6831394 - DNA, 69 bp, Homo sapiens
gccgtgtgtgtctgtgtgtgtgtgtgtgtgtgtgcacgcacatgcacccatgtacatacacatgtgtgc

SEQ ID NO: 6831395 - DNA, 71 bp, Homo sapiens
cagttgtgcagtccattgacagaggtcttttggagagagaggaggccgttcgtttgttgactaagcaagtg

SEQ ID NO: 6831396 - DNA, 73 bp, Homo sapiens
gagcaggcacccagggatgtctctggaagggaggatggggcccacttcaccaactgccacatccctcctgctc

SEQ ID NO: 6831397 - DNA, 71 bp, Homo sapiens
atctcacatcttggttgattttctttatgccgattgagggataagctgaatagtcaacacaaaatatagat

SEQ ID NO: 6831398 - DNA, 83 bp, Homo sapiens
aggcagagaaagtctggctctggaaggcaaagggcagttgtgttccctttgatgttcagagcatgggtttggttgatctgcct

SEQ ID NO: 6831399 - DNA, 73 bp, Homo sapiens
gaggcaggaagcctagcactaaggtgagatacttttccatgaagtcttcagtgatataggcttctcctggctc

SEQ ID NO: 6831400 - DNA, 87 bp, Homo sapiens
ctttgtagatcataagatgcccagtgtaagtttctgtccacattaatgatgatgatgttaccagtgcacatttgatggtttatggag

SEQ ID NO: 6831401 - DNA, 91 bp, Homo sapiens
tggccactgctcattctgcaccatttccttccaaacaaacggcttccctttggggaggttatcggtgtgcagcccagggtgggcagggccg

SEQ ID NO: 6831402 - DNA, 93 bp, Homo sapiens
cgggaaaggaatgtggaatgaacaaaggaggcgtctgaggtgcagtctacctgaaagctagccttctattggtcaccattattccctgccccg

SEQ ID NO: 6831403 - DNA, 56 bp, Homo sapiens
tggtcattcaaattaagattttgttagatttctggcatcttggatttggaagacca

SEQ ID NO: 6831404 - DNA, 55 bp, Homo sapiens
tctccccccaaccaatcctgcaatccacaatagttgaagtggtcggggaggcaga

SEQ ID NO: 6831405 - DNA, 60 bp, Homo sapiens
gccctgggaggttagaatatgtattgggaaggataacccaggtctcctgcttcccagggc

SEQ ID NO: 6831406 - DNA, 72 bp, Homo sapiens
cctcttgtcttggaaggtcatcctgcccagagcttgtgaaggtgcagtggcctgagccaggcttccaagagg

SEQ ID NO: 6831407 - DNA, 78 bp, Homo sapiens
taggttagtgtaaaagtaattgtggtttttgccattgaaagtaatggcaaaaaccccaattatttttgcaccaaccta

SEQ ID NO: 6831408 - DNA, 74 bp, Homo sapiens
tcagagcatcgtgtccaggagcccctgggaaaaggcaacttcttcctgaggaggaccaggaccacagatcctga

SEQ ID NO: 6831409 - DNA, 119 bp, Homo sapiens
tagtgagaaggccctggattagggatcatgctacctgagttatattaataattacatttctgctatgaatttgggtattctcaggccaaagcctctcggaatccctgttttctcttctg

SEQ ID NO: 6831410 - DNA, 105 bp, Homo sapiens
tagaatgagaatacaaaagtatcaactgcaatctggatcctagaagacaatgaaaaaatgtcttcttgggttctgagattacattattttgaaccaagaattcta

SEQ ID NO: 6831411 - DNA, 130 bp, Homo sapiens
tggtaccagggaaaaataaatgtcttaatgtgttcttcatgtattttgatgtgccataggtatgtatagaagctaagcatttcacagtatattcaaaatttttgcagaaggcattttttctgtggtgcta

SEQ ID NO: 6831412 - DNA, 72 bp, Homo sapiens
gggatggttggctgaattgagtcatgctgtattgaatttaaaaattctgtctcaacattagctttccctcct

SEQ ID NO: 6831413 - DNA, 63 bp, Homo sapiens
caacctggagtagggggtggaggtgatgtatttttctttcttccagtttccccttccagtctg

SEQ ID NO: 6831414 - DNA, 57 bp, Homo sapiens
gttcagtgaaggggagctgttttgatgactacctctccctttgatcactaacagaac

SEQ ID NO: 6831415 - DNA, 88 bp, Homo sapiens
gtgggtgtcacatagggcgttctctgcatgatgctgttgtcgctgggcctgagaagcagcctcccagggagcagcctgtggaccccac

SEQ ID NO: 6831416 - DNA, 85 bp, Homo sapiens
ggagaatcgcttgaacctggaaggtggaggttgcagtgagctgagatagcgccgttctccagcctgggtgacagagcgaggctcc

SEQ ID NO: 6831417 - DNA, 69 bp, Homo sapiens
aaaagtaattgtcttgaattcacaacctactagtcaagagcgtagttgagtgacaagacacttcctttt

SEQ ID NO: 6831418 - DNA, 57 bp, Homo sapiens
ttcatgaggtaaagtttaagctaagttctctggatttagcttataaatgcttttgaa

SEQ ID NO: 6831419 - DNA, 60 bp, Homo sapiens
ctcttatacatatttttaggcgaccaaatggatgggttgctactgagtgaatgttgggag

SEQ ID NO: 6831420 - DNA, 96 bp, Homo sapiens
gctcttgctgttccctccacctggagtgttcttcccccaaagcagtacacagttgtttactgcatgaaggcacctatttggggggttagtgggggc

SEQ ID NO: 6831421 - DNA, 70 bp, Homo sapiens
ttattgctgttgttatggcactgtccttgaaattgcagagaaaatacaggtcaacgagagcaggcaatga

SEQ ID NO: 6831422 - DNA, 69 bp, Homo sapiens
ctgctgcctgatgctttctggacatgaaatgaaatggtccagggctaaatcaggttccccactgggcag

SEQ ID NO: 6831423 - DNA, 64 bp, Homo sapiens
ggttcgggggcccctgcggtctcctggatggcagaccagtgaggcagcaggagcctctgtgtcc

SEQ ID NO: 6831424 - DNA, 90 bp, Homo sapiens
tctaatgtgctatcaatgataggattcaccattattttatgcaccatggaagatgaataaagattctaagaccaagatgtgtatattaga

SEQ ID NO: 6831425 - DNA, 72 bp, Homo sapiens
tagatttaaggaaagtttataggttatataattggatccaaatattatattatgtggatgttcctaaatttg

SEQ ID NO: 6831426 - DNA, 129 bp, Homo sapiens
cacatctctgcccgttaacaaaattaaaggctttacttttcctgggagagtgtgatttaagggctaatcagcaccatggtccttgcacattatctgggaaagtagaaattactggctactgaatctgtg

SEQ ID NO: 6831427 - DNA, 60 bp, Homo sapiens
aaactttgttcgtctgatgtggaaaattatgcagtttcccaaggcaggggatcaaagttt

SEQ ID NO: 6831428 - DNA, 81 bp, Homo sapiens
gagtatgtgtgcagctatatttctatgtgtatctggaagagcgtgtacatgtatgagatatgtgtatctgcatgatggctt

SEQ ID NO: 6831429 - DNA, 63 bp, Homo sapiens
gttatgctgagttgcatgaggttccctagtcctcccaggctgcttcatgcctctggtgtttgc

SEQ ID NO: 6831430 - DNA, 77 bp, Homo sapiens
ggatacagttgtgttacaaactgttgtttctatagatggaagttcatgaaaataattacttgtattattctgtatct

SEQ ID NO: 6831431 - DNA, 92 bp, Homo sapiens
ttttatttggggaattaaactgccataagtttttacttcagtggatgaaacatcacaaaaatgctcatggcagtataattcctcaaaaagaa

SEQ ID NO: 6831432 - DNA, 62 bp, Homo sapiens
gaaggcaggagaaaggtgtgttgggcatggtgaatgggcacttagcatccattcctaccttc

SEQ ID NO: 6831433 - DNA, 82 bp, Homo sapiens
tgcagggtataatacttaggtgatgggttgataggtgcagcaaaccaccatggcacaagtttacctatgttataaacctgca

SEQ ID NO: 6831434 - DNA, 79 bp, Homo sapiens
tttttaaggcagtttgggaggcagtgttgcaaagggtccagtaatcgttgcaaaatcatttctcaggatgtcttagaga

SEQ ID NO: 6831435 - DNA, 62 bp, Homo sapiens
cctaagcccagctctgcctgctctgcggactcccctatagcagtagaatgctgtgtggtagg

SEQ ID NO: 6831436 - DNA, 59 bp, Homo sapiens
tagacgtcatttgccttttaaactcacaatggaattttccagaggcgacctgatgtcta

SEQ ID NO: 6831437 - DNA, 74 bp, Homo sapiens
gggaaacccgtttaattactcgagctgtcaaaatgttttattgtaaacagcttttctgatagatcctgtttccc

SEQ ID NO: 6831438 - DNA, 111 bp, Homo sapiens
ggctaccaaggggcagagaacagaaacagccaccaagttcctgggccaagtccagggcttcctggactgtattcagagagctgtggcttttctctaccacttgcaacagct

SEQ ID NO: 6831439 - DNA, 56 bp, Homo sapiens
tgtgtgcacatgatttgaaatggagattgcatactaaatttaactatgtgtacaca

SEQ ID NO: 6831440 - DNA, 66 bp, Homo sapiens
ggggtgccactcacatgtaccagatgcagatggtgtacctcctgcactgtgtgatgtgatgatccc

SEQ ID NO: 6831441 - DNA, 126 bp, Homo sapiens
tgattatttttaaaattctctttccctgtggctggtagtatcgtttttccatgaagtggtatcagagattaaatggtgttatctgtccatgaacaatttacttactggagcatgaaaaagtgatta

SEQ ID NO: 6831442 - DNA, 62 bp, Homo sapiens
ggggcccttggaaagccaaggcagctgtgctttcctgcagcttggcaccctccaagggcccc

SEQ ID NO: 6831443 - DNA, 73 bp, Homo sapiens
cttagtttctctgtatgtttacctagaagcttgccttctctagtgacaggatacagcagagatcaagactaag

SEQ ID NO: 6831444 - DNA, 56 bp, Homo sapiens
gaggcgaggggctgcggcgagtctggcagaggcggtgcccggatacccctggcctc

SEQ ID NO: 6831445 - DNA, 80 bp, Homo sapiens
ggagatttagccttctttttattgggttttggtgttcatttttagcaaatacttgaataaaaagaataatcacaatctcc

SEQ ID NO: 6831446 - DNA, 55 bp, Homo sapiens
ttcaagtagaaagtattgatgatcagtgacatcaactggacagtttctgcttgaa

SEQ ID NO: 6831447 - DNA, 109 bp, Homo sapiens
ccgattccctgtgatgagttgtgctcctggaaagctgccctgtgacatttcttcccttttgtgtccctgacagtagcatttccctggaggctcttaaaggagaaggagg

SEQ ID NO: 6831448 - DNA, 57 bp, Homo sapiens
gttatttttctagcgtaggacaacaggatgtcctgttaaggatgttacagaagtaat

SEQ ID NO: 6831449 - DNA, 111 bp, Homo sapiens
ctggtgagcacccctgggacccgagcagcatcctcaggagccagtgccggagccatctggcatccagcagtgctctagagcgtgcctcctgcggtctcagctgccccccag

SEQ ID NO: 6831450 - DNA, 129 bp, Homo sapiens
tttttatatctttcagaagcttggaatgctcaaacatgcagtacatacaaacactgatttctttaaaccatgaggtggtatttgcctttgtactgcacagtgacaagtttccattttaatgatgtttga

SEQ ID NO: 6831451 - DNA, 128 bp, Homo sapiens
tcctccttgcgctggtcctggccactgatgacgtagcagagcgcgcgcacgcgctggaagaactcctcatccaccaggtgggcgctgctcccgctgggcaggtaggccaggtccaggtagaccgggga

SEQ ID NO: 6831452 - DNA, 68 bp, Homo sapiens
ctgtagcagactctgtggcctctccaacagcctagatcctgaggggtggccaaggactctgaccacag

SEQ ID NO: 6831453 - DNA, 80 bp, Homo sapiens
ggcattctgggtgagctgcctcgggtcagcccaggggtgcaggctcctctgactgggaccacaggcagccacccgaggcc

SEQ ID NO: 6831454 - DNA, 66 bp, Homo sapiens
ggagagaaacagaactcttaaaggaccttcatacagcctggaaatgtcaagattctgcttctctct

SEQ ID NO: 6831455 - DNA, 56 bp, Homo sapiens
cctgaagatgctgtggcctggtagagctttgtacaccctcccaagcttctctcagg

SEQ ID NO: 6831456 - DNA, 76 bp, Homo sapiens
tgaacaaaatagtcctgggaatagtactgtcttcagaagtctgatacatggtgggctattgtaggtctattgatca

SEQ ID NO: 6831457 - DNA, 66 bp, Homo sapiens
gcagctgtcttctaccttcaacctccagctcccatcctgaaggcctgtggtagtgagacgttctgc

SEQ ID NO: 6831458 - DNA, 97 bp, Homo sapiens
taacggcaaaaatgcatgctctctttttggaaaaggaaatgagaagaacacccattttaactgattcctttttgaaaatgtatgcaaagtgctttta

SEQ ID NO: 6831459 - DNA, 86 bp, Homo sapiens
ccccaggtaatttatatgaacattaaaatggtagaattgacttaaatcaattaggctcgaacgttgcatattagaatcacctgggg

SEQ ID NO: 6831460 - DNA, 129 bp, Homo sapiens
ggttcttcttagttggctaatgaactcctgactagttacagatgaaagggattaaaatgactttactgagcactcactttagtctgtttcattatctgaactaaggaagtctaagacaattaggattcc

SEQ ID NO: 6831461 - DNA, 122 bp, Homo sapiens
gaataatttgtaggattgttatcaggatcatgttaactaagattaactatattaaagtgctttgaatagtggctggctcatagtgagcatgtaagtggtgacggttaaagacaatattgttt

SEQ ID NO: 6831462 - DNA, 74 bp, Homo sapiens
cagtagcttgcttaggcttttaaaccattttaatgtaggaatataaaggccttggcataaacaaaagctaactg

SEQ ID NO: 6831463 - DNA, 55 bp, Homo sapiens
tacagtttctgtccttgtggagatgacagtctactctggaaaacagaaagttgta

SEQ ID NO: 6831464 - DNA, 128 bp, Homo sapiens
gcatcagagtcacctgggtggattgttagaactcatattgctcgcctcatccccaaagtgccactttcggtaggtctgaggtgggcttgtggatttgcatttccaacacgttcccgggagcatgctgc

SEQ ID NO: 6831465 - DNA, 76 bp, Homo sapiens
acttgtgccaggtgtcatggataatgggtagcagagtcaggatctaaacccagagtcatggcacttagccaccagt

SEQ ID NO: 6831466 - DNA, 75 bp, Homo sapiens
cctaaatattttgaaaatatgatgctagtcattccaatgtatgtaccagatgtatgttctcagataaattttagg

SEQ ID NO: 6831467 - DNA, 85 bp, Homo sapiens
attagagtgccttttaagagcagtgttaggaataaaaatgatggaaaatatatacattatcctgacaactaaggtcgactagaat

SEQ ID NO: 6831468 - DNA, 58 bp, Homo sapiens
agaaacagcattagcatcaattgtgagctagcttttcatcgggtgcaagctgctttct

SEQ ID NO: 6831469 - DNA, 75 bp, Homo sapiens
gatactgtgggatgttgtgattagaatgtcagctgataaacatagctagaaactatagcaacaacttatggtgtc

SEQ ID NO: 6831470 - DNA, 62 bp, Homo sapiens
aagcctgagcaacctgctggcgagagaacagctttgtcaaactagcaggtagctgcacgttt

SEQ ID NO: 6831471 - DNA, 66 bp, Homo sapiens
caaaagagtggcagagctggctgcggatgagaaaatgtcattggcaaaaagctctgcaatggtttg

SEQ ID NO: 6831472 - DNA, 69 bp, Homo sapiens
aaaattgtggattgcgttttatcagaagtcatttgagatttcatgtatgaggccaatctttgaaatttt

SEQ ID NO: 6831473 - DNA, 100 bp, Homo sapiens
attcaaatgcagtggtccctgctgctgtaaggcagaattaattatttccagaaatactatctctgcttctacgcaagccccttccactgtctgcctgagt

SEQ ID NO: 6831474 - DNA, 58 bp, Homo sapiens
tgaaccagagtctccagtggtttcagctgctttgaccacactgtggcacattggttta

SEQ ID NO: 6831475 - DNA, 63 bp, Homo sapiens
ccgggtctgctccacctgcagcccttcggtcgcgcctgggcttcgcggtggagcgggacgcgg

SEQ ID NO: 6831476 - DNA, 61 bp, Homo sapiens
atgctgggacacgttctattccaaatagcgattctatttggctgggcgttgtcttaggcat

SEQ ID NO: 6831477 - DNA, 93 bp, Homo sapiens
cattttctctgtgtctctgtgttgcaggaaaatctgggttcttgtcacatgaccaggttaatttaggcacgcagacactttgaagggtgagtg

SEQ ID NO: 6831478 - DNA, 87 bp, Homo sapiens
ggtgggtgggtagcgtggggcagaattgggagagagacacagtgaccgggtgtcccagttcccagggttgctaactgctcacgtgcc

SEQ ID NO: 6831479 - DNA, 77 bp, Homo sapiens
gcagcattttccctgctggctggggccaggcattggtacctgcagcctgggccagtccagccccagggaaagcttgc

SEQ ID NO: 6831480 - DNA, 78 bp, Homo sapiens
gctatagtgtcatgaaggctgccagcaggcatggagtgtgagtggttttcatgagtgtgagtggttttcatgaatagc

SEQ ID NO: 6831481 - DNA, 58 bp, Homo sapiens
aacagctctgctgctggctgggctgggtttatcggccagcgctcactcagagcatgtt

SEQ ID NO: 6831482 - DNA, 66 bp, Homo sapiens
ttactagaaaaacacatgctctgtagttaagatggatgaaactgcagtttgtgttgattttggtaa

SEQ ID NO: 6831483 - DNA, 103 bp, Homo sapiens
gagaattagaccgtgtagtacatgaagcacttggcaaaacagctggcacaaaggagccactcacatgctgattgttatcattactcactcagtctttcttctc

SEQ ID NO: 6831484 - DNA, 78 bp, Homo sapiens
aatcagggtcttcaaatcaggctttgaagtatatttcaggaaactcatctttcaaatgcttgaattggaaatttgatt

SEQ ID NO: 6831485 - DNA, 74 bp, Homo sapiens
ttgtttgttttgagatggtgtctcgctccgttgcccaggctggagtgcaatggcacgatctcagttcactgcaa

SEQ ID NO: 6831486 - DNA, 80 bp, Homo sapiens
tctgtgattggttgttcttctcatccagcttgcttgtggaggagttagggttgtcttgtgaggaactgacagttaccaga

SEQ ID NO: 6831487 - DNA, 128 bp, Homo sapiens
gcctctggtggtgggacctacttaagtctgacggacctgtcctgtccaggccagtgcccagggaaggtgtgggaggccctttgagcctggcctgcagagaccatccgtgtcccctcccaccttcatgc

SEQ ID NO: 6831488 - DNA, 76 bp, Homo sapiens
ggagttatgaggttttggatctgtgttgtaaataggtgtattttgggattaaagataaggagaccggttagcctcc

SEQ ID NO: 6831489 - DNA, 55 bp, Homo sapiens
ggggaggagcccacagcaggctcctatgtcacatgagcctggggaattccacccc

SEQ ID NO: 6831490 - DNA, 102 bp, Homo sapiens
aacggtgggtccatttcgtttaaggtccacatttttggagtcagtggaaaacagtattacgctgacccatataagagtggagggaaggaagcactcactgtt

SEQ ID NO: 6831491 - DNA, 74 bp, Homo sapiens
ggcattagatacattcacattgttgtgcaacagtttcactcgttttaccaaattgaatgttttgtctactggcc

SEQ ID NO: 6831492 - DNA, 92 bp, Homo sapiens
tactgatgattacttgttttgataagatgctgagtgcattgacttagtacctgtgttaattgctttatcctgttagaatctgattttcagtg

SEQ ID NO: 6831493 - DNA, 63 bp, Homo sapiens
tttgacagaggttgtggtgtatgttgttgggtatggtgtcccttgattgacagccctgttaaa

SEQ ID NO: 6831494 - DNA, 74 bp, Homo sapiens
gtgtttgtcttggccaaggttctgaatgaataaaaatattccctcaaaattagtgaccaaaggcatgttagcac

SEQ ID NO: 6831495 - DNA, 59 bp, Homo sapiens
tgaagagtgcttgagattttaatgttggaaaacaagatgaaaattttgcagtcttttca

SEQ ID NO: 6831496 - DNA, 121 bp, Homo sapiens
cacgaggcccctggccacccaggaacctgtcagtcccttctcaaagtgtgcgggaaacagcaggtccccaaactgtgcggaggagggtgggaggcgctgagtggacccacaggggctagtg

SEQ ID NO: 6831497 - DNA, 65 bp, Homo sapiens
tgagctcttttgccagtcactgcactgttttgtcaaccaaagtgcaaaggtagccaaggagctca

SEQ ID NO: 6831498 - DNA, 89 bp, Homo sapiens
cttgctagaaatacaaattgttgggtctcattcccgatctactgaaacagagactgggtttgagacttagcaatctgtgtttcaacaag

SEQ ID NO: 6831499 - DNA, 101 bp, Homo sapiens
tgttagaaaaggaagaacacatgcgatagagaggtaggaaatagaatcaacatggttagatctgtcatttcattatttcatgtgttttactacagttaaca

SEQ ID NO: 6831500 - DNA, 69 bp, Homo sapiens
ggttgtccagcttgtggtctcgcagatctttgatctgacatgtgggagaaggaagcaagctggaacacc

SEQ ID NO: 6831501 - DNA, 91 bp, Homo sapiens
tgtctgttaataacactgacatgatcattcaagttactgctgttttggtgaacagagtagctcaagaagattgtgtcttagattaatttca

SEQ ID NO: 6831502 - DNA, 94 bp, Homo sapiens
ccatccagtaggtcatttctttcaacattatatagccacatgccaggccctatgttaggcatgggagatataatggtggacctgataggcatgg

SEQ ID NO: 6831503 - DNA, 55 bp, Homo sapiens
gcaggattttttactacagtgttttgaaaactgatgtgtaaagttgaaatcctgt

SEQ ID NO: 6831504 - DNA, 57 bp, Homo sapiens
cggctttggtgtcagagagccctgagttcaagttttggctctgccacttagaagctg

SEQ ID NO: 6831505 - DNA, 65 bp, Homo sapiens
tctggccttgcctgctgctctgctgggaagagcccaaagcgacagaaaccaaggacaaggccagg

SEQ ID NO: 6831506 - DNA, 72 bp, Homo sapiens
atagaagcaatgtgttttcaacattcagcatgtgaaaaatgtggagttagttggtgaaattcattgttctat

SEQ ID NO: 6831507 - DNA, 67 bp, Homo sapiens
gtgtttctggcattgctttggtgcagtggctttccaattgatgaccacagcccacagtaagaaatac

SEQ ID NO: 6831508 - DNA, 69 bp, Homo sapiens
agttgaattatgagtgtctttgattatctggcttgaaggttgttttgcagggagactcataggacaact

SEQ ID NO: 6831509 - DNA, 77 bp, Homo sapiens
gatgataattgctccacacacattcggtagcaagtggtggtaattcagagtagttgtggagcaacttcattatcgtc

SEQ ID NO: 6831510 - DNA, 77 bp, Homo sapiens
gtacacacatgacagtgcttagcaaactgtgtcatacaacacagtttttattatttgttttagaaaggtgtgtgtat

SEQ ID NO: 6831511 - DNA, 61 bp, Homo sapiens
cacacatgtgccatcacagaccacgtaaatcagaatgccttggcatggaggtagcagtgtg

SEQ ID NO: 6831512 - DNA, 107 bp, Homo sapiens
ggaggcttcccggcctgggggccacgggcccggaggaatttgcctggaagttttccatcacggcagagccttctggagctcgccccgtgctcgacaaggggagcccc

SEQ ID NO: 6831513 - DNA, 65 bp, Homo sapiens
atggagagggtagagaccttctgatgaaaggagtaggggtttttcaaagaagattaccctcccat

SEQ ID NO: 6831514 - DNA, 57 bp, Homo sapiens
tgtgtgattgcaggagatgtggctgtagacaaagcctgcctccccatcagttataca

SEQ ID NO: 6831515 - DNA, 79 bp, Homo sapiens
gttaaattgctatggcttttaaggagatctgataaaaaggaagttagattatttaaactggccaaacgtaagaattagc

SEQ ID NO: 6831516 - DNA, 73 bp, Homo sapiens
gctgttcatattatcgtcatcatccctgtccctgaaacttcagtacaagtgatgtggtaaaaactagaatagt

SEQ ID NO: 6831517 - DNA, 59 bp, Homo sapiens
tgtctcaggcccaagccagtaagcacatcacgttcccctggccttggtgcttgcagaca

SEQ ID NO: 6831518 - DNA, 74 bp, Homo sapiens
tttggagattaatattgaaagctgtgcttaatctggatatcatcaagaatctgatgcagcttctcatcttcaaa

SEQ ID NO: 6831519 - DNA, 60 bp, Homo sapiens
aagtccagaactcctgtgatagcagagccttctccacctgctcccatcaggaactggctt

SEQ ID NO: 6831520 - DNA, 71 bp, Homo sapiens
gcccaccgcccccactctcatggcctctggtgcagccacagggccttggtaatgggggactgttggggggc

SEQ ID NO: 6831521 - DNA, 66 bp, Homo sapiens
gcccctcggcctcccgcccccggggtccccagcaggggtcgcggctccggagacgcccggaggggt

SEQ ID NO: 6831522 - DNA, 91 bp, Homo sapiens
tcccagggctccatgcagcggcgtttggtttaaagtggagagaggatacgcttaggttaaaggcagctgcaaggagacctgtgtcctggga

SEQ ID NO: 6831523 - DNA, 88 bp, Homo sapiens
gaaggcccttctctccagcagagccagattttatgcaagacatttagtatgtcaaagtatcagtctctggccttggaggcaggtcttc

SEQ ID NO: 6831524 - DNA, 67 bp, Homo sapiens
atggcttcctgctgccagtacctggggctctgctgttagcctttctctggcagcaggacaggctcat

SEQ ID NO: 6831525 - DNA, 68 bp, Homo sapiens
ggcaggaggccctgggcagaggagtgggctgactcccggaccccagcccctgcccagagcactctgcc

SEQ ID NO: 6831526 - DNA, 64 bp, Homo sapiens
aagcctctggaaatggccatagtcatccttttgggtgataagttatgggatttctgttcggctt

SEQ ID NO: 6831527 - DNA, 74 bp, Homo sapiens
ttttcccccagcatgcttccctcacatatcctggcctgcaatgcagaggccagggggaaacactggggagaggg

SEQ ID NO: 6831528 - DNA, 56 bp, Homo sapiens
tcccagagtcttctcctgtaatacaaaccactgtatgtataggcatccatctgggg

SEQ ID NO: 6831529 - DNA, 91 bp, Homo sapiens
ctgtccccgttgttctggatcatccagctcctgggggccaccgtgtgacccacggggcccctgtggcttgatgcccacagctaggaaacag

SEQ ID NO: 6831530 - DNA, 79 bp, Homo sapiens
gcctggaccatggcgtccacgctgccgctcaggatgcccatgtgggccagctcctccaggtggatgcggtcagccaggc

SEQ ID NO: 6831531 - DNA, 57 bp, Homo sapiens
ccatgcagaaactgccagtgggagtgatgtccgagtcccactggacgtctgtgctgg

SEQ ID NO: 6831532 - DNA, 58 bp, Homo sapiens
tagagtctaccactcaaaatgacaacatctgttaactttttcaagtcggtagagtcta

SEQ ID NO: 6831533 - DNA, 79 bp, Homo sapiens
tttctcatctgttaaatagatgggttaaacagcaaattggtctaatatgctgtgattctatactaaagaacatgaggaa

SEQ ID NO: 6831534 - DNA, 83 bp, Homo sapiens
caggtgggattcacattgttttaatgtgaataaggacatttacttattctagataagaaaagggctgtgaaatccataaactg

SEQ ID NO: 6831535 - DNA, 67 bp, Homo sapiens
caggataacagaaaatagctgaattcaaatatacctgagattttcttgctattttgcttttgttctg

SEQ ID NO: 6831536 - DNA, 116 bp, Homo sapiens
tccttggcgcggtgtaggaaaggtgaggatgcctgccgcgcggtgcccctcgtggtgacagagacactgcggaggtcgggtggctctcggagaaccttgtctcagtgccaaaagga

SEQ ID NO: 6831537 - DNA, 68 bp, Homo sapiens
gcctcagcatgcagcccctggcagctcctgccgtgtgtgagggcagccaagggtgtgtgcccactggc

SEQ ID NO: 6831538 - DNA, 92 bp, Homo sapiens
gaaataatttatatagatgagtttaagtatattgatttgtgtgataaataaatatcgtaagattgaaacttggaagtcttttaagttgtttc

SEQ ID NO: 6831539 - DNA, 82 bp, Homo sapiens
ttctcaaacctgctataactgggtattagactaccttccatggtgtagtgtatgatacactcagttaagctgtaggggagag

SEQ ID NO: 6831540 - DNA, 63 bp, Homo sapiens
gcgggtttcggtggaacagttccctggtaacttaagtgtgggtttgattccctctaaactcgc

SEQ ID NO: 6831541 - DNA, 73 bp, Homo sapiens
aagcggtaattgttctggacacgtgactctcatttagtatctgctgaagagcccttgttcataattattgctt

SEQ ID NO: 6831542 - DNA, 70 bp, Homo sapiens
cttctcctccttttttcaacatagtcctatttactatcagacaatcaggctgggtattaaagaggggaag

SEQ ID NO: 6831543 - DNA, 74 bp, Homo sapiens
agtttaggtacagcaatataagaggtcaggggtcaagcaatataaactgcctccgagaaggctgtaattaaatt

SEQ ID NO: 6831544 - DNA, 74 bp, Homo sapiens
gtattataggcacgttgtttatcagaagggcataaatacatattattactttgaaagcaatgggtctatagtat

SEQ ID NO: 6831545 - DNA, 81 bp, Homo sapiens
agccacctttgtttcgcagcctctctctggcacctccatccactgcattgtgtggagggaggctgaaggagctgaggggct

SEQ ID NO: 6831546 - DNA, 96 bp, Homo sapiens
caactgtatgtctgatccattttctatgttcacatttaaataaagttcttgctgtgatgtttaaatgtttatagagagtacaggcttaataagttg

SEQ ID NO: 6831547 - DNA, 84 bp, Homo sapiens
ctttccctgaggctaaggtgccagacgaattgggattctccttcaacctaatttctgctactgcaccctagtgaaagggatgag

SEQ ID NO: 6831548 - DNA, 58 bp, Homo sapiens
agcgtgtgtgcgggtcttctttcaaaatagtggggcatttgaaacccgcgctgcagct

SEQ ID NO: 6831549 - DNA, 68 bp, Homo sapiens
cacagcttgatctcttggacctgtgtggtaagaacctcagtttacagtgtttaaaaatcagatctgtg

SEQ ID NO: 6831550 - DNA, 69 bp, Homo sapiens
tttggcttcaggatggagggaagcacagaaatttcaagatttctgactgcttgatcctcctgtgtgaaa

SEQ ID NO: 6831551 - DNA, 59 bp, Homo sapiens
gtgtctgcctttggactaactggactgagctagggatgttggtgttagaggacagacat

SEQ ID NO: 6831552 - DNA, 68 bp, Homo sapiens
ggtgaatttgcctcccgactgactcttgcacttcccgtgaggaccacagacgttggaggaaatatacc

SEQ ID NO: 6831553 - DNA, 76 bp, Homo sapiens
ctctgtcttcctggagggggaaatgttcattgaaatttgttcaggaaccattttctctttatatatgtggacagag

SEQ ID NO: 6831554 - DNA, 66 bp, Homo sapiens
cactgtagccctctgctcaggtgcataggctggaagcagccagcacagaagtgagaggacttagtg

SEQ ID NO: 6831555 - DNA, 63 bp, Homo sapiens
cctatttgcgtcaataaccagtttgtttacattttttcataggcttattgtagaccaaatggg

SEQ ID NO: 6831556 - DNA, 76 bp, Homo sapiens
accactactctactttctatgtctgtgaatttgcctcttctggacatttcatataaatggaatcagaataggtggt

SEQ ID NO: 6831557 - DNA, 62 bp, Homo sapiens
tccatgctgagtatttgtttgaataacttatcagttcattggggcatatacttaagagtgga

SEQ ID NO: 6831558 - DNA, 66 bp, Homo sapiens
tggcgatctccttgaatgttgctgtgagaataccagcctcacagaagtgtgtttcaggagtggcca

SEQ ID NO: 6831559 - DNA, 100 bp, Homo sapiens
ctcccagttttggctaaatctcaccatggtgcttgcttatgactctcactataggtgacaggaaaaataaagctgctcttatgttgattggctctaggag

SEQ ID NO: 6831560 - DNA, 92 bp, Homo sapiens
catgtaggatttttgagaagaattttgcttttatgtcaagtggaatgagggccactgatgatctgggagtagagtgactatgatccgacatg

SEQ ID NO: 6831561 - DNA, 55 bp, Homo sapiens
tcaccactgaacagacctttggcaaagagtctacaaaggtaagttttcagagtga

SEQ ID NO: 6831562 - DNA, 86 bp, Homo sapiens
gaggcactgcaaagtcgaaactgcagtttaggctgtaattaaatcatccaggagactaggcttcaggtttgctttgcagaaatctc

SEQ ID NO: 6831563 - DNA, 129 bp, Homo sapiens
cagtctggaatattcatgaccagttgcaacaagagcatttttccagttggacagtagaaaagggacgtagtactgtcttattttgaagtgttcacaagttggatgttaactgtgagtctgtccttgatg

SEQ ID NO: 6831564 - DNA, 74 bp, Homo sapiens
tggtggcttagatctagatggcagcgaagaggtgatgaaagtggtcagattctggatagatcttcaagccagca

SEQ ID NO: 6831565 - DNA, 71 bp, Homo sapiens
tggatactttgtaagctgtcatagccgatagcctttaggtgttttgaaacctacagtcttacaaatgtcca

SEQ ID NO: 6831566 - DNA, 64 bp, Homo sapiens
ctggaagaggccacagctgacagcacaggagaccaactggctggaggctctggccattgtccag

SEQ ID NO: 6831567 - DNA, 94 bp, Homo sapiens
gtgctgggagccatgactgaaatactgctcttggattctgagctcaggagctccattagagagtattactaaagccagttgtggtgcccagcgc

SEQ ID NO: 6831568 - DNA, 68 bp, Homo sapiens
actcaggcctgtgtgcaggactgtgcaccagtctcggaggtgtggatggccctgcacacaggtagggt

SEQ ID NO: 6831569 - DNA, 77 bp, Homo sapiens
cacctcaggcctgcaggaaaggctcccctgcctgcctgacaaacctggctggggcctcaccagcaggcccgagtgtg

SEQ ID NO: 6831570 - DNA, 58 bp, Homo sapiens
aaggtcttatggtgtcttagttttggtttgcctggaagcagggcatgaataagggttt

SEQ ID NO: 6831571 - DNA, 65 bp, Homo sapiens
gtttcagagtagaacctcaaggagcttttgcagaattccacatcgttctcttttctctctgaaac

SEQ ID NO: 6831572 - DNA, 60 bp, Homo sapiens
ctttttggacccataataggcatcattcttcaaaatgatttccatgattgggccagaagg

SEQ ID NO: 6831573 - DNA, 65 bp, Homo sapiens
gggtggagcatgtgtagctgatgacattttccagagaggaaacatcaattgcatctcccaaaccc

SEQ ID NO: 6831574 - DNA, 57 bp, Homo sapiens
ttctcatgatgcaattcatccccagccacttatctggccatgaaatatcaatgagag

SEQ ID NO: 6831575 - DNA, 103 bp, Homo sapiens
ttgaggcacaagaatcacttgaacccggtaggcagaggttgcagtgagccgagattgtgccactgcactccagcctgggcggcagagtgaaactgcgtctcaa

SEQ ID NO: 6831576 - DNA, 64 bp, Homo sapiens
agtctttactaaacagaccaccattctttttccttgcaaatgtggctctgttgaggtatggatt

SEQ ID NO: 6831577 - DNA, 114 bp, Homo sapiens
atgtagaaataagcattgttaatattatgttgtatttccttgcagtctttgttctaaatgctcatagttgcacagaatgacaatatgtacatgtttttaatgttgtatttatat

SEQ ID NO: 6831578 - DNA, 74 bp, Homo sapiens
ctgattttttgctgagccctggctttgggtcaaaccatgctgaatgctaaggcccaggagaaaataaaaggcag

SEQ ID NO: 6831579 - DNA, 64 bp, Homo sapiens
ccagcagctctagtttctgggcacgtctgatttacagatttcctagacatggggcagatactgg

SEQ ID NO: 6831580 - DNA, 68 bp, Homo sapiens
cccaggtgagagctgcctttccccagagaaggtggtgtgggacttggcggggcggagcctgacctggg

SEQ ID NO: 6831581 - DNA, 76 bp, Homo sapiens
gccaaatctctctgagccctgctttttcacctctgtaaaatgagggggttaggtgagctacagagttccttttggc

SEQ ID NO: 6831582 - DNA, 78 bp, Homo sapiens
gcagaggttcaagtgaaatgctttttgcgaaatgtgcaagttccttttgtacatttacaaaagctttatttactctgt

SEQ ID NO: 6831583 - DNA, 89 bp, Homo sapiens
gggtgtattgcagctgcttaattttttctgcttttctctgacagtcactgagagaatgcctggcgattagtgtagctgctaaaaggcct

SEQ ID NO: 6831584 - DNA, 65 bp, Homo sapiens
ggagcacttcctgagtgcgtgtttgcttttgaccctggctgagactggcagcaggaagtatctcc

SEQ ID NO: 6831585 - DNA, 76 bp, Homo sapiens
gggtgtatactcatctccaagctcaccaagttgtatatattaaagttgtgcagctttttggatgtcagttatacct

SEQ ID NO: 6831586 - DNA, 57 bp, Homo sapiens
gagcatgtcgctggctttcccgggccttggtttccaggctggtcgcgtgcatgtctc

SEQ ID NO: 6831587 - DNA, 89 bp, Homo sapiens
gttgttcccattttgcaaaccaggacttggtaagatttagggactcaaacatgattcttctggttccagcttctgttgccgtgcacaat

SEQ ID NO: 6831588 - DNA, 56 bp, Homo sapiens
gctaggttgaggaagttctcctggataatatcctgcagagtattttccaacttggt

SEQ ID NO: 6831589 - DNA, 55 bp, Homo sapiens
ggggaagcagaagggagcgggcatggagcctgtgcttaattcctctgcttcacct

SEQ ID NO: 6831590 - DNA, 67 bp, Homo sapiens
gcagtaagtgaggaagtcagaaattcttgtctttccacatgtattgtctgacttctttagttactgc

SEQ ID NO: 6831591 - DNA, 92 bp, Homo sapiens
atctaaagtctcactctctggcagtctggtggaaggcctcagtttctctctacatgagcctcaccatatggctgcctcagtgtcctcaggat

SEQ ID NO: 6831592 - DNA, 62 bp, Homo sapiens
ccatctgtctcctgatctagctcaagtacccaaggtgagccctagaagtggggggcaggtgg

SEQ ID NO: 6831593 - DNA, 62 bp, Homo sapiens
ctggcctgtgtgcctttaccgtgcttgcgtcttcatgctgagcatccagcaggtactgccag

SEQ ID NO: 6831594 - DNA, 58 bp, Homo sapiens
cagatactcaagcttagactttttgggctcgccattctttcttagctttgtgtgtctg

SEQ ID NO: 6831595 - DNA, 60 bp, Homo sapiens
ggcctaaagagagtgatttatgttttactgagtgaaacagtcaactttctttccctggcc

SEQ ID NO: 6831596 - DNA, 56 bp, Homo sapiens
ttcagctatgcgctttgggcaaactttactttttttgcctcagtctgctgcctgaa

SEQ ID NO: 6831597 - DNA, 56 bp, Homo sapiens
gagaagttttgagggcacttagctgggtctacctagttaccacccacaagcttgtt

SEQ ID NO: 6831598 - DNA, 76 bp, Homo sapiens
gtgaaggtctgtttctcttcactctagactgataaggatccttaatcagcaagactaggggaatacttatcttcac

SEQ ID NO: 6831599 - DNA, 64 bp, Homo sapiens
aggtagctattactgtttttattatttataataatgtaattgaacttaacagtaagtggcccct

SEQ ID NO: 6831600 - DNA, 75 bp, Homo sapiens
ggcactcactgccatgttgatagatgtgtaaagagattaattccaggcttgtcagtcaaggtgtgcaggcaggtc

SEQ ID NO: 6831601 - DNA, 66 bp, Homo sapiens
tttgtttacagtattactgtgttgttttggttaacagaatgaaaaacagcactgtaatactacaag

SEQ ID NO: 6831602 - DNA, 56 bp, Homo sapiens
cattcctaacccatgcccatcatggtttggtataccaaggcatggcagtggggatg

SEQ ID NO: 6831603 - DNA, 57 bp, Homo sapiens
taggactgataaggggccagagcaggtaaagccagaggctgggccatatcagtcctg

SEQ ID NO: 6831604 - DNA, 58 bp, Homo sapiens
tctgatgttcttggagataaattcttacagatttcttttgtaatctagtcacatcaga

SEQ ID NO: 6831605 - DNA, 129 bp, Homo sapiens
agttaatagatagcatgaatatagtgattaaacacatggattgcttagctggactgctttgatttaaatataagctctgctattttctatctgtgtgacattgatcaggttacttatctctctgtgact

SEQ ID NO: 6831606 - DNA, 74 bp, Homo sapiens
ggtcataataatgataatggttatagctatgagaaagacattaagtactatatacacattatcttgttgtatcc

SEQ ID NO: 6831607 - DNA, 64 bp, Homo sapiens
tctctgtatcccagaaccaaaaaggagcccactaaatattccgttttgactcaatgaacagaga

SEQ ID NO: 6831608 - DNA, 129 bp, Homo sapiens
ttcttcagttggttgaacagtagttaggaaccttcttgctgttgattcatcttctaatacccacacagatgtgggtacatgaaaatagaacaatgcaagaacacctcacattaccatcacaactgataa

SEQ ID NO: 6831609 - DNA, 69 bp, Homo sapiens
cttcctgctcccctgccaattcccctggaaagaaagaaagaagggagggagggaaggagggagaggaag

SEQ ID NO: 6831610 - DNA, 68 bp, Homo sapiens
atttacctgaaaggttaatttccagttagccttcaggagctagttggaaactagccttttaggttgat

SEQ ID NO: 6831611 - DNA, 56 bp, Homo sapiens
gtcaacatcggaaagcgtgtaaaccgttctagcgtgttgctgtggttggtgctgac

SEQ ID NO: 6831612 - DNA, 84 bp, Homo sapiens
gctgagggattcccttggatggcaggacaaggacccagggcctgtgctcttctcattctgttattcaatgcctaaccctcaagt

SEQ ID NO: 6831613 - DNA, 130 bp, Homo sapiens
agaaaaaaagaacggtttaactagaaagaaagggtgtctcctggaagaataccacactttggcactggagtaggagcaatttataggcagccacatcttaaacttttcaaagcagcccctcttctgttct

SEQ ID NO: 6831614 - DNA, 71 bp, Homo sapiens
ttcctcagacctgagattttgaggctcatgaccctggtaagtgcagaaaggatatcttgtggtctgaggag

SEQ ID NO: 6831615 - DNA, 83 bp, Homo sapiens
ttctaagcattgtacatatttgtaactcacttaacctcacaaccttgtgaggcagggagtttaattgtcctcattttgcagaa

SEQ ID NO: 6831616 - DNA, 112 bp, Homo sapiens
ttatgagcaaatatgtgataagaggctcatcgctgactctttgacaaaatgcagcattttcttttaagctacattatgttaagagcagaatttcctctctactagctgataa

SEQ ID NO: 6831617 - DNA, 75 bp, Homo sapiens
gaggtggctggctggttttggtgagctccgaagctgaggaggctgccggggctgcctggggctgcctcccgcctc

SEQ ID NO: 6831618 - DNA, 69 bp, Homo sapiens
ttgccctttgctgggaagccttcactctccagctttcctggggtagggaaggtctcccacattatgcaa

SEQ ID NO: 6831619 - DNA, 87 bp, Homo sapiens
gcttgctgttgccaggtgcgtgtgtgggttctctggagaggcctctctgaaggcatcctcactgcaactccctcacacaggcaaagc

SEQ ID NO: 6831620 - DNA, 88 bp, Homo sapiens
actgcaagaacaataaggatttttaggggcattatgactgagtcagaaaacacagctgcccctgaaagtccctcatttttcttgctgt

SEQ ID NO: 6831621 - DNA, 81 bp, Homo sapiens
gagattttgttggctttacatcaaattgagtatagtacttcaaactgagtatttgatgaaggtaaagtcttatcaagtttc

SEQ ID NO: 6831622 - DNA, 60 bp, Homo sapiens
tgtgagacgtgttagaacagtgttttatatttaaacacccccattcatacgcatctcaca

SEQ ID NO: 6831623 - DNA, 60 bp, Homo sapiens
gggttcacaaggcatgatgtaaacagaatgggttgtggcgtcaggactgttttgtgaccc

SEQ ID NO: 6831624 - DNA, 86 bp, Homo sapiens
tccactcaggtttgattaatagaaagtggatccctttatactgcattttagtcagaggcctttctgttgagtgaagccattgtggg

SEQ ID NO: 6831625 - DNA, 81 bp, Homo sapiens
ttggaccttgttcatagcacttgtgttatgccttgtgccattatcatttgtatacacactgagtgtccccactaggtttga

SEQ ID NO: 6831626 - DNA, 82 bp, Homo sapiens
tttggtaaaagacagtgataccttgggatgtggcagctctacaaatctacattgctaacaccagtcaactgttcttatgaaa

SEQ ID NO: 6831627 - DNA, 57 bp, Homo sapiens
aagctactgagcagatgttcgcccctgaagcctgggagagacagagctcagtgggtt

SEQ ID NO: 6831628 - DNA, 61 bp, Homo sapiens
ttctggctccactctgtgcatgctggaggacaatttacagcagtcagtaaggcagccagaa

SEQ ID NO: 6831629 - DNA, 74 bp, Homo sapiens
tcttctgtggtgtaggtcacagttaggatgaatctgacctcatcttaattctgtgtcttcactagtcactaaga

SEQ ID NO: 6831630 - DNA, 60 bp, Homo sapiens
gttggtgtgccagtgggtagtcttgcttctggtctgagaaatcccaaggcatcaaccagc

SEQ ID NO: 6831631 - DNA, 57 bp, Homo sapiens
tgcagagctgttaatggagctgaatctgatttgtgtttagcctgtaagcactttgca

SEQ ID NO: 6831632 - DNA, 82 bp, Homo sapiens
ctccattgaactttggctctttagaattccctcattccttctttgggaaagtggaatgggaaagtcaagggtgcgaggggag

SEQ ID NO: 6831633 - DNA, 128 bp, Homo sapiens
cccttagaacagctgcctaatactcaagagcctcaagccttctgatttatatatgcagatactacatatggaatttgttaaaaattagatcgcctctactttttgggtggtgtgggtgggaggagagg

SEQ ID NO: 6831634 - DNA, 79 bp, Homo sapiens
ttcctgcacccatgttcaaagagaaattgtattttctcatattaattattatttagaattttctttgttatggcaggga

SEQ ID NO: 6831635 - DNA, 67 bp, Homo sapiens
atgaggaatgttgaatatacctgcatttgtgtaactaatctacataaatgttaaatattttcctgat

SEQ ID NO: 6831636 - DNA, 88 bp, Homo sapiens
gaaataaacctttgtggtcttaagccactgtgatttggcatttaccacagcagagcctagcttaatctgactgatagaggttaatttc

SEQ ID NO: 6831637 - DNA, 57 bp, Homo sapiens
cctggggtccatgctgtcatcatccccattttacagatgagaaagtagagactcagg

SEQ ID NO: 6831638 - DNA, 70 bp, Homo sapiens
ctggtcctttgccatctctccacctcgctcctggccttccttgccgggggagcagagggcagaggctcag

SEQ ID NO: 6831639 - DNA, 70 bp, Homo sapiens
gatgttatctgccttagatcacaaaactggtaaatagcaaaccagaatttgatcctaggcagtgtgattc

SEQ ID NO: 6831640 - DNA, 61 bp, Homo sapiens
gattcctggccccacccctggagagtctggctcagcagatctggggtaggcccaggacttc

SEQ ID NO: 6831641 - DNA, 69 bp, Homo sapiens
gctttgattgaagtgttctgttccaggcagcctcaatgattgcttgttcacagagactctaatccatgc

SEQ ID NO: 6831642 - DNA, 66 bp, Homo sapiens
tcactccttccctaccatcaatgtttctctactgcatgatgaacaaagatgggtgggaaagagaga

SEQ ID NO: 6831643 - DNA, 64 bp, Homo sapiens
gtttttcaaaggcttctattggacgttgcagctgacagctgcagtagagcttcttttgatgaac

SEQ ID NO: 6831644 - DNA, 125 bp, Homo sapiens
gaaaagagttaaagcccaattttggcagaaagcagggctggagccagctgtggctgcggtgatcacgcagccgggtctgtctttagagcttctttctgcctttcctttgtcggcatcctcccttc

SEQ ID NO: 6831645 - DNA, 76 bp, Homo sapiens
ctgtgaatattgtgctgtttagatccacactgttggagcagctgcttaccaatttttggttcaaatagtttcatag

SEQ ID NO: 6831646 - DNA, 55 bp, Homo sapiens
cagatgaggcaacctcattgctgagactgagctgagagtgagcatggcttgactg

SEQ ID NO: 6831647 - DNA, 55 bp, Homo sapiens
atgggtagacattcctgaaactcgctgacacagtgtagttgtttttgtttcccat

SEQ ID NO: 6831648 - DNA, 72 bp, Homo sapiens
ttaggcagaactctcaagctaatatccaaaggctaaaggccaagataagttaaggtttgtagaattgcttaa

SEQ ID NO: 6831649 - DNA, 82 bp, Homo sapiens
ccatgttctctttctttggctgccagtctggagacatcagcctgagtcctagagtgggatgccgtggggcagagaacactgg

SEQ ID NO: 6831650 - DNA, 63 bp, Homo sapiens
ggaggtttgtggccagagattaaatagagtccttcctcgacctttcgatctcaggctgatccc

SEQ ID NO: 6831651 - DNA, 73 bp, Homo sapiens
ttcctttcactttttacttgacataaatgagtttatgtattgtgtgccaatttgttcaggtaagtactgggaa

SEQ ID NO: 6831652 - DNA, 58 bp, Homo sapiens
cagtggagaggtgaggaatgcttgggcttttgtccatctctgttcctgcctttctctg

SEQ ID NO: 6831653 - DNA, 57 bp, Homo sapiens
gtttacttagatgctcatgcagagaggttatcatcaaagatgggcactagagtagac

SEQ ID NO: 6831654 - DNA, 64 bp, Homo sapiens
gacttgagaccctccccagagcacatcttctcagaactgctctggggcccagggatcacaggtc

SEQ ID NO: 6831655 - DNA, 79 bp, Homo sapiens
gcatgactgtctatgtcctaatctcagctaggagatcttgcatttcttttccttctggagatggggaataggagcaagc

SEQ ID NO: 6831656 - DNA, 76 bp, Homo sapiens
ggtggaaggggcaatgggcttttctgtaagggcactaatccccttcatgagactccactgccatgaccttatcacc

SEQ ID NO: 6831657 - DNA, 71 bp, Homo sapiens
tttgtcttctctagatgtcttgtgctttactacatgctgacttgcatgtggaagatactccagaaattaaa

SEQ ID NO: 6831658 - DNA, 67 bp, Homo sapiens
tggttcaggcagggtgttgctggaaaccgaaaagaaaagtctcttccataaaatgatgcctgaacca

SEQ ID NO: 6831659 - DNA, 68 bp, Homo sapiens
gagcaggtgcccaggggacagtggctgtttgttctgcatgggccatgcggtgtcctgagcacctgttc

SEQ ID NO: 6831660 - DNA, 55 bp, Homo sapiens
ctggctacccttctctagcatgctttgtgctgcctaataagtcgagggtggttag

SEQ ID NO: 6831661 - DNA, 94 bp, Homo sapiens
attcagtggaagtaaccagtagctatgtataaataggccactgtagtcaaagctcagtgtatctaggtatctatagttctttccagacttgaat

SEQ ID NO: 6831662 - DNA, 58 bp, Homo sapiens
gggaaagaccttcctggggtgtggcctttgtctgttttgtcccgggtgggctgttccc

SEQ ID NO: 6831663 - DNA, 76 bp, Homo sapiens
tgagggtgaggggccaagagtagggcacccagccatgtgtgctgaaagctgccttctgcttggaactcccacccca

SEQ ID NO: 6831664 - DNA, 93 bp, Homo sapiens
gtagctatctgtggctggtaattgcatgtttgaaaagtaactcacatgaaatattagacaggcaatactaactagtcactcaaggatttttat

SEQ ID NO: 6831665 - DNA, 56 bp, Homo sapiens
tggcctggtgctcaggcagtagtagattttgcctgctgacttcagtatcaaggcca

SEQ ID NO: 6831666 - DNA, 79 bp, Homo sapiens
gaggtgaaatgatttgcttagtcttacgaatatttgggagccaaacttcaactggaatgggctatcctgatttcatctc

SEQ ID NO: 6831667 - DNA, 60 bp, Homo sapiens
gccctagaatcacatttcttgtgtataaatactagattcattattaatgtgatcttgggc

SEQ ID NO: 6831668 - DNA, 93 bp, Homo sapiens
ggtttcaccaggtggcacgcaatgtcaacttatctctttatctgtgggttcacgttcatgatttgattaggatgatgtgcgcctggtctcacc

SEQ ID NO: 6831669 - DNA, 84 bp, Homo sapiens
gaatcttataagaaattgttagtatgtgtgcttacatctgctatgattatagcattagattaaaaatttagatttgtgatattc

SEQ ID NO: 6831670 - DNA, 124 bp, Homo sapiens
tgtggtgatgcacttttttttgtaaatctttttttaaatagactttctttttagaacaattttgtgttcacagcaaaattgagaggaaggtagagagatttcccacaccaccagcacacacaca

SEQ ID NO: 6831671 - DNA, 65 bp, Homo sapiens
tcctctgagcctcagtttctcatctgtcaaatgggcatagtgagacttctgtggcatttagagga

SEQ ID NO: 6831672 - DNA, 70 bp, Homo sapiens
ggggccggctctgagcagcaacccagagcctccctgtgggatgggacctgctgctgctctgctgtgtccc

SEQ ID NO: 6831673 - DNA, 63 bp, Homo sapiens
tacatgtacacatatcatttgtgggaatgtgtattttctacttcttaggtgtgtgtatatgta

SEQ ID NO: 6831674 - DNA, 60 bp, Homo sapiens
atgcctgggttccatcctcagagatttggattcaatttaagtgagtgggagcccaggtat

SEQ ID NO: 6831675 - DNA, 128 bp, Homo sapiens
ggtggttttcctgttatctatgtagaggacatattattagctatgttgttccttggggtcttattgtatttctttgaagtgcttggctaatggttatgtcacctcagctactctgtggaagtcctacc

SEQ ID NO: 6831676 - DNA, 61 bp, Homo sapiens
ccctaaggcagcccagtctgtgtataattggtgcggcacagaccccaggagggcctcaggg

SEQ ID NO: 6831677 - DNA, 82 bp, Homo sapiens
tggctcactgcaacctctgcttcccgggttcaagcagtttcctgcttcagacttccaagtagctgggattacagacatgcca

SEQ ID NO: 6831678 - DNA, 73 bp, Homo sapiens
ggcttagtggtttaggggaaagaactgtgaataggatgatcttggtacagtctagcttctccactaatcagct

SEQ ID NO: 6831679 - DNA, 70 bp, Homo sapiens
ggctatctcactcgaaacacagcatcccctcccatcccatcacgaggggaccctgtggagggtgagagtc

SEQ ID NO: 6831680 - DNA, 57 bp, Homo sapiens
gattctgttgcccttagagttgttacccctacagttttcactgggcttgcagaaatc

SEQ ID NO: 6831681 - DNA, 66 bp, Homo sapiens
aatttgttctagcctcctgttttgacaagtattccttcataacaacctggaaggccagaccaaatt

SEQ ID NO: 6831682 - DNA, 75 bp, Homo sapiens
agtaagcccccctcagtaaggatgcttcagcggacccctctgattcacaggggtctccattctcacgggcttgct

SEQ ID NO: 6831683 - DNA, 68 bp, Homo sapiens
atacaaatcctctgggatggtaaacactcttcagtatttccaggctatcctagggtgaagatttgtgt

SEQ ID NO: 6831684 - DNA, 68 bp, Homo sapiens
cagctcctgtttttctgtgagcttaaagggctgtcacttttatgtcactttgaaagagagtaaagctg

SEQ ID NO: 6831685 - DNA, 60 bp, Homo sapiens
cacccaggctggagtgcattggcacaatctcggatcactgcaacctccacctcctgggtg

SEQ ID NO: 6831686 - DNA, 55 bp, Homo sapiens
tgcccagatggaggccctgaccccaaaggtcaaaggctaattaaccacctggtca

SEQ ID NO: 6831687 - DNA, 64 bp, Homo sapiens
cttgggagtcaccttagctgtgagaaccgtttttcgatcttaccagcaaaaatgacagcccagg

SEQ ID NO: 6831688 - DNA, 59 bp, Homo sapiens
ggttattcaggtcatggactgtcatctgcttagaaagatgatatcttttcctgagaatc

SEQ ID NO: 6831689 - DNA, 126 bp, Homo sapiens
gctgctgtgcccggaaatccatggccacctttgcactcaggccactcttcccatcagtgaatgagtgtggcagggatactgaggcaggctggttccagagagacccagggtgcatcgaacggcagt

SEQ ID NO: 6831690 - DNA, 61 bp, Homo sapiens
tttggcgtccctggccccgccctgcccacagcctggctggcgcgtggcctgggatcccaag

SEQ ID NO: 6831691 - DNA, 55 bp, Homo sapiens
cccaggctggagtgcagtggcgcgatctcggctcactgcaacctccccctctggg

SEQ ID NO: 6831692 - DNA, 59 bp, Homo sapiens
catattccctccctcttcagccctataggtggggaaactgaggctggggaagggaagtg

SEQ ID NO: 6831693 - DNA, 96 bp, Homo sapiens
tgcaggtggggatgccagaagttctacaagtggagttctgacgcattagctggatgctcagcaaaaagcttgtgagagacaactacaccccgggca

SEQ ID NO: 6831694 - DNA, 83 bp, Homo sapiens
atcttaaataagtcacttgattctcctgagctctgtttcttcctctgaaaataaagccattgaattatggtggtttgaaagat

SEQ ID NO: 6831695 - DNA, 66 bp, Homo sapiens
gcaggcctggggctggcttccagtccagagcaagtgctcttcctcctgcatgagcctcaggccggc

SEQ ID NO: 6831696 - DNA, 80 bp, Homo sapiens
ggttttcccttgggctttatgagattgagatctagtggcttatgaaactatacttaatcagataagtctcacactaaact

SEQ ID NO: 6831697 - DNA, 56 bp, Homo sapiens
ccttgctctttaggtggcagcataactttgttgttaacacaattctggagagaagg

SEQ ID NO: 6831698 - DNA, 62 bp, Homo sapiens
aatgccattccatcacacacctcagtaaatatgtaacggtgtgtgaaagctctgggagcatt

SEQ ID NO: 6831699 - DNA, 80 bp, Homo sapiens
gcatgcttctctgtattccaagcttcttcctccaaagtacaaacaggagtgaatcagctcacgaaaatggtcatagctgt

SEQ ID NO: 6831700 - DNA, 58 bp, Homo sapiens
ggagagcattgaggagagattctgaactagttgttttatgttcctctttatgcgatcc

SEQ ID NO: 6831701 - DNA, 72 bp, Homo sapiens
ccttctgccgtctgagtgtgtctaatctttctctgccgctatcttagaagaacatttatgatggcatttagg

SEQ ID NO: 6831702 - DNA, 93 bp, Homo sapiens
gttgcaggctcattctcttttaccaagttgttagatgttgggatggttcaaaaaacaggcattcttttctgcagctggtatttatgttgcaac

SEQ ID NO: 6831703 - DNA, 55 bp, Homo sapiens
aggcatgatacgtgctctgtgagctcaaacttcacagttgggctgtagcatgctt

SEQ ID NO: 6831704 - DNA, 67 bp, Homo sapiens
gcaggtggtgggagagcttgctttgatgctcccaaagaaagtgttgcccaggttctctcctgcttgt

SEQ ID NO: 6831705 - DNA, 67 bp, Homo sapiens
tgttggggtattattctatgacttgttctcatcttatcataacattgtatgagatttgacctcaaca

SEQ ID NO: 6831706 - DNA, 129 bp, Homo sapiens
ctgggattcacaggtgctgaccactgtgcgtttgaccatctgtcagtaaagaagcaagtgccaactcccctgtttcttgggtgctcacatcatggagacagcacatcgtccaccatgtgttatcatctg

SEQ ID NO: 6831707 - DNA, 128 bp, Homo sapiens
attttacataggacacaaaaaatggaatgcttttggacttaaacctgttttcttttcaactccttctgcctagaggagatggtagcctcagaagagttcttacttccccttcctagaactgtgcaaat

SEQ ID NO: 6831708 - DNA, 70 bp, Homo sapiens
cagactatttatgtccaagtgttttaaccaaggagttaaatggttagatttctcattcatagattgtttg

SEQ ID NO: 6831709 - DNA, 100 bp, Homo sapiens
gttacaataatcaaaagtactctgaagagctaaaactggtgatttgaatgtttgtagactctagattaacagttttgttgaagagtgtggttccagtagc

SEQ ID NO: 6831710 - DNA, 66 bp, Homo sapiens
acttagtaaatgtgctaaaatgtgtcgggctacatagaagcttgacacccagctcattaactaagt

SEQ ID NO: 6831711 - DNA, 72 bp, Homo sapiens
agggtagatggtaaacaatattcagttgaggtcttattcataaaaccttagctagagtgtgtcatttatgct

SEQ ID NO: 6831712 - DNA, 66 bp, Homo sapiens
gctgtccagcagggagttagaaatccaggataagaatattgaagacaagctaattcccatgtcagc

SEQ ID NO: 6831713 - DNA, 87 bp, Homo sapiens
acatgtctgccaaggagaaatatggtgtccagtctcccattgaagtgccactggaatggattggccgtggctgctggcttgacaggt

SEQ ID NO: 6831714 - DNA, 100 bp, Homo sapiens
gggagtcattctcaaacttgggcatgcatcagaatcacctagagggatctatacacctcccttctagagtttctgatgcaacaggtcgaggatgatgacc

SEQ ID NO: 6831715 - DNA, 71 bp, Homo sapiens
acactccctggcacagcgagaggttgaatcctcctcaggcgcagcctcagggctctgcgcagactcagtgt

SEQ ID NO: 6831716 - DNA, 85 bp, Homo sapiens
aggttttgagcagaggtgacataataatctgacctagattttaaaaggatcactttagttactatgttgccactagcctgaacct

SEQ ID NO: 6831717 - DNA, 77 bp, Homo sapiens
tgatgctgcagccatgaggatgggggagtccaagggtcgcgcccttctcccctgaccctgatgaggcacttgcatca

SEQ ID NO: 6831718 - DNA, 57 bp, Homo sapiens
acccctcagctcctttgaccttaggatccacttattttgtcaataaaagttaggggt

SEQ ID NO: 6831719 - DNA, 66 bp, Homo sapiens
gtgtgtgcgtgcatgtgtgtgtgtgtgtgtgtgtgtgggcatgtacacatgcatgcatgtgcatgc

SEQ ID NO: 6831720 - DNA, 71 bp, Homo sapiens
ctctaaatgcttgtattgggggaaaaaagctggaggttaattttttagacatccaatttaagaatttagag

SEQ ID NO: 6831721 - DNA, 58 bp, Homo sapiens
ttctagctgtggtcgagtgaggaaatcatcaaatcatcttccttaaaagcagctataa

SEQ ID NO: 6831722 - DNA, 69 bp, Homo sapiens
gtcatcatgtcatgttttcctacaaggtaacaataatgatgctgcctctagaagatgtgataatgtgat

SEQ ID NO: 6831723 - DNA, 90 bp, Homo sapiens
gggagtggaggggtatagatttgaggaatagaaattaaaatagaacttaaattaccatcgtcaaatcatatgaaagctctttttactctc

SEQ ID NO: 6831724 - DNA, 66 bp, Homo sapiens
cccaaatgccttggcaggacctcctgtgtacacatccctgacaggacactgctgtagcatattggg

SEQ ID NO: 6831725 - DNA, 59 bp, Homo sapiens
gtcagggccatcttttgcctcaagtgatgaatgatttgtcaggtcctgatggccctgat

SEQ ID NO: 6831726 - DNA, 80 bp, Homo sapiens
agcagttggcagtagtggtagtacattctcttaactttcaggttctgttaaaagaagtaagtttctctctccaagatgtt

SEQ ID NO: 6831727 - DNA, 71 bp, Homo sapiens
agtgtgtcatgtagaaattgatgaagaagcgataattatagcagattcattgatagttttatgtatgtact

SEQ ID NO: 6831728 - DNA, 79 bp, Homo sapiens
tgggtgcgctcaccttgtcctgcagcctctcttccccttggtggtggggaaggcggtgctgtggacagtgactaactca

SEQ ID NO: 6831729 - DNA, 93 bp, Homo sapiens
gcttgttcaaacacagatttctttgtcccatctccagaatttctgatttagtaaaggtgggataaaccttgagaatttgcgtttctaacaagt

SEQ ID NO: 6831730 - DNA, 68 bp, Homo sapiens
gctgcaagacccagatgtcaggttcagggatgcattttctctggcagggatatctggctcctctcggc

SEQ ID NO: 6831731 - DNA, 81 bp, Homo sapiens
ccaggcagctttgcagacagcaggccgcattgcaggaggtgctcctccctcctcggcagctgattgcagagcaccgcttgg

SEQ ID NO: 6831732 - DNA, 57 bp, Homo sapiens
cacagaggtgatagtggtcaaggcaggaacggccttgcccccgctgatccttttgtg

SEQ ID NO: 6831733 - DNA, 65 bp, Homo sapiens
ctgagctgagctgggctgagctgggctgggctaggctgggctgagctgggctgggctgagctgag

SEQ ID NO: 6831734 - DNA, 91 bp, Homo sapiens
actccaggttctatagccccatgtgtcttatgctctggagggataatggccacattatccaatataagacatgtatgggttgatcttgagt

SEQ ID NO: 6831735 - DNA, 124 bp, Homo sapiens
attttataataaatacaaaatagtttcagaattacgttacctctaaaaaattagaagcctatcatgtaagtgtcaatatttttgtaggttttggttttgttattatttttttctattttagaat

SEQ ID NO: 6831736 - DNA, 82 bp, Homo sapiens
taatagggggtgtagtaggtacctggttatctcatactcgttaacattcctttgagagtcagggaactacttctccctattg

SEQ ID NO: 6831737 - DNA, 88 bp, Homo sapiens
ggtcgtttatcgatacaaagtgagtgttggaggaacccatcaagacacaggaagggggaaatcctagcgccgccagtcggagatgacc

SEQ ID NO: 6831738 - DNA, 85 bp, Homo sapiens
gagctgctcccagccagctgtgtggtcaggcaagtcattctcccagaagatgctgcagtttgtttgaccataaagtgggcagctc

SEQ ID NO: 6831739 - DNA, 68 bp, Homo sapiens
atatatgtacacacacatgcatgtaaatatatatagatgtacatgcatacttgtgtgtgtatatgtat

SEQ ID NO: 6831740 - DNA, 58 bp, Homo sapiens
acaactgaacacgtctctcctctggttatacaacttgggagaagaatgtgtcaattgt

SEQ ID NO: 6831741 - DNA, 79 bp, Homo sapiens
gctggcctttgacaagtgcatgaacaggagcctaagcggggtcacctggatgggctgatttctgactctctgggccagt

SEQ ID NO: 6831742 - DNA, 57 bp, Homo sapiens
cagtcattggcaagtctttccctgaggtatttcaagaattgctaatccaagtgactg

SEQ ID NO: 6831743 - DNA, 60 bp, Homo sapiens
gcacccttttaagcagaagaaaagcaagcatcatttacatttctgcctgcttgtaggggc

SEQ ID NO: 6831744 - DNA, 83 bp, Homo sapiens
agaagcataggcactttcctcctccttggatataagaggagactgaagctgaagaagaggaggggataggcctgtggacttct

SEQ ID NO: 6831745 - DNA, 94 bp, Homo sapiens
ggttaactgtttttgtgtgtgtgtgttttatacagtgaaacatttttaatgtgaaattcttgaaatgcacacaaaagtacagaaaatgctaact

SEQ ID NO: 6831746 - DNA, 69 bp, Homo sapiens
cgctcagcgtgtccagtggaaaagagatattcgaatcctaactgctctattgggactctgcggtgagtg

SEQ ID NO: 6831747 - DNA, 60 bp, Homo sapiens
ccattcagtaggcatcccacagtctcctgggaggtcaggaaaggatggttttgctgaagg

SEQ ID NO: 6831748 - DNA, 69 bp, Homo sapiens
gttgccatgctaatactgagccaccaggtagggcagtgttgccctggtttgggtgccagtgagtttaac

SEQ ID NO: 6831749 - DNA, 57 bp, Homo sapiens
gcaggaaaggttgagactttgctcttaaagatctagcagctccaagatcttccctgc

SEQ ID NO: 6831750 - DNA, 79 bp, Homo sapiens
cagaatccttctgggtagttactgtgacgatccttcaccttggcagtggaggaagttctatgattacatcctggttctg

SEQ ID NO: 6831751 - DNA, 68 bp, Homo sapiens
tttagttccaattcatgtgagcggactcttctctaagtggaagattttggaacatgaaatggactgga

SEQ ID NO: 6831752 - DNA, 67 bp, Homo sapiens
cttaggtttaaggttgaagaacagaataatattcacatttaatctcaaatcaaactttgagcttaag

SEQ ID NO: 6831753 - DNA, 57 bp, Homo sapiens
gggtatattttgcatgcagtttgtagaaatttacaggaaccatgaagacatataccc

SEQ ID NO: 6831754 - DNA, 57 bp, Homo sapiens
tgggctagatatttttgggctgcaagaattccttttgcttagatggattttggccta

SEQ ID NO: 6831755 - DNA, 84 bp, Homo sapiens
gttttggggctgagttttgaggtccctcaacatgtcatagctgagttgaagaggatgagagggcccagagcacaccaaaagagc

SEQ ID NO: 6831756 - DNA, 99 bp, Homo sapiens
gaggcaggagaattgcttgaaccttggaggtggaagttgcagtgagccaagatggtgtcactgcactccagcctgggtgacagagtgagactccgtctc

SEQ ID NO: 6831757 - DNA, 117 bp, Homo sapiens
ggatgcttatggtggaatgaaggagcactatttaggcaatatcattggagttgctttgaaatactcaattaactagtaattctgttgctaatgttctgtacagatacataagcatct

SEQ ID NO: 6831758 - DNA, 72 bp, Homo sapiens
ttgatattaaagacaaactcatgctaaaaacccagggtactctcctgggttttcagcatgagtttatattga

SEQ ID NO: 6831759 - DNA, 56 bp, Homo sapiens
gtgtcttagggttgcacagagtctccctcactggagggagtgtaactatgagccat

SEQ ID NO: 6831760 - DNA, 56 bp, Homo sapiens
agcagcagctcattcttcctgtagtctctcacccaggtggatcttggtaggctgct

SEQ ID NO: 6831761 - DNA, 63 bp, Homo sapiens
cagctttctgtctcatgactgacacccttccttggttcctgtcatctgtagccaggtatgctg

SEQ ID NO: 6831762 - DNA, 81 bp, Homo sapiens
ccagcagctggcctggttcagagggttcactcagtagttaagaaaacaggagggggtctatgaggtagagccagtttatgg

SEQ ID NO: 6831763 - DNA, 81 bp, Homo sapiens
aggtttgcagaaagtaggcagtgcttgattttccaggtttatgatattggaacactgatcattgcctttatctgcaaccct

SEQ ID NO: 6831764 - DNA, 60 bp, Homo sapiens
ctccactccagccatttgtccccagccctccctgtgggccttgtgtgactggaggaggag

SEQ ID NO: 6831765 - DNA, 91 bp, Homo sapiens
agtaattgtgcaaggttaatatgaacagcagaaggaatgtaaaaatgtaaagtggtcttctaattcttatgtaagctttgtcatagttatt

SEQ ID NO: 6831766 - DNA, 75 bp, Homo sapiens
tagatcatctttcttattttctgagaatttgatacagttgtcaggagctcagctaagttggagagagctgaactg

SEQ ID NO: 6831767 - DNA, 61 bp, Homo sapiens
ctcacaaagattgaaagatatactgttctcacacttttgtgtgtgtgtgtgtttctgtgag

SEQ ID NO: 6831768 - DNA, 61 bp, Homo sapiens
ggcagataaacaatgttgtataggaacttcaacacacactgtacaatattcccactttgct

SEQ ID NO: 6831769 - DNA, 69 bp, Homo sapiens
ctttggtcagagggatggagttctatcatcagcccagtcttagatacctgctcatccctgtgaccaagg

SEQ ID NO: 6831770 - DNA, 80 bp, Homo sapiens
gcagactacaacagttcagttgagctcaacaaaatgtactaactcacagaattgtgagctcaatatggtggttgttatgc

SEQ ID NO: 6831771 - DNA, 61 bp, Homo sapiens
caggacttctccgataagtcagagccctctatctactgtaggctactggaagagagtcctg

SEQ ID NO: 6831772 - DNA, 119 bp, Homo sapiens
ggcccttgggttttttgtttgtttgtttgcttgttttgtttctttttctgaattactagagttaacttttgagcactgtcaggaagaagacggggcaggaaattagaagacccagggct

SEQ ID NO: 6831773 - DNA, 82 bp, Homo sapiens
attgggaagcagctgatcaccagtttcaggtgttttctatctattagaagacagcctttccctggtgccagctgtgaccaat

SEQ ID NO: 6831774 - DNA, 85 bp, Homo sapiens
aattacagtgacacctgagggtccagccctgtgtaaaagatatgaatatttacaatgcactcacctttagaagtggactataatt

SEQ ID NO: 6831775 - DNA, 64 bp, Homo sapiens
ggcagctatcaaagtgctttacgcacattaaaacattcatagcccaggcaccttgatggcttcc

SEQ ID NO: 6831776 - DNA, 59 bp, Homo sapiens
ggttattattcatgtaactcaggacttatagttcagggtttgacatatgaatggcaatc

SEQ ID NO: 6831777 - DNA, 82 bp, Homo sapiens
ggttccaagtctttgctattgtgaatagtgccacagtaaacatatgtgtgcatgtgtctttatagcagcatgatttataatc

SEQ ID NO: 6831778 - DNA, 58 bp, Homo sapiens
cagagacaggcttgccctccaccaaaaaggtggagactccaggcacagcctttccctg

SEQ ID NO: 6831779 - DNA, 81 bp, Homo sapiens
attctttaatgctagtctaatgatgacactgttttgtttattagaacatgtattttccttggcaactagtttttgttgggt

SEQ ID NO: 6831780 - DNA, 63 bp, Homo sapiens
ctcaggtccccagggtacctacctatttcaagttgcttgaaggtgtgcttctgggcacctggg

SEQ ID NO: 6831781 - DNA, 78 bp, Homo sapiens
ggcaggtctcagcagtgtgcttggaatggaacaagatgtttagcctctatcttcaatctgtagtagctgagaactgcc

SEQ ID NO: 6831782 - DNA, 70 bp, Homo sapiens
tacatgttctgagccagagtaaaccagagaccatgtataaagtaatataatatttattctggcatatgtg

SEQ ID NO: 6831783 - DNA, 61 bp, Homo sapiens
cctgagtccaggccccagggattcttgtttaataggccttgggtgcagcctgggtattggg

SEQ ID NO: 6831784 - DNA, 66 bp, Homo sapiens
agacctctgagggcatcttgtccaacttcaaagttttctatgaatataatgagcctcagaggtgct

SEQ ID NO: 6831785 - DNA, 74 bp, Homo sapiens
ggtcctggcctgataggcggtttgaggaagctgagtgggagctgacctcctctgcgcccttgatcagccagacc

SEQ ID NO: 6831786 - DNA, 130 bp, Homo sapiens
gcaatgtgatgcacacagaaatgaagaatgaccatttagaaactgtttttaacagtttgacattgttgtgtcatccatgtgtgataacatttttctagtaattcttgtatttacaaaagtatcacatcgc

SEQ ID NO: 6831787 - DNA, 61 bp, Homo sapiens
gctggagagcaaacctaccgctcggcggccgccgcagagagcaggcccagggcttctcagc

SEQ ID NO: 6831788 - DNA, 60 bp, Homo sapiens
ctgatttcaaatggtgctagatacaaagatggaaaaatctaagccaccatgtgaaaccag

SEQ ID NO: 6831789 - DNA, 69 bp, Homo sapiens
ggccacctgcgggccgtggtggagaagggccagggtacggtattgctccacaacagtgtgcctgtggcc

SEQ ID NO: 6831790 - DNA, 78 bp, Homo sapiens
ttcttagcagaagaacaacatgatctgacatagcacaaaggataaaagttagatttagcaaatcttactagctaagga

SEQ ID NO: 6831791 - DNA, 92 bp, Homo sapiens
tgtgtagcttttattgatcgtttcgtggcctttgactccaagtccgtgaatcagttacaggtctaactaaatgaattcagtataggccagca

SEQ ID NO: 6831792 - DNA, 130 bp, Homo sapiens
tgtccattaatgtcatttttcattttcattttttaatgtatggggttgagatgatactatgggattgagtataattgccttttatagaatgcgtgggactgatattttctaaaaatggacaaaaatccag

SEQ ID NO: 6831793 - DNA, 85 bp, Homo sapiens
agcactagagcgtgacagggtctggctggtcatcctttagtagatgaccagttaagtcatcctgtctacttagttcttcagtgct

SEQ ID NO: 6831794 - DNA, 61 bp, Homo sapiens
agatctttcggtttttgatcaaggacatggctttgtttacaaatcaaagactgcaggattt

SEQ ID NO: 6831795 - DNA, 64 bp, Homo sapiens
agtttccttgggcatttgtttagggaaaacaataacatttgaacaaatattttcaaggaatgct

SEQ ID NO: 6831796 - DNA, 67 bp, Homo sapiens
gcccaatttgaacaaagatacttcaatcattatagagaggaaaacagtactttttgttcaattgtgc

SEQ ID NO: 6831797 - DNA, 130 bp, Homo sapiens
aatgaattcagagatgaaacatttatatatatacacatttttacctatagtattaaaatcactgatcaatcatcgggggaggctataggaagaaatttgttttgcatatttcttctcatgtttttgcatt

SEQ ID NO: 6831798 - DNA, 58 bp, Homo sapiens
cagaatggggagactagcagcacttctgggcagcccatgaagcagcctcttccctctg

SEQ ID NO: 6831799 - DNA, 58 bp, Homo sapiens
ctttgccttttcttgagtaagctgctgattagcaggcagctagctaagaaggccagag

SEQ ID NO: 6831800 - DNA, 58 bp, Homo sapiens
caggttcaacagctagctgtggacagagccagactttgaatgcaggctgttgaaactg

SEQ ID NO: 6831801 - DNA, 122 bp, Homo sapiens
acatgctgcatccagggagggattgtgtcagataatctggagagcattgaacaaaactctttacttttgaaatgcatcatcatttagatgatgataccaaattgcctccttttttatgctgt

SEQ ID NO: 6831802 - DNA, 70 bp, Homo sapiens
tgcatgccaggtacttggtatgcattcacttccctgattcagggtactgataccaggtacttggtatgca

SEQ ID NO: 6831803 - DNA, 71 bp, Homo sapiens
tccgccctgtaaactttctgttctttaaatgcactgacagtatcttgcagatgaagtttacaggaaacgga

SEQ ID NO: 6831804 - DNA, 86 bp, Homo sapiens
taacctgtttctcattctcagctattccaattgtcgataattctcacagtaacaaatggcctgaggacaaagatgaaatctggttg

SEQ ID NO: 6831805 - DNA, 61 bp, Homo sapiens
gtttattgagtatctactatgtgtcagacactgtgttaggcactggagatgcatagtgagc

SEQ ID NO: 6831806 - DNA, 72 bp, Homo sapiens
acatcaaaatgtgtagtcttgatctaatgacttagatctaatgattttgattaagattacatatttaagtgt

SEQ ID NO: 6831807 - DNA, 85 bp, Homo sapiens
ggtgtgcttggggtgcacttgggtactcagggtgtactggtgatactcagggtgcagttgagtactccgggtgcacttggctgcc

SEQ ID NO: 6831808 - DNA, 68 bp, Homo sapiens
gctgaaggcaattgagaagaaacagacacataaaaagctctctgccctccccttatttgcctaaaagc

SEQ ID NO: 6831809 - DNA, 89 bp, Homo sapiens
tgttttagtataattatagctccagtagtagtttgttctttaatccagtgttgtagaataaatacttttggtataataaactcagagca

SEQ ID NO: 6831810 - DNA, 70 bp, Homo sapiens
tggatgaatcagcaaataaactctttggagtattcctttgtatcctgaagtctttgattgctgtcatcca

SEQ ID NO: 6831811 - DNA, 114 bp, Homo sapiens
gctcctcacagctccagaaatctgtgaagccgagatggtatttttaacgcagccattttaaacaatgtctgtgccgaaccacttttgctttcgctgttggcgcaggtgaggagc

SEQ ID NO: 6831812 - DNA, 58 bp, Homo sapiens
aaggttgctgttttgcttcaaatcttattttagataccagaagctgaatattaacttt

SEQ ID NO: 6831813 - DNA, 56 bp, Homo sapiens
tgagcagtggctcctgctggaccttctttgcatcatccagctcctgccactcctta

SEQ ID NO: 6831814 - DNA, 100 bp, Homo sapiens
gctgggaactccaggaaggaaggggtggggttgagggtggggaagcttctctattaccctccttaccaccacagctccagccaagcttggagtgatctgc

SEQ ID NO: 6831815 - DNA, 78 bp, Homo sapiens
agaaagctgtccccttgaggggaatggctggagttggcaacagatccttagtcacggtcttcagggtcacagacctct

SEQ ID NO: 6831816 - DNA, 57 bp, Homo sapiens
ctgaagtatttagggatggaattacactacggtgtgatgtactttaaaatacttcag

SEQ ID NO: 6831817 - DNA, 62 bp, Homo sapiens
tttctgctgtgctttcttgcgtattttcttaatggatagataggacaatggtacagcagaaa

SEQ ID NO: 6831818 - DNA, 59 bp, Homo sapiens
agccttttcatcttctctgagcatgtgcctatagccagtgttgagcagatgcaaaggtt

SEQ ID NO: 6831819 - DNA, 78 bp, Homo sapiens
gagaatgtgttacaagcagctgaaccattttacctactcaccagcagtgtataaggattccagttgctccatatcctc

SEQ ID NO: 6831820 - DNA, 90 bp, Homo sapiens
ccgcccgcccctcggccgcccgtgcgcgctcgcctcccgggctgcaactttgggggaactgttgcgcgcgggcgtcgcgggggcgggcgg

SEQ ID NO: 6831821 - DNA, 92 bp, Homo sapiens
gcacccaatctttaaggggtcctttgcaactgtattctggctgaaaaatagagtttctctcagaactgcagctgcagctccttgactggggc

SEQ ID NO: 6831822 - DNA, 63 bp, Homo sapiens
gagttgagtatatgcaatatatcttgattgcagaaaagcagttgatatagcattattcaattt

SEQ ID NO: 6831823 - DNA, 60 bp, Homo sapiens
gcaaagggaaagtggcagggtcatcgggcttttgtctcttccactgcccttctctttcgc

SEQ ID NO: 6831824 - DNA, 84 bp, Homo sapiens
tctttctttgtgtacttacagttgatcgatgtatttaatatttaattaaattgggtaattgcaatagtaagtacaacagataga

SEQ ID NO: 6831825 - DNA, 110 bp, Homo sapiens
aataggcagtgagcatgtttaagccattatgaacactatttttaagggctttagcaaattaattttatgcaaatggtgtttctaatgctagagctgctaatctgttcatt

SEQ ID NO: 6831826 - DNA, 57 bp, Homo sapiens
tagaggtcttatgctaagaatattggacttgatcatctgggcagttcggatcctctg

SEQ ID NO: 6831827 - DNA, 81 bp, Homo sapiens
tcgccctgcctatcgccaccatgtcaggacacggtgcacctgcttgcgggatgtcactgtgcctggcacagcaccgggtga

SEQ ID NO: 6831828 - DNA, 65 bp, Homo sapiens
tggtctgattctgttgaacaccttccttatgactttaagcaaactgttggagtagagtcttgcca

SEQ ID NO: 6831829 - DNA, 59 bp, Homo sapiens
ggctagcactagattctgaagcagcagtctctgctgataaaccagactcagtactgact

SEQ ID NO: 6831830 - DNA, 126 bp, Homo sapiens
ctccctgaaccctattgagttttctccatatttgagcaagttagttattcttgtgagctgtgttttaaagtagcagcaccagaaacatgactctgaagagggatagaaccctaggattcaaaggag

SEQ ID NO: 6831831 - DNA, 61 bp, Homo sapiens
gctctctgggagcaattgtttgcttggcctgaggaaagcagcatagatgctatccgagagc

SEQ ID NO: 6831832 - DNA, 77 bp, Homo sapiens
tggcctgtggataatctgggagaaaactgatgagatgggctcttctttcaagttccccagatatgcaattcaggcca

SEQ ID NO: 6831833 - DNA, 71 bp, Homo sapiens
gtctcttcatattatgatttgaaatgcctttcacattaaggcatgtgttattttatgtatgaaaatgaggc

SEQ ID NO: 6831834 - DNA, 81 bp, Homo sapiens
cttgtcctctgtgtgtcctgttttaaaatagtgctgtgcagggttgcactgtcaatgtgcgggagattaatggagcacaag

SEQ ID NO: 6831835 - DNA, 71 bp, Homo sapiens
ttccagggagctctgggccggactccactttctgggaatagagttaggtggccagtgctctcagactggaa

SEQ ID NO: 6831836 - DNA, 79 bp, Homo sapiens
ggatgggtgcaggtctgagtgccagggagagaagccaggcacccgaactcctagccagctcacttagcctgcaccgtcc

SEQ ID NO: 6831837 - DNA, 62 bp, Homo sapiens
tctaggtcttcagacactattaatgcagattgtagcctctaggtcctgaagattttactaga

SEQ ID NO: 6831838 - DNA, 55 bp, Homo sapiens
tgttcctgggcactcagctaacccacaggactataaattgagtggccgggggaca

SEQ ID NO: 6831839 - DNA, 73 bp, Homo sapiens
ttgctttgtcacccaggctggagtgcagtggtgctgtattggctcattgcaacctcctcctgggttcaagcga

SEQ ID NO: 6831840 - DNA, 80 bp, Homo sapiens
gtagccccattctatgttaatatttcagagtggtgccatcttcttgcacagaacttcaaacaattaacagagaatgctat

SEQ ID NO: 6831841 - DNA, 88 bp, Homo sapiens
tccagacactttcttccttcagttcagggaaccctcaatacacagtaagaatgaagaggttgcaggtctgagcttgaggaggactgga

SEQ ID NO: 6831842 - DNA, 57 bp, Homo sapiens
tttccatggcagcagccagagtctggaaaagaggcctggagaggaagccggtggaga

SEQ ID NO: 6831843 - DNA, 117 bp, Homo sapiens
tcagatggccctgcgcctctgtcagcaaacccgccctggccttcagggctcaggttcttagatgcagcttcagccctgggacccagggatgctgaagtagagagttctgtcaactga

SEQ ID NO: 6831844 - DNA, 56 bp, Homo sapiens
gtcagggaaatggagagtgtagttttataaaaagtcttcactgtctatttctaggc

SEQ ID NO: 6831845 - DNA, 116 bp, Homo sapiens
caaagccaaaatgtaggttaaggtggcaaccgggtaggtgtcaactctgatttaagaccagtgcagagtgaagacatcaccccatagctccttacctgactctaccccaagctttg

SEQ ID NO: 6831846 - DNA, 108 bp, Homo sapiens
gatactggtttgttttatacttgcatctaaggtggataacttctccccttaggggagaatggctggaagttatccaccttagatgcaagtataaaacagaccaatatc

SEQ ID NO: 6831847 - DNA, 57 bp, Homo sapiens
cccagatgtttgccactctgtgagaccaggggatccagtgttgtcagatcatctggg

SEQ ID NO: 6831848 - DNA, 71 bp, Homo sapiens
gctaagtacactggatgaagcaagctaaacccacaccccaggcagctttagctcttctctagtccctttgc

SEQ ID NO: 6831849 - DNA, 64 bp, Homo sapiens
ctcattaagattacgtgccagaagttagacataagcttttaaggccactgtggttttatgtgag

SEQ ID NO: 6831850 - DNA, 80 bp, Homo sapiens
ttccagatggaaaagcctgtggataaaccaagaagccccctttaggacccttttcaactacaggttaattttcagtggaa

SEQ ID NO: 6831851 - DNA, 65 bp, Homo sapiens
gcagtttgtcttgattcagaacacgttgcccaaccttcagcgtggttggattttgggccagctgc

SEQ ID NO: 6831852 - DNA, 78 bp, Homo sapiens
ctttcttattggtctgtgagctgttgacatgatgaatactcttaaagatgtcatcaactcacagagccaataagaaag

SEQ ID NO: 6831853 - DNA, 69 bp, Homo sapiens
cctctgttttgtatttacgtagaaatctccactttacaattggggaaaatgtagcttacaagataaagg

SEQ ID NO: 6831854 - DNA, 61 bp, Homo sapiens
gcgcgcggtcggagagtacgagcgcctcctgcagggcgcggctctgcgggccgctgagcgc

SEQ ID NO: 6831855 - DNA, 83 bp, Homo sapiens
ctgtctttgcctgtgtcttcactcaagtctcttgggacagcctgagctgctgagatgtggtggtggagaggaaacagagatgg

SEQ ID NO: 6831856 - DNA, 65 bp, Homo sapiens
tcaaatttaagtgaggtctttgttaagttctgtaaattgagcttataaagacaaacactatttgg

SEQ ID NO: 6831857 - DNA, 77 bp, Homo sapiens
gatgcagcctccaggcctggaccatgccagggctgggagtcttttctccaggcatgtcccaagccggatggctcatc

SEQ ID NO: 6831858 - DNA, 64 bp, Homo sapiens
aggccaggctggttccttgaccttcagagctggggcatcctttaggtgagaccagtcatggcct

SEQ ID NO: 6831859 - DNA, 111 bp, Homo sapiens
gagcaaagtcaggactcagagttagaagatgggattcaagtcccagttctattgcacatggactggtcaaccttaaagaattctttcacttctctggtcctaggttttctc

SEQ ID NO: 6831860 - DNA, 55 bp, Homo sapiens
tccttccttcattcaacaaatagtaattaactgtgattctcagaagagggaagga

SEQ ID NO: 6831861 - DNA, 79 bp, Homo sapiens
tttagaagcatatgtcctcggcacataatgttggctgactgtttggttaataatatgttcttgaagacatacttctgga

SEQ ID NO: 6831862 - DNA, 75 bp, Homo sapiens
gcagtaagaggaagtttatattgtaattgtatcatgaaaatgagaaccataatttacaactgcttttaatactgc

SEQ ID NO: 6831863 - DNA, 64 bp, Homo sapiens
cagatgtccaggatctatccccagaaactaactagttcactctagggtaggacctagacatgtg

SEQ ID NO: 6831864 - DNA, 69 bp, Homo sapiens
tattgtatcttaccacatgtatagaggacctaacacttggttttttccctgtgtgctaggactacagtg

SEQ ID NO: 6831865 - DNA, 59 bp, Homo sapiens
gctagcaaatgtcatttggaaggtaaagataaaagctttcagagagtacagttgctggc

SEQ ID NO: 6831866 - DNA, 80 bp, Homo sapiens
ggaaagaaataggcctgcttaaggttcatctccacgtgtgcttgtaaatgaactcaccttggcagtttctacctttttcc

SEQ ID NO: 6831867 - DNA, 88 bp, Homo sapiens
cagagtaaaacagtagtcacactggtctgcaaggccatatagagactcgtctccatttgcctcgcagatcatatttgctttttctttg

SEQ ID NO: 6831868 - DNA, 59 bp, Homo sapiens
cactgaggtatctgtctctcctactatagtgtaaacaccttggaggcaggtctcatgtg

SEQ ID NO: 6831869 - DNA, 113 bp, Homo sapiens
tgtgactctcaggcacttagcaagtgagtcaacccaaatgatgactccccatgtacgccacctggatgggccacacacgattgggtgactcataagtgcttctgagagcaaca

SEQ ID NO: 6831870 - DNA, 77 bp, Homo sapiens
cagctctcccttagcccggtagggactccagaaaaccacctctgaggaccatcggggagctgctggggaaagagctg

SEQ ID NO: 6831871 - DNA, 56 bp, Homo sapiens
actttgcctacaagcccatggtcagttaatagaagacctgggcttgaaagcaaggt

SEQ ID NO: 6831872 - DNA, 57 bp, Homo sapiens
ctcagcctaaagtttctgataaacctgttacctagcactgttattttttgggctgag

SEQ ID NO: 6831873 - DNA, 72 bp, Homo sapiens
atttaattttctcaacagtgctaccaggtgagtactcttttcccatacattttactgatgagaaaattgagt

SEQ ID NO: 6831874 - DNA, 61 bp, Homo sapiens
atgctggctagaatattttaaaactgtttttattgaaaagtacaaatgttctagccatcat

SEQ ID NO: 6831875 - DNA, 89 bp, Homo sapiens
gttaagaatctattcaggcagagtgcagcaggtaaatctctaagacaaataacagtgctgtctcctggcctgaatatcaatttcttgat

SEQ ID NO: 6831876 - DNA, 90 bp, Homo sapiens
tattctgcccagttttgtaaagtctgttctgagttgttattataaatacatttagtcatcttgaaatactttctagaataaggtgggata

SEQ ID NO: 6831877 - DNA, 56 bp, Homo sapiens
ctagatcagattgctgtttctaacagtgaacccattgggaaggtaagttggtttgg

SEQ ID NO: 6831878 - DNA, 86 bp, Homo sapiens
ctgacagctgcttgtcctgagggagaaataaaggaaactggtgaaacacatgctatttccatgaattcccactcatgtgctgttag

SEQ ID NO: 6831879 - DNA, 66 bp, Homo sapiens
gttaggctgctcacctccctgtctgcatcatccaacacgctgccgatgctggaggagtcgctgaac

SEQ ID NO: 6831880 - DNA, 57 bp, Homo sapiens
ctctggattgctgtgagatgctcatgaaataatgtctgtctcgtggttaatccagag

SEQ ID NO: 6831881 - DNA, 61 bp, Homo sapiens
acgtgtaaaatgttgtgtaccaggaagctcattagagactcagtgcttaacattttattgt

SEQ ID NO: 6831882 - DNA, 130 bp, Homo sapiens
ttttgtgagaagaagtaattatataccatatttaaaataagtgctattaacatctataagcacaagagaagttacgagtttgcaattttaaatgtggtaggcttaatgagaaaatgacatttgaacaaag

SEQ ID NO: 6831883 - DNA, 75 bp, Homo sapiens
tgatttagttctataagtagttgttgaagactttctatattgaaagttgtttctagacacttcagggagcttgca

SEQ ID NO: 6831884 - DNA, 62 bp, Homo sapiens
gctgtggcaatgtttataattaggacatagtaaacaacctaaattattttaaatgccacagt

SEQ ID NO: 6831885 - DNA, 78 bp, Homo sapiens
tgcccattctctctacttgttttcaacatagttctggaaaccttagagcaattgagcaagagaaagaaatgaaaggca

SEQ ID NO: 6831886 - DNA, 65 bp, Homo sapiens
ctggaactcaatgagaggctttggaaagtgattgtatcattcataaatgttctcactgaccccag

SEQ ID NO: 6831887 - DNA, 57 bp, Homo sapiens
cctttgtcttgggccaagcttgctcagcatgagtcattgcattgtttgaggcagagg

SEQ ID NO: 6831888 - DNA, 81 bp, Homo sapiens
ttctgctcatggactcacagatgtcctggcacttcctcaagggagcaagattctttccccaggggacaggacatttcagaa

SEQ ID NO: 6831889 - DNA, 93 bp, Homo sapiens
catctgccacttgtttggggagctcctactctatgccagacactgaaagtgctcagggacaatggagaggggcattctaagctgaggcaggtg

SEQ ID NO: 6831890 - DNA, 66 bp, Homo sapiens
atctttgttgctctcatttctgcttctgtagtgtttctattcttctgaactgcagagagcaaagat

SEQ ID NO: 6831891 - DNA, 70 bp, Homo sapiens
gctgatttatgtttgcattttgttccaggacagcagattatagcccaagttctgaggcaaaggcagcagc

SEQ ID NO: 6831892 - DNA, 130 bp, Homo sapiens
tcgggagtcatcgctgggctggggaaagtccaggtcctcattccatccttctttagccccagcctcgggatgggaaccagcagagggcctagactatccagaaaccccctgaccccagaagctccgttga

SEQ ID NO: 6831893 - DNA, 60 bp, Homo sapiens
gaagtctggctgacgagagttattccattcaaaaggcaggctttcttagaccaagacttt

SEQ ID NO: 6831894 - DNA, 56 bp, Homo sapiens
cagacctcagtcctcagtaggaagaggatggaaacgctatggggactggaggcctg

SEQ ID NO: 6831895 - DNA, 87 bp, Homo sapiens
tgatgcaggatctcacattccagattgttaatctggtaggatcagccatgtaaagccacaatttggacatgtgcaggataagtatta

SEQ ID NO: 6831896 - DNA, 64 bp, Homo sapiens
aggagcaagactcactgcatcttgcagttgtactgcagagctggcctgtgatttttgaactcct

SEQ ID NO: 6831897 - DNA, 68 bp, Homo sapiens
gagggccctactgagaagtcatcaatggttaaatttcagccttgggggcatattgagtagtggtcctc

SEQ ID NO: 6831898 - DNA, 115 bp, Homo sapiens
gttcaccatcccgctggatgttttcttttagtgattttgtcctgacaaacagcaagtgcagttctgcctccgtgttctccagagataatctaaaagaagaaaggggagagtgggc

SEQ ID NO: 6831899 - DNA, 71 bp, Homo sapiens
gaaggctagtttgtttcttggtcaagcctgatcttaacagatgagaccatggccatcctaggaaagccttc

SEQ ID NO: 6831900 - DNA, 64 bp, Homo sapiens
acctggtgggaatgtgttagcttttacttcttaatgcctgctttgtcatcagtatccactaggt

SEQ ID NO: 6831901 - DNA, 57 bp, Homo sapiens
acatttgaaattctgaacagatccctaaggggaatactgtttaacattttatggtgt

SEQ ID NO: 6831902 - DNA, 59 bp, Homo sapiens
cccccagagctcctgcactgtccttcccaacccttgggctcccagaggagctttggggg

SEQ ID NO: 6831903 - DNA, 75 bp, Homo sapiens
gcttcatggaggagttaggtgtgagtctagcaaagaccccagcccatgatactcagcctaactccccaatgtggc

SEQ ID NO: 6831904 - DNA, 99 bp, Homo sapiens
tttaatataaatgcatttgtctatgtctttaaactttttctaaaatatctatttcataggaatgggcaagacaaagaaactgatgtagattatcttaaa

SEQ ID NO: 6831905 - DNA, 59 bp, Homo sapiens
atgtctgtgggggagtcctttgactgaatcctgtggtcagagaggccccctgcagagat

SEQ ID NO: 6831906 - DNA, 99 bp, Homo sapiens
tctcttctctggttctctccttcctttgtttgcccatatcaggattataggccaaggacagtaaggacaggactgaacatgcttagagcaaacatggga

SEQ ID NO: 6831907 - DNA, 97 bp, Homo sapiens
tctggaggacccgaccgaatttgctttcgtgacagggtcaagcgccctttcctcgccggccgcagccctcaccaaaggggatttgggggcctccgga

SEQ ID NO: 6831908 - DNA, 58 bp, Homo sapiens
ctgtgaggcaatttttgatttatgtgacctagacacttatttcagaagagtctcagag

SEQ ID NO: 6831909 - DNA, 90 bp, Homo sapiens
cagcaagtgaataacacagctagtgagtggcagagctgggctttcaactcaggctctgggtcccacgtcattgctgtctatgctatgctg

SEQ ID NO: 6831910 - DNA, 76 bp, Homo sapiens
ttgcttgaacccgggaggcggaggttgcagtgagctgagatcgtgccactgcactccagcctgggtgatagagcga

SEQ ID NO: 6831911 - DNA, 80 bp, Homo sapiens
tagctgcatgacatttagcaaactgacttctctggactctattcctttaaaagtggtgtgttggaagaaatcatgtgttg

SEQ ID NO: 6831912 - DNA, 56 bp, Homo sapiens
cctgagggtgcatgtgtgcacgtatgcacatgtgtgtgtccattcgcactcttagg

SEQ ID NO: 6831913 - DNA, 83 bp, Homo sapiens
ccacgcagaccaccaagctggggactcagaccccatcggggttcacccactgtgctctggcctcagtttctctttctgtgtgg

SEQ ID NO: 6831914 - DNA, 85 bp, Homo sapiens
agtttttcacctggaaatggatccagatggtttaggaaaatttctattggatctgaaagtatctggatctttttggcaaagagct

SEQ ID NO: 6831915 - DNA, 67 bp, Homo sapiens
gtcaggaaatgctgtggagccgtggacagatctgatgtcatcctgtggggctccatgcatgccctgc

SEQ ID NO: 6831916 - DNA, 62 bp, Homo sapiens
aatgcccatctgttggttcacaaagaaggttcttttgatgcctccttctgaaacagggcatt

SEQ ID NO: 6831917 - DNA, 74 bp, Homo sapiens
gacctggatgaccaaggagcaagtttacacctgctgggctttcttcaggaattgagttctatgtgctccatgtc

SEQ ID NO: 6831918 - DNA, 70 bp, Homo sapiens
gtaggcactttctgggccctgggggcatagtcctgaatgagagaacatgtctctgccccagagagcttac

SEQ ID NO: 6831919 - DNA, 59 bp, Homo sapiens
gagtttccaaatccctgaagggctgcccatggttaaagcagatgggtttgtgacagctc

SEQ ID NO: 6831920 - DNA, 60 bp, Homo sapiens
gctgtattcaacagtgaaaagagagttcggttggatattatagtcggtgatggacacagc

SEQ ID NO: 6831921 - DNA, 67 bp, Homo sapiens
gtagtaagcattcaataagttccatcatttgttgaaagtggtgctgacagttctgagtgcaaactgc

SEQ ID NO: 6831922 - DNA, 59 bp, Homo sapiens
gcaggattgcacttcctcacttttttggcttagagtgggcctgagtgaccagttctagc

SEQ ID NO: 6831923 - DNA, 60 bp, Homo sapiens
ataggtcctgtgagattcatgctcaaagaggttctgttttgatgtgtttccaggatttgt

SEQ ID NO: 6831924 - DNA, 111 bp, Homo sapiens
taagtctcaaaataatcttatgacgaaggtgtcattaacctcatttctatagtagagtaactcaactaagagtacataggtaggaagtggcattcacaagatttgacctta

SEQ ID NO: 6831925 - DNA, 59 bp, Homo sapiens
caggggtctccattccagcaggcactgatgaaaagcctccaggagtgataaggccactg

SEQ ID NO: 6831926 - DNA, 105 bp, Homo sapiens
gcattactcatcttgttatgagtacctgttccgataaagttcaactgaaaataagagacagaaaatgaacaaatgaatcagtgtagctcaaacaagataaaatgc

SEQ ID NO: 6831927 - DNA, 84 bp, Homo sapiens
tcatggaaaggaacacttgccttgggagccagcatgccagtcttccctgcaacagctgaccttccccagggaccttctccgtga

SEQ ID NO: 6831928 - DNA, 56 bp, Homo sapiens
gccgcgctcgaggccgccgggcgcctcgctcttctctatggtggctcgggcgcggc

SEQ ID NO: 6831929 - DNA, 63 bp, Homo sapiens
gggggtgcaggagccacttcagggatgcagcaggagctgcccggtgactgtctcctgcctgcc

SEQ ID NO: 6831930 - DNA, 78 bp, Homo sapiens
tgcacctgctggggctgatgagatgaacccatctggcatattctggttcacaattcttcccagtgccatgctgtagca

SEQ ID NO: 6831931 - DNA, 81 bp, Homo sapiens
gtgtttctatgtttaaaatgaggatattctgtcttgaacatcagtgaatgatgaataatctgttgactaacttgggagcat

SEQ ID NO: 6831932 - DNA, 110 bp, Homo sapiens
gtttttcttctttatagtaggcctgacagaaacatactgaagcaatctgggagacaacctgtgatagatcctatgctaaatgttaatgttacctctgttgatttaaaaac

SEQ ID NO: 6831933 - DNA, 69 bp, Homo sapiens
gctgtctttggttcaggcaaggagcgcaaatctgagactgcagtgttccttgtggaaactatggacggc

SEQ ID NO: 6831934 - DNA, 62 bp, Homo sapiens
ggctcctgtctgtatccctgttggtaacactgcgtacaccagtgggatggggactttgggcc

SEQ ID NO: 6831935 - DNA, 130 bp, Homo sapiens
agggctgggaagcacctccctgagatgcaggctcccaccctcctgcagctgcagtacctgatgagcaggatggcagtgtcatgctgcagggggtgggcgtctcccttcatgttgatgcttttctgccact

SEQ ID NO: 6831936 - DNA, 117 bp, Homo sapiens
ttttcatttcgctacctgaaagtcagggctggctcatgaaaagttgttaaacaacagctaaatgtgaaatgtcaaccctccctctaaactttccctgttctgagcatcaaatgaaga

SEQ ID NO: 6831937 - DNA, 60 bp, Homo sapiens
accaccccattgtatcctatagcacagttgaactggtttaaaagccatgcatggggaggt

SEQ ID NO: 6831938 - DNA, 74 bp, Homo sapiens
tgttaataggaatcagaattaggatttgaagccaggaccgcctgatttttttcaaaattctgtttcctacaaca

SEQ ID NO: 6831939 - DNA, 75 bp, Homo sapiens
atgtgattgtccttttccttatctgtgtctccaactactggactatacacagtgtcagggcaggggccagtccat

SEQ ID NO: 6831940 - DNA, 60 bp, Homo sapiens
tgctatgtgactgcttcagattgccatgcggttttaaatctggacacagttctcatgcca

SEQ ID NO: 6831941 - DNA, 63 bp, Homo sapiens
agaatgattatttctcagagtagactccctagtttggcttctggcttgagaggtaattatttt

SEQ ID NO: 6831942 - DNA, 95 bp, Homo sapiens
tgcctgtggggccacctagattctctgctggctgacatggacacatttccaatggacagtgtgaagcagatagagcagagtgtggattacaggca

SEQ ID NO: 6831943 - DNA, 75 bp, Homo sapiens
ggaggcggaggttgcagtaagccgagattgcgctattgaactccagcctgggcgacagagcaagactccgtctcc

SEQ ID NO: 6831944 - DNA, 126 bp, Homo sapiens
tggaattaaattgaatgcaatgaattgagtgaagagggatgataaagtgtgaggaaccctgctcaacaccttccttttagtatcctatctcatttaatccatttaatcatttaataatttaatcta

SEQ ID NO: 6831945 - DNA, 124 bp, Homo sapiens
ggtcttaaaatatttgagaatccggtccgtacaaactctgctgtgttgaatgattggtgagtttgtttgctcattgattgaatcactgcagagtttgtacggaccggattctccaatataggcc

SEQ ID NO: 6831946 - DNA, 66 bp, Homo sapiens
gcccgagcacagaactaaatgctggtagtgagagtcgacctctctcatcagggttctgtgatgggt

SEQ ID NO: 6831947 - DNA, 67 bp, Homo sapiens
aggatgtttgctctgctctgcatttcagaacatttaatctgaaattcacagttgagtcattcatcct

SEQ ID NO: 6831948 - DNA, 85 bp, Homo sapiens
actggctgtttctcacctaattctgaagtggttgtgggctgtgagatcagggagtccattttagaggtggaaaacgagatccagt

SEQ ID NO: 6831949 - DNA, 64 bp, Homo sapiens
tacacagatatgtgatcaatcacattatttctttgtctttcagtgattggtcactgcatgtgtg

SEQ ID NO: 6831950 - DNA, 61 bp, Homo sapiens
aagcaatgcatttggaagtattgaagcagggacccttgtaagagctacacaaatgctgctt

SEQ ID NO: 6831951 - DNA, 130 bp, Homo sapiens
taccaaaactgtaaactgcccagtatgttagaggacttgaaagggtgaacaacttctcatattatcttctcaattcaaaaggtgtcactgtttctggccttcatactgtaagaatcatagagtcaaggta

SEQ ID NO: 6831952 - DNA, 96 bp, Homo sapiens
gagaaacattaagttctctgtgtaaaaataacgctatctctttaggagatgctttcctgatatttatgcataaatgagtagaactttcactttctt

SEQ ID NO: 6831953 - DNA, 87 bp, Homo sapiens
aacaagccaaccccatacctttctcaagcacatgtgcacattgacacatgtcaattgcagacaggccttgtggggtttccatttgtt

SEQ ID NO: 6831954 - DNA, 64 bp, Homo sapiens
gctctgccatcttctctggggatgttggcttgttcttaactcctcaaatatggggtggtagagt

SEQ ID NO: 6831955 - DNA, 58 bp, Homo sapiens
ttgatggcactggaactcaaatccaggtcttcctggttccagagtctgtgttcatcag

SEQ ID NO: 6831956 - DNA, 83 bp, Homo sapiens
tgctggtagaagagaatctggggctgactggtgacgattattcactgtcttaattgttggaaatagattattttctacctgca

SEQ ID NO: 6831957 - DNA, 57 bp, Homo sapiens
attccacatgctcttgttacagtgttgcatcaacatgcctccattgagctgtggggt

SEQ ID NO: 6831958 - DNA, 60 bp, Homo sapiens
ctgcccccaccatagttcagaccacgtaaactacttcactggatctaaaggtggatgtag

SEQ ID NO: 6831959 - DNA, 78 bp, Homo sapiens
gctcctggtgatctctggctctgcttgtacttcatactgaatgaaccacttgcatcttagagactcacctaaaagagc

SEQ ID NO: 6831960 - DNA, 58 bp, Homo sapiens
ccttttatgaacttgagcaggtttcaatgacctgaatttccacgacaagttcaaaagg

SEQ ID NO: 6831961 - DNA, 59 bp, Homo sapiens
tggtcagagctgtgcaaggctgagggtgtgattaaactttcagcagagaggcctggcca

SEQ ID NO: 6831962 - DNA, 78 bp, Homo sapiens
tgcaattttgcctgttatttgttatttttggaatatatgttctatttttacttcctagaataagtaacaggacatgta

SEQ ID NO: 6831963 - DNA, 69 bp, Homo sapiens
ttgtgttatatagttctgtgggttttgtcaatgcacagtgtcacatatccacattacagtatcatacaa

SEQ ID NO: 6831964 - DNA, 61 bp, Homo sapiens
gggcaggatgcagtttcagagaagagcaattacacaggttcttaatggaggcatctggccc

SEQ ID NO: 6831965 - DNA, 102 bp, Homo sapiens
ggtgatgctgcccagagtggtggtcgggtagtgctggaaggatttgaaaacccaaagattatcttcacatgcttgtagaacagatttgaggccagtgtagcc

SEQ ID NO: 6831966 - DNA, 64 bp, Homo sapiens
tggagatttcactttctggatgtgcatgttgaattagctgcacgaacctggaatgaaaactcta

SEQ ID NO: 6831967 - DNA, 79 bp, Homo sapiens
aatgtccaagtcacagattttcagcagacaggagaataaaatccatgccaatgatggaaacttgggaacttggcacatt

SEQ ID NO: 6831968 - DNA, 57 bp, Homo sapiens
ggtctgtgacctcagtgtctcagaacctttgttattatgcaccctgaggtcatggcc

SEQ ID NO: 6831969 - DNA, 70 bp, Homo sapiens
ccatctgcatgtgaatttccatttccaaaagtcgtcagcaatagtaaatgcctagaaatcacgcagatgg

SEQ ID NO: 6831970 - DNA, 100 bp, Homo sapiens
accatttgatcggggaggtctgagctccttcctctgaacgctgtgtcttcaggccttgtgtattcagaggagggactcagacccaggattgggcaggggt

SEQ ID NO: 6831971 - DNA, 95 bp, Homo sapiens
gaagttattttagctgaagaagaaaatgagttaagatggtttaaagagaaaaaaagtacaccagtccttactcatttttcatttagtgatacttt

SEQ ID NO: 6831972 - DNA, 55 bp, Homo sapiens
aaattctcttcagaggaaccaggtgggtatctgaacttcctttgaagtaggattt

SEQ ID NO: 6831973 - DNA, 95 bp, Homo sapiens
ttcctttttttccattatcagtcacagtatgtcctgggctgggttatgttgtaatttaactaactctagctagaggattagtggctaagaaggga

SEQ ID NO: 6831974 - DNA, 102 bp, Homo sapiens
tgagacaggagaatcgcttgaacctgggaggtagaggttgcggtgagccaagattgtgccattgcactctagcctgggtgacaagagcgaaactctgtctca

SEQ ID NO: 6831975 - DNA, 88 bp, Homo sapiens
gccgcccgccgccatcttggtagggtacagtgtcgccagcccgtccccgcggccaccatcttggcaaaggttcgcgatcgcgggtagc

SEQ ID NO: 6831976 - DNA, 77 bp, Homo sapiens
attgagtatacacgtacttgtgaaacctgcatctgttcataaagcacctgcctgtgtcacagtgatgtttgctgagt

SEQ ID NO: 6831977 - DNA, 90 bp, Homo sapiens
cagggtaaaaagttggaagacaagaaatcaattgttggcgaataatgtcaatgttaatttactgtcttcattttttaaatcactactttg

SEQ ID NO: 6831978 - DNA, 63 bp, Homo sapiens
gcgcgcgtcccccttccccactgcccatggccccgtcggggttgggtggaagcgggaggccgc

SEQ ID NO: 6831979 - DNA, 65 bp, Homo sapiens
caagaaaagtactcttgcagaaacatcaggaagttcaccatgaactgcaagacatgctgttcttg

SEQ ID NO: 6831980 - DNA, 58 bp, Homo sapiens
gccagctggctgcaggtcccaggggaggcggccttgggagctctggagtgggttgtgc

SEQ ID NO: 6831981 - DNA, 68 bp, Homo sapiens
tactagaatctctggggtaagtctatagggcaccagtagtttccagaggtccccagatgattccagta

SEQ ID NO: 6831982 - DNA, 82 bp, Homo sapiens
cactgtgattatctactggcttgactctctcccgtctagactctaagctcctagagagaagggcctgtatgtaatcaccctg

SEQ ID NO: 6831983 - DNA, 84 bp, Homo sapiens
agtctcgctctctcacccaggctggagtgcagtggggtgatctcggctcactgcaatctccacctgctgggttcaagcgattct

SEQ ID NO: 6831984 - DNA, 77 bp, Homo sapiens
catgtcttatttatgcttcttactccccatgatgaagaaaaccagctccgaggggtgaggacattggtcaggacatg

SEQ ID NO: 6831985 - DNA, 74 bp, Homo sapiens
ggtgtgaaggcacacaggctggctgagccctgaccccagtgccaagctatcccagcctctgtggctgccacacc

SEQ ID NO: 6831986 - DNA, 57 bp, Homo sapiens
taaagctgcaggctcagaaaacacttgtatccccggatgctctggtttgtttcttta

SEQ ID NO: 6831987 - DNA, 90 bp, Homo sapiens
tgagtacatgtactgggatctgtgttctaggaagacaccatatctcttgggctttggtagacacagattgattaggtgccatgtatctca

SEQ ID NO: 6831988 - DNA, 57 bp, Homo sapiens
tctgactgtgtgcacgctcacactcctgtacgtgtgacgctcagtgtgacagtgagg

SEQ ID NO: 6831989 - DNA, 65 bp, Homo sapiens
atgggaaatggtccatttgatggttttattgataactaaaccatttgaaggaatcattgactcat

SEQ ID NO: 6831990 - DNA, 71 bp, Homo sapiens
agactgtattccaaaggttaatgcccattaatccgaagggagtggtgagtaaattccttatatatcagtct

SEQ ID NO: 6831991 - DNA, 63 bp, Homo sapiens
ccaggaatgctggccaatacagaaacatcataaacattttccttgtatttcatgcattcctgg

SEQ ID NO: 6831992 - DNA, 70 bp, Homo sapiens
attattttggctctgtctgtatctttgctctattcctatttgagcaaagacagagagaagccagaacaat

SEQ ID NO: 6831993 - DNA, 66 bp, Homo sapiens
tgcttcctagcaatcttcagccgcccagccagcaaagagggctgagcgcatggttgctggggagca

SEQ ID NO: 6831994 - DNA, 57 bp, Homo sapiens
gccagagtaaccctttcctcttaggagagcagggagctatttcagggttattttggt

SEQ ID NO: 6831995 - DNA, 81 bp, Homo sapiens
atctctgaaagaagaaatagtctatctgaacgtaactcaaattaggtataagaagattatttataatagctctcaagagat

SEQ ID NO: 6831996 - DNA, 84 bp, Homo sapiens
gcttggcgagccctgaagaaaggtgtgggatactccaggcaacctcgtggagtactctactccttccttctggaagctggaagt

SEQ ID NO: 6831997 - DNA, 55 bp, Homo sapiens
ggcagagtgtgagggtcctgctcagccagtaagagtttgactcaggcctttagcc

SEQ ID NO: 6831998 - DNA, 58 bp, Homo sapiens
aggtaattgcgtcttcatggaggtgtcatttgaggggaggactgaagatgcaagacct

SEQ ID NO: 6831999 - DNA, 62 bp, Homo sapiens
cttaaagcactaaatgatgagggggtggtgacagtggtaacctttatgatagatgctttcag

SEQ ID NO: 6832000 - DNA, 89 bp, Homo sapiens
tccatgtaaggttcaagaacatttcagcaaataagaacagcattttcattctgtttcttttgagtttctgaatgatctgaacatatgga

SEQ ID NO: 6832001 - DNA, 57 bp, Homo sapiens
agattaggctacacctggaaaagccttccaagaaggcctcctggtctaggctagact

SEQ ID NO: 6832002 - DNA, 96 bp, Homo sapiens
cttgagtacagaagtgaaagtggggagagtattttattcaagtcacagcagaactggaaaaaaactcttctgttttaccaacttcttgtgtttcag

SEQ ID NO: 6832003 - DNA, 57 bp, Homo sapiens
ctcaagtttcatatttgtctaggaagcccttctcgcctcccaggcttgaaatatgag

SEQ ID NO: 6832004 - DNA, 71 bp, Homo sapiens
gagctgctcagggctttctgattcgtggctgtggcacgggtagctttggcctcgtttagaaatggcagttt

SEQ ID NO: 6832005 - DNA, 73 bp, Homo sapiens
cacctgtaatcccagctactcgggaggctgaggcaggagaattgcttgatcctgggaggcggaggttgcagtg

SEQ ID NO: 6832006 - DNA, 94 bp, Homo sapiens
gagttgatgctctgtgattatgctaatgaccaaaagaatcgatgatgcgagactagatgaaatcagtggtataatcggggaaagttatcagttt

SEQ ID NO: 6832007 - DNA, 72 bp, Homo sapiens
gaattttagaattcttcaaggtcaaagaagtgtaactgcttctcaatatgtgcccgaagtattttaaaattc

SEQ ID NO: 6832008 - DNA, 66 bp, Homo sapiens
gcagctgggacatgatagaaacagattctgcacttaagaattctacttttagaatgtccatgatgc

SEQ ID NO: 6832009 - DNA, 78 bp, Homo sapiens
gctgagtccttgtatcacagagctactggagctgaacatcagttaactccacgtgacctttgtggtggagacaacagc

SEQ ID NO: 6832010 - DNA, 80 bp, Homo sapiens
cccacattcagtttcaaatcctgtgaagttttagcactttaactccacaaaatacacagggagagattggaaacttaggg

SEQ ID NO: 6832011 - DNA, 63 bp, Homo sapiens
acttgtgaagtaccattcaaatgcaaatagttactatcatcattaagagtggtcttcatgggt

SEQ ID NO: 6832012 - DNA, 68 bp, Homo sapiens
ctgcgtgggaaggggaagagaccgcagagtcagggaccccctgcctcctctccttccccatccctcag

SEQ ID NO: 6832013 - DNA, 75 bp, Homo sapiens
gtaagtcctcagatcatctttaaatggcagcaggcatttccacctacatgctggccttgtgtctgaggaagttat

SEQ ID NO: 6832014 - DNA, 68 bp, Homo sapiens
ggggcttttgacagctgagccccaggcaagcacgacactcggcctcctggtaattagcgaaaggccct

SEQ ID NO: 6832015 - DNA, 95 bp, Homo sapiens
gctttgagtgcacccagcagggggcatccttgcccttccactgcccaccctggaggggtgagactggcccactgcagggttgccctctacccagc

SEQ ID NO: 6832016 - DNA, 64 bp, Homo sapiens
agcacacataacactcttctctagtgagcagtctctggtgctgactgagtatatgtttggtgct

SEQ ID NO: 6832017 - DNA, 77 bp, Homo sapiens
ctacggatatctgacagaagccttcggtggttgtcggcctaatgagcggacggcaaagaacgctttttcagacgtgg

SEQ ID NO: 6832018 - DNA, 77 bp, Homo sapiens
aatctgcccggaggagccttccagactgcccacactaggccaggtgtgggaggtctggaaggctccccaggcagatt

SEQ ID NO: 6832019 - DNA, 79 bp, Homo sapiens
gcccagcactgcctgagccaccggcagggacatctgagttagatgacttgcagctggctggctttcagcaggagaaggc

SEQ ID NO: 6832020 - DNA, 67 bp, Homo sapiens
tcagtatggagaagacatgattggggattaattaaggtacttgttatcatcttttccttataactga

SEQ ID NO: 6832021 - DNA, 60 bp, Homo sapiens
gcctgtttccctgacgcttacacaagctaaggcaaggtgaagcagcagcagggagaaggc

SEQ ID NO: 6832022 - DNA, 61 bp, Homo sapiens
cctggcacatgtgagccacatcatcaacatttcctggatgagggcattattctgggccagg

SEQ ID NO: 6832023 - DNA, 83 bp, Homo sapiens
cagttatcatttgaagccactgttttggagtgctttgttatgcagcagtagttacccagaacactggaagtaagggatggctg

SEQ ID NO: 6832024 - DNA, 59 bp, Homo sapiens
agtatgagctgctagatgatttatgaccaaaggtcaaatcagcaagcagcttcccagct

SEQ ID NO: 6832025 - DNA, 56 bp, Homo sapiens
atgcacagaacaattttaagagtggtactgaactgttcttcaggttgtttgtgcat

SEQ ID NO: 6832026 - DNA, 66 bp, Homo sapiens
ctgaaaatcagaggaagcatcaagttctcagaaaaccttcggggcaacttaactgtttcttagcag

SEQ ID NO: 6832027 - DNA, 66 bp, Homo sapiens
cttgactaattacactgagcagttgtctgttgctacaacttctgccaaacagctgttattgttggg

SEQ ID NO: 6832028 - DNA, 56 bp, Homo sapiens
gagctggtcgaaatgggctgactacatgacaggtagagcgccttttcaacaagctt

SEQ ID NO: 6832029 - DNA, 59 bp, Homo sapiens
ggaaagtccagggaaagagcgtcttttaattcagaaaggaggccttgctggaattttcc

SEQ ID NO: 6832030 - DNA, 55 bp, Homo sapiens
taccagggaccgccacactgcaattatcattgcagcccgggttggtttgtgtgtg

SEQ ID NO: 6832031 - DNA, 80 bp, Homo sapiens
ggacccttgaaaggtctgttgagtgaatagtaaatgttgctgcatttcttttacttttacaggtttcctttggggagtct

SEQ ID NO: 6832032 - DNA, 126 bp, Homo sapiens
atcagactcacctggggacttgttaaatacagattgttgggtctcactcctagagtttcttcttcagtattctagggagcagcctgtgaatctgtatttccagcatgattttcaggtgctattgat

SEQ ID NO: 6832033 - DNA, 56 bp, Homo sapiens
cctagttatttggtacctggccctggggtgattagggcagggaaatagtagcttgg

SEQ ID NO: 6832034 - DNA, 62 bp, Homo sapiens
gccaaatggctaagtatgccctggggcagagagaagcctctggggcagctgagtcatgaggc

SEQ ID NO: 6832035 - DNA, 76 bp, Homo sapiens
gtgccattctgcagcctcactagtttcagtataattttttaaatcacatgccattattgagggtgtagattggtgt

SEQ ID NO: 6832036 - DNA, 55 bp, Homo sapiens
ctgtgccttagtattctcatttttgcaatataaaattaggatattaagagtacag

SEQ ID NO: 6832037 - DNA, 84 bp, Homo sapiens
ggagttgattcaaaggggacaagtggggcctccattcattctgacctgatcttcactctgtcccccattgagatcaagtgcttc

SEQ ID NO: 6832038 - DNA, 55 bp, Homo sapiens
ggacagtacaaaaagtgtctaagtttttgccttgtttgcgctggctgtcctgtcc

SEQ ID NO: 6832039 - DNA, 71 bp, Homo sapiens
cttaggaatgcgtttcctgggtcccagttataatttaaaacccatggatcactaggcagcgagtgactgag

SEQ ID NO: 6832040 - DNA, 76 bp, Homo sapiens
tgtttacctttgaactagcatttctgggccatggtgaaaaattacacatgagcattttggtctagtttaagagaca

SEQ ID NO: 6832041 - DNA, 84 bp, Homo sapiens
tcctgccagccacatttctcattgccatctggctcttccttaggcagtgccaacggggcaggagagggtgactgcatggccgga

SEQ ID NO: 6832042 - DNA, 68 bp, Homo sapiens
tctgaaagtcctgtttgaaggacctgcctagaacttgcaggtgagggtctggacacagggctgtcaga

SEQ ID NO: 6832043 - DNA, 85 bp, Homo sapiens
cctccagtgtgtgctctcgtgtggtttcaagtaggggctactttcatgcccattttgtaaatacagaagctgagacactgagagg

SEQ ID NO: 6832044 - DNA, 76 bp, Homo sapiens
accttgtttccccgtgaggctccgatcgctgggccaggtcctccagctcctcctgagtgtctgggagggacgaagt

SEQ ID NO: 6832045 - DNA, 96 bp, Homo sapiens
tgtgttgatatgagtgccaatgacagaaaagtgtatagtttgtgagaagtcattaagatttgtgcatttctctgagtgtgtgtcatatttaataca

SEQ ID NO: 6832046 - DNA, 71 bp, Homo sapiens
acttttcatgtatttcccaaagcttttaacagtaaacatgattgggttgggggaaatgcctggattcaagt

SEQ ID NO: 6832047 - DNA, 57 bp, Homo sapiens
gggaggagggtgctggctaaacaggaactgaatgaatggcctgaagctccctctccc

SEQ ID NO: 6832048 - DNA, 114 bp, Homo sapiens
ctgtttaaaatggcccccatgtgtaggactgaagtgctgtctagtgttcctaagcacaggaaggctggatgtgcctcaccgagaaaatacgtgtagtcaataagttttgttcag

SEQ ID NO: 6832049 - DNA, 101 bp, Homo sapiens
cttccctccccggcggaggcccctgcggactgcctagagctgggtcgcaactgaggcgttatccgcgggcctggcctcgggaagtggcggggaggaagaag

SEQ ID NO: 6832050 - DNA, 92 bp, Homo sapiens
aggagagtcttgctctattgcccaggctggagtgcagtagcacaatcttggctgactacaacctccacctcccgggttcaagcaattgtcct

SEQ ID NO: 6832051 - DNA, 57 bp, Homo sapiens
gagatagagttggcacagtcctgctttgagacagggcaatggatgtgatgactcctc

SEQ ID NO: 6832052 - DNA, 73 bp, Homo sapiens
atgataccagggcagcagaattggggcacattagagacacaggctctgcccacattctgaagctccctgtcat

SEQ ID NO: 6832053 - DNA, 65 bp, Homo sapiens
tctaacttgtaaacatctgttgcttagacttcttagtctttgcagttgatgttttgcattttaga

SEQ ID NO: 6832054 - DNA, 61 bp, Homo sapiens
gcatagacgtctaccaagggcagttcttacctaaaagggagagctgtttggacatctgagt

SEQ ID NO: 6832055 - DNA, 57 bp, Homo sapiens
actgctttgtcttatattgatgaaattttcagatgtcaaaaagctgggacaagcagt

SEQ ID NO: 6832056 - DNA, 80 bp, Homo sapiens
ctgcagacatgggagtgttcagaacaaaggtaaatgaggtggtcctcacagacccttgctgagctcttatcccgtgccag

SEQ ID NO: 6832057 - DNA, 58 bp, Homo sapiens
gcctgaggcatctgggcacagaagtggtcaacagcacacacgtcccatggtgccaggc

SEQ ID NO: 6832058 - DNA, 71 bp, Homo sapiens
gtgatcaagtgattctccctacgcgggagctccctctcccagctcccaagtagatgggaatacaggtgcgc

SEQ ID NO: 6832059 - DNA, 130 bp, Homo sapiens
cagagcttaggaaagaatgggaggcttggagttctctgtcatgcatcaatttctctttaggacattttctcttacagagaatgtataatagtcatgaataacaggaaaatgctgtagtctgaaagctctg

SEQ ID NO: 6832060 - DNA, 97 bp, Homo sapiens
attaaactaagagatctgtgacagtacagacatatataaatatagtaaatgtcttgatattttactgtttggaaaacacagagcatattagtttgat

SEQ ID NO: 6832061 - DNA, 79 bp, Homo sapiens
atgaggaagatatcaggagagaaagaatacaattagtttgctaatgtgtaaaaggttttcttcaggaattcttactcat

SEQ ID NO: 6832062 - DNA, 81 bp, Homo sapiens
ggaaggcagcctccctaatgcagaagaaaccatggcttctttgggggcctgattctttggtgtcacttagggagttgttcc

SEQ ID NO: 6832063 - DNA, 87 bp, Homo sapiens
gggaaagtgaagcctggaggagctggacgcggggaggccggggcaggaggggcttctctggctcctgccgggtccacacggtcagcc

SEQ ID NO: 6832064 - DNA, 63 bp, Homo sapiens
ttacatgttctcatacacagagtactgtataacgtgagtctgcctgtgtgtacatgcatgtaa

SEQ ID NO: 6832065 - DNA, 78 bp, Homo sapiens
tattaaaaaatcagtaaagtaccaaagtgtgagtatgatttcatacacaccctgaaggctattgctcattaactagtg

SEQ ID NO: 6832066 - DNA, 77 bp, Homo sapiens
gcagctgcatggcttgtgagggtttgaacccgcatgggtgggtctaggtcaaagctcatagtgccatgctcagctgc

SEQ ID NO: 6832067 - DNA, 81 bp, Homo sapiens
ttttgtttgggacttgtggatgcagtgtattaggatggaggcgggattttcttaatgcttaattttcacaagcctccaaaa

SEQ ID NO: 6832068 - DNA, 56 bp, Homo sapiens
ggtttctatgtaggattttggtaactgaatcggtttcctcatctagcacagaaatt

SEQ ID NO: 6832069 - DNA, 64 bp, Homo sapiens
aaagcagccacagagagagcgttagataaaaggaccatgatttttactctgtttgcgctgcttt

SEQ ID NO: 6832070 - DNA, 77 bp, Homo sapiens
taggcggtccttattgttactcctccgcctttatagttgtggaaactgaggctcagaagtgccaagtgacctgccta

SEQ ID NO: 6832071 - DNA, 82 bp, Homo sapiens
gtctttgctattgtgaatagtgctgcagtaaacatacatgtgcgtgtgtctttatagcagcatgatttataatcctttgggc

SEQ ID NO: 6832072 - DNA, 82 bp, Homo sapiens
gtctttgctattgtgaatagtgctgcaataaacatacatgtgcatgtgtctttatagcagcatgatttataatcctttgggc

SEQ ID NO: 6832073 - DNA, 123 bp, Homo sapiens
gccagcggggcgaacgtacctgcctgagcttcaagagatgtggcgggctggtggacttgtgggcttgtgagctacaagcatctatgtttcaagctgcggagctctgtgcctgtcctgctgcgc

SEQ ID NO: 6832074 - DNA, 62 bp, Homo sapiens
gtgtgcatgtgcttgcacagatgtatctttgtccacatgtgtctgtgcgtctgcgtgtgtgc

SEQ ID NO: 6832075 - DNA, 84 bp, Homo sapiens
gcacaatgtagcatttgactaaggaaacaacttgtatttttcccccctcttctttagggaattgctttgttttcttgtattggc

SEQ ID NO: 6832076 - DNA, 81 bp, Homo sapiens
gggtccaggcatctgtattttttaagttcccccagataatgctaatagacatctaggattgaggactgctatcctggaccc

SEQ ID NO: 6832077 - DNA, 67 bp, Homo sapiens
cccaggcctggctgcagctcgcctttcacacccagatgtaggagcgggcgcgggagccctgcctggg

SEQ ID NO: 6832078 - DNA, 59 bp, Homo sapiens
agcaggcgtggactggactgtgactctctgcttacttatcatctggtctggggcctgct

SEQ ID NO: 6832079 - DNA, 81 bp, Homo sapiens
gtcagcaggggccgttgggtggaggaagccggcaggatgcaggcgtccctccatctcagctgcccgttgtgtagaactggc

SEQ ID NO: 6832080 - DNA, 79 bp, Homo sapiens
cttccagggagtcaacaaacagatcaactaaggacaatttacagatgatttgttttctgcactctcctctcctggtaag

SEQ ID NO: 6832081 - DNA, 80 bp, Homo sapiens
gtaactggtccccatggggttcagatttgtgatcttggcctcattatcacacttttgtaaccatcagacctaatagatac

SEQ ID NO: 6832082 - DNA, 84 bp, Homo sapiens
ctcattccatttctgtattaggtctgatttagtagcaagttataggaaccaagacaaaccagcttaagcaagatgagaactgag

SEQ ID NO: 6832083 - DNA, 60 bp, Homo sapiens
ggaaattgatctgagctcaccttcgaacattatgaagaccgtgaagtctaatcaggttcc

SEQ ID NO: 6832084 - DNA, 65 bp, Homo sapiens
gaccaggtacatggagaagaacagcccaaagaggaagggctgcaattctggtttatctgaaagtc

SEQ ID NO: 6832085 - DNA, 60 bp, Homo sapiens
tcagttgcatgggaagttcagacaaatttgccaactgaaactcacccccaaagtagctga

SEQ ID NO: 6832086 - DNA, 80 bp, Homo sapiens
gcaggtttaagtgtagtgctaagggcagcctaactagattaactactgagttattgtccaggcacatattttaaaattgt

SEQ ID NO: 6832087 - DNA, 130 bp, Homo sapiens
aacccagatttcctcactcccagcccagtgctttccccccgtgctacattcattctttaatcatccattgacaggatggattctgtatgtgggatggaaggtaatcacacacagtgtggcttcagaggct

SEQ ID NO: 6832088 - DNA, 60 bp, Homo sapiens
tgtaacagagcttttttatagcagcacacttgtagcagctgttgagtggttttacttaca

SEQ ID NO: 6832089 - DNA, 56 bp, Homo sapiens
ggtgagagttatgattccaattgaggtagttaagccacagagtccgtgacttcacc

SEQ ID NO: 6832090 - DNA, 77 bp, Homo sapiens
gagtggcaggcatccggcaccttctaccccctgtttccaccagcctttaggaagagaggactggggtgcttgccctc

SEQ ID NO: 6832091 - DNA, 66 bp, Homo sapiens
ctccccgtgtgtgcgaggctcccgcctgcgtgtgtgcgtgtgcatgtgtgcctgcgcacaggggag

SEQ ID NO: 6832092 - DNA, 69 bp, Homo sapiens
gggagctggtgctcggggagctggcgtgccgggcacccatgtctgcctgttctccagcatccaggtctc

SEQ ID NO: 6832093 - DNA, 57 bp, Homo sapiens
gtgtgtatacatacatatatttacatgaactatatgtatatgtgtgtgtatttacat

SEQ ID NO: 6832094 - DNA, 88 bp, Homo sapiens
ggagaatcacttgaacccaggaggcagagattgcagtgagccgagattgtgccactgcactctagcctaggtgacagagtgagactcc

SEQ ID NO: 6832095 - DNA, 61 bp, Homo sapiens
aaggacctgcctgagcctcagtggccaagtgtcttcacccctgtagcccaggacaggcttt

SEQ ID NO: 6832096 - DNA, 93 bp, Homo sapiens
ggacccatgctgtcttggtcatgctatgtctcagctgcagaagtgacctggtgctagaaatctgaaactagcattccaccgggatgacaatcc

SEQ ID NO: 6832097 - DNA, 98 bp, Homo sapiens
cttggtcatgatgttctgccctggaaaacgtatcttatctgagcagaagctactgagttagttagtccaggtgcagggcaagcatggaaaagtccaag

SEQ ID NO: 6832098 - DNA, 74 bp, Homo sapiens
gggtgcctgccaggacattgcttgaagtagtctgccacaaacaagacttttcagtgaagtctcaggtttcaccc

SEQ ID NO: 6832099 - DNA, 104 bp, Homo sapiens
tcttgcttgctggggaaagagatgataaattgttggtactttagggactgctgtttgaaccaccctgaggcagcaattgattattcaggcctaaggaaacaaga

SEQ ID NO: 6832100 - DNA, 57 bp, Homo sapiens
tggcagaaagagaatatttatggaattctagaagcctgagtatttgaatttctgtca

SEQ ID NO: 6832101 - DNA, 76 bp, Homo sapiens
catgtttcagattttcggaaggtaacttggcgcatatgccccatcctgtgttactcttccccggggtctggggctg

SEQ ID NO: 6832102 - DNA, 95 bp, Homo sapiens
ttcaccttctctgctacatactagggctttaataaaatgttacttgaatctggatccccacaaagtatgagcctcatgaagagaaacaagatgag

SEQ ID NO: 6832103 - DNA, 123 bp, Homo sapiens
agcaagagacaggcactttaaagtggccagatgctatgtgagtgctccaggtgaggacattctattctagcacctgagattttcacaatcactgtgtatatgcttttaaaccctaatcttgtt

SEQ ID NO: 6832104 - DNA, 67 bp, Homo sapiens
gatttcatagttaatctttttcacacaaacaagaagttgagtgaagcaggcattgactgatgaagtc

SEQ ID NO: 6832105 - DNA, 63 bp, Homo sapiens
gagcatctctttgatggctcctgtgagctgacagcagctatggagtcactgaaaagggaaatc

SEQ ID NO: 6832106 - DNA, 88 bp, Homo sapiens
gcctgtcatcttggagtttggctctgggtgcctgtgcagcccctgggtgagcgcggtgcccccaagaggccagggtccctggcggtgt

SEQ ID NO: 6832107 - DNA, 75 bp, Homo sapiens
agctttacactttcgtttgtggattagattcaagcacagtttatcccttcatgcagatgagaatgtcagacagct

SEQ ID NO: 6832108 - DNA, 70 bp, Homo sapiens
tcctttattcacagttgatttacagttgtcttaggaattgacaactgtgagatatacttgacctaaggga

SEQ ID NO: 6832109 - DNA, 72 bp, Homo sapiens
gctattcaggaaagagtgtatccatcaatccatgtaatgtgacgtgatgagtttactcttttctaaagtggt

SEQ ID NO: 6832110 - DNA, 57 bp, Homo sapiens
agggtgtcctaattcatttcatttgtttggataagtacagatggctaggatcaccct

SEQ ID NO: 6832111 - DNA, 65 bp, Homo sapiens
ttcagtggtctaggcaatatataaggatggtttctgataccttggtgatgacagagatggctgga

SEQ ID NO: 6832112 - DNA, 68 bp, Homo sapiens
atgttctttctgttgggtagcacatggccccacagtgctacacaattctatcagaaagcagaaaacat

SEQ ID NO: 6832113 - DNA, 68 bp, Homo sapiens
ggagtgttcatcttgtgtggatacggtggtttttctgtggcctcaggtgaccactggccacacactcc

SEQ ID NO: 6832114 - DNA, 55 bp, Homo sapiens
agatgggtgccttctttctttaacctcttgtggtgaagagagaaatcatctttct

SEQ ID NO: 6832115 - DNA, 60 bp, Homo sapiens
agaattggctgaggctgccaggctggcatcacagcttggcttctccctctgcctgattct

SEQ ID NO: 6832116 - DNA, 67 bp, Homo sapiens
gagttgcttaacctatttttctcattgatctccattttaatgatgaaaactgaaggttaggaaactc

SEQ ID NO: 6832117 - DNA, 55 bp, Homo sapiens
attggacatgttgagtctgagatgacacttagtcatctaattaaaattgtctagt

SEQ ID NO: 6832118 - DNA, 84 bp, Homo sapiens
ttgcccttatgcctaagaatcagtagatatagatttctaaagtgataaggaggtctctataaaaatgatcacataaagaggcag

SEQ ID NO: 6832119 - DNA, 87 bp, Homo sapiens
cctttttttttcctttttcatctctggatgtcattgcctggaacttttgcaggcttctgataccatgagagaaagtaggctagaagg

SEQ ID NO: 6832120 - DNA, 98 bp, Homo sapiens
gggaggatcccagcctctgctcatcctgcaggagagctctagagcataaattacatctcagagtttgtactgacaggaggcaagggagctaggctctc

SEQ ID NO: 6832121 - DNA, 78 bp, Homo sapiens
gctagagagctacagaaagccttcaagtagatgtaaggtgtgatctgacctatgttttagaaaggcagttctattggc

SEQ ID NO: 6832122 - DNA, 68 bp, Homo sapiens
ggaaacttacttactcacatttctggagtctagaagtaaagatcagagtgccagtatggtgagtttct

SEQ ID NO: 6832123 - DNA, 65 bp, Homo sapiens
acctagagtagaagtttgctttttaaaaaaatcatggattggcaagagtcagcttctgtatgggt

SEQ ID NO: 6832124 - DNA, 67 bp, Homo sapiens
tcccttttttagtcccttttatcatgtaaggtaacacagttacaggttccaggaattaggacagggg

SEQ ID NO: 6832125 - DNA, 76 bp, Homo sapiens
cctcacgtgatccacatgaggtgacttccaagctgttaactggcaagctcttgagtcagttcatctggggatgagg

SEQ ID NO: 6832126 - DNA, 72 bp, Homo sapiens
gttcacaaggtcgtgtgggggttgctgctgtaggagtagatgagctcacatgaccttgtacgttgcaagaac

SEQ ID NO: 6832127 - DNA, 79 bp, Homo sapiens
ggtacttgaagggagatcgaccgtgttatattcgctttattgacttcgaataatacatggttgatcttttctcagtatc

SEQ ID NO: 6832128 - DNA, 72 bp, Homo sapiens
gtcctgttaagatgcagagtccataaccgctccatagaggagcagggggaggcgtttgtgttgtgatgggat

SEQ ID NO: 6832129 - DNA, 80 bp, Homo sapiens
cagccttttagctcatactgctcttccataagaatggcaaaggtatggctgtggaggtgcaggtgatactgtagaggctg

SEQ ID NO: 6832130 - DNA, 63 bp, Homo sapiens
tgctaagattggcaacataagttggcaggtttctgctgcaaacttaccaaccaatacttggta

SEQ ID NO: 6832131 - DNA, 66 bp, Homo sapiens
ggtgacaatgaaagtcttcaaagtctgttccagtgatggttcaatattgctagcttttgtgtcact

SEQ ID NO: 6832132 - DNA, 66 bp, Homo sapiens
ggctgggagtgagtgggcatgttgcacattgagaacctctttacacaattgcccatcctcctagcc

SEQ ID NO: 6832133 - DNA, 65 bp, Homo sapiens
gagttacaagcatctgaaatctgcctacaagctgatcggtgttgttggcgatatcagaatgactc

SEQ ID NO: 6832134 - DNA, 91 bp, Homo sapiens
gggagccaggtttcaacttattagcagccaacttagctgtacaactggctgctgtgaggcgggttggctggtggttgtgaggccagtttct

SEQ ID NO: 6832135 - DNA, 60 bp, Homo sapiens
tgtgtgtgtatgtatgtgtgtgtgtgtgtatgtgtgcagacacgtgtgtgtaaacacaca

SEQ ID NO: 6832136 - DNA, 94 bp, Homo sapiens
cctttaacctgagagcattccacactgaagtctgcttttcttgaagcaaaaattctagtgtccttggacttgctattttatcagggatcaaagg

SEQ ID NO: 6832137 - DNA, 129 bp, Homo sapiens
acaggccaagggaaccagtgcaagttagaacatttggacatgggctctctgagctccagggcacacagctcacccctgaggtaccctgagcctgtgtccacatgcacttgaagatggcggctcttctgt

SEQ ID NO: 6832138 - DNA, 101 bp, Homo sapiens
tggctgcctggctctggccgtagagatgctgtcaggctatctgtctggaagagtagatgatggagctgatagaatttaaaaatggccaagctctgtagcca

SEQ ID NO: 6832139 - DNA, 59 bp, Homo sapiens
gaacacttcttgtgcctctgtgtcctcatttttaagtggatatacaagatcaagtgttc

SEQ ID NO: 6832140 - DNA, 68 bp, Homo sapiens
gcatcccctgtgtagcaaaattgcccccagttgagaaccactgggatggtgctacctatggggtatgc

SEQ ID NO: 6832141 - DNA, 60 bp, Homo sapiens
tcctctgagctcaaaatccagccttcggttgctgtgattcaaggagctccgatatctgga

SEQ ID NO: 6832142 - DNA, 66 bp, Homo sapiens
gtggttatcagagctattttgggaagtggcttgtctccagcctcctggccttgctcctgatgccac

SEQ ID NO: 6832143 - DNA, 67 bp, Homo sapiens
gagctactgtttattttggttatcattttagtatggctgttaagaaaggccgaaataatagtggctt

SEQ ID NO: 6832144 - DNA, 74 bp, Homo sapiens
ggcctcagtgttcctgatgctttgaaattcacgttgaaaagctggaattcattctttcggttaacttgactgcc

SEQ ID NO: 6832145 - DNA, 81 bp, Homo sapiens
gcaaatgatctaatctctctaagtttccatttctccatctgtgaaaatgagaagtggctacccacttaagagagcatttgc

SEQ ID NO: 6832146 - DNA, 66 bp, Homo sapiens
cccaaatatgtcaggggtggaagtggagaaggaattcactatttcagtgattctgcagaagttggg

SEQ ID NO: 6832147 - DNA, 106 bp, Homo sapiens
cctgagcgagagtaacatacagtaaaaataaagactaaacaaccaatatcttgagagctgagggatttttgtgtgtttgttttgaagcttgtttatttttgacagg

SEQ ID NO: 6832148 - DNA, 124 bp, Homo sapiens
aaaatgttcaaaagtccaggcagatgttaacaaatgattgttggttggaggatgattgaatcgtttactattttctcagcctttcattttgatggatctttgctcattcgcttttgttcatttt

SEQ ID NO: 6832149 - DNA, 81 bp, Homo sapiens
gctgctgagccccagcctgggaactggaggaagcagtcccagttgctgacctcttgtggtccctggcttcgggtgtgcagt

SEQ ID NO: 6832150 - DNA, 67 bp, Homo sapiens
cccacacactggctgctgccaaaagctccgtcttcagggagccgcgtggggatggccgggtgctggg

SEQ ID NO: 6832151 - DNA, 77 bp, Homo sapiens
gtgtatcagaggctgtgttataatcttgcaacgcttgttcaattgtattttgcttgaattggcatgctttgatacat

SEQ ID NO: 6832152 - DNA, 64 bp, Homo sapiens
gagtcaaatgcaatgttttcaggtgaacctgagactacagaatggcattgtttttgtggaactc

SEQ ID NO: 6832153 - DNA, 69 bp, Homo sapiens
ggagccatggccagcccttcccgcagctccgaagccactggcaagccccgaggcagggatggccggccc

SEQ ID NO: 6832154 - DNA, 84 bp, Homo sapiens
agaagctccttaccgaggagtgtgaaggcttgtcgagtcttctcaaagtcctcagcatcgtccacaccctcgatggaagtgtct

SEQ ID NO: 6832155 - DNA, 70 bp, Homo sapiens
gtctggggaggggtgcgttgtgaatgaaggtctatctaagacagcattatccaacagcactttccatgat

SEQ ID NO: 6832156 - DNA, 93 bp, Homo sapiens
cccaggtttccatgacttcaagttttgtgttctttttctgctacttcagcaagagtatttagagacacaagacggccaatcatagaatctggg

SEQ ID NO: 6832157 - DNA, 85 bp, Homo sapiens
ctgcctgttctcactttctttcgaagacgtgattaagtttccacatttgtttggtccctcaaaaggcaaagatgaagtacaggag

SEQ ID NO: 6832158 - DNA, 59 bp, Homo sapiens
tctgtcacttattaagatggatggctggagtgcagctttccattactggaaatggcaga

SEQ ID NO: 6832159 - DNA, 71 bp, Homo sapiens
ggcggtgaagcagcttcagtaggtgaagacatggcacgaagcaactgtctggctttctggggctcaaggtc

SEQ ID NO: 6832160 - DNA, 71 bp, Homo sapiens
gctgcctgcctggcccaggaaccagtaggcctcaaagatcttggtcaggtctcgagccaggcagctgcagt

SEQ ID NO: 6832161 - DNA, 59 bp, Homo sapiens
gtgtggtttttagatttctacagtctttctcttaagatttaggaatatagaaaccatgt

SEQ ID NO: 6832162 - DNA, 77 bp, Homo sapiens
gagacagaaagccaggcagccaagccagtgtggggtctctgaaataacactgtgctagctgctactttccctgtctc

SEQ ID NO: 6832163 - DNA, 69 bp, Homo sapiens
gttctttcccgagtcattgattcaacagaacagcccactgtggttattggaatgcactgggagagacac

SEQ ID NO: 6832164 - DNA, 60 bp, Homo sapiens
gtcacatcagtccaccactgcagttgcttttagctgccacatggtgtcactgttgaagac

SEQ ID NO: 6832165 - DNA, 85 bp, Homo sapiens
tttgcatccccccaaaattcttaagttgaatcctaacccccagtgtgatggtatttggagatgggaactttgggaggtgatcagg

SEQ ID NO: 6832166 - DNA, 67 bp, Homo sapiens
tctgtgtctcttcctttcaagtggggaaacagcccattatcctcactgagaccttggcgacgtaaga

SEQ ID NO: 6832167 - DNA, 103 bp, Homo sapiens
tcttaacaccaaaaatactttcagaggaatagtttgaggatttcagttcaaatatcatcatcaaaatcctggaagatctctgtgagatttggaggacttgaga

SEQ ID NO: 6832168 - DNA, 64 bp, Homo sapiens
gcacctgcaggagctgtgcggtgaggggctggtggcctctgcacccccggctcctcgtttgtgc

SEQ ID NO: 6832169 - DNA, 130 bp, Homo sapiens
gcctcctcaactttccacaacccatctctggaactgactcataaaatagaaaccactgctcaaactctaacagggttacagcaacaggtttattatcttatgactgtagttctccagaaattgtagaggt

SEQ ID NO: 6832170 - DNA, 57 bp, Homo sapiens
atctgcagaaactgtgactatgttgttatatggcaaataggaattaagtttgcagat

SEQ ID NO: 6832171 - DNA, 67 bp, Homo sapiens
tagtgtttgggaattgtagagagttcattcatttgttttaataactgcaaattccatttaaacacta

SEQ ID NO: 6832172 - DNA, 65 bp, Homo sapiens
aaagccaaagtcatccaaatttttatgtcatggcataacataagctcgagatggctttgtgtttt

SEQ ID NO: 6832173 - DNA, 60 bp, Homo sapiens
ttcaaatcagaccgaaggcaacctcagaaacaagaagagcctttaaaattctggtttgaa

SEQ ID NO: 6832174 - DNA, 58 bp, Homo sapiens
gtcactttcacactttattgctgcacacacaaaccagctggatgtttttggaagtgac

SEQ ID NO: 6832175 - DNA, 72 bp, Homo sapiens
ggccgcgaggctgcggggaggagcctgcacgagggcccggcagccccggcagcccccccagccctcggcgcc

SEQ ID NO: 6832176 - DNA, 63 bp, Homo sapiens
taaaaggatgagttgtaaattgaggttaattcactgtttcttaatgacagccagatcctttta

SEQ ID NO: 6832177 - DNA, 103 bp, Homo sapiens
ttgagatggagtcttgatctgtcacccaggctggagtgcagtggctcagtcttggctcactgcaacctccgcctcccgggttcaaccaattctcctgcctcag

SEQ ID NO: 6832178 - DNA, 88 bp, Homo sapiens
tggctttcaggctcagggttcaggaggacagataaggatagggcatggctctgcccttccaagttctcctggatcccccaggaagcca

SEQ ID NO: 6832179 - DNA, 72 bp, Homo sapiens
gtctccctggcccaatagtggggatatacctgagttgagctagaggattttatccctgttgggatgggggac

SEQ ID NO: 6832180 - DNA, 74 bp, Homo sapiens
ggaaggtcagtcagtgcgcaagtggttatagggtcttctccatgttaactgccttagtgcctgagtgcttttcc

SEQ ID NO: 6832181 - DNA, 67 bp, Homo sapiens
ggaaggagatgcagggttgggcagccatgtggatggatggcgctcaacagtgcatgctaccacagcc

SEQ ID NO: 6832182 - DNA, 57 bp, Homo sapiens
gcagaatgtcagtatggtcacctcaagatatcagaggccctgacttcatcattctgc

SEQ ID NO: 6832183 - DNA, 70 bp, Homo sapiens
aagactgcatatctgggagtatggagaatggagagaactgatttgctgtatatcatggttttgcagtctt

SEQ ID NO: 6832184 - DNA, 78 bp, Homo sapiens
atctttgtgtctcaggcctcagcctgccaggcctgggctttctgcttggcagtgtctaggggtctggggcaaaaagat

SEQ ID NO: 6832185 - DNA, 61 bp, Homo sapiens
gccagaggctcctcggtgcctcgtgcgagtccccgccgtcagccccgaggagcctcctggc

SEQ ID NO: 6832186 - DNA, 94 bp, Homo sapiens
acctcgcagatgacttgagagtgaatgtccccgcgggtcagcaccacattggctgtgctgtggatgctgtaggacacgctctctcttgcggggt

SEQ ID NO: 6832187 - DNA, 81 bp, Homo sapiens
gagaagactctcaatggcttctttttggtataatgctcaagtatactgctaatgggaatgctaatgggcagagcctttctc

SEQ ID NO: 6832188 - DNA, 90 bp, Homo sapiens
catctctatatccctagtcctgcacatagtcctactagtcctactatgtgtagtactagagatgtgtgcgggtatgggtgggtggacgtg

SEQ ID NO: 6832189 - DNA, 58 bp, Homo sapiens
cttggattgtacctagtatggttgtaaatttatgtgaccatttcttagtcagtcttgg

SEQ ID NO: 6832190 - DNA, 129 bp, Homo sapiens
atgtcagtagagttcatttgagccaaatttgaggactgcaagctgggagtatctatttaagttgcccggaatatacactcctgggttgcagtcctcaaacttggcccaaaataaactctatacttatat

SEQ ID NO: 6832191 - DNA, 73 bp, Homo sapiens
tacctgtggaaatgtttgcttcaaggtcatccttagataacaatatgaagtagatatcacttctctctgggta

SEQ ID NO: 6832192 - DNA, 65 bp, Homo sapiens
ctgagttacagctggcgtggggaaatctaggagacaggtggttcccttaacagctgtatatttgg

SEQ ID NO: 6832193 - DNA, 59 bp, Homo sapiens
ttgtaagcacagaatctctccttacgtgactgaccttcaagagaccctgtagcttgcag

SEQ ID NO: 6832194 - DNA, 61 bp, Homo sapiens
gtacggccaagtgcatcctggtatttcagaaatgtgaatttcctggttgcattggctttgc

SEQ ID NO: 6832195 - DNA, 93 bp, Homo sapiens
gccacagcacctcggcaggcgtggcttttcacctgctcctctgggacagatctgcagggggcagcgtagaaaatgagtccctgagagcatggc

SEQ ID NO: 6832196 - DNA, 102 bp, Homo sapiens
acttcgcacctgaatcccacatgctgacctttggtagccacctttgatgtattctgtagaggtgagccatcaaggggcagtgtggcagagcagagcagaagt

SEQ ID NO: 6832197 - DNA, 79 bp, Homo sapiens
gatggagagccagaaaatagagtttctctgagtggcagcccctagacacttgatttttctgaaagataggctcttgatc

SEQ ID NO: 6832198 - DNA, 70 bp, Homo sapiens
gaggatatcattaatttgctaggtttcgttcccacagggaaatgttaaaaaccagtacagttggttcttc

SEQ ID NO: 6832199 - DNA, 105 bp, Homo sapiens
cttgctttgtggaactttactcacttcattcatttggagaatagtaatgaatacctactatatttcaggtatggtgtgaaatatttaagtaaatatataagtgag

SEQ ID NO: 6832200 - DNA, 65 bp, Homo sapiens
agagaaaacaaatgtttctgagagaattcacacttcatttctctctgaggtcctgtgatttctct

SEQ ID NO: 6832201 - DNA, 74 bp, Homo sapiens
tcaatttgatcccatttcctgttttgtcaagggggaaagccgccttgcaggattttagagatgacatgaaatga

SEQ ID NO: 6832202 - DNA, 75 bp, Homo sapiens
aaaaagagagcatatagtacattgtggagaccaaaaatcatttatgtctccctagcttatttgtgctctagtttt

SEQ ID NO: 6832203 - DNA, 58 bp, Homo sapiens
actgacccggaaagaaaatgaagatgtcctctaggccaggctttacctctgggtaggt

SEQ ID NO: 6832204 - DNA, 81 bp, Homo sapiens
ggccaatgatatctaggaatgggactacatatcacatactgcttttgtgcaactgtccttgtattccaagatacaatggct

SEQ ID NO: 6832205 - DNA, 112 bp, Homo sapiens
agatagggagagagattgatcacaaagttgtaattcaatctgtagattgtgatgtttatgatatcatcagtatcatgagattaaattacaagttgcaatctatcttccttct

SEQ ID NO: 6832206 - DNA, 78 bp, Homo sapiens
tcttatatggcagaatttctagcagattctataaatgtaatgcatgaagtgagcgaagaagttttgtccaaaataaga

SEQ ID NO: 6832207 - DNA, 92 bp, Homo sapiens
gacttttgtttgcttgcttgcttgtttagttcacagattaggaataaatctggactggaacttgtaacaattaactagggcatttgaaagtc

SEQ ID NO: 6832208 - DNA, 67 bp, Homo sapiens
gggatgaagtggcaggttataagcatctcaacagataattgaaaatgttgaatttccgctttggccc

SEQ ID NO: 6832209 - DNA, 62 bp, Homo sapiens
gtgctgggtcaggcatctgcagaactggttcctattctcctttctgatggtctgcttagctc

SEQ ID NO: 6832210 - DNA, 84 bp, Homo sapiens
ttggtctacagctttgccaagtaaggtctttgaaaggtagctatagacttttgaatgccttcattggcgaagtgcttagaccaa

SEQ ID NO: 6832211 - DNA, 87 bp, Homo sapiens
gcctcagacccattgaacactgaaccgtaaatgatttaggaaagctgcgagaagttatactatggggttctttaaagggtctgaggc

SEQ ID NO: 6832212 - DNA, 106 bp, Homo sapiens
gtatctgtactagttaactgctcagttaagcagaggaaatggtgaggctactctatttcttttaaataactttgcattgttacatttgaatcctggtattcattat

SEQ ID NO: 6832213 - DNA, 66 bp, Homo sapiens
tttgtgaataggttggcttccagtccttggattgagattgcacaagttatgtgattcactcacaaa

SEQ ID NO: 6832214 - DNA, 76 bp, Homo sapiens
ttttgttaatagtaatggactccagaccaagaacatttttagtcactgtgtcaacagttcatactgagtaacaaaa

SEQ ID NO: 6832215 - DNA, 60 bp, Homo sapiens
ctacagtctcttctatggaaagctgtttatcatgagctttctaggcagagatgactgtag

SEQ ID NO: 6832216 - DNA, 55 bp, Homo sapiens
gtagcatctgtactgacataatccgcactttagggtgatgaatgtcaattgctac

SEQ ID NO: 6832217 - DNA, 76 bp, Homo sapiens
agctctgtagatgtttaggagagatcactccagagggaatggcaaacgtggagatcctgagtgcatctgggagact

SEQ ID NO: 6832218 - DNA, 79 bp, Homo sapiens
ggaagtgctaactatactgtttttctgcctaagctcctccctttggaggaaggtacatgaagcttgtgttggcatgcac

SEQ ID NO: 6832219 - DNA, 58 bp, Homo sapiens
agattatttttaacaattattgtgaatttggactctcagtatgtgttagggataattt

SEQ ID NO: 6832220 - DNA, 70 bp, Homo sapiens
ggctcaatactgtgatccttctagggctggaactaaaggagacaggctcttgagaggcacaggtttggct

SEQ ID NO: 6832221 - DNA, 59 bp, Homo sapiens
ttggcatcagtgtaggacctgtttgcaagtcagacagatccttggttatttgtgcacaa

SEQ ID NO: 6832222 - DNA, 64 bp, Homo sapiens
tctgttgtctgcaattctgggacatggaatagaccgaggctaagccctgaatagcagtagcaga

SEQ ID NO: 6832223 - DNA, 86 bp, Homo sapiens
agccctgccctgcttctcttgggacagagacgaacttgaagattcttaaggattcagttgtcactagtgaagaatcaggctgggct

SEQ ID NO: 6832224 - DNA, 66 bp, Homo sapiens
tgagtataaccatgtgccaggtgttgtgtttaacactgataatacaaagctaaatatggtttctca

SEQ ID NO: 6832225 - DNA, 96 bp, Homo sapiens
gaggagtcatatttggggccttggcactcatcctggttgtttacgcaggtgtaaacccgtacgcgggatgtagttccatgcactcatggtttcctc

SEQ ID NO: 6832226 - DNA, 60 bp, Homo sapiens
tagtgtacatgaaggagcctaattatatgcctctttttggtaggccctcaagtaacatta

SEQ ID NO: 6832227 - DNA, 76 bp, Homo sapiens
tcacttgaacccgtgaggcggaggttacagtgagcaaagattttgtcactgcactccagtctgggtgacagagtga

SEQ ID NO: 6832228 - DNA, 98 bp, Homo sapiens
gaaagtcttcagcaaattacagtataattagatatcaaaagtctggtttcaattttctctagactatctgaatgttattgttgttgtcattatttttc

SEQ ID NO: 6832229 - DNA, 90 bp, Homo sapiens
tggtggcgtgcgctaggccgaagctgacccaggagcgtgtgcggcagtgcaccagcgcctccgtgggcagcatgtgccagtccgtcacca

SEQ ID NO: 6832230 - DNA, 72 bp, Homo sapiens
tccttcacccaggctggagtgcagtggcatggtctcggttcactgcaacctccacctcccgggttcaagcga

SEQ ID NO: 6832231 - DNA, 102 bp, Homo sapiens
gggtgggacggaatccgttccccgccggaaagatggatgcgcccttcccgggcgtgcccggggctgtgtgcccacttcccatccggggagctcaccccaccc

SEQ ID NO: 6832232 - DNA, 73 bp, Homo sapiens
gtgtataatctctcatgcaaaatttagttctttgtttctcagcttaaactggattttgatgagcagttttcac

SEQ ID NO: 6832233 - DNA, 73 bp, Homo sapiens
cagatttgctaattgctgaactactatccctcagaagatgagagaaagaacacacagctattagtaagggctg

SEQ ID NO: 6832234 - DNA, 63 bp, Homo sapiens
tccctggacccaatgacaatgggactgctaagcctattctagtctgtcatgtccaaaatggga

SEQ ID NO: 6832235 - DNA, 62 bp, Homo sapiens
gctacagaggaagttccttgatgagactcaagtccgttctctaggagaaacttcctttccgc

SEQ ID NO: 6832236 - DNA, 76 bp, Homo sapiens
gtagcaactgaggtagggcacacctaggtggggcatcccatataaccttttctaggttggccttgcccagtgtgac

SEQ ID NO: 6832237 - DNA, 59 bp, Homo sapiens
tggaattatctgaagtgatttgatgacttttcacattagttttcatttcagtaaatcca

SEQ ID NO: 6832238 - DNA, 56 bp, Homo sapiens
acttcatgttgctcttggctatcgctggggaaaggcttgagccaggcatatgaagt

SEQ ID NO: 6832239 - DNA, 72 bp, Homo sapiens
tcagtaatcttgccagtctccaaatcaatctgaatgatatcattcaccttgataaggggatcaggatagtgg

SEQ ID NO: 6832240 - DNA, 101 bp, Homo sapiens
tcagacagatactaggttggtgcaaaggtaactggggttttgccattgctttcagtggcaaaaactgcagctgcctgtgtacaaatctaatgcatgagtga

SEQ ID NO: 6832241 - DNA, 110 bp, Homo sapiens
gacctggccctggagctgctttcaaagatcagggggctcacgggttctggggctttccccagcctctgtttgctcctctcttgaaatccacaatctcctgggctggtgtc

SEQ ID NO: 6832242 - DNA, 78 bp, Homo sapiens
gggtttcagtgctccaggataggctgacctgagctccagctgcaaacaggtgatctggtcctctgggctctgaaaccc

SEQ ID NO: 6832243 - DNA, 80 bp, Homo sapiens
ctgatgcccaagagcagcagtgttggtgggagcatctgctctggggagcagagaggaggccatcaacactgtggtataag

SEQ ID NO: 6832244 - DNA, 58 bp, Homo sapiens
gcaggtctggcatagagcctgcatgctgtgcagatccctacttgttccccaggcctgc

SEQ ID NO: 6832245 - DNA, 65 bp, Homo sapiens
gctaatagcttatgggatagatgttactgctagatgaagaaacatcttcagagaagctaagtagc

SEQ ID NO: 6832246 - DNA, 81 bp, Homo sapiens
ccctggccctggccccgaggtggctgggaggtggctcctcaaacagccgctgtctcatcagtgcccggtgctgggtcaggg

SEQ ID NO: 6832247 - DNA, 109 bp, Homo sapiens
ggaatttcacttgaaaaagataaaagatttcatagtagtaatagaatgttggctaagtagctaattattgcatacttaaatttccggtctttaaagtgacaaaaattct

SEQ ID NO: 6832248 - DNA, 73 bp, Homo sapiens
acatggggaaaacagaggaaattagaaaaggccctgtagtttggttaatgatacctatgttaatttcccatgt

SEQ ID NO: 6832249 - DNA, 94 bp, Homo sapiens
tctataggactccgcctctctgccggcttctgtaggccaatcactgaggccttagaataacagaaggcggggacaaggcggggctctcacgaga

SEQ ID NO: 6832250 - DNA, 56 bp, Homo sapiens
gcagcggtgggcagggctagggcccctggctaccggggcatcctttcccaccctgc

SEQ ID NO: 6832251 - DNA, 77 bp, Homo sapiens
aggaagggacgctcgggtcctctgatgcccacgggccttctgcgtgtggaaggcagaggtctgatgcgtccctgcct

SEQ ID NO: 6832252 - DNA, 70 bp, Homo sapiens
agtgataacttgtaaattagattctctttttgtgctttggccagtggatccacatttgcacgttatctct

SEQ ID NO: 6832253 - DNA, 105 bp, Homo sapiens
ctctatggagctctctgtgtattgcaggtttattatagaggatgacgctccccaaaatttcctcagtgtcccttctgtgatgaaccgtaggagagttttgtgtag

SEQ ID NO: 6832254 - DNA, 60 bp, Homo sapiens
tgcagtgttcctgtgggtttatatatcattttatatggacacacataaatacctcttgca

SEQ ID NO: 6832255 - DNA, 107 bp, Homo sapiens
accacattcctaggcactcttctaggcactggagatacagagatgaacaagacagagatggtcacagtttttctgtctcttacattgcagaaagagagggatgtggt

SEQ ID NO: 6832256 - DNA, 85 bp, Homo sapiens
caaatgtatacattctggcaacgttttctataggtaaagatgattgttttacagaggtatgtatgtctctgagtgtaaatatttg

SEQ ID NO: 6832257 - DNA, 77 bp, Homo sapiens
tatctccacaaaggaactgcattttgaagttggagtaagccactctgacatttaaaaagcaattcagtggaaaggta

SEQ ID NO: 6832258 - DNA, 61 bp, Homo sapiens
atggctggtctcccatggaaaactgaccttttccattttcagtaactccaagaccagctgt

SEQ ID NO: 6832259 - DNA, 64 bp, Homo sapiens
tatgctggacaggctggggactgcaaactataatgtggattaaggtgaaggcttgtcaaggatg

SEQ ID NO: 6832260 - DNA, 77 bp, Homo sapiens
ttatcttgatgtcctatttctctgtgcatgattctaccttcagacacagatgagacaaggagtggtctgtgtgatga

SEQ ID NO: 6832261 - DNA, 67 bp, Homo sapiens
ggagcctttcagaggttactcaggaaatggactcctgtttcctgtgactaatctggacagcggcttc

SEQ ID NO: 6832262 - DNA, 103 bp, Homo sapiens
tgagaatggcatatttacattatttagtgctgattctagattaaaacactgaaaaatgtacatagagggtaatagcatcaagaaggtaaatgtgttcctatta

SEQ ID NO: 6832263 - DNA, 71 bp, Homo sapiens
tactgaaatattttctgtcactaatgttcttcataaaaaattgaaggaggggcatagaaatgtaatcagtg

SEQ ID NO: 6832264 - DNA, 76 bp, Homo sapiens
gagcccacagtgtgactgaccttcagccagggtcctcctgtcacctgcggaaggtacagtacacctgtggagtctc

SEQ ID NO: 6832265 - DNA, 79 bp, Homo sapiens
aggtgaggaccagtctggtggtcagagtccacccccggcacaaggccgtggatcatggctaaggcgatggtaattattt

SEQ ID NO: 6832266 - DNA, 74 bp, Homo sapiens
gtacttatgcaaagccacccagggacgaggccctcttcagagtggctgtgtgttggcttagcattccagagtgc

SEQ ID NO: 6832267 - DNA, 66 bp, Homo sapiens
tgcctggcctcctgattccctcctgtccccttctcattccccaggggcttatctgaggcctgggca

SEQ ID NO: 6832268 - DNA, 71 bp, Homo sapiens
atcctggtgctctgtggctgaatctggatggctcagtggcctaacagaaacagacatgacgcagtaaggat

SEQ ID NO: 6832269 - DNA, 62 bp, Homo sapiens
acgctgtctacagatgaaataagcagccaccagctgctcccaggcattctctgttgatatgt

SEQ ID NO: 6832270 - DNA, 90 bp, Homo sapiens
tcagggctgcaagtttaagcagattgctgtggtgtatacacatgattttagcatgataacacttctgtttaatgtccttagttgttctgg

SEQ ID NO: 6832271 - DNA, 77 bp, Homo sapiens
caataaaatgtagtaagaagagcaggagctttggaatctacttgggttcaaactcttgctctgctagttgcttgttg

SEQ ID NO: 6832272 - DNA, 71 bp, Homo sapiens
gagtgatgttgttatatcatgcctacaaatacctcatctgggtctgtagtctctgatatatctgctcattc

SEQ ID NO: 6832273 - DNA, 61 bp, Homo sapiens
atatcagtatggattcatggattcctcttgtattcaatgagttataatctgctactgatat

SEQ ID NO: 6832274 - DNA, 101 bp, Homo sapiens
caggaaatttccatctttaactatactctgtaaatgtgctgtccaatacacagatagctactgagcactggaatatagctagtctgaatggagatgttctg

SEQ ID NO: 6832275 - DNA, 70 bp, Homo sapiens
agggctcttcagggatgagatttcaagcatcttaatgggatgtcaaggagctgtttgtgcagagagccct

SEQ ID NO: 6832276 - DNA, 59 bp, Homo sapiens
ctgaggcaccggcaatgttctgtttcttcaaccacgtgcaggttacacggtgcgctcag

SEQ ID NO: 6832277 - DNA, 60 bp, Homo sapiens
agagcaagtgatatgcttcccaggtcaaaggaaactaaaactgaaggatattatagttct

SEQ ID NO: 6832278 - DNA, 74 bp, Homo sapiens
ccttctctttaatccttgatactggtactagtgctctccacatgcaatgcaccttggcagggattcagatgggg

SEQ ID NO: 6832279 - DNA, 116 bp, Homo sapiens
tatttggagttaaaatgttagtctacatagatggatgattgtaactttactgccattaaaaagatttcagattgcattcatgcttctgtgtacacataatgaaaaatggacaaata

SEQ ID NO: 6832280 - DNA, 67 bp, Homo sapiens
atataatgctgcttgggttatcagaaagtattgaatacttcagataagtcaagttagtatttagtat

SEQ ID NO: 6832281 - DNA, 59 bp, Homo sapiens
tgaaaagattcacctgaaatgttttggctatctgagttcatcacaggatgattttttca

SEQ ID NO: 6832282 - DNA, 60 bp, Homo sapiens
gctttaccatacatcaaaatattttatacatttctaggaataaaaactgtgtggtaaagc

SEQ ID NO: 6832283 - DNA, 76 bp, Homo sapiens
ccggccagggcctgagggctgctctgctggcagcgaagaccttgacacactgcagacggccctggccctcgcgcgg

SEQ ID NO: 6832284 - DNA, 60 bp, Homo sapiens
catctccaggagttctactcataagagtggtcatctctgagtgtgaaaatcctggagatg

SEQ ID NO: 6832285 - DNA, 62 bp, Homo sapiens
cactgtgatgtgggttttattatttccagtacagatgaggaagactgaggcctgcatcagtg

SEQ ID NO: 6832286 - DNA, 77 bp, Homo sapiens
gaacgaacaggcaaactgtgggatcccggcctgccagggagggttcagggtaaagccttcagtttgcttgttcattc

SEQ ID NO: 6832287 - DNA, 60 bp, Homo sapiens
tgaattttgtgtgtacaaaggtgtgtgtttgtgtgtgcgtgtgtgtatgcataaaattta

SEQ ID NO: 6832288 - DNA, 62 bp, Homo sapiens
actgcattcctttagcagatttgatttttacaggatttcagtggaaaatgctgaaggacagt

SEQ ID NO: 6832289 - DNA, 62 bp, Homo sapiens
gggatgagctcatccgagtcacactgggccagggctcagcctattccaggatgagctcaccc

SEQ ID NO: 6832290 - DNA, 87 bp, Homo sapiens
gcagctggaaggtcttggctgtggattttggtttgtctacactcctttttatattagagaaaacttgtcacagctctcacacgttgt

SEQ ID NO: 6832291 - DNA, 75 bp, Homo sapiens
tggatgagttacggcaccaagctgggccctctccgaatttccaggaggaggcttttgcaggtgccacaagtacca

SEQ ID NO: 6832292 - DNA, 73 bp, Homo sapiens
ggtcaaggtaaggcaggctttcatccagagccatgccatgcacagctcaggtgagcactgccttacccagacc

SEQ ID NO: 6832293 - DNA, 61 bp, Homo sapiens
gtggggagctggggaggcttggcctggctgcagggggcctggcttccttcccagcccccac

SEQ ID NO: 6832294 - DNA, 95 bp, Homo sapiens
gaatgaggtgttctggttaatttaattttctggttgaggtttaacataatttaatcttattttttaatgacagagaaacttgaatagctttattc

SEQ ID NO: 6832295 - DNA, 65 bp, Homo sapiens
cttgctgatctttgggccattaataaagcacatgtcctgtgttttgaattccaatgatttgtaag

SEQ ID NO: 6832296 - DNA, 56 bp, Homo sapiens
cacatttcattggcttacgtaatatttaattctattatgtaagttacaaagatgtg

SEQ ID NO: 6832297 - DNA, 67 bp, Homo sapiens
atgcaaggttgatgttgtctgccctgccaagcttttagcttgtcaaggcttttaatattctttgtat

SEQ ID NO: 6832298 - DNA, 80 bp, Homo sapiens
gaagaactgtgtttgaatctcctagcgatgttttttgaatctgcattgaatagatagcttggatggttgtttagttcttc

SEQ ID NO: 6832299 - DNA, 76 bp, Homo sapiens
aaagactgagacagctccgctgcccgctgaactccatcctcccggcggtcgggcggcggcggctgcctcttttttt

SEQ ID NO: 6832300 - DNA, 61 bp, Homo sapiens
tagatggggaggaggttatagctgctttcacagtaagatctattaatttttcttcccacta

SEQ ID NO: 6832301 - DNA, 74 bp, Homo sapiens
gcctcgtgtaactcaaatacttatgttacttggtgaaggcaacacattagtacaagtattagagttattctggc

SEQ ID NO: 6832302 - DNA, 129 bp, Homo sapiens
tattaaaggtagttgagaaggtgctgacgtcaccagctctcaggaggatgactgccttggaaaaacagcttttaaaggcagtaattcctgagtttagtagatgcagttttgcctcttggctgggaatga

SEQ ID NO: 6832303 - DNA, 91 bp, Homo sapiens
gcgcgagggcttctggggtttgtggttcttctgcgcccttttgccgctgcgtgctcggatctaggactatacatcccagaaggctgcgcgc

SEQ ID NO: 6832304 - DNA, 68 bp, Homo sapiens
gctttggagccagataagaccagggtttgaactctgatcctgccagtcactatgtcaccttctaaggc

SEQ ID NO: 6832305 - DNA, 55 bp, Homo sapiens
gagaggggcacagcagctgttgcacaggctggtgcaagattccctgcttcttctc

SEQ ID NO: 6832306 - DNA, 91 bp, Homo sapiens
ctgggaagtgccattatctgatttgtaattttagaaagatcgttttatctttcatgagcagagcaggttctagagagtgagtgcagcccag

SEQ ID NO: 6832307 - DNA, 77 bp, Homo sapiens
ttaatcctttaggttaaaagaggatcaacatggcaacaaagtgttttggaaatagcctcttgtgatttgaagattaa

SEQ ID NO: 6832308 - DNA, 77 bp, Homo sapiens
ggcactcaggattcaagctcagctttcccgcggacctgctgggaagccacgggtaagctgctttatctctctgtgcc

SEQ ID NO: 6832309 - DNA, 60 bp, Homo sapiens
gctgtgggacaggtccagccagagcccaggccagaggggcagaagctggagtcctggagc

SEQ ID NO: 6832310 - DNA, 87 bp, Homo sapiens
ggcagtctagcttccctgctggatcataagaccaggacagcagagattgggtttgtattgatcagtagtagggaagtattgattgtc

SEQ ID NO: 6832311 - DNA, 72 bp, Homo sapiens
ccatgaccatacctgggcctgaagtgacaaggaaaggaagcattgttgctggagagggctggatggccatgg

SEQ ID NO: 6832312 - DNA, 55 bp, Homo sapiens
ggagcccggcctctccagcagccacacaggcctgcagtaggatggggctgggcct

SEQ ID NO: 6832313 - DNA, 59 bp, Homo sapiens
ggatgagcaatgatgcgctgtaatgtacgtaagtgtgcagcaagcaagtatggttctcc

SEQ ID NO: 6832314 - DNA, 130 bp, Homo sapiens
tcttgttatttattcttcacctgaagccatcatctcagtttctgacattaaaatctgttagtatggaaacaattttggttgtgtcaagagactgaaggataataactccatggtagcctaagtagcagga

SEQ ID NO: 6832315 - DNA, 60 bp, Homo sapiens
gggcctggcagggctgcagtaatggggaatcacacttcattattgctgttttctaagtcc

SEQ ID NO: 6832316 - DNA, 72 bp, Homo sapiens
gaaaaagagatgcaacagagaaaatattgagcatatttctagaggagcttaaatttcctgcatttctctttc

SEQ ID NO: 6832317 - DNA, 62 bp, Homo sapiens
ttcctcgttaggtatattacttggaaatatattgcattcaaagtaccgtacttaatggagaa

SEQ ID NO: 6832318 - DNA, 58 bp, Homo sapiens
ggggaattggaagcagaatttgattcagtctaaggaaattattgctcttcaattgcct

SEQ ID NO: 6832319 - DNA, 60 bp, Homo sapiens
tattacaaaggcggagttaaaatgattgattttaagcaagcatgatctgcccttgtaata

SEQ ID NO: 6832320 - DNA, 80 bp, Homo sapiens
gctgggaaacactgtgaagatttggcatgcagaacacagacgtaatttttgctgctttctatcagaagaggttttatagc

SEQ ID NO: 6832321 - DNA, 101 bp, Homo sapiens
gggtcttcgccgggacttgggacagtgtggctggtctccgagcgtcgccctgcggcggagcgcagaattgcagatcaggcacccgagccttgggaggaccc

SEQ ID NO: 6832322 - DNA, 58 bp, Homo sapiens
gttggccttgaggtggtagagttcatcgaacttcatgctgatatcctcgatggacagc

SEQ ID NO: 6832323 - DNA, 83 bp, Homo sapiens
caagggtatgtgaagcgaagttgcaccaagccagcaactgcagttgccgctgttctagcttcagtttcgcgatgcttcccttg

SEQ ID NO: 6832324 - DNA, 72 bp, Homo sapiens
tggtttttaagtaccaaagtaggaatttgaccctaagcattttatgtcagagtccatggtacttaattatta

SEQ ID NO: 6832325 - DNA, 63 bp, Homo sapiens
aaatgtacaacatccatatataaatataaataatatgtgtggtttctgtggtgttgtacattt

SEQ ID NO: 6832326 - DNA, 63 bp, Homo sapiens
tagtgctaatgtgcaatatagaggtagcaattgtgtcttagctctgtattacatatcagtctg

SEQ ID NO: 6832327 - DNA, 55 bp, Homo sapiens
ctttctctgtcaaatccatttaacctctctgaaaggtcagtggagaaaggggaag

SEQ ID NO: 6832328 - DNA, 71 bp, Homo sapiens
gaagtggcttggagcaggtgatgggggcaaacaatgtctgccaggccacgtagcttcaagataaacccttc

SEQ ID NO: 6832329 - DNA, 60 bp, Homo sapiens
gccaatcaggaggctgtacatcagggcgggggcgggaggagctgcagctttgtgattggc

SEQ ID NO: 6832330 - DNA, 57 bp, Homo sapiens
gcctggaaattgaggcacagttccaacaccagggcggattcaggcctttttccaggc

SEQ ID NO: 6832331 - DNA, 65 bp, Homo sapiens
ttgtataaatatacatgattttttgagggtggaggacttcaccctttgaattatagtgtgtacag

SEQ ID NO: 6832332 - DNA, 62 bp, Homo sapiens
cctggattcaagtgtctattccctcctgactctggaagaatgagttacatcttgaattgagg

SEQ ID NO: 6832333 - DNA, 67 bp, Homo sapiens
gtcatctcttatgctgcagtgaggcaacaaataaaataggaagttttcctcttgcaaaagagatgac

SEQ ID NO: 6832334 - DNA, 65 bp, Homo sapiens
ctctttaaatttgtgtttagagggtctcatgtttctccatgaaactttgctgcaggtttaaagag

SEQ ID NO: 6832335 - DNA, 59 bp, Homo sapiens
ggtgaacattgatgtggttacagcccacatgtggtctgtcatagaatacagtgattacc

SEQ ID NO: 6832336 - DNA, 94 bp, Homo sapiens
gtgcaatgtactttgctgaagcgtaaaaattatagggtttcaatctacagaaagaaactgaagagctttttgacactaggtaagtacattgtgt

SEQ ID NO: 6832337 - DNA, 60 bp, Homo sapiens
ccctgaatggctggcatccaggtgggcttcccataaggagcccccttctgcgggcctggg

SEQ ID NO: 6832338 - DNA, 57 bp, Homo sapiens
gcatggccatggcactatggacaccagtccggtcctgagtccagtcccaaggccagc

SEQ ID NO: 6832339 - DNA, 59 bp, Homo sapiens
ggtgcactggtgtgttagtaagggatgccagaaatgcgtgccttctcttatcagtcacc

SEQ ID NO: 6832340 - DNA, 102 bp, Homo sapiens
gcatggcaaggtcaccttgggcacagagaggcctccctcaccatgacccgctgttagagacaaggaggtctggggggccctcccaggcctgacctgccatgc

SEQ ID NO: 6832341 - DNA, 57 bp, Homo sapiens
ctgcgggaagggagggacctcagtctccatgggaggctcagggactccctccctcag

SEQ ID NO: 6832342 - DNA, 92 bp, Homo sapiens
gcagtcggttagacaaaagggggcagatatgaatttcaccaattggttttcttattgtcctgcttttgttttgttttgtattaaatgactgc

SEQ ID NO: 6832343 - DNA, 62 bp, Homo sapiens
agtgctgtgagggactggattacttggtcagttttggttgctggcttccagttttcagcact

SEQ ID NO: 6832344 - DNA, 66 bp, Homo sapiens
tctaccctgcagcttttgcatagtcagtgacacacttgacaattggcacagctgtgctggggaaga

SEQ ID NO: 6832345 - DNA, 101 bp, Homo sapiens
atgtcctatgcaagtatacaccaaatgtggcaggaaagtattttaaaattttatatattttacttttgcagccattattgctgcattgtttgcagaaacat

SEQ ID NO: 6832346 - DNA, 58 bp, Homo sapiens
ggcgctggccacggtggctctgtcccctccctcaacaggtgctcctggggccaacgcc

SEQ ID NO: 6832347 - DNA, 61 bp, Homo sapiens
gatggagaagggatgggatagggagaaagtctgtaagcttctaccctctcctgctcatatc

SEQ ID NO: 6832348 - DNA, 106 bp, Homo sapiens
ctctctcggggctggccccggtgctggacggctgcagccgtggactccgggagctccaggcatgtggccagtactcatggctcctctggggccagtgtctggagag

SEQ ID NO: 6832349 - DNA, 82 bp, Homo sapiens
tggtctaagcacttcgccaatgaaggcattcaaaagtctatagctacctttcaaagaccttacttggcaaagctgtagacca

SEQ ID NO: 6832350 - DNA, 70 bp, Homo sapiens
gggcaaagtggtggaggcagtttttggtgggtggagagacattgagcacttccttccacctgctctgccc

SEQ ID NO: 6832351 - DNA, 57 bp, Homo sapiens
gagctccattgtaatcacctggtggcttgtctgtttccaccaggagacagtgagctt

SEQ ID NO: 6832352 - DNA, 66 bp, Homo sapiens
tgtttttcactgtatgttccatttggtgttccaggggagaaaaaggataaatacagtgtttaaata

SEQ ID NO: 6832353 - DNA, 65 bp, Homo sapiens
tgtgttttctcctaagacccttcaccaaggttgctggggtgaagggccttaggagacagatcaca

SEQ ID NO: 6832354 - DNA, 58 bp, Homo sapiens
agaaggtgatgagttccagcattttttcagacttggatctggctttcattccccttct

SEQ ID NO: 6832355 - DNA, 74 bp, Homo sapiens
tcaggagcagtatgcattgacattttgagtaaatatttcagttttatgtcgaatgtatactcagttgcttctga

SEQ ID NO: 6832356 - DNA, 69 bp, Homo sapiens
ttcaggctgataaatgacagtaattgttcttaagttgaagagctggtttaatatgctgtctggcctggg

SEQ ID NO: 6832357 - DNA, 68 bp, Homo sapiens
gttgaggaactgaagacttttactgtataggataaacaactgacattaaatgtttcagttatctctgc

SEQ ID NO: 6832358 - DNA, 124 bp, Homo sapiens
ggtgatgcaagcacaccttccttcttcaagagttcatcttgagttcctaaccagcagagaaacaatattatatttctttcctctgactgcctaggagagacagtactcttcagtttgcattccc

SEQ ID NO: 6832359 - DNA, 66 bp, Homo sapiens
gctcccaggagtctggatgaggtgtcatttgtttagtgccattccaaatcagaccttctgggtggt

SEQ ID NO: 6832360 - DNA, 129 bp, Homo sapiens
cataccaatcccagggtgggtctagtaggcaggacagagataagctttgactcagtgaaccgagagctgggagaggaggcagaagtttacctctgccttgcttaccagacccaccctgggattggtatg

SEQ ID NO: 6832361 - DNA, 70 bp, Homo sapiens
ctgctgttctgaagcaacaagcaggggtagctgaaggtgacctcgaaccgtgtgttgcttgagatcacag

SEQ ID NO: 6832362 - DNA, 85 bp, Homo sapiens
gataggttagtcagccagtcacagttcctacccagtaaacacttgcagtttatttttgacagaattgtacttcaactggcttatt

SEQ ID NO: 6832363 - DNA, 82 bp, Homo sapiens
ggtgggcagcccaccccagtgtggcttgagacagggagagctgctgccctgctcggggtgcagtgggctcggggtgcccact

SEQ ID NO: 6832364 - DNA, 55 bp, Homo sapiens
ttcctttcttgagacctctctacccatgttggatgaggtcagccataagacggaa

SEQ ID NO: 6832365 - DNA, 67 bp, Homo sapiens
cagacaggtagggacagaacatgagtggcagcaagccagacttggtcttagtgctctaacctgtctg

SEQ ID NO: 6832366 - DNA, 96 bp, Homo sapiens
tcatgggaagtttggtttccagaggacagacggaaagtgccacctgatttgcagtggtattacaactgacttctagggggagccacctgcttgtga

SEQ ID NO: 6832367 - DNA, 65 bp, Homo sapiens
acaacatggcagttatttgtccccagagcaagcaacaccggagggcaaggaagaagccatgatgt

SEQ ID NO: 6832368 - DNA, 57 bp, Homo sapiens
tgaactgtgccagccacagggctcaggggactggctctgttgtgctgagccagggca

SEQ ID NO: 6832369 - DNA, 93 bp, Homo sapiens
aaattcctaattgtgtctactaaatttattttagcattaaacattctttaaatggaagtctggtgagaacataaatagatgtgagagtggttt

SEQ ID NO: 6832370 - DNA, 129 bp, Homo sapiens
ctgtcacacaagatgtctcaaaggctagaagttgagtgattcacacctccgtgtttgaacaactgtgactcacagctctgggtgcaggaggtgggctgtgttgactcaactcttccggcaggcaggtag

SEQ ID NO: 6832371 - DNA, 55 bp, Homo sapiens
ggtggttcacgcctataatcccagcgctttgggaggcagaggcgagtggatcatt

SEQ ID NO: 6832372 - DNA, 87 bp, Homo sapiens
tctgttctcatggaacttgaactctagtagacctcagcggactccactccaggctgggaagaacaggagagaattcaaggaggcaga

SEQ ID NO: 6832373 - DNA, 94 bp, Homo sapiens
gctttcatcattttataatactgccaacaatactgagcatttgatagtgaacaggtctacagttttcttgggagttgtataaataaggtgaagc

SEQ ID NO: 6832374 - DNA, 79 bp, Homo sapiens
gcattattgaggcgataggattactgggtggctataaacacatctgctgcacagctgacatttatcttctacaatgagc

SEQ ID NO: 6832375 - DNA, 61 bp, Homo sapiens
tcaggagcctgaaagaggtctaactaattaaatactaggatttcttgcccctgctccctga

SEQ ID NO: 6832376 - DNA, 130 bp, Homo sapiens
gctgctttcaggtggctttgctgtcaccatttatcgccccattcaaaatgggctgacctgtgcctagaggaggcagcagctccagagccctttgaaccgaacacgcagagcaatcctgaccacttgcagc

SEQ ID NO: 6832377 - DNA, 68 bp, Homo sapiens
ctctggactttaaatctgttgcttagctactgatccacaatagctcccaattgacttgaactacagag

SEQ ID NO: 6832378 - DNA, 68 bp, Homo sapiens
gctctttcccacagtggttgtggcatgtggtcattatgatttctgttttaccactgtggcatcagagt

SEQ ID NO: 6832379 - DNA, 115 bp, Homo sapiens
aagccatgttattactaaatgtgggtttttatcttgtgtattgttgtgagccactgaagggctttaatcaggtaacatgataaaacttacatttttagaaaagttagttgggctt

SEQ ID NO: 6832380 - DNA, 62 bp, Homo sapiens
acatgttggatttcaatggactctccactgaggagcccatttactagggagatctagaatgt

SEQ ID NO: 6832381 - DNA, 109 bp, Homo sapiens
cctattaaaatgcaaatacccttaggagatattagacttgaagtcatttaaatcaagtgtaacttactgtgagtttatttatctgatctgagtagattgctttgatagg

SEQ ID NO: 6832382 - DNA, 74 bp, Homo sapiens
aaagtgaagagatgatggcagccagagggccagaaccttctcaggccacttggaggatgccgcattctgacttt

SEQ ID NO: 6832383 - DNA, 61 bp, Homo sapiens
ctagagacagatagggtgatgagggggattgagtcttcataattaccttgtctgcccatag

SEQ ID NO: 6832384 - DNA, 80 bp, Homo sapiens
ttctcctggagttttcaacatattgaagttacagtattgcagttttactatagtacatacttcaaatgtacttaagggaa

SEQ ID NO: 6832385 - DNA, 65 bp, Homo sapiens
aggaggtgaactctggggccaccctcccagctctgtgctgagagcccacagctcgttcctctcct

SEQ ID NO: 6832386 - DNA, 78 bp, Homo sapiens
ctctcccccagtttcttcctcccccagagaccctatgatctcctccattttcacagaggaggaagctgaggcacaggg

SEQ ID NO: 6832387 - DNA, 60 bp, Homo sapiens
agctgcgatttgtttttgtcctattagctcctgcaaaggacagaaacagattgctgggct

SEQ ID NO: 6832388 - DNA, 95 bp, Homo sapiens
gaggcaactgtggccatttggagcagcagttattccaacaggctgttaattaacctgttcatgaaactgctttcctagtttcgccatagtttctc

SEQ ID NO: 6832389 - DNA, 62 bp, Homo sapiens
atctgggttcctactctgttagctttctgcctggaaaatttgattctttcagggacctagat

SEQ ID NO: 6832390 - DNA, 56 bp, Homo sapiens
gggaggcctgcagcctgggaactgggagacctgggtcccagtggagaggcctcacc

SEQ ID NO: 6832391 - DNA, 108 bp, Homo sapiens
acttcacgcagcccttcttgttggggtggtgacattcaggatatcaatggccatccgcaagcagaacaaggccattccgattgggtgcgctacctggggtgtgtgtgt

SEQ ID NO: 6832392 - DNA, 107 bp, Homo sapiens
cttagttccattggggtttatgcttgtgcaacagccaagatagaagagcaaaaagaaatcttgttggtcatgcataatgtatctgctgccactggatttgggctgag

SEQ ID NO: 6832393 - DNA, 101 bp, Homo sapiens
tccctgaacaccacagttagagaagctgagctgaggcatgttgtttcttccctaacatcactgtccaaagttcagttatcactgtactgcggacactggga

SEQ ID NO: 6832394 - DNA, 58 bp, Homo sapiens
cgcttgttagatgccgttagccattaacctctgctgactccctgggacatcacaggtg

SEQ ID NO: 6832395 - DNA, 72 bp, Homo sapiens
tagttttctttccactccccgtcagttgtgaggtatatgactgcaggcactggagtctgaggaagaaaactg

SEQ ID NO: 6832396 - DNA, 75 bp, Homo sapiens
tctgcagtctcatatttaggactctgccttggctagacaggcagacacttttattctgcatatgagagaggcggg

SEQ ID NO: 6832397 - DNA, 114 bp, Homo sapiens
gtacaaggctgtttgcatccaccatttaatctctgcagctaggattattagttctccctattttacagagagcgaaactgaggctcagtgattaaagtggccacatacttgtac

SEQ ID NO: 6832398 - DNA, 70 bp, Homo sapiens
gcttctaaagagtgactgtgtagctatgattctgaattttatagacatgcaacactttttaccacatagc

SEQ ID NO: 6832399 - DNA, 55 bp, Homo sapiens
gggtgttggggccctgattcgcccatgggccaccgtcagagatgcccaactgcct

SEQ ID NO: 6832400 - DNA, 109 bp, Homo sapiens
caggagagatagagaacggacggaggcagagactccaccttcaggccaaagagcctctggtgggggtcatcttgcccttttccatattccaacttttatctgctttctg

SEQ ID NO: 6832401 - DNA, 61 bp, Homo sapiens
gccaccagcagaacccaccagacagaagctccgtgctctgcctggctggtcactgcctggc

SEQ ID NO: 6832402 - DNA, 56 bp, Homo sapiens
ttcaaaggtgactttgggccagcactatgttggaatcctggtggttaccttttgag

SEQ ID NO: 6832403 - DNA, 66 bp, Homo sapiens
gggacctggtctagcactgagctccaaacaggcagaggggactttgtgccaaacgccagaactccc

SEQ ID NO: 6832404 - DNA, 59 bp, Homo sapiens
ttgaaggccctatctccatatacatttatattcagaggtactggggcttggggcttcaa

SEQ ID NO: 6832405 - DNA, 93 bp, Homo sapiens
gtgaaatccaaggaaactctgtagagtataccaatgtcaatttccgggttttaatattgtatctacttctataagatgttacctggggaaaac

SEQ ID NO: 6832406 - DNA, 93 bp, Homo sapiens
atgttaaactgctgccttagtaaccagggaaatgctttttaaaattttgtatttcattatgttcctggaagagcaaccttgtcagtttaatat

SEQ ID NO: 6832407 - DNA, 69 bp, Homo sapiens
tgagatactgaaaatagctaacaaacctactttattactttcaaaggtcctagctagattgggtactta

SEQ ID NO: 6832408 - DNA, 83 bp, Homo sapiens
gatagcccaaagtttagaagggcagctgttttccctcatccaatggaactaggtagcaagacacctgctttttactttctgtc

SEQ ID NO: 6832409 - DNA, 124 bp, Homo sapiens
catctttagatcttattacgccaatgacatcaggctatgtgtgtccagtgtattatcactcttagtcatctccaatatacaaagctcttgaaggtcaaaacgctcttcttaatatttggtaatg

SEQ ID NO: 6832410 - DNA, 129 bp, Homo sapiens
acattagcctcatctgaggaacttaaaaaacactgatgcccaggccccacctcagtgattctgatttgattcctctgggtggagcctggtcatctgtgtttgaagaatcttcccaagtgaggctagtct

SEQ ID NO: 6832411 - DNA, 79 bp, Homo sapiens
cggacggaggtgtctttgcggcccgccgcgccctggctgcctccggggcggcggggagccggggagagcgcttctgccg

SEQ ID NO: 6832412 - DNA, 72 bp, Homo sapiens
gaagctggtgctcactttcatcattgcctgagttttcccaagcagcttttgaagagtgaggaactaagtttt

SEQ ID NO: 6832413 - DNA, 69 bp, Homo sapiens
cctctctcggcagggcggcgagcagtgtctgtgcatgaggaccagctccaggcccctgctggtgagggg

SEQ ID NO: 6832414 - DNA, 61 bp, Homo sapiens
cttttctgctgtgtaaaatgagggtactactgtataccctgccagcttcacaggaggagag

SEQ ID NO: 6832415 - DNA, 71 bp, Homo sapiens
ctttttgaaaggggagatgtcatgggccctgagatgactgagaggtgcaggactccctttttatcaagaag

SEQ ID NO: 6832416 - DNA, 92 bp, Homo sapiens
tgtttacagagacagattaatttttttcagcttttattttctctttgggagcttagtttacaaatgaagggagctgaagtcttctctaaaca

SEQ ID NO: 6832417 - DNA, 103 bp, Homo sapiens
aggtccaagctcagtttggggtcggagtcagggtcaaaggtcagtttgcggtgaacagtgaacccggccctctaactcctaactccaagctgagtctggacct

SEQ ID NO: 6832418 - DNA, 104 bp, Homo sapiens
attccaaagtgaaaaattgggaaacttttctagttgtagttctctttgaaacaaaagagtaaatgtctaattaggatggtggtcaggaggttaagctttggagt

SEQ ID NO: 6832419 - DNA, 67 bp, Homo sapiens
tggagcaaggagggtggggcctttgatgaaaaccagatgtcttcaaacgccttgcccctcccctcca

SEQ ID NO: 6832420 - DNA, 100 bp, Homo sapiens
gcgcggctcgggggtgaggggtagggtgcgggggtgtcacccgtggagcatccagctgcgtgacaacgccgccccctcccggtgccctgccgagctgcgt

SEQ ID NO: 6832421 - DNA, 124 bp, Homo sapiens
gctttgtgggtgtttgttttattaaataatctgggcagatttcattgagaatataagatttgaacaaagacttggaaaatctatctggaggaagagtagtccagatagagcagataattagagc

SEQ ID NO: 6832422 - DNA, 56 bp, Homo sapiens
tcactgcagaaaacagcaggtgctcatccactcatttgcagtgattcttgcagtga

SEQ ID NO: 6832423 - DNA, 80 bp, Homo sapiens
ttgaccattctgagtgttattgaggcaaaactgtgttaagatgaactgagacagtaatcttagaatctaagaattgtcag

SEQ ID NO: 6832424 - DNA, 80 bp, Homo sapiens
gaaggagccagatggttcccgtctgctgccttgagtcaatgcacttcctcccacagactggagcccttttgccctccttc

SEQ ID NO: 6832425 - DNA, 87 bp, Homo sapiens
tcacaggtatccctgcagggccattgtgcagacggtccccatctggatgacatctgtggctgcgccctgggggagctctacctgtga

SEQ ID NO: 6832426 - DNA, 114 bp, Homo sapiens
tctgcggcttggctgtgcttatttggccaaacaggtcccctcccctaccaggcttcctgctggggccttgggaacaggggggacttctggaccaaatcagacaattgttgtaga

SEQ ID NO: 6832427 - DNA, 97 bp, Homo sapiens
cagctgtgtgggaggaggaggactcctaccctggtcgaagttgagtttcttagctggaggagtttctcctagcccttcaatatccaccacgtcactg

SEQ ID NO: 6832428 - DNA, 72 bp, Homo sapiens
ccagcatctgtcctttccctcacacctgagaggatgggaggagacgaggacagctcagactgcaagtgctgg

SEQ ID NO: 6832429 - DNA, 83 bp, Homo sapiens
tattaaacattttattctcatctccctacttagattctaagcttctattttgaatggtcagatgtggagtactgagtttagta

SEQ ID NO: 6832430 - DNA, 68 bp, Homo sapiens
ttcatcagaatactatcaacagtgataaattctgctgctagtctatatcattgatagaatgtgatgag

SEQ ID NO: 6832431 - DNA, 110 bp, Homo sapiens
tcttccaggccctcttgctcaaaattaccatgtgatcaaaacaaatcctatcgttgtcccagcagggttcattggtcttatgaatttggggacagacagtgcctggggga

SEQ ID NO: 6832432 - DNA, 59 bp, Homo sapiens
cagtcctgttggttccagaggtggcctgtcaccaggcatctggggacatcattaggctg

SEQ ID NO: 6832433 - DNA, 127 bp, Homo sapiens
ttcacactggtcagaagccttatgagtgcagtgaatgtgggaaatcttttgctgcaagctcctatctcactagtcacaggagagttcacactggtcagaagccttatgagtgcagtgaatgtgggaa

SEQ ID NO: 6832434 - DNA, 62 bp, Homo sapiens
gccaccagctccaccagggcaggtggctcacaagccatgacccttacaggtggtgttggggc

SEQ ID NO: 6832435 - DNA, 59 bp, Homo sapiens
gacacagttctgttctagtaggtgacatttcctgctcattactggagaatggctgagtt

SEQ ID NO: 6832436 - DNA, 104 bp, Homo sapiens
tcccattagcaaaagcaaactgtgtatgcagagagcatttctggaaggacagcagagaaacttttaacaagcatgcttcagcggtgtgttggggctggatgggg

SEQ ID NO: 6832437 - DNA, 58 bp, Homo sapiens
agcaggctgatgggcatgcttgcatcaacagaacatgggaggcatgatattagctgtt

SEQ ID NO: 6832438 - DNA, 62 bp, Homo sapiens
accatgggtcagccacctcagcccctttagtataggggccctaaaggtctcttgcccattgt

SEQ ID NO: 6832439 - DNA, 71 bp, Homo sapiens
gggagtcatgaagttagaactatgaggataaatgagtaagtttgtaaaccagaatctggctgcaaattccc

SEQ ID NO: 6832440 - DNA, 55 bp, Homo sapiens
tgattcacgtaataagaaaaaggtgcctgcaggctattgttcctagcgtggatta

SEQ ID NO: 6832441 - DNA, 57 bp, Homo sapiens
gcttttcagctcatcttatcagatacctgctaccttttaaggtgatctcagagaagc

SEQ ID NO: 6832442 - DNA, 62 bp, Homo sapiens
gaggatcctgatttggaggctctgccaccattctgtttggccctcttttggtttggatgttc

SEQ ID NO: 6832443 - DNA, 115 bp, Homo sapiens
actgcttctggcccagtctcctgtgtacttttgtttctaagcctcggaagcttagggatcttttgtggctggatgatggcaaggtgcatggaatatagaaagaggtcaggagagt

SEQ ID NO: 6832444 - DNA, 56 bp, Homo sapiens
ccatttgtgctccctcagagagagtgaggcccctgtctctggaagagtttaaatgg

SEQ ID NO: 6832445 - DNA, 55 bp, Homo sapiens
aaagtcattgctgttatcaatgctgcacatctccagagtggcagcctttggcttt

SEQ ID NO: 6832446 - DNA, 87 bp, Homo sapiens
gggtatgctctcatttactgtagaacagttaggattatttttcacctttcactactctagttttgtagtaaataccctcgtatatcc

SEQ ID NO: 6832447 - DNA, 63 bp, Homo sapiens
ttttccaaaagtttgttctgtgcaatttaagtgccttgttgtaagggagaagaaattggggaa

SEQ ID NO: 6832448 - DNA, 57 bp, Homo sapiens
cacctgcacatccttgagctctagcgatgatatgtttagggctctctgtgtcaggtg

SEQ ID NO: 6832449 - DNA, 57 bp, Homo sapiens
agattgactagaggctaaaatcatatttacgaaagattactggctctcaagtcagct

SEQ ID NO: 6832450 - DNA, 61 bp, Homo sapiens
ctgttgctgaggttcaagggtctaaaacttgctgctctccaggccctggacctatggacag

SEQ ID NO: 6832451 - DNA, 69 bp, Homo sapiens
agcaaggaaagtaggcacggaagctcccaggtatgtgccaagagtgccacctggcctgtgtcctgtgct

SEQ ID NO: 6832452 - DNA, 58 bp, Homo sapiens
cacagttttgcccagggcttctcttgatatctaagaagagcagtgtggggagactgtg

SEQ ID NO: 6832453 - DNA, 66 bp, Homo sapiens
gggtggcatttgctgaagagcggtatgacatgaaaatcaaatccttgagaaaataaatgaccactc

SEQ ID NO: 6832454 - DNA, 55 bp, Homo sapiens
cagcagatttttgagtgacttttgaattgaaggtgaattctaggagatctgactg

SEQ ID NO: 6832455 - DNA, 68 bp, Homo sapiens
gtccaaaagtatcagcctggccgctctgttgacaatagtcagcaagagggtaaggttgaagcaaggac

SEQ ID NO: 6832456 - DNA, 81 bp, Homo sapiens
gtcgatcgagcatctctgacaccatctcatgacagccctacggggtatgtagaagctgctcaaagaagaatttgaatcgac

SEQ ID NO: 6832457 - DNA, 129 bp, Homo sapiens
taagaataacctggggtgtgattttagcaaaatggattcccaggttctggcccctggagattaattcagtaggtctgagtggagccaggcaatctgtactttgtaaaagcttcccaggtgattttgata

SEQ ID NO: 6832458 - DNA, 78 bp, Homo sapiens
ctcctgccctctcagctctgacctcacaggcccctggaaaacgccatctgtcctctgtctggaggctgagagcaggag

SEQ ID NO: 6832459 - DNA, 115 bp, Homo sapiens
ggatgtgggctccagagcaggccctggcagtcagagcacttggctcatggcaggcgggcctcttatgtgtagtgcattgaacgaaggtccctgttctctgccagagcaaacatcc

SEQ ID NO: 6832460 - DNA, 80 bp, Homo sapiens
tttgatttcttctaatacacggtatgactttgctcgtttttcatacaagtagacactgaaatgtattgaagagtattaaa

SEQ ID NO: 6832461 - DNA, 58 bp, Homo sapiens
tgaggggagatcgtgccactgcactccagcctgggagacagtgtgagactccatctca

SEQ ID NO: 6832462 - DNA, 59 bp, Homo sapiens
cttgctttcagtctcggcctcactcagcttctctgtggggctctgggattcagagcaag

SEQ ID NO: 6832463 - DNA, 61 bp, Homo sapiens
ttggtcagtccaatgattgtaggacattacctaataatttcttttatcttggctgatacaa

SEQ ID NO: 6832464 - DNA, 128 bp, Homo sapiens
atcttccttcatcgtcttctattcagacaacttgctgctttcagattctgacataagatatacctacagtatgtgtccagggctggaagtgaggtggctgtgttcttagggaaaatggaagaggagat

SEQ ID NO: 6832465 - DNA, 61 bp, Homo sapiens
gagcagcacacaaagccctcaatgagcaagaaagaacagctcgtaaggcaagtgctgcatc

SEQ ID NO: 6832466 - DNA, 104 bp, Homo sapiens
tggtgttgccattgatagtaatggacaaacttgggaagtatgccattttgagggtgagaatcatgaatccaaagtttactattatagtgttgatgggacaacca

SEQ ID NO: 6832467 - DNA, 73 bp, Homo sapiens
agtatcgtctcttagtcaatattttctggtgacaagaaatccactcaaaataccaccactaggggaggatatt

SEQ ID NO: 6832468 - DNA, 64 bp, Homo sapiens
ctggccagtccccagaaacaacgaggctctgtggactgggaagggctgctgggggttggcacag

SEQ ID NO: 6832469 - DNA, 65 bp, Homo sapiens
cactgagcatgcacccaggaagggttaaccctcaccctatcccttccctaaagcgtcgcttagtg

SEQ ID NO: 6832470 - DNA, 71 bp, Homo sapiens
tctttgtcctgtaacattaggggccgtggttttaatctaaggaattacagtaaatgctacaggcacaagga

SEQ ID NO: 6832471 - DNA, 80 bp, Homo sapiens
gagttgttagggctttagtggggatgtatgggaggctctgataaggctttacatgatttctcaccctggtactaacagtc

SEQ ID NO: 6832472 - DNA, 61 bp, Homo sapiens
ggctgccacaggggagcaggcagagtcagcctcagctttgaagaccttctctttggcagcc

SEQ ID NO: 6832473 - DNA, 64 bp, Homo sapiens
gtggaactggttccctgggctgaccggagccgggagaacaacctggcctcagggagagagacgc

SEQ ID NO: 6832474 - DNA, 59 bp, Homo sapiens
ctcagaagccttcagtcttggcttgcaatcccttatcctcagattagagggctgctgag

SEQ ID NO: 6832475 - DNA, 64 bp, Homo sapiens
gtttgtacagagtttaaacactgtcacagagggtccttagtgttaattttaaactctggctaat

SEQ ID NO: 6832476 - DNA, 76 bp, Homo sapiens
gaggggggtgccctgatgacagagcccgtgtctcctccatcagactgggctcactggggcagggaccgtctccctc

SEQ ID NO: 6832477 - DNA, 76 bp, Homo sapiens
gctgcatgaacatcatttaggacaccactcctgctgtttcctttaaaaggctgacagggtcctaagtttctccagc

SEQ ID NO: 6832478 - DNA, 64 bp, Homo sapiens
gcttgtgtgtctcttgagctgcctgatgcttgtttttcaagtggtctgtaaagagcacgtgagt

SEQ ID NO: 6832479 - DNA, 65 bp, Homo sapiens
aggacaggatgaaattatggagcgttatatttgatgagagccgaatggatgattacatctttcct

SEQ ID NO: 6832480 - DNA, 81 bp, Homo sapiens
tagcaaatgcctggttaattagaaaatctcattcagactacattgtttttgtcagagaatggttagcctgtgtttatgcta

SEQ ID NO: 6832481 - DNA, 64 bp, Homo sapiens
tctagacaactggagatagtctgacttgatccaaagtgatcatctcaggtcatgttgtattaga

SEQ ID NO: 6832482 - DNA, 92 bp, Homo sapiens
atgtataaagtaactatttgtttcttttaataatctctgtgggaaacattactaagagtgtgtgctgagaaacgagaaagtatttaatagat

SEQ ID NO: 6832483 - DNA, 67 bp, Homo sapiens
tctgcctggaccctggtgagctgggaacctgtcacacagtgccctacacgccatggttctcggcagg

SEQ ID NO: 6832484 - DNA, 107 bp, Homo sapiens
tgattgttttgattgtttgataaattggtatatgtgttagcacaagtgtatttattattgcaaggcacaatacctaaaaagccttattgagataattaaaatactca

SEQ ID NO: 6832485 - DNA, 55 bp, Homo sapiens
cacagcccccttgacactctggggctttccagagcagatggccagggggcctgtg

SEQ ID NO: 6832486 - DNA, 85 bp, Homo sapiens
agccctgggcaaattatgttactcatggtttctgagtttccccacatggatgaaggggtgagtagtatacttattgcatagggtt

SEQ ID NO: 6832487 - DNA, 78 bp, Homo sapiens
gagagtttgggtaatatcagtagagtctagagtaagcagaaggaactttactaaagatgttggcctaataaggccctt

SEQ ID NO: 6832488 - DNA, 97 bp, Homo sapiens
attactccgaaaggaccttttgaagataagctattttgatggggttagaattcacatgagtattattttccaaagtaattgtaactttctgagtgat

SEQ ID NO: 6832489 - DNA, 70 bp, Homo sapiens
actgatggagactccactgtgattcactcgtttacttaaaaacatttcagggatgtctgtaaatttcagt

SEQ ID NO: 6832490 - DNA, 64 bp, Homo sapiens
gctctaaaggtcttaatgttaacatacaggtgtctgaatggcaactgctagggctttgtggggc

SEQ ID NO: 6832491 - DNA, 83 bp, Homo sapiens
ttcatttaacaaatcaggaaattgcaacagtctgagctcaaacatataactggtgcttacattgtcttagttttcaaaatgaa

SEQ ID NO: 6832492 - DNA, 87 bp, Homo sapiens
tttggcagtctgggtggctgagctacagcgaagcaaatctgaatctgccatatgcgttgtcctcaggatgctcagagtctagccaga

SEQ ID NO: 6832493 - DNA, 80 bp, Homo sapiens
ccttaccctagccaggtaataaaggtcaacatccatagtgatgtcttgttgatagtatttacccttggtaggaagtgagg

SEQ ID NO: 6832494 - DNA, 97 bp, Homo sapiens
ggaagtgatgatgatgatttgaaaccagtttcttgattttttaagatcataaggtgtctcgtcttcaaatcatttaaatacatccaatgtagcttcc

SEQ ID NO: 6832495 - DNA, 71 bp, Homo sapiens
cagcaatgtgatgtttccctatgtttctacaggccccggtaaaggtcagggaaattcaagggagattgctg

SEQ ID NO: 6832496 - DNA, 112 bp, Homo sapiens
aggcaaacatagtttcactgttctactgcatttcataaattacaataatttatgatttacaatgtgcttatgaaggcagtgatctttagaagagctggctgttatattgcct

SEQ ID NO: 6832497 - DNA, 120 bp, Homo sapiens
gtactacctagatcacagctatggggctgtgagactacaggatctcctgagaaggaagagtccaaagaattgtagtccagatcattcagccatttactagcagagatcttaggtagtcac

SEQ ID NO: 6832498 - DNA, 65 bp, Homo sapiens
tgggtccttgccatcttggagtgaccaaactgacaccatgggggctcttgtgtgcaaagggccca

SEQ ID NO: 6832499 - DNA, 89 bp, Homo sapiens
cagctgggggttttgttaaaacacagattcaaattcagtaggtctgggatagggcctgagagtctacatttctaacaagctcccagctg

SEQ ID NO: 6832500 - DNA, 57 bp, Homo sapiens
gcgttccttaccgcttcccgcgcctgatgcgtgaatttcagggtctggtaggaaagc

SEQ ID NO: 6832501 - DNA, 73 bp, Homo sapiens
agctgctttggcaaaacttgctcttctcctgcaagatccaaaaagagaacctcaagtcctttgccaaagtgct

SEQ ID NO: 6832502 - DNA, 57 bp, Homo sapiens
tcgctttaatggtcttcacagcacgtcgtgtttatgagtcagaggaccctagagcga

SEQ ID NO: 6832503 - DNA, 55 bp, Homo sapiens
gctcagaatgcagttttcttctttctgcagaggttagaactgaatcattttgggt

SEQ ID NO: 6832504 - DNA, 62 bp, Homo sapiens
agaaggctccagtgaatgctggcacgttcagccaggatgcctccgtgaagctggagacctct

SEQ ID NO: 6832505 - DNA, 67 bp, Homo sapiens
ctcttttgagggccagaggaagaggagagtcaggataccttttcctaggggctcttcatttgaagag

SEQ ID NO: 6832506 - DNA, 59 bp, Homo sapiens
gcgtttacggatcatatatgtactgtttccaaaatgtatatgtagactcgttagaatgc

SEQ ID NO: 6832507 - DNA, 92 bp, Homo sapiens
aattgaagagtacatttaggattcattgaaagcctaataatgcaacaccctgcctttctttccagtgaaattttgaatgttgaatttcagtt

SEQ ID NO: 6832508 - DNA, 58 bp, Homo sapiens
aggagtggaattactgggttctgggagatacacatacttagtttcagtaactactctt

SEQ ID NO: 6832509 - DNA, 72 bp, Homo sapiens
tctaaggtccagaagggcatgggatgaaaagtagggctctcttctgctctctcctatctctcaggccccaga

SEQ ID NO: 6832510 - DNA, 106 bp, Homo sapiens
actgcttaacttgtattagggagtctgaagatggaggaacttagaatttgatcaagtaatctaagtgcggccgtttaagcactctcaagttgaatattggagtagt

SEQ ID NO: 6832511 - DNA, 67 bp, Homo sapiens
aggcctctgatttgatcagcaatagggaactggatgtcctctgagctccaaaagtcagcacaggcct

SEQ ID NO: 6832512 - DNA, 115 bp, Homo sapiens
gcagaatgaataaagcatgtaggaagccaatcacttctggaatttagagcactggacaagaatctaatggaaaataaattccacaaaaggttctcttccttgtgtgttatactgc

SEQ ID NO: 6832513 - DNA, 62 bp, Homo sapiens
ggtaaatgtctgttaacatgaatgagctagtatttgtatctggcccatagcagattcttact

SEQ ID NO: 6832514 - DNA, 68 bp, Homo sapiens
cagggcataagatgaggctgtagatgtaggttgaccatatagagtattttagcacatattatgctttg

SEQ ID NO: 6832515 - DNA, 89 bp, Homo sapiens
tgtggaaacaagggaagtttcagagttagtgctggctgagctctcactgcttccagtctctactctgagataataacttgactgcctca

SEQ ID NO: 6832516 - DNA, 77 bp, Homo sapiens
tggctgagcttccactctaagtgtcaaacagatatgtaggcttacatattaattggataattggtgtgatgcttcca

SEQ ID NO: 6832517 - DNA, 69 bp, Homo sapiens
acctcaggatgtggacacagaaatccttggcctttttgttgtgccctgatgtcccaagcattcgcaggt

SEQ ID NO: 6832518 - DNA, 72 bp, Homo sapiens
gctcccacagtaaagaaacaacttcgcctcaggataacctggactgcagttgctattacgtggttaaagagt

SEQ ID NO: 6832519 - DNA, 76 bp, Homo sapiens
agtctttagatagtaaatagcactaagtctaaaagcaaggagataagatttcatgttggatactgtttcaagaact

SEQ ID NO: 6832520 - DNA, 73 bp, Homo sapiens
cccaaactggagcgtgggtccaaggctctggttctatcccagggatcaaagcagcatggcccagtccaatggg

SEQ ID NO: 6832521 - DNA, 82 bp, Homo sapiens
attatttttcttctacctgctgtccaatactgaatagtatcagttattttaagatttgccagtaggagctaggaaaagtgat

SEQ ID NO: 6832522 - DNA, 74 bp, Homo sapiens
atctgcctaacctccagctcctagatcggcgaagtggagtcatcctacttacttcctaggacgtagaagcaggt

SEQ ID NO: 6832523 - DNA, 59 bp, Homo sapiens
tttcgtgactggacaaacttgggtggctttaagccacggccgatgactccagcatggaa

SEQ ID NO: 6832524 - DNA, 63 bp, Homo sapiens
ccaggaggctcagagacctgcgatctgagtggcatttcctcaggccttgtcctgacctcctgg

SEQ ID NO: 6832525 - DNA, 63 bp, Homo sapiens
cgctccaagcttgatgggaccagaaatcctacaaaaagcctttggtcccagcttgcttgagtg

SEQ ID NO: 6832526 - DNA, 79 bp, Homo sapiens
ccccacagattgagctttttcactttggatgggagaatagactctttgatgacagaggaggcaaggttaaaatgtaggg

SEQ ID NO: 6832527 - DNA, 116 bp, Homo sapiens
ccgtgaggctggataggcagcacatgatgcctctggctggcattgctggacttccatgggagggggatcctggcaagtaggggctggtgcttgggagccaatgtccagtgttgagg

SEQ ID NO: 6832528 - DNA, 70 bp, Homo sapiens
tggctcacctgtttgcttcctcctgttcagcgattatttcttattggacggtggaggcaacttggatcca

SEQ ID NO: 6832529 - DNA, 62 bp, Homo sapiens
gctccaggaggatgaccttcctcccatttctttaattaaagggggaccaatcctcttcgggc

SEQ ID NO: 6832530 - DNA, 64 bp, Homo sapiens
ggttttctctgagatgcctttctgccctgatattttgtggttctagaagcattcaaagaaaact

SEQ ID NO: 6832531 - DNA, 61 bp, Homo sapiens
gtaagccactggagatgtcagacaggttcctttcccaatagaacttccattccagtggtac

SEQ ID NO: 6832532 - DNA, 83 bp, Homo sapiens
gataagtgggtcacttcttgggtttgctggggtttcaagtcagtgtaagaaatgaaccttcataaaattaagtgccacttatc

SEQ ID NO: 6832533 - DNA, 55 bp, Homo sapiens
ctctggatatgcactgggtgaggagggcctgcccccacctccaggcatatctgag

SEQ ID NO: 6832534 - DNA, 73 bp, Homo sapiens
tgccccggtggcttatgtccagcagatatttgtgaagtcctcagtgtttccctggcacaagaacctcctggca

SEQ ID NO: 6832535 - DNA, 62 bp, Homo sapiens
gagcaaagcaaggccggaaggaaactctccagaagatgagtaagagctggctttggtgtctt

SEQ ID NO: 6832536 - DNA, 68 bp, Homo sapiens
gcctcatttaaccttagttatgtccttacacgctctttcgctaaagacaaacccactagggttagggc

SEQ ID NO: 6832537 - DNA, 76 bp, Homo sapiens
gccaacctccagctttttagagacatttctggtttgattcacggagtctgtgttgtctagaagagcttgacttggt

SEQ ID NO: 6832538 - DNA, 67 bp, Homo sapiens
tacagttgttttttggttgtgtttctggttggataatccagatcagactttgtgactaggagctgta

SEQ ID NO: 6832539 - DNA, 95 bp, Homo sapiens
ctaatcaatcagcaggagcagcctagagagccactttgagaagaattctgaggctgtctctgggctccacttgaaatcttatcttgattgattag

SEQ ID NO: 6832540 - DNA, 65 bp, Homo sapiens
ggcacttgcttgctgcctttatctctactgccaatgataatgagagttggcattagccaagtgct

SEQ ID NO: 6832541 - DNA, 56 bp, Homo sapiens
aaggaaccatttgtgtgcatgggcatagtatgagccatagtatcagttggtttctt

SEQ ID NO: 6832542 - DNA, 85 bp, Homo sapiens
cttacgaatcttgagcctggtataacgtaaacactcagaaaacactttattgtttacagtatagtaggactcatcccgtcgtggg

SEQ ID NO: 6832543 - DNA, 94 bp, Homo sapiens
agccgctccgagcgtcgggccccgcgccctggccctcctgggtgtagtcccggtcctgcctctgcggggcccgagcccgcccacggcgccggct

SEQ ID NO: 6832544 - DNA, 55 bp, Homo sapiens
ctagggtggttaattatagtgcacttgagtctacttcatgtgctgacagctctgg

SEQ ID NO: 6832545 - DNA, 61 bp, Homo sapiens
tcttttgtgattctttagttacttcaggccatctgggcgtatacgtgcaagtcacagggga

SEQ ID NO: 6832546 - DNA, 82 bp, Homo sapiens
gccgttagacgaagctaaatatcagagcacctactctgccgtatattcttaatagggttcctgtacttagctatgtaacagc

SEQ ID NO: 6832547 - DNA, 69 bp, Homo sapiens
ggctactttcttggtcccatgtttgatttgatatagtttcagctcaacgcatgctccaagaaagaagtc

SEQ ID NO: 6832548 - DNA, 55 bp, Homo sapiens
gatggcaatgctagaaatttaggagctacagctcctctctaacatgaatgctatc

SEQ ID NO: 6832549 - DNA, 67 bp, Homo sapiens
gtaggcacatctatagggacagcaacaccgagaggtaactgtttttaaatagatgagtgttgccaac

SEQ ID NO: 6832550 - DNA, 58 bp, Homo sapiens
cgtgtgtatgcatggcagtgagagagtaaatctctgcaggatgcaaagtgtacatctg

SEQ ID NO: 6832551 - DNA, 58 bp, Homo sapiens
ttcacatttctctgctgtttgatcttaaataagagcaacagactaggagaggtgagaa

SEQ ID NO: 6832552 - DNA, 103 bp, Homo sapiens
ggaggaggtggtccagagttttgtccaatcatagggtaggcagttgcagagcaggaagcatgtggactttggcattggacttggccttgaaccccgctcctcc

SEQ ID NO: 6832553 - DNA, 127 bp, Homo sapiens
gtggggacagaggatggtggcgcacgagttgaggcggctcagggctaaggctgaggggctctcctgtccgaggtccctcaccagccctgggcccaccccgcggggccccacctgtccttggccccac

SEQ ID NO: 6832554 - DNA, 57 bp, Homo sapiens
taggctcacatagcactaagtgtctttgaggcattgcagttgtctatgttgagtcta

SEQ ID NO: 6832555 - DNA, 63 bp, Homo sapiens
ccttaatccagcactcgctgattttaggattagtaaatcttggtttaggatgctggggagagg

SEQ ID NO: 6832556 - DNA, 108 bp, Homo sapiens
ctaagttgaatttcactgacctgaattgcatgtggtataatactaacaaatggttcactattagcatatcatgaatggttatactttatagaaattccatagacttgg

SEQ ID NO: 6832557 - DNA, 99 bp, Homo sapiens
gtttaaagattcagtttgctatcaaagataatgtttccttattctgcagtttaattagcaaggaggaagcattttatctcaaatactgattttctaaat

SEQ ID NO: 6832558 - DNA, 76 bp, Homo sapiens
caaaggaggagtcagttgggctgctttgacattgcatgggcaggcgcttgaagacatcccattggctctagctttg

SEQ ID NO: 6832559 - DNA, 79 bp, Homo sapiens
ggtttttataatggagcctcttttgcaaatcaatataaaattgttagctgacctggaagggggcacggaccggaaagcc

SEQ ID NO: 6832560 - DNA, 84 bp, Homo sapiens
aaagagtccatgtgtatttatccatgtcagattgccccacaaagtatggtaggcagtctctcaggtgatcctcaaagattcttt

SEQ ID NO: 6832561 - DNA, 92 bp, Homo sapiens
gggctggtcctcagagagtgggcccactgccttcagcctgaggtcaagcagcctaggtctgagtcccaggggtaccctctttcctccagtcc

SEQ ID NO: 6832562 - DNA, 58 bp, Homo sapiens
tatagatagactgacgatacaggttccctaacattgccgtcttctcattctgtctgtg

SEQ ID NO: 6832563 - DNA, 59 bp, Homo sapiens
tctctcagaggaagaggcagtgagaaaacaattttacattgtctttaacctctgagggg

SEQ ID NO: 6832564 - DNA, 71 bp, Homo sapiens
cagagccagaagcaagggccaaagtcttctctgagttgtcaagatggacttggactctggctctggctctg

SEQ ID NO: 6832565 - DNA, 65 bp, Homo sapiens
gaggtgggtgctgtcaggcagggaaactaaacatctttccttactctactagctcccaggacctc

SEQ ID NO: 6832566 - DNA, 85 bp, Homo sapiens
aatgaaaggctctttgtattatactgagagtgctcagaagatctttataatcctgtgttaatcagataaaggagagcttagcatt

SEQ ID NO: 6832567 - DNA, 73 bp, Homo sapiens
cgcctgagagatgagacctctcactgaggtgtgttgtcctctcactgaggtgtgtggtcctctcacttaggtg

SEQ ID NO: 6832568 - DNA, 60 bp, Homo sapiens
gggttttcagctgacagcagggcctagtggcaacagtcctgagataggagttgaaggccc

SEQ ID NO: 6832569 - DNA, 57 bp, Homo sapiens
acctgctgtcttgggggaatgcgcctcctgaaaaaagccatttccacggacggaggt

SEQ ID NO: 6832570 - DNA, 76 bp, Homo sapiens
tgcgggccagtgtggaatgtacagagttccccaaatttcagtcattaattttggccatatctatactcagcctaca

SEQ ID NO: 6832571 - DNA, 59 bp, Homo sapiens
cagtactgcattaaatttaggttatggctgtagctatgccaaaataatgtatgtatctg

SEQ ID NO: 6832572 - DNA, 55 bp, Homo sapiens
agtgttatttaggcagtatattttgcttaaaatgtgctttgctggaaatgtcact

SEQ ID NO: 6832573 - DNA, 127 bp, Homo sapiens
gcttaggttcttctttttcacattagagactttcttcaaacttattgtttccttggctgtctgttcatatttaatggtaaggttctacagtgttgagtaaaagctctgggtgcttggtgggtctggc

SEQ ID NO: 6832574 - DNA, 82 bp, Homo sapiens
gcttttgaggcagtgaagccagatctgaaatggacacacggtttacttagggtaaaggactttagtgctccactcaacaagc

SEQ ID NO: 6832575 - DNA, 71 bp, Homo sapiens
aggctatgagcagagacttcaagggcagggccagggaacattcctgaactctgggtctctgctctgggcct

SEQ ID NO: 6832576 - DNA, 72 bp, Homo sapiens
gacagaaggggatctaggatatttcatgaataataataaattcatagacatgtctggttctaaaccatggtc

SEQ ID NO: 6832577 - DNA, 85 bp, Homo sapiens
ttaaaactgacggtcttcattctcatagccctgggaagacatttaggtgttttaatgggggttgcagaagtactctcagttttaa

SEQ ID NO: 6832578 - DNA, 70 bp, Homo sapiens
cctcatcctgaacccattttctgagcacgctgcattcataaatagcctgccaggctttgggcttctgagg

SEQ ID NO: 6832579 - DNA, 65 bp, Homo sapiens
gaaggtgggaggcaggctgctcccatgtggtgagaacagtgggaacagctgggcttccctccttc

SEQ ID NO: 6832580 - DNA, 55 bp, Homo sapiens
acagggaacaggaatatacaaaagtaaaagaaggtttttgtaatgtgttctctgt

SEQ ID NO: 6832581 - DNA, 59 bp, Homo sapiens
ggcatgtggatagcacaggaatggtactgtagataactgaccaggtctatccacaagct

SEQ ID NO: 6832582 - DNA, 60 bp, Homo sapiens
gtgtttcaaacagcaggtctttcatagctgggaaaaccccaagctagacctgctggacac

SEQ ID NO: 6832583 - DNA, 66 bp, Homo sapiens
gcgagctcaggccctggcccaccagccatgggaaggcgggtccgtgtggccccagggcctcctcgc

SEQ ID NO: 6832584 - DNA, 79 bp, Homo sapiens
tgggccgagatgatgcatctgtttaaggctggaaggaagagaaatagaggccttgacaaaaacctcatttcaccgccca

SEQ ID NO: 6832585 - DNA, 61 bp, Homo sapiens
tctgaatagagttgaggatgtagacctgcacagacagtgagggatcctctagcttctcaga

SEQ ID NO: 6832586 - DNA, 66 bp, Homo sapiens
ggagctgtgctgggtgatcaggtgagccccagcctaagcctgctgcctgggacactcaccagctcc

SEQ ID NO: 6832587 - DNA, 61 bp, Homo sapiens
gtggaatttggagctttgtttctagaaacattttctcatgactagtgctccagccttccat

SEQ ID NO: 6832588 - DNA, 90 bp, Homo sapiens
ggaggaggaggaggaggaggcggcagaagttcctgcaccacagaggcccaggcatcctctctgccttgaggttccaaacctaccaccacc

SEQ ID NO: 6832589 - DNA, 98 bp, Homo sapiens
taggctggaatgaagccagaaggcctggggcactatggggggctgaggctggagttagccctccaggcccctggccttctgcgcctgcgtttccccta

SEQ ID NO: 6832590 - DNA, 62 bp, Homo sapiens
tcacagaaacagaatggcacagctgtgcctatatgcccagaaaagccatcgagttttggtga

SEQ ID NO: 6832591 - DNA, 58 bp, Homo sapiens
ccacagctggaatggggtacctgctgggggattctcacagagcagcgttctgctgtgg

SEQ ID NO: 6832592 - DNA, 83 bp, Homo sapiens
gtaaactacgcgttgtctgtaacacactcttcagtgtcgtctgattctgaactgtgtacattgtagataactgatagcaatgc

SEQ ID NO: 6832593 - DNA, 58 bp, Homo sapiens
agatatcaccagttttacatacacttgtgtgtgtgtgtgtgtgtgtgtgtgtgtattt

SEQ ID NO: 6832594 - DNA, 86 bp, Homo sapiens
agccttagactgttaacacgcaggcagttaagaaagagaagtaaacttccatcttgtttaagccgctgttaagccactggtatgct

SEQ ID NO: 6832595 - DNA, 71 bp, Homo sapiens
ccctgcccattgagtgcccgtgagcccctacacagttccagtgattggcacaggaagcctcatgatcgggg

SEQ ID NO: 6832596 - DNA, 65 bp, Homo sapiens
tctgccttatttatgtctgacctggtgcagtactgctgaccttggaaagtttaattgaggctaga

SEQ ID NO: 6832597 - DNA, 63 bp, Homo sapiens
gggggctcacacctccctaagggctcgctaattgaaccccttgggcctgaggttgagaaacct

SEQ ID NO: 6832598 - DNA, 57 bp, Homo sapiens
gagagaagggtagcccattctcccctggccccagaggactcagactatctttctctc

SEQ ID NO: 6832599 - DNA, 63 bp, Homo sapiens
gttgagagttaagcgggctaatgaatggggagcacttgtgttttctccctccttggcctcagc

SEQ ID NO: 6832600 - DNA, 92 bp, Homo sapiens
agggaactgcgtcttatagtcttacacttacctgtccattgaatgtagacttccccaggaagggagtgtgatcttggataagccagttctct

SEQ ID NO: 6832601 - DNA, 76 bp, Homo sapiens
aactttctctggatggcttcctccaataaacaatatcttacaatgtgagttaacaggaagccactgaatgaaagtt

SEQ ID NO: 6832602 - DNA, 77 bp, Homo sapiens
tattttgtggcacagtgctggatggtgctggctcccacaggtgacacagtcatcaccagtacagtgtgcaggagata

SEQ ID NO: 6832603 - DNA, 83 bp, Homo sapiens
ggagtgtgcagggaagggttaggtcacgctgcctggaatcctgggagggagccgggctgaggctcacccttcacccacattcc

SEQ ID NO: 6832604 - DNA, 78 bp, Homo sapiens
tcctttccatttttagcacctctcaaggagaatggtttatggaacttgggagcaggaagcaggaagtaggaaacagga

SEQ ID NO: 6832605 - DNA, 69 bp, Homo sapiens
tctggctgaggtctgctcaagtccctggtaaacggctgggaagtccaggggttggctgcttctctcaga

SEQ ID NO: 6832606 - DNA, 85 bp, Homo sapiens
agagagcttaaagagtatttaatataatgcaggcaaattttttaaaagcccttattatttagaagaaatctttttaatgctcttt

SEQ ID NO: 6832607 - DNA, 62 bp, Homo sapiens
gctgtgcatcttcattctggaccctggtctttgctacaggggctcagtgatgtctgcagagt

SEQ ID NO: 6832608 - DNA, 66 bp, Homo sapiens
ggggagggcacgaaacaaccacttctggaggcattcatccaaggagggttacactgtgctctctcc

SEQ ID NO: 6832609 - DNA, 57 bp, Homo sapiens
agtgtttcttctcacacaaactcacctggatgtgagtcctgtaggatggagagcatt

SEQ ID NO: 6832610 - DNA, 86 bp, Homo sapiens
atcagaagcaaatgcaggattaacagctttggagaccacctttttaacccagagagcatagctgtatgtttttaatttgttatgat

SEQ ID NO: 6832611 - DNA, 65 bp, Homo sapiens
gaggcggcggatcacgaggtcaggagttcgagaccagcctgaccaacgtggtgaaaccctgtctc

SEQ ID NO: 6832612 - DNA, 60 bp, Homo sapiens
ctgcaccattaatttatgtgagaatgtgttaacagcattttcaatggctgatggatgcgg

SEQ ID NO: 6832613 - DNA, 73 bp, Homo sapiens
gtagagatgggtgtcaccatgttgctcaggctgatctcgaattcctgagctcaagtgatctgcccaccttggc

SEQ ID NO: 6832614 - DNA, 72 bp, Homo sapiens
ggcctctgggctcaatctgcttctgtttactaactctcctagaggcagaaagacagagtgagcatccaggcc

SEQ ID NO: 6832615 - DNA, 72 bp, Homo sapiens
aagtcaactaggtggttctatctcggcctctcagaatgcctggtacctcagcttggacagcttggttgactt

SEQ ID NO: 6832616 - DNA, 111 bp, Homo sapiens
tcctggggagttcttcatgccttccggctgccagcccaccttggggcctccacgttcagatttgggagaggcctcagtgagggctgggagggaggaagaggatgcccaggg

SEQ ID NO: 6832617 - DNA, 60 bp, Homo sapiens
tatggaactataaaccattgtcaactttaacacacattaggtagactttggagtttcata

SEQ ID NO: 6832618 - DNA, 62 bp, Homo sapiens
ctattcattaatttccaggcactgtgctgggaaacagcatagagcaggaagttaagagatag

SEQ ID NO: 6832619 - DNA, 100 bp, Homo sapiens
atctggactagaacatattactcatgtgactatattctctggtttccaggctatagaaaattgtatcacacgactatgctttgttctctgaaaaacagat

SEQ ID NO: 6832620 - DNA, 70 bp, Homo sapiens
caggaaaacaataaacgtttaagtatcgtccatgcattacttgggacatactgaaactgttgtttatctg

SEQ ID NO: 6832621 - DNA, 63 bp, Homo sapiens
ggctgatgcagggttgagaggagctggtttcctccttcctctctcatccttgcaggcttagcc

SEQ ID NO: 6832622 - DNA, 68 bp, Homo sapiens
ttggtctgtatgccttggtgctagaagtgataagacttaggtaatggaaagccagagcatatctccag

SEQ ID NO: 6832623 - DNA, 130 bp, Homo sapiens
caaaacctgatatgtggcaaaatactgaaagaatgcagaagactgaaaagctgaagtcctcttcttccccagagctgcttctgtcctttgaaaaacattctgtacatattcaaggcatattaatctcttg

SEQ ID NO: 6832624 - DNA, 61 bp, Homo sapiens
tcattcaagatttcaatagatttttagaaaaatggaaatcatatgcaggagttgtgaatga

SEQ ID NO: 6832625 - DNA, 78 bp, Homo sapiens
aactttcatgtgtctaaagatcatttagtatgcttattccaaatgcagataaattgctgattttagatgctttgagtt

SEQ ID NO: 6832626 - DNA, 68 bp, Homo sapiens
ggtgtgctgaggctagacctggaagtgtagcacatcacttccacttacattctagttatcaggccacc

SEQ ID NO: 6832627 - DNA, 56 bp, Homo sapiens
ctctctgatgtcaggtcgctgaatacaacttcagtggcctaaagcttctagagcag

SEQ ID NO: 6832628 - DNA, 70 bp, Homo sapiens
tggaaataatggcaccaggcagctgagtggtgccacctcaccattaggctctttgtgctagttataacca

SEQ ID NO: 6832629 - DNA, 63 bp, Homo sapiens
gagttggctgttcgaaggtagcttgacatctggctacctaccatttgtggacagctcaaactc

SEQ ID NO: 6832630 - DNA, 116 bp, Homo sapiens
agcgtctctgccttagaacattccttttcttctttatgcagcctgaaaaaccaggagttaaaaatgcctccatggagattgaaaagggtaataatgttgggaaacagagttatgct

SEQ ID NO: 6832631 - DNA, 67 bp, Homo sapiens
tcctaaggctagtgcctgactgggttacattactaaatgaagttggtgagtaggctggcttgaagga

SEQ ID NO: 6832632 - DNA, 55 bp, Homo sapiens
gcagtagtcgctggagatgagggtccttgtgccctttctttggggtgaccactgt

SEQ ID NO: 6832633 - DNA, 69 bp, Homo sapiens
gcagttggtagcaggcaagctttctcctgggtgtcgccttgaaaagttgcaaaattgctcttcacctgt

SEQ ID NO: 6832634 - DNA, 59 bp, Homo sapiens
gcccaggatctgctcagatcataggcaaccttgaagcactcagcagttccgctttgggc

SEQ ID NO: 6832635 - DNA, 129 bp, Homo sapiens
gcatcctgtggctcggccgggtccacgggggtcagcgccggcttgaggcaggcggcaggcagctcgccttcgcccagctccaggctggcctgcttgctgctgaaggagtcccgcaggctgagcagctgc

SEQ ID NO: 6832636 - DNA, 57 bp, Homo sapiens
ctcaccttgtgatccacccgccttggcctcccaaagtgccgggattacaggcgtgag

SEQ ID NO: 6832637 - DNA, 64 bp, Homo sapiens
gttgtgaatagtgccgcaataaacatgcgtgtgcatgtgtctttatagcagcacgatttataat

SEQ ID NO: 6832638 - DNA, 60 bp, Homo sapiens
agttgtgataacagaattcactctaccttctttaggaagaaaggattttgttacaagatt

SEQ ID NO: 6832639 - DNA, 70 bp, Homo sapiens
agagagcagtctttatttagagttaggactgaaactttttaggcctacctagtttaaggaagtgctccct

SEQ ID NO: 6832640 - DNA, 55 bp, Homo sapiens
gcctgctccggagagggaagcattgtgtgcagctcaggattctcagggcagtagc

SEQ ID NO: 6832641 - DNA, 82 bp, Homo sapiens
gctgacctctgttagtcttcttgccacatgttgctggagccagaacagaggccctgaggcatttaggcagataacagacagt

SEQ ID NO: 6832642 - DNA, 90 bp, Homo sapiens
tatggagttagtgagaatgttgtcagttgcagggagaatggataagggcattgcattaaggtaattgtataatattgcatttcctccata

SEQ ID NO: 6832643 - DNA, 73 bp, Homo sapiens
ggtggtggggtcgtaggtgcccgccaggtagtagaggtcctgccggtcctggcacttgcggctccgggccatc

SEQ ID NO: 6832644 - DNA, 61 bp, Homo sapiens
ttgttgtatgactctgtgaggagaagaaacaaaccatttttcctctgctctcataccacaa

SEQ ID NO: 6832645 - DNA, 59 bp, Homo sapiens
aaggaggaaaatattgttgctgttacctctttattaaagcaaagcagtgcatcctcttt

SEQ ID NO: 6832646 - DNA, 61 bp, Homo sapiens
caggacatcttctgtgtttttactgttggagtctcagaaaaacaaatctttaggtatcctg

SEQ ID NO: 6832647 - DNA, 55 bp, Homo sapiens
ccagccccgggccttaccgtgcgcggggcagccccggcaggcccagtcgggctgg

SEQ ID NO: 6832648 - DNA, 60 bp, Homo sapiens
gcaggcaaggaacagagactgtgcctctcccccaccattcacctctgaggccttgcttgc

SEQ ID NO: 6832649 - DNA, 63 bp, Homo sapiens
tccattttcttgctctaggtaacctctggaatgaacattacagagatagagcaaggaagtgga

SEQ ID NO: 6832650 - DNA, 102 bp, Homo sapiens
ctctaaatctgctgctgtttcctgaggcacaatcctagaattgtgaaaattgttgatccaatttagatgagagagtcttataaaacagcagcacattttaag

SEQ ID NO: 6832651 - DNA, 130 bp, Homo sapiens
tctttttttttttttttgagacagaattttgctcttgtcgcccaggctggagagcagtggcatgatcttgcctcactgcaacctctgcctccggggttcaagcaattcttgtgcctcagtctctagaaga

SEQ ID NO: 6832652 - DNA, 77 bp, Homo sapiens
tggcatctgctattcagctgcttttgtgatgctgcaaacagtgagatggtacgattagagatgaatgcatgatgtta

SEQ ID NO: 6832653 - DNA, 86 bp, Homo sapiens
taaaggtcatggcattgggctttatgtaggggaagaagaaaagttgtatctgtttgctctggaaaaagccctgggtctggagtttg

SEQ ID NO: 6832654 - DNA, 57 bp, Homo sapiens
tgacaagatagattgagttttacatcagtaattgacactcgagtgtctattttgtta

SEQ ID NO: 6832655 - DNA, 58 bp, Homo sapiens
gaagttacccatagccggaatttgctcagtatgctttctgtcttcttgggtgtatttc

SEQ ID NO: 6832656 - DNA, 70 bp, Homo sapiens
ggggataaaattcagtgtctggcactgctgttggtgaggctgcggactgctttggcactgaagggttttc

SEQ ID NO: 6832657 - DNA, 76 bp, Homo sapiens
aagccaatgagattcaattccaacttttcctaaatgttggagaagtatctaagttgtgaatagatctgattggctt

SEQ ID NO: 6832658 - DNA, 60 bp, Homo sapiens
ctcactatgctatggctgccttcttttatagtctaggaaaaggcagaagcatggaatgag

SEQ ID NO: 6832659 - DNA, 64 bp, Homo sapiens
cttcccagacaatggaaagcccgaatcaacaataacaatttttgtgggcagattccatggggag

SEQ ID NO: 6832660 - DNA, 78 bp, Homo sapiens
gtcatgctgcacatggcctttatctcagtgtctgtggaacttcccgattggaagagttaaggccactgtcagtatgat

SEQ ID NO: 6832661 - DNA, 73 bp, Homo sapiens
gaaaggtccccatctaagctgatgacaattagaagtactattattttcaagacgttaagtcagcttacctttc

SEQ ID NO: 6832662 - DNA, 78 bp, Homo sapiens
taactgggaagggacgccagtgcctctctatgaggtccagacagcctggccaggcatgccattgtgtcccccagcttg

SEQ ID NO: 6832663 - DNA, 66 bp, Homo sapiens
tgagtttcttgatagagtgctttcagagttttgagtaacctgaaacatcttctgtaaataggctta

SEQ ID NO: 6832664 - DNA, 88 bp, Homo sapiens
ctatctgcattatatttgtacaattagcagaggctaaaagaaacttgataatttcttagtttggtgaattgaaatataagcatattag

SEQ ID NO: 6832665 - DNA, 64 bp, Homo sapiens
cagcagatgccaagttgtagtcttgagtgaggtgaactcggactcacaaagcaggatcatgttg

SEQ ID NO: 6832666 - DNA, 60 bp, Homo sapiens
ggtgatagaaaatgctgtcaagctgattcatgaaataatattagcatacagctctatccc

SEQ ID NO: 6832667 - DNA, 129 bp, Homo sapiens
ccctgcagatgggctacgcgcagggcgccaaccagagcggccaggtctttggcctgggccggcagatatacgaccccaagtactgcccgcaaggcccagtggccgatggggctccctcgggtgcaggcg

SEQ ID NO: 6832668 - DNA, 69 bp, Homo sapiens
ttccaattctcctacaccattagaagttctggggacaagcacctgcacagtggaggaaattagttggga

SEQ ID NO: 6832669 - DNA, 59 bp, Homo sapiens
ggagatgtggaagaggtagagatggatggatactgaaaatacaaattttccatgtttcc

SEQ ID NO: 6832670 - DNA, 78 bp, Homo sapiens
ggaattttaccccaataactgtaactttctgtgtaccacaaaaacttactcagtagtttggttgttggaaaaggtcac

SEQ ID NO: 6832671 - DNA, 63 bp, Homo sapiens
ggtttcaactcagctagtaaggactgtcctcttaacagaactttgccaatagccagttaagcc

SEQ ID NO: 6832672 - DNA, 67 bp, Homo sapiens
aatgctctctgcttttcttccaacagagttggcaagtgattctgcaggaggtactgtagctggcgtt

SEQ ID NO: 6832673 - DNA, 56 bp, Homo sapiens
acaggggagactggaatctaacatctttactgatgtggaatcacagccttctaggt

SEQ ID NO: 6832674 - DNA, 69 bp, Homo sapiens
ggcaaattcaatgatcactggctcaaaacacccccaagtggcatcctgagcaggatggtttaattttct

SEQ ID NO: 6832675 - DNA, 56 bp, Homo sapiens
agacactgaatcagagggacatcagcctgcagcatgctgtcccagactccgtgtct

SEQ ID NO: 6832676 - DNA, 68 bp, Homo sapiens
ggggtggggaacactgtgtaagggcaggggtagcaactttcctccaggatacctgttcctatatcccc

SEQ ID NO: 6832677 - DNA, 58 bp, Homo sapiens
actgtgatgtttgtgatcatctcctaggtgcctggtagtttgatcaagatagtacagt

SEQ ID NO: 6832678 - DNA, 122 bp, Homo sapiens
caagtttttttagcagaggagtgacacgttcagatttgcattctagaaaaatttctgtggtcttagcaggagaaaggttttagaagcagatggatcagttaaaagattgctatagaaatttg

SEQ ID NO: 6832679 - DNA, 68 bp, Homo sapiens
gatggaaggctgagtgctcccctagatgtcttcaggctcttgaggcttgcattcacgtgggttccctc

SEQ ID NO: 6832680 - DNA, 117 bp, Homo sapiens
tcagaatggaaggggtggggaaaagcaaacaggagaagagctgtcaccaattctaatgaaagaatccaatactcaagttctactgtctctgtcttcctctttatcctttcatcttga

SEQ ID NO: 6832681 - DNA, 74 bp, Homo sapiens
ggtagaaaaaagaggagtggtttatgacaagtggaatccaaatgtcattcaagtggctccagttcctttctatc

SEQ ID NO: 6832682 - DNA, 95 bp, Homo sapiens
aaagttgcatgacattgtgaatgtacaaaatgccactgaattttacactttaaaatgattgatgaattttgttatgtgaatgttattacaacttt

SEQ ID NO: 6832683 - DNA, 64 bp, Homo sapiens
tgtgtcctcttacctctgaccccagagcatgtttgctgtgggctggatggagctgaaggacgca

SEQ ID NO: 6832684 - DNA, 59 bp, Homo sapiens
tggccagcagagttcactctctacctgatcctttagagaaaagctgtccctgttggcca

SEQ ID NO: 6832685 - DNA, 98 bp, Homo sapiens
agaaggtgcaacttttcttaagtatttcagagactgatgatttatcagcttcgccttcattagatttatatggtacataggatttgtttgtcacttct

SEQ ID NO: 6832686 - DNA, 55 bp, Homo sapiens
cagggaagggtctgtcttcactgagtcattgccaatgaaggtgactcctttcttg

SEQ ID NO: 6832687 - DNA, 58 bp, Homo sapiens
gctgtagtgaatggccgcgttctggccctggtcccggtccgtggcctgcactcgcagc

SEQ ID NO: 6832688 - DNA, 99 bp, Homo sapiens
ctgtgtatctcatttctgctgatgtgtggtgcttcataagatggggacgttaagcatgcagcaactacagtcatttgttctcagaggtgagtgttgcag

SEQ ID NO: 6832689 - DNA, 72 bp, Homo sapiens
tctggacatctgctcctggcccccaccctcagtggtcagctaggcacgtggcgccaggagtgagtttgcagg

SEQ ID NO: 6832690 - DNA, 56 bp, Homo sapiens
gtccatgattctgtgtagtagatgttatcatacatttatacatttatttcatggat

SEQ ID NO: 6832691 - DNA, 119 bp, Homo sapiens
gagctggctggttggcagaggatggagaacagaggctaggggccaactataccgggatgggtcgtgggacctctgtaagcctcagtttcttcatcataaaattcagagaccagaagttc

SEQ ID NO: 6832692 - DNA, 85 bp, Homo sapiens
tgggaggaggtgtagaaatagtgatttgtggctaacagttaagaggacatgttagaagttaatcactaatttgttacctttccta

SEQ ID NO: 6832693 - DNA, 124 bp, Homo sapiens
tctctagactgctaatgggttttgcatgttggcaaggatacagcagaataaataataactaaaaatccatgttgacctgttgtcttcattgtcatatcaaaataagattttagttttttaaaga

SEQ ID NO: 6832694 - DNA, 58 bp, Homo sapiens
agggtgtacatttgttggtgaaggattgattcatctcccatcaacaccttgtcagcct

SEQ ID NO: 6832695 - DNA, 70 bp, Homo sapiens
ttgaatagtatcccagtttgcagccaagggattatattcagccaaggctgcaaactgggacactattcaa

SEQ ID NO: 6832696 - DNA, 85 bp, Homo sapiens
ggggcagggctctgacgcctcttccctgctgcactgtgcctgatggtgggggaaggagacagggaagggcgggatgttctgctcc

SEQ ID NO: 6832697 - DNA, 87 bp, Homo sapiens
tttcttccccagtggactttaaaatgctagaacaggggccattttgcaccctgttctagtctttacagtgaaagggacaaatagaaa

SEQ ID NO: 6832698 - DNA, 59 bp, Homo sapiens
ttgaagtcctagcccctggtaaatgagaatgtaactttatttggaactagggtctttaa

SEQ ID NO: 6832699 - DNA, 59 bp, Homo sapiens
gacagatcttgactttgcagcagaacgaaggttgtgctcactctaaattaagatgtgtt

SEQ ID NO: 6832700 - DNA, 64 bp, Homo sapiens
cagtgcaattacaagctaattcagtgctctttgtgttggactaatagcttctgatttgctgctg

SEQ ID NO: 6832701 - DNA, 60 bp, Homo sapiens
ggcgcagtagcggggcccagagcatacaagggattgggctttggcttctctgctgcagcc

SEQ ID NO: 6832702 - DNA, 64 bp, Homo sapiens
caccagatgaaaggacatatcaggtgtgttcctctaacactattttctgtattttcattaggtg

SEQ ID NO: 6832703 - DNA, 64 bp, Homo sapiens
tagcacatctggcgcttataggtgtcatggttcattgtcacgactataagtgacagatggacta

SEQ ID NO: 6832704 - DNA, 63 bp, Homo sapiens
ctctggggttcacactcagactactaaactctgttgcctgtagtagcttgaagaactccagag

SEQ ID NO: 6832705 - DNA, 63 bp, Homo sapiens
tctattttgtaaggtctcagtaggatttgtacaattgcattatgattgagcattacaaataga

SEQ ID NO: 6832706 - DNA, 70 bp, Homo sapiens
tgcatgacctgagacagcgctctgtacagattagtgtttctgttgacagaatgagctcttagtctctgta

SEQ ID NO: 6832707 - DNA, 74 bp, Homo sapiens
tggggagtgatgcctcggataacacacccaacaagttccccaccatggcactgatgtcccaggtagcgccccca

SEQ ID NO: 6832708 - DNA, 76 bp, Homo sapiens
gggctccctcaccaccatcacatgacacaaaccaaaaaagaggtcttcaagcatgtgctgagtgctggggaagtct

SEQ ID NO: 6832709 - DNA, 118 bp, Homo sapiens
ccttatgtaacagaaacaatcatttaagccttctaattttgtcaccaggccttgggaaaaatatgggttggtaaaatattacaaggcacttgaacctattgggtccgaaatataaagg

SEQ ID NO: 6832710 - DNA, 74 bp, Homo sapiens
tgctctcctggaggccacatgaacgctgcgccacttttctggctcacatgcagtcgagtggtttcctagaagca

SEQ ID NO: 6832711 - DNA, 88 bp, Homo sapiens
accagcagttcaatgcttttagcttcagcttgcccagaaacaaaccttgagggcaagttgtttaggaggtgttgtagatgttgctggt

SEQ ID NO: 6832712 - DNA, 62 bp, Homo sapiens
ctgcatgcctcctgtgccactgtgatgtctgatgcagtagtgagaacacagcgggcatgcag

SEQ ID NO: 6832713 - DNA, 79 bp, Homo sapiens
gtggccaagcttgtttctcctgggggtgctcttccgaggatatctgggctgcctccggagtcgcagtgtcttgggccgc

SEQ ID NO: 6832714 - DNA, 57 bp, Homo sapiens
taaagtgtgctctgttgaaatgtatcattctgtgctgccaggagagcatgcactttg

SEQ ID NO: 6832715 - DNA, 107 bp, Homo sapiens
cagccacatctaagtgtctcacagaggtgagtatacactcctaagggtatatacttctgtatttttgaagagttatacacacttctgtgaatcttttgtagtgtatg

SEQ ID NO: 6832716 - DNA, 84 bp, Homo sapiens
gctgagcggccacgagcagggctggccgggccgccattaatgattaacttggggcctgggccttgacctcgtgggcctctgagt

SEQ ID NO: 6832717 - DNA, 103 bp, Homo sapiens
ttcactgtcagccagaagagccatcatcttgaaaaatggcaccaaaattaaaaaccaatagtcaaatttcagttggaatgagctctcctggcataatgatgaa

SEQ ID NO: 6832718 - DNA, 70 bp, Homo sapiens
acaaccacttcagcttgctaaaagggcatctcctctctatacagtgatggtgcccttaggttctggttgt

SEQ ID NO: 6832719 - DNA, 129 bp, Homo sapiens
ggcctctgccagcccttgcagctgcagcccatccctgggccatgtcccctccatcgagtgcccggtgcttgggggaggagggcagggacagggagggagccacagtcagtgcccgggaacctggaagct

SEQ ID NO: 6832720 - DNA, 73 bp, Homo sapiens
atatgactattctggatctgaatgtgaatagctgatatctgctctgcacaaaactgtcgcagaatgggcatgt

SEQ ID NO: 6832721 - DNA, 84 bp, Homo sapiens
gaagcttacttggaagactcaacattattcataaaactattagtattgagaagaatgtgttgagtttcaaactctaagtttatc

SEQ ID NO: 6832722 - DNA, 101 bp, Homo sapiens
gcagcaatttttcttcttattctttctttgcaatgaagctgagaataatgcccttaggtttttctcactatgtatgtagattggaagcaggaaggagctgc

SEQ ID NO: 6832723 - DNA, 86 bp, Homo sapiens
tggcacagctgtgaagcaagcactctagttagtgtcttttcccctcatctttgctgacctccggaggcatgcttcatgctgctcca

SEQ ID NO: 6832724 - DNA, 60 bp, Homo sapiens
aggtgaattgattgactctgggttatattactgagcactgggaatacaagttattcacct

SEQ ID NO: 6832725 - DNA, 68 bp, Homo sapiens
agacttgggtgtcggggcagtctgggcaggaggaggacactgaaggatgtctcccagcaccaaagtct

SEQ ID NO: 6832726 - DNA, 61 bp, Homo sapiens
ccctaggccctggggtctgttaaattgttcaagttagtcaatatccaccaggagcccaggg

SEQ ID NO: 6832727 - DNA, 83 bp, Homo sapiens
agcacttttgtcattgagaaaataagtatggataaatattgattgtttttctggaaaatgctttcttatttcaaaagtcagct

SEQ ID NO: 6832728 - DNA, 71 bp, Homo sapiens
gatatcatagtagactgactggtctttccctccgagggacaacgtgatcagttagttactgctaagatctc

SEQ ID NO: 6832729 - DNA, 85 bp, Homo sapiens
ctgcctggaagacttggaagacggaaatctgtagatagtctgcaactatttatccacccatttctgcttacataggtcatggcag

SEQ ID NO: 6832730 - DNA, 65 bp, Homo sapiens
cagtaaacaagaggcatgatcttataatttagcttagcataaaatagcttatgtcttttgaactg

SEQ ID NO: 6832731 - DNA, 73 bp, Homo sapiens
tgattgaaatagatacagaagtatgattttcatatcaccttggggatacataaaaatgtgctctatccaatta

SEQ ID NO: 6832732 - DNA, 61 bp, Homo sapiens
gaagatgttatggagagctcagacttctcatggaagccttcttgctatctctaagatcttt

SEQ ID NO: 6832733 - DNA, 100 bp, Homo sapiens
gaagtaaaagataatgtcttattatcatgagttcagcaagtttcacacattgcatttggcaattatattggttaactctgtgtgtcaagacagtgacttc

SEQ ID NO: 6832734 - DNA, 68 bp, Homo sapiens
agcaggcatgattagatcactgttttacagctaaagaagctggctgacagagatttaaaagtggctct

SEQ ID NO: 6832735 - DNA, 76 bp, Homo sapiens
ttgggcttctttcgtctcggaagtcttctcttgaagagaagactttaagccgagattaggatgaagtgagggccag

SEQ ID NO: 6832736 - DNA, 112 bp, Homo sapiens
ggcacacttcaggtctgcatcctttataaccaaggggatgagctaaggtgaacgtctattctacgatggttcatcttttggggattctgggctgtcttttttgaagcttgct

SEQ ID NO: 6832737 - DNA, 87 bp, Homo sapiens
attgcctagccatgtctctccaagcctgggagagccatctgtggccaaaactgtcctctggcctttcccaggacacgggcaggcagt

SEQ ID NO: 6832738 - DNA, 118 bp, Homo sapiens
gagtttgaaacagagaatacctgagttccaggttctcctcaggctgctcacacttgtcttttcagaaagaccagccaaactgagggatcctgttgagctattttctgaattcttactc

SEQ ID NO: 6832739 - DNA, 63 bp, Homo sapiens
agtttttttccctaactttcctgattgttttggaagggagcagggaatagcggaaagaatact

SEQ ID NO: 6832740 - DNA, 57 bp, Homo sapiens
taaaaggccctgggcttggtgtctgttcagctctcgcacattccatgggtctattta

SEQ ID NO: 6832741 - DNA, 75 bp, Homo sapiens
tgagtacagtaaaggctttgagaagtcctgcagcgaagaaacttgtttaatgtagcattttctcaagcttattca

SEQ ID NO: 6832742 - DNA, 72 bp, Homo sapiens
ggctgcgtcgagacagcctggcaccccaggggtcaccatggaggccttgccctgctgtggctctgcccagcc

SEQ ID NO: 6832743 - DNA, 86 bp, Homo sapiens
ggaagcaggaggtctggatttcagttctaaatctctagatctattactaactggaggtatggatagagtcaggaaaattttcttcc

SEQ ID NO: 6832744 - DNA, 104 bp, Homo sapiens
tcacattcttatgcagtcactgaggctagtataaagagcatgatccatttggcgaatcagatcaagttctctaaagtccagtgtcacagcacaagataatgtga

SEQ ID NO: 6832745 - DNA, 64 bp, Homo sapiens
tgtgtaaagcttgttccagaaacagtgagaaaaccatttggattggagcttaaggtttgacata

SEQ ID NO: 6832746 - DNA, 61 bp, Homo sapiens
acctgaaccaggatgggagtagcgggagttgtgagaggagcttgcattctggatctatggt

SEQ ID NO: 6832747 - DNA, 65 bp, Homo sapiens
ctagaagtgcaagatcaaggtgtcaggaggtttggtttctcctgaggcctctccttggcttgtag

SEQ ID NO: 6832748 - DNA, 59 bp, Homo sapiens
ttgctcttggctaatacagtatgtcactagacatagtactgcctggggccagagagcgg

SEQ ID NO: 6832749 - DNA, 119 bp, Homo sapiens
cagggctaaccaaaatgatttgaatgctagatcccgtaaagcatgggttatgctttggctctggtctttagcaccatcacagctgtatgtctctgttctgcattcagattttattcctg

SEQ ID NO: 6832750 - DNA, 78 bp, Homo sapiens
ttcgtgtgacactgccgggcagctgccttggcatgagccttctctgtccaagaacagactgccaggcctgaacacgga

SEQ ID NO: 6832751 - DNA, 85 bp, Homo sapiens
agattacttccaatagtgtgaccttatagttgatgctacaattaataactgtgattattttcatattgttttaggtgtgtaattt

SEQ ID NO: 6832752 - DNA, 76 bp, Homo sapiens
cagtatgcttgggactccctgtagcagtgcctggaagatggtatgttttgctgctgcaggaattctcaagggactg

SEQ ID NO: 6832753 - DNA, 71 bp, Homo sapiens
tgggtctaaatttagagtgttcactctgagctgatgtaataagctcaaagaatattcagaatgaagaaaca

SEQ ID NO: 6832754 - DNA, 67 bp, Homo sapiens
tagtattcttcaaagagtgtcaaagttcatgcatgatgaagaaagactgaggcattgaaggaaacta

SEQ ID NO: 6832755 - DNA, 79 bp, Homo sapiens
tcagagcccaggatgatgaggccatgaggcaggggacgccagtactttgcctcacaattcatccataacagggctttgg

SEQ ID NO: 6832756 - DNA, 79 bp, Homo sapiens
agttttctaaatactagccttcagattttagaattgctgttgtaagagaagattctgaaggactagtttttacaaaact

SEQ ID NO: 6832757 - DNA, 60 bp, Homo sapiens
gccaaggccctgtctgttttactttctgaaagagccagtctgagagatggatgggttggc

SEQ ID NO: 6832758 - DNA, 56 bp, Homo sapiens
attttatcaaggtcttgctgggatgcttgtcagtttccaaaatgccttgatatgat

SEQ ID NO: 6832759 - DNA, 57 bp, Homo sapiens
gagggagtgactcaagagttgcacatcccaagagacagcccttaagagtcatccctc

SEQ ID NO: 6832760 - DNA, 55 bp, Homo sapiens
cctgggtctatagacttcaagactgagccagaatgaagcaagtctattgccctgg

SEQ ID NO: 6832761 - DNA, 65 bp, Homo sapiens
ctgtctagttaggatgccagcagagtggaacaatatgctacaggcgatcctcaactattctccag

SEQ ID NO: 6832762 - DNA, 87 bp, Homo sapiens
ctgtgtgtaagtagttagaatagtcagattgtagatatactttgaaagtagacctaggatttgctgatttaatttgtcatgtgatag

SEQ ID NO: 6832763 - DNA, 63 bp, Homo sapiens
ttaggtttatgaggtctgcattgttaccaagaagtgatatggtttgcagctgtatgagcttaa

SEQ ID NO: 6832764 - DNA, 61 bp, Homo sapiens
ttcaagttctgtggagagctgtaaccatgtgaccttccatggcagagcctcagagctagaa

SEQ ID NO: 6832765 - DNA, 78 bp, Homo sapiens
tttggatcctcttcagatctggtgaagttatagtataaaaaagcatactggctagcgtatctgaacaatgggttcaag

SEQ ID NO: 6832766 - DNA, 101 bp, Homo sapiens
gagtgagctcttctggactaataacttcagtgggcccaatgggtctcaattccccatgaaggtctctgcaggttttgcttcaaagaagaaaatgcatactt

SEQ ID NO: 6832767 - DNA, 95 bp, Homo sapiens
cacaggtcaggagagacccagttaatctcaggaaggctgagagccccccactgctcttcaaggccttccaggttgaaggggtctcaagtcctgtg

SEQ ID NO: 6832768 - DNA, 78 bp, Homo sapiens
gatgtagagttgaatacttgagaaatccatacttcagtgtgtatttccccttaggtattcatttttgtttatttcatc

SEQ ID NO: 6832769 - DNA, 64 bp, Homo sapiens
tgcaaaggcctttaggttgaaaaattcctaagctgtttgaaaaactgataggggccaagttgca

SEQ ID NO: 6832770 - DNA, 130 bp, Homo sapiens
tttttgttttgtcttcagatttcccaaaatgaaagaagattcatttcaatactatctgagaattattttgatttaagatgtgatgaaattctactgatcatatgggtataaatctgatagaggttaagaa

SEQ ID NO: 6832771 - DNA, 56 bp, Homo sapiens
ccagcctgccatgttggccctgggtttgcctttggtcacaggtgtggaggtgctgg

SEQ ID NO: 6832772 - DNA, 58 bp, Homo sapiens
tttgcaggcacggaggcagctggacatccttcgcttcaccagcctctgggcctgcaag

SEQ ID NO: 6832773 - DNA, 57 bp, Homo sapiens
tgccacatataaccgtacgtgtcatgcattgtcatgacaccctcattgtgtgtcgca

SEQ ID NO: 6832774 - DNA, 69 bp, Homo sapiens
tctgaaagctttgggacagtgtgacctttcaggaggaaaatttaatctgctgtcaaaagggctaacaga

SEQ ID NO: 6832775 - DNA, 81 bp, Homo sapiens
agtagaaactttggtgccatttttctccagaaataagatccagtcttctttctttgtataagtggtactttgttatctcct

SEQ ID NO: 6832776 - DNA, 88 bp, Homo sapiens
ccctcactcacacgtaagccccatgagaacagggacttggttttgtacacggcttcattcccagaccctttcttggcatgtggtaggg

SEQ ID NO: 6832777 - DNA, 63 bp, Homo sapiens
tagaaatgtacaccgtgggttttttaatttttaaaattaaaacatcatggttgtacatgtttg

SEQ ID NO: 6832778 - DNA, 67 bp, Homo sapiens
agaggcaggtatttgaaggcagtgggacaggaagaggcttgttctggacttccaaatggcttccttt

SEQ ID NO: 6832779 - DNA, 103 bp, Homo sapiens
ctgggggctgtagaggaaatggagcactcggcaatggaaggaagatggatgtctccttccatggtggggctgcttctatttcacaggcttctactaaacctag

SEQ ID NO: 6832780 - DNA, 80 bp, Homo sapiens
gatgtttggtctgtatgttagtttgtggtgtcagtgaaaattgtgtacaattacaactacataatctcagaagcaatatt

SEQ ID NO: 6832781 - DNA, 76 bp, Homo sapiens
aaaaatacagatgctcatatgccccaggaagttctgatcctggagaggtggggtgggcataggcatctgtgttttt

SEQ ID NO: 6832782 - DNA, 71 bp, Homo sapiens
cactcgcaaatgaaggtggtgggtcattgtcaccataataaagatgtgcctgtttcatagtgatgagagtg

SEQ ID NO: 6832783 - DNA, 61 bp, Homo sapiens
gctatgaacagacagctgtggggttgtgtctagaccacacaatgtaagagtttgttcatgt

SEQ ID NO: 6832784 - DNA, 66 bp, Homo sapiens
agtgttcatcaatgtgtttaataatgcctggggaggctttggttctggcattgaataatgaacatt

SEQ ID NO: 6832785 - DNA, 66 bp, Homo sapiens
ggtggctcagtagcagtgtggtcagaaggagaaccaaggcctcctggcttccagagctgctccacc

SEQ ID NO: 6832786 - DNA, 57 bp, Homo sapiens
cagctccaaagccccactgtcctgtctctgtgtcctgggacaggggacaaggggctg

SEQ ID NO: 6832787 - DNA, 63 bp, Homo sapiens
tgcccttaaccacgaggctatcctgctagggttacactttccttttcagggtcttgtgaggca

SEQ ID NO: 6832788 - DNA, 56 bp, Homo sapiens
tcaatgcctagagaggctgggtgacttccaaggtcacacagctggtcaggtacaga

SEQ ID NO: 6832789 - DNA, 59 bp, Homo sapiens
attcctgggtctccttcctaaaattctaattcattgagtcagaagtgcagcccaggaat

SEQ ID NO: 6832790 - DNA, 89 bp, Homo sapiens
aaatctctctgctgctgagactggctttgtgtcccttcttcatacacagggcacaatggaccgtgtgctctgctctgttttagagattt

SEQ ID NO: 6832791 - DNA, 67 bp, Homo sapiens
ccccacccacctaagagaaactaaaatctattcctttgcaagggacagttcctcaggtggggtgagg

SEQ ID NO: 6832792 - DNA, 65 bp, Homo sapiens
attgccaaggtctctaaattgttaagaaataataaagaattaatagttggaggcagtttggcaat

SEQ ID NO: 6832793 - DNA, 58 bp, Homo sapiens
gagaggcttaagggctgtgaaggaaacacctgaaattccataatagctagtgcctttc

SEQ ID NO: 6832794 - DNA, 81 bp, Homo sapiens
ggcagggacagagctcagactcgggcctggggctctttgtggagcctgccagatcccctgagctgactgcctctctctgcc

SEQ ID NO: 6832795 - DNA, 99 bp, Homo sapiens
gggaagggggccgctgtgccgctgagagttcgttccaccctcctggcagtgctggagggggctggagctctggcgtctggcctagtgaccctacctccc

SEQ ID NO: 6832796 - DNA, 78 bp, Homo sapiens
ggcaaaaaatgcaagagtaaattcaggactttaaggctactgtcttgaagttaaagaagagttcattctgcacttgtc

SEQ ID NO: 6832797 - DNA, 60 bp, Homo sapiens
cttgtgtagacatctctagaagacttgatggactaatctttaagagttcatttgcatgag

SEQ ID NO: 6832798 - DNA, 79 bp, Homo sapiens
tgggtctgcagcagggcctgcttcttcagggctgcctcgacccttctctctgccagctgcaggcccatgctcagtccca

SEQ ID NO: 6832799 - DNA, 85 bp, Homo sapiens
ctgtggttgataagcatcccatgactctggaggaagctgcattaagcttcttcccaggcttagaattgtgttggatgtaccatag

SEQ ID NO: 6832800 - DNA, 69 bp, Homo sapiens
tctgtggatcttacccattagaatcacccggagagctgaatgtgaattctaatgggtgagatccacaga

SEQ ID NO: 6832801 - DNA, 83 bp, Homo sapiens
gaatttattggcccatttaactgagaagtccagggatagctctggatttgagctcagttgtatctatgtgaccaataactgtc

SEQ ID NO: 6832802 - DNA, 57 bp, Homo sapiens
ggcacactcacttctgccctgagggggagctgctctctggctgaaaggggctgtgcc

SEQ ID NO: 6832803 - DNA, 102 bp, Homo sapiens
ctcgttcgctgacatttgattttgcattgggtgccttctcttctgtttttttcagccagtgagatccgtcctgggcactcagctgtagagcaggggaacgag

SEQ ID NO: 6832804 - DNA, 105 bp, Homo sapiens
atcaccatgagatttccagtatactgattagatagtaagtgactaaaggactactttcaactgggcggatctgagaaggctattctgagaggtaacatttaagat

SEQ ID NO: 6832805 - DNA, 75 bp, Homo sapiens
aatataagatgtcagaagcttcagtgacaaatataataaatgtgctgaagtccatctgtttgactatccaatatt

SEQ ID NO: 6832806 - DNA, 55 bp, Homo sapiens
ctgtgtttggacaacttttcagatttctcttgtctctggggctgtgtagatgcag

SEQ ID NO: 6832807 - DNA, 65 bp, Homo sapiens
ctcacaagttagtattggttttgggaagttgctttgcttttgatgttgatactaccttcagtgag

SEQ ID NO: 6832808 - DNA, 57 bp, Homo sapiens
actgccggcgcctgcggttcctcctggccccaaggcaccgctgcaggcgcctgcggt

SEQ ID NO: 6832809 - DNA, 71 bp, Homo sapiens
gacttgacaggtattttatagataagtaaaccaagggtttatagataaggtgaaataaattgttgaaagtc

SEQ ID NO: 6832810 - DNA, 75 bp, Homo sapiens
gctgggagctgaaagaatgaaggatttagctgttagtctctgaaggcacaacaggcctcattccagctctccggc

SEQ ID NO: 6832811 - DNA, 107 bp, Homo sapiens
gcacagcgactcaagggcctgatgcgtcaggctgctgagatatctatctgttccgacaaaggctgcctcagtgccatgaaaacacatcacgtgctgcaagtcctggc

SEQ ID NO: 6832812 - DNA, 65 bp, Homo sapiens
cctgattcatttgtggaagtgattgtggagctatgagcaccagagccttccctgaataattcagg

SEQ ID NO: 6832813 - DNA, 58 bp, Homo sapiens
ttggacatgagctgagtgggtgtgggtgtgagcccacgcaagcatcatctctgttcag

SEQ ID NO: 6832814 - DNA, 63 bp, Homo sapiens
ttcccacagttcagaacaaagggtttaaatcagtcagctcttgttatctgtgcttgtgaggaa

SEQ ID NO: 6832815 - DNA, 121 bp, Homo sapiens
tcacatggtcaagcctgacatcactggagcaaaggggcacagcaagaagggaaatgaaatatttggtccaccagtcatagactctatcatgctgtgttttcagtcttgggagatgatgaga

SEQ ID NO: 6832816 - DNA, 87 bp, Homo sapiens
gtccctcccttcatgaagtttatggtcaggtgggctatcccccagctaccagccctccccacaaagcttcacactggaggcagggac

SEQ ID NO: 6832817 - DNA, 130 bp, Homo sapiens
tgtctaaggcaaccatcacaaaatggtattttggaaagattattattatgaagagaatatattttcctccattatctctttgtttttatctttttaaaggtaatcatagcctcctggtatcgcacatcca

SEQ ID NO: 6832818 - DNA, 66 bp, Homo sapiens
tggcggggtgagccttagagatgggcacagacactcatgtctgtgagctaggaggtaatttagtca

SEQ ID NO: 6832819 - DNA, 57 bp, Homo sapiens
cctttagaaaagtctgggacacaccatgggctgtgtcagtggtcctagggtttaagg

SEQ ID NO: 6832820 - DNA, 102 bp, Homo sapiens
ctgcaatacatcagctgggagtcaaccctcacgagcaaacagattagttcagcttatatccctgaaacagcttgttaggtggggtctggctctgctgagcag

SEQ ID NO: 6832821 - DNA, 57 bp, Homo sapiens
gccagcttggactccatgacacgttagcctcgagaaggccggtctggggccattggc

SEQ ID NO: 6832822 - DNA, 64 bp, Homo sapiens
cttgtttattatgcactgtagacatcattttcacaaagctgagtaatataggcatttagataag

SEQ ID NO: 6832823 - DNA, 91 bp, Homo sapiens
acatattcactagaagctaagtcttcacatgggtactgctgatctcttccccatagatcattgtttctaatgtgacttcttttgactgtgt

SEQ ID NO: 6832824 - DNA, 98 bp, Homo sapiens
caggggaagcggagggagcctcgtgctgggcctgcttcttgggtctttcttctgggaggtgtgcacagcgtgctgacagcctccttcaaacatccctg

SEQ ID NO: 6832825 - DNA, 56 bp, Homo sapiens
ggggaaggcaggcttgactcaggtggccaaacagctgtctcaagaaaggcctctcc

SEQ ID NO: 6832826 - DNA, 63 bp, Homo sapiens
gcctctgccctcctgggactgcatgggaagcaggccaagtgcaggaagggctaaagtggaggc

SEQ ID NO: 6832827 - DNA, 67 bp, Homo sapiens
cccttccaatagcaacaaagattattttcatcattcgctgagttaatttgctaattttggatcaggg

SEQ ID NO: 6832828 - DNA, 72 bp, Homo sapiens
ttccctcctccatgttcagtccagtgtctgcaactgtccgacactgtctcatatgaggggacatcacgggaa

SEQ ID NO: 6832829 - DNA, 75 bp, Homo sapiens
gagcccgcgctcttgaccatgatattgtgcccctattagtcctatctccacaatcaggagaaagagcgtgtgctt

SEQ ID NO: 6832830 - DNA, 100 bp, Homo sapiens
ggctcctgaccctcagggccagcatggggcagtgtgggccgtcgagcctggatctcggggtccacctccaagctggggaccttggggagtcacagcagcc

SEQ ID NO: 6832831 - DNA, 60 bp, Homo sapiens
cctctgcctccctgggtcctcaagccagagctccaatgagtgactccactggggcagagg

SEQ ID NO: 6832832 - DNA, 68 bp, Homo sapiens
tgggaagagggatgcttaggtgagagtggggtggaaaaaacttcttgaaagtggtgaccctctgctca

SEQ ID NO: 6832833 - DNA, 70 bp, Homo sapiens
gggcatggtggacctggcattgaacctacatggaccattcagttttagtgtggcaggttccaaaatgtcc

SEQ ID NO: 6832834 - DNA, 63 bp, Homo sapiens
aagcgaggaaggtgtgaactgattcattggtgtgaacaccaattgaattcacacctcttgctt

SEQ ID NO: 6832835 - DNA, 89 bp, Homo sapiens
tgttttttgataccatgttgcttttgggaaaacatgcctgaaagtaggcaagtttctctaaagcaagaactgtaaaactcacagaaaca

SEQ ID NO: 6832836 - DNA, 86 bp, Homo sapiens
gactgttattgaatccccatgatttagagggttgtaggagcttcaggggatccaataaaactcttgaattaaactcaatagtggtc

SEQ ID NO: 6832837 - DNA, 68 bp, Homo sapiens
tcagtaatgtgtcgcaggtgcctagaagtgttcctggcagatagtaggcactgagtacatattggtga

SEQ ID NO: 6832838 - DNA, 66 bp, Homo sapiens
cgcaagctggtcaccacctcggagacctacgtcaagaccatgtccctgcagcaggtgatcaatgcg

SEQ ID NO: 6832839 - DNA, 105 bp, Homo sapiens
cagatatatacagtatcaccctgaatcagcttttctcatcagaaatggagctactgtactttattgtgatgtcagagattgaactggggtgagaatgcacttctg

SEQ ID NO: 6832840 - DNA, 78 bp, Homo sapiens
gacattacagtttagtccaagccagaaggtaattgggtcaaccacacctggactctgaggattttaaattctagtgtc

SEQ ID NO: 6832841 - DNA, 79 bp, Homo sapiens
gtgaagggatattgtttgcttacccacctgtaatcatttagagttatgattaattgagccagaaagtatctgcttttat

SEQ ID NO: 6832842 - DNA, 70 bp, Homo sapiens
atgctactatccttctgcttaaactgctcacattctagactacacagaccaaagcacaaggtggttgcgt

SEQ ID NO: 6832843 - DNA, 62 bp, Homo sapiens
tgtcactatcctgtgttgtttgttgagactgatgaagggttaacgagcacaggtagaggata

SEQ ID NO: 6832844 - DNA, 99 bp, Homo sapiens
tcagcaacatccaccctggccttgtgtttaagcaagaaatccactgcagataaatgatttctccccactgcaaaatgcagggctgtgcggttcatctga

SEQ ID NO: 6832845 - DNA, 62 bp, Homo sapiens
tgcagccctggagtaccgtggccatccagcctgtgggtggtgggcacagtgcccaggctgca

SEQ ID NO: 6832846 - DNA, 60 bp, Homo sapiens
agaacttgttttgtgtatctctagctaaatattgccattattgcacacagataagtatct

SEQ ID NO: 6832847 - DNA, 58 bp, Homo sapiens
agccactgtctctggcactagttctttccagacaagagctctttgctggcagtaggct

SEQ ID NO: 6832848 - DNA, 65 bp, Homo sapiens
caggctgcccagggcctgcatgcgggtgtggggtacatcctcggggaaaggcactggacagcctg

SEQ ID NO: 6832849 - DNA, 76 bp, Homo sapiens
gcagactaagaagtgccttgcaggtgtgatggctaccttttgttattatggatggaggcattagtcttttctctgt

SEQ ID NO: 6832850 - DNA, 80 bp, Homo sapiens
ctactagatgaatgacagtgtatgctggtgattttgattttaaaaagtcaaaatcaaagatacttgaaaacatctggaag

SEQ ID NO: 6832851 - DNA, 66 bp, Homo sapiens
cttccatcacagaatttttgcttccagtcacatgtggacttacgaatgattattctgttagggaag

SEQ ID NO: 6832852 - DNA, 116 bp, Homo sapiens
aatttgaaaatgttgcagatggccttttatcaggagctatggactgtcaaaataaatagatataattatgaaccattgttgttgaatgggccatcttaaataatagcagtcaagtt

SEQ ID NO: 6832853 - DNA, 56 bp, Homo sapiens
gctcttagcagagatacccctgtgagagaacaaattgggttcctcacgctaagggc

SEQ ID NO: 6832854 - DNA, 74 bp, Homo sapiens
cacattctaaagcatgctcaggatattatcatttatttttgcacatattctttctgagtatgattttgtctgtg

SEQ ID NO: 6832855 - DNA, 56 bp, Homo sapiens
acactgtggcctttaaccccatcaataactctttgaaggcctggaggacgcgttgt

SEQ ID NO: 6832856 - DNA, 129 bp, Homo sapiens
gctggggctgcagagcttgaagggtgggcttgagttgcctgaagtcccaaggaggtttcaaggtgcccaagaacttaggaagtaaatggagaccaggaattctgcccatctagcttggtggttttagat

SEQ ID NO: 6832857 - DNA, 98 bp, Homo sapiens
catgaactgttttggacagtgtgtggcaaactgggcctgcaagaagggtgaatttctggggcatgctgagtttgccacaagaatttaaaatttttgtg

SEQ ID NO: 6832858 - DNA, 55 bp, Homo sapiens
gggactattagaaactatgccagaacaataggcataaattaggatctggggttcc

SEQ ID NO: 6832859 - DNA, 73 bp, Homo sapiens
ggtgcggcaccagcgtggcatcttcccagcatctgaatgttggcttgaccttcgctgtttgtgtgacctcacc

SEQ ID NO: 6832860 - DNA, 67 bp, Homo sapiens
gagaggtgtgtttcagataagaaagggtgtgtgtgcactttcctgaatgtgtctgaagccacttttt

SEQ ID NO: 6832861 - DNA, 70 bp, Homo sapiens
ctttgaataatggagctctttgtcaatttcccatgatttgcgagaaccaaacaagagctcagattcagag

SEQ ID NO: 6832862 - DNA, 59 bp, Homo sapiens
gagcatccccaaccccccagtttacataaaacccttaaaacctggggttgcctgtgctc

SEQ ID NO: 6832863 - DNA, 57 bp, Homo sapiens
aggtggttcatgcctgtaattctagcagtttgggagactgaggtgggtggatcacct

SEQ ID NO: 6832864 - DNA, 59 bp, Homo sapiens
gttcattatattgctgcaaacatgaataatccacatgtaattgtagctttgtaatcagc

SEQ ID NO: 6832865 - DNA, 55 bp, Homo sapiens
ggatctaccttttatcatggtcttgaagagaaagaacgatggtgatggtacatcc

SEQ ID NO: 6832866 - DNA, 66 bp, Homo sapiens
atgtaaagtatctgaaatgctgcctgacacatagttagcacacagtaaatgcagatatagatacat

SEQ ID NO: 6832867 - DNA, 129 bp, Homo sapiens
acggaaacaataagctccaggtgcccagcagcgctgtgcggttactccgctgatcgttagagttaacgtcagtgtaaaagacagcaccgccactgggactgcctgggcttcctgtccagttatttttgt

SEQ ID NO: 6832868 - DNA, 91 bp, Homo sapiens
gaggcgctccacctctgcacggccagggctgtgggtgcggcccccgctgctgcactgcgcctggggccctggctgtctctgggccagcctc

SEQ ID NO: 6832869 - DNA, 77 bp, Homo sapiens
aattacctatttgagtcctgtttccaatttgttgggttatatacccatgaatggaatcactggagcatatggtaatt

SEQ ID NO: 6832870 - DNA, 56 bp, Homo sapiens
ctgggtcccctcagtgacactgagagacataagtcattgtcactgtcatggcccag

SEQ ID NO: 6832871 - DNA, 55 bp, Homo sapiens
tgcagtaaataattttgtgtatatgcctttgggcgtatgtgcaagtatttctgca

SEQ ID NO: 6832872 - DNA, 80 bp, Homo sapiens
acttctgagtcttcaggggaggttgaatcgtctccagcccagcacgagaccccagctcagcctccagaacatcatgaagt

SEQ ID NO: 6832873 - DNA, 67 bp, Homo sapiens
gtccaacttcctcctaaaacccagtcctgtctctctatgcacagctttgtgtagaaggaggatggat

SEQ ID NO: 6832874 - DNA, 61 bp, Homo sapiens
ggtagaatgattttggacaatatggatcataagatgatttaatgtcttagatgttactact

SEQ ID NO: 6832875 - DNA, 96 bp, Homo sapiens
gctaacacttgtagaaaagtttgactatattcaagccaagaacacaaggattcttggctgtctttgaagttagggactcatctgcaaatgtgaagc

SEQ ID NO: 6832876 - DNA, 70 bp, Homo sapiens
tgtcccgacatgatggcaagctgcagcacatcatgcagattaaagttcagcctgcctcagactcaggata

SEQ ID NO: 6832877 - DNA, 109 bp, Homo sapiens
ggtcttagttctgcagcgacatcttatggagttggttagtttgcacaaccatttaataatgtctgccagaactgatcattgttctaacagatttgatgcaaataggatc

SEQ ID NO: 6832878 - DNA, 67 bp, Homo sapiens
tccccctccatgggggctggcctgtgtcatcaaaaaggaagcagcagccatcccccaaggaaaagga

SEQ ID NO: 6832879 - DNA, 72 bp, Homo sapiens
ccgggagctgtaacgagccattgctgcgattattattatctctcgtagtcatgcatttcattacagctcagg

SEQ ID NO: 6832880 - DNA, 86 bp, Homo sapiens
gccctggagtcagaatgtcctcctgcggctgcacacggtcagttgtctccccaggatttgggctttttggcttcagtaaatgaggc

SEQ ID NO: 6832881 - DNA, 90 bp, Homo sapiens
cagctctgctgctctcagctgctgtgttgtttcctacaagttgtttgctagtgtagaaactacacatgcaacagattagccttagggttg

SEQ ID NO: 6832882 - DNA, 67 bp, Homo sapiens
gcactgtgtacagaaagaagggagtgaaaattagacaaagttctttctttcaagaagttcacagtgc

SEQ ID NO: 6832883 - DNA, 107 bp, Homo sapiens
agcctgcagcatctccgcagctcttctggcttgtgtccttccttgctaggggtcctttcttggggaagggtggacacaacgtgggaacagaaggggaaaagcaggtt

SEQ ID NO: 6832884 - DNA, 61 bp, Homo sapiens
aatagaatttgtactgtgttttctgagagcttgttctctgaaatacagatgcaaatctgtt

SEQ ID NO: 6832885 - DNA, 63 bp, Homo sapiens
aacacaggaggctatgttttctaggtgagaaggctcactgttgtaactggagctttttgtgtt

SEQ ID NO: 6832886 - DNA, 69 bp, Homo sapiens
gctccctgccctgtgagttggccgttttcttcccatggtggattcaggcattggcatggcggggtgagc

SEQ ID NO: 6832887 - DNA, 69 bp, Homo sapiens
cagaacagaggaggaagcacacggcttgtattaaaagggagttaatggaatgtttcctcttttattctg

SEQ ID NO: 6832888 - DNA, 68 bp, Homo sapiens
ctctttaactttctggctttggggagaggtaggcaactcttctttgcagaaatagaaaggccgaagag

SEQ ID NO: 6832889 - DNA, 64 bp, Homo sapiens
gcctgccgcgcgcccaggttaggtgtgtccgctcttttcacactcgcggccggcgcgcgcgggc

SEQ ID NO: 6832890 - DNA, 59 bp, Homo sapiens
gtgtgtccttgggcctctgcagaccacggactgtggagctgcgggggcagaggtggcac

SEQ ID NO: 6832891 - DNA, 60 bp, Homo sapiens
tggggaggtatgatagctgtgtccttgaggacactggaggaggtagaagatacttcccta

SEQ ID NO: 6832892 - DNA, 71 bp, Homo sapiens
tcttggctttggtagttctttctcaatgttcaaggccgccttgagatttggaggtaattccctcgtcaaga

SEQ ID NO: 6832893 - DNA, 93 bp, Homo sapiens
tagaggcaaaatctttgatggagagatagatattctgagactctatggtcttatatgcatatatcctgtttctcatcatacttttgcctacta

SEQ ID NO: 6832894 - DNA, 55 bp, Homo sapiens
tggaaactcagggccagaaggagatttcaatcatcctcttgcctttgagtgtcta

SEQ ID NO: 6832895 - DNA, 89 bp, Homo sapiens
tcgcctgggaacttgttagaaatgcagaatcccaggacaggccagccctcctgaatgacaatctgcattttaacaagatccccaggtga

SEQ ID NO: 6832896 - DNA, 65 bp, Homo sapiens
gtcctggcagaaatggggctgtgggcctagcaggactactctctccttttttctgctcttaggat

SEQ ID NO: 6832897 - DNA, 63 bp, Homo sapiens
ggcttctcagcgtgaatgtggagctattaatacccacagcccagccagtctgccagagaagcc

SEQ ID NO: 6832898 - DNA, 58 bp, Homo sapiens
gaggaggggcacttgtctcctagtccgccaggatgaaggaacaagggagccttttctc

SEQ ID NO: 6832899 - DNA, 76 bp, Homo sapiens
tagacagaggattcacagatatctgaaagtcacgcttcttgaagattatcagtttaaaatctgtgaatcactgcta

SEQ ID NO: 6832900 - DNA, 55 bp, Homo sapiens
acagctctccctcagagaaatgcgcacattttctacacagaaagggcgaagctgt

SEQ ID NO: 6832901 - DNA, 78 bp, Homo sapiens
accttgacagtgtattaaggatcttgacctagcagagtatcctggactattcaggtgtccattaatccaatcacaggt

SEQ ID NO: 6832902 - DNA, 62 bp, Homo sapiens
gtgacagagaaggagctcaaatatggcttttctgaagctacatctggactctttatgtgcac

SEQ ID NO: 6832903 - DNA, 81 bp, Homo sapiens
ggtcttttcccaagagcagctgcattcagcacctgaccagactctagggttttaagggtgcagctgcccaaggactggtcc

SEQ ID NO: 6832904 - DNA, 55 bp, Homo sapiens
tgggcctctgggctattcagactcaacatcttggaaacctgaggcccagggccca

SEQ ID NO: 6832905 - DNA, 72 bp, Homo sapiens
gcacagtaggctcagctctatcttaattggattttctgacaatcaccagtaacttggagctgagtgctgtgc

SEQ ID NO: 6832906 - DNA, 69 bp, Homo sapiens
gcagaaacaaactctataggcagaagcaatcagcatagattaatttagcctatggagttgagtttctgt

SEQ ID NO: 6832907 - DNA, 81 bp, Homo sapiens
caatgccaaaagtacagtgccagacttctaggtggtcccaacatgatgacttggaggggatggcattcttttggacatatg

SEQ ID NO: 6832908 - DNA, 72 bp, Homo sapiens
tactgaatgaatgaattaatagagtatgtagtttttttctgccttgggctctctccatttatttgcacagta

SEQ ID NO: 6832909 - DNA, 127 bp, Homo sapiens
ttgcttaagtagtttttttttggtctcctgcacaatccctaaggtgtttttcagtcttaattgtgagataacaatgatatagggattggcagtgagcatcatcaatcaacaaagagcatagtagcaa

SEQ ID NO: 6832910 - DNA, 128 bp, Homo sapiens
gggcccattgttcccatcacttcaaaagtttccctgtgcagagtgctgaatagttaatacctccagagaaaactaatcagaagcacagctgttcaacaggaatgagaggttatggaaagcagaggctc

SEQ ID NO: 6832911 - DNA, 81 bp, Homo sapiens
taaccagcccatcaaatctatcgatttttcaaaattagtatatcattaaagtttgtagcaattgatatagtgggatggtta

SEQ ID NO: 6832912 - DNA, 78 bp, Homo sapiens
atctggtgcccttccagcattcttagacctctatactcttaaagtccgttgcatatgactgggagcaagggactagat

SEQ ID NO: 6832913 - DNA, 77 bp, Homo sapiens
tacggctatgtcagtattcagcaaacgtgaacagaataatttgtttccactagctgcaatacttgaaccaagttgta

SEQ ID NO: 6832914 - DNA, 100 bp, Homo sapiens
acagaagtcatgatgatggggcccatgactggcaacctgctgggagaggtggcctgcagtgtgtctggagtacatgggggaccccgggagcatcttctgt

SEQ ID NO: 6832915 - DNA, 68 bp, Homo sapiens
agctctgaaacgagtgctttttaatttccaagatggtaatctgatcagaagtacttggttcatatgct

SEQ ID NO: 6832916 - DNA, 113 bp, Homo sapiens
tttatttggccgtcattacctaggcttgctgttattttgaagtctcaagtgagcgaaagaaaggatttaagaatgattctaaggatttttacctaagtaattggaaggataga

SEQ ID NO: 6832917 - DNA, 55 bp, Homo sapiens
tggttagtgtatatttggactgtggccaaatccccactaaattgtatattaatca

SEQ ID NO: 6832918 - DNA, 86 bp, Homo sapiens
gccacgcccatttgctttcatattgcctatgactgcttttgaaatataacagcagaattaagtcattgcaatagagacggtgtggc

SEQ ID NO: 6832919 - DNA, 72 bp, Homo sapiens
gattctcatgatacatcttcatgtcagtgttactctagtattttactgaaatggcagatatataaaagagtc

SEQ ID NO: 6832920 - DNA, 74 bp, Homo sapiens
aactacctggtcatggtgatttgcgccttctatttgggaggatgaggtgggagaatcacttgagcccaggagtt

SEQ ID NO: 6832921 - DNA, 85 bp, Homo sapiens
gtctgtattgctgtacttcaaatttcatgaactgtatcaaagctggtaacatatgacatgaacattcagaaatacagctacagat

SEQ ID NO: 6832922 - DNA, 71 bp, Homo sapiens
gggagaagattgtgtcagaacgtttgtaaggacacttcaaaggcaagcttcatatggcattttctgctcct

SEQ ID NO: 6832923 - DNA, 73 bp, Homo sapiens
aaggaaggaatttgggattccaggacttgggagcatccctcaaattctattctatactcagctttcttctctt

SEQ ID NO: 6832924 - DNA, 79 bp, Homo sapiens
tgaaggaacaagtcatgagtcctcttctgtgaagtgtgtgtgttactttaagaaaattatatttagatttgacctggca

SEQ ID NO: 6832925 - DNA, 79 bp, Homo sapiens
tggctgcagtttgaccttgttttcttagttttgggttgcatggaacaataggaagagaaaacaaatggatcactgttca

SEQ ID NO: 6832926 - DNA, 72 bp, Homo sapiens
ggcaaaggtgttcaaggaaagcctgcctgtcaagaattaggcagagctgggttttgaaatgccatctctgcc

SEQ ID NO: 6832927 - DNA, 82 bp, Homo sapiens
ccccacctgctcagagccagcctgggtgctggaaccacacttgcctcaggaccctgggcttgctcctggggaaagagtgggg

SEQ ID NO: 6832928 - DNA, 100 bp, Homo sapiens
tcaggtttacatgtttatttgtgaagcttgtatttaaataagttttctatgcaagtgagatacactttaagagatacatgcctcgtaaaaacatgcctga

SEQ ID NO: 6832929 - DNA, 56 bp, Homo sapiens
ggcatcctgggactggcttctttgtgaaagacaatcagagagcagaactgggtgcc

SEQ ID NO: 6832930 - DNA, 84 bp, Homo sapiens
ttcttgatgtacctattgtaagaggtttggctgtgtaataacaaataatattagccactctttttagcacggggacaccatgag

SEQ ID NO: 6832931 - DNA, 55 bp, Homo sapiens
gtttgcagttttgatagagacgggcttctggaagtctgttcaaggaactacggat

SEQ ID NO: 6832932 - DNA, 84 bp, Homo sapiens
gctgagttcctcctccagaagtgtcagtgcaggcagctagtgtgagcacacagccttctgcggatgctggagggagcagccagc

SEQ ID NO: 6832933 - DNA, 129 bp, Homo sapiens
ctaatgtacacacaattcgaggagtaaactgatgtctgttttactcattgctggatctagaactagaatggttttgggcacatgggaaattttcagtaaatatttgttgaatgaatgaatacatgaatg

SEQ ID NO: 6832934 - DNA, 75 bp, Homo sapiens
gcttaagtgtttgtacattgtgatggttaatttatgtgtcaatttaactggcttatggagtgccagacatttggc

SEQ ID NO: 6832935 - DNA, 108 bp, Homo sapiens
gggtttagattaggtgagttcctaaacctttctcagtgctaaaatcctgatcccatgagctggcattgaagaatggttaagatttggaactctataaacactaaaccc

SEQ ID NO: 6832936 - DNA, 73 bp, Homo sapiens
cttttatttgattcagcacctggcatagtacctacacttacaggtgctcaagtgtttgttgaatggatgaaag

SEQ ID NO: 6832937 - DNA, 128 bp, Homo sapiens
attatttgtttacacatctgccttccttatgagaccatgggctctgaagagcaggaatcatgtccttgttttgcaatctcaggtcctagcatagggctccaggcatagcagatgcttaataaaatgat

SEQ ID NO: 6832938 - DNA, 79 bp, Homo sapiens
tgagataggcacaattattatctctttctacagaagaggcaatgaagacaaagagatggtaagtgaattatgcattcca

SEQ ID NO: 6832939 - DNA, 57 bp, Homo sapiens
tatgtgattagtccttacatgcagccaatcattttgctcgtaagtgattatctcata

SEQ ID NO: 6832940 - DNA, 75 bp, Homo sapiens
ttaggtttgctttatgtgtatgacttgactttaaataagaacagtcaaactcattttaaactagagaaaacctag

SEQ ID NO: 6832941 - DNA, 96 bp, Homo sapiens
gctgctctttgttatttcagccacagagtgcaagaaagaccttttgccgttttattagtgtgccatgctgaacgatattagaggtttcctagcagc

SEQ ID NO: 6832942 - DNA, 79 bp, Homo sapiens
gatttatccttgggaagggtcagtttcttcattaggacaatgaagaaaaatccagctgtcccttccaaggggaggtatc

SEQ ID NO: 6832943 - DNA, 68 bp, Homo sapiens
ccacctcttcctctgtaaaatgggtctaacagtccttgtcctgcctaccttgcggaggtgttgggtgg

SEQ ID NO: 6832944 - DNA, 94 bp, Homo sapiens
aactatgtggcacattgggaagatttagatccactgcctgtttttcatccttttccacctgcagtttattcttcccaagtgagctcatattgtt

SEQ ID NO: 6832945 - DNA, 60 bp, Homo sapiens
tcctggtttatagcttagggaaagttacagcttagttatatgtatgcttataaaccagga

SEQ ID NO: 6832946 - DNA, 80 bp, Homo sapiens
tttcaaaagattcgagcgatgtataaaatctcttgttttactaggtgtggagttttgtaaaggcctgaatttcagtggaa

SEQ ID NO: 6832947 - DNA, 64 bp, Homo sapiens
ttggctccatgcctagagcaggctgtgtgactcagtgacagttgcaatcagagcatggagttgg

SEQ ID NO: 6832948 - DNA, 99 bp, Homo sapiens
gttctcccatctaattttcagctacctaaaaagctgttagcccaaaaggtgctggtgaggctgtgggtaaacgctgagggtacaatgcgagggacggac

SEQ ID NO: 6832949 - DNA, 72 bp, Homo sapiens
attgttgatcttctggtaagcctgtgtgaagatacaaaagcaaagggtccaacatatgagaagattagcaat

SEQ ID NO: 6832950 - DNA, 60 bp, Homo sapiens
tgctggagatgaaagggccctgtgataaccttgaatgttgctgcctccgtcatttccaca

SEQ ID NO: 6832951 - DNA, 129 bp, Homo sapiens
cgtcctcttggcctccttccagcaagcccctgtttcaggttctcacacgtctacaccctggccattgctgctccagggctgagaggtgctgcagggaaggaaggagggaggagggaagggcaggaggag

SEQ ID NO: 6832952 - DNA, 79 bp, Homo sapiens
ggagaaggatgtccatttcaaacctcatttgcagctgctttttagtcttagtggttttggaatggaattcatctgcttc

SEQ ID NO: 6832953 - DNA, 66 bp, Homo sapiens
aaggatgccattaaagaagcattatgtcacatttgtcactttgtgtcacatttagttggcattgtt

SEQ ID NO: 6832954 - DNA, 72 bp, Homo sapiens
tggctgtgcccagctccagctctggaagagtctctctgaggagcagggcctggagctgggcctgcaaagcca

SEQ ID NO: 6832955 - DNA, 56 bp, Homo sapiens
ggctgtgaggaatgaatttgatggtgttcaaatatgaccaatttcatccttaagcc

SEQ ID NO: 6832956 - DNA, 81 bp, Homo sapiens
cagcaaatgggcttgtgtagtgctccacagtgaagctgccctatctgtgagcatcaggagagctgacaagccaagtttctg

SEQ ID NO: 6832957 - DNA, 63 bp, Homo sapiens
ggatgttcctgagaaataaagagagagcaaaagaaccagagctcttttaacaccaggaattcc

SEQ ID NO: 6832958 - DNA, 59 bp, Homo sapiens
tgtaaccttacatggcagaaaaggaaaatagctttcatggtttctgttagaaggataca

SEQ ID NO: 6832959 - DNA, 58 bp, Homo sapiens
gtcaagtacaaggcagtttctacttctacattcctgtagctgcagccatgtacatggc

SEQ ID NO: 6832960 - DNA, 101 bp, Homo sapiens
cactgaggtgaggagggcaccagggctgaagggtctccaaggcaggcgtgtgatatcagactgtcatgtaacctttctgagccttggttccccaacttgtg

SEQ ID NO: 6832961 - DNA, 104 bp, Homo sapiens
gtgaccacctaccagaaagacttagagccaggagcctcggggctcttcgcacccaggtctttagagctcctggcatctcagcagtgttctttctagtaacgcac

SEQ ID NO: 6832962 - DNA, 76 bp, Homo sapiens
atgtgttatcttattatcacttatgagctttttgcatgacaccagtagagttgagtagtggtaacagagaccacat

SEQ ID NO: 6832963 - DNA, 64 bp, Homo sapiens
gggatagaagagctaatcactgatttgatgtctacacctgcatctctgagagcctgcttgtccc

SEQ ID NO: 6832964 - DNA, 72 bp, Homo sapiens
cagggccaagttggtgcctttttcttcccctgttcagggaggaatggccctgagtgcccagcctggcccctg

SEQ ID NO: 6832965 - DNA, 84 bp, Homo sapiens
tattatgttggtgcaaaagtaattgcggtttgtgccataactttcaaggtcaaaaaccgcaattacttttgcagcaacctaata

SEQ ID NO: 6832966 - DNA, 75 bp, Homo sapiens
ctagctcaaagtccttgctttttctgtgacatcatataggggaatttacagattagctggggccattgattctgg

SEQ ID NO: 6832967 - DNA, 61 bp, Homo sapiens
aactgtctactctagctatgagcttggtgaaggttgttctgcaactcagtctggagcagtt

SEQ ID NO: 6832968 - DNA, 60 bp, Homo sapiens
gtcattctatcttggactggatctaggacggtgtccagaaatcaatacaagataaatgat

SEQ ID NO: 6832969 - DNA, 92 bp, Homo sapiens
gaagccaggaactttctgttacaagtgaaaaaatggtttgtttcataatttgatcactgttaacaccctgggggctcctcagaattggtttc

SEQ ID NO: 6832970 - DNA, 57 bp, Homo sapiens
gcaagagcacgtgccctccataagggatgaccctcttactgggagggctgccttagc

SEQ ID NO: 6832971 - DNA, 71 bp, Homo sapiens
ctgctcggcgcgcatggctgccaggggaaagtattgtccttaaatccagagcggcgatacgcgcaggggag

SEQ ID NO: 6832972 - DNA, 88 bp, Homo sapiens
ttaggaaaatgatctttgcaaactttgtcacttaccgttcaagttatagaatcaatagtaggcttgagattgcagtagcatttcctaa

SEQ ID NO: 6832973 - DNA, 77 bp, Homo sapiens
gccaggagctgctcatttccttgagtgtggagactgaattcagccctctcccctcaatgtctacagcagtccctggc

SEQ ID NO: 6832974 - DNA, 56 bp, Homo sapiens
gtctttggctcccctgggcagccgagagggaggaccgtctgagggagcacgaaggc

SEQ ID NO: 6832975 - DNA, 91 bp, Homo sapiens
gaaatacagagtgaccccaatatggcctgagtccttgcctcttcccaggagcaaggctccagggctgtgtgggagcacactttctgatttc

SEQ ID NO: 6832976 - DNA, 61 bp, Homo sapiens
accagtgcctggaccccacctccggaaattcagatttgatttctcttgggtcaggcctggt

SEQ ID NO: 6832977 - DNA, 63 bp, Homo sapiens
cagcaagagagcagcgtgcaagggaaatacacagatcaacccttggagctgtaatcttgtctg

SEQ ID NO: 6832978 - DNA, 72 bp, Homo sapiens
tgtgtttgagatgtggattcacgctgctcctctacaaaagctgcatgttaggaaaccaggttatcaatcaca

SEQ ID NO: 6832979 - DNA, 69 bp, Homo sapiens
gtgtgtggatgtgagaaggatcaggctcaaattttatgagccaagccatgattttctatatttttatgc

SEQ ID NO: 6832980 - DNA, 89 bp, Homo sapiens
ctctgtttacttgtattaataccatttatcaagtacagtgcctgttatgtatcagacactagtattagatggtttacatatatttagag

SEQ ID NO: 6832981 - DNA, 75 bp, Homo sapiens
tgggcacccagtgtatttgagcatctccttaagcttatgtataatagagattcctcaaagagcaactcatgccca

SEQ ID NO: 6832982 - DNA, 88 bp, Homo sapiens
gcacttcagttagattccttgagtttggatcagaaatacaccacgagcttctgcttaattcaagtctgaagaggactaataaaagtgc

SEQ ID NO: 6832983 - DNA, 64 bp, Homo sapiens
tctgccagagaagacccagtcactcatcctgtagctctgagagtcatattgcttttctggtagg

SEQ ID NO: 6832984 - DNA, 65 bp, Homo sapiens
tcttgtgtgttcttttctgattaaaaaagcaatatgtgcttatttgagagaaaagaaactctgga

SEQ ID NO: 6832985 - DNA, 84 bp, Homo sapiens
tggttcgttgaggatgttccaactgattcaccatggtaggtgtgattgaaccatggaaatgatggaacattaaatcaatagcta

SEQ ID NO: 6832986 - DNA, 82 bp, Homo sapiens
acaattccagagccttcaacagaaagtaattcagcaaatatattttttacctgactacctgtttagggaattggtaagctgt

SEQ ID NO: 6832987 - DNA, 55 bp, Homo sapiens
cttagtagtagtcctggtaccagagcccagtctggctctataactcctagctgag

SEQ ID NO: 6832988 - DNA, 75 bp, Homo sapiens
ccctttatcatcagactgactgtggttctaaaatactaacaattcagagaataaaatagtctgaagatgggtggg

SEQ ID NO: 6832989 - DNA, 86 bp, Homo sapiens
gaaggatttgtcacaaagcgcggtggtcggttaccggttaccacataagccaaggccttgatctgctgtgtttgaggaaacccttt

SEQ ID NO: 6832990 - DNA, 70 bp, Homo sapiens
agccaattagatgttgaagtcatatttgggctcatggcccatggcatagtgttcaacctctcattttgct

SEQ ID NO: 6832991 - DNA, 93 bp, Homo sapiens
gcgtggttggagggcagcctgtggatccctgcactggagtcttgctgtcttcgatgcaggttggatcatacattgttacctcctactgtatgc

SEQ ID NO: 6832992 - DNA, 76 bp, Homo sapiens
caagcccattcattcacattttgtctatggctactttgaccctacagctatagttagtgagtgagtgaatgaattg

SEQ ID NO: 6832993 - DNA, 106 bp, Homo sapiens
acagaatccgggaagtggggtgagccggactggggacgcagggaaaggctggtgtccagctagcaatccgttgatcccttgcctctcggccccaaatctgctctgt

SEQ ID NO: 6832994 - DNA, 64 bp, Homo sapiens
gctgctgctgtgcctggcgtcctgtgggacaagagtgcaacagggcgctgggcaccttggcagc

SEQ ID NO: 6832995 - DNA, 124 bp, Homo sapiens
gtgataattgtaggctcctgtcaaaggtcatcaatggcttatggtaaatatttctgtcttgttcttaatagcaaggaaaggaagccaagcctgacactcaacagggtttgctttaaaatgtcac

SEQ ID NO: 6832996 - DNA, 82 bp, Homo sapiens
tgtcttagttactggaaaatgggattagtttcttcatttaaaattagaaaaatgctgcttcttttgggtaattgatgagaca

SEQ ID NO: 6832997 - DNA, 73 bp, Homo sapiens
gtcacaaagtcaaggcatttcgcttagagagaaatctgagatttctgttagcaaaattctttgatcaaatgac

SEQ ID NO: 6832998 - DNA, 86 bp, Homo sapiens
cattggtgactgatagacatagtttttatgacttagcatcctgtaattgagccaaagaaattgtgtttacaatggcatacgcagtg

SEQ ID NO: 6832999 - DNA, 116 bp, Homo sapiens
caaatcacttgcagaacaaattagttcacataaattgtatttttcattccaagtgagatgctggtctcattacttgaatggataggatttgaactgtggctgcgagaacagaagtg

SEQ ID NO: 6833000 - DNA, 83 bp, Homo sapiens
gctgggctccacccatcaggcagagtggaagctgcaagtcttccttgcctccccctttcttcctggcttggatggagttcagt

SEQ ID NO: 6833001 - DNA, 71 bp, Homo sapiens
cgtgcctgcactgtgcgggctgctgagttcagaagggctcaggcaggaagcccctgcacagggtaggtgtg

SEQ ID NO: 6833002 - DNA, 90 bp, Homo sapiens
tgggacaggagttagctcttctaagtctgctgtcttcatctgcttatgtagatggtaacttacaggccttagcttagcacttatgtgtca

SEQ ID NO: 6833003 - DNA, 93 bp, Homo sapiens
tgaaaaatgccaccaatcagactatagacagctatgtcccaaaaactggggcctccggttacatggtggttgagtcaatttggtggaagttca

SEQ ID NO: 6833004 - DNA, 92 bp, Homo sapiens
ggtgcattggttgagggaagatagatgtcatcagcatatatttgcaaatgaactatgtgccggtgacctctaccttccctcaacctctgccc

SEQ ID NO: 6833005 - DNA, 64 bp, Homo sapiens
gccagctgcttccaggaatccatctggcctcaacaacattgggctgcctggaataacggctggc

SEQ ID NO: 6833006 - DNA, 74 bp, Homo sapiens
tctgggcagtacccctctcctattatcaaagtggtggctaagacattaaagtgagagaagaggtaaagtctagg

SEQ ID NO: 6833007 - DNA, 103 bp, Homo sapiens
gcctaattgtttcccttcttctgtggatgttggatgcatgccctttatcttttggggtttggatgcatttccatctcatagaagcactctctacactgtaggt

SEQ ID NO: 6833008 - DNA, 60 bp, Homo sapiens
tgactttcaaggtatgcctgggcttgccctcctgggttctgccattgccatgagggctca

SEQ ID NO: 6833009 - DNA, 78 bp, Homo sapiens
ttcacaatgttggctaggctggtgtcaagctcctgacttcaggtgatctgccagcctcagcctcccaaagtgttggaa

SEQ ID NO: 6833010 - DNA, 80 bp, Homo sapiens
tgacactgtgaaagttacagaaaccattagtgagatgcctttctcagtattatgctaactgcagcttttgcgagtgtaca

SEQ ID NO: 6833011 - DNA, 106 bp, Homo sapiens
tccaaaattgtaaaaatatgaaaggagatagtcaagagacttaaaatatttcagctgctgaaatgattatgatcttgagtaagcatctcttattaacaatttagga

SEQ ID NO: 6833012 - DNA, 56 bp, Homo sapiens
agtgggatagctgggtgtcagaattctgtttccgttcttgtccttgctctcccact

SEQ ID NO: 6833013 - DNA, 69 bp, Homo sapiens
ggcgcgaggtttgttaaaatgagtcttcggaagcaaacctctggtgactcttaaagcaaatcttgggtc

SEQ ID NO: 6833014 - DNA, 75 bp, Homo sapiens
gcatcagtctgtgaagagggctaggcctttcattatgcctatcttcagctgccgtttttctcagtaagctggtgc

SEQ ID NO: 6833015 - DNA, 63 bp, Homo sapiens
gcgaacagttacccttaagatctttcctagttaggaaacactcgcctgcaagtgtagctgcgc

SEQ ID NO: 6833016 - DNA, 78 bp, Homo sapiens
gaggtcttttctgggaagccacagggtgtggggctgagtgaggaacagagcacctgcctggcttccagaagagacttt

SEQ ID NO: 6833017 - DNA, 89 bp, Homo sapiens
aggcagaacataggatgtagagcagtcattaatacatgtaattgtacatgtcagccatggagcttttttcatcctggggtacactgttt

SEQ ID NO: 6833018 - DNA, 103 bp, Homo sapiens
cggggctgcggccatggcagccaccctccagctcccgggggctggggaagacgctggggtccccgtggaggctggagcggcgttcaggtcctgcggtcactcg

SEQ ID NO: 6833019 - DNA, 59 bp, Homo sapiens
cccatttgtccaaagtataaaactaggcattagttttaaaatatatgagacagagtggg

SEQ ID NO: 6833020 - DNA, 84 bp, Homo sapiens
gaggccaaaggggtccagaaggaggtcaagttggctgagcaggcctttccagctctggcttcttgctgggtcccctaacaactt

SEQ ID NO: 6833021 - DNA, 62 bp, Homo sapiens
tgaccatttgatctacattccattattttggcagcatggtgggagtggattcggaatggaca

SEQ ID NO: 6833022 - DNA, 62 bp, Homo sapiens
gtgttgctgaaaacaggtcatcaggaactgttgttttcctggccatttgaacttcagaccac

SEQ ID NO: 6833023 - DNA, 59 bp, Homo sapiens
aggagtctcactatgttgcccaggctgatcgcaaattcccaggctcaagtgatcctcct

SEQ ID NO: 6833024 - DNA, 57 bp, Homo sapiens
ttcctgatctctggaggatcagggagaaatgagacttattctccagggacttaggga

SEQ ID NO: 6833025 - DNA, 65 bp, Homo sapiens
agccatcttaatggggccatgtctcagtgtaatagaaagagaaagtggctagcattaaaatgact

SEQ ID NO: 6833026 - DNA, 79 bp, Homo sapiens
ggggtaatcttaatcaccaagcaattactaaatgccgaccatgttctcaggcttggcagaggtgggtgcttgttacccc

SEQ ID NO: 6833027 - DNA, 59 bp, Homo sapiens
ttcttgattcttccttgaaggatactgcgtggtccattcctacacaggataattaagaa

SEQ ID NO: 6833028 - DNA, 61 bp, Homo sapiens
gctgtttgaggcacatgattaaggaacatttgcatatcctccagtgcaatactcaagcagt

SEQ ID NO: 6833029 - DNA, 72 bp, Homo sapiens
atgtcagaactcaaacgtatatttgagtttctgttcgtcagaactgaaacatatatttgagtttctgttcgt

SEQ ID NO: 6833030 - DNA, 59 bp, Homo sapiens
cccctgggcctggcgggtcggctctgctgccggagccggttttcaagtgtccatcaggg

SEQ ID NO: 6833031 - DNA, 74 bp, Homo sapiens
ggaaatggcctcagggcttcactaggaaccctccatttgaaggtggaagtaccaggaagcattgtcttatttcc

SEQ ID NO: 6833032 - DNA, 71 bp, Homo sapiens
ctaacgtaaagggaggtaggtgtctcttaagttgctgaccttgccacactcgctcttccttgtttacttag

SEQ ID NO: 6833033 - DNA, 129 bp, Homo sapiens
gtttcactgtgttggccagactggtctcgaacccctgacctcgtgatccgcccgctttggcctcccaaagtgctgggattacaggcatgagccactgtgcccgacccacaatagcacgttttaagaaac

SEQ ID NO: 6833034 - DNA, 74 bp, Homo sapiens
aggctagggccatggctggtgagcaatggatccagatgagaaccaaaggtcgatgacaccagttgtctgagcct

SEQ ID NO: 6833035 - DNA, 86 bp, Homo sapiens
ggtaatatatacaaagtgcatagagtagtgcctattttataatgggtcttcaataatgtataaagtaattatttgtatatattatt

SEQ ID NO: 6833036 - DNA, 63 bp, Homo sapiens
ggtgtcagaatttccttttttaggctgaatgcgcctacactttttaaagggagacatgatatt

SEQ ID NO: 6833037 - DNA, 55 bp, Homo sapiens
tctgttagcttcctagggctgccaaaacaaaacctgagcagcttaaactaacaga

SEQ ID NO: 6833038 - DNA, 60 bp, Homo sapiens
tcgtgaagaaacagttttctgtctttattacaaagttatttttgaagtgtttcttcatga

SEQ ID NO: 6833039 - DNA, 64 bp, Homo sapiens
ccacaccagcctgcagtttcctcttctaggctgtggcttggaggtctgcaaggcgctggagtgg

SEQ ID NO: 6833040 - DNA, 66 bp, Homo sapiens
tcagtatggtagccattagccccatgtgacttattgaatccttgaagcatggctaatctgtactga

SEQ ID NO: 6833041 - DNA, 58 bp, Homo sapiens
gcataatggataagagcacagatgttggagcaaacctgcatttgaatctccattctgc

SEQ ID NO: 6833042 - DNA, 116 bp, Homo sapiens
gcattcctgccagtgcccctactgctcttgcacatggcaatgctgctcccaggactcaagtggctttggactagcaggcattggcatgttgggcagggttgggggcagctatatgc

SEQ ID NO: 6833043 - DNA, 129 bp, Homo sapiens
gggagaaccagcctggggctcagagagaagagcacgttttgtttgtttttgtttgtttcagctggatcgcattcaaaggagacagagggaaggttgcaaaatgccctttttttgcccactatggaagct

SEQ ID NO: 6833044 - DNA, 57 bp, Homo sapiens
agatttgcggctttactttgcacgcatgctgcgtagaggggaatttgctgcgggttt

SEQ ID NO: 6833045 - DNA, 77 bp, Homo sapiens
agagactgggaaatataatttagctgtgtgctcagaaagaacaggatataggtttgataagtattcatccagtctct

SEQ ID NO: 6833046 - DNA, 83 bp, Homo sapiens
ttttggaagtcagggaaaatttggtagatttttttaaaaggcaataaaatgagaagatttgttgtaatttttagcttccaaaa

SEQ ID NO: 6833047 - DNA, 88 bp, Homo sapiens
ggcaggtcctgagaagctggagagtgaggggagcaaggccttcctggagcctgtcccttcattattcactacttaccctctctatgcc

SEQ ID NO: 6833048 - DNA, 56 bp, Homo sapiens
gcatggaacctgccagtccaggctcctttctggatggaacactggctttccactgt

SEQ ID NO: 6833049 - DNA, 58 bp, Homo sapiens
tcatgacaacttgcacagttttgaggttgagacttttgatatgtgtaagttgcataga

SEQ ID NO: 6833050 - DNA, 79 bp, Homo sapiens
tctcctttttctgggacccccactgcgtagctcggcatgggtccaagtcttcagggggggctcagcaaagacttggtga

SEQ ID NO: 6833051 - DNA, 66 bp, Homo sapiens
gtgacaaatgaagtcactgaccttgtataagtcattttaggaagggtcaacatttcattgattcat

SEQ ID NO: 6833052 - DNA, 108 bp, Homo sapiens
tcagtgcgcgtatgtcagtgtgtgtgcaccccgtctgcacgtccacgcgtgtgtgcttgtgagcgcgcgtctgtgtgtgcaggcatgtgtacgctggtccgtgcctga

SEQ ID NO: 6833053 - DNA, 66 bp, Homo sapiens
accctcagcctgccccccagcctcagtctccccaagcctgcagtggggccggtgaggccgaggcgt

SEQ ID NO: 6833054 - DNA, 73 bp, Homo sapiens
ggctcttttaggtgttttgctcaggatttgagacacgttttctctccctcagaggagcacctgttgaagaatc

SEQ ID NO: 6833055 - DNA, 102 bp, Homo sapiens
ttgagatggagtctcgctctgttgccaggctggagttcagtgatgctatcttggctcactgcaacctccacctcccgggttcaagcgattctcctgcctcag

SEQ ID NO: 6833056 - DNA, 57 bp, Homo sapiens
actccctgggcctcggagcacaggagacatttgtactcttgccatctgagcctgagt

SEQ ID NO: 6833057 - DNA, 107 bp, Homo sapiens
tagaatgttgcagaggatttcttgcgtgtagctgatctgagattttccaagttccaagaaggggtcaagcggcagctacaggacattttccaaaatgcaacaaccta

SEQ ID NO: 6833058 - DNA, 95 bp, Homo sapiens
gtttgaggctgcagtgagttatgatggcaccactgcactccaatctggggagctgcagtgcaatggtgccatcatagctcactgcagcctcgaac

SEQ ID NO: 6833059 - DNA, 60 bp, Homo sapiens
ccaaattgccagcccacagagttgtgaactaataacctgctgtgctggtcagtccaatgg

SEQ ID NO: 6833060 - DNA, 102 bp, Homo sapiens
tgtattgaatttaggtttctttgatttattgcaagagctgtaaggtaaccaaaaatgtttaaattaacagctctgcattttgggttaaaaccaaaagatgca

SEQ ID NO: 6833061 - DNA, 75 bp, Homo sapiens
tcgtgaaactgtttttctgtgcacagtagctttagattactaccagactgtgcacacaaaaatagattttagtga

SEQ ID NO: 6833062 - DNA, 64 bp, Homo sapiens
tccctgagaggtaggaaatgaacaaggtgatctggacaatttgcccagcatctgccttagggga

SEQ ID NO: 6833063 - DNA, 58 bp, Homo sapiens
gacctacagttaattagttggagatgttgaagctgctttgacagtactctgtaggatc

SEQ ID NO: 6833064 - DNA, 88 bp, Homo sapiens
tctcagatactgccccagacctactgaatgggaatctgcattttcacaagattccccaggagatttgggagcacactgaagtttggga

SEQ ID NO: 6833065 - DNA, 83 bp, Homo sapiens
ctgctacttaatccattttaactgttagtgcaaggccgtccctctaaaaccttgcaaactattggtagagatgggaatggcag

SEQ ID NO: 6833066 - DNA, 77 bp, Homo sapiens
gcaggagtcctctccagactttctgcaggatcgctaatgagatcaagtctgcctgtctggaggggcgattatcctgc

SEQ ID NO: 6833067 - DNA, 63 bp, Homo sapiens
agccattttcctgaaatataacatgtttatgtcctttctagacatatggagggatcagtggct

SEQ ID NO: 6833068 - DNA, 67 bp, Homo sapiens
aaatgccattcaatgaggcatctggaaatttgtatgagcattttgttgtcacatgtggatggtattt

SEQ ID NO: 6833069 - DNA, 78 bp, Homo sapiens
atcctggacaacatggtgaaaccccgtctctactaaaaatacaaaaattagctgggcatggcacctgtactcctagat

SEQ ID NO: 6833070 - DNA, 89 bp, Homo sapiens
ggagaatcgcttgaacctgggaggcggaggttgcagtgagttgagatcacgccattgcactccagctagggcaagaaaagcgaaactcc

SEQ ID NO: 6833071 - DNA, 83 bp, Homo sapiens
gagaagaggtgggaagttcttggaggatgaagagtagacacctcctggagctcttgatttccaggagctagtggcctcatctt

SEQ ID NO: 6833072 - DNA, 63 bp, Homo sapiens
ggatctgagggattaactaattcgtgtaaggtaacccagatacaagtgctgaccctgggatcc

SEQ ID NO: 6833073 - DNA, 116 bp, Homo sapiens
cagcggccgccacccttcgttgcccctggagccgccggggaggccagtgtcggagccagccatgcggcggctcctctctggccgctcccgcggggccggggcttcggcggctgctg

SEQ ID NO: 6833074 - DNA, 100 bp, Homo sapiens
gggggaggaggaggacgaggaggaggaggaggaggaggagaaggagaaatggactctcactcttcacgccaagtgcccctcattgtgttcatcatccccc

SEQ ID NO: 6833075 - DNA, 96 bp, Homo sapiens
aagtagtcctcgggaattatatgcaatttgcagattctgtcaggtttctcaggaagacgtgctcaatttgtaaatttatgtgaccagggaatattt

SEQ ID NO: 6833076 - DNA, 55 bp, Homo sapiens
tcaggaggagctcataagtttggctttgcagatgttgaggtttaggctctcttga

SEQ ID NO: 6833077 - DNA, 60 bp, Homo sapiens
tggagtgtctttcttgccactttagccctttggtttggtggcagtcttaagagatcttca

SEQ ID NO: 6833078 - DNA, 82 bp, Homo sapiens
ttgtgatttaattcctgcatacataatcgagaccagtaataccattagtgtctcaggactgttgtggggattgaatgaataa

SEQ ID NO: 6833079 - DNA, 68 bp, Homo sapiens
gggcagaggctctggcccatcctggcctcctgctcagccttggccaatggggctagagggttctgccc

SEQ ID NO: 6833080 - DNA, 56 bp, Homo sapiens
ttctggaggtgtgaccattagcatttctcctaatctgctctgtctacctcatagaa

SEQ ID NO: 6833081 - DNA, 64 bp, Homo sapiens
gcacacggcagcctcctcctgagatagtgtccatcgcaaaccaggagatggctgctgtgtcagc

SEQ ID NO: 6833082 - DNA, 57 bp, Homo sapiens
gtggcttgagcaggggcagaggttgtgatgctatttctgttgactcctagcagccat

SEQ ID NO: 6833083 - DNA, 82 bp, Homo sapiens
gggcagctgtggatgccgcaggcttcatggagctcccctaggctggagggggctggatgggagccttggccttcagggtccc

SEQ ID NO: 6833084 - DNA, 61 bp, Homo sapiens
ttgcatgtgtataaaagttggaaatcagtacagtgtaatcagcttttattttacagagcaa

SEQ ID NO: 6833085 - DNA, 60 bp, Homo sapiens
aagatggcccagggcacagcagggagatggccttatttccttatgccttttggctacctt

SEQ ID NO: 6833086 - DNA, 57 bp, Homo sapiens
atgtggtttttatggttctggagttccacatggcccagtctctttccaaaatcacat

SEQ ID NO: 6833087 - DNA, 68 bp, Homo sapiens
ggtgctaccatgctctgcatctcacaaagggttgctctctttgtaaggtgagagtcatggctggcacc

SEQ ID NO: 6833088 - DNA, 72 bp, Homo sapiens
cacagctggtgacagagcccagacttcccccaggtttctggcgggtccgggggtctctcctccccagctgtg

SEQ ID NO: 6833089 - DNA, 68 bp, Homo sapiens
tgaaatgaatgtgattcgatagttatcgcatcctcataaatgtgttagattgaatcccattcatttta

SEQ ID NO: 6833090 - DNA, 55 bp, Homo sapiens
acttgttgaggaatgttttccacagtgcagtgttttacattcccatcagcaatgt

SEQ ID NO: 6833091 - DNA, 76 bp, Homo sapiens
ttgaggtaataaacagccattcctgttggataaccccagagagtgagacttggctgcatatccctacctgcctcaa

SEQ ID NO: 6833092 - DNA, 65 bp, Homo sapiens
ttttatcagcagggataacaagagtcttttttccttctttctcaactcagtccctgctggtcaaa

SEQ ID NO: 6833093 - DNA, 59 bp, Homo sapiens
gaagtgtctgacacaaaatatgtacttgtaagggtgggtaactacatgtcaggcacttt

SEQ ID NO: 6833094 - DNA, 73 bp, Homo sapiens
aaagaatttcatatccctgttttcggtgtgctgtgtcactgtttgccatgggtaaaggtatatgaatctcttt

SEQ ID NO: 6833095 - DNA, 75 bp, Homo sapiens
ggtgagtcgctgcagctgcaggcccccaggtcctcgtgagaggcagtcagcacctgcagctgctggggctccacc

SEQ ID NO: 6833096 - DNA, 73 bp, Homo sapiens
ggcaaagacccagaaggcaagcacaaacttggcatgtttgagaagttagaagtgtgtcatctgtgtctctgtc

SEQ ID NO: 6833097 - DNA, 77 bp, Homo sapiens
ggacacaccacacattgaattcattcttgtagctgctactaggcaacaagataaggtgtcagtgtgtggtggtgttc

SEQ ID NO: 6833098 - DNA, 97 bp, Homo sapiens
gtgggatgggttgggggtgttttttgagggattgcaccagaagagacacaaaagttcctctttgctttctcttataagcccctcttccttttcttat

SEQ ID NO: 6833099 - DNA, 71 bp, Homo sapiens
aagattaggatcttcattgtgctgcaaatagctataatatatatgcagtctaactgggaaggtagtgtctt

SEQ ID NO: 6833100 - DNA, 130 bp, Homo sapiens
tgattttaactcgtttatttcagagctctttgcctcacctttatttttagatttagtcgtgtttgctgaaatatcagttgcttcttctgtgaatgaagtgtgggaacttgctctcgtcgcagttaatgaa

SEQ ID NO: 6833101 - DNA, 76 bp, Homo sapiens
cagttttcattactgctgtgattttcatatcagatcatgggggagggaggtagagatcacatgctgatggaaaatg

SEQ ID NO: 6833102 - DNA, 66 bp, Homo sapiens
tgtgttagtaactacctttattgcatggacaagacaggtctattaattgcttgagttagtaataca

SEQ ID NO: 6833103 - DNA, 78 bp, Homo sapiens
ttcaaagaacttagcacagagccaggtaggaggcagacactcagttaatcttacctgccttgcgcaagtcctcctgag

SEQ ID NO: 6833104 - DNA, 70 bp, Homo sapiens
tacatgtgcatgtgtatatgtgtgtacatgtgcatatgtatatgtacatacatgtgcatacgtatatgta

SEQ ID NO: 6833105 - DNA, 80 bp, Homo sapiens
ggtggagaagggaagaaacagttcttgagcccctactgtttggtgaatgttcacatgtgttatcttctttaatccccacc

SEQ ID NO: 6833106 - DNA, 64 bp, Homo sapiens
caacacttcttatacttactgaagagacagacatactgcaaattcagtgtatttaagaatgttg

SEQ ID NO: 6833107 - DNA, 72 bp, Homo sapiens
gaaccgaggatatggcattctttttaagggtgtgtgtattcacaacttagggaagaatcccaaattgaattc

SEQ ID NO: 6833108 - DNA, 59 bp, Homo sapiens
ggacaggcgcagggccaaggaagtctttgtttttgtttctttctctagcccttcctgcc

SEQ ID NO: 6833109 - DNA, 56 bp, Homo sapiens
agcagttatgttctataaagtcattatgaacattgagttattgaacgctgattgct

SEQ ID NO: 6833110 - DNA, 111 bp, Homo sapiens
gtacctactgtatcttttctctaattagagatggcgtatagactggctcattacttctgcctaatgagccaggctccatgccacctctctaatcagaaaagagataggtac

SEQ ID NO: 6833111 - DNA, 59 bp, Homo sapiens
caagaggtggtaggtgcaggattcaaacttaggggtctggctcccagcctgctctcatg

SEQ ID NO: 6833112 - DNA, 92 bp, Homo sapiens
agggtgtggatgatgaacataggggtggagtggattgcagcctctgagttgaaggcactcagagtatttcattcttaggtgtctcctgcctt

SEQ ID NO: 6833113 - DNA, 84 bp, Homo sapiens
tgctttataagcaaactaacagatggctgaatctggatataactgcggagaccattttcagcatttctgttgttggctaaagca

SEQ ID NO: 6833114 - DNA, 60 bp, Homo sapiens
cttatcttctctctttacttgttcgttggtttactaatggccttcatgatagaaggtaag

SEQ ID NO: 6833115 - DNA, 108 bp, Homo sapiens
acattactaagtaaaacaacctaaagttactgatcatttttctgttttgggaggaaaatgaatactttttttgtcggtttatctttgctatttttttaacctaagtgt

SEQ ID NO: 6833116 - DNA, 60 bp, Homo sapiens
gggctgtttgcatatgtttatagagtatttagtttactctaaaagatgacaagacagctc

SEQ ID NO: 6833117 - DNA, 76 bp, Homo sapiens
ggtcagaatggtgtctgtcatctgagatggagtggggtttccattaccccctctgggtgacagactcttggttacc

SEQ ID NO: 6833118 - DNA, 60 bp, Homo sapiens
gtaatgtgtgtattgagcatctgctttgtgacagtgtgttagatgctttgcttacgttat

SEQ ID NO: 6833119 - DNA, 77 bp, Homo sapiens
gcagaagttcacatagctggcaggtggcagagctgggattagaatggtgatctgcctggctccaggtgagctgctgt

SEQ ID NO: 6833120 - DNA, 117 bp, Homo sapiens
aatgacattcatttcatagaactgttaagagcgtgaaatgagttgaattattgctctttatttccaaagcccttagctcaatttcttgcccacagtatctgctatgtaactgttatt

SEQ ID NO: 6833121 - DNA, 106 bp, Homo sapiens
actgtattatgggagagcatgtgggatgggagatattgctgtggctgtctttgaaaatacaatctgtcgtgtttccccttcctttctgttttccagctacactagt

SEQ ID NO: 6833122 - DNA, 56 bp, Homo sapiens
cagttatgaggtgtttctggcagcttcctggactcagaataataacctagtaactg

SEQ ID NO: 6833123 - DNA, 108 bp, Homo sapiens
tttagaatcttggatctcttccactcacactaggatgttgtttctagaaatctccctgaagtatggtactgactcttggtggtaaaagtggagaggcttagaactgaa

SEQ ID NO: 6833124 - DNA, 82 bp, Homo sapiens
gccctccccccaggtttggtctcctttgtcaaggccccgctgcctcagtggtggccaggtggctgtcctggcgtgggagggc

SEQ ID NO: 6833125 - DNA, 56 bp, Homo sapiens
tatgaactgtactgtactaagctacggtaaaattgtttggtacaatttagggcata

SEQ ID NO: 6833126 - DNA, 62 bp, Homo sapiens
taacatggtactgagtgaggaaatttcatgcctctaagtctccccctccaattgccatgtta

SEQ ID NO: 6833127 - DNA, 73 bp, Homo sapiens
aaaatactagactgttctgttatcacttggccaggaatgtactggagtgggggacaggaaagctagttatttt

SEQ ID NO: 6833128 - DNA, 62 bp, Homo sapiens
ggattggaggagctgctgagggttgggttacaagggccaggggtgctctggttccttcaacc

SEQ ID NO: 6833129 - DNA, 56 bp, Homo sapiens
atgtgcttcaggatgtcagtgtctggtcatgaaaacagagaccattctagccacat

SEQ ID NO: 6833130 - DNA, 58 bp, Homo sapiens
taggattgtggtgagactgcatatcatgaggaagataaagcatcgagccccaatcctg

SEQ ID NO: 6833131 - DNA, 57 bp, Homo sapiens
tatcaatctaagtataacatcagtatgtaaacagattgatgaattgctagattgcta

SEQ ID NO: 6833132 - DNA, 57 bp, Homo sapiens
ccatgacaaggtcagcacaaggtcagcattacttccactgctttcattttgtcatgg

SEQ ID NO: 6833133 - DNA, 113 bp, Homo sapiens
gtctaaaaatttctgacaatttaagccaaaagcagctgtctgtgaatccttctaagaagaatttaaactgtttttgctcaaaatatgtccagcatttattctatttgagagac

SEQ ID NO: 6833134 - DNA, 82 bp, Homo sapiens
gcttctgtacaagttgtggctgctcagaagaggcccaaggagccccgtaatgagtgtcacaaacctgccttgtaaagacagc

SEQ ID NO: 6833135 - DNA, 66 bp, Homo sapiens
ttctttggcatttcctgtatgtccctgccacattcccactctaagctcatgataggagccagggaa

SEQ ID NO: 6833136 - DNA, 68 bp, Homo sapiens
gtgtaacatttagttttaagatggtatctttaaatagataccttagctgttaaaactaagtgatatat

SEQ ID NO: 6833137 - DNA, 56 bp, Homo sapiens
aaatatgctgtactaggtgtagcataacattgttactgccttgttcatgtgtattt

SEQ ID NO: 6833138 - DNA, 100 bp, Homo sapiens
ggccttgatgcctccttgcctgactggtgggaagatggaaaacatttttgcagctcaagaggttggttctggcccccacattcaatggggctctagggcc

SEQ ID NO: 6833139 - DNA, 86 bp, Homo sapiens
gcagccttctgggccagatctagggatcttccctccctccctgcactctagctgcaggagcttcctggtgtctgcccagagcttgc

SEQ ID NO: 6833140 - DNA, 62 bp, Homo sapiens
gtgtggggagctgcagccacattcccgcggacaggctgctcagtggtggcagttgcccatgc

SEQ ID NO: 6833141 - DNA, 76 bp, Homo sapiens
atgggccacactgtgagaagttcctgagtcagcttccattgttagtgctcagaaacttgctcattttctcctccat

SEQ ID NO: 6833142 - DNA, 81 bp, Homo sapiens
ttgttataaatcattgttcttcagatttgactgggtaaatattccctcaggttatttcctgacacagctgattaataacag

SEQ ID NO: 6833143 - DNA, 84 bp, Homo sapiens
catttcttccctgctggaagcctttctaactcctattagctcactggatgctgctttcaaaggctttctagatggggtggaatg

SEQ ID NO: 6833144 - DNA, 124 bp, Homo sapiens
gttgaagtagatttttcaattagaaagtaaatggaacgcattgtaaatgactgcagcttctcttgttgtgtttttactgtgatccagaaatgactatattgatttttgaagtttttacgttaac

SEQ ID NO: 6833145 - DNA, 57 bp, Homo sapiens
gtaaggaccacacaatctgccatgtaagttattggcctgagtgatggatctccttgc

SEQ ID NO: 6833146 - DNA, 57 bp, Homo sapiens
catgtggacaaatactctgttgtaccctgctgcacagagctgtacatgtgccatgtg

SEQ ID NO: 6833147 - DNA, 60 bp, Homo sapiens
gccagagattctggttaggtgtatttcacatagaaagctaccttggcagaattgaatggt

SEQ ID NO: 6833148 - DNA, 61 bp, Homo sapiens
ggagtctgggtccgggggtgaattgagcccgagctcagtcccagtgcttgcctttgctgcc

SEQ ID NO: 6833149 - DNA, 72 bp, Homo sapiens
gaattcttctaaatctagcgctgattacttatgttatatatatttcatttggctgggtgttagaaagaattt

SEQ ID NO: 6833150 - DNA, 58 bp, Homo sapiens
gtgtaaagatgccaggaatcttgcagtaaagatctttgagtcctggtattgcaagcac

SEQ ID NO: 6833151 - DNA, 92 bp, Homo sapiens
aaaatgctcagcaccaggtctggaatgtagtgagttcctgcttggtagtgattgctgatattccattttactgtcaccgtgctgggtatttt

SEQ ID NO: 6833152 - DNA, 74 bp, Homo sapiens
gagttgggggagagttaaaaggaaactatggaaatccttttttaattcctagacttttaagtccctctttactc

SEQ ID NO: 6833153 - DNA, 80 bp, Homo sapiens
agagtctgtcgcccagcctggagggcagtggtgggatcttggctcactgcaatctctgccttccaggctcaagcaattct

SEQ ID NO: 6833154 - DNA, 75 bp, Homo sapiens
taaagaatcttctgtgttgctctttgtccactacatgtgtggggcttacagggaaggagcatagaaaaagtttta

SEQ ID NO: 6833155 - DNA, 77 bp, Homo sapiens
tctaaagttagttgcagtcacactctaaagtagtaacccagctggcaactgtgagtttggctgcatggattagtaga

SEQ ID NO: 6833156 - DNA, 55 bp, Homo sapiens
tacagtgtctgcaactgcacacctaggatacaaggtggagacagagggcactgtg

SEQ ID NO: 6833157 - DNA, 72 bp, Homo sapiens
ttgttttctgcttaataatgttttaggtgctgtggtaaaaatatctagacatctgaaacatttaggaaacaa

SEQ ID NO: 6833158 - DNA, 55 bp, Homo sapiens
ccggaatcctgctttcaattcttttgaaagaattgaaagaagtgggattgccagg

SEQ ID NO: 6833159 - DNA, 75 bp, Homo sapiens
agcaagcattttgatcagtcataaattggatccttttacaaaaaaggcttagattgacactgatctcactttgct

SEQ ID NO: 6833160 - DNA, 101 bp, Homo sapiens
cacatctgtcgttgatggtctaaatatttgcatgtttgcaggtccagcgatggcacaatgcctagcagcagaaggtttgcacccactgtgcgacatgagtg

SEQ ID NO: 6833161 - DNA, 69 bp, Homo sapiens
cacaggctcttctcacttgattcccggttttctttggagatgccattagtcacagagggaagagccttg

SEQ ID NO: 6833162 - DNA, 69 bp, Homo sapiens
gaagcttcctgcagctcctgagctcagagacagcagtggcttctctgtgcaggatgctgagttcacttc

SEQ ID NO: 6833163 - DNA, 61 bp, Homo sapiens
ggcgaggcgcgcggcccgggccagcatctgtttgaaggcgctgtttcccgtgcgctgcgtc

SEQ ID NO: 6833164 - DNA, 74 bp, Homo sapiens
gagggccatgcagagggagacccggttgtatcctcaaagcctcattactacaaccatcgtctttgcagccactc

SEQ ID NO: 6833165 - DNA, 68 bp, Homo sapiens
gtggtcctgatgtcttctataatgactcgatgtttttaggaatcagagtcctggacacagagacacat

SEQ ID NO: 6833166 - DNA, 85 bp, Homo sapiens
gggactaagtactgactacttggtacctgaagatcgggattcttttctactccctcagaccttgctagtagtctaggcttatccc

SEQ ID NO: 6833167 - DNA, 76 bp, Homo sapiens
gtgctggagggctgagtgggagagagttgcaaataaaaatgttatattaattctaaaaacctatggcccccttcac

SEQ ID NO: 6833168 - DNA, 79 bp, Homo sapiens
gagaggaggctatgccgaggcctgagcagaggagtggacgttctgtgctggatgcctctgctcggactttgcctccctc

SEQ ID NO: 6833169 - DNA, 79 bp, Homo sapiens
gatatgccaagctttgcaccggtggctggaggcctagcggggattccaccggaaatctggttctagagaatggtatatt

SEQ ID NO: 6833170 - DNA, 75 bp, Homo sapiens
ttactccaaaacatatttgattggcatctgcttgaagagactttggatgtctttctaatactggcttttgagtga

SEQ ID NO: 6833171 - DNA, 60 bp, Homo sapiens
tgctctcagagaggagtgcgtgtgatttccaccttattgcattatcctctctgaagacca

SEQ ID NO: 6833172 - DNA, 59 bp, Homo sapiens
ccatgtgctataccacattggaaatgtcagcaaattccataaaggtgatagtatacagg

SEQ ID NO: 6833173 - DNA, 87 bp, Homo sapiens
cctgctcgagtttcatggggtgggcgtgcagggacacccagctaatttatggaatgtgtactgagtgccccttggaatagatgcagg

SEQ ID NO: 6833174 - DNA, 56 bp, Homo sapiens
gggcctgcaggtggtgtggaggagagggtcccctctacaaagctgtgtcaggaccc

SEQ ID NO: 6833175 - DNA, 101 bp, Homo sapiens
gtaggatcattgattggacctatgatgaaatgataggtttgttataggtggagaagaacaaataggctgagccatttcaagtagaccagctaagattttac

SEQ ID NO: 6833176 - DNA, 69 bp, Homo sapiens
taggtgtcttgtgtatggtacaagtttgaaagtgtttatgtgcactacctgttccattcatcatatcta

SEQ ID NO: 6833177 - DNA, 56 bp, Homo sapiens
agctgtcttgatgattggatgcttaacagagcatataaattcagccacagatagtt

SEQ ID NO: 6833178 - DNA, 62 bp, Homo sapiens
tgagtgcatgctctcccactaaaagagcgaacagtgttcatgtgtgagtagcatgtgtctca

SEQ ID NO: 6833179 - DNA, 57 bp, Homo sapiens
cccaaaggagagtgagtcagatgccctgcacaccagccaggggctcctcccctgggg

SEQ ID NO: 6833180 - DNA, 81 bp, Homo sapiens
gggggagggagttgcatgtaagtgtgcatgtgcatgagtgtgtgtgtgtgtttgtacatgaatgtgcacccaacatctcct

SEQ ID NO: 6833181 - DNA, 108 bp, Homo sapiens
agctgagtgctggccgcattgctctggcctccctgggatttcacatttgatcgcttttcagtgtggctgcaaaggaaggctgcaggagccatttggtgggcactggct

SEQ ID NO: 6833182 - DNA, 64 bp, Homo sapiens
cggctccaggaccagggctcctggagctgtcgcctccgaaagggtcctgcgtccttcggagccg

SEQ ID NO: 6833183 - DNA, 90 bp, Homo sapiens
tcctgcattgtatggttataaatagcaccctagtgagtgctgtcgtccagtctctcttgggtgtggtttgaatgatctcgggatgcatga

SEQ ID NO: 6833184 - DNA, 76 bp, Homo sapiens
gcctagaaatatctacatttgttttctctcatcaatattatcagcttctgagggatcaaaaaatgtacatgcaggc

SEQ ID NO: 6833185 - DNA, 55 bp, Homo sapiens
ggcagagcattggagggaccctgggggaccttctccctggttctgatgttctgct

SEQ ID NO: 6833186 - DNA, 76 bp, Homo sapiens
tccatcaggctagctcatgtaagagagcattagtttgttccaaaacaagggcatttttacagagccctaggatggg

SEQ ID NO: 6833187 - DNA, 94 bp, Homo sapiens
ccttgagaggttgctgaaagccctgactggctccagaaatgggcagtgttacctcttcagtgggtttcagtagctgtaaacttgaaacttaagg

SEQ ID NO: 6833188 - DNA, 88 bp, Homo sapiens
gacattaaacagtacttcagaggctgcccaggagttctatgatgatgagatggacccaccgggagccctggagtaatggttcagtttc

SEQ ID NO: 6833189 - DNA, 70 bp, Homo sapiens
caacagctgggcaaaggtgaaagggtggtgccctgccccaaattccttatacctttgctccgcttcattg

SEQ ID NO: 6833190 - DNA, 98 bp, Homo sapiens
gccttccggcagaagagggtaaaggtggagatgaattggcctttctgcgtttcagaaatgtgaatttcatttccttccacacctctctgtccagtggc

SEQ ID NO: 6833191 - DNA, 63 bp, Homo sapiens
gctggactgcgttacggacatgggcttccttcgggtggcatcagtttggagaggcggtttggc

SEQ ID NO: 6833192 - DNA, 86 bp, Homo sapiens
agattgtagagagtttgtgtaacatgatgatgatgatgatgtaaggatttgtatctcttatgtcacataaaccataaatacggttt

SEQ ID NO: 6833193 - DNA, 58 bp, Homo sapiens
ccttcagccagttttctttgttgcagaagtatttgtctggttaggattctgctgaagg

SEQ ID NO: 6833194 - DNA, 61 bp, Homo sapiens
tttgggaggaaggatttttgccttctcagtctactgattcaaatgctaacttctttccaaa

SEQ ID NO: 6833195 - DNA, 59 bp, Homo sapiens
cccaaggagtcctgaagctgttcctagatttttttctcccttctctggattccgttggg

SEQ ID NO: 6833196 - DNA, 82 bp, Homo sapiens
tggtactgaaaaataggtcaaccgtgtatgattcgtcacaaataaagcgaaggcaacacggataacctatcttcaagtacca

SEQ ID NO: 6833197 - DNA, 85 bp, Homo sapiens
gcgttttccgtttccagttctgctatcttgtcttctttggcctacaaccaaggatgcaaaaaggacagcgaacaacagagcacgc

SEQ ID NO: 6833198 - DNA, 58 bp, Homo sapiens
gaaactctcgcatcctgggaaccccttcagttctgggcagaccaggagcgtgggtctc

SEQ ID NO: 6833199 - DNA, 80 bp, Homo sapiens
cgctgctgcttctgggaggcctttgtgtctgtgcctgtaacatgggccatgattctctgccttccccatgggctgctgtg

SEQ ID NO: 6833200 - DNA, 56 bp, Homo sapiens
ggtgggagatgggggagaggtggttttcaatggttaattcttctacctctaccact

SEQ ID NO: 6833201 - DNA, 56 bp, Homo sapiens
attgacacaatgggatgtaagggagtttctagctgtaccatcctattgtgcacaat

SEQ ID NO: 6833202 - DNA, 109 bp, Homo sapiens
tttcccatcacctagcaccatctgagaattctagtcacacacattcagagagacctttctcatggtgtttctacaattctgttgccagtcttgactaggaggcgggggg

SEQ ID NO: 6833203 - DNA, 86 bp, Homo sapiens
gcagcccctgttaaataaatcatccagtaacggtttctaattcccagacttggttgcaaatgaattattcacatggtaaggcctgc

SEQ ID NO: 6833204 - DNA, 57 bp, Homo sapiens
tgacaccctctcctggagagaggctcacagcgtagctgttcccaggaaaggggtgca

SEQ ID NO: 6833205 - DNA, 86 bp, Homo sapiens
agagtcagtgtctgatgcttgcaacaaagaaccctgactgacacgtagagggttttcttattgtaaagtgttgtcggcactgctct

SEQ ID NO: 6833206 - DNA, 76 bp, Homo sapiens
ggggactgtgggagcgcagtggcagctggtgactgcccggatccgctggttcttgttgcttcctccccatgtcccc

SEQ ID NO: 6833207 - DNA, 73 bp, Homo sapiens
gattttgaggccatgcctcctgatcagttttatatctgaatcaagaactgagttatgggtatgccttgagatt

SEQ ID NO: 6833208 - DNA, 67 bp, Homo sapiens
ccacaataaatgctgggcgtggccattgtgttctaacatccatgcctctgcagctgtttattagtgg

SEQ ID NO: 6833209 - DNA, 55 bp, Homo sapiens
agagtgttttggagtgggaaggcaggcttcacttgcatttcacccagggcactct

SEQ ID NO: 6833210 - DNA, 110 bp, Homo sapiens
actgcccttctctttcttgctcctgttcttatggctatttctccctatgagttaccctcgttctctcgggctgtagcctgaggatgaagtagataagagtttagcgtagt

SEQ ID NO: 6833211 - DNA, 86 bp, Homo sapiens
tgctgttgcgattagatgatgacagctagctggcttttaaaattgatcaggaagtattctggcagtcattcagtgttgtaatagca

SEQ ID NO: 6833212 - DNA, 59 bp, Homo sapiens
tgaggcggggaaggaggggacggggaagaggtcggatcacgtccagcctttgggtctta

SEQ ID NO: 6833213 - DNA, 79 bp, Homo sapiens
tttcaacctcttcatccagcttggcagagctacctggggtgtgtaggagaggccagagctggaagaaaggaggctggaa

SEQ ID NO: 6833214 - DNA, 124 bp, Homo sapiens
ttgagaatgaaatcctttcatgttatcttcttttgtttagtctgttggacattttcctttggattcaagtgtttattgattggtctagggggtgtgacaactagagtgacttcctacttctcaa

SEQ ID NO: 6833215 - DNA, 60 bp, Homo sapiens
gaggagctgattagagagggtcattgggttctcactggctggccctcaggcagctccatc

SEQ ID NO: 6833216 - DNA, 85 bp, Homo sapiens
tctccttcctgaggagatgtggcatctgggtgacagcagtagagggcctctagctttcttccggagccgcaggcagggaggcaga

SEQ ID NO: 6833217 - DNA, 61 bp, Homo sapiens
ctctttctcgccgcccgcagtccgacgcagacaggtcgatagctggttaatgcagaaggag

SEQ ID NO: 6833218 - DNA, 66 bp, Homo sapiens
tgaatcatcttgaaagtctatgttttgggttgttttttccagcagcctgatgatctgggttgttca

SEQ ID NO: 6833219 - DNA, 87 bp, Homo sapiens
ctctactcatgcagttccttttgcctggaaagttacttccttcacaaatgccaggacagcattttcagcatctctgcatctgtagag

SEQ ID NO: 6833220 - DNA, 58 bp, Homo sapiens
gcaagttttcattcgttagcataacctgggtaaagttttttgttaaatgaagatttgc

SEQ ID NO: 6833221 - DNA, 71 bp, Homo sapiens
gccggggagggtgatcagcagacaggcctggctggagtggaagggcgtgatctggaggtcccagccctgtc

SEQ ID NO: 6833222 - DNA, 100 bp, Homo sapiens
agcctttggacactcaagagagaaaagtgccagcttctaaggacccaggcttcctatgtgaggcctgtggtcgggttggcgtgagctctgtcctggggct

SEQ ID NO: 6833223 - DNA, 107 bp, Homo sapiens
cctgggagctgatttaaaatgcagatttttggctttatccccaagttactggttcagtagctgttgggagagggctagaaattgcgtttttaataagagcccctagg

SEQ ID NO: 6833224 - DNA, 58 bp, Homo sapiens
ccatggcttggaaagggaggtggtgttttccacaagactcttgtgtcagagccagagg

SEQ ID NO: 6833225 - DNA, 85 bp, Homo sapiens
tgtttggaggcattttaggttgtcactacttggggaggcacattaccagcctctactgtgtataacccaaatatgctgctaaaca

SEQ ID NO: 6833226 - DNA, 84 bp, Homo sapiens
ggccagtgtgaggacagacaggtgtggtaggcacaggtgcagggctgctggcctcactcactctgaatggcagactcacaggcc

SEQ ID NO: 6833227 - DNA, 78 bp, Homo sapiens
tgagtttactattgggctgcccacctcggagagacgatgagtttgtcccagttttgcaggttagaaatagaaagctca

SEQ ID NO: 6833228 - DNA, 86 bp, Homo sapiens
ctgggggtcagaggtcactgcaggtttaacagagtgctcaggagggtagcatctgaataaagacttgcagatgacaagccattcag

SEQ ID NO: 6833229 - DNA, 105 bp, Homo sapiens
ctgaggcccagagatctcatggtcacacaggcactcggggaacagatctggaacttgggtccaggagtcctgggtggcccccgtgggaacagtttcagggtccag

SEQ ID NO: 6833230 - DNA, 64 bp, Homo sapiens
gcaaatagttctagctcagaagctctcctgaggttgcagttgagcttcagctgggactgcaggc

SEQ ID NO: 6833231 - DNA, 62 bp, Homo sapiens
aggctatcagatagaatgaaggtagagtaaaacttttccttaactttaatatctgagagtct

SEQ ID NO: 6833232 - DNA, 89 bp, Homo sapiens
taatgatctctactgcttcttcttttaataaatgtctttagtagctagagaacagttacacaagagaaaggaccaacgagaaatcattg

SEQ ID NO: 6833233 - DNA, 62 bp, Homo sapiens
ttggcctcaagaatgccaattacagatgctctgctgtctgattagagcattcttgagtccag

SEQ ID NO: 6833234 - DNA, 58 bp, Homo sapiens
cctagattaattttctgacctttacaactgcaaggtctctgcagaaagtaagtcaggg

SEQ ID NO: 6833235 - DNA, 70 bp, Homo sapiens
taggaaacacatcctgaaagaaacatttcctgatccaacctagatcaggtgcctctcctcagggtcccta

SEQ ID NO: 6833236 - DNA, 90 bp, Homo sapiens
gcattccggggccctgaggatgccagcatgggtggtcctgggctcgccctctccacagcatggctggcgttcctcgactgccgccggagc

SEQ ID NO: 6833237 - DNA, 69 bp, Homo sapiens
atttcctgctttctcttcactgatgttcaagtgctggcttggaaagaccccaaagaggaggaaggaaat

SEQ ID NO: 6833238 - DNA, 57 bp, Homo sapiens
gccatcattataggtttcttgcttcttatcacaacagcaaggcttctttgatggggt

SEQ ID NO: 6833239 - DNA, 74 bp, Homo sapiens
gtagagatggggtcttgctatgattcccaggctggtcttgaattcctgggctcaagtaatactcccatcttggc

SEQ ID NO: 6833240 - DNA, 63 bp, Homo sapiens
ctgattccatcctagtttctctcatccaataatgaaggggagcaaaagctgggaaggagacag

SEQ ID NO: 6833241 - DNA, 58 bp, Homo sapiens
aggtgcattaatggaagagcatcatcccagattcttgcacttctccatagatgcatct

SEQ ID NO: 6833242 - DNA, 58 bp, Homo sapiens
gggcaggtatttatcttctatttcatagataaggagattaataataaataacttgccc

SEQ ID NO: 6833243 - DNA, 78 bp, Homo sapiens
gtgggcccaggtacaagcagattagtgtttatttcactgtggaaactaaagaggtgtttttgcatgggcaataaccac

SEQ ID NO: 6833244 - DNA, 84 bp, Homo sapiens
atgcttgcaagaaacatattccacaagcgtttgggtaagtcatatattatttgacactttggaaataaatttcttgttaagtgt

SEQ ID NO: 6833245 - DNA, 67 bp, Homo sapiens
tacttgtggcactcacctccgtgtccccagtgcccagcacagcatgacacagaatgggtgctcagta

SEQ ID NO: 6833246 - DNA, 66 bp, Homo sapiens
acctctactggccttgcccagcgcctaggtatgtacccacagctggcgctgcatggccagccaggt

SEQ ID NO: 6833247 - DNA, 57 bp, Homo sapiens
ctggatgttttgctaaggactcaatacagttgggtgaagtggaagtagaacgaccag

SEQ ID NO: 6833248 - DNA, 67 bp, Homo sapiens
tctctgacccagatggcaccgtggctacttgacagccccgagccactttgaaccactgaggtggagg

SEQ ID NO: 6833249 - DNA, 120 bp, Homo sapiens
gtcactctggattattttcctgacaagcctgagaaaagctttcttatacaaatttattcattttagtttgttttatgagatattttctgcatgctttggatactcaatagttcttttgac

SEQ ID NO: 6833250 - DNA, 92 bp, Homo sapiens
gataagagaggaaatgacttgtacagggaggcctgtggttaagttattttaacacaagaacttcctgcttgtgcaatatttcctgctctttc

SEQ ID NO: 6833251 - DNA, 61 bp, Homo sapiens
ccacaacattatccctccattttaccattatcgtttggattgaatggagcctagtgtgtgg

SEQ ID NO: 6833252 - DNA, 59 bp, Homo sapiens
aagatccatgagggcagagattgtgtctgtcttattcagcattgtgttttcaggatctt

SEQ ID NO: 6833253 - DNA, 79 bp, Homo sapiens
ctgtgggtcaagaatttggccgtggcttaaccgggtcctctgctcatgcaaggcagccattcaagttgtttatccaggg

SEQ ID NO: 6833254 - DNA, 79 bp, Homo sapiens
ggggacacatgctttaagtcacagagttggaagtcagatccaagtctgattcctaaactgtggataaagttgtgtttcc

SEQ ID NO: 6833255 - DNA, 72 bp, Homo sapiens
tgctgagttctggaggagaactccaatctgaattctactcagtattagctacctatccttcagggcctcaca

SEQ ID NO: 6833256 - DNA, 66 bp, Homo sapiens
gatgcaaagaggaccttcagtaactatttctaaaattgttaaataattgggttcttttcatgtgtc

SEQ ID NO: 6833257 - DNA, 66 bp, Homo sapiens
gttattagctaagatttattaaaggccctctgttttaggggcttcatatgattttatctcaataat

SEQ ID NO: 6833258 - DNA, 103 bp, Homo sapiens
acatatatatgatcttacgtgatactcactattctatcagataggttttctgaatggagcccgatcttgtgggtagtgtattgcttgtacgaaatgaatatgt

SEQ ID NO: 6833259 - DNA, 90 bp, Homo sapiens
gagagtagatcttatagaagtggcagctcagccttcccactccttgacccttcagaggcccagggctgctctctgaatttccccactctc

SEQ ID NO: 6833260 - DNA, 84 bp, Homo sapiens
aggatttagggaataggactttggtcctagctctgttatcagctagctgagctggacactaaaggtccctggtcttcaaattct

SEQ ID NO: 6833261 - DNA, 75 bp, Homo sapiens
ctgactgatttccaggattctaatcttcactgtctaagctgtgggtttccaatcctggatgctggttacagtcag

SEQ ID NO: 6833262 - DNA, 66 bp, Homo sapiens
ggctgcaggcattttcctgggcagggtgcagtcaccatgtgtcactggcagatgcctgcagaagcc

SEQ ID NO: 6833263 - DNA, 60 bp, Homo sapiens
tttgtgttctgatttttctacaatgaatatgaattacttgtgtggaaaaacagaagcaga

SEQ ID NO: 6833264 - DNA, 60 bp, Homo sapiens
gtgaccagatgcaacaacttatcctttaccttagaagagatatcttggcgtgtctcacac

SEQ ID NO: 6833265 - DNA, 130 bp, Homo sapiens
gcctcaatactcaaaggtgaccacatgtagattctgagacaggaagtggagggtgaataggtcaccctcctaacatttccttttttgctgtctagtcatccttgttggtcttctgcttcttggtataggc

SEQ ID NO: 6833266 - DNA, 100 bp, Homo sapiens
tgagatatagtcttgcctgtcacccaggctggtatgcagtggcacgatctcggctcactgcaacctccgcctcccgggttcagacaattctcctgcctca

SEQ ID NO: 6833267 - DNA, 130 bp, Homo sapiens
tcacgtctcaaacagaaacatcatgtggatctttcactcaaaccaaatggaagttgttttcctttccacaacaatatgaattcccttggttagacagtaagaaggtcactggacaatttctgaactgtga

SEQ ID NO: 6833268 - DNA, 73 bp, Homo sapiens
ctggttctgaggtatgtgggactagcctggctggctgaccaggcttcttgagccccacaggcctctttcacag

SEQ ID NO: 6833269 - DNA, 77 bp, Homo sapiens
ttttattctgcaccatgtattcagtttggcacagaacctggctcatagttggctgaaatacatgacaatgaatgaag

SEQ ID NO: 6833270 - DNA, 82 bp, Homo sapiens
aatttctgagttacacaagcaagggtctgcaatgtttttccataaacctctcataccaggcttgatgatttgcttagaaatt

SEQ ID NO: 6833271 - DNA, 64 bp, Homo sapiens
ctttgaagatggatcgccactctcatttagatgaaattctttggagaggagtttattttcaaag

SEQ ID NO: 6833272 - DNA, 59 bp, Homo sapiens
ttcaggggaggggctgtgttgcagagaccacagtcacagcaaagacactctcaactgaa

SEQ ID NO: 6833273 - DNA, 78 bp, Homo sapiens
gaggaggggagagtcttagtgtggttggggactgagtatggcagggactccccagcattgagggtctctctcttcctc

SEQ ID NO: 6833274 - DNA, 68 bp, Homo sapiens
ttctgttcacctctattttgtttgtgccatggcaatttcttcaaggaagactagaccagtgaatagga

SEQ ID NO: 6833275 - DNA, 60 bp, Homo sapiens
gagtgtggaacccgggcatgagctgcttgtgtgggcagctggcaggggttcacactgctc

SEQ ID NO: 6833276 - DNA, 86 bp, Homo sapiens
ctctagcatgatagaaaacttgacagtgagacagtttgagtcgaaagataagaaatgttgtctctgcagcaatgtcatagctggag

SEQ ID NO: 6833277 - DNA, 69 bp, Homo sapiens
gcatgtttactgctctaggttgcacaggcaatgctttgccatgtcaagttgtggcatgtctaaagatgc

SEQ ID NO: 6833278 - DNA, 57 bp, Homo sapiens
gtgttttgtgaggccttctttcctggcagggttgatggtgaatatcctccagaatgc

SEQ ID NO: 6833279 - DNA, 70 bp, Homo sapiens
tattctctgtgtgtgtgcacatgtgtgtatcggtctgtctatctgactgtgtgtaatatgtataagaata

SEQ ID NO: 6833280 - DNA, 130 bp, Homo sapiens
ggtaggagccttttggcagggagcacattctcagtaatgcagagtgcactcacctgggttctagcttcaacacttaggatttgcttgatattttgtattctctgaggcactgcctgtatttgtttctgct

SEQ ID NO: 6833281 - DNA, 61 bp, Homo sapiens
agagccagcatttgacactggcttttctaccagaaaggagtgtggtgttcaagctggttct

SEQ ID NO: 6833282 - DNA, 61 bp, Homo sapiens
gatagggttgcagtgatgggaggaaaaataatctttgctcttattcatctgtagctctttc

SEQ ID NO: 6833283 - DNA, 88 bp, Homo sapiens
ggaaggaggaaggaaggacagggatggttgattgtatgtgagaaatttcagacactgcagtgttcccttcttcctgctcctaccttcc

SEQ ID NO: 6833284 - DNA, 61 bp, Homo sapiens
agctggaataaaggggtgaagagagtagtcccttctctgggagggagcccctttccaagtt

SEQ ID NO: 6833285 - DNA, 68 bp, Homo sapiens
cctcctgtattgccttcacttgccagataggtccatgtgtctgaggagttgggccagtgctgctgagg

SEQ ID NO: 6833286 - DNA, 74 bp, Homo sapiens
tattaggttagtgcaaaagtaattgccgtttttgccattgaaagtaatgcaattatttttgcaccaatgtaatg

SEQ ID NO: 6833287 - DNA, 83 bp, Homo sapiens
ggagaaaggctgatacagttccagaaaaaaatgtatatctaaactttaggtgaagtttttttctggctttgcagtaattaccc

SEQ ID NO: 6833288 - DNA, 73 bp, Homo sapiens
gtccaagggttcacagactcttgattgtctaagcattgttaagatccaggcttctgtgcaatagctcttgaac

SEQ ID NO: 6833289 - DNA, 64 bp, Homo sapiens
tgactccgaagccctgttctttctctcaccctggaggatggatgagggtgggatggggcagtta

SEQ ID NO: 6833290 - DNA, 114 bp, Homo sapiens
ggtttctaggaaatgaattccatgtacagtagagccaggttcagttgacctcactggagaccttgaacccagcttgctgcaccgtggggtcctttaatcatctccctgctgacc

SEQ ID NO: 6833291 - DNA, 90 bp, Homo sapiens
tctgaaaactcttgaaagtatcttattttgtccctatgaaagacctagatgtacatgaagacagaaagtgagctacaggagttgaaaaga

SEQ ID NO: 6833292 - DNA, 68 bp, Homo sapiens
actcagtcttgccttgtaggtctgcttataattagaaagaggcatacctacattatagggatatgggt

SEQ ID NO: 6833293 - DNA, 121 bp, Homo sapiens
gacaaatggtctactgtgtaaattttagaaagaggcagacaaaagttggaaggccggttaattttcccctctttctcctgcttcagctttgtctccttgggtatccagtgtccacaatgtc

SEQ ID NO: 6833294 - DNA, 78 bp, Homo sapiens
tactcctcattttgtatcacttgcaattttgacaaaacttccttctttgtctaaggcattgaacaaaagaggggagta

SEQ ID NO: 6833295 - DNA, 57 bp, Homo sapiens
cacagcccctccctcaggcaggtgaaacatctggttcatctagcatgtggggctgtg

SEQ ID NO: 6833296 - DNA, 57 bp, Homo sapiens
ttggctcacatgattatggaggctgagaagcctcaaggtctatagtcagtgagctgg

SEQ ID NO: 6833297 - DNA, 61 bp, Homo sapiens
ggagctgagcagcgatggcggaagcagcagcagcggccgctcctcgcacctcaccaactcc

SEQ ID NO: 6833298 - DNA, 94 bp, Homo sapiens
cggccagacgggcagaggctgaccaggctgcagtcatcagaggagcaataaaggtcactacgatatggctggagcctctgcctttcatcagctg

SEQ ID NO: 6833299 - DNA, 62 bp, Homo sapiens
ccatcatttcccgagagcccaaatagaacgcagtgtgagtgtgtgtgggtgctgggatgagg

SEQ ID NO: 6833300 - DNA, 55 bp, Homo sapiens
tctttgtgtcactggcattgttttggtgccccagcaaaggctagagacacaggga

SEQ ID NO: 6833301 - DNA, 63 bp, Homo sapiens
tctctgtacagtacatgccgtgtgtgtgtgtgtgtgtgtgtgtgtgtgtgtgtgtgagagaga

SEQ ID NO: 6833302 - DNA, 61 bp, Homo sapiens
tgcaagggtgtgaaccaatgagattctactgtgtgtcatgcaggtttgttatagacttgca

SEQ ID NO: 6833303 - DNA, 105 bp, Homo sapiens
acccaagtgagaccacaatatcctgacttccagtctagagctatctgtaatgcaataaatctcttcacaggagcatatacactgggaacgggaactctcacaggt

SEQ ID NO: 6833304 - DNA, 59 bp, Homo sapiens
caagagggcttcagcggtgatgccctcaatagtctcattcagggtgctggggccccttg

SEQ ID NO: 6833305 - DNA, 65 bp, Homo sapiens
tcttgggctcttcctatagtttataacttttgttttagttttatattacctggaatagcttagga

SEQ ID NO: 6833306 - DNA, 66 bp, Homo sapiens
cattattctacacctctctcatttagatgaggtagacatttaaatcagtggaggttgtgtaaagtg

SEQ ID NO: 6833307 - DNA, 55 bp, Homo sapiens
agggacactggacccagtgtccacctgactcaggtgatatggggctagtgttctt

SEQ ID NO: 6833308 - DNA, 61 bp, Homo sapiens
ctcgatagcagcgctggccctctgccttgaacgccacggcggcacgcaggctgctgtcgag

SEQ ID NO: 6833309 - DNA, 80 bp, Homo sapiens
taaatgacagggtggaaaagctagttggaacctcttgaaataattggttctaatatgagaatttcacatttgtctatttg

SEQ ID NO: 6833310 - DNA, 97 bp, Homo sapiens
atataacatttgtgtatgtgtgtatgcttgtgtgtatatgtgtctgattatatatgtgcatatgcatacacacatgtgtgtatatagatgtttatat

SEQ ID NO: 6833311 - DNA, 59 bp, Homo sapiens
ctcagcgcaggaacacgtctgccttactcacttctgtgttgttgacacctggcgcagag

SEQ ID NO: 6833312 - DNA, 61 bp, Homo sapiens
ataaatgaacattcacagagcttttatcacttgtcactgtgttctgtgattttacatttgt

SEQ ID NO: 6833313 - DNA, 70 bp, Homo sapiens
gtttcactttacttgtcctgttagccatgacttttggtcttgaaagtcacatataacaagggcatgaaac

SEQ ID NO: 6833314 - DNA, 60 bp, Homo sapiens
cctcccttgagctctcagccactagctgatcccccatcagctggggttagggcttggagg

SEQ ID NO: 6833315 - DNA, 59 bp, Homo sapiens
gttaggcggtgtggttgccgtgctcaagcccatgctgatttgtacactacatgtctaac

SEQ ID NO: 6833316 - DNA, 88 bp, Homo sapiens
gggccgggggccgccgccaaccgctgccgccggccgtacgggggctccgtcgtgccggccgcggggcccggcgcccgccgcccggccc

SEQ ID NO: 6833317 - DNA, 68 bp, Homo sapiens
ttattatctcatttaaaaatattctaggtcgcttcagtgttctcaggcagtggtaaatgagttaatga

SEQ ID NO: 6833318 - DNA, 73 bp, Homo sapiens
attcactccccattagattatgcatcatgtctctgcacattacaaataggatattgtatccatctgagtgaat

SEQ ID NO: 6833319 - DNA, 81 bp, Homo sapiens
gagagtgggggatgctgagttggaaacacacaattcagtgtggttttcaaatgattttgcgttttccaaaacctgcctctc

SEQ ID NO: 6833320 - DNA, 66 bp, Homo sapiens
gtgtgactttgtcaagttgcatagatattgaaataaccataattttatcacagtgacaaggtacac

SEQ ID NO: 6833321 - DNA, 67 bp, Homo sapiens
tgtatctatgtgggaatcataatagttatggagtctccagacaatggttggtacctatatagatcta

SEQ ID NO: 6833322 - DNA, 101 bp, Homo sapiens
aattgtcctaagagcatacagatggagaaacatgcattcaagaaaatctactagatattagtaaaatagtgagaatttttgcagtttagccatggacaatt

SEQ ID NO: 6833323 - DNA, 99 bp, Homo sapiens
tttcataattgtctgtatgaggagactacttaatatttcatgacagatatatttcttgttgttgaatgagtgttttactcatgtaatcatgatatggaa

SEQ ID NO: 6833324 - DNA, 78 bp, Homo sapiens
tctttcctttcctgtcctggtacttggcaccttgtagacagttgcatgtcccctgcccagggatgggatgaggagagg

SEQ ID NO: 6833325 - DNA, 62 bp, Homo sapiens
taatctactgtttatatgaaatgtctggaacaggcaaacccatagagacagaaattagatta

SEQ ID NO: 6833326 - DNA, 87 bp, Homo sapiens
gccactgtgggttcagctggcttctctgcagacattaaagctgatttggtctctgtttaggaagccagatttctgatcccagtcggc

SEQ ID NO: 6833327 - DNA, 111 bp, Homo sapiens
caccaccacacacttgatggcctgcatcgtgtccggagcctggagagtgtcggtggtgacagctcagggccaggcgcgtttctgcgggcgcaaggggtgtggaggctggtg

SEQ ID NO: 6833328 - DNA, 77 bp, Homo sapiens
tgctgccatgcagagcaacagacaccctccaccaattacccatgcagaggagccctctgctgccatgcagagcagta

SEQ ID NO: 6833329 - DNA, 64 bp, Homo sapiens
tctggtctcttgtgggtggcagatgacagacaatctggtatctgttcaatggaagatgacgaga

SEQ ID NO: 6833330 - DNA, 65 bp, Homo sapiens
gcctagagcagcaaacgggattttaattgcctacggctatttctctagtgccttgctctctaggt

SEQ ID NO: 6833331 - DNA, 130 bp, Homo sapiens
ttcctccaattcacaaactagtaaatgaaagaaggggagcaggtgatgagagaggtcattgaaatgtgagtgttccacagtgcttttctggttgttttcctagaaattgatagtgggtaatttgggggta

SEQ ID NO: 6833332 - DNA, 68 bp, Homo sapiens
taggaagtggaagaatctggctcattctttttccatagtaggagtcagaacactttctctactgacta

SEQ ID NO: 6833333 - DNA, 85 bp, Homo sapiens
tacctgcagaatatcttgtattagtttcccatgctccatttttttcccatggtgctgtgataaatgcagatgtcacctgcatgta

SEQ ID NO: 6833334 - DNA, 74 bp, Homo sapiens
ttcctattgtaagttcattagactacagatatccagaattggatgctacactgtagcagtggagttttggggaa

SEQ ID NO: 6833335 - DNA, 124 bp, Homo sapiens
ggggaccctgggggctcaggatccagcaaggggcagcaggagtaaaggaggaaggaatgacaggtgcaaataccttcccactaaagcccttgttgccctctggctcctccccagagttgtcccc

SEQ ID NO: 6833336 - DNA, 77 bp, Homo sapiens
tatctacacgcagcatcatatatatggttcatggaaagccagggagccacagtctgatgcctgagattttgtaggta

SEQ ID NO: 6833337 - DNA, 94 bp, Homo sapiens
aggagtacgacgctgtggtagctatgatcatgccactgcactccagcctgggtgacagagcaagatctagataattacagtctgtcctgctcct

SEQ ID NO: 6833338 - DNA, 64 bp, Homo sapiens
gatatgtgttcctttagttcagaagatcatatcacttattctgaatttcagaggtaacatcatc

SEQ ID NO: 6833339 - DNA, 73 bp, Homo sapiens
tcacggacaaaccaggactttgtattcagcttcaaggaagaggtgagagaagaatcttggtaatagtaagtga

SEQ ID NO: 6833340 - DNA, 57 bp, Homo sapiens
taagcactttatatgctttatctaattagctattcttgaagccctgtgaggtgctta

SEQ ID NO: 6833341 - DNA, 98 bp, Homo sapiens
agagtggagatttaagtaagattaggtaatttgctcaaggcagttagtagcagagccagattcaaacttacgtagtcttactacaaaatccacactct

SEQ ID NO: 6833342 - DNA, 60 bp, Homo sapiens
ggctggctacattggaggaaggaaaactggtcgcatccctagccctgcatgtgcacagcc

SEQ ID NO: 6833343 - DNA, 59 bp, Homo sapiens
agctgtaagcaacagaaacattctaataagtgatttattagaaaggctattgcatagct

SEQ ID NO: 6833344 - DNA, 85 bp, Homo sapiens
ggggttggcctatttattgagagggaggggaattgcacttacaaggttctccttatcaatgaagacagaatgattggccgagccc

SEQ ID NO: 6833345 - DNA, 73 bp, Homo sapiens
tgaggttcagttcttggccacaatcctggagaggcaatagtatgcaacgagaagtgtgccagaatctgcttca

SEQ ID NO: 6833346 - DNA, 84 bp, Homo sapiens
gcttcaatctattttgtgattaattttcaacctcggtttttttaacggactggaaaagggttaatgacattgtctggttgaagc

SEQ ID NO: 6833347 - DNA, 61 bp, Homo sapiens
cagcagccactagagggctcacgaagctgcagccgcgggctgccctctagcggcggtgctg

SEQ ID NO: 6833348 - DNA, 77 bp, Homo sapiens
ttgctttaggttgggaggtcagaaagttattaaaaagaagatgacatttaagttaaaacctcagtgaccaaaaggaa

SEQ ID NO: 6833349 - DNA, 60 bp, Homo sapiens
tgggtattattgcatgtatcttcataataaatgaatgaggtcatcaccaatatatgccca

SEQ ID NO: 6833350 - DNA, 57 bp, Homo sapiens
gcagctttgtggagaggcccatatagagagaaactgaggcctcctgacaacagctgc

SEQ ID NO: 6833351 - DNA, 123 bp, Homo sapiens
gttttccaaagaatgttttctattgttctgttatttgttttctgagaagtatcaagtttgtttatttgtaatacatatccacaggagataaaaagcaagcatgagtactgaatttttgaaaac

SEQ ID NO: 6833352 - DNA, 60 bp, Homo sapiens
ccttaaaaagataggctttgataagcacttaccactgggtttcagacctatctttgaagg

SEQ ID NO: 6833353 - DNA, 55 bp, Homo sapiens
gctgctgctgagaatgcctcaggtacaattgacactcttggttgctcagtgcagc

SEQ ID NO: 6833354 - DNA, 74 bp, Homo sapiens
ctgtttttgacatctgaatttagcagttttggtataaaaagccacaagagcattgcaggtgtgtttaagaacag

SEQ ID NO: 6833355 - DNA, 62 bp, Homo sapiens
atgttacagagaaagtggaagctatcagaaatgaagtttcctcaatcctttctctctggcat

SEQ ID NO: 6833356 - DNA, 84 bp, Homo sapiens
ctctaccttgtacaagctgtgtgactatttctgagtcattcatgagctcttagaggaccatcagtttgctcataatgggtggag

SEQ ID NO: 6833357 - DNA, 77 bp, Homo sapiens
cctgcctggtccccatcggcccagcgcccacccagccttggcttttgcccgtgggccgttgggagcgccagcgcggg

SEQ ID NO: 6833358 - DNA, 68 bp, Homo sapiens
ccctactttcattttactttgttcaagctcccgaatgttttttgaacttagagtatatgaaaggaggg

SEQ ID NO: 6833359 - DNA, 85 bp, Homo sapiens
gagagcagacactgccttctttgaagttcccctggaagaggccagacttttccactctgacattcagtgagcactgttgctactc

SEQ ID NO: 6833360 - DNA, 63 bp, Homo sapiens
ccacagggcctttcctgctggccacaaaacccacttggcccagggcagtagaaggctgtgtgg

SEQ ID NO: 6833361 - DNA, 55 bp, Homo sapiens
cctcactgcagctgtggacagttaataaaagtgcatgttcagaaatgcagagagg

SEQ ID NO: 6833362 - DNA, 91 bp, Homo sapiens
aaacagtggtacaatctttccagtcctttctgaaatcctatactcaaccatggtatcagtcctctgagaagaccaaagatagcactagttt

SEQ ID NO: 6833363 - DNA, 66 bp, Homo sapiens
gggttctgctgcatgccctgtgtcatgtggggtttggagggtgatacgggaagtacagcggaaccc

SEQ ID NO: 6833364 - DNA, 70 bp, Homo sapiens
gaaagtatggacagggcacaggcgcagagacaggtcactctctgtgtttcattcccgtcctgacactttc

SEQ ID NO: 6833365 - DNA, 61 bp, Homo sapiens
cctgcccagcttcttacttttaaaatatatttttttaattctgcaggaagtggggtgaagg

SEQ ID NO: 6833366 - DNA, 70 bp, Homo sapiens
cttgagacttatagctactcttgtatttccttggaggtacaacttctgtagctacttttaagtttctaag

SEQ ID NO: 6833367 - DNA, 59 bp, Homo sapiens
atactacaatcataattgtacatttagaaataattaaagtgtataattggattgtgtgt

SEQ ID NO: 6833368 - DNA, 85 bp, Homo sapiens
atggattctacaggttaggaatttggacagagaacaatagtttgtctctgcttcccaatttctgggacctctatttggaagacat

SEQ ID NO: 6833369 - DNA, 59 bp, Homo sapiens
ctggccctgtggcctaaggactctctcaaggaggtcagcggagcaatcacagggctcag

SEQ ID NO: 6833370 - DNA, 119 bp, Homo sapiens
caaaagtagaaacactagaatgcttccttttaagctttggcttctgttgaacctgcctactggtcaaagcaagttggaaactgagagtcaaagaatggggatagatattctaccttttg

SEQ ID NO: 6833371 - DNA, 71 bp, Homo sapiens
ggggttggggaggggaggtagtagctgctccctttagataaagcatgtactttctagctctccccagttcc

SEQ ID NO: 6833372 - DNA, 55 bp, Homo sapiens
tgtgttgggcgttgggaatattaagagccccctgaattatcctaacgtgcagcca

SEQ ID NO: 6833373 - DNA, 56 bp, Homo sapiens
gaaatggaagagacctgtctcacacctaatgagtggctcagctagttttccatttc

SEQ ID NO: 6833374 - DNA, 59 bp, Homo sapiens
ggcagctggggttggaatcatctgaagataccatctctcaaatatctaacacctctgct

SEQ ID NO: 6833375 - DNA, 55 bp, Homo sapiens
gcacgcgcgcgggcggggcctggcgctcctccccggtcccgcccactgagcgtgc

SEQ ID NO: 6833376 - DNA, 55 bp, Homo sapiens
tggggagattgttaaatttagattctgattcagtaagtctgtaacaagctcccta

SEQ ID NO: 6833377 - DNA, 55 bp, Homo sapiens
gaggcctggctgggaggaggtgggtggaaagtccaaggctcctcctctaggcctc

SEQ ID NO: 6833378 - DNA, 73 bp, Homo sapiens
aggccctggcaacctctgtgctatggagtccacgcagaacagggacttcaaagtgcttggggtgtgctggctt

SEQ ID NO: 6833379 - DNA, 62 bp, Homo sapiens
agactgctgtgatgctaactttctacagttctatgatactgaatctttagccatggcattct

SEQ ID NO: 6833380 - DNA, 84 bp, Homo sapiens
gcgcccagagcctgtgcctgccccggggagggaaggaagtgccgtctttggcctcctccttcccgagggtctctggctgggcgt

SEQ ID NO: 6833381 - DNA, 58 bp, Homo sapiens
gtcttggttgttcaggtcctaggggttccaagtccccagtcaccttgaggactcagac

SEQ ID NO: 6833382 - DNA, 61 bp, Homo sapiens
aaatagcttggttaagggttcttagagtttgttttatctcttggctctcttaaagctgttt

SEQ ID NO: 6833383 - DNA, 83 bp, Homo sapiens
gctagcaaatggtcccaatgatccttgcctcctgatatgcatctcttgtgtcagtgacaacatcaattggggctgatttgtgc

SEQ ID NO: 6833384 - DNA, 72 bp, Homo sapiens
ctgcgggggacaaggcaaccagggaggcttcccagaggaggtgcctcgttcctgaccttggaaaccaggcag

SEQ ID NO: 6833385 - DNA, 58 bp, Homo sapiens
attgatgtgtaatgaaggagttcttcactgtggaattcttaaattattacctattaat

SEQ ID NO: 6833386 - DNA, 66 bp, Homo sapiens
tttttggaaagctatttgtgagttatagacacctgtcaatttctcagaaatggtcttatctggaaa

SEQ ID NO: 6833387 - DNA, 69 bp, Homo sapiens
aatctttatttacaaacacaggctgtgggctggatttggcctgcaggctgtagtttgtgatccttgatt

SEQ ID NO: 6833388 - DNA, 83 bp, Homo sapiens
agactttgtggccatgtggtctgtgtagcaactactctgtcattgtaaaagcaacagtagaccatatgtaaactaatgagtct

SEQ ID NO: 6833389 - DNA, 77 bp, Homo sapiens
gcctgcattaaatcttttatatggaaactaattcatttttctactcctggaaagcaggattgtttccattgcatggc

SEQ ID NO: 6833390 - DNA, 95 bp, Homo sapiens
cccgggcagggctcaatgggcatcgtgggtcagattctgcgctccttctgggacacggagaactgtatgcacgttgccattgggtcctgcctggg

SEQ ID NO: 6833391 - DNA, 121 bp, Homo sapiens
catagtgatgaaaaaagaacagactccaaagccagatacttgggttcaaatcccagctcagttccataagaacagtgtaattttggacaagttactggtttcctgtgttttcgttattatg

SEQ ID NO: 6833392 - DNA, 85 bp, Homo sapiens
tgttcatgctgttctaaaagtcaaggtggatgttgggctgaacttttaggctgcattcacgtgattggggtagaacattttaaca

SEQ ID NO: 6833393 - DNA, 90 bp, Homo sapiens
ggcacaacggaccacatattgcatgattccatttgtgtggaatggctggaacaggcaaatccatagatgggaaacagattagtggttgcc

SEQ ID NO: 6833394 - DNA, 78 bp, Homo sapiens
ctgctttgcatctaatgttagattcctccacctaggagtatttttcctgggagagtatttcttattaaagatgagcag

SEQ ID NO: 6833395 - DNA, 64 bp, Homo sapiens
cctgctttgctggtaccatcagcttaaacttagtctgacttctgggtgagccagcattggtagg

SEQ ID NO: 6833396 - DNA, 56 bp, Homo sapiens
ccgtccgattgtcggcaggactcgctttcaggaggacctggctgcattcaggacgg

SEQ ID NO: 6833397 - DNA, 72 bp, Homo sapiens
tgtgtatttcctaaaaacaaggacactctctgacataaacaccatagaatccttcaagttaggaagtgaaca

SEQ ID NO: 6833398 - DNA, 66 bp, Homo sapiens
ggtagagatgggctgagggaaaggaaagctaggaacgaagagtacaccaccccagtcctctttccc

SEQ ID NO: 6833399 - DNA, 78 bp, Homo sapiens
gggaatcttttaattatactcatcgaaattagcagtgcctctggccggggcagcatgatgagtgcagtttggagtcct

SEQ ID NO: 6833400 - DNA, 84 bp, Homo sapiens
tctatggtatattgccctggggtgtaaaatcctccaggaccctaaacagatggacagttgatgcatttcagggtaagctgtaga

SEQ ID NO: 6833401 - DNA, 70 bp, Homo sapiens
ttgttcaatatattaggttgaaacaatgaaatttctgtttctctggttcaaagtagtataatatggacaa

SEQ ID NO: 6833402 - DNA, 57 bp, Homo sapiens
tgggtgtcacatcttatccttgggtatcagtttgctcctggactggtgtgagattca

SEQ ID NO: 6833403 - DNA, 81 bp, Homo sapiens
tgccacctctgccaacaccaggggcagagaccaaagtggaagccactgtctgctggcccctggttaggtgacatggtggca

SEQ ID NO: 6833404 - DNA, 89 bp, Homo sapiens
tagcacaggactctagagatcctttggtttctgatttagaatgctagcctaaagcaggttgaaaattaaaggttgaaatagcttggtta

SEQ ID NO: 6833405 - DNA, 65 bp, Homo sapiens
ttctctgtattttttgatgctgctaagaaggaatttcctcttgcaatcaaaaagaagtacaggaa

SEQ ID NO: 6833406 - DNA, 67 bp, Homo sapiens
gcaataatttaatacagcgctgtggtagtcttattgtaaaaccacagggcttagtggaaatttttgt

SEQ ID NO: 6833407 - DNA, 59 bp, Homo sapiens
ggtctcagtgaaggagtgtgctggtccagattcagctgccactgattgcctttgaggcc

SEQ ID NO: 6833408 - DNA, 97 bp, Homo sapiens
gtgttttctgagtgagttaacaggaactagggctatgaaattcccaatcaggagagcaagctgcttattctctgctctagctcacaaagggagtcac

SEQ ID NO: 6833409 - DNA, 62 bp, Homo sapiens
ggtgggcattatcagaaaagcagtgttacagctttctagttccctctggaatgtatcccacc

SEQ ID NO: 6833410 - DNA, 82 bp, Homo sapiens
tggtttcagttttgcacatgtgcctgtggcacatccatagggaagtatgtaggaggtagatggatatgcagcttggaacgca

SEQ ID NO: 6833411 - DNA, 77 bp, Homo sapiens
tgcttctccagtatttgctgttttccttccccactgggcaaagccaggggatctgagtaggcagaagctgaagagca

SEQ ID NO: 6833412 - DNA, 61 bp, Homo sapiens
tggagagtcagttatgtcaagtgctggatagcaataagcatcatttttatttgactcttta

SEQ ID NO: 6833413 - DNA, 98 bp, Homo sapiens
tttgttaagccaatacattacagttctgcaggtagtttttaagagactactacatgtcaggcactgtgctaactgttggagataaaataattaacaaa

SEQ ID NO: 6833414 - DNA, 60 bp, Homo sapiens
gagcactctggcatgtaacctttaagcctgtcaggttttcaagttcttgccagattgttc

SEQ ID NO: 6833415 - DNA, 88 bp, Homo sapiens
tagaaggtcgttctctggagtccctgggccccgagtcactaagcgggtccccaaggtaggcttcagaatcaaaggggcagactatttg

SEQ ID NO: 6833416 - DNA, 76 bp, Homo sapiens
cccaggatcatacattacaggaaagataaagatgaacaacaaatatcttggtttctgctgattgtaattttctggg

SEQ ID NO: 6833417 - DNA, 65 bp, Homo sapiens
tccaccttgggatatcacctttcagaacccagctgccacgttctgaggagaccaagccaagtgga

SEQ ID NO: 6833418 - DNA, 90 bp, Homo sapiens
gttgatatttcactgtgtttgctccattgcccactctctaggctttttctggatatttggagagcaagtcgcagacatgataatatgaat

SEQ ID NO: 6833419 - DNA, 90 bp, Homo sapiens
gagcctaggaattgagcttcttttcctgtggctcatccatgggtcagacaccatggtgaggaggaggaagagtgctgagtgtctgagctc

SEQ ID NO: 6833420 - DNA, 62 bp, Homo sapiens
tgctgctgctgtggggcctcaaggacagcccactgctaacttctagagccagggcagctgca

SEQ ID NO: 6833421 - DNA, 69 bp, Homo sapiens
gtggcttcatgaacactgatgaaccaaacactccccttaccatggtgtgatgggtgttgatggagacgc

SEQ ID NO: 6833422 - DNA, 72 bp, Homo sapiens
gcaccctggagacttcttgagggttgggggaagcccccatcttccctgagggattttcggaaggcagggtgc

SEQ ID NO: 6833423 - DNA, 66 bp, Homo sapiens
cagttttgttttctaagtaggtagcaccaggtactgactgacttgcctcttacttggaagggactg

SEQ ID NO: 6833424 - DNA, 68 bp, Homo sapiens
gagatggggtcttgccatgttgcccagctttgtctcaaacttctggcctcgagcaatactcccatctt

SEQ ID NO: 6833425 - DNA, 128 bp, Homo sapiens
gcccaagggtgtctctgatcagggagcaatttcagggaagcctgggtgatcctaaagtcacctcccagttcaaagatgtatttaggataactccagttttccctagaaactcttcagtactcttttgc

SEQ ID NO: 6833426 - DNA, 58 bp, Homo sapiens
tgcaggcctggactgatgtggtaatgggcagctgaattcgggtactctaggccaggca

SEQ ID NO: 6833427 - DNA, 80 bp, Homo sapiens
ctcattttaatgtgtttgtacatataaatcttgtatttacagataatttcagaaacacatggtatgtatagacaaatgag

SEQ ID NO: 6833428 - DNA, 68 bp, Homo sapiens
tgttggtgaaatcttcacagagaaaattagggccaagcatggctttatgaatatgattttaccagaca

SEQ ID NO: 6833429 - DNA, 93 bp, Homo sapiens
gggaaatcactgtgttggaggcaactggaacactggtcatttaccacaccaggtgactaaatcacagttgcctcagaaagtagagtgtcactc

SEQ ID NO: 6833430 - DNA, 87 bp, Homo sapiens
ctagagttgatatgagaatcagatgaatcaatatatccgaagtgtttggaaagtgttgaaacatattgagtgctctacaaacactag

SEQ ID NO: 6833431 - DNA, 80 bp, Homo sapiens
ggtcacagtgctcagagacctgagttcaaagcccagccccactctttgggcaccttgggtctcaggcaaatgatgtgacc

SEQ ID NO: 6833432 - DNA, 80 bp, Homo sapiens
cttcagcttggttttgctcttgttcacaaacttcagtgccatttttgtgcctgatgggagcaacagcaacagggttgaag

SEQ ID NO: 6833433 - DNA, 81 bp, Homo sapiens
gccccaggtcaacaacagcttagccagtcaagctctcccatcgggatggcaagatcttggctgagcatcttgacatgaggc

SEQ ID NO: 6833434 - DNA, 56 bp, Homo sapiens
gctaccacctcaacctcatctgacagcccagagtctgcaggagcgggaggggcagc

SEQ ID NO: 6833435 - DNA, 114 bp, Homo sapiens
gcggcgaggccctgccatgttccccgagagctgcacattgccacctgttgctatggagaagcctctttatcgcaaacactgggtaaacagctgctgctgggagcccctttctgc

SEQ ID NO: 6833436 - DNA, 67 bp, Homo sapiens
aggttcagaggtcagcagcttgcccaaagtgctcaactagtgggtagcagggctgagctgtgagcct

SEQ ID NO: 6833437 - DNA, 57 bp, Homo sapiens
ttaagcaatgctaagaaaagtgtcatgcctacggtgatcttagcatcacttgcttaa

SEQ ID NO: 6833438 - DNA, 104 bp, Homo sapiens
ggcttcaagggtgtagacagatgtacattctaagtatgtgtagtttattgtactttaattatatgttaatgaaggtataattgttttaaaaatccttattagct

SEQ ID NO: 6833439 - DNA, 72 bp, Homo sapiens
ggcaaatagatatagtgaaagtgatgtgtgggtttcagacttaggcctcaagattccctgtgtgcttctgcc

SEQ ID NO: 6833440 - DNA, 72 bp, Homo sapiens
ggtgttttgtggcctgggccagaataaccctcttcctctgaggaccaacctgtgccagggcctccaaaagcc

SEQ ID NO: 6833441 - DNA, 65 bp, Homo sapiens
gaaagaaagcctaatgcaagacagagtataaccaagtctgctttgtctgagactgttttactttc

SEQ ID NO: 6833442 - DNA, 91 bp, Homo sapiens
tggcatagatgaggagcttaaagctagcgctgcttggaaggatttttaaaaatctacagccagtctggtttgtagcatcggtttagggcca

SEQ ID NO: 6833443 - DNA, 63 bp, Homo sapiens
tttttcaagctccattgccactggtacattcccagcgatgacctggaatgggtccttgaaaaa

SEQ ID NO: 6833444 - DNA, 74 bp, Homo sapiens
ctcagctttgtaaattccactggtggaaacaagacttcacttgttgacccaaggccctggaattgcaagcagag

SEQ ID NO: 6833445 - DNA, 55 bp, Homo sapiens
agccagtgcaacagcagtgaagttattctttgctacaatactgctccactggact

SEQ ID NO: 6833446 - DNA, 62 bp, Homo sapiens
ctctggtgtgggtgctatgatatataaaagtaaattcaatatttggcattatgtcaccagag

SEQ ID NO: 6833447 - DNA, 57 bp, Homo sapiens
agtccaagatcaaggtgtcaacaggtttggtttctcctgacacctctctccttggct

SEQ ID NO: 6833448 - DNA, 67 bp, Homo sapiens
tgtacttacaaacatccaggagagtctgagagagatctagtgacaccgtggagttgtgctgagtatg

SEQ ID NO: 6833449 - DNA, 97 bp, Homo sapiens
ttggccaggtgcggtggctcacacctgtaatcccagcacttcaggaggctgaggcaggtggattacaaggtcaagagttcgaaaccagcctggccaa

SEQ ID NO: 6833450 - DNA, 101 bp, Homo sapiens
ttgattcaaccacttaataatctacccagcagtatacttacctgtcttccatgtacacaggtaagtatactgttgggtagattattaagtggttgaatcaa

SEQ ID NO: 6833451 - DNA, 83 bp, Homo sapiens
cattgtgttcctgtgttcttgacatctttgatgtgtcctttaatgctggccagtgcaagatgttagattatggggacacggtg

SEQ ID NO: 6833452 - DNA, 62 bp, Homo sapiens
ggtctgcgtgtctggtaccattgtgagcaggcactggagcatggtgggccaggcagaaggct

SEQ ID NO: 6833453 - DNA, 75 bp, Homo sapiens
tgtttgtttgaaaactcacgatttgttctttttggctagagttgctttaagcaaagctgtgaattcctacaaaca

SEQ ID NO: 6833454 - DNA, 61 bp, Homo sapiens
ttatgacacattctggcaacgtttagatgcaatttcaatgagccagaatgtagtactgtaa

SEQ ID NO: 6833455 - DNA, 58 bp, Homo sapiens
tgactcaccaggtagccagtgctcagaattttttgcatcagttgccaaagtgatgtca

SEQ ID NO: 6833456 - DNA, 92 bp, Homo sapiens
aggagagtggccatctcccagccctgttggcagcgacaggcggaggatggacgccagctgtactagggctggagcttcatgaaccctttcct

SEQ ID NO: 6833457 - DNA, 127 bp, Homo sapiens
tatgctgttacttcacaacagtgttagtctggtagctgcatattttcttagaactattattgcaggctttatggattttaaggactatgctgctttaaagacaataattgtgtaagttccaaacatg

SEQ ID NO: 6833458 - DNA, 97 bp, Homo sapiens
tcttcaagttctaggtagactcttggggaaatctgcagaaaagagttgtgtctattattctggagagtcatctgctacaacctaaggaacatgagga

SEQ ID NO: 6833459 - DNA, 66 bp, Homo sapiens
ggcagtaggccagggctgggcgtgctagcctcggggctgataggcgtgctgcccgggcctgctgcc

SEQ ID NO: 6833460 - DNA, 57 bp, Homo sapiens
taaagagtttcagttatgcggctaagaaatggctgcctttagaacggatgctcttta

SEQ ID NO: 6833461 - DNA, 74 bp, Homo sapiens
caggtcataagtgcacaaatgctgttgctagatacttatctctggctgacaaataggtgcagttcaatgaaatg

SEQ ID NO: 6833462 - DNA, 59 bp, Homo sapiens
ttctgagccacagtaaggatctagtccagccctaaatgagtccttgactgtattcagag

SEQ ID NO: 6833463 - DNA, 70 bp, Homo sapiens
atatcttgattttgttaaaattagagtggtaatatttccctctctaaaatgagtagaaaatcaaagatat

SEQ ID NO: 6833464 - DNA, 81 bp, Homo sapiens
tcatgttgttgtcattattctgggattctataacttggcatagaaagacctgtaggttccatagtgcgaaatgcagcatga

SEQ ID NO: 6833465 - DNA, 81 bp, Homo sapiens
aataaataatgacagcatttaaggactgctgaccctgagctaggcagtgttctaagtctttacatgtgttatatatttgtt

SEQ ID NO: 6833466 - DNA, 97 bp, Homo sapiens
ttgtgttttgtctgtctcctctcactagaatgcaagctccacaagggtaggagtttttgccttgttgaccggtgtatctctagtgcccagaacacaa

SEQ ID NO: 6833467 - DNA, 70 bp, Homo sapiens
acaattgcaaactagcatcaactagtacatcatctctttgaagactgctggtctatgttatgtatcatgt

SEQ ID NO: 6833468 - DNA, 62 bp, Homo sapiens
agaaatctcagtatctcagggattcttggtaagacagaagtaactgatgtgctcagatttct

SEQ ID NO: 6833469 - DNA, 118 bp, Homo sapiens
tcctttcttggggaatattgcaaagtgtcttcaattcaattgcatttctgtggtcgtggggttttatataattacagaagttctgtagttgatttgaatgttatatccctgttgtgga

SEQ ID NO: 6833470 - DNA, 55 bp, Homo sapiens
tgaagtcttccagggaaacgtggtttgactgcagttcaccccttgggagccttca

SEQ ID NO: 6833471 - DNA, 55 bp, Homo sapiens
gccctctaacgtgaccttagccttcattcatcacaggttgaaagtaggtgagggt

SEQ ID NO: 6833472 - DNA, 75 bp, Homo sapiens
ttgtactacaatgttcacaacattgttaataatagctaaaaatgaaaacagtgtaagtgatcattgatagtagga

SEQ ID NO: 6833473 - DNA, 55 bp, Homo sapiens
ctgcccattcaaccagctacagaatcccaggcctgctgttggatcagtgggtcag

SEQ ID NO: 6833474 - DNA, 66 bp, Homo sapiens
tggcttcgctccggtggtgcgcccagcccacgcctccgggctgcagctgcgggaccggagcggcca

SEQ ID NO: 6833475 - DNA, 63 bp, Homo sapiens
gatgaatgagctgtgcacattacaaaccctgttggttatctgactgctccacagctcaacatt

SEQ ID NO: 6833476 - DNA, 66 bp, Homo sapiens
tcctcaccacaccgtcggcctcctctgtcaacaccagcaacgtaggaagctaagtgtggctgcgga

SEQ ID NO: 6833477 - DNA, 74 bp, Homo sapiens
ccacctctccatcccccactgccctgtcagcaaggggaccccagcatggcagctttgggaggaggaggggctgg

SEQ ID NO: 6833478 - DNA, 70 bp, Homo sapiens
ctagaggctgcccacagttctctgccatgtggccatctccactggccttttacaacgtggcaacttctag

SEQ ID NO: 6833479 - DNA, 57 bp, Homo sapiens
tgaaatatccagcccagcaggacagaagatttgagatttggctggttggaagtttta

SEQ ID NO: 6833480 - DNA, 68 bp, Homo sapiens
gatagatgcttatagggtggttaagtctcacaatttctttgacttgtcttttacccaggtgtcttttc

SEQ ID NO: 6833481 - DNA, 72 bp, Homo sapiens
ggctctcatggtgttcttagtggcactggcaatatactgactgttccaccaatcctgagacatttgagagct

SEQ ID NO: 6833482 - DNA, 58 bp, Homo sapiens
gccacctgtttcagatgtggttggaggtatgtgcagccacagcagtttctggggtggc

SEQ ID NO: 6833483 - DNA, 88 bp, Homo sapiens
agcaggggcagcctgagcagtgactggagcatgagaagaaactcacaatatcttctctctctgctctattactctttgtgcatctgct

SEQ ID NO: 6833484 - DNA, 80 bp, Homo sapiens
aggcagttcaaacagaggcgaggcagctgaacctggtgaggctgccaggaacagcgagttctgcctctgaatttgctcct

SEQ ID NO: 6833485 - DNA, 61 bp, Homo sapiens
cctcctggggtgaaggatgggaaggctggagaccttaaaggccagcccgacccccgggagg

SEQ ID NO: 6833486 - DNA, 81 bp, Homo sapiens
ttctgggacctgctgtggctgaagatgcagggatgggtcaatgcagtccgtacctgggagggcttcagtctagtgggagaa

SEQ ID NO: 6833487 - DNA, 61 bp, Homo sapiens
ttgtggcagattgctcaccatggtttttcattttcagaaacgcctagctcaatctgtccga

SEQ ID NO: 6833488 - DNA, 74 bp, Homo sapiens
ttgtgtggaagagcaggtttcaatgctgatgcttgttttataaagacattggcaagtgaacctgcatcatacaa

SEQ ID NO: 6833489 - DNA, 64 bp, Homo sapiens
tctgcaaacccccatctatcattcatgcacagcctttgcgtgcctttgaataggggtttgcaga

SEQ ID NO: 6833490 - DNA, 70 bp, Homo sapiens
tgtgcgtctatctcctggtacccttcctagcatcaattctgtatttgcaggagtccaatcaggagacaca

SEQ ID NO: 6833491 - DNA, 61 bp, Homo sapiens
tgagataagcaaggataaaggtttggaggcaaggcagacaccacaattcctgcttatctca

SEQ ID NO: 6833492 - DNA, 64 bp, Homo sapiens
ttgtcagatgagtaggttgcgaaaattttctcccattttgtaggttgcctgttcactctgatgg

SEQ ID NO: 6833493 - DNA, 95 bp, Homo sapiens
gctctcaattacctatgctctagtaatcagaaataaaaattagttgttttgttaaaagtgatatagtgcatgggtgattgcaacttactaggagc

SEQ ID NO: 6833494 - DNA, 80 bp, Homo sapiens
gtgtgcagggccttgttgatgtgctccacaatccagccgaacaactgggcatagatgtgcttcgccagggcgttgcgcgc

SEQ ID NO: 6833495 - DNA, 56 bp, Homo sapiens
gcctttgcataaagtgccatagtattactaaggtttacagggcactcttatgcagc

SEQ ID NO: 6833496 - DNA, 73 bp, Homo sapiens
tagggatgtggccttcggtctttcctcgcagctccggggcaagctaggagtgggatggaagtcgaggtcccta

SEQ ID NO: 6833497 - DNA, 121 bp, Homo sapiens
tgaatggagttcaaggcagctcccttttgtctctggctttatgctggttttacttttcattccagtaagctgttagggggcagagatgaaacacagttgtttacaggacttggaacgttta

SEQ ID NO: 6833498 - DNA, 69 bp, Homo sapiens
gcatggtggagaggggagtctgtgagtgctcctccagcctctgtgcacagcttcctactttgctgctgc

SEQ ID NO: 6833499 - DNA, 73 bp, Homo sapiens
ggggagtctatgggaacagtagctgctgagctctgtgccagatccggcggcttctgtatcagaaagacagccc

SEQ ID NO: 6833500 - DNA, 66 bp, Homo sapiens
gtgtttcttcacaagctgggtcccaacaattactgctgatgccagatgaacccagagagggagcgc

SEQ ID NO: 6833501 - DNA, 58 bp, Homo sapiens
gccgggagagtggaaccaagaggaaaaatgcaaatgcctaggccttactttcctgtgc

SEQ ID NO: 6833502 - DNA, 57 bp, Homo sapiens
cccagggtgcagggccctcggcttctggttggtgccgctgcagggctgcgcctgggg

SEQ ID NO: 6833503 - DNA, 62 bp, Homo sapiens
tgtggaatgagcacaggctttgaaatcactgaatactgacttcagacttgagctcttctaca

SEQ ID NO: 6833504 - DNA, 82 bp, Homo sapiens
atttttgtattctttgcccttaatgaaataattgttatatgctggaagttagtgattgccgttttgggtagaatgagggagt

SEQ ID NO: 6833505 - DNA, 112 bp, Homo sapiens
agtgctgatgatgcaacaagtaattaactttctgtgacgcaaagctgggaaggcagctgtggctattttccagttgttctagaaagctagcgcctaggcctttgtcagcgct

SEQ ID NO: 6833506 - DNA, 65 bp, Homo sapiens
ggatgcagggctggcaggagctttgtcaggctctgtggactgagtaggcactgttgtctgtatcc

SEQ ID NO: 6833507 - DNA, 57 bp, Homo sapiens
tctgagcattgagctctccaaagccccagagtaagcatggagtagttggagctcaga

SEQ ID NO: 6833508 - DNA, 75 bp, Homo sapiens
cccacccccgccctgctcggccagtttcaggattcctggggccagagatggggcgcagatttgttttggggtggg

SEQ ID NO: 6833509 - DNA, 64 bp, Homo sapiens
cctttatgagatcctggggtgagcactttgacaaggcagtcacccccaaaggagctcgcaatgg

SEQ ID NO: 6833510 - DNA, 58 bp, Homo sapiens
gagctgtcttgaaaataagctggagggattatcactctctctgggtcgagacagactt

SEQ ID NO: 6833511 - DNA, 83 bp, Homo sapiens
ttttttatgcctcatcttgttacagaatggacttggggcgctttcataagggcatataagctgtgggagattggcataaagga

SEQ ID NO: 6833512 - DNA, 55 bp, Homo sapiens
ctattttttccttggagtagctctgaaacaaggttcattctccaggcaagaatgg

SEQ ID NO: 6833513 - DNA, 80 bp, Homo sapiens
cagcgcgtttggctcttgcaagccctgaagggctggaggcttgtgcctgccagctccgaggagctgcagcccaacttctg

SEQ ID NO: 6833514 - DNA, 79 bp, Homo sapiens
tataaaaacaggtggcttattagggtcagtggaacataattcaaaggctgaattattaatatgctacatcttttttata

SEQ ID NO: 6833515 - DNA, 62 bp, Homo sapiens
tgagaaaaggttgagatgataatttccttttcattttatttgtcttcattaatctcttctca

SEQ ID NO: 6833516 - DNA, 90 bp, Homo sapiens
tatcagatactgggttgagcactgtggatacagaaattagtaacatacaatactgattctagtaatatagtataatgtgggtgtcagata

SEQ ID NO: 6833517 - DNA, 80 bp, Homo sapiens
tacaggctcctctgtgttactgactgggggctttgtaaagatcacaaggaactgactcagcagtgacaagagagtatgtg

SEQ ID NO: 6833518 - DNA, 95 bp, Homo sapiens
cgccagtttcaccaaaacccagaggcaggagtgaccctgacaggaacaaaccctaaggtattcacttgcctgcccagggtctggtgcagctggcg

SEQ ID NO: 6833519 - DNA, 64 bp, Homo sapiens
tgtcttcatgaggccgctctttgactggtgtgactaaatcagatgaagcagcttcatgtagaca

SEQ ID NO: 6833520 - DNA, 74 bp, Homo sapiens
ggatttgacaaccaattaggtttggggaagaagagagaacacaaagtctagactgactcctgggtttcagattc

SEQ ID NO: 6833521 - DNA, 69 bp, Homo sapiens
ctgggttagaattctggtcctgtccaaggtcacagttattttgagctaacatgactagaagcttctcag

SEQ ID NO: 6833522 - DNA, 80 bp, Homo sapiens
caagcatgctctgggtcaacataggcctcagtgaggctctctggcctcggcttctgtattgataaaaggggattcgattg

SEQ ID NO: 6833523 - DNA, 62 bp, Homo sapiens
ggcagaagcagcagatgggcgcagtcagcaagatgccctttgcgcccatgaactgctctacc

SEQ ID NO: 6833524 - DNA, 74 bp, Homo sapiens
aaagactctgctgactagttgactatctgaaatgcactcagaaagaaaatatagaactattagcaatagttttt

SEQ ID NO: 6833525 - DNA, 55 bp, Homo sapiens
attcggtcacacccattaatggtcaagaccaccttcattatggctgtgaaagagt

SEQ ID NO: 6833526 - DNA, 77 bp, Homo sapiens
gggagatgccagcagtagcagtaggccatggaaccagcatgcaaggagtgggctgcttctattggtggtctactttt

SEQ ID NO: 6833527 - DNA, 61 bp, Homo sapiens
gaatgattaactagttgatacagactttagtatttgagtcactatcagcttataatgattt

SEQ ID NO: 6833528 - DNA, 61 bp, Homo sapiens
ggctgcagaggcgatctgaggtgccatcatcaatgttcttcacaatgacggctttgcatcc

SEQ ID NO: 6833529 - DNA, 62 bp, Homo sapiens
gggaactcttatttagagtttaaggcccaagccaagtatctccttctctctgaagagttccc

SEQ ID NO: 6833530 - DNA, 60 bp, Homo sapiens
acatggtatagagccacatgtattgtgtatacttagagtagatgatgtttctttgcctgt

SEQ ID NO: 6833531 - DNA, 94 bp, Homo sapiens
acatttgccagcactgttatatgcttgagcagtgggtatgcagtggagaaccagacagaccctctcctcatggacatgagccaactggcagggt

SEQ ID NO: 6833532 - DNA, 71 bp, Homo sapiens
aaggactgagtttggcctccccagcagttcactgacttgacacatggcttggagaccaaaagaaagtgctt

SEQ ID NO: 6833533 - DNA, 58 bp, Homo sapiens
cccaggaggcagagcttgcagtgagctgagatcgccccactgcaacagatcgcctggg

SEQ ID NO: 6833534 - DNA, 71 bp, Homo sapiens
gtgctgattttggttttgaaaaggtttaggagctgctaaactcttctgtagaatcagattatggtcagtgc

SEQ ID NO: 6833535 - DNA, 74 bp, Homo sapiens
ggtgtaactgggccgaaatggacagaatagacattatagtaaaggttctttttgctttggtttcaagttgcact

SEQ ID NO: 6833536 - DNA, 64 bp, Homo sapiens
gtggtttaaaacagttgttttcagaagaggttattatgaattaactgtctttaactggaaccac

SEQ ID NO: 6833537 - DNA, 61 bp, Homo sapiens
gaggaacagttggtatttgtgaactggtgacctagaacattcaaatgaagctgttggcctc

SEQ ID NO: 6833538 - DNA, 67 bp, Homo sapiens
ttttaactttaccatttcttcagttgtaaaatgatgcaccaactgacagtgtgcccggaggttagaa

SEQ ID NO: 6833539 - DNA, 71 bp, Homo sapiens
ctgtgtcatctgtgttacataattcttaaagaatgcacactgctttaattgtgcagcacagatcatgacag

SEQ ID NO: 6833540 - DNA, 64 bp, Homo sapiens
aggattacatgtttctttgctgcaggacttctcagagccttagtaatgtgttaatatgaatctt

SEQ ID NO: 6833541 - DNA, 58 bp, Homo sapiens
ttcctttgcctcagagatttgttcacagttaaaatgcaaatatctttggcaaagagaa

SEQ ID NO: 6833542 - DNA, 130 bp, Homo sapiens
cccctcctgtgaagtgttaaggtcctcgtttttattaaatgcaagtgctcctgggagggctaatagcttaagttgagggaggctcttgcagaggaaggatgggaacagagacagttttctaggaggttgg

SEQ ID NO: 6833543 - DNA, 91 bp, Homo sapiens
taggcttccggggacactgcagtgttcccactgggctaagactggaacctctctagccatgtgtggaacacagcctggttcctggtccctg

SEQ ID NO: 6833544 - DNA, 59 bp, Homo sapiens
gtgacaaatgcaaattgggctgcttcgtccaaacatgtcagcctatttagcaggtgcat

SEQ ID NO: 6833545 - DNA, 67 bp, Homo sapiens
ggggtttaggggatagtaagtaacaccctagccacctgctgaatgtagaaactgtcttttacaccct

SEQ ID NO: 6833546 - DNA, 70 bp, Homo sapiens
gaccaaatatccgagaccaaataactggcagttagaattggcccagttgttcctcttgaatttagtggtt

SEQ ID NO: 6833547 - DNA, 55 bp, Homo sapiens
ggtcactgtctgaggtactggagattaggacttcaatatacctttctgcagggct

SEQ ID NO: 6833548 - DNA, 79 bp, Homo sapiens
ctcagctttaacagacatatatatttgtatgtgtatagaagccttcatatgtaaatgtatatgtgtgttatgtactgag

SEQ ID NO: 6833549 - DNA, 89 bp, Homo sapiens
gcttatgtggtaagtgagggagctgggacttgaaccaggcagtaaagctccaaattccattcatgctcccttaccactctctacatggc

SEQ ID NO: 6833550 - DNA, 59 bp, Homo sapiens
ggggttggaggcattgaaacagaagcagttatgcttggtctgccagtttctcttacttt

SEQ ID NO: 6833551 - DNA, 62 bp, Homo sapiens
agctgtggttctgggcagcgactccggggagatgcttaaccgcccaggaacccccgatggct

SEQ ID NO: 6833552 - DNA, 65 bp, Homo sapiens
gccccgctccagcggagcacgtgcagtgagaggcttcagaaacaggtgccttccgcggagctcgc

SEQ ID NO: 6833553 - DNA, 65 bp, Homo sapiens
tttgcttgtttgttttgacaagtgcggtttagttttatgataatatttcagagcacacaagtaaa

SEQ ID NO: 6833554 - DNA, 70 bp, Homo sapiens
ttatgcctggaacctttctctttggcgggtgccaggaagctgagagagaggaatctcaagccaggtatga

SEQ ID NO: 6833555 - DNA, 67 bp, Homo sapiens
tgtggccagccttgtcatcgcttttcctggttaaagatggcaaaagtgactgccagtgctgggcata

SEQ ID NO: 6833556 - DNA, 74 bp, Homo sapiens
tgccacataaggtgttgtatccagagacagagtaacagcaaggtggagctggatggggcagcttaggtgtggca

SEQ ID NO: 6833557 - DNA, 55 bp, Homo sapiens
atctcagggctggagccctggaatctgtattttttcaaagcctcgagacctggat

SEQ ID NO: 6833558 - DNA, 70 bp, Homo sapiens
tgtgattaagttaggattttgagatagagaaattatcctatattatcttggtgggcttaatataattaca

SEQ ID NO: 6833559 - DNA, 94 bp, Homo sapiens
ggccggagtaggcaaagctgccttctaaatatttgtctggagattagcctactcctgcagctctgagaagcatctttgatttacttatactgct

SEQ ID NO: 6833560 - DNA, 112 bp, Homo sapiens
aatgacttcacaggtgcccagctccacctcacagacaccatttttctctctgcagaggcctgatacattctgtgggtcagacgctgggcagcaaagtgcctgtggggacatt

SEQ ID NO: 6833561 - DNA, 73 bp, Homo sapiens
ggtttggatgagagggtgtggtacattggttgcaaacaggaccctgatccttcactccctctgcatccactcc

SEQ ID NO: 6833562 - DNA, 84 bp, Homo sapiens
accaactcatcaagctctttcccctccctatggcactgagaagaggccatcttgggagggcagggaggattcgatgctcatggt

SEQ ID NO: 6833563 - DNA, 81 bp, Homo sapiens
ggcaagagtgtcagtttccatgtctgtgaactggagataagattcgtctctaaatacagatgtcatggtggctctctcacc

SEQ ID NO: 6833564 - DNA, 55 bp, Homo sapiens
gcatcagttactaggagggaaaactctggaacccagggcctcttggaattgaggc

SEQ ID NO: 6833565 - DNA, 65 bp, Homo sapiens
tggcaaagatgaagcatttcgtctcttcgaggtaatgttgaattggcttcatctatatgttgcca

SEQ ID NO: 6833566 - DNA, 61 bp, Homo sapiens
gttcctggccaaccccctcagcttcccaccagagtttgccaaggcttggcttggcaggaac

SEQ ID NO: 6833567 - DNA, 94 bp, Homo sapiens
gtatcttttcttcgactatttcttgactttcttgggaggctgctggcatagctgtctcagtaattaatgttatggaaagtctcatcaaggatgc

SEQ ID NO: 6833568 - DNA, 56 bp, Homo sapiens
cagtgattttctcagaacttgagaagagaaagatcaagtttgagaggaagtcagtg

SEQ ID NO: 6833569 - DNA, 56 bp, Homo sapiens
gctggacaggcgcagtcaaagaaatactgagacctcagcttctgctgcctttcggc

SEQ ID NO: 6833570 - DNA, 81 bp, Homo sapiens
ggtatctcttagaagatcagcgtcagttagcaagttgaatgacaggcctgtgaaacttgctaattgcacgtaggaggaacc

SEQ ID NO: 6833571 - DNA, 57 bp, Homo sapiens
gggaaaatattaagcaggacttctaagcccaaagaagtcatatttatataatttccc

SEQ ID NO: 6833572 - DNA, 64 bp, Homo sapiens
caaagagctggagtttgcagccctttctagttctgaacccaggcgttgcaaatgtggcttgatg

SEQ ID NO: 6833573 - DNA, 84 bp, Homo sapiens
tgtccaccgtctccacatagcacaggctgctgggctccgtgctggccagcaagagcatgtcggcctggtgtggagtggggggca

SEQ ID NO: 6833574 - DNA, 118 bp, Homo sapiens
cacaattgattggtgaaaaatgcatgcctgataatattgacctacagaccaatgagatctcttataatttgctgggaaaatgtatcaatttgtacaaacattttgaaaaataattgtg

SEQ ID NO: 6833575 - DNA, 78 bp, Homo sapiens
cttcagtgtttttttggaataaagtagtgtatgcatacatacatataaatctttgttcctagaatttagcactgttag

SEQ ID NO: 6833576 - DNA, 65 bp, Homo sapiens
ccctagccccagcctcttgccacctaagtgtaagtgtaaactctcaccaggagatggaggcaggg

SEQ ID NO: 6833577 - DNA, 83 bp, Homo sapiens
gcagcatgtggttgaaggttattacttatgagtttaaaataatagctgatgagccgtggttatctttaaggctactaagctgc

SEQ ID NO: 6833578 - DNA, 74 bp, Homo sapiens
tatttttctgaagagagggaaacaattggaattgaagtgactaattccttttgcaaggtcctctaggaaaaata

SEQ ID NO: 6833579 - DNA, 74 bp, Homo sapiens
tctgctctactagatccagtttgtttattttcttgaaatagttgatgcaaataaacagtctagttgaaaacagg

SEQ ID NO: 6833580 - DNA, 91 bp, Homo sapiens
ggatcaccacacaaatattctggaggcaaagcagcaccttctgttttaactcgggcctccggttgatattatgttagtgctgggctgatcc

SEQ ID NO: 6833581 - DNA, 90 bp, Homo sapiens
ttttttaatctgtgaaagagctttgcattattcagaagcaaaatattaatgttgttattaatggggcacaggcaatcatagtagagaaaa

SEQ ID NO: 6833582 - DNA, 115 bp, Homo sapiens
cctcctcttgaagtctggagagtcataggcgtcctcctcgtctgaggcggcgtactgccccgcgctgcttctctctaggaagacgctccttttctctaacttggaaagaaaaagg

SEQ ID NO: 6833583 - DNA, 112 bp, Homo sapiens
caggcgcgcggggccgtcggggctgagcggcggtgtgtcgggcggcggcggggggcggcccccgggacctcgcatgcacgaagccgccgggcccggggcgccctcgcgcttg

SEQ ID NO: 6833584 - DNA, 115 bp, Homo sapiens
ctctcagctaccttgtcactccaccaattaagattttcaacatctggagcaagattaagagatgtatatccattgttgacctgttccagatgcagaaatgatggtagttgctgag

SEQ ID NO: 6833585 - DNA, 107 bp, Homo sapiens
cctgtgtgcgtcttcagggggtgtacttttataaatgtatgtgcacacacagaggtgccaatgcatttgtaaaatataatcgaaatattagacataaagcatagagg

SEQ ID NO: 6833586 - DNA, 70 bp, Homo sapiens
gggggcatggggcatggagtcattctgtttgaggcagagcacagtggcttctatgtctacatttgcctct

SEQ ID NO: 6833587 - DNA, 55 bp, Homo sapiens
tggctctgtcaaactgcacacatcccagccaaagggtagtcaggggagggagcca

SEQ ID NO: 6833588 - DNA, 56 bp, Homo sapiens
gtagtgcgggggtaacttctcatgcaaacggtgtctgagataaatttccttactac

SEQ ID NO: 6833589 - DNA, 90 bp, Homo sapiens
gctttgaaaggcactgccccggctatggctcaccatgtcctgggagggagaccccacagtcaggccagccaggtccgatgtcctcaaggt

SEQ ID NO: 6833590 - DNA, 81 bp, Homo sapiens
gggcctggggctaacttgtcttcaacaccttgtctagtgaataaatctagttcaggaagagaaacaacagcccgcaggcct

SEQ ID NO: 6833591 - DNA, 74 bp, Homo sapiens
cttgggagtcacaggcctggatgaggggcatgacatggaggacatgccctgagtgagggtgtgtggtgagaaag

SEQ ID NO: 6833592 - DNA, 73 bp, Homo sapiens
tttatagaggtaaccagttattatgaggtcattaggatgggtcctaatccaatataactggtgtctttgtaaa

SEQ ID NO: 6833593 - DNA, 112 bp, Homo sapiens
tccttaatttggctgaggctccttttctataatgcaagccactgcatgcacaggtatcatttggccttctttgcattgtgttgggaataggggttcagaaaactagtgagga

SEQ ID NO: 6833594 - DNA, 72 bp, Homo sapiens
tcctgtccattgcaaggaaaacagatgatcaacatgagaagctcagctgttgattaattttcccaaacaggg

SEQ ID NO: 6833595 - DNA, 76 bp, Homo sapiens
agagagaggcagaaactgagacagaaggacagagagagaaatgctctgttactctgaatgtttctactgattcttt

SEQ ID NO: 6833596 - DNA, 64 bp, Homo sapiens
tctgcaaattttgctgctggaatttttggaatttaccaggaggtgttgatagaaggtttgcaga

SEQ ID NO: 6833597 - DNA, 55 bp, Homo sapiens
cccacatctcacatcttggaaccaatggtcttctgaagaaaaatgagatgatggg

SEQ ID NO: 6833598 - DNA, 61 bp, Homo sapiens
tactggagactcacacatggtatcttgatcagcccagcatagccagtgaatgtttccagtg

SEQ ID NO: 6833599 - DNA, 56 bp, Homo sapiens
ggggaaggccatcttaggtcagaggcagtggttcttggcatacagtggttttcccc

SEQ ID NO: 6833600 - DNA, 124 bp, Homo sapiens
tttgtcattctcagtgatcttgagcttaacaggtaccgtatttttacattttaattgttattgatgagttttagagggaacttacgataatgttaaatggtgcttgttgaggtcaaatgacaaa

SEQ ID NO: 6833601 - DNA, 64 bp, Homo sapiens
tcatccctggctaattttttgtgtttttagtagagacgtggtttcactgtgttagccaggatgg

SEQ ID NO: 6833602 - DNA, 68 bp, Homo sapiens
tgactgattcatatttaactttggctccacgctgtcttaaagtgcacagagttgaatattgacattca

SEQ ID NO: 6833603 - DNA, 55 bp, Homo sapiens
tttcaaatggagtcgtgaaatgaagggcacccttcatatccgattgtattggaaa

SEQ ID NO: 6833604 - DNA, 83 bp, Homo sapiens
agaaggtgcctgggctttagggttgaatgcatctgggtttgaagcctggagcccccacgtttcctgggtccaggtgatcttct

SEQ ID NO: 6833605 - DNA, 65 bp, Homo sapiens
ttttctggaattgctgtgtgagttcctttcatagggtaggaaatcatgccagcaataccaaaaaa

SEQ ID NO: 6833606 - DNA, 62 bp, Homo sapiens
tgcagtgtggatttagttgtgctttttacttgctgggagagcacagccaccatttacaagca

SEQ ID NO: 6833607 - DNA, 78 bp, Homo sapiens
tcagagcctgcccctccaccaggatgctgcagcgcttttatttaaggcattctgtggtcacaggggcagcagcggtga

SEQ ID NO: 6833608 - DNA, 76 bp, Homo sapiens
gagagcacatttggggtcaacagaatttgtactcagcctagagaagaaggtagagggttgttgaatcaatgctttc

SEQ ID NO: 6833609 - DNA, 80 bp, Homo sapiens
cttcaagtgatggaggaaggctaataatgcaagaaatgatattttcaacgtacttattatcttctcccaagtactaagag

SEQ ID NO: 6833610 - DNA, 67 bp, Homo sapiens
tcccagagcagggtttctcagcctcggcactactgacattggggatggatgaatctttgctgtgggg

SEQ ID NO: 6833611 - DNA, 71 bp, Homo sapiens
acggggctggttcctgtgtactgtggcttagctggctgggatgagaagcagcttacaggtgtccaccttgt

SEQ ID NO: 6833612 - DNA, 57 bp, Homo sapiens
ccacctcctcggccatgtgacggagcgagggttctctccagcgggctgagcaggtgg

SEQ ID NO: 6833613 - DNA, 55 bp, Homo sapiens
gttggaggatgcaatgagggagtaggccgtctgcctcccaaccagcagttccagc

SEQ ID NO: 6833614 - DNA, 55 bp, Homo sapiens
caactctactctacttttcctgaaatccttcaggtataaagttcagggagagttg

SEQ ID NO: 6833615 - DNA, 72 bp, Homo sapiens
tccctgagaaagcccaggaggtaactgcccagcagggaccaggcagcatcttcctgaggtttgctcacagga

SEQ ID NO: 6833616 - DNA, 67 bp, Homo sapiens
gcctcccctctgccctcagctctatctccctcggcctgggagtggcactctgaggcggggggagagt

SEQ ID NO: 6833617 - DNA, 57 bp, Homo sapiens
tcaggaaggcgccccatcaggaaacatctgtttcttgcctttcatgccctttcctga

SEQ ID NO: 6833618 - DNA, 64 bp, Homo sapiens
tcgtttttattgctgatagtgtttataaaaatgttttatagtttatggtcggctgtgagaaaga

SEQ ID NO: 6833619 - DNA, 130 bp, Homo sapiens
agccaagcaggccggacttttccctggcaaccctctcgcctcaattctggcagccctgtgcgctagagtgaaccaagtgtgggctggggagtcaggtttaatttctagttttttaccatctatgtagcat

SEQ ID NO: 6833620 - DNA, 55 bp, Homo sapiens
aaaccacctccccagctgctgtgctaaggcacagtaatagatttgagagtggttt

SEQ ID NO: 6833621 - DNA, 95 bp, Homo sapiens
ttgacattattctgcttctttgttcccattttagggcagtgcaaggagagctgtgcattagcttttgtgggctttaatgaagcaggatttgacag

SEQ ID NO: 6833622 - DNA, 74 bp, Homo sapiens
atgcaatgtccaatttcagagtctcatttgcctgtgaattgagagagttcagtggactcatggaagacttgggt

SEQ ID NO: 6833623 - DNA, 60 bp, Homo sapiens
ttctaagattcatgaggacaggattagggtttgtgtcttgtttgttattgtttcttagaa

SEQ ID NO: 6833624 - DNA, 77 bp, Homo sapiens
tatgtgtctttaaagtgtacttctgctgagccatggatagtgtccagtgtcatttgtatacttttttaaagctcata

SEQ ID NO: 6833625 - DNA, 71 bp, Homo sapiens
aagaggttcctcatggttttacccccttgtattttctaaagcctggaagtagaaacatgagagaaactctt

SEQ ID NO: 6833626 - DNA, 88 bp, Homo sapiens
ttcagggttgtgaagcaggaaatactccctgctggaaacatagaaaacctccagtccagtgatttttccagtttcacaattacatgaa

SEQ ID NO: 6833627 - DNA, 74 bp, Homo sapiens
atttgggtgggagcaggaagcagttgggaattagagggatatggaaagatattttctccagcttgcacttaaat

SEQ ID NO: 6833628 - DNA, 63 bp, Homo sapiens
cctggtggtgtataatagaatgtttgtaaataaaaataaagcattattataaagaccacaggg

SEQ ID NO: 6833629 - DNA, 85 bp, Homo sapiens
actatctcctcaaaggtcaaagacagtaacttttattattaagctttgtagaagctaattcatgtcttatggccagagtgatggt

SEQ ID NO: 6833630 - DNA, 62 bp, Homo sapiens
ttcattttgagggaacctcttacataggacatcctatccatgcaagagtttctcaaactgga

SEQ ID NO: 6833631 - DNA, 58 bp, Homo sapiens
gtccccagagctggtggtggtttctcagctctgcatttccacctcattgctctggggc

SEQ ID NO: 6833632 - DNA, 80 bp, Homo sapiens
gggattaatgagtacccagggaatgtgggatgactctaggctggagctggggtcattaaattccgctggtcattaatccc

SEQ ID NO: 6833633 - DNA, 87 bp, Homo sapiens
tggtaatgttctcttccctggctggctgtcaaggaaagccagagagatctatcttcggccctcagccagctggaatgggcactgcca

SEQ ID NO: 6833634 - DNA, 66 bp, Homo sapiens
agcagaaaattggaaatgacaaggctgaaatccaaagaaaagtgtctttcgtttctatactttgtt

SEQ ID NO: 6833635 - DNA, 129 bp, Homo sapiens
atctagttctgtttctattaacgtttttctcttagtgtttagtcatttggatttgatcttttgcatggctcataattattttgtattggatcccagatattgtataagacaaaattgtagactctggat

SEQ ID NO: 6833636 - DNA, 63 bp, Homo sapiens
cctaatcccagagaataatgatcaggcgttgatccaagtgagaattattactctttgggcagg

SEQ ID NO: 6833637 - DNA, 114 bp, Homo sapiens
gggtgtcaggcagagggagggaggtgtcaaccacagagcagagccaggcaagagcactgtcagccccaccctcagctctgcctgtggaggcacaccctacagctgcttaacctc

SEQ ID NO: 6833638 - DNA, 94 bp, Homo sapiens
ggcctactcttgacttaatcccttcatttaaggctgagatctattacgctctgtcactcaaagcatttctgcctagggttgagaagtagttgtc

SEQ ID NO: 6833639 - DNA, 114 bp, Homo sapiens
acatttattggctgtgatgtgtccactgcaatcgtgtatgggtgctggcctgagtagagagcacttgccaggtcacctcactcatccagagacagcctcatggtggatgagtgt

SEQ ID NO: 6833640 - DNA, 111 bp, Homo sapiens
acatcagcatcatcatgtaggatcctgttagaaatgtagactctcaaatcccatccagaacctgctgaatcagactctgcattttaacgagatccccaggtgatctgatgt

SEQ ID NO: 6833641 - DNA, 98 bp, Homo sapiens
tagagaattgtgtttgtgtgtgtgtgtatctatgtatgtgtacttttaattttggtagtatactgaaagtaaatatgacaaacaaataccctttgcta

SEQ ID NO: 6833642 - DNA, 66 bp, Homo sapiens
cctctcggagcggtgtttagaatgttctctctcattaatcctatttaaagcccggctgctgagagg

SEQ ID NO: 6833643 - DNA, 89 bp, Homo sapiens
ggtgaccttggagcagctacttaaccttgtacatcatgggtttcccctctgtatcatgaggatgatagcacacactccgtgaggttatt

SEQ ID NO: 6833644 - DNA, 76 bp, Homo sapiens
gctccgcggggccgagctctgcggaaaacgtgccggcggctaccccgacggacgcagcgcgggccccgcagggagc

SEQ ID NO: 6833645 - DNA, 75 bp, Homo sapiens
gaggaaaggagacatttgcagagcacccactatgtgctagatctggtgcaagcagatgtcttccaaataatcctt

SEQ ID NO: 6833646 - DNA, 84 bp, Homo sapiens
atccactcactagaggtagatccctgattcactgatatgaaaagaagtggataacaggtaaataattcatagtgaggtttggat

SEQ ID NO: 6833647 - DNA, 65 bp, Homo sapiens
aggaagtgtgcaattaatttctatttaccatcccttcttctctagaaaaattgatatcgcttcct

SEQ ID NO: 6833648 - DNA, 57 bp, Homo sapiens
tctgcaggtggattatcagaagtgcacaaaaatggctgtgtagatctggcacccagg

SEQ ID NO: 6833649 - DNA, 67 bp, Homo sapiens
ccaggccttgcatttgtgatttagcttggtgcttcccagaattctaggctgcagatgcatggaatgg

SEQ ID NO: 6833650 - DNA, 83 bp, Homo sapiens
tgatggtgctgtctctagagaaacagtgctctgaacagaaggaataaatgcttaaggttgtttctttggaagacggattgaca

SEQ ID NO: 6833651 - DNA, 62 bp, Homo sapiens
aggaagaatgtttacatatcaaagtggataacatttcatgctggtggaaggcgcttcttcct

SEQ ID NO: 6833652 - DNA, 71 bp, Homo sapiens
gcctttttgggttccatagaaacggtgctgcccatagagaacgttgctgtttccatggtgatccaagtggc

SEQ ID NO: 6833653 - DNA, 63 bp, Homo sapiens
actctcatttgtcacctctctgtcactcgcacatcataaaatggagcccaggtgcaagagagt

SEQ ID NO: 6833654 - DNA, 70 bp, Homo sapiens
acagatgcaaggaaatgattgctttttaggtttctgagtccggtgagttgattgcttctttgctatctgt

SEQ ID NO: 6833655 - DNA, 65 bp, Homo sapiens
tccctagaatatctgctgcagctttagatgccagtacacgtaactctctggcaggtaattaggga

SEQ ID NO: 6833656 - DNA, 98 bp, Homo sapiens
gcgtctacagttttgacagctgaggcgggagcacgggaggcggagctggtggcagcgcagcgccccgccccggctccagcatcagccaatggtgacgc

SEQ ID NO: 6833657 - DNA, 57 bp, Homo sapiens
gtttcctcttataagctgttctagggagggacgtccttcagtttcagggcaggaaac

SEQ ID NO: 6833658 - DNA, 70 bp, Homo sapiens
ctgagtgaatctgccctgggttttatgggagtcctagaatcagaactgctgtcccagggtagtccatagg

SEQ ID NO: 6833659 - DNA, 60 bp, Homo sapiens
ctttctctagacctgtttcctctgccctctgttcaaagaggtcttttggtctgcagaagg

SEQ ID NO: 6833660 - DNA, 103 bp, Homo sapiens
tctctgatttggtcctgtctgacatcactgctatatgctttgctcctctcaatttcctctgccctcatgccagcaggagtcatgccagagatcatatctgaga

SEQ ID NO: 6833661 - DNA, 81 bp, Homo sapiens
acttggtgcaaactggtactcagctggcactcacattttccagtatgtagatgtaagcttggatcaggcatgtacataagt

SEQ ID NO: 6833662 - DNA, 64 bp, Homo sapiens
ggcagtgaacagaaatgcagaagtggaatttactagccaaacactgcatctgagtcattatgcc

SEQ ID NO: 6833663 - DNA, 69 bp, Homo sapiens
agaagagcacaaatttgagcttaatgctttcattatttccaaagcagtgttagcttgtttttgccttct

SEQ ID NO: 6833664 - DNA, 77 bp, Homo sapiens
atcagtttagttttctagtgtttaggaaagcttaatgaaaaatataagacaacagacaactagaaaactagacagat

SEQ ID NO: 6833665 - DNA, 65 bp, Homo sapiens
tcttgtttactcttgcaggccaaggcgttctgtacagagtttgaaagtggcctgcaagaacgaga

SEQ ID NO: 6833666 - DNA, 87 bp, Homo sapiens
ctttctattcagtttcttctattttgaactatgctaaggaaatttgggcttaatgtggtgcagaaatggaatagaaatgaaaggaag

SEQ ID NO: 6833667 - DNA, 81 bp, Homo sapiens
caggagaatcactcttaacaaaatcttcacctgaagctatatttattgcttttggaagcctagttaagatgaaaacttctg

SEQ ID NO: 6833668 - DNA, 73 bp, Homo sapiens
gcctgattatgacttcccaggtggtgtggagttcctcttgacccagataacttgaaggaagaagaaattaggc

SEQ ID NO: 6833669 - DNA, 117 bp, Homo sapiens
cttccagccctcaagcttttgctgctccccaggaaggcccttcctggtgctgttccctcccctcctgcaggtgcctttggggtcctgcctgggctgcagcaccagcttggcttgagg

SEQ ID NO: 6833670 - DNA, 88 bp, Homo sapiens
tgttgaatgaatgtttgaatgaataaaagagtaaggcagcttggaagagtgttttcttctgcctgttcatttatttgcccattggaca

SEQ ID NO: 6833671 - DNA, 67 bp, Homo sapiens
tcatttagagtagcagagaatcatgttatatgaacatgactgctcctgctctaacaatatattatga

SEQ ID NO: 6833672 - DNA, 56 bp, Homo sapiens
tccttggcaagctgcaatgggattgaaaaagatgaatcacaaaagtagctcaggga

SEQ ID NO: 6833673 - DNA, 77 bp, Homo sapiens
cagaactcttaaaagcaatatttaaaggtttgcaactctctgttggaatcaattcatgttgcaaatagtgagatctg

SEQ ID NO: 6833674 - DNA, 62 bp, Homo sapiens
gatctatccaaatgtttacttctggatatagcatatatttatcctgtaagcttgggtggctc

SEQ ID NO: 6833675 - DNA, 130 bp, Homo sapiens
ccagcagcttctaagtggataagcacagatagcaaaggccctaatagagcacatattatatattggagggacagagtggttctctattaggtcttttgctatctgtgcttatccagttagaagcttttgg

SEQ ID NO: 6833676 - DNA, 98 bp, Homo sapiens
aaacggtggccgggagctgcgcagtgcccttccaggactgcaggagtggttgtggccgtggctgcagggcagggcctcctggcacgtggccgctgttt

SEQ ID NO: 6833677 - DNA, 90 bp, Homo sapiens
atgttattcctaccatttggtatagtgaaaaggaacttttcaggagttctcttaaatacttcacatctccaggcagtggtactttaatat

SEQ ID NO: 6833678 - DNA, 129 bp, Homo sapiens
tgattgaggacagtctggctttaggcttgaggttgaactagattatttctgaggactctaacaaatctaacaccaggagtcagtgatttggttcatacttccaatttaggcccagagactgccggccca

SEQ ID NO: 6833679 - DNA, 70 bp, Homo sapiens
gtctcccgagcagccctgagttagcccacggaccagtcaccggtctccggctccccagggattgttagat

SEQ ID NO: 6833680 - DNA, 69 bp, Homo sapiens
tctttattatgacagacttaagagaatggaagtgtaacccaccttcacaggcaagtctgtttttggaga

SEQ ID NO: 6833681 - DNA, 55 bp, Homo sapiens
tcagttcctctgcccaaggcagcctcctccctggggtgcctgtgtggaggactga

SEQ ID NO: 6833682 - DNA, 82 bp, Homo sapiens
tattaaaacacagactgctgggccccatccctcgagcatctgattcagtgtggggttggggttagtcttttgcattttaata

SEQ ID NO: 6833683 - DNA, 58 bp, Homo sapiens
agttatttttggttgtttctaggtctggaggccaggaaaatgtcaatggaaagcagct

SEQ ID NO: 6833684 - DNA, 76 bp, Homo sapiens
acagccttactatactaaacaggctcttttcttctatattttctagctggcatttgtttctgtgtaggaaggctgt

SEQ ID NO: 6833685 - DNA, 62 bp, Homo sapiens
cagggcttgccttgccccggcgctcgtcgcttccctgggcgccgggcggtttgcaagccctg

SEQ ID NO: 6833686 - DNA, 61 bp, Homo sapiens
gctttgggtgtcctctgggcctggtctcatggagtagttcaggctggagactcaagactgc

SEQ ID NO: 6833687 - DNA, 69 bp, Homo sapiens
ggccttccaaagtgctggggttacaggcgtgagccaccgcgcccagccacagtcactttcatcagggcc

SEQ ID NO: 6833688 - DNA, 55 bp, Homo sapiens
cctttggaagctggaaatggaaaggaaacagatcctctttcacaacctccagagg

SEQ ID NO: 6833689 - DNA, 71 bp, Homo sapiens
cctcccactctcctctctctctttctgtctctctccctgctaagaaagtgggaacaatggagagtgttagg

SEQ ID NO: 6833690 - DNA, 81 bp, Homo sapiens
tcccactcactaggtcatccctgtcctccctcagttggggcaaatctcgctggcctggaggggagccagagaaggtgtgga

SEQ ID NO: 6833691 - DNA, 86 bp, Homo sapiens
catttagggccctgctttatggatagcctttccccacactgtgggaaggtaggcaggggagctgtctgggttgagggccctggttg

SEQ ID NO: 6833692 - DNA, 96 bp, Homo sapiens
agtgaaattttctgcttcttatcaagtggcaaatcttttgaaattgatatttcattctcatggacgctatttagttgaagatgtatttattttatt

SEQ ID NO: 6833693 - DNA, 79 bp, Homo sapiens
gcagctttttgtcagggactggaaaagaaagagtacatgcctcaaattttcttgcagctgtctctgcatattagttagc

SEQ ID NO: 6833694 - DNA, 87 bp, Homo sapiens
cttgcctagacgagacacagtgcataaaaacaacttttgggggacaggtatgttttcttgcagctgcggttgtaaggtcttggcaag

SEQ ID NO: 6833695 - DNA, 56 bp, Homo sapiens
tatttatgtggaccataagccttctctaatcaggaggtgttgggcctatataaata

SEQ ID NO: 6833696 - DNA, 65 bp, Homo sapiens
tgagccagctgcatctcctgggctgcacggagacacatcctcagacttcaggatgcactgattca

SEQ ID NO: 6833697 - DNA, 93 bp, Homo sapiens
tatctaccagggtatactttgtaagatcttctgattcctataagatattttgctgataatagaaatcttatcaagaaatgccctttggagata

SEQ ID NO: 6833698 - DNA, 90 bp, Homo sapiens
ttccaagagactcttgaagattctttttgttagtagggaaaacattctccatttttctgccaactttagggttttcagagaagtttgggg

SEQ ID NO: 6833699 - DNA, 59 bp, Homo sapiens
tctaagaatgcccttccaggaatccaggcactgcatcccaggacccaggcattcacaga

SEQ ID NO: 6833700 - DNA, 59 bp, Homo sapiens
tcacagttatagtctgtagaatgtcaagatagccaagatctctgcagactatattgtga

SEQ ID NO: 6833701 - DNA, 55 bp, Homo sapiens
acagtgataccctagggacagaagagtcgctgtcccagtcaaggctgtcatctgt

SEQ ID NO: 6833702 - DNA, 81 bp, Homo sapiens
gcatttttcagtcatctcaaactgtgcttgtaaattcagaccttttactgaaagcattaatttggatgaaaacgatgatgt

SEQ ID NO: 6833703 - DNA, 60 bp, Homo sapiens
ctcctgacctcgtgatctgccagccttggcctcccaaagtgctgggattacaggcatgag

SEQ ID NO: 6833704 - DNA, 78 bp, Homo sapiens
ggcaggcgggcgagctgcaggcggggtcgcagcggctgttgttgaagaggcgccagcactgcagcgcctcgcattgcc

SEQ ID NO: 6833705 - DNA, 63 bp, Homo sapiens
gtgtttaagatacttcacttgccgaaatgtatttgaacaattcattatgtggggtatctgcac

SEQ ID NO: 6833706 - DNA, 77 bp, Homo sapiens
tgtccatgtttttgatggtatggccttttttactacaaacaccgtaattataaagaggaaccaagagcacgtggata

SEQ ID NO: 6833707 - DNA, 56 bp, Homo sapiens
tgcaagtcccttgttcacttggagcccatggctgctgcttggaaatggggctgaca

SEQ ID NO: 6833708 - DNA, 58 bp, Homo sapiens
cagtgtctgggacagaaagtcacagcagcctgtatgctgtcacttgtgccaggcactg

SEQ ID NO: 6833709 - DNA, 71 bp, Homo sapiens
gaattctaccccatggtccccacgctctgaaaagtggtggaggagatggttgggttaacaactaagagttt

SEQ ID NO: 6833710 - DNA, 91 bp, Homo sapiens
gagactatttttagataaatgaatgattaaagagtacagtgttattgcacaatgtgtttttatacatttggtatttttaaaaaatgatttc

SEQ ID NO: 6833711 - DNA, 84 bp, Homo sapiens
ttaatgcgagcgactcgggtggtttatgagaagtgacacttaatacccagcttcttgtatctgccgccgagcagttaacgttaa

SEQ ID NO: 6833712 - DNA, 64 bp, Homo sapiens
gcctctggctgtcccgatgagcagagatttaagatcctgttctccataaagatggctagatagc

SEQ ID NO: 6833713 - DNA, 60 bp, Homo sapiens
aagtggcatgtataagaaagaatcatcagagaattaatggtccttccttaaagtgccctt

SEQ ID NO: 6833714 - DNA, 64 bp, Homo sapiens
aaagttgagtagggtttgggccttttacatgaactctgtattttccacaagccctgttattttt

SEQ ID NO: 6833715 - DNA, 61 bp, Homo sapiens
cttttgtagatatcgcccaaggtgctcaccaatggtcagcactgatagaagtcaataaaag

SEQ ID NO: 6833716 - DNA, 61 bp, Homo sapiens
tctctacagacactgttgacttctgcttctaattgggggacctcatagttaactgtaaaga

SEQ ID NO: 6833717 - DNA, 57 bp, Homo sapiens
gatgattgttgctgcccaatgatgagccaactctcctgccagcattaaacagtcatt

SEQ ID NO: 6833718 - DNA, 69 bp, Homo sapiens
cacggttttattttagttttagacatatgacaaatcatgccatgtttgaaattgtaagtatattttgtg

SEQ ID NO: 6833719 - DNA, 85 bp, Homo sapiens
tccaggcactttctctaagagttatatgaattgctccctctaaactggggtgagagttctaaacacttgaggaaccatgctttga

SEQ ID NO: 6833720 - DNA, 87 bp, Homo sapiens
agtagggcagaaacatgtagctctgccaggtatggagcacatggcccgtccctgggcaccaggcctggtaaacagcctgctcctgct

SEQ ID NO: 6833721 - DNA, 72 bp, Homo sapiens
agtagctgctctctagctaacctgtagcattggcattcagctccagtgcatagatcctgaggcctagctgct

SEQ ID NO: 6833722 - DNA, 65 bp, Homo sapiens
tttattatatatacagtagagtttgtaagtactaaattcgtatcacagaactgtatagtgataaa

SEQ ID NO: 6833723 - DNA, 92 bp, Homo sapiens
aagtaaatagtcagcagtgcttttacaaatatattcacatgaaaatttttatgctgaaatttattggtaaggaattgctaaatgttgtactt

SEQ ID NO: 6833724 - DNA, 129 bp, Homo sapiens
actggtggccagggcatgtctcccccagccctgagtctccgcagtggtgaccagggcatgtctcccccagccctgagtctcccggcagtggaggcagcgtgggcacagggtttgtcacagcctgtaagt

SEQ ID NO: 6833725 - DNA, 55 bp, Homo sapiens
ggacaaagcagtatattggtagttgttaatatagcagtgctagctctgcctgtct

SEQ ID NO: 6833726 - DNA, 67 bp, Homo sapiens
cttgctggagtctggaaggagctgggggccaatctgaggcctccagagggtcagactctgagacagg

SEQ ID NO: 6833727 - DNA, 60 bp, Homo sapiens
gtccacagatctcttgttgacctgtgttgtaaagtcatcagcgagtgatgctgtctcgac

SEQ ID NO: 6833728 - DNA, 66 bp, Homo sapiens
gtgcaagatgctgattttatagaataaagagtctaggaatcttcattttaaaattgtatcttggac

SEQ ID NO: 6833729 - DNA, 94 bp, Homo sapiens
ctcttttagagtgaagacctaaaattccctcagatgcatccaagaaatcatctagtcaagagtagggatgataggtctaagtacaagagaagag

SEQ ID NO: 6833730 - DNA, 57 bp, Homo sapiens
ctgtccttggctaaagggaactgctttttctaaggtcattcccctccccagggatag

SEQ ID NO: 6833731 - DNA, 55 bp, Homo sapiens
gactgggcttctccccctggcagagggcttctctctgccacatgaggatttagtc

SEQ ID NO: 6833732 - DNA, 122 bp, Homo sapiens
gtgtgttgtcaaaactattttcatcgtaatgggaaattgctagttgcttttttcactgtattgacatttgcattgaggatgcatagcaattttgggttaaaactgctggtgccttagcacac

SEQ ID NO: 6833733 - DNA, 96 bp, Homo sapiens
cacctggtagatcagtgcctcttagcaaatgcctgtgctgctgtgcaaggtacaagagtacgtcagctgggcatctgcagatgatggctccaggtg

SEQ ID NO: 6833734 - DNA, 57 bp, Homo sapiens
cccaggccaagggggaaggagatgcaggtacacttctccctcatgcctaggcctggg

SEQ ID NO: 6833735 - DNA, 66 bp, Homo sapiens
ggagcctccctatgcaccttcaggaacaacacccaagcagggtgcctgtctgcaaggggtggatcc

SEQ ID NO: 6833736 - DNA, 90 bp, Homo sapiens
ccctacttttgttctgtttagttttgacagtaagtcagagacttggtcaataaaatgattgtgcttactgtttactgtcgaaccttaggg

SEQ ID NO: 6833737 - DNA, 57 bp, Homo sapiens
accaagctagaacattacaggcactgctgcctttgcttgtgggattctcagcatggt

SEQ ID NO: 6833738 - DNA, 82 bp, Homo sapiens
acacagataatgctcatataggtaaatttttaaggacacaaaaactatcaaataactcctgattatatgtgtatgtctgtgt

SEQ ID NO: 6833739 - DNA, 55 bp, Homo sapiens
gctatacatcccaatttcagagacccatgttatgggttttccagagatgtgtggt

SEQ ID NO: 6833740 - DNA, 60 bp, Homo sapiens
ccttcctgcttaacatatggtcaagttgggaaccaattgctaagttaaagcgggagcagg

SEQ ID NO: 6833741 - DNA, 74 bp, Homo sapiens
ggatgataagttatgggggcttctgtagagatttctatgagaacatctctaaggaactcccccaaactgaattc

SEQ ID NO: 6833742 - DNA, 60 bp, Homo sapiens
aggatgtataagttttatgagagactttgctaaaagccttgctgaaatctatgacatcct

SEQ ID NO: 6833743 - DNA, 81 bp, Homo sapiens
tctttgctataactacttgaagagttcagcagaaaaattttactgaagaatccctgatcctcctttaagtagctgtagaga

SEQ ID NO: 6833744 - DNA, 81 bp, Homo sapiens
tccagtagtctatcagtgctaagagagggcctgcaccccatgatggggtccccgaggccagctctaagccctacccctgga

SEQ ID NO: 6833745 - DNA, 68 bp, Homo sapiens
acactgtaggagaaaggagtttgcctcagtcctttcagcgtgttttttccttcttgttcctgcggtgt

SEQ ID NO: 6833746 - DNA, 62 bp, Homo sapiens
aggtaatattgatttcctcagtaaaacaagaagttaaaaaatgaggatttcagtagatgcct

SEQ ID NO: 6833747 - DNA, 64 bp, Homo sapiens
ggccagtattcatctaaggagcttgctaagtttcccttcttatattgagctcctgaatctcgcc

SEQ ID NO: 6833748 - DNA, 79 bp, Homo sapiens
tgtgccaccacaattagctgtgtgtctatctccattgttaacatccaatcaagcaacaggaaatagctgattaggtaca

SEQ ID NO: 6833749 - DNA, 59 bp, Homo sapiens
gacaaggagccaccagtcacgtcccgcttaaaggacgaacaaccaggaagcttcttgtc

SEQ ID NO: 6833750 - DNA, 91 bp, Homo sapiens
gggggtgtggaggagagagagtgagctttgctaaacccaggcccaattgcatgaagttgctgtagctcatttcactctcctttgttccttc

SEQ ID NO: 6833751 - DNA, 79 bp, Homo sapiens
ggttgttcctgttatttgcttgctaaggaaatagagggaaaaactagtatttcagtgtcagtaatgcagcaggaatact

SEQ ID NO: 6833752 - DNA, 61 bp, Homo sapiens
tgaaatcttatactttggtagtcttctcaaggttcagaggatagagctccatgagatttca

SEQ ID NO: 6833753 - DNA, 65 bp, Homo sapiens
ttgggagcaccttgagggcagaaaccaggtctgactcatctttattcccctcaaggagttcctgg

SEQ ID NO: 6833754 - DNA, 67 bp, Homo sapiens
gggattcacctgggatagtctgacattacttaaccccaacttgtccttcagatctcaggagagtctt

SEQ ID NO: 6833755 - DNA, 63 bp, Homo sapiens
ttcattaagggctgtcatgtgtcagtgaccttacggtaaggtctgagttacagtcttcttgga

SEQ ID NO: 6833756 - DNA, 86 bp, Homo sapiens
gaaaatcaatctagttgaatggatttgttatattatatttaattgatgataataatagatatggccgtctgttttaattgattttt

SEQ ID NO: 6833757 - DNA, 86 bp, Homo sapiens
gggaaatatattacaaatagtggaatgcagagagcagacaaattcacagagcaaaaagcaattctactgcttggaatatctttcct

SEQ ID NO: 6833758 - DNA, 80 bp, Homo sapiens
gtgagtgatactgattcctttgaggcttgcattaaacattttttagggtgagtctgaagtagtctttagtgttaatttat

SEQ ID NO: 6833759 - DNA, 74 bp, Homo sapiens
ctgcaggtggctgggctgacgctgctggctgtcggggtctactcagccaagaatgcgacagccgtcactggccg

SEQ ID NO: 6833760 - DNA, 60 bp, Homo sapiens
tattccttggctgaaaaactagatcattgataaacttggaacagtctcagcggaggagta

SEQ ID NO: 6833761 - DNA, 57 bp, Homo sapiens
tcctctgacttctggttgagttggtcaatggggagcaccagcaggagatcagaagga

SEQ ID NO: 6833762 - DNA, 122 bp, Homo sapiens
tggcctgatgcacgccaccagcctcccgctgaaaggtgacactctgccagctgggttcccttagtcaccctgtgggcgcctgtcagcctcactcaagaatggagctggtggctgcatcccca

SEQ ID NO: 6833763 - DNA, 57 bp, Homo sapiens
ggaggaggaaggggggaagggttaaatgaacagaaggccaccctctcttattcctcc

SEQ ID NO: 6833764 - DNA, 87 bp, Homo sapiens
ttgtgaaatcatcattccttgtaaaaatcttatgaatggcaaggaattccttacccttcatcagattttggggttttggttacatgg

SEQ ID NO: 6833765 - DNA, 69 bp, Homo sapiens
tgcaaagtgcatgatgattattccgttcattacttggtaactggaagtataattatcaagtaatctgca

SEQ ID NO: 6833766 - DNA, 82 bp, Homo sapiens
actgagatgctagcatgcaggttagagcatccacacagatactaaacacttttgggatgttggctggattttagattttagt

SEQ ID NO: 6833767 - DNA, 81 bp, Homo sapiens
cagtcaacatcactgtttatactcaaaagatacaggttttttttcatctgttaagtcttttcttgtaaacaatgttgagtg

SEQ ID NO: 6833768 - DNA, 56 bp, Homo sapiens
ggaggtgggagacataggcggcagggtcggaggcgcgcacagtgttcgccacctcc

SEQ ID NO: 6833769 - DNA, 60 bp, Homo sapiens
cagccctccaatgtctaggaagttaatagaagtatctggccccacttccaagcattgctg

SEQ ID NO: 6833770 - DNA, 74 bp, Homo sapiens
tgtatacagaattttacctggctgacttatgtcctttccaccaccagcagctgagatggtaagattcagtaaca

SEQ ID NO: 6833771 - DNA, 110 bp, Homo sapiens
ctttaataatggaatattggactatttaaataaaatctattagaaggcatcttatggatccatcagactgtgtcataagtaggtcttgaataacaattgcattaaaaaag

SEQ ID NO: 6833772 - DNA, 64 bp, Homo sapiens
ggcccctggggctggctgtgacacacagctgaacggcacaaatccagcttgcttcaggatggtc

SEQ ID NO: 6833773 - DNA, 80 bp, Homo sapiens
ggagcctctaaacagttctcatcatgaagcataagatttgtgattttgacagcttgcagtgagacctgtgcttatgttct

SEQ ID NO: 6833774 - DNA, 64 bp, Homo sapiens
tcattggtcatacattgtcctatagatcacaactatggtcagggcatctatatatgaccactga

SEQ ID NO: 6833775 - DNA, 78 bp, Homo sapiens
tcagctgttggccatctgcctcaatgtgtgcttttgaagcccagcagattgcacattctgtgtaggtggatagcttga

SEQ ID NO: 6833776 - DNA, 65 bp, Homo sapiens
tggaaatgccatccctctgtcaccaatccacagtgggtttggggaggaggcatggccaacatcca

SEQ ID NO: 6833777 - DNA, 122 bp, Homo sapiens
tgtcagctattgtaaaggtactgagatcctgttttatgaagggaatgagacatccggtctttaaaaaaaatgcatatttcttatttcccataaggcagttagaagtctgcacaataatgata

SEQ ID NO: 6833778 - DNA, 95 bp, Homo sapiens
ggccacatagggagtagcaaggtggggaggagtgtctctttgttttcttgccacagagagtcattcttttttaagcttgggagttcttggtggcc

SEQ ID NO: 6833779 - DNA, 129 bp, Homo sapiens
tgaatgatcagccaagccgcgattggatcttttcagtggcagttccagaatttcagtacatgccgtgtctgattggaagaatgggaactggacttgaagagtactttctcgacatggtgttttcatttg

SEQ ID NO: 6833780 - DNA, 63 bp, Homo sapiens
ccatcattgatcatcctgctgtctcatccactactagcagtcagacagcagatagtcgaaagg

SEQ ID NO: 6833781 - DNA, 61 bp, Homo sapiens
gcgtgggctggactgggatgaaatgagcttaatcgccagacactcagtacctgcccgctgc

SEQ ID NO: 6833782 - DNA, 86 bp, Homo sapiens
cagctaccgttcttttgtaaagtgcttgttgtatctcacaactagtgggttggcaaggtgttttaacaggaaaactgaaatagctg

SEQ ID NO: 6833783 - DNA, 90 bp, Homo sapiens
tttctgattgcttttaacaagaacgagagacagtacatagtctgatggctgaaggttcagatgtctgtctttcagttagcagttgagaaa

SEQ ID NO: 6833784 - DNA, 56 bp, Homo sapiens
ccgaggactacatgagccacatcattgagaagtggtagtggcggtggtggccacgg

SEQ ID NO: 6833785 - DNA, 81 bp, Homo sapiens
ttctcacctcgtcttcccttgttcctccctcaattctcagatccaccagtgagacagaaaacataggagacaggaaaagaa

SEQ ID NO: 6833786 - DNA, 56 bp, Homo sapiens
ctgatgggcaaagtgatagagcttccactcacagggctcgtcagttgctccatcgg

SEQ ID NO: 6833787 - DNA, 113 bp, Homo sapiens
cttttctgagtttcttgacacatttttcacaaccaggtaaggttcccatgggaattggcgggacatctcagggggacttaatttactgtgacccaaaagaaactaaagaaagg

SEQ ID NO: 6833788 - DNA, 119 bp, Homo sapiens
atgttgtagaagtaagtgtgctttagcatttatggtcatgtgtccacttatgatcatgtgaatgaacacatgattataaatgctagggcacacatactttaatgagcacaatacaacgt

SEQ ID NO: 6833789 - DNA, 104 bp, Homo sapiens
aatccaggcaagagataatggtggctttgccagtgtagctagggagacacggccagattctggctatattttgaaggagagccaacaagacttgctgatgggtt

SEQ ID NO: 6833790 - DNA, 101 bp, Homo sapiens
agggccaatgcacactttgacatttcttccttctcttttctgagtttgtttaacccagagtttagggctgagagcttggcagaggcctgcacaatggccct

SEQ ID NO: 6833791 - DNA, 80 bp, Homo sapiens
cttcaactagagagagctgtggtggctctatcccaactgccctgttctttccagagcctgggcagctcctctggctgggg

SEQ ID NO: 6833792 - DNA, 66 bp, Homo sapiens
aggtttgtttggcaggtggcagctctgggcacctttcccaccgacgctccttctccgactcagcct

SEQ ID NO: 6833793 - DNA, 96 bp, Homo sapiens
gttgtccaatgaaaatggttatggagtaatgagactttgcatctagtataatttgtttaatagtcttatggccatctctgatttttatccagaaat

SEQ ID NO: 6833794 - DNA, 115 bp, Homo sapiens
ggaagaatgctttgaaaacagcagggctctatagaggttagatgttctccagatgggaggcattactacttgtcacttccagaacattccatgtgccctgcccagagcacattcc

SEQ ID NO: 6833795 - DNA, 75 bp, Homo sapiens
cacccagctgcatcctattcactgcctcccttcctctcagctgggtggcagtgttggcaggatggggctgaggtg

SEQ ID NO: 6833796 - DNA, 67 bp, Homo sapiens
cctccagggctgtgcctggtctctgagcgcagtgctcagagagctggtgggcagaggacctgggagg

SEQ ID NO: 6833797 - DNA, 77 bp, Homo sapiens
agattcttagtggtctctaaatgtttaaatacttaaattcaagcatttatcactctttggggacctctgtagaattt

SEQ ID NO: 6833798 - DNA, 83 bp, Homo sapiens
tgccataagaggaaaagtcaggggagtgttgaagactctgcctcctacaaatatgtgagtttttctcccctggcttcatggta

SEQ ID NO: 6833799 - DNA, 73 bp, Homo sapiens
tatttggtgcaagaatgcaaatgctccctgagagaaaagcatcccaggcagaattagtgtttcatgctagata

SEQ ID NO: 6833800 - DNA, 77 bp, Homo sapiens
ggtttcttaatattttccaagataatacacagaaacaatgtttcagtagggtcttaggtgagtaactctaagcgact

SEQ ID NO: 6833801 - DNA, 59 bp, Homo sapiens
agcttgatggattgctgaggcagagtgcaccgagcaagggttcagtcctccatagagct

SEQ ID NO: 6833802 - DNA, 62 bp, Homo sapiens
attttctgtgtgcagataaataacaaagtgcttttatagttgtttatttttatagagagaat

SEQ ID NO: 6833803 - DNA, 64 bp, Homo sapiens
attgaaattgatgaaattcttgcattccagtgcttcaaagacctggactttcatcagttttaat

SEQ ID NO: 6833804 - DNA, 73 bp, Homo sapiens
gcatatatgttatacacatatacgtttgtgtgtatatgggtgccgcactgtgtgtgtgtgtgtttatgtgtgt

SEQ ID NO: 6833805 - DNA, 80 bp, Homo sapiens
attagcaaattgttgtgttacagtcttaggcagtatttcttctttttcaaagaatgcactgtaagactagccatgctgat

SEQ ID NO: 6833806 - DNA, 87 bp, Homo sapiens
caagaggaaggagtggggaaagccaggacagaaacccaggcctgggactctcagctgactgctttcctcgcattgccattcaccttg

SEQ ID NO: 6833807 - DNA, 102 bp, Homo sapiens
ggcaatacagagaatgttatttggaaaagttgacttcaaaccttttaatttttctttccattaaatagcgtgtcttccatttattcaaatctttgtgttact

SEQ ID NO: 6833808 - DNA, 59 bp, Homo sapiens
gtggtacagctgaaaggcttgctcattgtaccactgcaaatctgataggattgtaccac

SEQ ID NO: 6833809 - DNA, 60 bp, Homo sapiens
aagtggcagaaaataggtggtggctgaattcccactgcatctccatctgctctgcccctt

SEQ ID NO: 6833810 - DNA, 65 bp, Homo sapiens
ggctggctatctgtggttgcctgccaatcttctgcagccagtcagtccccagatccctgccagcc

SEQ ID NO: 6833811 - DNA, 77 bp, Homo sapiens
ttaggaaatgtggcagttcttccaagttgttattgcttagttaacttatttggaagcatttccaaagcatttcctga

SEQ ID NO: 6833812 - DNA, 75 bp, Homo sapiens
atgatgacatcgccctggggaagagaagctgagaggaactcctcactcagctagcttcaggagccatgacatcat

SEQ ID NO: 6833813 - DNA, 62 bp, Homo sapiens
ctgatgatgatgaatataataacgatgactaacattcagtgagtatgtatttatcatgtcag

SEQ ID NO: 6833814 - DNA, 79 bp, Homo sapiens
ccctggcaagacagagggaagcaatgatgcaagcaatcaagtatttattaaagcatctactctgcttggcccagtgggg

SEQ ID NO: 6833815 - DNA, 129 bp, Homo sapiens
cttgccccaagccagagaccccaaggtctgcagtagaggtcctaggagctgtggtgtcccgattgagggggctgccccagcctggggccttcttgggatgtgtctctcctcattggctccaggggcaag

SEQ ID NO: 6833816 - DNA, 79 bp, Homo sapiens
caggagagggagatatagtaagaggttgtcgggaacaaacaaagacatccctgacaatagcgatttatcttgctacctg

SEQ ID NO: 6833817 - DNA, 86 bp, Homo sapiens
ggagtaagagtaagttggtggtcggcataatgaatggctgtgatgtcaaggccaggatctgtttgtccaccaatctttcctactcc

SEQ ID NO: 6833818 - DNA, 129 bp, Homo sapiens
agaggtgaaagctgatatttctagtttgtgaaagctatttttttctgtacaactctcatctaaagatataggacagtcaggaaaaattgataattttgttaaagtggcagataaacagcttgtaaatct

SEQ ID NO: 6833819 - DNA, 61 bp, Homo sapiens
tagttatcttatctgggctgaaaagacagaaggtattggacagtccagtgagaatttgcta

SEQ ID NO: 6833820 - DNA, 76 bp, Homo sapiens
ttgcaaaagcagagagttgaatatttttccacactattttctagtcatctgggtaatgttcaaatttaagcagcaa

SEQ ID NO: 6833821 - DNA, 61 bp, Homo sapiens
cacactcattacctcatttaatcttctcaacagccaggagcaatgggctttgatgagtgtg

SEQ ID NO: 6833822 - DNA, 66 bp, Homo sapiens
ggaagctatggtaatcatccaccaagcccagtttctcatggcttgagtgttatccccagggctacc

SEQ ID NO: 6833823 - DNA, 84 bp, Homo sapiens
tctggggtgcgcttctggaggcctgagctcagggcccgtattctccttggggatgccctgctgctggggcagtgcagctgcagg

SEQ ID NO: 6833824 - DNA, 59 bp, Homo sapiens
cctcagcatcctggtgaagtagacatcacaatcacacaccacagatttggaagctgagg

SEQ ID NO: 6833825 - DNA, 91 bp, Homo sapiens
gtggagaagcgggggaagcagaaggatgaggataggtggggttggggctcagctctgcgcccacagaccttggcttccacctggtctctac

SEQ ID NO: 6833826 - DNA, 74 bp, Homo sapiens
ccaggggctttgcaaagaaattattgctgtgttaggtagaacactaacatagatatcttgaagagcctttctgg

SEQ ID NO: 6833827 - DNA, 60 bp, Homo sapiens
gtgggagggagataactgggggattggagtctgtctcattctccccattcttattcccat

SEQ ID NO: 6833828 - DNA, 69 bp, Homo sapiens
gcttctgggcttttgcactggccattccctttgcctggaatgttcttcctctgcacagctacagaaagc

SEQ ID NO: 6833829 - DNA, 59 bp, Homo sapiens
tcattttgtgccttatgaccgctgggccacccctagaatcctggttgagtacagagtga

SEQ ID NO: 6833830 - DNA, 64 bp, Homo sapiens
ctttaatgcatgaaactgtactgtggactaccacctcagtatgtactcttatcatgtagtaagg

SEQ ID NO: 6833831 - DNA, 69 bp, Homo sapiens
gtgaattccttctagagcttgtttaggtgctccttggctccttggtgctgggctctggcaggatacagc

SEQ ID NO: 6833832 - DNA, 63 bp, Homo sapiens
gtcacaattgggaataaaggctatttatcagtaaatacttcaagttaccttcttcccagtgat

SEQ ID NO: 6833833 - DNA, 71 bp, Homo sapiens
ctccacctgcctgcctcatgctgcctgcagccccctccttggaggccatcagcctggggtaggggtgtgag

SEQ ID NO: 6833834 - DNA, 102 bp, Homo sapiens
ctgtgtcatacactgcagggctaggagcagtctaaatgataagagccgggccattttttagttttatatatgtttaactgctattttctgtgtatgatagag

SEQ ID NO: 6833835 - DNA, 108 bp, Homo sapiens
cagctgctgcccctggcctccatggtcatggcagccacgctgtcgggggctgtacccagaggctgctttcatggccgccccattttggaggtgaggggcctgcggctg

SEQ ID NO: 6833836 - DNA, 60 bp, Homo sapiens
gacaacatactgtacctggtaaactcctcttaccaggagttcttctatatagtatgagtc

SEQ ID NO: 6833837 - DNA, 65 bp, Homo sapiens
ctcagtgagttgtgctgaggaccaccagctggacattgcaagtgttttcaccagaattcactgag

SEQ ID NO: 6833838 - DNA, 124 bp, Homo sapiens
ttatgtatcttatttctgtagctagactgaaaccttgtggagtaaggtgggcatatgaatgaattaacaaaatgtgctttctttgtttcataatttgctctatctcaaatcttcagatatctaa

SEQ ID NO: 6833839 - DNA, 60 bp, Homo sapiens
ggctgtcctcactgctcacttgctccccctcaggttcagtgtgtattgctgagggcagct

SEQ ID NO: 6833840 - DNA, 64 bp, Homo sapiens
tgtcactttgccttctggactttggagtctttccaggaagaaataagtttaggggaaagtgaca

SEQ ID NO: 6833841 - DNA, 55 bp, Homo sapiens
gctcagggagagagggcagccgcccagctcgggccccatgccatcccccttgggc

SEQ ID NO: 6833842 - DNA, 55 bp, Homo sapiens
cctaatgataccacgatgtgccattttacatcacggcatgtcagaaatcaatggg

SEQ ID NO: 6833843 - DNA, 106 bp, Homo sapiens
tttcaaaacagcttacaaggcattataggtggaattatatctcccccaacaaaaatattatgaagtcctaaccctctagtccctcagaatgtaggcttatttggaa

SEQ ID NO: 6833844 - DNA, 100 bp, Homo sapiens
ggaggcgtgcccggttcatccaaggcgcaagatggcgctgctttttgcacgttctttgcgcttgtgccgctggggagccaaacgattgggagttgcctcc

SEQ ID NO: 6833845 - DNA, 71 bp, Homo sapiens
tccggactgtccaagggcctcctggggagcctgggaggccaggctcacctggagcccctggtgaacaagga

SEQ ID NO: 6833846 - DNA, 129 bp, Homo sapiens
aaagtattgcactgaaaataacacacttgaggggaaagattatgggttgaagcagcaagtctatggatcacatcactgttctgccaactttggttaccaaattaggtgagttcaattcaacaaatcttt

SEQ ID NO: 6833847 - DNA, 68 bp, Homo sapiens
gggctagagtgtattatagtacatatgggtatgttgttttcccccttttgactaaataaactctcccc

SEQ ID NO: 6833848 - DNA, 58 bp, Homo sapiens
ttgctgggaattctttttctatggtcaagtaaagattacaaggctagaattccagcga

SEQ ID NO: 6833849 - DNA, 99 bp, Homo sapiens
gggaatggaatggggtcaggaagccacaggacaggtagagaatcaaaacgtgttggctgtttttgtgctgtgtctccctgtcatgccttgctccagccc

SEQ ID NO: 6833850 - DNA, 57 bp, Homo sapiens
atgtgcctgctacctgacttgtttctaggcagatacgagtatattgtggaggttcat

SEQ ID NO: 6833851 - DNA, 73 bp, Homo sapiens
agcctttctctgggctgttggcagccactgcaggcagcggagggagcgccacctgcccagagcacatgaggct

SEQ ID NO: 6833852 - DNA, 66 bp, Homo sapiens
tccatgttgagaatgctataatgccagtttttaaaagatgtaattatgctcagcattccagctgga

SEQ ID NO: 6833853 - DNA, 92 bp, Homo sapiens
tgtggttattgattcaaattgctttctttggggaactgtactggaacctcactaacacagttaactggagagcgagttcaatataaggccca

SEQ ID NO: 6833854 - DNA, 63 bp, Homo sapiens
gttgatacacctcatggttactgttgccatagcaactacctccctgtaaccatgtgtaccagc

SEQ ID NO: 6833855 - DNA, 129 bp, Homo sapiens
cacatctaccactggtcatatatcagtatgatatataatatttgcattactgtgataataaacaaagaggatagagtcaagaaaagtaaatattaatgtttaatgtgtttccaaatatgtaaaaatgtg

SEQ ID NO: 6833856 - DNA, 72 bp, Homo sapiens
gagtgtgataaggactttgaaggatacatatttgattctgtgggactatgtacccaaagatctgatctactc

SEQ ID NO: 6833857 - DNA, 61 bp, Homo sapiens
cagatatggttgtcatgaaggctaaataaggtaatatgaagtccttagaacactgtatctg

SEQ ID NO: 6833858 - DNA, 96 bp, Homo sapiens
atagccgactgccggctccatggaggggcctgtgccggagaacgcacatgttgacttatttcttcagtctaggcctttcttggcccccttggttat

SEQ ID NO: 6833859 - DNA, 93 bp, Homo sapiens
tgtgaactattacgtgctttctaaaggctttttgtttaaatgctatttatttatctggcatcagtaaaacctgcttttagtgtatgtttcaca

SEQ ID NO: 6833860 - DNA, 74 bp, Homo sapiens
cagcccatgtctgacagggtgggggaacaggcaacagtcaaagggccacgcttctgcccatgtgggatggtttg

SEQ ID NO: 6833861 - DNA, 62 bp, Homo sapiens
ctcacagcagccagtctgccttaaaaagcttccaggcaaaaagggcagattagctgtaagag

SEQ ID NO: 6833862 - DNA, 55 bp, Homo sapiens
tttggctgcagccccagcatttccttcagattattgatggagttctgcagtcagg

SEQ ID NO: 6833863 - DNA, 60 bp, Homo sapiens
acccagggcttaaggcggtgcattgcttctgcagggacaccatgctgcaggccctgaggt

SEQ ID NO: 6833864 - DNA, 61 bp, Homo sapiens
gtccctggtttgcccaggaccatcccagttttagcactgaaagtcctgggcaaactgggat

SEQ ID NO: 6833865 - DNA, 69 bp, Homo sapiens
caggaaacgggaaggcagaatattgtatggggatacctaggcactgattctgttttccatgtgtagatg

SEQ ID NO: 6833866 - DNA, 68 bp, Homo sapiens
ggtaatagctataggggagcagttttcagctgaatataagaaagcatcttctatcagttagacttacc

SEQ ID NO: 6833867 - DNA, 85 bp, Homo sapiens
cattttacagttttcccttaactaacacgctggtctggcattgtctagcctgtgtttctgttggaattaagggagcttagaaatg

SEQ ID NO: 6833868 - DNA, 77 bp, Homo sapiens
gatgttagagtagatgaagggagagcgtagatacagtggctgtagtgctctgttcttcctacattcacattaaaatc

SEQ ID NO: 6833869 - DNA, 77 bp, Homo sapiens
ccaggaagtcttgaggggagagtcttctgcttggtttatcctgggggtaaacttctgaagacctcctgttttcttgg

SEQ ID NO: 6833870 - DNA, 55 bp, Homo sapiens
aagtgtgagccagccctttgcatgaagaagcattagaagggatcactgcatactt

SEQ ID NO: 6833871 - DNA, 71 bp, Homo sapiens
ggaggcaactgggatctgcctcagtttcctggcctgtaaaatggattaatcaggcatgtcccagtttctcc

SEQ ID NO: 6833872 - DNA, 56 bp, Homo sapiens
attgatgtgtgtttgtgcttatcatatgtacatgagtataaaacatatacatcaat

SEQ ID NO: 6833873 - DNA, 105 bp, Homo sapiens
agcagaaattttaaattaattgtggtctaaactgagagcaaacaggttctgatagcagtctggtggcctcttgtttagccagcagagagttcggttattgctgct

SEQ ID NO: 6833874 - DNA, 55 bp, Homo sapiens
agcagcagctcagttctcagctggagcagagccagagaaccttgagctgtgagct

SEQ ID NO: 6833875 - DNA, 77 bp, Homo sapiens
cacatatcagccagctgtcctccctttcctgggagctggtccagagacgaggggcagggcgtctggttttcattgtg

SEQ ID NO: 6833876 - DNA, 90 bp, Homo sapiens
aattgctacggggagcggggaggaagtgggcgctgcttctgcgttatctggaaggagcagcccactcctgtcctgggctctgtggtgatt

SEQ ID NO: 6833877 - DNA, 68 bp, Homo sapiens
ggaaattttaagggatattttgatagctgtttttcattatgatcagcttcctttcctttgcagtttcc

SEQ ID NO: 6833878 - DNA, 67 bp, Homo sapiens
cctttaagctatgagctaggcatctctgtaagctcagcatctagcccaatgcccagcacatagtagg

SEQ ID NO: 6833879 - DNA, 60 bp, Homo sapiens
gccaccagatgcatttctctgccaatgtgttggtgcaggctaatggaaatgcactgctgc

SEQ ID NO: 6833880 - DNA, 57 bp, Homo sapiens
gggcgggagaaagaaaagtcaagagagaggttattggccacaacttgctcctagccc

SEQ ID NO: 6833881 - DNA, 76 bp, Homo sapiens
ttcaggctgctagaataaatgaccatagatttgcttaaacaacagatacttacttgtcataattctggaggctgga

SEQ ID NO: 6833882 - DNA, 68 bp, Homo sapiens
gctgaagcagatccaggtgtggcagggcgtgacatttggcccaggtcagtgtctggatcctgctcagt

SEQ ID NO: 6833883 - DNA, 61 bp, Homo sapiens
gagcttggatctctggggacctggggcaggctgctgcaattttccccaagagttctagctc

SEQ ID NO: 6833884 - DNA, 61 bp, Homo sapiens
cccaggcactcttggtcattttcctgccatggaatcttccgaccaatgagtgaagcctggg

SEQ ID NO: 6833885 - DNA, 60 bp, Homo sapiens
cttatgaactgtggacaaccacttttcctgctatgagaaagttgatttgcagtttaagag

SEQ ID NO: 6833886 - DNA, 81 bp, Homo sapiens
tgctaggcagctttctggtgcaccatatctgttaagctagaatgtcatggaaatgagtgtcactgatgaaagctgacagca

SEQ ID NO: 6833887 - DNA, 68 bp, Homo sapiens
atgggtacaagaaggtgcaaggaagttcccaaatctagaaatgcagagctgattgcccacttgttcat

SEQ ID NO: 6833888 - DNA, 77 bp, Homo sapiens
tattcttactctcgactgcattataaagcaccatatgtaccagcttgtttttgtgtattttgaaccgagtaagaata

SEQ ID NO: 6833889 - DNA, 94 bp, Homo sapiens
gctgagctccaagttcggggctgaaggcccggaggacagggcagagggctccctgcctacagggttttcttttccatatttgagaaatgtttgc

SEQ ID NO: 6833890 - DNA, 75 bp, Homo sapiens
ttttgagagacaggcaatatataaattatgagctcatggtttttgagtttagtatgtagtgtttgtttttctgaa

SEQ ID NO: 6833891 - DNA, 68 bp, Homo sapiens
gtcttagcattacatctttgatgcagtatgtcagaggacatagagcattcatagcatgtaagaaggat

SEQ ID NO: 6833892 - DNA, 62 bp, Homo sapiens
tcccagagacagagcctcctcccaccagcagacgggagctggaggcagggctgtcctgagga

SEQ ID NO: 6833893 - DNA, 58 bp, Homo sapiens
ctcatgcagctccccatgggatggtaccgtatgcatccctgtgtacagcctgcatgag

SEQ ID NO: 6833894 - DNA, 62 bp, Homo sapiens
gcggaagagctagagctgacccgtgagttatgcctcatgctgaggcagctcttgtcttctgc

SEQ ID NO: 6833895 - DNA, 65 bp, Homo sapiens
caagattcattttgtccttgtccctttgcagttaaatgagggccacacattggacatggatcttg

SEQ ID NO: 6833896 - DNA, 86 bp, Homo sapiens
tcccagcttgtgagacgttaatcactcactggactctgctttttagaggcagaagtgaatgtgataaaccatttgaatagcgaaga

SEQ ID NO: 6833897 - DNA, 67 bp, Homo sapiens
aggtctccaagaagggtggccaggatggcattgacatctcttcacaggtggccttggtgagagacct

SEQ ID NO: 6833898 - DNA, 56 bp, Homo sapiens
tcctctactcgcttgccctttgaaaatgcacagagctagccatgccttgtagagga

SEQ ID NO: 6833899 - DNA, 71 bp, Homo sapiens
gtggatggctagttgagaagggccacagacaatctcctgtactactgaactcttcctagccagctctccat

SEQ ID NO: 6833900 - DNA, 82 bp, Homo sapiens
aatttcccaatatgtttatctagtgaagtgaagaagagtctttgtacactgtctactatgaatgaaagcaaattgggaagtt

SEQ ID NO: 6833901 - DNA, 61 bp, Homo sapiens
ctgagggagaagtgatctctactgatagctttcttcagtggaggatcttggtttctttcag

SEQ ID NO: 6833902 - DNA, 89 bp, Homo sapiens
tccaaatagccatcctgtggatgttggcttctttcccaagctaccctgtgggagagtgctcaatgtgcaaagtggctatggcatcagga

SEQ ID NO: 6833903 - DNA, 76 bp, Homo sapiens
gcgcggcaagtaggcaaggctcggcaatgtgcggctccttccacgagggggcggccgagcactggcctcgcctcgc

SEQ ID NO: 6833904 - DNA, 62 bp, Homo sapiens
tctgcaggtcagtgtgcagctgtttcagcatcacctccagctggtacaccttgcctgtcaga

SEQ ID NO: 6833905 - DNA, 103 bp, Homo sapiens
ggctctacccagtcctcttgtcttgcacacggttgccacgctcacggagaaaggatgatggtatgaccgtggtgcaagcacaagggatgaggccaaaagagcc

SEQ ID NO: 6833906 - DNA, 60 bp, Homo sapiens
agaatatctgggagtgggaagctatatacttgtattttcataaagtccccagatgattct

SEQ ID NO: 6833907 - DNA, 71 bp, Homo sapiens
ccatgcttgtgggagaagatttggtcatctagaactctgttcagtgttgttttctctcactttgagcctgg

SEQ ID NO: 6833908 - DNA, 75 bp, Homo sapiens
ggatcaaaggaatgctctaggagggcagcccatgctgaagggcctgactggctctggggacgtaatcctggatct

SEQ ID NO: 6833909 - DNA, 66 bp, Homo sapiens
ctcagagtcatttattatgtttgtaaaatacttggcagtcctttgcaaataaataagtgctcggag

SEQ ID NO: 6833910 - DNA, 61 bp, Homo sapiens
tcctggctgagttcccaagtcgtgatcatcgcttagtgtctgacttgagactctgttaggg

SEQ ID NO: 6833911 - DNA, 68 bp, Homo sapiens
cattttcttgttttagtcacaggactttacaataataataaaggaacctggagtagagggagtggatg

SEQ ID NO: 6833912 - DNA, 73 bp, Homo sapiens
tcaggagcagcatgggtgagaggcagtggaatgtactaaggagaaaactgccaaattcacattctgtacctga

SEQ ID NO: 6833913 - DNA, 78 bp, Homo sapiens
cacttgtcattggatttaggggcctcctggataatccacaatgatctcgtctggaggtccttaacatagtgatatctg

SEQ ID NO: 6833914 - DNA, 119 bp, Homo sapiens
aggtttgtttattaaacataaatagagaatgtcaactgtacctaaagaaagtgcattgctaatccaaagggcactcatttttactgcaattgagcattaaattttactataaacttcct

SEQ ID NO: 6833915 - DNA, 80 bp, Homo sapiens
tgaggcatatccgaacaggagactcaagtgaaattgacttcgaattccatcagggtcttttgtaacatcaaggaagccca

SEQ ID NO: 6833916 - DNA, 110 bp, Homo sapiens
cccacgtccaggcccatcttcctgaggtcacctggaggcagccttctccaccccatgttcataggcagggccctcagcaggtggcctggcgggggtctgggcctggaggg

SEQ ID NO: 6833917 - DNA, 67 bp, Homo sapiens
tggtgatgtaaggtttcttcctgttcccagctcagacagaggagggagacaaggtaccacgttaaca

SEQ ID NO: 6833918 - DNA, 67 bp, Homo sapiens
cacaagtgcaggtctcagctactctctggcccagtttcttaagagggtgcaggcctgatgcacagtg

SEQ ID NO: 6833919 - DNA, 76 bp, Homo sapiens
ggaagcacagagctgcggcggatgggcacagcccattaatctcctggttggctcctccaagcaactctcagctttc

SEQ ID NO: 6833920 - DNA, 64 bp, Homo sapiens
tgaataagtgcatcacataatgatgttagctattattattgtggttgcattatctttccgttca

SEQ ID NO: 6833921 - DNA, 68 bp, Homo sapiens
ggatataaaaagagttcagcagtatcatgatactggcataccctgctgaatgtctctttggtttgttt

SEQ ID NO: 6833922 - DNA, 81 bp, Homo sapiens
gttttgcttcctggcacacgtggcagggtagggaggcctctgaaaacccccttccatccttcagttgttggaagtcaggac

SEQ ID NO: 6833923 - DNA, 89 bp, Homo sapiens
gcttatgagtctgagagtggttcagctcagaagagcaatctggatgcattttcagttaacttcttgggctgccagtttcagaaaggagc

SEQ ID NO: 6833924 - DNA, 61 bp, Homo sapiens
ccagagactcctgggggtgggcaaggcacggtgtctgtgcatactgctgggggagctctgg

SEQ ID NO: 6833925 - DNA, 58 bp, Homo sapiens
gtcccagggaggttcagggcttgccactggaagtggtaacctgtgcaggccctggggc

SEQ ID NO: 6833926 - DNA, 82 bp, Homo sapiens
gattgagaaaagacagctccctaatttgttaatgctggttaaagcactttcattacttgttaagggtagaagtcagtctatc

SEQ ID NO: 6833927 - DNA, 107 bp, Homo sapiens
ggggtcaaagcacttcccatgtttcatgggaaatcagtatagtatcaggtcaatatctccatttgacctgatattgaattgacttcttatgcaatgaaaagctctcc

SEQ ID NO: 6833928 - DNA, 59 bp, Homo sapiens
aattttgagacaaagttgttggatgttcatctgtatgaacactgaaatgtcttaagatt

SEQ ID NO: 6833929 - DNA, 73 bp, Homo sapiens
gggttgagtggtcattagctatttcagtaagactcccaagactggaagcaaagcgctgagggccacccagccc

SEQ ID NO: 6833930 - DNA, 86 bp, Homo sapiens
taagaaattcatagtaatggatgtgctaagggagtataaagtaaaataatttaatactgactaaagatatcaaaatgaatttttta

SEQ ID NO: 6833931 - DNA, 118 bp, Homo sapiens
tttttcctgcccctagcatgtatgccctgtgtgtgcaagcactgtctggcgaaccactgtacacccagtgtctggcacatagcaggtgacccatacatatttgcgtattaaggggaaa

SEQ ID NO: 6833932 - DNA, 66 bp, Homo sapiens
ccttccctgccctggcagcctaccatggggtgggcactccctatgcctgtcctagggcagtacagg

SEQ ID NO: 6833933 - DNA, 128 bp, Homo sapiens
cccagttaaatttaagtttcaggtggtcagcaaatacatttttagcataagcatatcccttgtaatatttggggcatatttatactaaagaagtatttgctttttatctgaaattcaggtatggtggg

SEQ ID NO: 6833934 - DNA, 77 bp, Homo sapiens
agctcacttttctgtaattgcagggtgcaattctctgtttttcttccctcagtgcaaaaaggcagactggtgatgct

SEQ ID NO: 6833935 - DNA, 74 bp, Homo sapiens
atagataaatagatgcacaaagcagagggaatcaagtagaataacatggtttatttgtgtgtgtattgttctgt

SEQ ID NO: 6833936 - DNA, 85 bp, Homo sapiens
tctgaagacaatctaaggggaatggttaaacacatctcattataggaatgttatgtagctattctcatacatgatgtttgttaga

SEQ ID NO: 6833937 - DNA, 85 bp, Homo sapiens
tgcagttgggtctattcattcccaggccaaggatgcagcccccgggataaatgcacgccttgggatgcataagagcccagaagca

SEQ ID NO: 6833938 - DNA, 68 bp, Homo sapiens
ggaatatcatgctgacacagtttatctatgttgaaaaaagataggaatttggggttacatgatgtttt

SEQ ID NO: 6833939 - DNA, 59 bp, Homo sapiens
tggcatctgtgttgcggttgtcacttggtaacaagataagtacttcgacagaggtgtta

SEQ ID NO: 6833940 - DNA, 59 bp, Homo sapiens
aggcaagaagacgccaggactgatgtcaccggctctgtagttcaaccgtcttctcccct

SEQ ID NO: 6833941 - DNA, 120 bp, Homo sapiens
gaatcattaatttggcttttgaaaaccatttgctttgctagtgactggatttgggaactccaacatccagatctcagcatggcttttgaggtttacaaggtaatgctcatgatgtgattc

SEQ ID NO: 6833942 - DNA, 68 bp, Homo sapiens
aggcacatgcaacagagattttcagtggcgaagccacaccccttgagtcctactgtttgcatctgttt

SEQ ID NO: 6833943 - DNA, 82 bp, Homo sapiens
ggcatgtcagcaagggataaagagttacttacagaagttaaagtgaaattaaataactcttgaatccatttgtaaaagtgcc

SEQ ID NO: 6833944 - DNA, 98 bp, Homo sapiens
gtgccatggtcctggagcagccagctgtggctatggctcctcattcagcaggcagcttcctgagccagcagctccttggcggcccagttctgtagcat

SEQ ID NO: 6833945 - DNA, 62 bp, Homo sapiens
gctggtttagtgaaataggccagagagatttcttgttgcttgaaattcactgggtcctgggc

SEQ ID NO: 6833946 - DNA, 81 bp, Homo sapiens
ttccttcctatggagtagatatatgaggtagccccaattattcctctccttcttcagactgtttgcaccataggcaaagaa

SEQ ID NO: 6833947 - DNA, 94 bp, Homo sapiens
gtccccaggcagggctcagcctgcctccctgctgctgaggcccctaccaaattggaacccgagtagcaccagggaagcagggcctgcaggggat

SEQ ID NO: 6833948 - DNA, 64 bp, Homo sapiens
gagaataatgggtaagggaggtttgggaccatttgggcaccgatgccctcattcacttattctc

SEQ ID NO: 6833949 - DNA, 83 bp, Homo sapiens
tagaatttgacatgtctgataaataatgcataagttcaatttagcatttaatgagctaggtactgtggggctgtcactatcta

SEQ ID NO: 6833950 - DNA, 59 bp, Homo sapiens
gcactcaatttagaactcctttaacaagtggtcttggttctagttccttaaattggtgt

SEQ ID NO: 6833951 - DNA, 69 bp, Homo sapiens
cggaaaggtggcttccagcagttattacattcttccctcttcggaaggactgctaggaagccgtgtctg

SEQ ID NO: 6833952 - DNA, 57 bp, Homo sapiens
tcttcctcacatcaaatgctcaagccgtctttaattgtagcacagggttgggggaga

SEQ ID NO: 6833953 - DNA, 118 bp, Homo sapiens
gtaacattgacttgttcccataaacacagctgagtattaatgaccaaaagaattttcctggtctgttttctgttgttaatccaactcagcttgccatgggacgacaatctagtgttac

SEQ ID NO: 6833954 - DNA, 64 bp, Homo sapiens
gctgtttccctccagggggtggatttctagatcattcttcaggcccctcggaggcgatgagagc

SEQ ID NO: 6833955 - DNA, 63 bp, Homo sapiens
cagtgggttatctgtgggaactttggaaagggcttgagaattcttacaaggctggcccacttg

SEQ ID NO: 6833956 - DNA, 78 bp, Homo sapiens
ggccatctgcgtattcaggtctagctggtgtgtaacatggagcaccagcattggacttagaatgcaccaagatctgcc

SEQ ID NO: 6833957 - DNA, 57 bp, Homo sapiens
ttagtgatttctaaggagagaagtagaacccaactgattctccaaaggagacactag

SEQ ID NO: 6833958 - DNA, 78 bp, Homo sapiens
gtattcctgtaactagtatttaaaggctatgattttaaccacagtagtgaagtcaccttgtttatgcccagggattac

SEQ ID NO: 6833959 - DNA, 85 bp, Homo sapiens
agattaattttgttgatttctattgagttcctgtaatatttgatcaaaagctagcaaaagcacagtagaaaaggaaaattgttct

SEQ ID NO: 6833960 - DNA, 63 bp, Homo sapiens
gtaatacatatatggtacttcctggcattattgtgtcaagataccaccattatatgtcatgac

SEQ ID NO: 6833961 - DNA, 63 bp, Homo sapiens
ctcctggtatttgctttttgtggtctgggatgtcccagactcaacagggaacaagatcagaag

SEQ ID NO: 6833962 - DNA, 77 bp, Homo sapiens
tcttatagcctatttgcctctttttctagattgccttacttaattctctggcgggaatgaggcagatagataaaaga

SEQ ID NO: 6833963 - DNA, 72 bp, Homo sapiens
tgggcttgagttcgcaggcagaggaggccttctcctttggctggcctgccgtaggctctgcctgcaggccca

SEQ ID NO: 6833964 - DNA, 64 bp, Homo sapiens
acacagcaagacccctagcatggtggcacaaacctgtagtaccagctactcggttggctgttgt

SEQ ID NO: 6833965 - DNA, 62 bp, Homo sapiens
actcttcatttccatccaactgggaaccatcacaaacgaggatctgatgggagttggggagt

SEQ ID NO: 6833966 - DNA, 67 bp, Homo sapiens
tgagaggcagcagaacatggaagagaaacagaatgagagtccctagttctaaatctgttgtccatta

SEQ ID NO: 6833967 - DNA, 97 bp, Homo sapiens
ctggcccttcctgccatacccagctgcagtcatcttctagaaagcttccccctgctgcttctggaaatcagcagagggtgggcaagggggaagtcag

SEQ ID NO: 6833968 - DNA, 55 bp, Homo sapiens
agcttgatttctctgcagtgtgaacattggctgttcagattgcctataatcagct

SEQ ID NO: 6833969 - DNA, 67 bp, Homo sapiens
agattttggctggctggagagaagtattcctgtatttggttctcaactcagctcagctcatgagtct

SEQ ID NO: 6833970 - DNA, 62 bp, Homo sapiens
tatggctgaggcctccgtggccacgaacaggagtagggctacgcaaaggaggccaggctgtg

SEQ ID NO: 6833971 - DNA, 98 bp, Homo sapiens
tttttgtttctgtcatcggtatttttgttctgattatactggtagtatcttctttgcacatggttgaaagggtgcagaaataccagaggaaacatgaa

SEQ ID NO: 6833972 - DNA, 64 bp, Homo sapiens
cttgaagttctggctcagagaggaaatggcaggctgccacttccttccacttcaggattttgag

SEQ ID NO: 6833973 - DNA, 55 bp, Homo sapiens
tcttttttcaaactgaggtagtgtcagcactgacacagacagtccagagaaaaga

SEQ ID NO: 6833974 - DNA, 95 bp, Homo sapiens
gtcttcctggcaagatgatgcctttctggtgttcttcctaccaacagagtaacctcctgatctctagaaggaatcctgaagcatgtgccagagac

SEQ ID NO: 6833975 - DNA, 82 bp, Homo sapiens
cagcattcttggcagctctgttagtcattttcatcttctttcctaaaagaaggtggtttataactggagaactgtttacctg

SEQ ID NO: 6833976 - DNA, 65 bp, Homo sapiens
aaatgagggagcatggtcaaaagcctttggtaaattttaaagtgctttacaaatgtctgttgttt

SEQ ID NO: 6833977 - DNA, 60 bp, Homo sapiens
tcttctgcttccaaattcagggctcttttcactctaccatcctggctttgcagcatgaga

SEQ ID NO: 6833978 - DNA, 70 bp, Homo sapiens
agcttttcaccacagaggcaagacaagctaacatttacccatttgtttgcccttgcagctggtgatggct

SEQ ID NO: 6833979 - DNA, 76 bp, Homo sapiens
gctgagctgaggcagggctggggatggtgagtaggggcctcagctgaccctccggcccccagccctccagctcagc

SEQ ID NO: 6833980 - DNA, 67 bp, Homo sapiens
tggctgctgagaaggcagctgtcccatgcccagattaggtttcttgcagacagtgcttctcaggcca

SEQ ID NO: 6833981 - DNA, 88 bp, Homo sapiens
cttcatctaccagtgagtacatgcactgagagggtctcggctcccctggaggcctccctccaccactgcaggtcacttactcatgagg

SEQ ID NO: 6833982 - DNA, 73 bp, Homo sapiens
tcattcatccattcactgaacaaggctaaacaagcagtgtttggcactgttctaggtgcaagaagctgactga

SEQ ID NO: 6833983 - DNA, 69 bp, Homo sapiens
ccctgcttcctatccacacaatgcctctgaaatcggaaagggcaccacaggtggtgtgggaaggcaggg

SEQ ID NO: 6833984 - DNA, 68 bp, Homo sapiens
tcattcgtgtaacaaacggttccaagatgcctgctatatgccaggcattacgttagttctagggatga

SEQ ID NO: 6833985 - DNA, 62 bp, Homo sapiens
gcccgtgatgcccatctttccagcagagaccaaaattagctgaggggaaaagggcttcaggc

SEQ ID NO: 6833986 - DNA, 77 bp, Homo sapiens
ttaaagcagcattcatgatgacaacaggaagacaatttggttctatcttcttatgtcaagaatgaatattgccttga

SEQ ID NO: 6833987 - DNA, 60 bp, Homo sapiens
tcataggagtagcagtgagaggacagtgtcacagcaagggcctctctgcatgctccctga

SEQ ID NO: 6833988 - DNA, 59 bp, Homo sapiens
tttggttcttagacaagtaaccttagttccactgaaggaaaattatcatgagagccaaa

SEQ ID NO: 6833989 - DNA, 66 bp, Homo sapiens
gaaaggggtggagccaggatctaacccaggcagtgctccagttacccactgagcttcagccctttt

SEQ ID NO: 6833990 - DNA, 55 bp, Homo sapiens
agggagggagaaaggagataaagggcaggtattttatttctttgactctctccct

SEQ ID NO: 6833991 - DNA, 61 bp, Homo sapiens
gacaaaggaatattcaaaacagtcatcagtatggtcgattgtactgatcatttctgtagtc

SEQ ID NO: 6833992 - DNA, 89 bp, Homo sapiens
gcccttttggttacagattatctgtagctcatttcccactatgatggcatagtgaattgttgccacagagactgtaaagaccacagggc

SEQ ID NO: 6833993 - DNA, 129 bp, Homo sapiens
caagcatgtggaacaattggagctctattaccttgctgccaggagtgtagagtggtttaaccacactggaggactatttagtagttctgataaaggtaaacatagatctaccttaaccctatgtcttag

SEQ ID NO: 6833994 - DNA, 59 bp, Homo sapiens
gccatcttgagccaggaagtgaccgaataaaaggtggctcttgggcagattaatatggt

SEQ ID NO: 6833995 - DNA, 93 bp, Homo sapiens
ctctgtttcttgccagccttggacttctaccatagcactcagactgagcttagtgtctgtgatgaggtcaggaaggaatgcaaggtagctaag

SEQ ID NO: 6833996 - DNA, 71 bp, Homo sapiens
gcctgtagaaagagggggctgtacatgttgcagaaatggttgcaaatttgagcagactgttcaagacaggc

SEQ ID NO: 6833997 - DNA, 93 bp, Homo sapiens
aaacaatgtattagcttctgtgcatggactttgtagctctttaagttggagacttttaagttaactgtattaagaagttttgtatgtatgttt

SEQ ID NO: 6833998 - DNA, 62 bp, Homo sapiens
gaatgcatgttttctaggctttcacaaccatctggagttgtgggggtgagaaaactgcattt

SEQ ID NO: 6833999 - DNA, 69 bp, Homo sapiens
tactataccatgtaagatatgaaggagttctcttcacctaactccctcaaatgctaaatggtggtggta

SEQ ID NO: 6834000 - DNA, 69 bp, Homo sapiens
tcacaatatgggtgtgggaactggaccacagagttacagtggtcatttcctccccaccacatcttgtga

SEQ ID NO: 6834001 - DNA, 78 bp, Homo sapiens
tagacaaactgatcccctggaaagttgaatagtggcataattatccaattgctctcaggggtattttaaaactgtttg

SEQ ID NO: 6834002 - DNA, 59 bp, Homo sapiens
ggtgcttctctaagctgagctaaccacactgctggttcctcgtgcctatgagcagtgcc

SEQ ID NO: 6834003 - DNA, 57 bp, Homo sapiens
tgaagatcctatctgcaaatatagtcacattctgaggcatttggggttagggtttca

SEQ ID NO: 6834004 - DNA, 66 bp, Homo sapiens
tctgcttccactatgagagtaatcccagattaacctactggagaatgagagaccatgtggagcaga

SEQ ID NO: 6834005 - DNA, 61 bp, Homo sapiens
ggtgttgttttccatagtttggttcatttttattgctgagtcaaattctgttgaatacacc

SEQ ID NO: 6834006 - DNA, 69 bp, Homo sapiens
ctgcattcataagactttgctcttgtgagaattcgctcatgccccaaaagcaaagatctttgattgaag

SEQ ID NO: 6834007 - DNA, 103 bp, Homo sapiens
aaggctttttaaaggagggggccttggagctgaactttgaggccagtggcattcgaacacatccacgggtctccctttcggatttcagtgccctcttggcctt

SEQ ID NO: 6834008 - DNA, 70 bp, Homo sapiens
tccttaaggttttattctccatgatcaaatgactttgaaaaattaaagagtttggaaaatgagacaagga

SEQ ID NO: 6834009 - DNA, 110 bp, Homo sapiens
tagcagatgagaggcagcaaatcttgaaaagcagcatggcctgctgattaaggatcagtcttcaggctgactgcttgggttcagatactagctctgtctctcatttgttg

SEQ ID NO: 6834010 - DNA, 59 bp, Homo sapiens
tctgaagaggactgggttggaggcagcacaagactgtctctaggattttctgcttcagg

SEQ ID NO: 6834011 - DNA, 66 bp, Homo sapiens
gtattctctgagattctctgttattttataaatcatctactataaaatgccagtcccagggaatgc

SEQ ID NO: 6834012 - DNA, 84 bp, Homo sapiens
ggggagatcttgttcttcgataatcaattcccagatgttacagaaaatggcagattaaaagactctaagaacatgattctccct

SEQ ID NO: 6834013 - DNA, 129 bp, Homo sapiens
tccattagtactgtgtctgtttcttctgaccagtgtatccccagtagctagcttaaatgcctatccattctttatttatttacagtgtgcctactatatgccagatgttatagataatagaaaaatgga

SEQ ID NO: 6834014 - DNA, 68 bp, Homo sapiens
agtattagcagacaagctgctggaaaagttaaatctttaaaaagtttgcaatttgtgctgcaaatgct

SEQ ID NO: 6834015 - DNA, 75 bp, Homo sapiens
tgcgtgtattgactgcacctgcaggggtatagctggagaacacccagtgagcatcttcaggagccaagtcacgca

SEQ ID NO: 6834016 - DNA, 67 bp, Homo sapiens
gtgtcatgtgcggggaggtgaagcgcgctttctggctgtaatccttccctccccgtggctgtgaggc

SEQ ID NO: 6834017 - DNA, 57 bp, Homo sapiens
gagactggctaacagaggttccatgtgtgctcattgtcatcgatgttagccagtttc

SEQ ID NO: 6834018 - DNA, 59 bp, Homo sapiens
gtgtgtccctcctctcctgagtgtcactgcagccacactcaaggataccgaggacacat

SEQ ID NO: 6834019 - DNA, 63 bp, Homo sapiens
gagcggcagaggtgttgcgagcgagtgggccagggctgctgagagcgagacctttgccagctc

SEQ ID NO: 6834020 - DNA, 57 bp, Homo sapiens
ctgagcctccatttcatcaggtgaataaccatcctggctggttgtgatggggcttag

SEQ ID NO: 6834021 - DNA, 98 bp, Homo sapiens
tggctggagagcaggaaggggcagggggctgccaaggaatgtaacaggtttatttttgttcaggctgcattctttgcccagcctgcacgccccagcca

SEQ ID NO: 6834022 - DNA, 77 bp, Homo sapiens
tagtgtgctcagtttgattccagggatatctcaggcttatttaacaatgctacccttagaacaacattagcatacta

SEQ ID NO: 6834023 - DNA, 116 bp, Homo sapiens
tcgctattaaccagcatttacaagggtgtgctgcttgggggtgtctgggctcccagggtcttctctgaggtgtgcagtctgctaggcagggcatttttatgtggtgtatgtactga

SEQ ID NO: 6834024 - DNA, 68 bp, Homo sapiens
gggttgggatgatttagtcaagcacttggaacatacctggtgcttaattaacattagttcccatgccc

SEQ ID NO: 6834025 - DNA, 129 bp, Homo sapiens
ggccgagcccgtggcctggccgaggaggccgccgctctgcgaggggagcgctgttttccaggccggcgtctggaatgttgctctgccttgcggtgtgagccgactcctgcccccatttcagctgcggcc

SEQ ID NO: 6834026 - DNA, 77 bp, Homo sapiens
atggttgtactttgaggctctgtatgaaggtttgggtcagaactgcctactccatgcggaagtctgagtgccttcgt

SEQ ID NO: 6834027 - DNA, 84 bp, Homo sapiens
aggatcacttgagcccaggagttggaagctgccatgagctgtggtcacaccattgcactccagtctgggccatagagtgagact

SEQ ID NO: 6834028 - DNA, 74 bp, Homo sapiens
cagtgcagacccacagggcagtgctgcccactcccaggactcgggagcatggctgcctccctgtgccaacactg

SEQ ID NO: 6834029 - DNA, 98 bp, Homo sapiens
tcttggaattcacgagatggaagcatagatcaaagctgtttggagaaaatcggaagtacagttttatctagccacatcttggagacattattgcaaga

SEQ ID NO: 6834030 - DNA, 82 bp, Homo sapiens
cactgttcagagtggagacctctacccatctcctccccagcagggctggaaggtgcgggtaaggtgctccacacagacagtg

SEQ ID NO: 6834031 - DNA, 70 bp, Homo sapiens
gagtggcaggaaagtggaagagaaaagcactgagcagcatcctcttatccaccttctcccatgctctctc

SEQ ID NO: 6834032 - DNA, 69 bp, Homo sapiens
ggggacatcacaggggccacaggcctgggtgtggtcttggctctgtgagccacttgatgtacagtttct

SEQ ID NO: 6834033 - DNA, 93 bp, Homo sapiens
tttttcctggttaacttaaaaatctttgaaagcatgtatcaaaattgtatgacatgtgcttgtaatgttaaatgtttttgttgaatggaaaaa

SEQ ID NO: 6834034 - DNA, 67 bp, Homo sapiens
ttctacaggtgttttctttactttagagacaaggggcactgaggtaaatagaaaaaccatgatagaa

SEQ ID NO: 6834035 - DNA, 82 bp, Homo sapiens
gccgggctaaagcctcacacatgtcagctggttcttgtttccgaagatacgcatgccctcagtgaggccttgagcatccggc

SEQ ID NO: 6834036 - DNA, 72 bp, Homo sapiens
taaataaaagttctaagatgctccacagagaagacaaatgacttctactgggaacttttggaatgaatttta

SEQ ID NO: 6834037 - DNA, 86 bp, Homo sapiens
gcacgtggcggtggcgacgcaggcacgacgtgttgcggaaggccttgccacactccccgcaggcgtagggccgctcgccagagtgc

SEQ ID NO: 6834038 - DNA, 63 bp, Homo sapiens
ttttttgctcacatcaaggtttttcaggagctcctcagaaataatgaatgatggggcagagaa

SEQ ID NO: 6834039 - DNA, 77 bp, Homo sapiens
ggttagtaggtggcagaaatggaattcagcctaggatgtcttgctgtaagggctgagctattttccactactatgct

SEQ ID NO: 6834040 - DNA, 83 bp, Homo sapiens
tctcggtagcggttaagccacttactaacctcctatccactgggaagtgatgaaggaagaagtgactaatgatgctaaggaga

SEQ ID NO: 6834041 - DNA, 82 bp, Homo sapiens
ctttgtagctgcttctgatttatagagaaacccaattaaactagtattggcagaattgctaagtcagctttcagttacaaag

SEQ ID NO: 6834042 - DNA, 67 bp, Homo sapiens
ctaagaggaaaatgagttccagaatccatgaactactcattgaactaaaactggtttgttctcttgg

SEQ ID NO: 6834043 - DNA, 66 bp, Homo sapiens
aggtctcctcctctcccagttctagcgtttactctcttatgtgaagaacagaagggaggaaggcct

SEQ ID NO: 6834044 - DNA, 114 bp, Homo sapiens
atggttgtaaggcttgtaggggctaaggctatctgagtttatgtgattgctcacagagagcatatagattgagatggcatctagagtggaaactttacaagtatgcagagccgt

SEQ ID NO: 6834045 - DNA, 63 bp, Homo sapiens
gccactgaggtcacagctggggatggagttctcctcggtcttcatcaccagggtgtccatggc

SEQ ID NO: 6834046 - DNA, 107 bp, Homo sapiens
gctgttacacctatatgctctcaatccatgttcataagaattgtatagtacattgataattactactttacagttgaagaaatggaaactcagagaggtgaagtggc

SEQ ID NO: 6834047 - DNA, 75 bp, Homo sapiens
gcaataaagagttttatgtgtatgttactttccagaagtttggcaaagttactatcacaatgaaatttccattgc

SEQ ID NO: 6834048 - DNA, 79 bp, Homo sapiens
gcgtttactgtgtaccaggcacttgcctaggctcggaatattcactggcccacaacagtgcctagtatataggaggcgc

SEQ ID NO: 6834049 - DNA, 89 bp, Homo sapiens
ctttcctactgccagattcttctaatatgatcgtgttcaaacccagcatggcattattggaaggactgctgactttggaattgggcagg

SEQ ID NO: 6834050 - DNA, 76 bp, Homo sapiens
ggcctccaatacccacccagatttcaaacatctttccttgtttggcagagtagtttggagtgtggtctttgaggtc

SEQ ID NO: 6834051 - DNA, 70 bp, Homo sapiens
aaggtttggctccgttgtacaggctggagtgcagtgatgcaatctcagctcatggcagccttgaacgctt

SEQ ID NO: 6834052 - DNA, 69 bp, Homo sapiens
atgtgttagatatatttatgtgggctttcttgggcagatgtcattgtgtacatgagtgtatgagcatat

SEQ ID NO: 6834053 - DNA, 90 bp, Homo sapiens
tttgtgtgctgtctgtttactggctatagatttggtaatttactttccttccatatttcttgtggttagttgaatacaacagcatggaag

SEQ ID NO: 6834054 - DNA, 70 bp, Homo sapiens
tgctttaacataagatatcttttaaatactgtatatgtgttactgatagaagggtgttttatgtaaggta

SEQ ID NO: 6834055 - DNA, 82 bp, Homo sapiens
ggggtgctgggttgagatggctgggccccaggagcagcagctgtagcttgagggctcggctgggctccactgcagcacaccc

SEQ ID NO: 6834056 - DNA, 84 bp, Homo sapiens
tttctctgttttccacattctgtccttgaactgcaggtgtctagtgtctttagagtcagaaggaacagacggggagcagagaaa

SEQ ID NO: 6834057 - DNA, 60 bp, Homo sapiens
cctccctgccggctggactagtgggcacgcctccagagtccccctctgagcccagggagg

SEQ ID NO: 6834058 - DNA, 69 bp, Homo sapiens
gcatacagttctaccaggagaggttgattctcttggattgaacagtgtctctccaggtaggataaatgt

SEQ ID NO: 6834059 - DNA, 64 bp, Homo sapiens
gcctggagaaaggaaggtgggaaggccaggactcggacttaccacctgactcctactccagtgc

SEQ ID NO: 6834060 - DNA, 60 bp, Homo sapiens
atcttgtctgttagttggtgtgggggagaaaacaaatgtttctaatcttacagacaggat

SEQ ID NO: 6834061 - DNA, 79 bp, Homo sapiens
cttcttcaccactttgcaccaggcctagggttgcccccattagttactcttttgggtcatggtcccaaagggagagaag

SEQ ID NO: 6834062 - DNA, 60 bp, Homo sapiens
ggcaagggttcagatatactcatatgggggcagtctctttgcagtttcagaaccctgacc

SEQ ID NO: 6834063 - DNA, 67 bp, Homo sapiens
ggctcccagactgtggtgggcactaccggtcagctgcccagcagccagccctagtcccacttctgcc

SEQ ID NO: 6834064 - DNA, 65 bp, Homo sapiens
ctgatgagtctttgtatttacttcccatatcctaaatttcatggggggtatttataagattttag

SEQ ID NO: 6834065 - DNA, 72 bp, Homo sapiens
ccttcctggagtcacatcagagaggtgggagctgcccaccctgggttctgatgtggaagctcccagggaagg

SEQ ID NO: 6834066 - DNA, 77 bp, Homo sapiens
caagggcacttgggacttaacaatccagtcccacgtgtggggcttctttgtaacgtgccagccaacagtgctccttg

SEQ ID NO: 6834067 - DNA, 59 bp, Homo sapiens
ttgtgtccaaggctatggtgatctgagaagcaaagtcacattggggccctggcacacag

SEQ ID NO: 6834068 - DNA, 56 bp, Homo sapiens
gtcctgaggtgctcagccaggaagcgactatgattgatttgctgtgcacccagggc

SEQ ID NO: 6834069 - DNA, 55 bp, Homo sapiens
agtctcctctttccttgttatttagcatgagcaaaaagtagcttctggggagact

SEQ ID NO: 6834070 - DNA, 75 bp, Homo sapiens
tggtggtgcggggtgtaggggtagcgggggattatatagttcccagctccttgtttgcatctccttctcatacca

SEQ ID NO: 6834071 - DNA, 61 bp, Homo sapiens
actgcttagtattattaatgtctgctacaagcaagcactacagtaatgctgttgaagcagt

SEQ ID NO: 6834072 - DNA, 56 bp, Homo sapiens
actctgcattcacaatatcttggcccattagcagctaggacttgtttgggcagagt

SEQ ID NO: 6834073 - DNA, 56 bp, Homo sapiens
tgctgagggagcatcaaagaaaggagaacttgcccctttatttggctgttttagca

SEQ ID NO: 6834074 - DNA, 64 bp, Homo sapiens
ggtctgcagggctgcagagggcactgttgctaccaaacatacactgccgtagtcctagtctacc

SEQ ID NO: 6834075 - DNA, 78 bp, Homo sapiens
tccttcattcaacaagcattgattgagtgcctatggtgtttcagggcctgcatcaggagcttgggatagaaagaagga

SEQ ID NO: 6834076 - DNA, 64 bp, Homo sapiens
atgcttagcaggagagaagttttaagtttgcaaatagtagacatttctcctacttgttatttat

SEQ ID NO: 6834077 - DNA, 85 bp, Homo sapiens
gagagtcaggcatttggccaaaaagaggtggacagtttggttatgtctcttctaccacttatcttggttaaatgtcttgattttt

SEQ ID NO: 6834078 - DNA, 57 bp, Homo sapiens
tccacccatcgcggcctggaacagccagagagctgtagccagaagtcatagggtgga

SEQ ID NO: 6834079 - DNA, 66 bp, Homo sapiens
atgcgataactagagggaaagagtacttgcctcatacggcagattcttcattcattctacaagcat

SEQ ID NO: 6834080 - DNA, 73 bp, Homo sapiens
caggaagaatcttaatccagaaacctaagatctctctctcacacttgggttcatcaaaggacagactctcctg

SEQ ID NO: 6834081 - DNA, 55 bp, Homo sapiens
atgtcacaggcaacaagattgccaagaatgtgcaatatcctgagtgccttgacat

SEQ ID NO: 6834082 - DNA, 90 bp, Homo sapiens
aaggtttttgataccaagcaggtgcgtcctcagcagcatctaaagacatggctgctgctgaggatgcacctgcttggtatcaagaacctt

SEQ ID NO: 6834083 - DNA, 130 bp, Homo sapiens
tctccccgtccagctgggccggcctgctctcggccgcggggctccgcggcgcgcaccggcagttggcggcgctgtggccgcctctggagcgctgcttcccgcggctgccgccggagctggacgtgggcgg

SEQ ID NO: 6834084 - DNA, 60 bp, Homo sapiens
gatttatgctcttctctaaaacacagatgtgggtgtgtgtttgggggagatgcatttgtc

SEQ ID NO: 6834085 - DNA, 82 bp, Homo sapiens
ggacgttagaagagaaagcccttggattagaggctctcaatataaatttaaccaagagggttttccttgaatctcagcctcc

SEQ ID NO: 6834086 - DNA, 86 bp, Homo sapiens
gaatgaagacccagacctgagcccggtggggcctctgggaacactcctttcaaggccagctcaccctggctcctttctgttcattc

SEQ ID NO: 6834087 - DNA, 87 bp, Homo sapiens
taccacacttttatcactctgccattttttcaccctcagaacctaagggtggccaccaagtatgtcagagtcagtattgtgtgtgtg

SEQ ID NO: 6834088 - DNA, 60 bp, Homo sapiens
gggctctttgcatcctccagcctcagcttcccctatctagcaaatgggattaaagagccc

SEQ ID NO: 6834089 - DNA, 79 bp, Homo sapiens
tcagttttcaggagcacatctgtcatcattatgtatataattaacacagtgtcttaggtagtgtcatctgaattactga

SEQ ID NO: 6834090 - DNA, 129 bp, Homo sapiens
tctgaatggaggatctgtcttgtgttttgaaggtgtggcacttgcaaatattttgagagggaatctggtttttttctaatagaatgtgcaaatgtgcacaccattctagaaacaggagatcttgtttaa

SEQ ID NO: 6834091 - DNA, 65 bp, Homo sapiens
cagacctcaaatgacaagcacttttgggattgtgcctatcctcaggtgccatgttattggagctg

SEQ ID NO: 6834092 - DNA, 70 bp, Homo sapiens
gtccccgcgcctggagaggaggcgacgcgtggccggcggctttgtggcgcgcgggttccagcgcgggggc

SEQ ID NO: 6834093 - DNA, 71 bp, Homo sapiens
cttgaaagagtttggagacaagatcagaaagcaaattttgactgtctctatggctctaaaatctagtcaag

SEQ ID NO: 6834094 - DNA, 66 bp, Homo sapiens
tcctgaatcagaatctgcatgttaagcaggcccccaggtggttcataagcacgttttggtttggga

SEQ ID NO: 6834095 - DNA, 69 bp, Homo sapiens
cccaagtttggagtgggcaatgtaggcaagtcgatgaattttgctgccgacaccctttgagatcttggg

SEQ ID NO: 6834096 - DNA, 69 bp, Homo sapiens
tagcacagcaatgtacccatctgtgagttttagtagctttgaatgagtgcattgcagacactgtggcta

SEQ ID NO: 6834097 - DNA, 88 bp, Homo sapiens
tagattttagtaccagctgtacagtttactaggtgggcatgttgctcaactcttctacttgcaataaactgtactatactagaagcta

SEQ ID NO: 6834098 - DNA, 76 bp, Homo sapiens
gggtccaattttattcttctgcaagtggctatccagttttcccaacaccatttgttgaagtagttgtctttccccc

SEQ ID NO: 6834099 - DNA, 93 bp, Homo sapiens
tttgccccactttcctaggcagtatcctgatgtaagtggagaagttacagagattatgcccagagatgagtgctaataaacagacagggcagg

SEQ ID NO: 6834100 - DNA, 78 bp, Homo sapiens
aggttaagggggctcagcaggctctggatgatcatgacagctgtgatgcctccgatactgctggccctgccatagcct

SEQ ID NO: 6834101 - DNA, 66 bp, Homo sapiens
tctcagcacttcaatgagcatttcacctgtggcaacaatgacagtgcacacttggggagctaaaga

SEQ ID NO: 6834102 - DNA, 86 bp, Homo sapiens
cctcagagagtgccagttagctgactggttcttcagatctaggccaggattggtagaaccagctagtcttgcttttctgtctgggg

SEQ ID NO: 6834103 - DNA, 79 bp, Homo sapiens
tttggggctgccaccagctctccaccctcctggttccgctggccgggccaagagaggatggagggatgggagtcccagg

SEQ ID NO: 6834104 - DNA, 98 bp, Homo sapiens
cagatgctctcctttaggaattccctgggttacctttcaaggtctctgcttaccaatgccccaagccagacctggtaactctccaggggagagtgctg

SEQ ID NO: 6834105 - DNA, 71 bp, Homo sapiens
cttccaagttgctctgctgacctgagctcattacttttatataatgattgcagcagaagcatctatggaag

SEQ ID NO: 6834106 - DNA, 70 bp, Homo sapiens
tctctgcaggccttgagtgtggtataacagaacataaagtactgaccacgctttcaaagggttgcaaaga

SEQ ID NO: 6834107 - DNA, 84 bp, Homo sapiens
cagagctgtaatttgctaatcatatttcatcactcatgacaatgactgcacagaattatggttggtgaaattgttaagcgtctg

SEQ ID NO: 6834108 - DNA, 70 bp, Homo sapiens
cctggcctctgaggtcatggacttggcctccttcttttccaaaggggcccatgatccagctcagagcagg

SEQ ID NO: 6834109 - DNA, 55 bp, Homo sapiens
caaggatagggcctctgacttccagtctcagtgggaagatagaatcctaactttg

SEQ ID NO: 6834110 - DNA, 57 bp, Homo sapiens
tctaagaattgaagtggctctttgggggaatgggatgaggagctaaggattcctgga

SEQ ID NO: 6834111 - DNA, 67 bp, Homo sapiens
gctctgagtaaatgaaagcattcctgcacatttgaatttcacaggttttgtatttcacactgggagt

SEQ ID NO: 6834112 - DNA, 87 bp, Homo sapiens
gggcgccctgtcccgttcgcttttgtgccgacctggaaacactctgtggtgctctagattgttacaaagttcggggtggtgcagccc

SEQ ID NO: 6834113 - DNA, 71 bp, Homo sapiens
atggctagttgatatggtgtttatgaaatagggggatgaagatttcagtttctcacgatgttaatagccat

SEQ ID NO: 6834114 - DNA, 130 bp, Homo sapiens
cccctcgacgtgtgggctcatggggtgatggcactggtctcgtcgctggcagaagacggtcataccgcgatgcccttggtttccaggatgaggctgggcacatgccgcacagacaagcccacgcggatgg

SEQ ID NO: 6834115 - DNA, 59 bp, Homo sapiens
gttgaagtctgagggtcatgggtctcacctgttggtggggctgggctcttagctccagc

SEQ ID NO: 6834116 - DNA, 59 bp, Homo sapiens
gagttctcaagcaatcaaagagcaggagctctaactaattgttgccttgagatccactc

SEQ ID NO: 6834117 - DNA, 64 bp, Homo sapiens
ttgctttgttactgcagtttccactctttcagctccagctgggctgactgcagctgcagggcag

SEQ ID NO: 6834118 - DNA, 114 bp, Homo sapiens
ggggctccggaggtgtcagggcgcctccttgctctcagggttgcatgcatctgtggggaggaagacatccgtgagatgctgacggccaggaccgccctcgcttcccgcagcccc

SEQ ID NO: 6834119 - DNA, 59 bp, Homo sapiens
ttgtttctgaggctcagatgactccatgatctctgttatttgggcagtccatgaaataa

SEQ ID NO: 6834120 - DNA, 90 bp, Homo sapiens
tctgctgggtctgttgtcatctgctctgctctccagcctttcttcagcactgaggagtggtcagcagcagtgggagtgtaactcagtgga

SEQ ID NO: 6834121 - DNA, 60 bp, Homo sapiens
tagctatgttaagtatacctgttaagtgccagggtactgtactaattgctttacatgtta

SEQ ID NO: 6834122 - DNA, 59 bp, Homo sapiens
ggggagcaggggctctgctgccgtcccctggtgagttacggtagcagctgctgtcatcc

SEQ ID NO: 6834123 - DNA, 120 bp, Homo sapiens
gtatttcttcaagctattttgcttcctttccccaatcatatcgaatgtgtttttaacttaatataatcaaagcaacctggtaatgactggaaaagggggtaaagaaattgactgaaatgc

SEQ ID NO: 6834124 - DNA, 87 bp, Homo sapiens
tgacagctcaggctgtgggagggctcatctctgtcaacatctgagccatctctgtcaacatctgagccttccccatctacgctgtca

SEQ ID NO: 6834125 - DNA, 89 bp, Homo sapiens
gctgctgcgggacgagtcgagcagaaagccgtcggggcacacacacgtgtacccgccgcgcgtgtttgcacactcgccgtgctggcagc

SEQ ID NO: 6834126 - DNA, 56 bp, Homo sapiens
agcactgggaacgcatggggccggggggctccccacagctcagcagacccagtgct

SEQ ID NO: 6834127 - DNA, 104 bp, Homo sapiens
catcaggtgggagccagaaatggggttctgtggctggctcagctggtgaccatttggaggtccttgagcaggtcaagactccagcttcagctttttcatttgtg

SEQ ID NO: 6834128 - DNA, 76 bp, Homo sapiens
aagtgttacatattctaaaatgctagcttctgaaaatgaatgcaatacatggtgtttttctagttatgttgcactt

SEQ ID NO: 6834129 - DNA, 126 bp, Homo sapiens
gtaaatgggagggtgctggtgtcaggcatggctggccctgggagtgcagacaggcccaccaggcctctgccagctctgtgggtctcgcttagcctcattctgtgtgccggctctctttccacttgc

SEQ ID NO: 6834130 - DNA, 72 bp, Homo sapiens
aaaggctgcctggcattacagcactcctgctctgcacagtggtggagtgtagctaaatgcagctcagtcttt

SEQ ID NO: 6834131 - DNA, 67 bp, Homo sapiens
acaaaggcagtctagtccccaggcaagaaggggttttgttttgggaaagggctgttattctctttgt

SEQ ID NO: 6834132 - DNA, 61 bp, Homo sapiens
atgcatctttagcctctccgtggcagttctgtgttaaatctgtccaaagctttaggtgcat

SEQ ID NO: 6834133 - DNA, 62 bp, Homo sapiens
ttaataaggtttcctaaagtggcaacattaactctctgtcagccacaagggaatattgttga

SEQ ID NO: 6834134 - DNA, 96 bp, Homo sapiens
aagtgtttacatgattcttttgagtattctcacaaaagcgcatcctttagtgctatgtttacttatgagacactcaacaaagatatgacaacactt

SEQ ID NO: 6834135 - DNA, 65 bp, Homo sapiens
gggggaagggcttacacagggggaggccccagaacagaggccatccttgagagctgctctccccc

SEQ ID NO: 6834136 - DNA, 94 bp, Homo sapiens
agttacaggtgggccctgcgcctgctgcatcctcacccttgtgatggggcgacacttgggagggtgtgggcagctgtaaagggcactggagact

SEQ ID NO: 6834137 - DNA, 71 bp, Homo sapiens
ttgttttctagtgacattttacactgtcataaccttctagaaaataaattggcagtgttattgggagacag

SEQ ID NO: 6834138 - DNA, 62 bp, Homo sapiens
gtgcagctgccaggggcagctgtctcatggccacgtgtggctctgccccctggtaagagcac

SEQ ID NO: 6834139 - DNA, 62 bp, Homo sapiens
ctttgttttagaaaatggggctttgtcattctccttcactctacctcgttttctgaacaaag

SEQ ID NO: 6834140 - DNA, 78 bp, Homo sapiens
tctgatgattctttgaccaaaaaattgagacatttgggaaatgatgaagtgcacattgtttggtcagagcatactaga

SEQ ID NO: 6834141 - DNA, 77 bp, Homo sapiens
gcctttagtatatggatattggccaaactcatttgtttctgctgcaattgggttttcagatgtcctcctactgtggc

SEQ ID NO: 6834142 - DNA, 86 bp, Homo sapiens
acatgcaattaaatgtacttgtgagcacatatacacaggatcttcctaggatgttgtgatggttcactgggcatgactttgtgtgt

SEQ ID NO: 6834143 - DNA, 61 bp, Homo sapiens
tccaaatcagttcacgttctgaggtcctggccattaggacttcaacatatgaatttttgga

SEQ ID NO: 6834144 - DNA, 104 bp, Homo sapiens
tagatttcctctccttgtgattttgattatttcttttatggttttaagtaaagagttgttatgttagaaggaatgttaaaagtaacaagtaacaaggatgtcta

SEQ ID NO: 6834145 - DNA, 67 bp, Homo sapiens
ggcgttgctctcccaccccggccgtgacgcaatctctccgcgccgggggcgggacgagcttgacgcc

SEQ ID NO: 6834146 - DNA, 73 bp, Homo sapiens
gggtcaggaggctgaatggccagaagccagcaacctgctggtggtcaccattttcagacccaagtgcctgccc

SEQ ID NO: 6834147 - DNA, 61 bp, Homo sapiens
ggttataaggaacaggagtcattcaaggtactatgaattcaacttgctgggctttgttacc

SEQ ID NO: 6834148 - DNA, 61 bp, Homo sapiens
tgatttctgcgttctaagaaccaacccttggatggtttctgattctagaggcaggctttca

SEQ ID NO: 6834149 - DNA, 130 bp, Homo sapiens
atgactcctccccaacttctcctagttattttcagttagcttgtttctcctgatctttcaaaaagaaggaatcaggagatgagcacggtggatagaagggggaaatttaagtgggagaggatttatattt

SEQ ID NO: 6834150 - DNA, 71 bp, Homo sapiens
cctttgtttgccacatgaaaatatgttcctaggaagtcctacagggtaagtttcatgtggctaagggaagg

SEQ ID NO: 6834151 - DNA, 72 bp, Homo sapiens
gatgtgtgctaagaatattgtttttgcttttaagcatatcttttaagcatagttaatacttttggtaaaatc

SEQ ID NO: 6834152 - DNA, 89 bp, Homo sapiens
caggcacccgccaccacgtctggctaattttggtaattttgatagagacggggtttcaccatgttggccaggctggtctcgaactcctg

SEQ ID NO: 6834153 - DNA, 63 bp, Homo sapiens
cagcatagccagcctttcttcaagcctgtgtgtaccccatctgaagaaaaactggtactgctg

SEQ ID NO: 6834154 - DNA, 66 bp, Homo sapiens
tggggtagaaagcccaagtccccctctgtgtgcagcagggggctttgcacttgagcttgcttctca

SEQ ID NO: 6834155 - DNA, 85 bp, Homo sapiens
tgggaagtcgccgtcctggggcgctcgctctgtccccctcgcctcggaccaccaggcagagcagccccagggtttggacttgcca

SEQ ID NO: 6834156 - DNA, 70 bp, Homo sapiens
gggaagtggctcagagcagggactctggagctagactgcctgcgtttgagatcctgctcagccaattact

SEQ ID NO: 6834157 - DNA, 58 bp, Homo sapiens
aactgcatgtctagcatccacttattttaaaggagatatgtaaataggcattgtagtt

SEQ ID NO: 6834158 - DNA, 62 bp, Homo sapiens
gggcccacagggcctggggcagctgctcaattggcagctggggcagtgccctgtgaaggctc

SEQ ID NO: 6834159 - DNA, 68 bp, Homo sapiens
cctattctcagtgatttttacagtaaggaaatctagtgattataccaggcaacactgagaactgtagg

SEQ ID NO: 6834160 - DNA, 82 bp, Homo sapiens
gagaaaccccttgtgcatgcatacgtatgtgtcttcattctcctatgtgaacatacagtgagcagtggactgcttgtttctc

SEQ ID NO: 6834161 - DNA, 61 bp, Homo sapiens
tccctctactcctcaaagtgaattccttcccgtctggataagactttggtgattagaggga

SEQ ID NO: 6834162 - DNA, 66 bp, Homo sapiens
caacatggtgaaaccccgtctctactaaaaatacaaaaattagccaggcgtggtggcgcacagttg

SEQ ID NO: 6834163 - DNA, 64 bp, Homo sapiens
tactttggggacaatatggaatccctttagggacaatatggaatctcttgtgtccaactaagta

SEQ ID NO: 6834164 - DNA, 58 bp, Homo sapiens
gctactggcaggcaaattggtgggagccgcccggcccagcctgccttgccgagtcagc

SEQ ID NO: 6834165 - DNA, 103 bp, Homo sapiens
ttgagacggagtcccactctgttgaccaggctggagtgcagtggcgtgatctcggcttactgcaacctccgcctcccaggttcaagtgattctcctgcctcag

SEQ ID NO: 6834166 - DNA, 76 bp, Homo sapiens
agtctcgtgctccattgtctagaactggcttacttgcgtaccagcaaaccagtcactggaaaatgggaatgggatt

SEQ ID NO: 6834167 - DNA, 87 bp, Homo sapiens
taatgggattcttatgcctgaggatagctcttccttacttgtcaatattatcatgtagatttgcttctcctgcctggaatcctgttg

SEQ ID NO: 6834168 - DNA, 57 bp, Homo sapiens
ttgttacagatcacatttctgcggaacatcacgtggaccttgtcgaatctgtgccga

SEQ ID NO: 6834169 - DNA, 60 bp, Homo sapiens
ttagggagagggcatagacctccttataaatcttatgaaatctttgtacccttttcctag

SEQ ID NO: 6834170 - DNA, 87 bp, Homo sapiens
cctacaatggatcattagaatgggacagattcctggaagagttctagaacatccagtatcaaagtcctagtccaatctccctgtagg

SEQ ID NO: 6834171 - DNA, 59 bp, Homo sapiens
gagagatttggaactgtttctcagaagaagtagagaaagtcaacagtttccagattctc

SEQ ID NO: 6834172 - DNA, 87 bp, Homo sapiens
agatgaagaagattctttaagttctagcattgactgttgaaagccacttatataaaaggtgccaagaactacaggattctttcatct

SEQ ID NO: 6834173 - DNA, 67 bp, Homo sapiens
cagtgggtggatttatttaaggacctctctattactgaaaatagagtccttcaagagtcccctactg

SEQ ID NO: 6834174 - DNA, 56 bp, Homo sapiens
tctttgatcagcctttcactgaatacacaatctccatgtgagaggcaggtagagga

SEQ ID NO: 6834175 - DNA, 61 bp, Homo sapiens
tcagcttctttcacttaacatgatgcttgtgagattcatccatgttggtgtgggtagctga

SEQ ID NO: 6834176 - DNA, 81 bp, Homo sapiens
ttatctaaaacacagtttctctatgagagttcagtgaaaattccccttcccaaactgattctatgaatgactgttagataa

SEQ ID NO: 6834177 - DNA, 81 bp, Homo sapiens
tggtaccttctgtaggtgccatctctacctctgacacagactgtctgcctcgaggctgagaaggcacagggcaaggagcca

SEQ ID NO: 6834178 - DNA, 63 bp, Homo sapiens
ccaggagatgatgttggggattgtaaatatccacaagacagcccccccgcacccaactcctgg

SEQ ID NO: 6834179 - DNA, 94 bp, Homo sapiens
gtcatcttcagtgtgaaggactagcatggagggcaggaggttgaaggactcgtccagcaaagctctctagccagtgctttgggcctgggatgac

SEQ ID NO: 6834180 - DNA, 64 bp, Homo sapiens
agaccagttagttttatagcacaaaatcagaaggtgagccagtgtggtaaagctgagtaggtct

SEQ ID NO: 6834181 - DNA, 55 bp, Homo sapiens
agtcttcttgggtcagagaatcatttactttgagtgaatgagattcaaggacact

SEQ ID NO: 6834182 - DNA, 84 bp, Homo sapiens
aaacaagagtcggaagagttataaatacctaataggatttgtcagttataataaaacccagtatgtttatagctccttttgttt

SEQ ID NO: 6834183 - DNA, 97 bp, Homo sapiens
ggctagggacctcagggagaggcctctgttgcccttttcagcaaggctggaaatgggatatgggcaggggacgtcttctctgacttcaccctagacc

SEQ ID NO: 6834184 - DNA, 67 bp, Homo sapiens
tgtcttttccattcactaattaggggagtaatgttcctcctttggttgtagacaggaatattaagca

SEQ ID NO: 6834185 - DNA, 83 bp, Homo sapiens
ctcatttcactcagctgtagggtcctcatctataaaatgggaataatattgactttgcaggcctgttgtgataattaaatgag

SEQ ID NO: 6834186 - DNA, 87 bp, Homo sapiens
gcccactggcaaacttgcatgttatttttataggcactgggaactcttagtaattttaaacaagggaaacatgtaattagcagtggc

SEQ ID NO: 6834187 - DNA, 58 bp, Homo sapiens
gggaggaggagggccatggtccctgcagagacccaggggcccaggcctccttccttcc

SEQ ID NO: 6834188 - DNA, 77 bp, Homo sapiens
atcacttgggagtttgttagaaatgcagaatgacaggctttaccccagacttgcatttcagtagatccctgggtgat

SEQ ID NO: 6834189 - DNA, 61 bp, Homo sapiens
caagagtttctgggtcaaggatttggtggcttggcatggagttctggcccagggtttcttg

SEQ ID NO: 6834190 - DNA, 58 bp, Homo sapiens
tccagagcctcctccagctgcaggtctgggatctgaagctcagctgccagctcatgga

SEQ ID NO: 6834191 - DNA, 71 bp, Homo sapiens
ctggcccagcactccaagtagggagctctttatggatattgatcgctgctctggagatgagctaggaccag

SEQ ID NO: 6834192 - DNA, 66 bp, Homo sapiens
atcctgtcactcagaggtttgattgctcagaagttgtgttttctggcctactgagaatcacaggat

SEQ ID NO: 6834193 - DNA, 56 bp, Homo sapiens
tcttctctcctgcttggcagaaactgaacgatcagcagtcagacagagagagagga

SEQ ID NO: 6834194 - DNA, 108 bp, Homo sapiens
ggcgctagtcacacacactaactagaaatctctgtttacatcatgcagacacaatgggctgaaagtgaaccaagcaacgagatctctgtgtgtgtgtgtctctctgtc

SEQ ID NO: 6834195 - DNA, 78 bp, Homo sapiens
catgctagcgctcatctgccgcctgccggacggtccccttcgctcgtctggaaggaggagatggagccgatgctcgtg

SEQ ID NO: 6834196 - DNA, 58 bp, Homo sapiens
ctctgctggtgaccactgggcctcactgtcccctaagtaacgcccattgccagtaggg

SEQ ID NO: 6834197 - DNA, 69 bp, Homo sapiens
ttctcagcctacttcattatcaagctatactattttatttatgcagtttgatgatcttacggcagagga

SEQ ID NO: 6834198 - DNA, 60 bp, Homo sapiens
acagagctagaaaaaggcagaattgggacctatacccagaatttctaactctagctctgt

SEQ ID NO: 6834199 - DNA, 96 bp, Homo sapiens
agctttaatgaccaattttcacagaaagaagctagtttaatattcatcttcactgaattcaagcgagttttgttttgttcaggttttcattttgtt

SEQ ID NO: 6834200 - DNA, 63 bp, Homo sapiens
gtgtaggagtggcagagagggtatactaaggtctgagtgtatctatagctggtgctcaaacat

SEQ ID NO: 6834201 - DNA, 72 bp, Homo sapiens
gtgccatggcttggttggttaaagcacctgtctagtaaaatagaagtctggagccaccctaagcattggcat

SEQ ID NO: 6834202 - DNA, 61 bp, Homo sapiens
ttcactagttagcaatgcccaggaatgcaatacttgctatttaatcattggtagctatgaa

SEQ ID NO: 6834203 - DNA, 55 bp, Homo sapiens
tcttgcattgctcattgtgccaactcacctgacattgggacatgacagtgcaggg

SEQ ID NO: 6834204 - DNA, 84 bp, Homo sapiens
tcatggtcccttccttgtgtctggatttcagctttcctatctctgcggagggggttggaccagattacacgtgggtgactcaga

SEQ ID NO: 6834205 - DNA, 61 bp, Homo sapiens
gggaagtgagctggaatcaagggcacaatttggccacctacatatctggacctcactttcc

SEQ ID NO: 6834206 - DNA, 57 bp, Homo sapiens
ggaaccaggtgataccctttaacaggccccaagggggcaggtgtggtatcagcttcc

SEQ ID NO: 6834207 - DNA, 77 bp, Homo sapiens
ccccacagaattttcctttgattcccagatgtcgtaagagggacatcacttgagaaccaatgggacttgtgatgggg

SEQ ID NO: 6834208 - DNA, 56 bp, Homo sapiens
ttggcatagttaggctttcacacctgcatcaccatgtctgagaagccactgtccaa

SEQ ID NO: 6834209 - DNA, 104 bp, Homo sapiens
tcaagtacgtcttgtgttcatttgagatgtaaggtatgcttacttgaggaagaggattctctttcctagttcttatgtctgtacatctccacaagatagtctga

SEQ ID NO: 6834210 - DNA, 103 bp, Homo sapiens
cattattaactctttctggtcacttgggtaacattttgagtactgtacaaaaagagaagtaatttactaaatggtaccctaatggccagaaagagttaatgtg

SEQ ID NO: 6834211 - DNA, 57 bp, Homo sapiens
tatgtgcacattagagagatggcccctcacttcacaggccataaaatctggtatata

SEQ ID NO: 6834212 - DNA, 124 bp, Homo sapiens
aagtcaaggcatcagcagggctgtgctccctctggaggctctaggggagaagctcttctctgcctgttcaagtcttctagaggctgctcacattcctcagctcatctcactcccacctttgctt

SEQ ID NO: 6834213 - DNA, 67 bp, Homo sapiens
ggcaggtatctcagctggatcagtggaaaggcaaagcactttcatttcccagcctgagggctcagct

SEQ ID NO: 6834214 - DNA, 63 bp, Homo sapiens
agaaattacccagagctgagtctgatatatgctgttagtatacttcaattcagcctgatttct

SEQ ID NO: 6834215 - DNA, 94 bp, Homo sapiens
acattgtaaggtgaccataatagattatgagtcccaagcagatcctggctttaatgctcaattaatttataagtggtacttgttgcctcagtgt

SEQ ID NO: 6834216 - DNA, 92 bp, Homo sapiens
atgtaataggttaaagtattggttcatttgttcttccctcttctgaaagaaaaagttcaaaaatgtaatcagtgtttatctagtagttacgt

SEQ ID NO: 6834217 - DNA, 95 bp, Homo sapiens
gtacaagtttgaactacatagatgaattagcaattatctttctaatattggaaaagatctttttcattcgtatgtgtagcttctgattatgatac

SEQ ID NO: 6834218 - DNA, 120 bp, Homo sapiens
gcatcacttgggtacttgttagaaacgcaaattctcaaggtttatcccacctttactaaatcagaaattctggagatgggacaaagaaatctgtgtttgaacaagccctctctacgatgt

SEQ ID NO: 6834219 - DNA, 68 bp, Homo sapiens
gaggcgggcgcatcacctgaggtcaggagttcgagaccagcctgaccaacgtggtgaaaccccgtctc

SEQ ID NO: 6834220 - DNA, 71 bp, Homo sapiens
gcaacccagctcttttatcatgaggagaggtagccatgctgactcatgaacaggtggaggaaaggggttgc

SEQ ID NO: 6834221 - DNA, 75 bp, Homo sapiens
caggatccatgccggtgcccacctcttgtcccctcccacagtgggaagggagctgggtatttagcacagatcctg

SEQ ID NO: 6834222 - DNA, 74 bp, Homo sapiens
catggtggattatctttctgatatgctgttgaagttggttagctagtatttcattgaggatttttccatctatg

SEQ ID NO: 6834223 - DNA, 73 bp, Homo sapiens
tccaggagccctgactgagcctccctagcccccaactctactggagacctgggctgtgctccgggttcctgga

SEQ ID NO: 6834224 - DNA, 64 bp, Homo sapiens
tacattcgtgtgtgtgtgtgtatgtgagtgcacacacacacatacacaagcgtacatgaacgtg

SEQ ID NO: 6834225 - DNA, 75 bp, Homo sapiens
tttgaggagtagacacgttcctgcctcagagacttggctctcgctgtccttcttctggaatgtgcttccctcaga

SEQ ID NO: 6834226 - DNA, 75 bp, Homo sapiens
gggagactgcggctggagctttgaacctgatctctcaacctcgacaggacaactcagcagccagcagcggctttc

SEQ ID NO: 6834227 - DNA, 63 bp, Homo sapiens
ggaaatgaggcagggaggaggcatttgggagggacatttgtttcaactcctgccattatttct

SEQ ID NO: 6834228 - DNA, 55 bp, Homo sapiens
tgctggcaccattttcggacatgagggaaaagcccatctgggaatgatgccagca

SEQ ID NO: 6834229 - DNA, 59 bp, Homo sapiens
tgcatggaacggtctcctggtcatggccccatcccactgccacccacatcttttatgca

SEQ ID NO: 6834230 - DNA, 69 bp, Homo sapiens
gttggtggtggcagggcaatgctccctctggaggctttgaggaggaatctattccctgcctctcctaac

SEQ ID NO: 6834231 - DNA, 59 bp, Homo sapiens
cattccttaacgtggggagtcttggactgggtgagctcatgactccaactttaagcatg

SEQ ID NO: 6834232 - DNA, 85 bp, Homo sapiens
ggtgtgcttggggtgcacttgggtactcagggtgtactggcgatactcagggtgcagttgagtactccgggtgcacttggctgcc

SEQ ID NO: 6834233 - DNA, 75 bp, Homo sapiens
agaagtgggtgcactcaactttatggctataagccactggcactttcgcacatgtgagttgagcatccattctct

SEQ ID NO: 6834234 - DNA, 71 bp, Homo sapiens
gattctagctggactcattcttccccttttggcagatcaattagtgtcaagaactttggtcctgcagagtc

SEQ ID NO: 6834235 - DNA, 91 bp, Homo sapiens
tgtaggtgaccatttggcagggaggaggtgaaagtgagcacatcatagtcctcatacacctatctctctgtgcagatacgtgatagagaca

SEQ ID NO: 6834236 - DNA, 76 bp, Homo sapiens
caggcggggagggagcttccgaactacagcttctccagcacttggagcagctcgaggcctctcaccttaaggcctg

SEQ ID NO: 6834237 - DNA, 70 bp, Homo sapiens
tctttcacctgggctttctctgggactcacctaggagttccccagtgtggtaggtccacaggtgtaaagg

SEQ ID NO: 6834238 - DNA, 79 bp, Homo sapiens
tttggggatctgaagttgtggatcttgttgtcatgaattagttcctattagtgacaaattcatatttcagaggactaaa

SEQ ID NO: 6834239 - DNA, 60 bp, Homo sapiens
gctgcctgaactgggtgagcaaggcatgccccaggctgagccctgtcaccagtgggctgc

SEQ ID NO: 6834240 - DNA, 60 bp, Homo sapiens
ggcagccagcagttgaaattgacatgtgagagttcttctaagtcccagatgctagctgcc

SEQ ID NO: 6834241 - DNA, 95 bp, Homo sapiens
ggaaggcttccccacggacgaggggcaagcccctcgacgtcagggtgtcgtctatgtagaggggaatctgcctcctctcaaaggggaattctttc

SEQ ID NO: 6834242 - DNA, 77 bp, Homo sapiens
tgcaaactatacaagattagggatttgggtctctcttgttcactgccttatccctaacatctgtatagtgacttgca

SEQ ID NO: 6834243 - DNA, 91 bp, Homo sapiens
ttcgttctctatttattattagttagtcaaatccagtttttgatctccaaaaatagaaggattgactgagttggagtctgtggggaatgag

SEQ ID NO: 6834244 - DNA, 70 bp, Homo sapiens
gttaattcagtcaaagaaaccatttgatctgaatgtgtgaccgaatgaccagtggtttgactgaattcac

SEQ ID NO: 6834245 - DNA, 66 bp, Homo sapiens
tcttccgatctgggatgaaacctcaaataagttaatgtttccatccacattaacagatacggaaga

SEQ ID NO: 6834246 - DNA, 61 bp, Homo sapiens
ggaggggctttggccagggtgctttcagagctctgtccacagtggtccccgaagcccctcc

SEQ ID NO: 6834247 - DNA, 65 bp, Homo sapiens
gtcaccctgctggtagggacagatgccctaaaatctctttgtctgtccccattctaagaggtggc

SEQ ID NO: 6834248 - DNA, 79 bp, Homo sapiens
gagacataaggattcaggcaggccatacttttaggcaggcgatcatgaggctgtggctccctggtatttgcatgttctt

SEQ ID NO: 6834249 - DNA, 77 bp, Homo sapiens
agaacaaagccctgcccaagagctcgtttcctgggacctgccaacttccatgaataagcgggcaaggctttaattct

SEQ ID NO: 6834250 - DNA, 59 bp, Homo sapiens
tttaaagtgggcaaactctcatggtcttgtaatttaagtccattttgaccctttttgaa

SEQ ID NO: 6834251 - DNA, 66 bp, Homo sapiens
ggagctttggcgcccaccttcaggctctggccatgccagacatcatgaagggcagcctcaggctcc

SEQ ID NO: 6834252 - DNA, 116 bp, Homo sapiens
tctggtgagttcagcacggacactgttgctggcacagacagggcagcttttcccatgagccacaaacattgactgctgtccctaaagcaactgtcactgcccctgcccttgccaga

SEQ ID NO: 6834253 - DNA, 59 bp, Homo sapiens
tcaagatgtccagtgcctataaaatgaactgtaatgaccttgggtaaatggcattttga

SEQ ID NO: 6834254 - DNA, 59 bp, Homo sapiens
gtcactctttttcagctagctcaggctaaagataagcccaagtgggcaaggaagatgac

SEQ ID NO: 6834255 - DNA, 69 bp, Homo sapiens
ggagcgtggggcgtcggggctgtgtgtggtgtggaacacaggggaggatcctgagtgtgcccaggctct

SEQ ID NO: 6834256 - DNA, 58 bp, Homo sapiens
acaggcaccatgactcttgtgcagattgtcttgttttaatatgggtgatgatgtctgt

SEQ ID NO: 6834257 - DNA, 77 bp, Homo sapiens
cttgagatggaatctgtgtggagggctcagcctgaggataaaatgagttcatcgtttgcacatgtttcattcttaag

SEQ ID NO: 6834258 - DNA, 89 bp, Homo sapiens
agaccaaaattccatttgtttgcctatgtgaagggtttattattaattaccctattaatttatgtccaaaccagatgtgatttccttct

SEQ ID NO: 6834259 - DNA, 80 bp, Homo sapiens
ctgtaatagcagagcagacgttgagattaagatagtatttttatatgcaaacttctttactctgcttcgtccattattag

SEQ ID NO: 6834260 - DNA, 88 bp, Homo sapiens
taaatcaacactaacaggaaatggctgaataaattctaatagatcaaaacagtggaatttaatgcagtcattttaaaatgtgggttta

SEQ ID NO: 6834261 - DNA, 64 bp, Homo sapiens
ctttttacaggtgagaaaactgaggcacaggttaagtgactcactaagctctcactgtaaatgg

SEQ ID NO: 6834262 - DNA, 90 bp, Homo sapiens
cccaccctctttgtcctgcagggtgctgccacagatttatagaaagagatggagctgagaagatggtacctgtggacacagggggttggg

SEQ ID NO: 6834263 - DNA, 62 bp, Homo sapiens
cacccaggaggttgggaagggccccaaaacacaagcggcgtttcattcagcaccctgaggtg

SEQ ID NO: 6834264 - DNA, 82 bp, Homo sapiens
gggtggagttccctcaggcagaggatggggagcgtctggtgttgggactccctagttctctacctgcttttaactaataccc

SEQ ID NO: 6834265 - DNA, 84 bp, Homo sapiens
tcacactatcatttgtaccatactgtttattacggaccagttcagattcgatgagaaacacaagggtgcaaataccagaagtga

SEQ ID NO: 6834266 - DNA, 64 bp, Homo sapiens
ggaggtgcctgctctgccggggctgctgcgcacacacgcgtgcccaggcgagtttggactctcc

SEQ ID NO: 6834267 - DNA, 59 bp, Homo sapiens
gttttgccattttgagaaggatatataaagatatgctctgcatctcatagtggctggat

SEQ ID NO: 6834268 - DNA, 62 bp, Homo sapiens
attagcttggtatgccataaagtggtagtactattttccatactgtgggatatggagctggt

SEQ ID NO: 6834269 - DNA, 60 bp, Homo sapiens
cagagggagagttctggcagaatttggacctgagttctggttgcccatgacatcccgctg

SEQ ID NO: 6834270 - DNA, 74 bp, Homo sapiens
cagtgtttaaacagggcagtgtcttgaaaaatgactttgttctctagatcactcacggtgctggcctgacactg

SEQ ID NO: 6834271 - DNA, 70 bp, Homo sapiens
aggtcattccttgtcttcttgcaaacttattttctttgactcagtgttcccaatgagcgaggaatgacct

SEQ ID NO: 6834272 - DNA, 65 bp, Homo sapiens
tcttcttctcacccgtccattgatttctccacacctccagccaacttccagggtagaggggaaga

SEQ ID NO: 6834273 - DNA, 79 bp, Homo sapiens
cctcgcccctctcagccctgcaagttgcgtggttgtgtttacaaattctgccacaattgcaaaggaaataggggtgggg

SEQ ID NO: 6834274 - DNA, 63 bp, Homo sapiens
agactctgattccctcatgtcatagccagcatggcagggaaggaatgtagggattcagcgtct

SEQ ID NO: 6834275 - DNA, 68 bp, Homo sapiens
aggctgccttgtggcaggtggatggtgcccctcgagatgggcagggcaccatctggccacacgtgcct

SEQ ID NO: 6834276 - DNA, 67 bp, Homo sapiens
gaggaatgtggttgagctcatgggtgctttttataagactagggtgtgtttaatctaatcattcctt

SEQ ID NO: 6834277 - DNA, 94 bp, Homo sapiens
gttctgccaagtaaaacagctgcaatagtttagaataattgtaggatgaaaatagttaagaaataaattaatgcacttagttatattgaagaac

SEQ ID NO: 6834278 - DNA, 69 bp, Homo sapiens
agaagcgaatgggtttagccctgccagccatgaacttggggggcaagactgggcaaatcccttctttct

SEQ ID NO: 6834279 - DNA, 73 bp, Homo sapiens
gattgtgtgtggagtgtgtgtctgcctgtgcgccctgtgatgtttttggttcttttatatttcacacatattc

SEQ ID NO: 6834280 - DNA, 61 bp, Homo sapiens
ccttctctgtcaatgggggtaataagataagcattcttggccccattttacagatgaaagg

SEQ ID NO: 6834281 - DNA, 56 bp, Homo sapiens
gccactgtcatcttgtgaagcaatcaccacatgttcccatcacagctgatggtggc

SEQ ID NO: 6834282 - DNA, 59 bp, Homo sapiens
ggtcccaagtactaccaatctaatctaattttataggcttagcaagatagtactgggcc

SEQ ID NO: 6834283 - DNA, 61 bp, Homo sapiens
ggtttgaagcctaggaccaataggctatacaatatagtctagatgtgtactaggttatacc

SEQ ID NO: 6834284 - DNA, 59 bp, Homo sapiens
ctggccagcatggctgaagtacgtgcacccttccacctcttctctccctgctggtccag

SEQ ID NO: 6834285 - DNA, 107 bp, Homo sapiens
cagaggtgaagtaatttgctcaaagtgacatagtagtggggccagggtttgaactcaggaagtttaactccagagcccatactcttagcttagctatactacctctg

SEQ ID NO: 6834286 - DNA, 96 bp, Homo sapiens
ggctggctgtggagctgagcaggctccaggctggccatctggaacacctgcagctggcccagcgtggggccgtgcgccagtccaaacggcccagct

SEQ ID NO: 6834287 - DNA, 77 bp, Homo sapiens
tgcaaagaaagcacgatagtagcaaaagtgactgttaataatttgtgactacattgttcttttcttttccttttgca

SEQ ID NO: 6834288 - DNA, 55 bp, Homo sapiens
tctcccactggccttgtatgatctgagagctggcagtggacaagctaatgggaga

SEQ ID NO: 6834289 - DNA, 69 bp, Homo sapiens
cttgtcacccaggctggagagcagtggcatgatctcagctcactgcaacctctgcctcccgggttcaag

SEQ ID NO: 6834290 - DNA, 70 bp, Homo sapiens
gtttctcttcttgaaagaggaattcaaatgacaatgaacatttttggggtcctcttttatggagtttgat

SEQ ID NO: 6834291 - DNA, 71 bp, Homo sapiens
gctacctatgtgccctctggccacagggacattatatttctcccatggcggagtcagcaccatggcatagc

SEQ ID NO: 6834292 - DNA, 67 bp, Homo sapiens
ctgcaggctcgaagacacggatgcatctcatcacacatccaactgacaccccgtttcttccctgtag

SEQ ID NO: 6834293 - DNA, 102 bp, Homo sapiens
gatgactgagccaggtttcctgtcatcagagcgtacacctccagttagaaagatggacttgtaaacaaatctaatgtaacatgagacttgctttcggtcatc

SEQ ID NO: 6834294 - DNA, 99 bp, Homo sapiens
gtgttgcattcacattttggaaaatagttatacaggagattccttacttgctttaatgcaagtagaattgtttgtaagactttccatctgatttctcac

SEQ ID NO: 6834295 - DNA, 80 bp, Homo sapiens
ttgtggagggttctcttggtgtgttgtcgggcatttagtaacattccctctacccacagaatgccaatgagacctcccga

SEQ ID NO: 6834296 - DNA, 67 bp, Homo sapiens
gatttagagaatgttttgtaagtggagacttcgtccttcccttaatgtacaggaccttctttgtatc

SEQ ID NO: 6834297 - DNA, 60 bp, Homo sapiens
gctctggaggctggaagaccatgatcaggatatcagcatggtcaggttctggtgcggagc

SEQ ID NO: 6834298 - DNA, 59 bp, Homo sapiens
gtggcacttgcttcagatgatgtccccaggcaccatgacatagctgcagaagatgccat

SEQ ID NO: 6834299 - DNA, 68 bp, Homo sapiens
aatccttttaaaacataaactgacagcccatgggccaagcccaactgctgttatgttttgtttggatt

SEQ ID NO: 6834300 - DNA, 68 bp, Homo sapiens
gaaacgtctgctagaatttctggaaaagagagattcctctctttgctccatgaaatctattagatttc

SEQ ID NO: 6834301 - DNA, 65 bp, Homo sapiens
agccaaggttggctggtaagagcctagattatgctttctgcttaggttggtctagaccattggct

SEQ ID NO: 6834302 - DNA, 107 bp, Homo sapiens
gtttcaggtcattgatgcacagtgtaatctctaatttaaaaagtaacacacaatggtgttttattttcaaagttagagctcttttgggttctcaatgtgaccagagc

SEQ ID NO: 6834303 - DNA, 59 bp, Homo sapiens
tgacataatgctttgaagttgccatttgctgtttggcagtaacaggaagcattatttta

SEQ ID NO: 6834304 - DNA, 129 bp, Homo sapiens
cctctttggccatggtgggaaggtaatgaggaaggcaggccagaggctgttgttgcgttggaaatcattggacgacaagactctgacttatttctctcagtatctgactatttcctctttattgacagg

SEQ ID NO: 6834305 - DNA, 71 bp, Homo sapiens
ggtgctggcagagccgggagccagtcacagcagctgcccgcgtgaccagggctgccggctcaacctgcacc

SEQ ID NO: 6834306 - DNA, 63 bp, Homo sapiens
cgccaccatgcctggctaattttttgtatttttagtagagacaggttggtcaggctggtcttg

SEQ ID NO: 6834307 - DNA, 77 bp, Homo sapiens
gttctggatgtttctagggatggtaggtacaaacataatgttttagcacactttctttagcgacaacatcatagaat

SEQ ID NO: 6834308 - DNA, 74 bp, Homo sapiens
ctgggaaaactgtgacccctgtgtttccctaatgagtctggcatatagagaggggttaaatgagttggtcccag

SEQ ID NO: 6834309 - DNA, 58 bp, Homo sapiens
tatcagaacacagccacagccatttttttacatattgcctatggctgctttcatgata

SEQ ID NO: 6834310 - DNA, 104 bp, Homo sapiens
atctcaggggtttcatgatctctctgaaattgttagtaaaaatgaatgtgtatatacgtttttataggaagaatttccctagctttcaacagatcccttaagat

SEQ ID NO: 6834311 - DNA, 58 bp, Homo sapiens
acaggatagtttttaatcttccatgtagttctgatgccctggttgaaatctgttctgt

SEQ ID NO: 6834312 - DNA, 108 bp, Homo sapiens
ggcagtcatcttggccagccctcaattttaggtataaggactgcacctgagactgaaggaggctgatataccttacacctaaaatgagagttggccaacatgactgct

SEQ ID NO: 6834313 - DNA, 78 bp, Homo sapiens
tctttttagagctgaggtgatgtggtcgttctcaatttaaagatgaacgtttaaagccatctcatgtgcatagctgga

SEQ ID NO: 6834314 - DNA, 59 bp, Homo sapiens
cactcttgttcaaaaatctggctggctgagtgaaaacagcaaggagtagaacaagagtg

SEQ ID NO: 6834315 - DNA, 59 bp, Homo sapiens
gtatcttgactccatgcctcagtttctctaattaaatgaggacaaaaggttaatgatac

SEQ ID NO: 6834316 - DNA, 65 bp, Homo sapiens
gtatgtgcaggttaagtctacagtggaggtgggaaacagcctttgcagaagaaacctacaaatac

SEQ ID NO: 6834317 - DNA, 67 bp, Homo sapiens
gcttggcagcaacaggcatccccgagacaccaagggccaggtgatgtctctttttcgtgctccaagt

SEQ ID NO: 6834318 - DNA, 103 bp, Homo sapiens
tatatctccataagttgaactgaaaaatacctctgtaagtaaagattcaacccaagggttagtttttactgcgagttataaacttcaagaaactgggtatgta

SEQ ID NO: 6834319 - DNA, 86 bp, Homo sapiens
ctcacagggcttcaggcattccattacagatcttttcctaatgtgaggaaaagggaatagtggagagtcctgaggaccctggtgag

SEQ ID NO: 6834320 - DNA, 69 bp, Homo sapiens
acatgtctcctcctgagaccccttgtcctgacacactacaggtctctggctgtctcaggagtggcacgt

SEQ ID NO: 6834321 - DNA, 61 bp, Homo sapiens
ctgaatgccagctacctgcattatggcctcggttctaggaagggaagcatggcactattag

SEQ ID NO: 6834322 - DNA, 68 bp, Homo sapiens
gcttccctgtccagtctcatctgcatgggcacaccatcaggctgagaaaatctggacccctgggaggt

SEQ ID NO: 6834323 - DNA, 84 bp, Homo sapiens
gtatcctttcttgaaatttgattagctgtgtaattttttcatcagagaaatggttacagtctgattaagttatataggagatac

SEQ ID NO: 6834324 - DNA, 55 bp, Homo sapiens
ttccaggcacaggggactgccagagcacaggccccgcagtagaccatgcttggaa

SEQ ID NO: 6834325 - DNA, 67 bp, Homo sapiens
tcaagccttcctttaaagctatgatgtagttgatcttcagcaaaaatctggaattgaagaggtttga

SEQ ID NO: 6834326 - DNA, 87 bp, Homo sapiens
ctccttcggtggtggagattcagggactcactcctataattccttcagcttgggtctctgttgcctccatcaagtggccgtaaggag

SEQ ID NO: 6834327 - DNA, 89 bp, Homo sapiens
ggctgacaactctttggatgtaatacaagatttatagttgtttgtttcttctaatgaggtggcaaggtaaatctgcatctgttacagct

SEQ ID NO: 6834328 - DNA, 71 bp, Homo sapiens
ttcctgcactgtaggtcatgaggagcagaggacaagagggagctttgaccagtggcgctgggtgcaaagaa

SEQ ID NO: 6834329 - DNA, 67 bp, Homo sapiens
gaatgttactttgattttgtccacactttcttttctttcccaatggatagagtcatagaaatcattc

SEQ ID NO: 6834330 - DNA, 63 bp, Homo sapiens
ttccagaaatctttcagctcaaaccttgcaaaatactatcttgagctgaatatgttctagggg

SEQ ID NO: 6834331 - DNA, 64 bp, Homo sapiens
ggggtgttggcctccacattttccaggtgacatcagctgggaagagctgcagtccatccaccct

SEQ ID NO: 6834332 - DNA, 56 bp, Homo sapiens
ccagatgagatttcgccgacagtattttatggtttaaaatgggtgaaattatttgg

SEQ ID NO: 6834333 - DNA, 63 bp, Homo sapiens
atacttctggaggctagaaatctaagatcaaggtgttggtgagtttagtttcttctgaggtgt

SEQ ID NO: 6834334 - DNA, 88 bp, Homo sapiens
gaatgtgatacttgaatctgggtgactggttctttatggaggcacagaaaagggccggctgacactttacagattgagtgtaatgttc

SEQ ID NO: 6834335 - DNA, 66 bp, Homo sapiens
aagtaaagcaaggcgtcggggagctattcttagatagatgctcacactcctgagccctgcttactt

SEQ ID NO: 6834336 - DNA, 60 bp, Homo sapiens
gtttcttggcctttctatagcagagtggctggattctgaaagggagaacaccaagagcac

SEQ ID NO: 6834337 - DNA, 78 bp, Homo sapiens
gcaacaggaaagattatggcattgaaatactcatttatacttttatggtagttcaaaatggtggtcttatttctgggc

SEQ ID NO: 6834338 - DNA, 63 bp, Homo sapiens
gatgtagagcatttggatttagtagtccctctagagaaatgaccagatgcaaatgcagacatt

SEQ ID NO: 6834339 - DNA, 61 bp, Homo sapiens
tctggatgggatgaggcaacaaatcggtgactttccgccactccgtccccatccatctaga

SEQ ID NO: 6834340 - DNA, 117 bp, Homo sapiens
ggcagaaacatctggtctccctcaagtgtctatgttaaatggtttattattaattttgtatgttaatgatttggaaccctttaattttatgaagccaggaggattattatttttgcc

SEQ ID NO: 6834341 - DNA, 94 bp, Homo sapiens
gctgtcatcccgtgcctgtgaccggctttggtgccagcgtcagcctgtggctaacactgtgcccagagtcccaccacccacccatggatcaagc

SEQ ID NO: 6834342 - DNA, 65 bp, Homo sapiens
gtcacccaggctggagtgcagtggcgcgatctcggctcactgcaagctccgcctcccgggttcac

SEQ ID NO: 6834343 - DNA, 78 bp, Homo sapiens
tagcaatgctgtggcaagttactttgcacctctattttatgatctctaaaatgggagtactatgtgataggattgtta

SEQ ID NO: 6834344 - DNA, 61 bp, Homo sapiens
cataggatgttgcctctaattgctgtgcattaattattagcatctgggcatcaattttgtg

SEQ ID NO: 6834345 - DNA, 68 bp, Homo sapiens
gcatagagtggttaacagtttagaaactgtttgaatcttgattttcttactgtgtgacctctctaagc

SEQ ID NO: 6834346 - DNA, 64 bp, Homo sapiens
atgacaaggccctggcccccagagattctggttcagtggtctggggtcaggcctgagaattcat

SEQ ID NO: 6834347 - DNA, 68 bp, Homo sapiens
cacagggaagcaggaatagctctgagctacaaatagtcatgtttccttcagaattttccgcctctgtg

SEQ ID NO: 6834348 - DNA, 65 bp, Homo sapiens
gcatgacctggggtcaccaaaactgcctgctacccagcagcagcagaagggagacccaggttggc

SEQ ID NO: 6834349 - DNA, 88 bp, Homo sapiens
ttcaaagtagcatttagtttgaatgatttcttcttcatcccctgcttggtatgaaacagtgaattagtcaagtaaaaatgtctttgga

SEQ ID NO: 6834350 - DNA, 69 bp, Homo sapiens
gcccaatttcagctttctgttttatggatctgtccccgaggctgcatgacagttttgctgaaattgagc

SEQ ID NO: 6834351 - DNA, 87 bp, Homo sapiens
tttttcattcactgacagggcttccctttaatcaagtataataactgctgcatgaaagaaagagtaagccttgatctttgagaagaa

SEQ ID NO: 6834352 - DNA, 106 bp, Homo sapiens
gagacggagtgtcgctttatcacccaggctggagtgcagtggtgcaatcttggctcaccgttcatggcaacctccgcctcccgggttcaagcgattctcctgcctc

SEQ ID NO: 6834353 - DNA, 67 bp, Homo sapiens
cctctccccatgttgtggtggtgcctctggactcagtcctggtgcaccagtcacatgggcagaatgg

SEQ ID NO: 6834354 - DNA, 59 bp, Homo sapiens
cccggctcagcctcctgacccaggccctggctaagggctgcaggagtctgtgagtcagg

SEQ ID NO: 6834355 - DNA, 57 bp, Homo sapiens
ctccggcctgccttaaccccctttttgaattagagggtgggcaacatttggcctgag

SEQ ID NO: 6834356 - DNA, 78 bp, Homo sapiens
gggtgctggagagggctttactctgaagtaggggcggccaatatttgatcccatcattcagaaatccctcttctaccc

SEQ ID NO: 6834357 - DNA, 74 bp, Homo sapiens
ttttatgttcatctgtgtatgaaagtataactgctgcataacaggcagttttctttcgcaaaggtacaataaaa

SEQ ID NO: 6834358 - DNA, 78 bp, Homo sapiens
tctgtcaatgtagacagcaaccaaaccaggtggctgtttaagctagaatgacctgggttggcttctacattgatgaga

SEQ ID NO: 6834359 - DNA, 61 bp, Homo sapiens
tggaaaggtgtaaagcagaaccatcattttatccccggaactgtctgatgcaccttatcca

SEQ ID NO: 6834360 - DNA, 66 bp, Homo sapiens
gttgtgaggattgccaatgccagattgtaaggctgatctgggagccagttggtcattctacacaac

SEQ ID NO: 6834361 - DNA, 88 bp, Homo sapiens
tcccatcctgcccttactccagcccagctcctctcagaacttaggagtggagcagtggctgggttgggggaagagcaagcccttggga

SEQ ID NO: 6834362 - DNA, 73 bp, Homo sapiens
ggtcctgggatttcctgagcactctctggggacaaagctctatacttggagagtgcaggggaagcccagggcc

SEQ ID NO: 6834363 - DNA, 89 bp, Homo sapiens
cattatctgtttccttgtgcctgtagcatttactgtaattccttagattaaaaccacggcccctaatgttacaggacaaagatggagtg

SEQ ID NO: 6834364 - DNA, 87 bp, Homo sapiens
ccactctagtttccaaggttctaaatcgagtcactgaggttttcttttctagggcttccaagatgccttcggaattgcttggattgg

SEQ ID NO: 6834365 - DNA, 80 bp, Homo sapiens
gagggggaggagtgtacaggtttattttagagtccaggctggaatttgcattgctttttgtggatccacacctccccctc

SEQ ID NO: 6834366 - DNA, 130 bp, Homo sapiens
agaatgtgagttttcttgttttaaatcagcactttgtgtgtttgatgtattgcatagatttagtataaatatgtgtactcgttaaatatttattaaaatgtaaaggattatgaatcaatacccatattgt

SEQ ID NO: 6834367 - DNA, 67 bp, Homo sapiens
gatgctgagccaaaaagcagagcttggtatctccaattccagctgtgcttttattgggctttacatc

SEQ ID NO: 6834368 - DNA, 82 bp, Homo sapiens
cacatatgtttaataaggtctggattttatctactgtattcatcagaagtattacaaagtagaaattcagtaaatatttgtg

SEQ ID NO: 6834369 - DNA, 59 bp, Homo sapiens
atcagtggaaggaaagcaggaagggtctcttctttcaaatacattctttgccacttgat

SEQ ID NO: 6834370 - DNA, 62 bp, Homo sapiens
tcacatttgataatgcccattggccaaagcaagtcccatggccaagggcacagtcagtgtga

SEQ ID NO: 6834371 - DNA, 90 bp, Homo sapiens
ccagcctgctgtggtggctgagggtatagctgtcccagaggcccctccaaaactgggtccctgctgtaccctcccaccaggcagggctgg

SEQ ID NO: 6834372 - DNA, 59 bp, Homo sapiens
cagcaccctttccactgccttgtggccaggggggcccacggcagcctccgagggtgctg

SEQ ID NO: 6834373 - DNA, 62 bp, Homo sapiens
aggataggtttcctgaggatggagatgcagaaatagttgactttgccttcacgaagcatcct

SEQ ID NO: 6834374 - DNA, 73 bp, Homo sapiens
aagcctctcagaaatgcaaattttcatagagcacctcaggaaggggctctttgacttctattgttgtgggctt

SEQ ID NO: 6834375 - DNA, 69 bp, Homo sapiens
gaatatatgaagttacaggtaagaaactgcccaaacagaaagtttgttattactaattttatgctgttc

SEQ ID NO: 6834376 - DNA, 64 bp, Homo sapiens
attgcaccttgggttttgaaaggattcttatatcctaaatctatttgaaaatgcattgtgcagt

SEQ ID NO: 6834377 - DNA, 62 bp, Homo sapiens
tctgcaagtgacccgggcccagcccctgggattatttggcaagcgcctgttgtcactgcaga

SEQ ID NO: 6834378 - DNA, 57 bp, Homo sapiens
cagttcaggtgcattagtaatctccatctggttcctctaaatttgtactgtgaactg

SEQ ID NO: 6834379 - DNA, 70 bp, Homo sapiens
ttcaattcataagaaagacacacatcacaagcaaggtccccatgcttgcttggacttttgcgtgattgag

SEQ ID NO: 6834380 - DNA, 90 bp, Homo sapiens
ttttttgttgtttcctacaatgtatctgccacgatgctatgctttgggaatgtataattaaggcagaagacattctgggtcatcaaaaaa

SEQ ID NO: 6834381 - DNA, 64 bp, Homo sapiens
tggccaggatcggactgggcctggtccagtcttggctccaggccacaagttgggttcaaggcca

SEQ ID NO: 6834382 - DNA, 70 bp, Homo sapiens
tcatctccagcgcagcagccccgtggtaggtgaagtgctattcttcactgccttgcatgtgggagtttga

SEQ ID NO: 6834383 - DNA, 87 bp, Homo sapiens
ggtctggaactcctgggctcaagccttctgcccacctcagcctcccaaagtgctgggattacagatgtgagccattgagcccagact

SEQ ID NO: 6834384 - DNA, 79 bp, Homo sapiens
ccctcgcccgcagtgcctggccggcttccatttctccttgaggtggctgagctggccggagcgttcgcgggctgagagg

SEQ ID NO: 6834385 - DNA, 60 bp, Homo sapiens
ggtgcatggcagggttggagcccaggtccctctgggtccagagttttcccgccctgcatc

SEQ ID NO: 6834386 - DNA, 92 bp, Homo sapiens
ctttccatacactgtctgtcacagatgaagaatgacctgtgttgataagtataatccattcattgatttctgaacccagatacactggaaag

SEQ ID NO: 6834387 - DNA, 64 bp, Homo sapiens
aaggtatggagtcagaaggtagcttatcaagatggtgagtgatgagcatgattttaggtgcctt

SEQ ID NO: 6834388 - DNA, 80 bp, Homo sapiens
gcctggttagcccagatgattgaaccatgggacaaaactgatgaaggttatggtttcaatttctgggtaggccagttagc

SEQ ID NO: 6834389 - DNA, 89 bp, Homo sapiens
tggtgaggctatttgctcctgttgattttagggcaattgtgtagctctaacagcccctgagcagtctgcagagagcagccatttcacca

SEQ ID NO: 6834390 - DNA, 57 bp, Homo sapiens
aatcattgagacaaattagctttaatgtttacatgtgagttgagagtcacgatgatt

SEQ ID NO: 6834391 - DNA, 59 bp, Homo sapiens
gagatgtaagaggacttcaggatgcacagtgccctttgaggtccctgccttgccttctc

SEQ ID NO: 6834392 - DNA, 70 bp, Homo sapiens
aggtaagcgctattatgatcttcattttccacaaggaatctgagtcacagaccatgaaagtaacttgcct

SEQ ID NO: 6834393 - DNA, 64 bp, Homo sapiens
tggaagcagtatgcagtctttctgaccaattacagatgaaaacttgtgcatgcttttgtttcca

SEQ ID NO: 6834394 - DNA, 58 bp, Homo sapiens
cctttcatttctttgctgtcaccgaaaacccatctatgggtgctcagagaaatcaagg

SEQ ID NO: 6834395 - DNA, 83 bp, Homo sapiens
ctgataatagttatgtgaggtagataggatgcagaataaattttccgtttgtaaccacgtctccctcattttaatatttctag

SEQ ID NO: 6834396 - DNA, 63 bp, Homo sapiens
gcagtgttacttggagtactaatggcccaggtggcctcaatacagcatttcaaataactctgc

SEQ ID NO: 6834397 - DNA, 82 bp, Homo sapiens
atttctctaagcatccgtttgctcatctacattggatgatccatcatccaatgtagatgagcaaacggatgcttagagaaat

SEQ ID NO: 6834398 - DNA, 73 bp, Homo sapiens
ggtcagtctgtaatgggttttaaaatagttacatgtgtaataggtttttataaaccttattagagattgagcc

SEQ ID NO: 6834399 - DNA, 94 bp, Homo sapiens
aaagttcaattatttagaatcttaggtcattttctagcctgaaataaatgaacatttcagttagctgagacccaggatttaccaataggagttt

SEQ ID NO: 6834400 - DNA, 109 bp, Homo sapiens
tcccatgtgatggacaaacactcagaacccagcagcagtgttctagaatctttgtgagggacaaacattcagaatcttgtagcagtgttctagaatcctatttatggga

SEQ ID NO: 6834401 - DNA, 63 bp, Homo sapiens
taatgcttctgttaggatcttctttatattaccaaaattgaagaagctggaagaccagcattg

SEQ ID NO: 6834402 - DNA, 83 bp, Homo sapiens
tggagaaggcaggcagagaatggatgggggccggcaggtcagggagagtgacccatccactcgctgcctgccttgtacctctg

SEQ ID NO: 6834403 - DNA, 63 bp, Homo sapiens
gggtggatgtgcaggatccaggctcctaggccctagcttgggtcctgtctccttgttctgcct

SEQ ID NO: 6834404 - DNA, 89 bp, Homo sapiens
ggaggagcaagctcaccctgtgggttttcaagatgctaatttaatcttcgttgtttgtacttgacagaaaccacaaagcttgtttatcc

SEQ ID NO: 6834405 - DNA, 126 bp, Homo sapiens
gaggatcatcactaccactggacaccagagctgaatccatggaaggtgctgcttaactccagggaggccctatctgccttgcctgcagcgtctccagcaggaagctctcagtgtatgatccacctc

SEQ ID NO: 6834406 - DNA, 88 bp, Homo sapiens
taataacttttctaaaacatcctacctacaatcttgtgtgcaaattggtggctcaattctgcaactgttgttggtggtgttgttgtta

SEQ ID NO: 6834407 - DNA, 58 bp, Homo sapiens
ggtcctctggtgaaagcattcccccttttggaaatgggatctgtaaacctggagaacc

SEQ ID NO: 6834408 - DNA, 85 bp, Homo sapiens
agagagaggtgggcagtgaatattggtgggaaaagacatagtaacaagaatttcaaggcaatgttcacgccaaaacttaactgct

SEQ ID NO: 6834409 - DNA, 60 bp, Homo sapiens
aatttctattcaaatatgagctctattttgaataaaaggggctacattgtgagagaagtt

SEQ ID NO: 6834410 - DNA, 58 bp, Homo sapiens
gtaggacagcccttgagagcacatttatcccaatggcttttggtgtgttgtcagatgc

SEQ ID NO: 6834411 - DNA, 79 bp, Homo sapiens
gtcttcccagagagtgctcagctattggtgaagcaggcatcgtctattcttcaagaagacagcagagcatcaggaaaac

SEQ ID NO: 6834412 - DNA, 74 bp, Homo sapiens
gggttgttcaaagacttttgacttgagttctgcagcaatcaagcactcaaggctcacagttcaagatgaacccc

SEQ ID NO: 6834413 - DNA, 74 bp, Homo sapiens
gctcagctggtccagggtgtagtacagaggcacctgtgggagctcctcagtcatgacgctcaggaccctctggc

SEQ ID NO: 6834414 - DNA, 70 bp, Homo sapiens
tgcactaaatttttactcttgttttcaagttgattgttaatgtcctgtgaaattgtagagattttgtgtg

SEQ ID NO: 6834415 - DNA, 93 bp, Homo sapiens
ttgaagcatttatagccttatagggtagaattatgtacttttgttattggtacataaaatactgccatgtatttcttttatatttgattttaa

SEQ ID NO: 6834416 - DNA, 73 bp, Homo sapiens
cagtgttgggtctttagaatttatttaaaaggtaacacggtacctgctcttggtttgtgaagactttcacctg

SEQ ID NO: 6834417 - DNA, 64 bp, Homo sapiens
gctttgtatttgctggagatatggaaaagtttagcgacaaattttctagtaatcaatataaagt

SEQ ID NO: 6834418 - DNA, 65 bp, Homo sapiens
ttatgctgcagcatattgtactggcctgctgctggcccgcaggcttttcaatatgtttggcatgg

SEQ ID NO: 6834419 - DNA, 62 bp, Homo sapiens
tcagctggcatcggctcacccacacaccccaccctggtaccaggaggagccaggtgccttga

SEQ ID NO: 6834420 - DNA, 58 bp, Homo sapiens
gggagcgcgccacaaggagcggcggggggctggtctgctgcccgcttggcacgctccc

SEQ ID NO: 6834421 - DNA, 76 bp, Homo sapiens
aacagcagcagcacggatagttcagctaaatacttctgtatttttagctgaaaaaattcatgcaaggctttctgtt

SEQ ID NO: 6834422 - DNA, 66 bp, Homo sapiens
caagttctgcagagatttttatgcacaccaatttattggtaggcttggaaaactttgctaaaaatg

SEQ ID NO: 6834423 - DNA, 86 bp, Homo sapiens
ggctggtttagacatttctggttattgacaggccttactgcggcttcccccaaatgaatgaggaatatatttttctaaatccagcc

SEQ ID NO: 6834424 - DNA, 64 bp, Homo sapiens
catggttgtacagcattccatataggtgtacttcatttgttttcattgctgtacaatattcatg

SEQ ID NO: 6834425 - DNA, 79 bp, Homo sapiens
agtaaatacccagtgagactgtcttggtgaatggataatagtagctaacatttatgaagctctcactgtgtgtcaggct

SEQ ID NO: 6834426 - DNA, 101 bp, Homo sapiens
gcaattttcattcctctttgacacagatatttgtagtgggtaagaagttatttggcttattattacactgggaatttgttagaacagagtaatgacattgt

SEQ ID NO: 6834427 - DNA, 84 bp, Homo sapiens
agatagctgatatgttttatacatttatattgcatttattcatctgtgcagtaatgtcatggagccatatcataaatgctattt

SEQ ID NO: 6834428 - DNA, 61 bp, Homo sapiens
agttaactattttaagattgtttttgaataacatcaagtgccagtcacactgtagttgact

SEQ ID NO: 6834429 - DNA, 55 bp, Homo sapiens
cgcccaaaccccatgccctctggactatgcatcttaaaggtcatggtcatgggcg

SEQ ID NO: 6834430 - DNA, 65 bp, Homo sapiens
ccacctctcagggtttcctaatgcaaatccttgaaccctgcagaagtaagcatccagagaggtgg

SEQ ID NO: 6834431 - DNA, 109 bp, Homo sapiens
gttgtgacttctaccccatcttgcactgaatctcaaggggagggttcaatgacggacaaatcttcaggctcttgtgcagaatcagagagaaaggggaagtggagacgac

SEQ ID NO: 6834432 - DNA, 85 bp, Homo sapiens
ctcagggctctggaccccttcccctccgcccccgcagcctctgccaggaggtgggagttgggtgggagacttccagggccctggg

SEQ ID NO: 6834433 - DNA, 70 bp, Homo sapiens
ccaggtccagctgggccagggcactcatcccagtctatggggagagtccaccttggctccagctggcagg

SEQ ID NO: 6834434 - DNA, 89 bp, Homo sapiens
tctaatgcccatggtggcaagcagttcgcagcccgcctccttcctcagggcaggtccggtgtgtctgtttacctcaggatccaattaga

SEQ ID NO: 6834435 - DNA, 76 bp, Homo sapiens
ttctttctattaccagggggagtagaaaaatgaataaatcctatccataccactacttccctttcactggagtgag

SEQ ID NO: 6834436 - DNA, 119 bp, Homo sapiens
actgggtcttacgaaagacaataatagatttcataagtgacaatcctgggcctaaatgtctcagagattttgggaataattgcacagatttctcaccttgttgtttttctcttcctagt

SEQ ID NO: 6834437 - DNA, 80 bp, Homo sapiens
tatatataatacttgctgtgggcctgttatgcttaagtttagttgccaataataataaagttcatggctgattgtatata

SEQ ID NO: 6834438 - DNA, 80 bp, Homo sapiens
cagaggggatggtgcatactggcagaacgggccctctgggcctgagtctttcccattgcgctgggtctcagttccccctg

SEQ ID NO: 6834439 - DNA, 59 bp, Homo sapiens
ggctctgagtttagaagggtggggagaaatctatatccctcagtctcttggtcagagct

SEQ ID NO: 6834440 - DNA, 116 bp, Homo sapiens
acatgtggtcagaggaggatgcatgacttgggaggatgtctgccctgtgacctgagggaagactaagaattcagggcatgtctgatggcccaagtcatcccgctctgaaggtgtgt

SEQ ID NO: 6834441 - DNA, 59 bp, Homo sapiens
ctcaaagtttttgagaattacatgacataatgcatgtaaattgctcagtaaacttttgg

SEQ ID NO: 6834442 - DNA, 80 bp, Homo sapiens
ggtttgaaagtcaggatgtcagcattggctagagttgagctcagggtttctagaatgctgcatcttagctttcatcagcc

SEQ ID NO: 6834443 - DNA, 114 bp, Homo sapiens
agatggtggtcaaaaatatggccggatgagcagactgggagtcaggaagaagtgtttgcaatgacttctgacttctctcttgtttacttctcctttcacttttaaccccccttt

SEQ ID NO: 6834444 - DNA, 55 bp, Homo sapiens
ctaaacacccctttgacattacgtgcgccagctcctgaacactggggtgtttcag

SEQ ID NO: 6834445 - DNA, 79 bp, Homo sapiens
aagtgttctcctgaggacccttaggtcagacagagaagctttctctttctgatgggaagggtcaaagtggaaatctctt

SEQ ID NO: 6834446 - DNA, 73 bp, Homo sapiens
gaaaaagctaaggaaactttgtcaaaggcgtcccagcttctttcctggaaagctgacaaagtcccttcttttc

SEQ ID NO: 6834447 - DNA, 84 bp, Homo sapiens
atgttaagagacagtgcaggaaatctaaaaaatcatgatttagctataaacttttttagtattctgagtttattgttttgacat

SEQ ID NO: 6834448 - DNA, 123 bp, Homo sapiens
gtggggctttctttccccagatctcaggtgaaacttctaggttgacagcaaaatcctcctttcatttataaatggactatgtttgctctggaagcatctgagaggataaatatgggatcccac

SEQ ID NO: 6834449 - DNA, 73 bp, Homo sapiens
tagagccagagagctattccaagaggagtcaacatttctcttcaaggaagaagtggctttgagtcaggttctg

SEQ ID NO: 6834450 - DNA, 96 bp, Homo sapiens
gtctcaaatcaagaaaaatatatttgatatcagtgtttccacaggatagatgaaaaacatagataatagatagatgatgttgttgttgatgaagat

SEQ ID NO: 6834451 - DNA, 62 bp, Homo sapiens
cccgggcgggtttccatcgctgggggtggcctggtacccccaaagctgagttcccgcctagg

SEQ ID NO: 6834452 - DNA, 57 bp, Homo sapiens
agtattgcatttcccacgttcactcctgaaggtagtgagacaggtaaggtgaatact

SEQ ID NO: 6834453 - DNA, 85 bp, Homo sapiens
tgagggcagagggagtaagggagatactttagcccctcagagcatctctaagtctggattttctacccttctctcatttgcccca

SEQ ID NO: 6834454 - DNA, 67 bp, Homo sapiens
gcattcatacatcaataagctttgcatgctgacacctaattttgcaggctactttggttatggaggc

SEQ ID NO: 6834455 - DNA, 87 bp, Homo sapiens
caaacccaaatgatggggcttcagttactaaataaagactcactttatcttacttatgctgatgtccaggagtgttattaaggtttg

SEQ ID NO: 6834456 - DNA, 84 bp, Homo sapiens
gtttctaagaaattcatgtggattcctgcttagaaaatttcatatgggctttctgtggagggaattatgtgaatggtgggatgc

SEQ ID NO: 6834457 - DNA, 75 bp, Homo sapiens
agatgcccaaactgacattggcagttctaacctctttcctgagctccaggctgcctgatgtccagcaggacatct

SEQ ID NO: 6834458 - DNA, 78 bp, Homo sapiens
ttggtgccacacttagactaccagactccctgaaactgcatgtcctcagggagtctggcagtctaagagtggcactaa

SEQ ID NO: 6834459 - DNA, 118 bp, Homo sapiens
ggcttgtctttgtgggagatggagaagatagagtgataaattatatgccacttcttaaagcttatgcctgaaagtgacacatggcacttctataacatttcactggccaaaacaagtc

SEQ ID NO: 6834460 - DNA, 125 bp, Homo sapiens
gtatacaaatttagaattaaaatgttttctatttttttcatgattaacttagtgaataacttaaatccttaatcctcgtagtggttagaaagatgaggagacttttttgacttacatttgtaaat

SEQ ID NO: 6834461 - DNA, 89 bp, Homo sapiens
gttggcctccggctcagctgggcttgccccaccagagctccaggtttccatcccccccagctctgcagcccagcaggtgggattccagc

SEQ ID NO: 6834462 - DNA, 76 bp, Homo sapiens
tctgggagtaagactctattctaggtagaagcaattatattgcacataccccaggaatggtagttctgattcaaga

SEQ ID NO: 6834463 - DNA, 76 bp, Homo sapiens
ggtggtgctttgcaacctcataggacttgaacatagttcaaagctaggttaaaacctgtggtggaaaaagcccacc

SEQ ID NO: 6834464 - DNA, 126 bp, Homo sapiens
actgtgcaaactagaagacctgtgtaatcatttaatcacatagccatctctttgagaagataggatttagttatcatcaaagtgagtggctacatgaaggattgcattatttatgttagcttaagt

SEQ ID NO: 6834465 - DNA, 57 bp, Homo sapiens
cgcggctcctccctgcctgggcagtgaccattgctaggggctggcgtggagcctgcg

SEQ ID NO: 6834466 - DNA, 63 bp, Homo sapiens
cctgattcctgctttcttcgtcatctaataagcccagatttctagaaggagagctgagttagg

SEQ ID NO: 6834467 - DNA, 62 bp, Homo sapiens
ccaccatctatagaggtatttggttgcatttcttgcctttattagcccacatggaatggtgg

SEQ ID NO: 6834468 - DNA, 98 bp, Homo sapiens
ccttaaacacattttcagcccagttttatcatctgtaaagtggccccagagaacttgtaatagaggtgaaatagggtgtatggaagtgtgtggaaagg

SEQ ID NO: 6834469 - DNA, 78 bp, Homo sapiens
ctgctcccagggcacgggtcctcagggaatgtccacaggaattaccactgcaggcttcctggggcctcctgcaagcag

SEQ ID NO: 6834470 - DNA, 101 bp, Homo sapiens
gctttgggaggttttgttcatgctgtgtggttagaactgtttctatattgatctttttttcagcagtgctacacctcatacagcctaaacaccactaaagt

SEQ ID NO: 6834471 - DNA, 76 bp, Homo sapiens
cagagctcccagcagaccgctgtgatggccgcagtgctttctgaggcctaatttcagtctctgctgtatgtctctg

SEQ ID NO: 6834472 - DNA, 83 bp, Homo sapiens
gactgctttggtgctagttgtttttcagtttgttgtatctaaactccataagctggaggataactcacttctcttagtatgtc

SEQ ID NO: 6834473 - DNA, 57 bp, Homo sapiens
gaaactaatgattgtagatttgtgggtttctaacccaaagcaatattcatcagtttc

SEQ ID NO: 6834474 - DNA, 99 bp, Homo sapiens
gacaatagatttgcatgttctagcaggcaaaagctcggcatttgcattgaaatccagctcaccgtttgccttctgggcattatgctaaattatagtgtt

SEQ ID NO: 6834475 - DNA, 64 bp, Homo sapiens
gagggaaagctccccgaaacccacctctgaggtggccaaggagaatgggcaaggggagcctctc

SEQ ID NO: 6834476 - DNA, 66 bp, Homo sapiens
tcaaagattaggtttacctacatagctattgagttcaccaacagttatggctagactagtttttga

SEQ ID NO: 6834477 - DNA, 96 bp, Homo sapiens
tgagtgattaacatgttggcttgattctcagccagtctctgtcctcatggtggcaagatggctgcagcaattccaaccaatactcttccaagctta

SEQ ID NO: 6834478 - DNA, 69 bp, Homo sapiens
ctcctctgctgtcccttccacagtgtctggtggaagtgctaatgacagggaaagggacagcagcaggag

SEQ ID NO: 6834479 - DNA, 56 bp, Homo sapiens
catatgtgtgtgtgtgtgtgtaatatcctactgtgggatccacatatatttatatg

SEQ ID NO: 6834480 - DNA, 56 bp, Homo sapiens
tccagagcctttctgcttgacatccttcctctctgggtacagagcagggttctggg

SEQ ID NO: 6834481 - DNA, 63 bp, Homo sapiens
aggatacctgcttaacattgccatgacatttgtaaagtgtcatggtgctgttgggagtgtctt

SEQ ID NO: 6834482 - DNA, 75 bp, Homo sapiens
ttttacacagaatttggtagttatttttggtaaataatttttacagaggatgtttgatcaaattaaaatgtaaaa

SEQ ID NO: 6834483 - DNA, 79 bp, Homo sapiens
gctgaagctgagcatttgccggagcgtcatggggatgatgaatgacccgtaggcctttgaagtgctctgccagttcagc

SEQ ID NO: 6834484 - DNA, 61 bp, Homo sapiens
gtctgttggttatacatcaactcagtaaatacttacagaacaacaaggtggaccagcggat

SEQ ID NO: 6834485 - DNA, 64 bp, Homo sapiens
tcctctgagcatattgtctacatttcagaataagcataatgaataaacaaggttgctctgagga

SEQ ID NO: 6834486 - DNA, 74 bp, Homo sapiens
gtcctccctagcctccctagctgcaccttctacaggaccctttggagggtgcaggggaagctgccctggagggc

SEQ ID NO: 6834487 - DNA, 129 bp, Homo sapiens
tatgttttgtaagattttatttcattcaacattcaaccaacatttatgaatcacctctatgggacaggtgctgtgtgaaattttggtggtgtatagatgaataaaaatggtgccttgtcttcaataata

SEQ ID NO: 6834488 - DNA, 83 bp, Homo sapiens
gcgggtccagctttgaatatgtgcttgttaaattgtctgtgtgaggagccgaggggcactgttcaataggtagctggatatgc

SEQ ID NO: 6834489 - DNA, 57 bp, Homo sapiens
tgacccttcccctctgggttctgagtcgcctcggaaggagtgggaggtgaggggtta

SEQ ID NO: 6834490 - DNA, 70 bp, Homo sapiens
gtaagaagcccagggctaataggaaccagagaatatttagttctgggtgttctgggtgatcttttcttgc

SEQ ID NO: 6834491 - DNA, 76 bp, Homo sapiens
caagacccctggcttctctgcattgttctagcttctgatccattcagggaacatgaggagagcccttggggtaatg

SEQ ID NO: 6834492 - DNA, 77 bp, Homo sapiens
gaaatcaaagcatcagcagggccatgctctctctgaaggctttagagaagtatccttccttgctgcttcctagtttc

SEQ ID NO: 6834493 - DNA, 78 bp, Homo sapiens
ttatttaggctctctgcaactaagtattttcacgactgagttcttgcttcaaaaagttgttagaggaaagttaaataa

SEQ ID NO: 6834494 - DNA, 69 bp, Homo sapiens
ctggtaggtgatgtccctttaaggctctttaacataagagcaatgaaatgaaatcagtcttaaaatcag

SEQ ID NO: 6834495 - DNA, 71 bp, Homo sapiens
tcactcctcaggctagcatcatctgggggccgcatacacatctggtaaattgatgttgacctaagtagtga

SEQ ID NO: 6834496 - DNA, 59 bp, Homo sapiens
tgaattcttcccctgcaccaacccctagacccctgcgtggctggacagagaaggactca

SEQ ID NO: 6834497 - DNA, 87 bp, Homo sapiens
gtcctgatagcaggcatggctttaggcaggcgtccccaggtccgagaaggagagcccccatcctagccagcctgcggaactcgggac

SEQ ID NO: 6834498 - DNA, 75 bp, Homo sapiens
tttctattaggttggtgcaaaagtaattgcggttttgccattactttcaattacttttgcaccaatatacagaag

SEQ ID NO: 6834499 - DNA, 66 bp, Homo sapiens
gcagaggtgcccatctaatatgtactgtgttgagccattcaacacatgttggtgggtcaccttggt

SEQ ID NO: 6834500 - DNA, 55 bp, Homo sapiens
gcttaggttagctggcatttaaagggtttctttcaaaatgcagttctgccttggc

SEQ ID NO: 6834501 - DNA, 64 bp, Homo sapiens
ccagaaatgcagtggttctacttctcagctgaagttcatagagaggtagaggatactgtgatgg

SEQ ID NO: 6834502 - DNA, 88 bp, Homo sapiens
gttagttctttactgtgtccatctgtgacttctggcatttacccggttagtttcattgcagtggacatgcatgtggtttaggaaaaat

SEQ ID NO: 6834503 - DNA, 59 bp, Homo sapiens
actggaattaggtttgtatacagtccttccattttaatgtatacataccgcattccagt

SEQ ID NO: 6834504 - DNA, 66 bp, Homo sapiens
attgagaagaaaatctaatatatgataaagcagctgtttgaaaccgtatgtgattttctcatcaat

SEQ ID NO: 6834505 - DNA, 64 bp, Homo sapiens
tgttttcttccttttaggtctgttatgcttctgttattggcaggacagccagaggaggcagaca

SEQ ID NO: 6834506 - DNA, 73 bp, Homo sapiens
gacttagcagtttagaatatgtctcaatttttaaaatatttgttgaaatgatttactttagatctgttgggtt

SEQ ID NO: 6834507 - DNA, 76 bp, Homo sapiens
agaaagagcggctggcagcttcatcccagatttatagattgtggagctggaggtgtcagaaaaaaagttacttttt

SEQ ID NO: 6834508 - DNA, 64 bp, Homo sapiens
tattcctggctcggcttggggacttctgcggctgccggggctccaaggaggccagcctggaatg

SEQ ID NO: 6834509 - DNA, 75 bp, Homo sapiens
atgtgcgcacgattcacctgaagcacttgttatacagtctgatgtaggaggtcttgaggggagcggggcgcagat

SEQ ID NO: 6834510 - DNA, 55 bp, Homo sapiens
tagatccagctgttatgttatggccttggaggacatattcaccagttgtgatcta

SEQ ID NO: 6834511 - DNA, 61 bp, Homo sapiens
gcagatgcttggcactgacagtatttgtctcattgtggaatggtcagggctaatgtcatgc

SEQ ID NO: 6834512 - DNA, 98 bp, Homo sapiens
ggggctggtttggggcccctccagccccttcctggcatctggagcagcatctccagagggcgatggctgggggcggagggaacttgccaaccagcctc

SEQ ID NO: 6834513 - DNA, 71 bp, Homo sapiens
ttatggatcttggattatgtttattcttcatgacaacctgctgtcatttaatagatatgatgggtctttaa

SEQ ID NO: 6834514 - DNA, 86 bp, Homo sapiens
ggccccaggtggtgctgagagaagagcgcagtttgtttttggattctataacaatttgtgtcttttgcttattcaccagctgtgtc

SEQ ID NO: 6834515 - DNA, 117 bp, Homo sapiens
gactggtatataaaataaagttgtccatttcagacaccctttgtcttcaaggaaagctgtctaggtggcccatgggtggcaaaggcgctgaaaggaaatggaaattgataatcggtc

SEQ ID NO: 6834516 - DNA, 69 bp, Homo sapiens
gcagagactgagggcagctgcaggctaccaggaattgctggcagtgaagctgtctttaggtttttctgt

SEQ ID NO: 6834517 - DNA, 62 bp, Homo sapiens
gttgtggagtggtctgagctgccaggagtttaaacccggattctccaggccattcccagagc

SEQ ID NO: 6834518 - DNA, 69 bp, Homo sapiens
tcccttgagccaggttggaggctgcagtgagctatgatcgtgctactgcactccaacctgggcaatgga

SEQ ID NO: 6834519 - DNA, 73 bp, Homo sapiens
tcagtttcctcatctgtaaaatgaagatgataataatatctgcctcatttgagagactgaggacaaaacatga

SEQ ID NO: 6834520 - DNA, 58 bp, Homo sapiens
cttagaaggatgtttgctgtttcctgtaacagtgttgaagaatccatccttatctgag

SEQ ID NO: 6834521 - DNA, 72 bp, Homo sapiens
tttagagatttgtctgatagtagaatgtgaaaattgaatgtcttaattatttatttcagaaaggtttctaga

SEQ ID NO: 6834522 - DNA, 65 bp, Homo sapiens
ttcctggcctcaagtcctcctacctcctcagctttctagaggtatttggactacaggcacaggga

SEQ ID NO: 6834523 - DNA, 58 bp, Homo sapiens
tggttttcacagtaaatgtgtagggtgtatgttacttacagtaggagttggaaaacca

SEQ ID NO: 6834524 - DNA, 73 bp, Homo sapiens
cctgtgaactcagtctctcttgctacagttattccaaggtggtgaaaagaggggtgagttgactgttcacagg

SEQ ID NO: 6834525 - DNA, 77 bp, Homo sapiens
tgctacaataagtgattgactgaattatccccatcctccaaaaatggtgtgtgattcataaaacactagatgtagca

SEQ ID NO: 6834526 - DNA, 70 bp, Homo sapiens
cctgcatggctgcaagaacctctggatcactaagaatttcattgagtccaggcattccagccattccagg

SEQ ID NO: 6834527 - DNA, 62 bp, Homo sapiens
aacccaggccttgacctcattttcataaattccaaatttagtgaggtccatgttaatgggtt

SEQ ID NO: 6834528 - DNA, 75 bp, Homo sapiens
tgacaagtgacaaaagggtatccaaagcatgaatccagtagaaggactttttagaaaccctgtttgcattggtta

SEQ ID NO: 6834529 - DNA, 69 bp, Homo sapiens
ggtgggctggaagtgcattgatgcttcagggcagagaatcctcttggcaatggatgtgttccagtcccc

SEQ ID NO: 6834530 - DNA, 58 bp, Homo sapiens
gggagcagaagagggagctggaagaagaggaaagaacttccagtccccacttgctcct

SEQ ID NO: 6834531 - DNA, 96 bp, Homo sapiens
aggactctggaggccacagaaagttgtctagagtagagatatactacatctcctcctctctttagacatccagtttctctcaggtttctatttcct

SEQ ID NO: 6834532 - DNA, 80 bp, Homo sapiens
gaaggaaggccagagagagtactgggctctgagatagagatttccgttccagcatttatgtatttttctagttatctttc

SEQ ID NO: 6834533 - DNA, 94 bp, Homo sapiens
attcctttcttgtgataattgaaatcatttcaattcatttccttcttggttggacagaaacatgttttcagtagtgagcaaatcttgagggaat

SEQ ID NO: 6834534 - DNA, 81 bp, Homo sapiens
aaaagcgatggggatcagaatttacttataattgttgttgttggcaatattatagtcttgttatgtttcaccattgagttt

SEQ ID NO: 6834535 - DNA, 75 bp, Homo sapiens
actaggaaggcatatgggcagactgggcattccacttctgaaggccaaaaattgtgatatgtgcagattcctagt

SEQ ID NO: 6834536 - DNA, 57 bp, Homo sapiens
ctgccctgactgcagctgactggcaggggcacctggaggcagcgggttcgggcgcag

SEQ ID NO: 6834537 - DNA, 74 bp, Homo sapiens
tgttcattgttgtgtctcagcaggtagcatatagtagatactctctaaatgtttgtgggataaacaaatgaata

SEQ ID NO: 6834538 - DNA, 55 bp, Homo sapiens
catgattatgtgttagagtttggtcagagtttacctaattcacagcataattatg

SEQ ID NO: 6834539 - DNA, 57 bp, Homo sapiens
gccctgtcagcacctaattcagcttcccatggagaaaggcctccctgttgacagggc

SEQ ID NO: 6834540 - DNA, 60 bp, Homo sapiens
gatacacatttgctagagatgggctgtaggatttattagccaactcagactaatgtgttc

SEQ ID NO: 6834541 - DNA, 70 bp, Homo sapiens
atcctggtcgctgtgtaggttcagctaggtcgcttggtatctctgagcctgtttactgacaaaaggggat

SEQ ID NO: 6834542 - DNA, 89 bp, Homo sapiens
catagctcccataagattctaaaatagttccatagttcaaaaacaatagctaaggacagttgatttagagcatctaatgattacctatg

SEQ ID NO: 6834543 - DNA, 57 bp, Homo sapiens
ttcttccaaagcttccaggagaggacccttctttgcctcttccagcttctggtagaa

SEQ ID NO: 6834544 - DNA, 56 bp, Homo sapiens
gctcagatgcccacactggaaatgtcactcttcatgtatcagctgggtttctgggt

SEQ ID NO: 6834545 - DNA, 60 bp, Homo sapiens
gagaggtaacagttgtgttttgtacaggccaagagaaagacagcttagagtttgcctctc

SEQ ID NO: 6834546 - DNA, 86 bp, Homo sapiens
tcaggaatagataaaaggcattcatcaggcagccaggcccaattatcatgtcacgctgaatgaatgtattttaaaatcttttctga

SEQ ID NO: 6834547 - DNA, 77 bp, Homo sapiens
caaacccaggaagcctgcaggtgactgctcaccagagggcgatctcacacagcaaacctgcagccttctgaggtctg

SEQ ID NO: 6834548 - DNA, 64 bp, Homo sapiens
tagttaagcagtttttcaactgtttaggttgtagaaatctgaactctttatgacagcttggctg

SEQ ID NO: 6834549 - DNA, 79 bp, Homo sapiens
gtctagacaggtgctgactatgcaatgcagtatttattattacagatctgtcagattactggtgggaccgtgtcaggat

SEQ ID NO: 6834550 - DNA, 69 bp, Homo sapiens
gccagatctagtgttgtaaagcttttgccatacgttttcttctaacagttttacagttttagatcttgt

SEQ ID NO: 6834551 - DNA, 58 bp, Homo sapiens
tgtgaagatattgtgatcaggtgaatattggaaagtacactttaaaaatatctttata

SEQ ID NO: 6834552 - DNA, 72 bp, Homo sapiens
gatgacactgctcttatgaccaaaggaatgtgagctcgtatattcttttagaatttcctaaggtaggttatt

SEQ ID NO: 6834553 - DNA, 71 bp, Homo sapiens
atgcttccctaactgcaaagccaatctcaggagttgagtagctcctgaaagaagctttgagttagaagtat

SEQ ID NO: 6834554 - DNA, 56 bp, Homo sapiens
ctcctctggaaattcctctgccctgtgactgtctacagggggcatgaccagaggag

SEQ ID NO: 6834555 - DNA, 73 bp, Homo sapiens
tttagcagctcacagcctcccattgaggaaagggtaatgttgattctggaaatggaggcttgttctggttaag

SEQ ID NO: 6834556 - DNA, 99 bp, Homo sapiens
cctgaatttcttattgttgatgaatatttgttaatcctcctgaagtgggctgaaatttcaggacaaagggtaacaactgggacaaccagggaattgggg

SEQ ID NO: 6834557 - DNA, 65 bp, Homo sapiens
tgggatgcttgatgggagcgggtaggcatttgtgccttcattctgtacttttattttggcactca

SEQ ID NO: 6834558 - DNA, 76 bp, Homo sapiens
atgtattattgacagtagagcatttgttttgatgaggcatcaatgacagttgaattctacatttgacattttacat

SEQ ID NO: 6834559 - DNA, 60 bp, Homo sapiens
aaaagttcatgacatcctcttgataaggagttcttattctgggttcatgagtgagctttt

SEQ ID NO: 6834560 - DNA, 79 bp, Homo sapiens
tctgaatacctgaggcaaaaacactgattaggctgtgtccccctgttagctttgtggggtctttcctcaaatcctcaga

SEQ ID NO: 6834561 - DNA, 64 bp, Homo sapiens
ctactccaagggcagccatagaacttccagatggttgggggaaagtagtagcctttggagtcag

SEQ ID NO: 6834562 - DNA, 116 bp, Homo sapiens
gctcttgatagctgctgtgatagctggatttaggacgctatccctgcctgtggggctgtttgaaccatcttgtgggcagcctgctttctgatccagctgtgaagctacccagttgc

SEQ ID NO: 6834563 - DNA, 87 bp, Homo sapiens
ggaggcctgaagtccaagatcaaggtgtcagcaggcttggtttcctctgaggcctctctccttggcttgtagacggccactgtctcc

SEQ ID NO: 6834564 - DNA, 92 bp, Homo sapiens
ccgggcgcggtccccgcgcggggctgggggcacacggaccgagtctccgcccccttgttctctgcgctcccggcccgggaagccgtgcccgg

SEQ ID NO: 6834565 - DNA, 60 bp, Homo sapiens
ggaagtattcaatcctgccacatttctgcatacttatagggagaaaggatggatactttc

SEQ ID NO: 6834566 - DNA, 71 bp, Homo sapiens
tgaagacattgcatgataatgctgcaaccataaaatgaaatattatgtagctgttaccagttttgtcttca

SEQ ID NO: 6834567 - DNA, 71 bp, Homo sapiens
cagtaatcaaaagatgtctcactcagttctcataaaaatacaatgaggtcacagtgtttggcattttactg

SEQ ID NO: 6834568 - DNA, 56 bp, Homo sapiens
cgcggcggccggcgctcaccatgcagtcccggcctggccagcgccggctgctcgcg

SEQ ID NO: 6834569 - DNA, 129 bp, Homo sapiens
cagtgagctatgattgcaccactgcactccagcctgggtgacagagcaagaccctattttatgttttttgagtcaaagtctcgctctgtcgcccaggctgcagtgcagtggcatgatcttggctcactg

SEQ ID NO: 6834570 - DNA, 112 bp, Homo sapiens
caggcttggttccttctgaggactatgagggaaggatctgtttcaggcccctttccttggcctgtacatggccatctttaccttcatggtcttgtccctatgtgcatgcctg

SEQ ID NO: 6834571 - DNA, 74 bp, Homo sapiens
atttcaaagtgatgtgggagagtatagctaggggaattaactagtccatggcatggattcacacactttagggt

SEQ ID NO: 6834572 - DNA, 68 bp, Homo sapiens
agcatttagagcagggtgtggcacatctcaactctaaatgaatgttacctgctcctgctgctactgct

SEQ ID NO: 6834573 - DNA, 75 bp, Homo sapiens
ctcgcgcctgcgccatctcccggaaaaatttcgcgccacgcagagatgacagccaaggagatgaaggcgaccgag

SEQ ID NO: 6834574 - DNA, 84 bp, Homo sapiens
gtgccttttagttcctttagtgtttgtcttaattgatttttttaaagtagttttatgttcacagaaggattaagctgacggtac

SEQ ID NO: 6834575 - DNA, 127 bp, Homo sapiens
ctcatttgctgaggtgatgggagttcaccaatgcatcccttcacagatgcgatgtttatattgagtacacatttatcttctctgtgcaggagatgcaaagtcaaatcccttcagttggccagatggg

SEQ ID NO: 6834576 - DNA, 121 bp, Homo sapiens
ggaaaataaaatattgccagtctctttagtcattgtatgaagtgtactcattaaagggttacctcttaagctgagcccagagaacagtcagtacaatgaaaggtatggcaaccaattttcc

SEQ ID NO: 6834577 - DNA, 57 bp, Homo sapiens
gttaacaatgaggatctgttctgaggagtgcatccttaggcgatttcatcattgtgc

SEQ ID NO: 6834578 - DNA, 55 bp, Homo sapiens
ttctacctgagctaggagggaaaatgtgcctttccagcagccaagaagggtagaa

SEQ ID NO: 6834579 - DNA, 86 bp, Homo sapiens
gctgtgtaaacatcagcgcagaataagtgtgtgctgggtaaagttgggccaatatacaactttatctgtaatgagtgaaatgcagc

SEQ ID NO: 6834580 - DNA, 55 bp, Homo sapiens
ggctgcagcagagggactcacgggggtgtgcaggttctgaggcctctgctgggcc

SEQ ID NO: 6834581 - DNA, 58 bp, Homo sapiens
gctgggagaggccctgaagtgactcattttccatttgtttttcagactcatctccagc

SEQ ID NO: 6834582 - DNA, 63 bp, Homo sapiens
gcatgtgtgctgtgcatgcacatatgtgttgtacatgcacatatgtgttgtacatgcatgtgt

SEQ ID NO: 6834583 - DNA, 68 bp, Homo sapiens
agtttacttgtaaacatagagatttaggttggagttccatttattgtcctctgtgtttacagttttct

SEQ ID NO: 6834584 - DNA, 70 bp, Homo sapiens
taggcttactggttgagtgaccttgggaaaattatttaatctctaaattggtctcttcatctgtaacctg

SEQ ID NO: 6834585 - DNA, 70 bp, Homo sapiens
ttctaaaaggcagatgactgaggtactcgggggaatcaaagagaaatgttcttcatttgccatttgagaa

SEQ ID NO: 6834586 - DNA, 69 bp, Homo sapiens
cctgagctgtcctcttggactcagggctgcggtgctgtgaccagcccatccatggaggccagccgcagg

SEQ ID NO: 6834587 - DNA, 76 bp, Homo sapiens
tacaaataattgctctgatataaaagtgacattcatttgaaaatattgaagatcagttttgtgtctgatatttgtg

SEQ ID NO: 6834588 - DNA, 69 bp, Homo sapiens
tgtaaacagtgccagtgcacagaacctttatatattttttgaagccagtactgtgctctgcatataaca

SEQ ID NO: 6834589 - DNA, 56 bp, Homo sapiens
taagagaactggatagataggatagataaaaggattcttgttaaacagggctcttg

SEQ ID NO: 6834590 - DNA, 84 bp, Homo sapiens
ggcttttagagaactgtggctttctctgcctccttcttggaatccacttaccatgttgagaggggcccaagccacatagaggcc

SEQ ID NO: 6834591 - DNA, 85 bp, Homo sapiens
ctcttgtatggatcacaatagacagcgcattaaaaatgtcaaagtactgaacaaatgtgattgtttctgaaatttaggtcagggg

SEQ ID NO: 6834592 - DNA, 78 bp, Homo sapiens
gggcccccataatcactatgcttatgtggcacagctcttcctatgtcacattgtaacagtgtgtgtatgtgggtgtct

SEQ ID NO: 6834593 - DNA, 106 bp, Homo sapiens
gagcaaattctaccctaaaaatgttctagtagttcacaggaagaagatgaggtttaataactttcaaggtaattctagattgacattttgaggggaaaatgggctc

SEQ ID NO: 6834594 - DNA, 81 bp, Homo sapiens
gttacaccagaatctctgtggggactccctgggggcatccccaggttttaaatgcttcctgaggtgattctaatgtgtagc

SEQ ID NO: 6834595 - DNA, 55 bp, Homo sapiens
gtccttatcacagggtcacaacagttcccatcagattttgcccctgggtgaggat

SEQ ID NO: 6834596 - DNA, 65 bp, Homo sapiens
cacctcgcctcatcatcctaattacagaaatcctaaggttagaatggagatggggctccaaggtg

SEQ ID NO: 6834597 - DNA, 102 bp, Homo sapiens
ctgccagttgggggactggctgaattttgcaaggcatctgtagaaccaaccctgggtgaaaacagcaaagtcttgaaaagtggccagtttgtcactgtgcag

SEQ ID NO: 6834598 - DNA, 73 bp, Homo sapiens
ctcacctcggctgcaccctgagaactctgccatcacccaagagacatctgcaggaggctggctgcaggaagag

SEQ ID NO: 6834599 - DNA, 119 bp, Homo sapiens
gaagacccttcctgccctgggccaagtttaagtacacaccatggcttagaaggtgggtgtgaggttcaggctttggtgatacttgctggcttgtttttttgggggttttttgggttttt

SEQ ID NO: 6834600 - DNA, 72 bp, Homo sapiens
gcacttagaggaccatgcagtcatcaccaagcattttgccaaagcttggaagtgagcagcttggtttgaggc

SEQ ID NO: 6834601 - DNA, 68 bp, Homo sapiens
gaacctgaagtttctgcaattttcatgtgcaaatggataatcagcactggatcttgggagacgtgttt

SEQ ID NO: 6834602 - DNA, 57 bp, Homo sapiens
acgcggcatcatcttgatttatggactgcacttccttgagctcaggaagagctgagt

SEQ ID NO: 6834603 - DNA, 71 bp, Homo sapiens
tgcgataaagtgcatgcaaattactgtaaagtattttacattaccatagcaacgtgcatgattaaattgca

SEQ ID NO: 6834604 - DNA, 69 bp, Homo sapiens
gaaggcagcccagagatgttatctagtatcagaaattacagttaaatatttctactgggtgtttctttc

SEQ ID NO: 6834605 - DNA, 71 bp, Homo sapiens
agtgggctgtaaataactggtaattggggtttttggtggacaaaattacctagttattttctctgcccgct

SEQ ID NO: 6834606 - DNA, 63 bp, Homo sapiens
gctccctgaaattcagatgcctccatgcagtgacctcaagtgatgcctgcatttcaggagagt

SEQ ID NO: 6834607 - DNA, 98 bp, Homo sapiens
ttcttgcattttacagttggtcatattctcactttatgagctgattttcagcttgcacagtttgaagatgactctggtgattgttaaatgaaaaagaa

SEQ ID NO: 6834608 - DNA, 79 bp, Homo sapiens
taccctgtttttcagttccatctctgctctgtcctatagctttataaaaccagagtgtgtggggctgaggtcaggagta

SEQ ID NO: 6834609 - DNA, 68 bp, Homo sapiens
ctgtgcaccagggacaatgctaggggtatacggctgtgaccaccatagtcactgtccctttctcatag

SEQ ID NO: 6834610 - DNA, 55 bp, Homo sapiens
tttatgggcatccagggggtatatgtacacagacagccagacctgagcccatagg

SEQ ID NO: 6834611 - DNA, 81 bp, Homo sapiens
tgttgtttttgttgtaagaatatgaatacaaatgttaatagagcacagcattgtgttaaaaatgttcttaccaagttaaca

SEQ ID NO: 6834612 - DNA, 56 bp, Homo sapiens
cattactatcaaccaggtcacagatgacgattgcttggaccaggaaggtggtggtg

SEQ ID NO: 6834613 - DNA, 71 bp, Homo sapiens
ggggtggtgccttaggtgatggctcagctggcactgcctcctggggtgccatcatcttcaggtgcagctcc

SEQ ID NO: 6834614 - DNA, 70 bp, Homo sapiens
ttcatagacttgagtttttggtatggctaaatttaattatatggtacatacaagcattcaattttatgaa

SEQ ID NO: 6834615 - DNA, 127 bp, Homo sapiens
agttatttacagtgtgaagagtgctctgagattgaatttctcagcatatcaaaaccaagtcagcctgttattgatggctgtgatttactcagtgagcaaaaatttctctactaacaatgttatatct

SEQ ID NO: 6834616 - DNA, 56 bp, Homo sapiens
gtggggagctgggaccatgctgggaaatccatcgcttcaaatctcagactcctgat

SEQ ID NO: 6834617 - DNA, 76 bp, Homo sapiens
ggaagactctaattaatcttgccttgatcacatcctgataccagaatcagttattctggctagattgatgagtccc

SEQ ID NO: 6834618 - DNA, 80 bp, Homo sapiens
ttttggtgtatggtgtgagaaaagtgtcaaattaattttttcataagtatgtacagttaatcttaagccatttatcaaaa

SEQ ID NO: 6834619 - DNA, 103 bp, Homo sapiens
tcccagtggcagcaacagtgcctgtggctgcagtggtgtacagagaaggggtcccactctgtgtacaagcctgagtacagaggccactctgccagttgtggga

SEQ ID NO: 6834620 - DNA, 69 bp, Homo sapiens
tggggctgctggggctcaggatggcaaagtttgcttttccaagaccttgtccatcccaggccctcccca

SEQ ID NO: 6834621 - DNA, 88 bp, Homo sapiens
gttcctcagtttgcagctgctgagctgctcccgctgcagcgacaggctctgcgtgctgcggcgcaggcactccaggctctgcaggaac

SEQ ID NO: 6834622 - DNA, 57 bp, Homo sapiens
caagccgacacacttccctttgaggatggtttgagggaaggagggactgtctgcttg

SEQ ID NO: 6834623 - DNA, 68 bp, Homo sapiens
attgaaaggcaaagtaggaagcaatttggttttttcctcccctctgtcacctgcttctgtctgccagt

SEQ ID NO: 6834624 - DNA, 83 bp, Homo sapiens
ttttcctttacttcttgtctcatgcctattcccatgcttgttagcatttccacctataggtgagcaacagaaggaagggaaaa

SEQ ID NO: 6834625 - DNA, 69 bp, Homo sapiens
gaaggctgtggctggtctcagtttggttactcaatgcccaggaggggctgagcaccagccatatctttt

SEQ ID NO: 6834626 - DNA, 83 bp, Homo sapiens
tctgggtacacaatggctagcatgtaaaatatcacagtaaatttattactagataattataggctaagccacttgacctcaga

SEQ ID NO: 6834627 - DNA, 60 bp, Homo sapiens
tacctggccttaaggtgctgacgtgatgtctttatttctgtactgtcctggccagtagtg

SEQ ID NO: 6834628 - DNA, 105 bp, Homo sapiens
gcctttgtgtggagatctggctggcctctctagcatccagcctgtcctgtcctgttatgtctcggtttgaggttgtgctgaggggtctcttcccatagaggaggc

SEQ ID NO: 6834629 - DNA, 59 bp, Homo sapiens
aatgactaccttgatgggatcctttgtggtgaaccaccaaatgacctttctctagcatt

SEQ ID NO: 6834630 - DNA, 75 bp, Homo sapiens
gccctaagtcggcagagttgagttgttacaagaaagactatgtggccataaagcttaaaatgttgacgacctggc

SEQ ID NO: 6834631 - DNA, 65 bp, Homo sapiens
gagggtattacatttcatttcatgcttgacttaatcaaaactggggaaatgaaatgtacaccttt

SEQ ID NO: 6834632 - DNA, 79 bp, Homo sapiens
agcattcattctagttgagggagacaaataatatgtaagtaaataatgtatgttttatatcaggtgattaaggaatgtt

SEQ ID NO: 6834633 - DNA, 98 bp, Homo sapiens
agaagtggacaaatgagatattggtaagaatcaagaatcaagttggtttcagttgttttgcaggatccttacaaatgaacattttagtccttgctttt

SEQ ID NO: 6834634 - DNA, 63 bp, Homo sapiens
ctgctcagagctgttgctgccccaccagacacttggccaaggggcctgcaccggtctgcgcgg

SEQ ID NO: 6834635 - DNA, 64 bp, Homo sapiens
ttttgccctttcttttccttcacttgggaaagtttagaggtggagtgaaggaaaggcagtaaga

SEQ ID NO: 6834636 - DNA, 65 bp, Homo sapiens
ttcaaacaaaactctttcctataatgcaaactcaggcggcaggaaatatcatgggttttgttgaa

SEQ ID NO: 6834637 - DNA, 59 bp, Homo sapiens
tggaaattactaacacttagaggaagaaaaatattactttagggtcattgtgatttcta

SEQ ID NO: 6834638 - DNA, 63 bp, Homo sapiens
gtttacgcaggtccttagcaatcatcattgaagcattgatgagtgcaacagatcagcatgggc

SEQ ID NO: 6834639 - DNA, 105 bp, Homo sapiens
gcttgttcttcaccttggctctattgcctgtagcatccccttcagctttttcttgggcatggcagtgatgcggcaggacatatgctatggatgcaggaatgcagc

SEQ ID NO: 6834640 - DNA, 69 bp, Homo sapiens
ccttcgctgccagcacagttcagctgtgccgtccccagcgctgcggtgcctgtagctggtgtgcggagg

SEQ ID NO: 6834641 - DNA, 93 bp, Homo sapiens
ccgtaaccccatccttcaggcaggtttcccggctgtcaatgaggttcgttgtggctgcggatttgatctcccttggcctgcagggtgggcagg

SEQ ID NO: 6834642 - DNA, 89 bp, Homo sapiens
ggaacaagaatgttgatgcaagaggcatcttttaaaaataagtattattttgcatgtgtttagtccagcctcttgtttttgctttgtcc

SEQ ID NO: 6834643 - DNA, 100 bp, Homo sapiens
attaagatttgctattttttcttcagtggacccaggaattaattaagagggaaaaaatattctggtctattctggtcctaggaaagatgagcaacttgat

SEQ ID NO: 6834644 - DNA, 55 bp, Homo sapiens
tctctgtattgcccacagctagattccttaacatctcatgtgtgtcctacagaga

SEQ ID NO: 6834645 - DNA, 97 bp, Homo sapiens
ccagtcctgcattataataggcttttccagtataagagatcatatccagatttttcagctcctttggaaaattcctgtgatagactgctggacctgg

SEQ ID NO: 6834646 - DNA, 68 bp, Homo sapiens
tcatgaagcttacagtatgatcaacttttcacctgtggaaaaatataattatgctgtaagttgtttga

SEQ ID NO: 6834647 - DNA, 61 bp, Homo sapiens
aggggcggcctgcctgaagcagagctccaaaattggcaacctaggcctcgcagccgccttt

SEQ ID NO: 6834648 - DNA, 57 bp, Homo sapiens
gtgtcctttccgggcctggaggcttggcccctcctctcccaagcctggcaggggcac

SEQ ID NO: 6834649 - DNA, 78 bp, Homo sapiens
ccatgcagcaacaagggagctctctcagggggtccaatgtggtagatgttggccctgggaagttctgcaaacgcatgg

SEQ ID NO: 6834650 - DNA, 83 bp, Homo sapiens
ttggatgtgtccatatggaagatacaagtgctctgcctgtcagggtaggtagcttggtgctttcattctggtgatacttccag

SEQ ID NO: 6834651 - DNA, 77 bp, Homo sapiens
tggatgacactgggactatgtgtttctgtacttttcttacagaagacatactatgaatacatgtgtcctggaatcta

SEQ ID NO: 6834652 - DNA, 68 bp, Homo sapiens
taaccagacagaaacagctagagagaaaggaagaaataactctgtattagctggactgttcaaggttg

SEQ ID NO: 6834653 - DNA, 63 bp, Homo sapiens
ctggagaacagagctgtttagacttttctgcatgatgagaacttagcagttgttgatttccag

SEQ ID NO: 6834654 - DNA, 81 bp, Homo sapiens
cagacactgagagaacatctcctcccacgtgcaatctgtgcatgtgctcagttctgcacaaggagaattcattagtgcctg

SEQ ID NO: 6834655 - DNA, 66 bp, Homo sapiens
atggagatgataatggctttttgaagggtcgttataaggattaaacggaaacatttttatttccat

SEQ ID NO: 6834656 - DNA, 55 bp, Homo sapiens
ctgacagtttttatggctaaattgcaaagtgttaggccttagcgatcactgtcag

SEQ ID NO: 6834657 - DNA, 70 bp, Homo sapiens
ccagagtcattttgagtcataacttgctatcctttgtccttcttgcaggccttactctatgtggctctgg

SEQ ID NO: 6834658 - DNA, 57 bp, Homo sapiens
cctggtgtctgctccctcacagcttgttgaggcctgtgtcccttgcacacacccagg

SEQ ID NO: 6834659 - DNA, 61 bp, Homo sapiens
tcttgagggatcttcagtgtgttcccctctgtcttccaactcaagccaagacacctcaaga

SEQ ID NO: 6834660 - DNA, 68 bp, Homo sapiens
gtcgtgcaatctgtgtttgtaaagggccttcccaggtcttggcaagtggcagattcttgatacacgac

SEQ ID NO: 6834661 - DNA, 75 bp, Homo sapiens
gcggcgcacgaaaggtcaccgcggtggcattcctctccgcgctgtttacgtgacttaatgtactcgctgcgccgc

SEQ ID NO: 6834662 - DNA, 64 bp, Homo sapiens
accagcctggccaacatggcaaaactcatctctactaaatatgcaaaaattggccaggcatggt

SEQ ID NO: 6834663 - DNA, 86 bp, Homo sapiens
tgtccagatgacatgggagcaagcactacaggaaaggtgagggaaaggtcctggcaggccaggctagttcctgtgcatccagggca

SEQ ID NO: 6834664 - DNA, 56 bp, Homo sapiens
cttgaatgtgtggccaggataatgacagaaactgtccagttcaagccaacatcaag

SEQ ID NO: 6834665 - DNA, 83 bp, Homo sapiens
tatttaaatccacttaagagaacagctatagaagaatgactgtttaggactgtggctctgttttcttgtttgtcatttagata

SEQ ID NO: 6834666 - DNA, 62 bp, Homo sapiens
ggaggtttctggggaagttttgcttttggataaaagaaacaagggcactgaggaaaacctct

SEQ ID NO: 6834667 - DNA, 79 bp, Homo sapiens
ggaaaaagaagttgtatggggaggctgtcgagtgacaacacggatttttattaacctcctggtccagcatctcttttcc

SEQ ID NO: 6834668 - DNA, 74 bp, Homo sapiens
gattgttcaaattgattccaaatgagttccatcgaatggaaatttgatgacatcgtatgggcagttttgaagtc

SEQ ID NO: 6834669 - DNA, 86 bp, Homo sapiens
aagcacagagagacagctgctcgcagagctatgggcagaggattggttttcatggttctctatgaagcattgtctcactgctgctt

SEQ ID NO: 6834670 - DNA, 57 bp, Homo sapiens
ggtctttgcctgtcttttagagcctgccaacacctctcaaagagccaggtaatcacc

SEQ ID NO: 6834671 - DNA, 72 bp, Homo sapiens
gggatgatagtgttggcactgcggtagtgtcctctcctatctctttctaccatctgtaaacactttcattct

SEQ ID NO: 6834672 - DNA, 58 bp, Homo sapiens
gtccttcgcggctgaggccattgccatgaaccggcagctggcccagcacgacgaggac

SEQ ID NO: 6834673 - DNA, 67 bp, Homo sapiens
atgtgtctctaaaatttagtaataagatgttcttgtgaataatgcagtgctgatttaggagatatat

SEQ ID NO: 6834674 - DNA, 93 bp, Homo sapiens
tcacactatcacacccaggctagagtgcaggtgtatggttacagctcactgttgattgcacacctgcactcaagccatgatgtgacagagtga

SEQ ID NO: 6834675 - DNA, 66 bp, Homo sapiens
aggcaggggccaggctgtctgctgtcagaggacgaagcctgcagcctactgcccggaccccggcct

SEQ ID NO: 6834676 - DNA, 91 bp, Homo sapiens
cttgatgctagatgacagcgaaaaaatatttaccaagttcagagggaaagacttgtgactttagaattttatccagattatcagtatgaag

SEQ ID NO: 6834677 - DNA, 58 bp, Homo sapiens
attggacacattttcttcttaaggatttgtgtttcctccaggataaaatgtgttgagt

SEQ ID NO: 6834678 - DNA, 68 bp, Homo sapiens
ttaaaggggagttagtgataaaaccaaggcagcacttttgtgtatcaaagcacagacttcacctttga

SEQ ID NO: 6834679 - DNA, 67 bp, Homo sapiens
agcactgaactatcctgcaactgcagggaggaagctccttactttgcatttgtggtagtcctctgct

SEQ ID NO: 6834680 - DNA, 68 bp, Homo sapiens
gcggagaatgcagggcttcctcttggagttaaagactcattggctcctggaaagccctcgctctctgc

SEQ ID NO: 6834681 - DNA, 60 bp, Homo sapiens
gagatattaggaggattcataatgcacatggaaatgtcaactatggtattctgatgtttc

SEQ ID NO: 6834682 - DNA, 61 bp, Homo sapiens
tcattcattgcttaccctgtgtaaggctagcaagctgttgttagaacagggtaaatgaaga

SEQ ID NO: 6834683 - DNA, 80 bp, Homo sapiens
gccctagtgagattttatatatcaagcagggaacttctggattccattgctcaatatagagtttccaatatcacgatggc

SEQ ID NO: 6834684 - DNA, 70 bp, Homo sapiens
ctctgcccttggctggaattactctgggccatgtaatatttcatctctcagagtccccagtgggtttgag

SEQ ID NO: 6834685 - DNA, 71 bp, Homo sapiens
gcaggagagggggctcctgcaggcccccagcccgccatggggtggtgcagacaggagccccgctctgctgc

SEQ ID NO: 6834686 - DNA, 61 bp, Homo sapiens
ctgggttttattacagtgagctgacacaacagaatattcagaatcacttaaagtagcccag

SEQ ID NO: 6834687 - DNA, 64 bp, Homo sapiens
tctaattgcaattctcagagatgtctatggaagtgttcagcagtctctggagttagcagagaga

SEQ ID NO: 6834688 - DNA, 129 bp, Homo sapiens
tggacccaacacaagtggttcccagttttcatgtgccctgccaagactgagtggttggatggcaagcatgtggcctttggcatggtgaaggcatgaatattgtggaggccatggagcgctttgggtcca

SEQ ID NO: 6834689 - DNA, 74 bp, Homo sapiens
ctccaaggtctatgtgttgtcaggcctttatgactctgaggcctgcatcttactgacagcacatgcaatcggag

SEQ ID NO: 6834690 - DNA, 76 bp, Homo sapiens
gagtccttgacacatagtaggtgattaatacatttttgttaaataaatcagtgcctgaacttgctgttagggactt

SEQ ID NO: 6834691 - DNA, 109 bp, Homo sapiens
ttctaacggccgaaagagtgtcatatctcacggttatgatgtcttcaaaaggtgatatttctggctgtgtcatcatagctgtgaaaagcattttctcagcatctaagaa

SEQ ID NO: 6834692 - DNA, 66 bp, Homo sapiens
gggcctggctggcttgtcccaggacaaaggaaggccttggcctgggccgcagccactcccaggccc

SEQ ID NO: 6834693 - DNA, 87 bp, Homo sapiens
tacctgtttcagggtgtggaggagagggaactagaatccacaaaaggattcagttctggctgccttccttcacctgttcagcaggtg

SEQ ID NO: 6834694 - DNA, 87 bp, Homo sapiens
gccacagggctgacaagcaggaagtagtctgtaagcatcagctgccattgctgttgtctagtcttcctgctgttgtgcccccgtggc

SEQ ID NO: 6834695 - DNA, 79 bp, Homo sapiens
ccaaatgtcaatagtactgccgttgtgaagctcttagaaggcattctgtgaagctctgaacagcagctaaggcatctgg

SEQ ID NO: 6834696 - DNA, 102 bp, Homo sapiens
gggatcctattgcctttgctttgtgccccaaggtatagagtttggaaaaataccagtgctggtggttcttctgtttcggggaataaagaaaaggaatacccc

SEQ ID NO: 6834697 - DNA, 64 bp, Homo sapiens
gaacatggtggaatcggcgtgaatgggagagtaacaatctccattctacacgttccattacttc

SEQ ID NO: 6834698 - DNA, 59 bp, Homo sapiens
aggcctgaggggctgcgtgatgtcctggaggggcctcctgcagagccgccctcaggtct

SEQ ID NO: 6834699 - DNA, 129 bp, Homo sapiens
ccaacacaagtgtagaatctaggacaaggaaccacattgggcttgcatgcacggccaggagagcattgggttctgtaagcatgtgcttaataaggttattgacaaactggaactagcgtaaatggttgg

SEQ ID NO: 6834700 - DNA, 55 bp, Homo sapiens
acagtgttcaaaccactaggctgcagactgtattttatttggtttgggcacatgt

SEQ ID NO: 6834701 - DNA, 99 bp, Homo sapiens
atacatattttctgaagcaccatgttaggagttggggagttactgattagtaaatgcagcaatggtccctgccctcttggaatttcaggtccagtgtgt

SEQ ID NO: 6834702 - DNA, 128 bp, Homo sapiens
ttcctgcacacttgtttttgacatattacccagatcttcatcacctggataagcattgttcaataaagctttctgtggtgatgtaaaggatctgtatatttgcatatgggttaagtgtgattatggaa

SEQ ID NO: 6834703 - DNA, 55 bp, Homo sapiens
tgaggaggatggcagtgaggatgaagataatgaatccaccagctcttcctcttca

SEQ ID NO: 6834704 - DNA, 74 bp, Homo sapiens
ttgtgtttggtgctttaaatagaatttattgattttataatactgtcaagccctatttcaaggcccagatatga

SEQ ID NO: 6834705 - DNA, 61 bp, Homo sapiens
cctactcccctttcctagcttctgtgtggccatttcccagcagctagaggaagggcagagg

SEQ ID NO: 6834706 - DNA, 107 bp, Homo sapiens
ttgaaatataaatgatgtttgggagcaagctacttagggaatgcatgaataatgcttgttgcattccttttattatagtttattcctagattatcttacccttttga

SEQ ID NO: 6834707 - DNA, 82 bp, Homo sapiens
gcaccacacggtgtaaatactacctatatgctttcaatcagaccgataataatatagaaggtgctatttacatggtttgtgc

SEQ ID NO: 6834708 - DNA, 60 bp, Homo sapiens
taggattcaagatagtagactgaacatatgtgcccacagttcttgctgtctgaaatcctg

SEQ ID NO: 6834709 - DNA, 74 bp, Homo sapiens
ggctgacagaccggtatgcagggacgttcctccatggcctcccatgacaggctctgcagtgctggaggacagcc

SEQ ID NO: 6834710 - DNA, 87 bp, Homo sapiens
ttttttgttttctctgatagtttcattggactgaggtggtagctaatatcatcctgtatcctcagaccatgaaaagaacataaggaa

SEQ ID NO: 6834711 - DNA, 66 bp, Homo sapiens
ttctgtttcttctcgacaccttatccctcggttcccgctggggagaacacatgagtggaaacagga

SEQ ID NO: 6834712 - DNA, 59 bp, Homo sapiens
tgaatagcttgacaattatttttgtttcttgagaagcatgattactcccaagttgttca

SEQ ID NO: 6834713 - DNA, 55 bp, Homo sapiens
attctggttcttgctcattgtgtctctaggcattttgtagggcaggaatcagggt

SEQ ID NO: 6834714 - DNA, 106 bp, Homo sapiens
gggggtagacaggagacctggtcaatttcgagcagcactgtgtttttctgacctggaaaagagaaggaaacagctgtgctttgagcctgaatccttgtttaaaccc

SEQ ID NO: 6834715 - DNA, 56 bp, Homo sapiens
agatgtaaactctcatgtcattggccacctaaagccaaacacagagtattggatct

SEQ ID NO: 6834716 - DNA, 79 bp, Homo sapiens
taacatgattctcagaatagccaacgaggaagtcacaagggtttcatttctgtattgaagtgttggctgagtcaagtta

SEQ ID NO: 6834717 - DNA, 64 bp, Homo sapiens
agagactgagaagcagaaatatagattcatggttcctgatcatcttttcctgcttccagcctct

SEQ ID NO: 6834718 - DNA, 91 bp, Homo sapiens
atttggatggaatggtctaataatctgaagaaacaggacttgaacacattttaagtatggtagtctcagaattggcccagagcataagaat

SEQ ID NO: 6834719 - DNA, 59 bp, Homo sapiens
gcttccttccttacattggtggtctctgggcagcataccaaggtagtggagacagaagt

SEQ ID NO: 6834720 - DNA, 60 bp, Homo sapiens
atttggggcttatagcattgtatggagaagacaatgcagtgttaaatttcgcacctaaat

SEQ ID NO: 6834721 - DNA, 80 bp, Homo sapiens
aggctgcactgccctcttcggggttcctgaccagcccagaaaggctttgcccttggggcctgagagtggtggtgttgttt

SEQ ID NO: 6834722 - DNA, 65 bp, Homo sapiens
ggcagacgtggaggctgcgcagggctctgtcacagttgtggacactgccaggctgcacgcctgcc

SEQ ID NO: 6834723 - DNA, 64 bp, Homo sapiens
tcagagtacgcatgctctgattttctctttggagtcttcccaaatcagagtacgcatgcgctga

SEQ ID NO: 6834724 - DNA, 84 bp, Homo sapiens
gtcagcatggaacgtcagactcttagaacgccacagtgcagccgacgtatgtgtggcagctgggagtgtgaggctatttctgac

SEQ ID NO: 6834725 - DNA, 59 bp, Homo sapiens
ctgctcctccccatcaggcagcctctcttgcggctggtgacgattaggaggaaagccag

SEQ ID NO: 6834726 - DNA, 60 bp, Homo sapiens
gaagagcagtggttgaacagaggcatctcatttttatgcttctaggggcttctgcttgtc

SEQ ID NO: 6834727 - DNA, 83 bp, Homo sapiens
tttaccgagggcacaggtcaggagatgagattcgtttcgctttttgaattaccttttggcctgtaccaagatgaactggtggg

SEQ ID NO: 6834728 - DNA, 84 bp, Homo sapiens
acatttcccgctgtagcctcaggaatcaagaaaggggctgtgtcagagctcctgggaagagacctgagcatatgtgggagatgt

SEQ ID NO: 6834729 - DNA, 63 bp, Homo sapiens
aggtctcaaagtactttggttattgtggtacatcagaatgatagctagtatttactgagatct

SEQ ID NO: 6834730 - DNA, 55 bp, Homo sapiens
gcctccaaaattcatatgttgaaagctaatccccaataagatggtatttggaggt

SEQ ID NO: 6834731 - DNA, 56 bp, Homo sapiens
gtgtattttcagagtggcatttcttcaccacggtgaagaaggctgaaatgaagcac

SEQ ID NO: 6834732 - DNA, 77 bp, Homo sapiens
gaaggaaataatgatcaacagcatcttgccctgcagagatcatgaggcatgggacaggaaaggggtctgttttcttc

SEQ ID NO: 6834733 - DNA, 56 bp, Homo sapiens
gaaagacttcctttgagagtactttcttgtacttgtcaacccttatgaagtctctc

SEQ ID NO: 6834734 - DNA, 63 bp, Homo sapiens
tctcagctgacagcaaaggccagtggctcatcagtgagaacatcatacctctgtcagagggga

SEQ ID NO: 6834735 - DNA, 61 bp, Homo sapiens
catataatgtttgaagatgtgggttttaaataaaaatgagatgcatctcaaattttatatg

SEQ ID NO: 6834736 - DNA, 87 bp, Homo sapiens
tgaagtgagtatccttatgaaccatagttcctacctaagcataactttggttggaagttaggaggaaatatgagcatacttatttca

SEQ ID NO: 6834737 - DNA, 75 bp, Homo sapiens
ccccaaattctgagtttcattttgcctatagttctttgggggaccatatcgctcaaaaggaaggtctgtttgggg

SEQ ID NO: 6834738 - DNA, 76 bp, Homo sapiens
ccagggctggcagcacagactggtcccaggtctcctgaattcaggaacccgggcaaagctgtgcccattcccatgg

SEQ ID NO: 6834739 - DNA, 91 bp, Homo sapiens
acattttaatttgtgggactataatgcaggttaatatagcatctgtatggcatcttttgcatatgtagctcccatcccgttttcaaagtgt

SEQ ID NO: 6834740 - DNA, 79 bp, Homo sapiens
ccctgcctcggagtgattttggccgtgccattagcagcagctgctggtgataagcaccgggagagtcacctgtgtaggg

SEQ ID NO: 6834741 - DNA, 60 bp, Homo sapiens
tgtcttagtcctttccggctgctataataaaaatattataaactggatggattataaaca

SEQ ID NO: 6834742 - DNA, 70 bp, Homo sapiens
tatgccacatgttgtgttaagctctgagcattcaatggtcaatgagaaagacacagtcttatggggcata

SEQ ID NO: 6834743 - DNA, 59 bp, Homo sapiens
ctaccatagcagtaatgatttaggatatattaatgtcattttgtctcactgctatgtag

SEQ ID NO: 6834744 - DNA, 64 bp, Homo sapiens
tactttagtcctggatctcagagttccagatttcttctggctttaacacagaagggctgaggtg

SEQ ID NO: 6834745 - DNA, 77 bp, Homo sapiens
tgcctgtggtacattaatacctctgatttcactccatcactacagatttattgtattggtgtacttatagcagagta

SEQ ID NO: 6834746 - DNA, 124 bp, Homo sapiens
ggactggagagactgagattcagagacaatgtctctgcttgtggatcaccctggccatgtcacaagcctgttagatgttgtgctctctccactataatcacaaatatcagaactctctctgtct

SEQ ID NO: 6834747 - DNA, 62 bp, Homo sapiens
gagaggaaactgatgttttttacaatggccaactgtatgtctaaattttcagttctcctttt

SEQ ID NO: 6834748 - DNA, 55 bp, Homo sapiens
gtgactgagcgtctggggaagaaggtgataaacagcttctcagagcttgcagcac

SEQ ID NO: 6834749 - DNA, 129 bp, Homo sapiens
aaaagaaacagatgaggaaagagtagcaaaatcaagactgtcccaggaagtgagtgtcagtcaaaggttttgaaatccctcaaatagttacttctgctgtcttggttttgtccacctcccttctttttt

SEQ ID NO: 6834750 - DNA, 99 bp, Homo sapiens
gggggccctccaggtcgggccgggctgtggagaaggggtgtaagcggtcacgaccccgctccttgcagcctctggcctccttatgtctggagggctccc

SEQ ID NO: 6834751 - DNA, 75 bp, Homo sapiens
ccgagcctgagcacctaccagacattcagcttctgcccaaacatgaagttgttgttgaggtgggtaatggcccgg

SEQ ID NO: 6834752 - DNA, 58 bp, Homo sapiens
tcctgaccttgtgatccagccaccttggcctcccaaagtgctgggattacaggcatga

SEQ ID NO: 6834753 - DNA, 63 bp, Homo sapiens
gagcaaggggcaggcggcaggcccggggagacggagccctggctaaggccgccggccctgctc

SEQ ID NO: 6834754 - DNA, 76 bp, Homo sapiens
ctttcctgcctgcaggctggaccgtgccccactaggcaaactgtggccctgctggacacgcctgctggtggggagg

SEQ ID NO: 6834755 - DNA, 75 bp, Homo sapiens
ctcctagaggtgtaggttgcctcctagagaagggcgcagaatgcctcctagaacagcccacctggaagctgggag

SEQ ID NO: 6834756 - DNA, 59 bp, Homo sapiens
ctgagaaatgcatttttccagcacttctttttactgctgggatgggatgtccttctggg

SEQ ID NO: 6834757 - DNA, 55 bp, Homo sapiens
tccaggggagtgctacgcacagcaggagggtggctgggcagtgcaaagccccgga

SEQ ID NO: 6834758 - DNA, 66 bp, Homo sapiens
gatgtcctgggtcaaatcctggtcccgccactattttctgtgtgacctttgagtgtgactcatatc

SEQ ID NO: 6834759 - DNA, 105 bp, Homo sapiens
ccgccccctccggctttcatggcactggataggcgtcccgagaggaatgtaaggcttgccagcctcttaggaccctgttctcccctggcagcggagcgggagcgg

SEQ ID NO: 6834760 - DNA, 60 bp, Homo sapiens
tgagctgacacccaatcatacttcctgagcacctgggatttgttgattggtgtcatctca

SEQ ID NO: 6834761 - DNA, 66 bp, Homo sapiens
aggttcaactatggatggtgtgatgggtttaattgtgtccttccaaaatttatatgttgaaatcct

SEQ ID NO: 6834762 - DNA, 129 bp, Homo sapiens
ctgggccctctctcatggccgggttccccgtccctctgcagaggctgggaagggtccccgggctggagccacgggggcttctctgggctgtgcctccggggccaacactggctgcttggggctgcccgg

SEQ ID NO: 6834763 - DNA, 92 bp, Homo sapiens
ttgcctttcctgacacagaattagtgatcaaaatcaaaattgtgaacctcaccaattgtagtttttgatgctatacatctgagtggaagcaa

SEQ ID NO: 6834764 - DNA, 92 bp, Homo sapiens
tgctctccagcccaaatgggaggcctctgtcccgccagggagctttaggttccccgggtgcttctcggaggctgacaagggcgtggagagca

SEQ ID NO: 6834765 - DNA, 102 bp, Homo sapiens
cctaccgggctgtgtagctcacttgagctctgctaggtggtgagggaatctgggtcctctttctggtatttgaattcagtgctacacaggttactggctggg

SEQ ID NO: 6834766 - DNA, 100 bp, Homo sapiens
aaattttctgcatatgatgcttcctttttcccttaaggacaactgtaagaaatacaaaatctttggaggaaaatggaaagctagcatatttagaatattt

SEQ ID NO: 6834767 - DNA, 55 bp, Homo sapiens
gggggcaggatggagaagagagagacttgctggtcctgacccaatctctgtcccc

SEQ ID NO: 6834768 - DNA, 77 bp, Homo sapiens
cctgagggtatttacaatcacagccagcttccgctattatcaaggatagggaatggctgatggttccatctctcagg

SEQ ID NO: 6834769 - DNA, 68 bp, Homo sapiens
tgataactgcattcagaaagctcactcataagaaaggatgatgaatagttatgctgagtcagtggtta

SEQ ID NO: 6834770 - DNA, 74 bp, Homo sapiens
gggttccagagggaccagaacatactgtggggaactgcgagggaacacagtatgttctggtccctctagaaccc

SEQ ID NO: 6834771 - DNA, 58 bp, Homo sapiens
atctggtgtagcctcctttgctggcagtaaaccagcaaagcagtggctaagctgagat

SEQ ID NO: 6834772 - DNA, 74 bp, Homo sapiens
ctggtgaggctagatgtttgctgggagctcagctggggctctcgaccttcaacaactacatgtgccttttccag

SEQ ID NO: 6834773 - DNA, 55 bp, Homo sapiens
ttgtacagaccctgaaaagctcccttggctatttgatcctttcagttctgtgcaa

SEQ ID NO: 6834774 - DNA, 62 bp, Homo sapiens
cattctttggatgctgtatttaagatgctatgtcagacatctctatgcaggatctcaccatg

SEQ ID NO: 6834775 - DNA, 60 bp, Homo sapiens
ctcagataggaaagggcatcccagtcaaggctcttgtctgtggccctgtcctgatctgag

SEQ ID NO: 6834776 - DNA, 69 bp, Homo sapiens
tagttctattatatcagtaagtggaagcttgtaatgaaggcagagcccagaaagtatgtcatagagcta

SEQ ID NO: 6834777 - DNA, 69 bp, Homo sapiens
ctgaatcatatatctacctgcaattgcaaaggaatgggcttggtgtattgtaagtggttatatgcccag

SEQ ID NO: 6834778 - DNA, 94 bp, Homo sapiens
tggttcactgggtcctgaattggcctgtcagttttcccttgtgattgattgataggggctgactggaaagtgccatgacagattagtgatgcca

SEQ ID NO: 6834779 - DNA, 55 bp, Homo sapiens
ctagtaggttagtaatggtggagctccagggctctatacatactgcagcctctgg

SEQ ID NO: 6834780 - DNA, 79 bp, Homo sapiens
ttattcttttgcaccttttaagtaatgcgctacagggctgtagctaagaacatggacttctgaaggtgtgtcagtttga

SEQ ID NO: 6834781 - DNA, 55 bp, Homo sapiens
gctgtagggtgtcatatgaagccttcaaggctcattctccatgtgccctttcagc

SEQ ID NO: 6834782 - DNA, 90 bp, Homo sapiens
gtggttatgttcatatcattttgaaagctgagtggatagatttaaatagcaagagctttgttcggaatgatgtgtggaacccagaatcac

SEQ ID NO: 6834783 - DNA, 73 bp, Homo sapiens
gggaccaggacaggtgtagtgggctctgtattcagctaaggcctgagcttggtgcaacgctattgtctttccc

SEQ ID NO: 6834784 - DNA, 75 bp, Homo sapiens
cactgttaggtaataggacagcagacaattagtagatcagactacattggaattctgaggtcctttacctgggtg

SEQ ID NO: 6834785 - DNA, 65 bp, Homo sapiens
ggggtagtcctggtgatggctgagctggactttccttccaagcaggcaggatgaggactacactc

SEQ ID NO: 6834786 - DNA, 81 bp, Homo sapiens
ggtgtgcaggaagtagagggcgttatactgggtgaagtgggtggactctacccagagctatgacctgatttgtgacgcacc

SEQ ID NO: 6834787 - DNA, 130 bp, Homo sapiens
tgtaaagcaacaagatctgtgcagtataattctgtcttttaattaacatgaatctgttttttgtcaataaaatgtttttgtctctgataagtagttcagttggagtacaggctgtttttagattatgctg

SEQ ID NO: 6834788 - DNA, 59 bp, Homo sapiens
ggtgaagggtgtcatggcattttgggaattggagtcctgtgaccagactgcccttagcc

SEQ ID NO: 6834789 - DNA, 84 bp, Homo sapiens
cttacttgtttgtaaaataccattccttgtcactactctcactacttgtgacataccataaggtaattttgagacttcagtgag

SEQ ID NO: 6834790 - DNA, 57 bp, Homo sapiens
cctgtattatttgtatgtgctgctaattatgcttggtttacatgctcttggttcagg

SEQ ID NO: 6834791 - DNA, 62 bp, Homo sapiens
ggggcctggtggtgcctctgtgggccccaagggggctgggtggctgggctaccactggccct

SEQ ID NO: 6834792 - DNA, 88 bp, Homo sapiens
ggagaattgcttgaaccttggaggtggaagttgcagtgagccaagatggtgtcactgcactccagcctgggtgacagagtgagactcc

SEQ ID NO: 6834793 - DNA, 130 bp, Homo sapiens
gattatcagattgaatactggaaagaaactgattattgccattatcatttatgatacccaaatttctcttcctggtagccaagagtgaatggcttggttttatttggtaacttctattttgtattatttc

SEQ ID NO: 6834794 - DNA, 74 bp, Homo sapiens
ctggggaacgggccatcgggtgcgggaagccacgcagaacggggtctccagcagcccgaaggcccatcccacag

SEQ ID NO: 6834795 - DNA, 84 bp, Homo sapiens
gccatgaccacctagtgtctttagagtcacaaaaccatagccagttagtgttggaatggaccttggagataatttggttctggc

SEQ ID NO: 6834796 - DNA, 74 bp, Homo sapiens
ggcctctgggttttgtcagctgaggagattgaaatacttcaaactatgccttgagctgctcagaaacagatacc

SEQ ID NO: 6834797 - DNA, 107 bp, Homo sapiens
tgtaaaagtccagggttctagaacggctagcaggggtgtcatgggaaaattgggatacccacatacccggctattgctgcttttgtaaaaggatcctgaacatagca

SEQ ID NO: 6834798 - DNA, 99 bp, Homo sapiens
cggggtcgcagggcgggagggggagctgagccggcagagaaaatgcccaggaaggggtcgatgctggcctgggctgcaccttggtgccttgccaccccg

SEQ ID NO: 6834799 - DNA, 86 bp, Homo sapiens
ctggtatctcccgagtgtgtttgtaaccatatgcggggtgatatgccccagcctgtgtgtgaggactggctgtgtgggagtactgg

SEQ ID NO: 6834800 - DNA, 71 bp, Homo sapiens
tcttcccggcatgctacttcttcaattttgtgaccagatttgagtgaatggcgtgcattttgcagggagga

SEQ ID NO: 6834801 - DNA, 57 bp, Homo sapiens
ggctaagttctccagggttccctgtgaaattcatcacacaaagccttaggaacagcc

SEQ ID NO: 6834802 - DNA, 106 bp, Homo sapiens
cagctgataagctcatctgttatcttctgcataatgtacaatctgtatctaaatgccagtttttattaggcattatggggataaggactagcagagagaaaagttg

SEQ ID NO: 6834803 - DNA, 97 bp, Homo sapiens
ttgtaggatcctgctagtttaataactgagttgttaattttctatagaagccatttaaaataggaaatggctcagttactgcaccggattgctacaa

SEQ ID NO: 6834804 - DNA, 129 bp, Homo sapiens
tgtgggagcactgggagggggtaggattccagaagttggtcttgagccacctgcgaggagggggtccatgcaggctggggaggcagacttggccgcctggggttacacctgcatccgagagttcctggg

SEQ ID NO: 6834805 - DNA, 77 bp, Homo sapiens
gcttaaatgtattctctttataagatagaaaggaatagaacatacgctccctattttacaaatgggaatgctgaggc

SEQ ID NO: 6834806 - DNA, 60 bp, Homo sapiens
ggtgagcctgggtgtgctcagctgcaggatggcagctggccagcacctccaggtcatacc

SEQ ID NO: 6834807 - DNA, 130 bp, Homo sapiens
gcctggaggatctactttcaagagacctcacgcacggctggcatattggcgctggcttctgctaggagcccagccagagctgtgtgatgggggtctctattttctccaagtgggcttcttcaggactgtc

SEQ ID NO: 6834808 - DNA, 86 bp, Homo sapiens
ccataacttccaatagtgtatgttgctcttaaatgatttaaaaagacaggattggatagagctatatacagattattgagtagtgg

SEQ ID NO: 6834809 - DNA, 72 bp, Homo sapiens
tctgcttgagaatcaaagaaaacccgggaaaagtgtttttttcctgtgtcctatttcgactttctaagtaga

SEQ ID NO: 6834810 - DNA, 79 bp, Homo sapiens
cctggggagcctggcctggggggacacatcccaccaaggcttctggaggggtgggcccagcccagtgctggtccccagg

SEQ ID NO: 6834811 - DNA, 108 bp, Homo sapiens
ccgtggcgggcctctgtcttgcagagaagcaaccgtgtggatagtgacaggccacaggcctcttccagctgttgcttccagggctgagccagaggccactttccatgg

SEQ ID NO: 6834812 - DNA, 65 bp, Homo sapiens
gtcagatgcctcctacatactggtctggtttttgctttttggagcatatgaaagaagtatctgac

SEQ ID NO: 6834813 - DNA, 129 bp, Homo sapiens
atgtataatcatttgcttcctgttccttgtggttttaaagttgttttgtatgtttaaatttgattttactcaaatttcagaacccaaattagcgcaagaatcagacaaagcataactttctataaatat

SEQ ID NO: 6834814 - DNA, 88 bp, Homo sapiens
gtccctggcccggagggacccactctagaggtggtaagtaattcagtctttctgctagctcagtcctgggcctctccccaacaggggc

SEQ ID NO: 6834815 - DNA, 77 bp, Homo sapiens
gaggcagggctcgggctgggagtccagcaatctgcccttgggcagtgtctgaagcctcagcccgaaaagtctctctc

SEQ ID NO: 6834816 - DNA, 127 bp, Homo sapiens
gacttgagcaaggtaaccagggcacagcatgttgaggaggcactcactgtcagggttgtagaagttcagtgttagcacttgagagtgagtgctttcttaagttttgtgccctggctgtctcactgtc

SEQ ID NO: 6834817 - DNA, 110 bp, Homo sapiens
ctgaccacatctgctgaccatcctctgtggcgtgggaagtggtggtgtgtaagaacacacctgcccttaacactgtgtgcatggggaccagggaagggcggtgatggcag

SEQ ID NO: 6834818 - DNA, 60 bp, Homo sapiens
tagaaaccagacttggcccatttccccctagacaggccactctggtctggtaatattctg

SEQ ID NO: 6834819 - DNA, 69 bp, Homo sapiens
ggagaggaaggctgtgagcaggcagaatgctggtgtctggaccagcagtcccacatggccgtttgctcc

SEQ ID NO: 6834820 - DNA, 67 bp, Homo sapiens
caggcatggggaggtgcatatgggtagtgcttaatctaagcactgaaggaaagcctttgcatgcctg

SEQ ID NO: 6834821 - DNA, 129 bp, Homo sapiens
tcccatgctgatgcccatgtaaacttaaagtggtttaatatctattggcttttgtgtatagttagtattgcaaaagaatatagatattgtcataattatgtggtgtcataacattggcaaagtggtagg

SEQ ID NO: 6834822 - DNA, 81 bp, Homo sapiens
gagtgaacagctagactttgatattgtacacccttgatcttcaggggatgataatgccagagttaaataagcttcccattc

SEQ ID NO: 6834823 - DNA, 126 bp, Homo sapiens
tccttggatctgaagactaaaatgtgctcagctgcagaccaattatgatattcaagtattttcaagactgctgaatgggatatgttgagctgtgcttgtgtgattagcttcattgatttctataga

SEQ ID NO: 6834824 - DNA, 86 bp, Homo sapiens
cctctcgcagcctgagccaggcctcagggctgtccgtaggagaagagcttgaggacagtgcttggggcccctcagcatgttggagg

SEQ ID NO: 6834825 - DNA, 58 bp, Homo sapiens
aactcctccagacttactgaatcccacactctggatgtggggcccagcatggagggtt

SEQ ID NO: 6834826 - DNA, 83 bp, Homo sapiens
gctttttcaccccaatagctcacagaatatgatgattgttatatagatcaaatgatgctaattggatctggtgaccaaaaagt

SEQ ID NO: 6834827 - DNA, 60 bp, Homo sapiens
ccttcagcaaactcaagtgaaaggaacctcatccttgccgtttgtagagttttctgaggg

SEQ ID NO: 6834828 - DNA, 84 bp, Homo sapiens
gtgctgaatattctagatgaaagtgtttaagtttatgttgcatgacagcagaggctctttaatgcttagcatctagtgcagtgc

SEQ ID NO: 6834829 - DNA, 55 bp, Homo sapiens
ctgtcaggggcgggtggagcggggtggggccctggcttactcacatccttgagag

SEQ ID NO: 6834830 - DNA, 130 bp, Homo sapiens
cgcttttgattgtcatgacttggatgtggggatgctactggcatttagtgggcagaagccatggttactgctaaacatcctacagtgcacattcagctcctcacaacaaagagttatccagtccacaatg

SEQ ID NO: 6834831 - DNA, 73 bp, Homo sapiens
gacaacatggcgaaaccccatctccactaaaaatacaaaaattagccaggtgtggtggtgtacgcctgtagtc

SEQ ID NO: 6834832 - DNA, 64 bp, Homo sapiens
ctgaacaaggctggctgggaaaaacttaattttaagtattttattacctgctagttttaaacag

SEQ ID NO: 6834833 - DNA, 56 bp, Homo sapiens
ttgttgttggagccaatatgcaaatgcaagtgtttttatttggcatccagggagaa

SEQ ID NO: 6834834 - DNA, 64 bp, Homo sapiens
aacttaggtgccttagacactgccattgagtaagaatttgaacccagtctctgaggcctaagtt

SEQ ID NO: 6834835 - DNA, 69 bp, Homo sapiens
gctagaaaatgaggataccgcagggggcagaggcacatgtccctgacctcttggagtttctagtctagc

SEQ ID NO: 6834836 - DNA, 67 bp, Homo sapiens
taggagaggtgaatggcacactaaatctttttggcttccatgtgaaattctttggcaacctcttttg

SEQ ID NO: 6834837 - DNA, 58 bp, Homo sapiens
tgtatgtattggtcagggttctccagagaaattgaaccaatgggagataatgcatata

SEQ ID NO: 6834838 - DNA, 65 bp, Homo sapiens
gccctgcactacctctcaccaagtgtgcctcagcccctggcaggttctgaggatggtgcctgggc

SEQ ID NO: 6834839 - DNA, 64 bp, Homo sapiens
tactactttggatctggcaccacccaccaagaaataggtgatgtggaaagagacaggagtagta

SEQ ID NO: 6834840 - DNA, 92 bp, Homo sapiens
gacaaggcggaggacctgggcctccacgggccatcacatatagcaggggctcagagtgatgtcttgggggcccaggcctgtgtgatggtgtc

SEQ ID NO: 6834841 - DNA, 66 bp, Homo sapiens
gcttttgcacctgtccctcttttttgttactgtagtgacatgtcctgagaagatggctgcagatgt

SEQ ID NO: 6834842 - DNA, 65 bp, Homo sapiens
acacaaggcttccaagagcgtcctgagctgttttacagcaagattgctaatgaagttcttgatgt

SEQ ID NO: 6834843 - DNA, 58 bp, Homo sapiens
gacatttgttaaagcacttagcacgtgtctggtatgtggtaagtcttcgataaatgtt

SEQ ID NO: 6834844 - DNA, 76 bp, Homo sapiens
tgagcaggactgaccggccttagaacgccgccgcccagaggtcagagttgaggtgggggccggtggggcctgctta

SEQ ID NO: 6834845 - DNA, 65 bp, Homo sapiens
cccagtgttacgtgacagcctgtagctttttagtcatcactgtcaggcttttgcatagcactggg

SEQ ID NO: 6834846 - DNA, 90 bp, Homo sapiens
ctctgccgtgagtgctcccagggccttcgccagggattgtgccagagagaaggggcagggggagcgccttgggggccactgggggtgggg

SEQ ID NO: 6834847 - DNA, 73 bp, Homo sapiens
ggcgtggtgtttcatttgctgtaatgacaataagggtggcccttatcccacagagcaaatgtgaccaccacct

SEQ ID NO: 6834848 - DNA, 77 bp, Homo sapiens
tctccttctcccctctgcagggtgtgcctcccaacaggaacaggaaaccatcaccctggatcttagggggatggagg

SEQ ID NO: 6834849 - DNA, 89 bp, Homo sapiens
tgagcagacactcggaggtgtcttgagattatcatccgctgagggtggaaggggatagagcagacactccgcaggtgtcttgaggctca

SEQ ID NO: 6834850 - DNA, 130 bp, Homo sapiens
acagtgttttgcccaccccaaccaatgtccttgtcacttctcagggcctccctctgtttctgtcttctggctgagacagatgggctcctgaagagcacacaagaggtggaaggggcctgtgctctgcact

SEQ ID NO: 6834851 - DNA, 119 bp, Homo sapiens
atcagcaccacctgggaacatgttagaaatgcaaattatcaggcttctctagaaccactaagaagctctggcgaggcctagcaatctgtgttttaacaagccttccaggcaatgctgat

SEQ ID NO: 6834852 - DNA, 61 bp, Homo sapiens
gagggtccaactgaggctgaactgagcgtgaactacattcagcggcctaggcagtgccctc

SEQ ID NO: 6834853 - DNA, 62 bp, Homo sapiens
tgttgctgtgtggacattcagtgcattgcttctaagggctgccctgtgttccacagcagaca

SEQ ID NO: 6834854 - DNA, 61 bp, Homo sapiens
ctgtgggagcactggggaccgagagacttgtgtggacacatccccacgtgcaggcccacag

SEQ ID NO: 6834855 - DNA, 111 bp, Homo sapiens
aagagctaatagaggtctggctcttactccctctgtcttgtccagaaaggcagacctaccctgaggggacaggacaggagggctgagcacagcacacacttctgttctctt

SEQ ID NO: 6834856 - DNA, 65 bp, Homo sapiens
aaacaagcaggaggagaagtttctgacatttccttctccagaggccttgtcttctttgctagttt

SEQ ID NO: 6834857 - DNA, 55 bp, Homo sapiens
taggttttcagagtaagtttgttctcttctaacttatttgcatctgaataactta

SEQ ID NO: 6834858 - DNA, 86 bp, Homo sapiens
ccctttaatcttctgtgccatactcatatcatttttcatgtatcttttgtcattaaaaatgatgggatgcattttgtagacaaggg

SEQ ID NO: 6834859 - DNA, 58 bp, Homo sapiens
tctctcttctttgttaagaatgttgcttttacagttttctgatacttaggagaggaga

SEQ ID NO: 6834860 - DNA, 103 bp, Homo sapiens
gtgaccaacctctaggacacatggcagggcctgagggctgtctatccttcttgttagtagagcctcctggctctcaggcctgctgcgttgtcaggatgtttgc

SEQ ID NO: 6834861 - DNA, 65 bp, Homo sapiens
gtatcttccaaaattagtctcagttataattttggaatgtaacatgagaatcagtttggggacac

SEQ ID NO: 6834862 - DNA, 70 bp, Homo sapiens
gcagtcacataggtatacacatatcttaaaagtcactgaagatttgtgcattgtactgtatgtgaattgc

SEQ ID NO: 6834863 - DNA, 61 bp, Homo sapiens
gtggaaggaattaacagactagatctcttttcactctggtctcctcttaattgcctactac

SEQ ID NO: 6834864 - DNA, 90 bp, Homo sapiens
tgagtttgggggtgggaagatgagaagtggggctcccttctctagtagcaaagggtgaggagactgagtctcctttctactgccaggtca

SEQ ID NO: 6834865 - DNA, 71 bp, Homo sapiens
acatgccatttacttggaggagagaggcttgtgaaacagcactaaggtttcagtcaggttgatgagtaggt

SEQ ID NO: 6834866 - DNA, 130 bp, Homo sapiens
tattcttttatctaatattattctatttattcatttacctgacatttactgaatactgattaatgatgacgatgatgcaatagagagatagataggtagatggatagatgaatggatagatagataaaca

SEQ ID NO: 6834867 - DNA, 58 bp, Homo sapiens
gcaaggtgcccaaggaaggttgccgtcttttcagtataagatcctacctgggtcttgc

SEQ ID NO: 6834868 - DNA, 55 bp, Homo sapiens
cactaattaatgaaattccagggcgttgtttgccaggaggttcatgcaatgggtg

SEQ ID NO: 6834869 - DNA, 95 bp, Homo sapiens
gcaccacaaggttgcccgaagttcttttcagttatccagcctctcaaataccttgctggaaaaagcagaattgaatatcgggttcatctacctgc

SEQ ID NO: 6834870 - DNA, 56 bp, Homo sapiens
tccaggtaatctcatccagaaatcagtgaataatggttgtggatgtgggatctgga

SEQ ID NO: 6834871 - DNA, 79 bp, Homo sapiens
cagatagggagctatgacactagcaccaaagagagatttttcttctggttgggtggtgctggtgccacgcccctttctg

SEQ ID NO: 6834872 - DNA, 67 bp, Homo sapiens
agcttctgctgtttactgtgtgatatgctcacacacagaggagatgtcatccggagacagtgatgct

SEQ ID NO: 6834873 - DNA, 126 bp, Homo sapiens
gctctttagtccatcttaactcagccctcagagtagctgggagccaggtgagtgagaaagatgagaggctcacacctgtaatcctagcactttgggaggttgaggtgggaggatcactttaggagt

SEQ ID NO: 6834874 - DNA, 58 bp, Homo sapiens
cagtccatctggtttcaagatgaccccaatggtcactgctgctgccatgatggagctg

SEQ ID NO: 6834875 - DNA, 61 bp, Homo sapiens
aggagatggagctcagtgggcaagccagggtctcaggtcaggtccaggggctccacctcct

SEQ ID NO: 6834876 - DNA, 60 bp, Homo sapiens
taagtgtttgagggaggatattagtttcatttctgacttttattcaactttaaaaactta

SEQ ID NO: 6834877 - DNA, 73 bp, Homo sapiens
ggctttcttggggctcctgcgccattctcccaggaaagtgaggcgaaggtgctggcgccccaggagacgcgcc

SEQ ID NO: 6834878 - DNA, 59 bp, Homo sapiens
cctttctggaaagcaagatacattaaaaccttaaaatgttattgtcctttccaaaaggg

SEQ ID NO: 6834879 - DNA, 55 bp, Homo sapiens
gctttccctaagcatttggggagtcatttactcctttggctgacgaggaggaggc

SEQ ID NO: 6834880 - DNA, 130 bp, Homo sapiens
agtttttacctgcctcacaggagtgtcttaagaattgattcacatttacaaagcactcagaaatccttggatttgagatgctgtagaagtgagtgcattattattattatcaacctgaggcagataaatt

SEQ ID NO: 6834881 - DNA, 60 bp, Homo sapiens
ggagacttaggtgagatgtttgtatttatcacaactgctgcatcaattgcctaggacttc

SEQ ID NO: 6834882 - DNA, 56 bp, Homo sapiens
ttaaggaattacgaaaatatttagggttctgttctgagttgctttgggatccttaa

SEQ ID NO: 6834883 - DNA, 56 bp, Homo sapiens
ttcattgaaattaagcccaactggccaatttggtgagtgcttgatttgtcaaagaa

SEQ ID NO: 6834884 - DNA, 74 bp, Homo sapiens
ggagttagctgtgagtctcatatagaggggggcaagtggctccagagggcatactgggaccaaagtctattttc

SEQ ID NO: 6834885 - DNA, 107 bp, Homo sapiens
ggccctctcattggctctgctccccaagtgggaagtggggaagttgttttgtcaattctgccacttttgcttactgggaatagaagcagaggaccacaggcagggcc

SEQ ID NO: 6834886 - DNA, 78 bp, Homo sapiens
tcctcatcgaggtggtgggggtggaaagacattcacaggcagcagacattctcatccatcctcgcctttgcttgagga

SEQ ID NO: 6834887 - DNA, 69 bp, Homo sapiens
ttccagaggcaacaggaaaccacatgatcaggcggtcatttgggaaatttcctttggaagactttggaa

SEQ ID NO: 6834888 - DNA, 87 bp, Homo sapiens
ttcagcttgagaatatttgaagatgttagaagagggaaaaaattccaaccaagaatcatattgatatttaaaatattttcagttgag

SEQ ID NO: 6834889 - DNA, 102 bp, Homo sapiens
aatgataattcacagaagatgtttggtctctaaaagatttggatacccagcactgaagtagggaatcttccttttttgtaagctgacgtttttgttatcatt

SEQ ID NO: 6834890 - DNA, 71 bp, Homo sapiens
gctcatggagagaccagaatccagctgcctcaccaaaactaggaggcagctaaaagctgttttccctgagc

SEQ ID NO: 6834891 - DNA, 118 bp, Homo sapiens
gaggcagcccccggacaccctggcactggctgggcgatggcagcggggcctggctgggctgcagctggctgagttctgtcgtctgcagaggagcaggacctgggacgggggctccctc

SEQ ID NO: 6834892 - DNA, 62 bp, Homo sapiens
ggctaggtgcagcagacagcttaggggctttgaagtcaaatacatgggcctgcatcctagtc

SEQ ID NO: 6834893 - DNA, 57 bp, Homo sapiens
ggtgacctcacctggtcccaccctttcaggtgaacggccaggcccggtgacgtcact

SEQ ID NO: 6834894 - DNA, 99 bp, Homo sapiens
ccattttaacacacctccacaactcacagctgtttggattaggcattcaagacaagcattgacttagcctcaaaagtcgtgaggaggttactgaattgg

SEQ ID NO: 6834895 - DNA, 75 bp, Homo sapiens
catctggaactcggtctttggcctaaaatcacaattatgtgaaaacattttatacttaagacagagtttaaggtg

SEQ ID NO: 6834896 - DNA, 55 bp, Homo sapiens
ggcagtgactggggacccccaaaaaggataagcttgtgggtatccagaactggtc

SEQ ID NO: 6834897 - DNA, 69 bp, Homo sapiens
tgggtatctggggcctgggctagccatcagggtcccttccgtgtggatccagtgttccatgtcagccca

SEQ ID NO: 6834898 - DNA, 92 bp, Homo sapiens
cctgccccagtcttggaatcagccatttttccaaggagccctggctccttttattggagaatggctttagaaactgagatctgggtgccagg

SEQ ID NO: 6834899 - DNA, 86 bp, Homo sapiens
aaagtttatttcaaatctgcctccaagtccatgtgttctgaaaaggacagagggggccttggagtgcagccagatggaaggacttt

SEQ ID NO: 6834900 - DNA, 67 bp, Homo sapiens
ataaatatcactgttgtccctcagcgtgtacaaccttgggctggaagggacacatgtgattatttat

SEQ ID NO: 6834901 - DNA, 100 bp, Homo sapiens
gacttctgcttccagctcagagtcaagctggtgcatcttacactgctttggacagaggcagtgtgatgcttccagccactttcatttggaggtgagagtc

SEQ ID NO: 6834902 - DNA, 62 bp, Homo sapiens
tctttctttatcacctgatatgggtccctaaaagggggggaacatgcagggaagaagagggg

SEQ ID NO: 6834903 - DNA, 57 bp, Homo sapiens
ggaaacactgtgccaagccccaagaggattacgcttccaggtgtgtaacgtgttttc

SEQ ID NO: 6834904 - DNA, 64 bp, Homo sapiens
gctgggtgccacgggcaccctgggaccctccttccgtggcccagtggttccctgtggcctgagt

SEQ ID NO: 6834905 - DNA, 97 bp, Homo sapiens
tagtgattctgtgcatttgttggagtgttcggatttatcaaactttctgatttttgtaacatcccaacaaatttcctgtctgcactagtaattactg

SEQ ID NO: 6834906 - DNA, 71 bp, Homo sapiens
aatactctccccattccttgggctgccttattatggccattctatccaaattggcagttcagggaattatt

SEQ ID NO: 6834907 - DNA, 72 bp, Homo sapiens
cccataatgtttgtaataaagctcaccactgggctttctggcctcagtttcttcatctgcagaatccatggg

SEQ ID NO: 6834908 - DNA, 77 bp, Homo sapiens
gggtgcatgtgtatgtctgtgaattcatattgaaatgactgaaggttagtatagaaaagggaaatgcatttgtgtcc

SEQ ID NO: 6834909 - DNA, 57 bp, Homo sapiens
cctgagtccctgtctctctggcagcacccagtgcttggcatgcagcaggcactcagg

SEQ ID NO: 6834910 - DNA, 76 bp, Homo sapiens
tagtcaagctccaactgagctttgctttgctctatgttttcccaaagcaaagcaaggctcagtttgaacttggcta

SEQ ID NO: 6834911 - DNA, 57 bp, Homo sapiens
tcctggtgtaatggtaagcatgtcatgatgaaggcaggttttgtcaagacagcagga

SEQ ID NO: 6834912 - DNA, 94 bp, Homo sapiens
attgatagcaacagagagaggccactgctattaattcactgctgattactgatgcttattaaggatgatagtagtgggtttttttcctgtcagt

SEQ ID NO: 6834913 - DNA, 75 bp, Homo sapiens
aggtaggctgtgacagggtcatggagggtgtcgggttctcggctctggagtttttcattacccttacggccactt

SEQ ID NO: 6834914 - DNA, 81 bp, Homo sapiens
tcttcagtgaatctcatagcaaagctccgtagttattttccattaagtgtcaaatatctcagctggctatgtccctaaaga

SEQ ID NO: 6834915 - DNA, 99 bp, Homo sapiens
tttggatgagatttttctggttctggtataacaagtgattttcaatgaaaatctggacatttggaatactatattttgagaccctggatcttatttaaa

SEQ ID NO: 6834916 - DNA, 77 bp, Homo sapiens
ggactttcaatcaatgtgaggcccttgaaactgaactcaacctgataattaagggagtctagttgatgtggaatttc

SEQ ID NO: 6834917 - DNA, 67 bp, Homo sapiens
agagatctgctctcatgtttttcttatggcaatgacagaagtgcaagaggcaatgaaagcagtctct

SEQ ID NO: 6834918 - DNA, 55 bp, Homo sapiens
gagctgccagacatgggaatgaagccttgttggattttccagtctggccagcctc

SEQ ID NO: 6834919 - DNA, 56 bp, Homo sapiens
tcaggctggggaggatgctacgacctgcagagaattgctgtccctcccaggtatga

SEQ ID NO: 6834920 - DNA, 77 bp, Homo sapiens
cattggatgacatattgcactgtatagtatatcttttaataggtacatacagccaagtatgaagtaatttgtccatg

SEQ ID NO: 6834921 - DNA, 124 bp, Homo sapiens
ggttagagaaacatattacagatatttatgggggagatgatcgtacttgcaagaagcatttcaagcctattgcattttctcaagtgatttatttataagttagctgtgactgaaaatactaatc

SEQ ID NO: 6834922 - DNA, 110 bp, Homo sapiens
tctgacactcagtttgaagatccttcaagtgtctttctgatcctgacaggcagtttttaaaatgtttgtggcattccaagacgcttaataatttaaagctgtattttaga

SEQ ID NO: 6834923 - DNA, 70 bp, Homo sapiens
cacaggaaatgattctgcagcagagcatcgccttgaattctctctgctgctttgtgattttttcctgctg

SEQ ID NO: 6834924 - DNA, 78 bp, Homo sapiens
taggaacaaatgggacagcatcttggtattacacagctctagcaggtgatggccattgtggtctctctattgttagta

SEQ ID NO: 6834925 - DNA, 56 bp, Homo sapiens
taaatctgatgttaaatgtaaggttctcattggttgaacctttttactcaggttta

SEQ ID NO: 6834926 - DNA, 56 bp, Homo sapiens
tccagcagtgctcaggactcactaatgcagggagtgacattctaacactgactgga

SEQ ID NO: 6834927 - DNA, 63 bp, Homo sapiens
actttcatggatctctgttcagttgttacaaggtactcaacttttggatagatgccatagagt

SEQ ID NO: 6834928 - DNA, 72 bp, Homo sapiens
tgggtctggcatgctgagatggaggagctttgttaggtgagctacctttccagagggcctgcctagaaccca

SEQ ID NO: 6834929 - DNA, 55 bp, Homo sapiens
gctgccctgactccagcagcctgcagctccaacccacgctgctggtggagggagc

SEQ ID NO: 6834930 - DNA, 74 bp, Homo sapiens
attgaatagtagctctgttttaagttatttgagaaatctttaaactgctttccacagtggctaaactaattgat

SEQ ID NO: 6834931 - DNA, 59 bp, Homo sapiens
ggcttgcttgttagagatgagaggccatgtgaaacatagccagtcattccagcaaggcc

SEQ ID NO: 6834932 - DNA, 60 bp, Homo sapiens
ttacaatgggagcccttggacttaagaaaaaacatgtagtgcaaggagttgctattttaa

SEQ ID NO: 6834933 - DNA, 69 bp, Homo sapiens
ccagatcctggagaggaacccgtgacagctgggcagaatctactgtctgtgcctcttctcccagtctgg

SEQ ID NO: 6834934 - DNA, 75 bp, Homo sapiens
ggtcaacacaatacaactctcctaattaaatgctcttatgtaccacacaaaagcatgtgattgggagagttgacc

SEQ ID NO: 6834935 - DNA, 95 bp, Homo sapiens
ctgccatcaatgtccccaaggttcatgaagggtgaatatagtctaactcaaaaggacatctttatcctcatgagaaaagagactctgatacccag

SEQ ID NO: 6834936 - DNA, 83 bp, Homo sapiens
ggaaggttctagacccagccaagcagcaggggcctgagctgtagcttgagtcacagccttgccttggtcacactagcctttcc

SEQ ID NO: 6834937 - DNA, 76 bp, Homo sapiens
gggccttcctgagttctgtagggtgaaatagtcattcttggcctatctatcactgcagaccttggggttgtggcct

SEQ ID NO: 6834938 - DNA, 91 bp, Homo sapiens
gcttctgagagcggttttgcagatgtgttacctattgtgcggcacaaaaggtgccagcatagtaagcagtcatcaataccgagtcaggagc

SEQ ID NO: 6834939 - DNA, 80 bp, Homo sapiens
tacctttttgttggaaatgttcaagcagaggcccaatcaatatcatcaaggctttctgaggactattgcaatacttggta

SEQ ID NO: 6834940 - DNA, 63 bp, Homo sapiens
cctgtaactccttggctcaagtgatcctcccacctcagcctcttgagcaactagggttatagg

SEQ ID NO: 6834941 - DNA, 109 bp, Homo sapiens
tccgcctcctcccagttgggcgagtagccctggctgctgcacagggtgcctcccgtatgccaggcactctgctggctgcagggcagcttaacctgcagggcggtcagga

SEQ ID NO: 6834942 - DNA, 96 bp, Homo sapiens
ggcgggaggaaggaggcctcgtgagcagatggaggcttctgcagcagctctctctctgcagggcccctctgcatgagtgtgtcagcttcccctgcc

SEQ ID NO: 6834943 - DNA, 83 bp, Homo sapiens
gttttaatgatgcctccaatattatgaaagtgtgacatttgatgaatgtctcatatagttttgatatctgggcacatgtcaac

SEQ ID NO: 6834944 - DNA, 86 bp, Homo sapiens
caaacctgaacaggctgtactcatgaggacaaatatgtgatttatctaagcatagtaaatacttcagagtttagttttcagggttg

SEQ ID NO: 6834945 - DNA, 59 bp, Homo sapiens
gcctgctgtgacaagctatctttaggaagtaagaatttgtgaagattaagttactgggc

SEQ ID NO: 6834946 - DNA, 87 bp, Homo sapiens
aatgtaggtgacaatgtctattaaactgtcataaggatttataaatataaactattgttataatgtttaaagcattggttttgcatt

SEQ ID NO: 6834947 - DNA, 68 bp, Homo sapiens
gagaaccagagtatattatagtaatacatacttgcttatggtccagtataatgtctctatctgttctc

SEQ ID NO: 6834948 - DNA, 77 bp, Homo sapiens
gtcaaaggccctttattacactgaaagaattgcgtgactctgttctgcattttcttacatgtggaattaaggctgac

SEQ ID NO: 6834949 - DNA, 70 bp, Homo sapiens
tccttagcttcttacttaatgcgattctgcgaagcagccaactttgtgggatgcaggagttgaagaagga

SEQ ID NO: 6834950 - DNA, 58 bp, Homo sapiens
aagctggtccaaaattcggcactgcgagcgccgcgggtctggcttcgggaactagttt

SEQ ID NO: 6834951 - DNA, 55 bp, Homo sapiens
acattctgtatcatctgtctcacattttaccatttggagcaggtgtgcagaatgt

SEQ ID NO: 6834952 - DNA, 70 bp, Homo sapiens
ggtatgactgccgtttaggggaccctaatgctgaacaggtaccatggacctctgaaggcagagcagggcc

SEQ ID NO: 6834953 - DNA, 90 bp, Homo sapiens
agagttgctctgtcacccaggctggagtgcagtggcgcgatctcgatctcagctcactgcaaactccacctcccaggttgaagcgactct

SEQ ID NO: 6834954 - DNA, 92 bp, Homo sapiens
ccagaagctgggacaaaggcatggaacagattctcccctagagccttcagagggagcgtgaccctgccaatgccttggttttggacttccgg

SEQ ID NO: 6834955 - DNA, 92 bp, Homo sapiens
tttgaaagacttaattctttctcattttaagctgggcagtgatatgaataaaaagatcacttagttgccagtgaggaggattggttgttgga

SEQ ID NO: 6834956 - DNA, 106 bp, Homo sapiens
cttccaccttgaccatgttcccagactattccggaaggttctctagaattgctgacccagtctagtaggatctctgggctcactgggtactatgatgagcaggaag

SEQ ID NO: 6834957 - DNA, 68 bp, Homo sapiens
gaggcaccagcatttggtgatcatcttaatccagttacctggattgatatggttcaaagctgggcttc

SEQ ID NO: 6834958 - DNA, 83 bp, Homo sapiens
gcctttctgggctgtcctgatggaaaatgtgcctgctcagcacataggggttacatttctcataggagagccacctctggggc

SEQ ID NO: 6834959 - DNA, 57 bp, Homo sapiens
ccagcacacagtgggtgcccagagaatgggtcttgtgtgggcagcactgctggctgg

SEQ ID NO: 6834960 - DNA, 71 bp, Homo sapiens
ggcctttgacaatttggcagagtctggcttttttggtaggtctccagccagctcttcactttgtttcagcc

SEQ ID NO: 6834961 - DNA, 61 bp, Homo sapiens
gcacagtttatgatctcagtgaaatgttatagaaccattgcaatgattataaagattgtgc

SEQ ID NO: 6834962 - DNA, 61 bp, Homo sapiens
agttactcaacctctctgagcttcagttttcttcattagtgtgtcagagagaatagtaatt

SEQ ID NO: 6834963 - DNA, 66 bp, Homo sapiens
ccctctctcggttgctgtggttttggagacaggttcatggtgaagctggctgaagagacagatggg

SEQ ID NO: 6834964 - DNA, 90 bp, Homo sapiens
tgcccatgcatatgtatgtgtgtctgcatgcacatgcgtgtgtgtgtgcatgcatgtatgtgtgcaggcatgcgtgtgtgtgtgtgtgca

SEQ ID NO: 6834965 - DNA, 100 bp, Homo sapiens
cctcatgtagcactgagtgcagaggaactcaggaaattctttttaacagaatggctgcaggctatagaatttcagactggggccagtgcactaaatgagg

SEQ ID NO: 6834966 - DNA, 64 bp, Homo sapiens
ggggtgttttattaactgatctttttggtttcttgactttttaaattcagcagtgaaatgcccc

SEQ ID NO: 6834967 - DNA, 66 bp, Homo sapiens
ggcattcagtgaatgaatcctaacaaagacaatgtcaatgatttgtttttctttattccgaatgct

SEQ ID NO: 6834968 - DNA, 69 bp, Homo sapiens
acatcccaacattgccacatgccacgttttaaatttaaacaaataacagtataacagtgttgggtgtgt

SEQ ID NO: 6834969 - DNA, 61 bp, Homo sapiens
caagttctaggcagtgggaacagctggtgcaagctctgaggtggccacagcctggcacttg

SEQ ID NO: 6834970 - DNA, 83 bp, Homo sapiens
cagctgacccacaaacattctttcacactgggtttctctgaattagaatccaaaggatgtccctgtgttttatttggtcactg

SEQ ID NO: 6834971 - DNA, 57 bp, Homo sapiens
gtatgagcacatatttgtaccatgtgtgtatatagatacatatgtgtgtgtttatac

SEQ ID NO: 6834972 - DNA, 57 bp, Homo sapiens
agctaattgagtgcttagtgacttgttctccaaggtcataaagatactaagtgagtt

SEQ ID NO: 6834973 - DNA, 74 bp, Homo sapiens
tctgtgctctacaatgttacgatcaacaacacatactcctgtatgattgaaaatgacattgccaaagcaacagg

SEQ ID NO: 6834974 - DNA, 88 bp, Homo sapiens
ttccattcaaaacaatgtacacatgaatgtttaaattcatcagcctttcactgtgtaataatgtgacatgtttacagtgttgaaggaa

SEQ ID NO: 6834975 - DNA, 78 bp, Homo sapiens
tcctatttcacagagagaactcaaaccattggctagaaacttcttcaaaatctggtctgatttttcatctgttgggga

SEQ ID NO: 6834976 - DNA, 66 bp, Homo sapiens
gtggcttatgagaattgagtgtgggtagctgctaagttcctttggacacattttttataagcctac

SEQ ID NO: 6834977 - DNA, 57 bp, Homo sapiens
tgttctcgctcagaccttagcagtaaaaagccaactgtacaactgctgagcagaaca

SEQ ID NO: 6834978 - DNA, 100 bp, Homo sapiens
gtctatcttgtgtaccaggagtagtcacaaggcagattttcagtgtggtgtagcacaggtctgaatcactgtgcctatcccaggtggcacagtaatagac

SEQ ID NO: 6834979 - DNA, 77 bp, Homo sapiens
tgcctttctaatcgactgccatgtttagcgattactatgcgccaagcgctttacaggcactctcattaaaataggca

SEQ ID NO: 6834980 - DNA, 75 bp, Homo sapiens
ggtcagagggcaggaccgctggcaggtgcccatgggtagcagctcacctgcctggcccaccttgccactctctcc

SEQ ID NO: 6834981 - DNA, 58 bp, Homo sapiens
ggtcgggtggagctggctcttttgacccacatgctccaggggagctttccatctgtcc

SEQ ID NO: 6834982 - DNA, 95 bp, Homo sapiens
ccccctctcagggatgatctggtcctaacctcttgggtcattttggtgaaatgagagttcattcctgcagaggtcaggccagaaaagagaggggg

SEQ ID NO: 6834983 - DNA, 79 bp, Homo sapiens
ggccgtctgccacagtgcagcatgctggggaggctgccaagtgcgggagtcctcagctgctcagtgtcacagcaccgcc

SEQ ID NO: 6834984 - DNA, 55 bp, Homo sapiens
cctggggcacctcctcttggcaattcctgggaataaaggcagaggtggcctcagg

SEQ ID NO: 6834985 - DNA, 65 bp, Homo sapiens
ggggccagtgaccagtaaccagtgaccagtggccttcatactggacacatgcactggttggcttc

SEQ ID NO: 6834986 - DNA, 72 bp, Homo sapiens
aggcgtggtggctgagaatgggatgatgccaggttcacatctgtgctcttccacgtcgcagctgtacgacct

SEQ ID NO: 6834987 - DNA, 58 bp, Homo sapiens
ttctatggcttgtcagcaattaccaggttctctgggacagtgtagacagggcatggaa

SEQ ID NO: 6834988 - DNA, 55 bp, Homo sapiens
tcattgttaattcctgccggcccttatttttggttggaggtggggtggacagtga

SEQ ID NO: 6834989 - DNA, 67 bp, Homo sapiens
gagggttgtggcggcctgcgcggctgccactgtcgcagtgcggggcagtgcaggcccttcagccttc

SEQ ID NO: 6834990 - DNA, 68 bp, Homo sapiens
gccctggcctgtgaatctgagagccctggagccctggcctgtgagcctgagattcccggagccgtggc

SEQ ID NO: 6834991 - DNA, 60 bp, Homo sapiens
ttgatgaagggtcaagagggtagcagactttgggtgcacaacacttcaatcctttatcaa

SEQ ID NO: 6834992 - DNA, 56 bp, Homo sapiens
cttagcgtggtgggttcctcatcctgccttcacccggatgtcccaccgcccctgag

SEQ ID NO: 6834993 - DNA, 57 bp, Homo sapiens
ttttaggctttgatgggtgagatgtggtttgccacctccatggtaagaagcttagag

SEQ ID NO: 6834994 - DNA, 76 bp, Homo sapiens
agaaaggacatctccctttaaggcttagtaggagaaaatacctgttttctgttctatagagagttgtgtcttttct

SEQ ID NO: 6834995 - DNA, 57 bp, Homo sapiens
agacaggggaaaggtgaatttgctctctgagctgaggcacccatcttctcctgccct

SEQ ID NO: 6834996 - DNA, 61 bp, Homo sapiens
tgatttcaccagctggctgctgagtttgacggcttcttaacagccacactgctgagattca

SEQ ID NO: 6834997 - DNA, 86 bp, Homo sapiens
ttgaatctcttcctgcaacgcagttcacctgcagcctgggaaagtgttctagtgccatcttgagctgctttgtggaagggacccga

SEQ ID NO: 6834998 - DNA, 73 bp, Homo sapiens
tattcacccacccacctgccgggctcatgcagacccacccaggtgcagagtcccagcaggtggtggctgcata

SEQ ID NO: 6834999 - DNA, 55 bp, Homo sapiens
tgttaatgagtgggctgtggagaaggaagcttttcacaacacaatctcgttaaga

SEQ ID NO: 6835000 - DNA, 82 bp, Homo sapiens
caggagctggggctggaacttcttctggcatttgctgttcattcacaactgccatattaggagcttcagccatcagttgttg

SEQ ID NO: 6835001 - DNA, 58 bp, Homo sapiens
ctggcaagtactgggccagctcgcctcctggagctggttccctcccagagctcgccag

SEQ ID NO: 6835002 - DNA, 81 bp, Homo sapiens
gctgcaaggaggcactttgtctttcctcttggctgaggctgttttctgcccagggacaggacacaggttgtctcaaaaagc

SEQ ID NO: 6835003 - DNA, 83 bp, Homo sapiens
ggttgtctactagttaacagtggagctcagatgaaaatcaggtctgattgtcatttcagcccctgcctgacttcaaatcagcc

SEQ ID NO: 6835004 - DNA, 67 bp, Homo sapiens
ctcatgcaagattttcagctaatggtgcagtttttagtgattgcacaaacagcaagttttaaatgtg

SEQ ID NO: 6835005 - DNA, 74 bp, Homo sapiens
tatcaccagaattcttggtcctagtgtataagaatatccttatggactcgagacaaagaaagctatcagtgata

SEQ ID NO: 6835006 - DNA, 62 bp, Homo sapiens
ctcctccctctcctagcttaaagtgccaatgctttgtatcaatgccaggagaaatagaggag

SEQ ID NO: 6835007 - DNA, 56 bp, Homo sapiens
gctggtgtgcagttctgatgacaaccaaggcaacttcacacatgactgcacaaagt

SEQ ID NO: 6835008 - DNA, 87 bp, Homo sapiens
gggacaaaggatcagaggttgggagagcttgttacacattttataaacagatgattcaaacgtttggttttttgaaaattacttccc

SEQ ID NO: 6835009 - DNA, 80 bp, Homo sapiens
gacagaatcaatagattaggtattagattctattgctactataattagaatgttaatgcagaaatttaaaaaattctgtt

SEQ ID NO: 6835010 - DNA, 67 bp, Homo sapiens
tctgaccctggctgaaagcctggcctgccagtccctagggctgagatcatattcagtcaggaataga

SEQ ID NO: 6835011 - DNA, 103 bp, Homo sapiens
ccagcaaaatatccggagagagatgatgtttactatgatgtaacctatgtatatgcatacattaccttttggaaaattgtatattctctgcatccccttttgg

SEQ ID NO: 6835012 - DNA, 55 bp, Homo sapiens
tttggctcattgctcttgcctgtgaattaccttctgaggcaaccaatgaggcaaa

SEQ ID NO: 6835013 - DNA, 78 bp, Homo sapiens
gaggcttacagagttacataacttgtccagggtaatgcagctgacagtgttatttgattaaacaaaagctgaagcctt

SEQ ID NO: 6835014 - DNA, 59 bp, Homo sapiens
gattcttcactattttatattgctctcaatttggagcctatgtggataagggcagaatc

SEQ ID NO: 6835015 - DNA, 76 bp, Homo sapiens
tcatgcatttcagacaagggaataggtaatatttaaacattaatatacatctatgcctttctgacacatgcattga

SEQ ID NO: 6835016 - DNA, 58 bp, Homo sapiens
cctttttgttcttcccaactcttcaagccaggtggacagagagtcggggggacatagg

SEQ ID NO: 6835017 - DNA, 59 bp, Homo sapiens
tgctaatcagattaaaatatgtgcaaggaaattatacttatgcattttaatctgaggca

SEQ ID NO: 6835018 - DNA, 75 bp, Homo sapiens
tcactgtctccattttcaagtagcagaatatctgtagaaacagagggttgctgtcagataaatgaatgataatga

SEQ ID NO: 6835019 - DNA, 81 bp, Homo sapiens
gcaaaagagaaagctgatggcttgctggctgacagataaaagcaccatgtctgtatccagtctgtcttcagcttcttttgt

SEQ ID NO: 6835020 - DNA, 72 bp, Homo sapiens
tattcctcagctcagcgagagagaactagtccatctggttaatctaagactttcctggagttgacaagaata

SEQ ID NO: 6835021 - DNA, 79 bp, Homo sapiens
tcatcaggaagtgagtcttgtgaaaaatggcactgtaagaaaatactttcccttccatttttcataaactatccaatga

SEQ ID NO: 6835022 - DNA, 78 bp, Homo sapiens
tagctttaatgatacctattagatatgtaatcttgagcaagttttttaacttgtcagtgtctgaggttttataagtta

SEQ ID NO: 6835023 - DNA, 55 bp, Homo sapiens
catttatgttttacttggtcacattatatatgtgacacaggtcaaaaataagatg

SEQ ID NO: 6835024 - DNA, 82 bp, Homo sapiens
ggataaatatcaaataatctcactttatgtggaatctaataaagttgatttcacagaagcagagagtagaatggtggtttcc

SEQ ID NO: 6835025 - DNA, 65 bp, Homo sapiens
attgatttttacatgtggtgtgaagaagaggtcaaacttcattcttttacatgtgaatattcagt

SEQ ID NO: 6835026 - DNA, 75 bp, Homo sapiens
caaagacagctgccagtccattgcctgcgttcaccagctgaggaagagtacaggcggggactgggtgtgtgtttg

SEQ ID NO: 6835027 - DNA, 59 bp, Homo sapiens
tttggctcttcccgtaccataagaattgtaaaagcttgtatctatatggggagaccaaa

SEQ ID NO: 6835028 - DNA, 58 bp, Homo sapiens
atctgggtctggctcttaagtcttgggcatatgggatagagaatttaaggatccagat

SEQ ID NO: 6835029 - DNA, 93 bp, Homo sapiens
ctagttattcggttggtgccaaagtaattgtggtttttgttattaaaagtaatggcaaaatgagcaattacttttgcaccacctaatagatgg

SEQ ID NO: 6835030 - DNA, 72 bp, Homo sapiens
ggaagctggtatgaacaggataggaagggagtaagacatttcattccctcatcccatcatggccagtggtcc

SEQ ID NO: 6835031 - DNA, 75 bp, Homo sapiens
actatgtagcacatgccgggagtgatctgccagacattctaatttgaaccagatatctctgggtagctacaaagt

SEQ ID NO: 6835032 - DNA, 55 bp, Homo sapiens
cccccactgtgttcagtcactggctgtaagcaaccctgagtgaaggccgtggtgg

SEQ ID NO: 6835033 - DNA, 59 bp, Homo sapiens
tcttcacctgtacgctggagctaataatgacggtggctgcctgatcgagcaggtgatga

SEQ ID NO: 6835034 - DNA, 69 bp, Homo sapiens
ttctgccttgctctcctacagggccttgctcttctctggcagttcctacagtggaaagcgcaggctgaa

SEQ ID NO: 6835035 - DNA, 84 bp, Homo sapiens
gccaagggtctgccccacaggctcagttgcagagaatcaggacggcaagcagaagcctcaggggcatatttgagaccttgctgc

SEQ ID NO: 6835036 - DNA, 98 bp, Homo sapiens
agcgctctgagtcctatcagtgagggtggacttaggtgcgtttccaggcattcttcactggagtccgctccaagttctctccaccggaaggatgtgct

SEQ ID NO: 6835037 - DNA, 58 bp, Homo sapiens
gtttggaagatgctgcatcttatctcccttcttggagatttatagcacacttcagaat

SEQ ID NO: 6835038 - DNA, 55 bp, Homo sapiens
ggagtacgctaggcatgagaaaggtctcgggaggccgagagtgcctggcctgccc

SEQ ID NO: 6835039 - DNA, 89 bp, Homo sapiens
ccctgtcctgtcttcgagtatttgtttttaatgctgggtgtcgatcgagacaacaagcgctcagagcaaagcaaggatgcattacgggg

SEQ ID NO: 6835040 - DNA, 79 bp, Homo sapiens
ggaaattcacattgtgcaggtcagttattgcaattttatgaactgatttgtaattttacgtgacacagtttgtgttttt

SEQ ID NO: 6835041 - DNA, 116 bp, Homo sapiens
ctgaactctcttccttttttcaccactgcccttgaaatacgcttggggcgggctgcgtgtctcccagaatcctcccggggcacaagggcgaacgtggaggcaggaggagccaacag

SEQ ID NO: 6835042 - DNA, 64 bp, Homo sapiens
gacaaagaattaaaatctctaggttagtttttccaaactgttccttaagatgttaatagttgtc

SEQ ID NO: 6835043 - DNA, 81 bp, Homo sapiens
ggaatggctggtccagatgccttggctttattaactcactacactcactggtggagcctcctcacactgtggccagactcc

SEQ ID NO: 6835044 - DNA, 86 bp, Homo sapiens
tgtttaccgtagcattctctgtgagcgtgataaatgggtatccagctgtgtggaacctatgaactcttggtgtgctgacctaaaca

SEQ ID NO: 6835045 - DNA, 62 bp, Homo sapiens
agacaacatcactaaagctgagaaaacacatcttctctcgtgtctcaagtgataggttgtct

SEQ ID NO: 6835046 - DNA, 85 bp, Homo sapiens
ttcccatagaaggctttgtgcgtagtgagtggtcaatgaatactaatggctactgtttatgtacagcagctgttcactttgggaa

SEQ ID NO: 6835047 - DNA, 57 bp, Homo sapiens
atgactggtttcattaaggttattttagtaaagtagatttgatgtaagcatagtcat

SEQ ID NO: 6835048 - DNA, 87 bp, Homo sapiens
cattttgtcaggcaattaaagtactgtgaatgagtaatagcaatagatcctcatattaaggtcattttgtgtgtgtgtataaaaatg

SEQ ID NO: 6835049 - DNA, 101 bp, Homo sapiens
tgaggcaggagaattgcttgaacctgggaggcagaggtcgcagtgagccaaaatcgtgccattgcactcctgcctgggcaagaaagcaagactctgtctca

SEQ ID NO: 6835050 - DNA, 56 bp, Homo sapiens
ggcaggcgtggtggcctcagaagccctcggccctggaatgaggcaccgcacttgct

SEQ ID NO: 6835051 - DNA, 76 bp, Homo sapiens
gtgaccggtggcgggttcggatgcagaggaggcttctcagtgcggttcctcctcatctcggaacctgccaccccac

SEQ ID NO: 6835052 - DNA, 80 bp, Homo sapiens
gctttgcagagggggtgggagctgtgtatggcatgtttgatggagaccgaaatgaggagctcccgcgcctgctgcagtgt

SEQ ID NO: 6835053 - DNA, 63 bp, Homo sapiens
tggagtaacagaccttgcaggaaacgtgaatagcaaaaccattcaaacctggaggtcacttca

SEQ ID NO: 6835054 - DNA, 77 bp, Homo sapiens
agcacccagtaggtctgtggatgggagaaggtgacagaaagttgcaccaggcagtcaccgtccaggacccggctgct

SEQ ID NO: 6835055 - DNA, 64 bp, Homo sapiens
cacctgggtctgtcttataggaatggagggccggcctgtcataactttaaagacagtgtgggtg

SEQ ID NO: 6835056 - DNA, 57 bp, Homo sapiens
ctgaaacccgtccagatggaggacccggtttccattaaacctggatggagttctcag

SEQ ID NO: 6835057 - DNA, 70 bp, Homo sapiens
gggttagtccataattttcatatctgaaaaccagtttcagtgcaaaaaatgggctagatcattcctaccc

SEQ ID NO: 6835058 - DNA, 57 bp, Homo sapiens
ggaggcctggacttcctgatggtcttggtgggggtcaggaggagagcttggcctacc

SEQ ID NO: 6835059 - DNA, 84 bp, Homo sapiens
gcccgggcccatgcccgtgtgccccctgccatcgtgcagatgctgctggtgctgcaggtgggcacagtgggcagagggtcgggc

SEQ ID NO: 6835060 - DNA, 65 bp, Homo sapiens
gtctttttggggcgggtggtgtggggagaacggaaaacctttttgtgtatcctgctccatgaagc

SEQ ID NO: 6835061 - DNA, 59 bp, Homo sapiens
gcctgtgttttcctgcccacctctgatgctaaatgcaccctgaggcctgagaaccaggt

SEQ ID NO: 6835062 - DNA, 64 bp, Homo sapiens
tattaggagacatataactgtcaagagtaagtgaaacttagcagtattcattgtttccctgata

SEQ ID NO: 6835063 - DNA, 77 bp, Homo sapiens
ggctgagcagctctggctattgaggaccaccctgaggaataagggtggtcctcaccctacccagctgctcctcaccc

SEQ ID NO: 6835064 - DNA, 118 bp, Homo sapiens
gatccaataggtctatagcttggccccaaagtctggtgattctgactgagacaggaggtctctgaacctcactctgagaaacactaaaccatggggtacttgtaggagcagacggatc

SEQ ID NO: 6835065 - DNA, 69 bp, Homo sapiens
gcttacccatagaagaaacactaggtagataagcgcagtaatatcagtagtgattcgatgtgggtaagt

SEQ ID NO: 6835066 - DNA, 92 bp, Homo sapiens
tctacattagacatttatttctgctcatcctagtggagcatgcccaaatatctgctggctttaaggatgaccagatggaggtactatctaga

SEQ ID NO: 6835067 - DNA, 71 bp, Homo sapiens
gcctgaatgagtattgaagcgatttcaatttccttttaaattgagagattccaaaactctgtgatttaggc

SEQ ID NO: 6835068 - DNA, 122 bp, Homo sapiens
aggaaaaataacttcatatattgaatatattcaaaagtttaagcatttagttgtattgccctgttaagttggcatagcaaataaatgcttttcttttcctcattttattctttgtgtttcct

SEQ ID NO: 6835069 - DNA, 79 bp, Homo sapiens
ttgaaagacttaagtgaaaatccacagaaatcatgacaagcaagctgagatggctgtgaagttttccaagatctttcaa

SEQ ID NO: 6835070 - DNA, 116 bp, Homo sapiens
gctacacccagggtaccaaccatagtagccaggtctttggcctgggccagcatatatgtgaccccaagtactgcctgccaggcacagtggctgacggggctcccttgggtgctggc

SEQ ID NO: 6835071 - DNA, 90 bp, Homo sapiens
ctcattgaatgctcacaaccttatgaagcatgaattacccctttgctttcagccaatggtcatgccttccataatgtgggaaagaatgag

SEQ ID NO: 6835072 - DNA, 66 bp, Homo sapiens
tagctattattatgttcacttatctgctcaccacatttgctagtgcatgaataacaataatggcta

SEQ ID NO: 6835073 - DNA, 101 bp, Homo sapiens
ggctttacatctggcagggagacagctcctttctgaggatgacagctgcagcttcagctctacctgggagctgtctccccatggggaagatgttcatagcc

SEQ ID NO: 6835074 - DNA, 72 bp, Homo sapiens
tctctcactgggtataaatgagtaaccattagcactagttgctataagggggtattctatagccatgagggg

SEQ ID NO: 6835075 - DNA, 55 bp, Homo sapiens
ggccttaggctcaacaggcagagtcagttgatatctacagagtgaccctgaggcc

SEQ ID NO: 6835076 - DNA, 55 bp, Homo sapiens
accaatagctgctgagctggagtttgcccctgcactccaaaacctgcggcttggt

SEQ ID NO: 6835077 - DNA, 76 bp, Homo sapiens
tttggcagagagtatgctgaagatcatgatatcaacataaaaagttgttctttttcatttttagttttcttccaaa

SEQ ID NO: 6835078 - DNA, 105 bp, Homo sapiens
tggagtttctatttgagtatttataccatagaaaggaagctacttaggggcaaaatctgagtctttaatgtactttctttcacagtgactcatattgctacttca

SEQ ID NO: 6835079 - DNA, 94 bp, Homo sapiens
gggcttccacagcgttgtggtttccacttggaagggctgcagtgggaactgaggggcctgctccgggggctgagctgcatctgtgggaaagccc

SEQ ID NO: 6835080 - DNA, 103 bp, Homo sapiens
gctctctcccttttggtgctgagggtgggctttgttcctccagtgcttcctcaaagaccccctggtggccgaagccctctctcaggacctcctggtggagagc

SEQ ID NO: 6835081 - DNA, 59 bp, Homo sapiens
ggggctccccggctgcttgtctggaaacggagtgcatgtgaccgctgggtgagcgaccc

SEQ ID NO: 6835082 - DNA, 99 bp, Homo sapiens
ctgcttggcattcaggacagtcactattggtgcagatctcttgttaattgacatctatataacagatccactatggtgctgatgagctgtgaccaacgg

SEQ ID NO: 6835083 - DNA, 82 bp, Homo sapiens
agctcccgcctctgttgtctgtcttgctgtatcaccctcgggccttatcagctgaaaaacaggcagcaaaggaacggcagct

SEQ ID NO: 6835084 - DNA, 61 bp, Homo sapiens
tcctgcagcagctggtgaccttgaatgagggcatcgaggcagtgcgctggctgttggagga

SEQ ID NO: 6835085 - DNA, 76 bp, Homo sapiens
agccagtatacagatcacataagtaaaaattttttggaagaaaattttctaaggtgatgatctgacaactttggtt

SEQ ID NO: 6835086 - DNA, 83 bp, Homo sapiens
ggagagcagaaagagctcgggattaacagtcaagacagttaacttgtctgttgcatcatggctcttaatttacaggtgtctcc

SEQ ID NO: 6835087 - DNA, 62 bp, Homo sapiens
tgtccccctttggcttttgttactaactttaatgaccacaacatttaggccaaaaaggggca

SEQ ID NO: 6835088 - DNA, 55 bp, Homo sapiens
tttctactcctcatggcaggttgtttttaaaagattacattcagaggagtggaag

SEQ ID NO: 6835089 - DNA, 78 bp, Homo sapiens
tagtagtagcttgtcattcaactgcacattaggtcatttgctgggatatctttctgcagtgaatgataagcatagcta

SEQ ID NO: 6835090 - DNA, 67 bp, Homo sapiens
gtcacttaggaacacttactggtactatacttactgcatgctaagtgctgggttggatcctgaggac

SEQ ID NO: 6835091 - DNA, 83 bp, Homo sapiens
atggccagagctctgtgtctctttgggtgccatccagtatggcctcaccccttgaaggcagagaagctcacagtgctggccat

SEQ ID NO: 6835092 - DNA, 71 bp, Homo sapiens
tagcagaactgcagttaacaagtcttcatggtcccagagagaaattgatatttgctgactgcattgtgctg

SEQ ID NO: 6835093 - DNA, 77 bp, Homo sapiens
ttttacaagaggcttttcttcaggtatcaatagtctcatcccattttatcgaattgcactaggagcttcttgtagaa

SEQ ID NO: 6835094 - DNA, 68 bp, Homo sapiens
tttggagaggcagtcttgctctgttacccaggctggatcccagctcactgcaacctctgcctcccagg

SEQ ID NO: 6835095 - DNA, 81 bp, Homo sapiens
tttgctaagggggttctacagccacttgctgtaggccaaagtctgagcgatgtgggtatgtagaagtattgccagagcaag

SEQ ID NO: 6835096 - DNA, 76 bp, Homo sapiens
gtcttattttccttacttataaaatagtgataatattcctttgctttctggattatgtgtaagtgaagattaagac

SEQ ID NO: 6835097 - DNA, 68 bp, Homo sapiens
caatttcactgtggagcacattttccaacactaaaaatgatggcaaatgtgtatacataatgattttg

SEQ ID NO: 6835098 - DNA, 56 bp, Homo sapiens
tcaatctgatttgttctagataagttctgggaatgcttgtctacataatagattga

SEQ ID NO: 6835099 - DNA, 60 bp, Homo sapiens
ggggctggctcactaagagactcctggcactgtgttgagtctagcatggagccagcgccc

SEQ ID NO: 6835100 - DNA, 73 bp, Homo sapiens
ctctgaattcttttgtttatggattgtagaaactgctttgggggtagttggatgtagaagcagaaggacagag

SEQ ID NO: 6835101 - DNA, 65 bp, Homo sapiens
ctacagtatgaaacctttactctctatactatgcatgatataatggatgaggggttcgtatgtag

SEQ ID NO: 6835102 - DNA, 76 bp, Homo sapiens
tgctgacaggccaggggctgaggtggcctttcctgacagcccaggatttcccttaagccactgacctccaaaagca

SEQ ID NO: 6835103 - DNA, 66 bp, Homo sapiens
aagagagaactaaaagctaacatcaggcaagtttcatattagttttctgcattttagttttctttt

SEQ ID NO: 6835104 - DNA, 120 bp, Homo sapiens
tgctctttttcccttctaccctttctacctggcttctttcatggaaggaaaaagttttgtttggagagcttgctgtattttctggaggaaaatagaaggaaggcctagaggaaaacagta

SEQ ID NO: 6835105 - DNA, 59 bp, Homo sapiens
gggctccaaagtaagctttagtttgaaaacatatcaataagagccaacactgcgagctc

SEQ ID NO: 6835106 - DNA, 59 bp, Homo sapiens
ttgaataacttttaaaagaccctggtgaagcaccatggaatattctatgagttattcag

SEQ ID NO: 6835107 - DNA, 81 bp, Homo sapiens
gctgccctcttcaacaaaatcactgatgctggagtcgcctgagtcatcactcagcaccaggatattgttggagaggacagc

SEQ ID NO: 6835108 - DNA, 94 bp, Homo sapiens
ccatgcctatcaggtccaccattatatctcccatgcctaacatagggcctggcatgtggctatataatgttgaaagaaatgacctactggatgg

SEQ ID NO: 6835109 - DNA, 98 bp, Homo sapiens
tggtgccaggcctctagtctactggcctgagccaggctgatgctggcaccaccgggccgccaccctgagctgggccaggggaatgagccctctcacca

SEQ ID NO: 6835110 - DNA, 57 bp, Homo sapiens
tttgcacacattcttagaaatggatattatctgtttttagcaagagtgtcgtgtaaa

SEQ ID NO: 6835111 - DNA, 67 bp, Homo sapiens
gccaaatactggaatcatagaaaactgagtattcttatcggtatccctgtgactcagtgattttggt

SEQ ID NO: 6835112 - DNA, 61 bp, Homo sapiens
gcagctccctggctgcaaatgaatccatcggatacagaagttttgaggtgagtggagttgc

SEQ ID NO: 6835113 - DNA, 60 bp, Homo sapiens
ttggatctgtactctaggggatttcttccagaaaagaaatcaatagggaacagagtctag

SEQ ID NO: 6835114 - DNA, 59 bp, Homo sapiens
tgcacagcagggcatggctgttgttcgctgaagggcagagaagtgccttgctggttgca

SEQ ID NO: 6835115 - DNA, 61 bp, Homo sapiens
aggtctgggcaccactggctgccttcctctttgttccctgggccctgtgatgtcttgacct

SEQ ID NO: 6835116 - DNA, 85 bp, Homo sapiens
ggaaaggaggctgtggttgctctgatttcaaggcccacaaaacttctctgacaactctcagagtaactacagtatagacttttcc

SEQ ID NO: 6835117 - DNA, 60 bp, Homo sapiens
atcacagccatagatgcttatgtaaagctgtgttcagtgttacaggcatctgttctgggt

SEQ ID NO: 6835118 - DNA, 65 bp, Homo sapiens
cctaacaccaatgccattttctacacattgtgtcctaatgtaaagggcatggtattgggaggagg

SEQ ID NO: 6835119 - DNA, 94 bp, Homo sapiens
caaacaaatccacatgctatgatgcagtgtggactatctttggtcacctacatgtcaaaggtggtcttaaactgctctggtttggtaaatgttg

SEQ ID NO: 6835120 - DNA, 65 bp, Homo sapiens
gcagaaactgtgttactagaatgtcttgcagaaacattacatttggttactaatataggatctgt

SEQ ID NO: 6835121 - DNA, 107 bp, Homo sapiens
gagttgaaagaggcccatatcaacataattctcagttgtgtaatatctgagagaccaagatctgaagaaatacagctggggttggaaatgggattttagacagtctc

SEQ ID NO: 6835122 - DNA, 64 bp, Homo sapiens
gtggaattcagtccagtgctaacaggttgaggtttcctttactacaagctactggtctttgcac

SEQ ID NO: 6835123 - DNA, 87 bp, Homo sapiens
aaagagcccatacatccaggtagccttcagatatggtgtcaaacagcccctttttctgtcactccctgatgatgaatgaggttcttt

SEQ ID NO: 6835124 - DNA, 58 bp, Homo sapiens
aagagcatgtgcagactctgacaggctttcagggaagccacgtcccccatgtgctctt

SEQ ID NO: 6835125 - DNA, 78 bp, Homo sapiens
tccccgtcctgtggactgtgctgccacagtgggcattctccatccacctcacagtggcgtgacagccatggatgggga

SEQ ID NO: 6835126 - DNA, 60 bp, Homo sapiens
cttacctggcctcatcagtaaatcaggggtcttcctggcaggtctgagaggtcttctgag

SEQ ID NO: 6835127 - DNA, 69 bp, Homo sapiens
atgcctacttgtaaatcacaagatttgggtctttcaaattaagccaacttctgattagcaagtttgtat

SEQ ID NO: 6835128 - DNA, 61 bp, Homo sapiens
caccaggctgcccaggacagggggagaggcccaccccacctgttcctttatgagcttggtg

SEQ ID NO: 6835129 - DNA, 62 bp, Homo sapiens
tccctttttcctgatctgtgaatgctggtgctagacactgctgaatagacaggaaaaatgga

SEQ ID NO: 6835130 - DNA, 66 bp, Homo sapiens
cctaaagtggaaatataactatgtattcccttaaaaacatgggtagatatggttagttaccatagg

SEQ ID NO: 6835131 - DNA, 57 bp, Homo sapiens
ctgggcatggacagctgcacagaagccaagggcatagtgggccgagttcatgcttag

SEQ ID NO: 6835132 - DNA, 91 bp, Homo sapiens
gtagacagtcacataatcatatttgtatcttttaaatattactttgcagggaatgtattggaaggaagcaagagagggaatgcgattctat

SEQ ID NO: 6835133 - DNA, 58 bp, Homo sapiens
ggggagccagcagccggcaccaccatcagctgatgatggattgcccacgcggttcctc

SEQ ID NO: 6835134 - DNA, 78 bp, Homo sapiens
catcatttttattgtttttatctctgtgtacaaccttctaaaatataaggttgtcttagtcagaaatatgcaatggtg

SEQ ID NO: 6835135 - DNA, 72 bp, Homo sapiens
cacctgctttagagcccagcttggtggctcaccgtatccaaggaggaccgccggctttgctccagagaagtg

SEQ ID NO: 6835136 - DNA, 99 bp, Homo sapiens
gttctacccacctggaagattcaccactaccactattttttagggccaccccgagtaggtctgtaggtagtggccagtacttctggttggttccagaac

SEQ ID NO: 6835137 - DNA, 63 bp, Homo sapiens
gttttgagatagaaactgtgaagagcaacctctggattccttttgacagtgctattaagaaac

SEQ ID NO: 6835138 - DNA, 57 bp, Homo sapiens
caccaaggctaaaataacatgttccctagaattaggaacatttggctggcttttgtg

SEQ ID NO: 6835139 - DNA, 70 bp, Homo sapiens
tcaagatatatatcaaagaatcaagatagtgaggttcacagcttcttgataggttttatgtatagtttga

SEQ ID NO: 6835140 - DNA, 130 bp, Homo sapiens
acatatttcaactgtgagatttcaaatgaagcctgttgttggctctgtgtttccaggcagctcacagatccctgtctaaaagcactgggtatagcaatgatctcatgatgttatctcaataaatttctgt

SEQ ID NO: 6835141 - DNA, 115 bp, Homo sapiens
acaccacgttaagaaccatggctacttataccattaagcctcacttagttcctaagcagagcttcatattcaataatctgtggatggattgaggcagtgggagtgccgtgggtgt

SEQ ID NO: 6835142 - DNA, 77 bp, Homo sapiens
tttccactaaggtgactatattgattattgatgtgttatttttatttacatatggtccaagtcatctttgtgtgaaa

SEQ ID NO: 6835143 - DNA, 88 bp, Homo sapiens
caaagcaccagggaaacggggctggccttcccgggaggtgacaccctcctggcactttgggggctcgccctctgttgccctagctttg

SEQ ID NO: 6835144 - DNA, 55 bp, Homo sapiens
atgtagttttggatggttgctgggtgtcagctacaagctccattggaaatcacat

SEQ ID NO: 6835145 - DNA, 60 bp, Homo sapiens
ggccgctgtggtgtgggagttcagaacactgtttctggagccacaaacctcagctctgcc

SEQ ID NO: 6835146 - DNA, 61 bp, Homo sapiens
gtacagctggactggtagctgtgggagtcccgagaatcccacagccctcccgtccctgtac

SEQ ID NO: 6835147 - DNA, 101 bp, Homo sapiens
cacctatgtggctgtttgtttatggagttttcggtggcctactttacctgtcattgtagcccatgcataaaccgttacttgtactatattatttgtgggtg

SEQ ID NO: 6835148 - DNA, 68 bp, Homo sapiens
cagggtgactgccctggccactgccaggcgagggctcgggggagggtggcagaggtgcatcagccctg

SEQ ID NO: 6835149 - DNA, 88 bp, Homo sapiens
atgatgacaaagccctttccatttaaaaatcacagttcatcaacatcatcgaatcaatggctggaaatgaatggagaggtggtctcat

SEQ ID NO: 6835150 - DNA, 88 bp, Homo sapiens
tcaagaattttccagtttcatagctacgattttgggtgatcttgtcaagagcttccagtttcatagctaaggaactgtttattcgtga

SEQ ID NO: 6835151 - DNA, 61 bp, Homo sapiens
ggggacaggccatatggaatacattttggtggctgagatgtatctgtgtgccttgatttcc

SEQ ID NO: 6835152 - DNA, 76 bp, Homo sapiens
taatgttggtgttcactgaagctggctttaaaataattacaacactaaaaacagagcagcagtgatcattacatta

SEQ ID NO: 6835153 - DNA, 57 bp, Homo sapiens
acaacagctgttcacaggggtccatatagtcaaaagaccccgaggtgaatcttttgt

SEQ ID NO: 6835154 - DNA, 79 bp, Homo sapiens
cactgagcagatctcaggccttctgttgctgggtggtaaaggaggtctttgtggccacgggagggctgtttgcttggtg

SEQ ID NO: 6835155 - DNA, 62 bp, Homo sapiens
cagacatggcgccaagtgctagaccagtatcataatggtccaggcacttcccatcatgcctg

SEQ ID NO: 6835156 - DNA, 58 bp, Homo sapiens
ctgagaagcctgttcttaagcccagtccaaggctggcctctggagaagggctttccag

SEQ ID NO: 6835157 - DNA, 69 bp, Homo sapiens
agagactggctcagaatctgtcatgttctattgataatgatgaaaatatgattctgaggccctgttact

SEQ ID NO: 6835158 - DNA, 79 bp, Homo sapiens
ctgtttttcactgaagccactggaagaggagtcttaacattccatatttcagagtttcagaaccccccgtgaaaaccag

SEQ ID NO: 6835159 - DNA, 66 bp, Homo sapiens
gtccacagagggctgggcaggcgcctactcagggtagtgtgggccgaggcttagcccatctgggac

SEQ ID NO: 6835160 - DNA, 65 bp, Homo sapiens
atcagaaactcttagagcagggcctggtgacctgtattttaagaagctctgcaggagattctgat

SEQ ID NO: 6835161 - DNA, 66 bp, Homo sapiens
ccctcttagggaattatctgtcaaagagcgcattctccttgtttggcaggtagtcccaaagggcgg

SEQ ID NO: 6835162 - DNA, 67 bp, Homo sapiens
gagagaattagggcgtaattcagacaattgaatgcatactttctggagctacagtcctgaacctctt

SEQ ID NO: 6835163 - DNA, 129 bp, Homo sapiens
ccccaacatgtgctttccagagcctcagatgtttccttagttctacagatggtttgtaaattcatttcagctcaatttgccagtgctgcagaaagtatctatggctgattggagtcacagtttggacgg

SEQ ID NO: 6835164 - DNA, 59 bp, Homo sapiens
gtttgtcaggaggttgaagtcatctcccgtcttgagcttcaaagtgtgacctgacaagc

SEQ ID NO: 6835165 - DNA, 128 bp, Homo sapiens
gtcacctcaggatggagttgagctggggcctgccttacacttctggcagctctatcatgtcccctgagatctgcccacagcaaagaggtaggaaacgccctgaggttcatccatcctgtaccaggtac

SEQ ID NO: 6835166 - DNA, 91 bp, Homo sapiens
ccaagagtgtgtttctcagaattaataaccacaaggcccttttcttacagaggtcttgtaggtactggtttgctgtgaaatgcacttttgg

SEQ ID NO: 6835167 - DNA, 87 bp, Homo sapiens
gaaccatcagataatatatttgtgttgttttaagccaccctgtttgtggaaattgttacagcagcaatggaaagcaacacaaagttc

SEQ ID NO: 6835168 - DNA, 60 bp, Homo sapiens
cctcagtccttccttcattccttccctcggaaaggataagaatggaaggaacagatgagg

SEQ ID NO: 6835169 - DNA, 83 bp, Homo sapiens
attaaatagaaacaggctggctttccctggacaacagcgataacttgctgatgtgtttggaggtcagcctgtggctgtgaagt

SEQ ID NO: 6835170 - DNA, 75 bp, Homo sapiens
taactttttctagttagttgttgaacatggatgtgatggttctcctttcatgaaagacagcaactgtgatggtta

SEQ ID NO: 6835171 - DNA, 108 bp, Homo sapiens
tccacagtgggaacagtgccaagaggaattggaaggaagaaccgcggtagctgccctgcagttaacagctgttgcttctcttcttcctaaaagtcacagcactttgga

SEQ ID NO: 6835172 - DNA, 61 bp, Homo sapiens
gatgtcttaggtaacattctattgcagatctctgccttcggagcagtaacttgagatgatc

SEQ ID NO: 6835173 - DNA, 75 bp, Homo sapiens
tgtgttcaagctcctaagagcaactgtgcttttctggtgatttggcatgaggttcttggccagcattgatatata

SEQ ID NO: 6835174 - DNA, 128 bp, Homo sapiens
tgaatcacctgctggtatcgtggcctgggctcacctggtggcctggctctcaccttggccggccctgcccaggtgcctgccggtgccgccagcccaggcacgataggattctgccagctggagaggca

SEQ ID NO: 6835175 - DNA, 56 bp, Homo sapiens
tctagaagtatattgtagggtggcatattttggtctcctacagtcctatttttgga

SEQ ID NO: 6835176 - DNA, 125 bp, Homo sapiens
tagcaaagtagggacttgttgattttgaggttggcatttctttccctactagttcctcaggcctgacttcatgcctggctggtagagggggctcaacccacattgatgaatgggcctgcaggcta

SEQ ID NO: 6835177 - DNA, 58 bp, Homo sapiens
ctgaagggggtttcactgagctgcagccaaagcatgggtgagactgtgctccctccag

SEQ ID NO: 6835178 - DNA, 117 bp, Homo sapiens
gctggaggctacaaaaactggcttctcaaagttctattgcacacaaataattacttcaagaaacaaatgaagtgttatttattggcagtaggacctggatccttggtgatcaccagt

SEQ ID NO: 6835179 - DNA, 58 bp, Homo sapiens
acggtccttggggaccaaattgaaagctttagggctttgactttgtcctcaggaaagt

SEQ ID NO: 6835180 - DNA, 69 bp, Homo sapiens
cctcctctataaagtgcatgcggggccagatgcagtggctcacatctgacctcccaacactttgggagg

SEQ ID NO: 6835181 - DNA, 92 bp, Homo sapiens
gctgatcagttcagtagcagctgcctaaagtgctaagaaagataatgcatccacatctggactctagggggactgtgctctgatagattagt

SEQ ID NO: 6835182 - DNA, 85 bp, Homo sapiens
taaaatacatgggaaagttagactcttctaaatgggaaaacgattatctcagaacagttcttaatattgccgtctttgtatttta

SEQ ID NO: 6835183 - DNA, 92 bp, Homo sapiens
gccaaaataaattattctcatgtgtttcttggtaatgttctttctaacttaacaggaaggaaggaaagaaaacatgatctaatttaattggc

SEQ ID NO: 6835184 - DNA, 91 bp, Homo sapiens
tttgtttacctcattagatagtaatgttcagtgtctcacttatctttctagtggcttatctgggacagctaacaaataatgtataaataga

SEQ ID NO: 6835185 - DNA, 55 bp, Homo sapiens
tttataccccacctggggcaagccatagacagtgattggcagtgtggggtatgaa

SEQ ID NO: 6835186 - DNA, 59 bp, Homo sapiens
aaagctcttatagcagagtgtgatttgggaactaaccaacagactctgtgtgagacttt

SEQ ID NO: 6835187 - DNA, 57 bp, Homo sapiens
gaaatgatgtctgtgctgccactgtctctctgtggtaatagcatcatcaatcatttc

SEQ ID NO: 6835188 - DNA, 82 bp, Homo sapiens
cccctaggagggaacatcatgtctccaagtctctgaaaatcagtttcaaggttgttgaggcctgactgctgcccctagaagg

SEQ ID NO: 6835189 - DNA, 66 bp, Homo sapiens
caagccatctctggcctcactgccctcccctttagaaatgtgggaatgaggctcagagaggttgag

SEQ ID NO: 6835190 - DNA, 56 bp, Homo sapiens
tctttctatggacagcatacttctttggcctattgccatggctgttagtagataga

SEQ ID NO: 6835191 - DNA, 60 bp, Homo sapiens
aagcttgtactgtagtttgttggaagtaatgctacgtaccaaccaagtgcagagcggctt

SEQ ID NO: 6835192 - DNA, 76 bp, Homo sapiens
gcccccaacttttgaaaggacttagagagaaaaatggcaaaagtgccttctgggatttttgaagactcctgggggc

SEQ ID NO: 6835193 - DNA, 60 bp, Homo sapiens
gagggcatcaagttagtctcgaatatctgtagtgatggtagatgattatctgaagccctt

SEQ ID NO: 6835194 - DNA, 64 bp, Homo sapiens
acattgtagttgttctgcagcatccattccactcctctcccgctgtataacaactatgcaatgt

SEQ ID NO: 6835195 - DNA, 66 bp, Homo sapiens
gcactaaactaggctgggaagaaagattctcggggcagaattctgaaatctttgccttagctgtgt

SEQ ID NO: 6835196 - DNA, 130 bp, Homo sapiens
cattggaatcacctaggaagcgtaaacaacatactagtgcctgggacttgctccggattaattaaatcagaataactggaagtgaagcctaggtatgagtgtctcttaatatccccaggtgattctaatg

SEQ ID NO: 6835197 - DNA, 82 bp, Homo sapiens
ggtagggaccgaggctgcctagtcctaaccaagaccgaggtctcccccttggctctgggattaccagccttaggcctgggcc

SEQ ID NO: 6835198 - DNA, 111 bp, Homo sapiens
gtttatcactaaaattctatggctttgggattgatttattgtcaagtatgatgactgttatacttcaacatatcagtcagaatcacagaaaaatagataataaagatgaac

SEQ ID NO: 6835199 - DNA, 67 bp, Homo sapiens
tttgatttgcttgttcaccagtacttttggagcagaatgtcaggagtatgtgaggaagtaaagaaga

SEQ ID NO: 6835200 - DNA, 62 bp, Homo sapiens
gaagaaaagactatttcatggctgtcaacctacgcttcctgcctggaagacgtcttggcttc

SEQ ID NO: 6835201 - DNA, 58 bp, Homo sapiens
ggacactgcatatgttgagttagttgttacagttctggctcagagtattgcactgttt

SEQ ID NO: 6835202 - DNA, 59 bp, Homo sapiens
ggatggcgggccatggacaatgcgctgacctagctgtaagtcacctggcccgataatcc

SEQ ID NO: 6835203 - DNA, 88 bp, Homo sapiens
ggtggttctgggtctgggatcctctatggggtgtcaggtctaagtcctggagccttcaccaggggaaaggtccctgacccacactccc

SEQ ID NO: 6835204 - DNA, 57 bp, Homo sapiens
acattctttctcttcaggaaactgggaagacaacacccaaagccagagaaagggtgt

SEQ ID NO: 6835205 - DNA, 79 bp, Homo sapiens
tcaaagtgatcttctggcatctgctgtttttcaggtgtttttagcttaaacagttaacatgccagaatatcatatttga

SEQ ID NO: 6835206 - DNA, 61 bp, Homo sapiens
ttccccttttctaattatggtttgcccagacccatggaccaaccagaggcagaaaggggaa

SEQ ID NO: 6835207 - DNA, 62 bp, Homo sapiens
gcaggcagaaaaatgtgaaaagagagattggcctagtctcccagcctacatctttctcctgt

SEQ ID NO: 6835208 - DNA, 58 bp, Homo sapiens
caaggtttacattgggctatcaggagtggcttcatgggtagctgagaagtaaatgttg

SEQ ID NO: 6835209 - DNA, 67 bp, Homo sapiens
cggggggaatggtgggaggcgaacacggagcagcccccaagtgacagagcaccccatcttcctcctg

SEQ ID NO: 6835210 - DNA, 129 bp, Homo sapiens
aaggatgacatttccagaataaagcagccagccctgtggtaggatcagctgtctggagactcacgtcagttggaaatgactgtttttccagttgtcctatcacctgttttctggaaaaaaaaaaaaagt

SEQ ID NO: 6835211 - DNA, 64 bp, Homo sapiens
ggcacatagtcaacacacggtacttgagaatgcttttcccaagacgatgtgcttggcccttgcc

SEQ ID NO: 6835212 - DNA, 105 bp, Homo sapiens
ggggcaagaaaagacgaacttgagcatacacagcccacgagctacacttatccagaaatacagcaccctcttgagtgcgcttgggtgttctagtgatttctctcc

SEQ ID NO: 6835213 - DNA, 73 bp, Homo sapiens
agggtagaaagtcccagactccagttttctgctttgtcaattagtagctgggtcatctgggactagttgctct

SEQ ID NO: 6835214 - DNA, 57 bp, Homo sapiens
cctaggggcctctaggctcagcacaaaaagtaccgctcagtcctgttagcctttggg

SEQ ID NO: 6835215 - DNA, 77 bp, Homo sapiens
ttagtgaccactgaatatgactgcctacatggaaacagttaggaagatgtgtttagcaggtttagatcaagcactaa

SEQ ID NO: 6835216 - DNA, 129 bp, Homo sapiens
gaggtaagtcttctcctggtgtttagtcaggatgccttagagtgtgttgtgttgtattaaatgatggatggtgtaacaaatacccttgaagttctcactggcttaacataaagagttagtttcttcctt

SEQ ID NO: 6835217 - DNA, 74 bp, Homo sapiens
ggctatcagtcattgtccttaaaacactggaggagtagctcagtgcacacaggagcagtctgataaaagcagcc

SEQ ID NO: 6835218 - DNA, 66 bp, Homo sapiens
ggtgtctgcttccctccagctgtccagggttttcagctgggtctcagaaacgaagttcaggacacc

SEQ ID NO: 6835219 - DNA, 91 bp, Homo sapiens
ggagcaggggggaggaaagaaagcagaccaagaatatagaggcctggacctctttagtttagtgcctggtttccttcttgccttcagtttc

SEQ ID NO: 6835220 - DNA, 66 bp, Homo sapiens
agggagtgcctggtgttgcagctggtccggtaggcagagagggccagcagcccagaaggactttct

SEQ ID NO: 6835221 - DNA, 59 bp, Homo sapiens
taattagaaagggttttggggccagatgttaaactggtctcaaatgccagttttattta

SEQ ID NO: 6835222 - DNA, 130 bp, Homo sapiens
aagtaatagaccttgggattatcatagtgaattgtgctctgcccctgactgttttagtaagattaaaattaataacttcatcaaataggcacatttcatgtgtgtgaaaattactcaatttcttttcctt

SEQ ID NO: 6835223 - DNA, 67 bp, Homo sapiens
tgcaaaaatgacaagagttgtgaatctgaatgaggggcataccagagttctttacgacctttctgca

SEQ ID NO: 6835224 - DNA, 86 bp, Homo sapiens
aacatgttgtgtcagcttggaaataagggtggaataaaccctttactttctatcccatccttctagctgaccacctaacaactgtt

SEQ ID NO: 6835225 - DNA, 80 bp, Homo sapiens
tgtggacatgagagaatgtacaaagagtatagctttgagttcttttcattttaaggattactttgtgtacccatgtccca

SEQ ID NO: 6835226 - DNA, 107 bp, Homo sapiens
gagtggctgacaatatcaaattctgcaggcacatctgaaaagatgcacaagtagctgctggatttggcatttttcagatgactggtaaccttggtaaggttagtttc

SEQ ID NO: 6835227 - DNA, 63 bp, Homo sapiens
ctgtcccatactatctgggtgatgttctaactctcaactgcctcatctataaaatggagacag

SEQ ID NO: 6835228 - DNA, 64 bp, Homo sapiens
ctgcccatggctcctggctgtggttcttcttggtctgggtcccacatctcagggctacaggcag

SEQ ID NO: 6835229 - DNA, 88 bp, Homo sapiens
gctaagattgtaagggactcttgagtaatatttacatgtgtcttagccacattcagtgttaaattcaaagagttggtttcaatccagc

SEQ ID NO: 6835230 - DNA, 55 bp, Homo sapiens
aagccactatggtgattctcaaacttgagtggacttaagaattaccaaagtgctt

SEQ ID NO: 6835231 - DNA, 65 bp, Homo sapiens
ttggttctttgtggctcagatctgtcaccccttaatgaagtggctttctggctgccaaggattga

SEQ ID NO: 6835232 - DNA, 79 bp, Homo sapiens
ttcttagccattggctggaaacactgcaagtgtctcttgcaaatgcttgcaagtgtcaagctattattgctgctaggaa

SEQ ID NO: 6835233 - DNA, 82 bp, Homo sapiens
atgtgaaagtaatgtcctgtttgagatttgtcacaactcttaggaagggatagaacaggggcaggagcattcacttttacat

SEQ ID NO: 6835234 - DNA, 62 bp, Homo sapiens
gcattggagaacagaggctcatcattacattttatgtactgaatagcccttctgtctcctgt

SEQ ID NO: 6835235 - DNA, 64 bp, Homo sapiens
atgagcagggactttgagtgtagtctttggattcatacagatctgggcttgagttcctgctcgt

SEQ ID NO: 6835236 - DNA, 63 bp, Homo sapiens
tctgaaataagtggacacatactccaccatccccaggtagtgtacagtgtgtgccctttcagg

SEQ ID NO: 6835237 - DNA, 103 bp, Homo sapiens
gcacacagtcctgttggtccagcactgacgcctgggggatctcagtggggcctgggggactgcactggcgtcagtgagttggagtcaggaatctgtcaagtgt

SEQ ID NO: 6835238 - DNA, 64 bp, Homo sapiens
ctgagcccaggcagaggttgcagtgagacgagatttcaccactgcacttcagcctgggtgtcag

SEQ ID NO: 6835239 - DNA, 55 bp, Homo sapiens
gcctttgtactctggtccaaactttgccaaaatatggatgcgtgagtgcaaacgt

SEQ ID NO: 6835240 - DNA, 65 bp, Homo sapiens
tgagagcctgtgttcaaatgccagctctgtcctttcccgctgagtcaccttgaacaggctactca

SEQ ID NO: 6835241 - DNA, 113 bp, Homo sapiens
tggaatcacctggcaagatttaaatactatgatgcctggttcccacccctggaaattataatttaattctggggtgcagcctaggcatcaggaaattgttgcaggtgattcta

SEQ ID NO: 6835242 - DNA, 69 bp, Homo sapiens
ggctgttccagaggttactgaggggcccccaaggaagagaggggcccagagtggccacttggctcagcc

SEQ ID NO: 6835243 - DNA, 77 bp, Homo sapiens
gagattcgttgcctgaagacacttccatagattaggggacatactcagttgaagtagtatcttaaggacatgaactt

SEQ ID NO: 6835244 - DNA, 76 bp, Homo sapiens
ggcatagtagtgaggggaggtccagattctggccttcagggaactggtgtcaggtctgatgcctcatccattggcc

SEQ ID NO: 6835245 - DNA, 64 bp, Homo sapiens
ccatcttgggtcactgccccccgccggagggcggtttttctgaggtcagtgacccacgagatgg

SEQ ID NO: 6835246 - DNA, 85 bp, Homo sapiens
ggagaggagatggcaagaatcctcatcacgccgggtgtaagacctcacccaggtcccacggtgaattcgtgccagaatcctgtcc

SEQ ID NO: 6835247 - DNA, 75 bp, Homo sapiens
tctttcaaacatagatctgaatatgaaagagaaaagaaacacttccatatttgttagagtctatgtgtggacaga

SEQ ID NO: 6835248 - DNA, 65 bp, Homo sapiens
gtgttcagtggtatctcattgtggttttgctttccatttccatgatggctgatgatattgaacat

SEQ ID NO: 6835249 - DNA, 87 bp, Homo sapiens
gtgatgtcatccaaattgcttcatgaggtagtggcagtgggatccatccttgtttgcacatgccagcctcagcagcagtggcattat

SEQ ID NO: 6835250 - DNA, 81 bp, Homo sapiens
gttttgtacaggtaggttatttcagggataataatagttaaaatttataaagtgcttatgataaccaagcactgtactaac

SEQ ID NO: 6835251 - DNA, 59 bp, Homo sapiens
tttaggggaaaatctttggtttgtctgttattaattggctgtgagattttcgtcctgaa

SEQ ID NO: 6835252 - DNA, 73 bp, Homo sapiens
ccatttgcttgcctcccccaggtcaggcattcctcaattatagtcttaaacctggccaagcgagaacaaatgg

SEQ ID NO: 6835253 - DNA, 59 bp, Homo sapiens
ggcagaggaacagtgtcatgtagctgctactgctcactcacacatttctccttctgacc

SEQ ID NO: 6835254 - DNA, 65 bp, Homo sapiens
gaggtttccagttaaagccagctgaaaagtcttgaaagcgaaagggttggttacaactgagcttc

SEQ ID NO: 6835255 - DNA, 79 bp, Homo sapiens
aggctctaagtggtcctgagtagctttagaatctgaataaatcacacatactagggatccatcgagaccactagaaact

SEQ ID NO: 6835256 - DNA, 110 bp, Homo sapiens
gtggggttaatgttctttgccctgcggccttccagggttgtgggcttcagcagaagtgatattcctgcgaaagctttgaactctaaagtatgtttcgggtataaccttgc

SEQ ID NO: 6835257 - DNA, 67 bp, Homo sapiens
aggtccgatttcagtgctgtcatttgtatgaaggttttccttgtacattgaaagtcatttaatccct

SEQ ID NO: 6835258 - DNA, 67 bp, Homo sapiens
gcaagctgagactgcagccgggccagttggtgcaggcccagcatcctggctgtggatttgggcctgc

SEQ ID NO: 6835259 - DNA, 83 bp, Homo sapiens
atatgtgtgtgtatatgcatttatctatacatttgtgtacatgtatgtgtgtgcactagagagagatatatacacacacatat

SEQ ID NO: 6835260 - DNA, 68 bp, Homo sapiens
tactttatatatgagaaagctgaacttcagagggttgaaatgaagttcctgagctcatatagcaagta

SEQ ID NO: 6835261 - DNA, 57 bp, Homo sapiens
aagactacttttggcagtgtgtataagagatgtgtatacatgtaggtaggtagtctt

SEQ ID NO: 6835262 - DNA, 87 bp, Homo sapiens
ttattctccttatgcctgaaatgtctgaaagccaatctgcactgtgaaggatggagatggcagaggttatgggcataatggaaataa

SEQ ID NO: 6835263 - DNA, 82 bp, Homo sapiens
ggcctggagtatgctactgcttgggaagcactgtgggcagcggctgcaggtgacaagatcacagtcaagtgtatttggggct

SEQ ID NO: 6835264 - DNA, 90 bp, Homo sapiens
ggcggggacagtctgattgagctgtgtaagttggaagcagcgagacattgcattccagctctcatactctgggaacgtcacctacctgcc

SEQ ID NO: 6835265 - DNA, 127 bp, Homo sapiens
atctcagtcaaattgttccctctcttatcattctattttcatttttattagctcttgtttatactcaaaagatggggttataaaggtgataatggtcagatctagaagtgaactctcttactgcaat

SEQ ID NO: 6835266 - DNA, 59 bp, Homo sapiens
tattttctttcttaaacatgttgtgcttgttaagctaaagtgtgtgtggaatgagaata

SEQ ID NO: 6835267 - DNA, 61 bp, Homo sapiens
taagtgttctgctgaagcagccacattagaatagcctgtttggcagcttgggcagcagtta

SEQ ID NO: 6835268 - DNA, 55 bp, Homo sapiens
gtgggagcaggctgatgataggtaagaatcatgtatctagaatctctctccccac

SEQ ID NO: 6835269 - DNA, 61 bp, Homo sapiens
ggggtgatattgggcctgtgctgggcccccgagggcctcccaccaggcccggtgtctcctc

SEQ ID NO: 6835270 - DNA, 60 bp, Homo sapiens
ggactgcccttgagatgaggatctgggaggagggacaggtcctcatctcaagggcagtcc

SEQ ID NO: 6835271 - DNA, 61 bp, Homo sapiens
acacatgcatacctatgtgtatatatgatatgtgtgtgtgtgtgtatgtgtgtgcatgtgt

SEQ ID NO: 6835272 - DNA, 72 bp, Homo sapiens
ggtaacagtggcagtggaaagcacacggggtaggcatagagctgcctgggtgctggcactgtccctgacact

SEQ ID NO: 6835273 - DNA, 65 bp, Homo sapiens
cagtgtgaatagttctatggctgcagggctccagcgtggctcttccaaatggctgttcttcactg

SEQ ID NO: 6835274 - DNA, 60 bp, Homo sapiens
tcaccctcattcctaaggttctagggaaagtatttttaacacaggaactctgagaggtgg

SEQ ID NO: 6835275 - DNA, 87 bp, Homo sapiens
tttgtaaagctatagagtccaaagtatgaatatgctacaatttatgcatatactttcctcctttggtaagcttttggttttcacaaa

SEQ ID NO: 6835276 - DNA, 129 bp, Homo sapiens
ctgggagagctgggagagtcaggccatgggttccacccctggattcagttctcgtttctgggtaggaaacctggaacatttgactaggaaagccaaggcctcacctttcccaggacactctcagcccag

SEQ ID NO: 6835277 - DNA, 92 bp, Homo sapiens
cccaagcagtttgtcagggacacaggtatctcaaatgattctctgcggttgagaatcactgccttaggtgttactggtagcgcgtgcaaggg

SEQ ID NO: 6835278 - DNA, 90 bp, Homo sapiens
ttcctagtaagcctgagagtacttatatgaacatttgtcacatacaatatttaacagatgtctcatttcagtgtttctattactagagag

SEQ ID NO: 6835279 - DNA, 56 bp, Homo sapiens
gctctatagtattaggcctctagatgcttagaaagagggttgtaagattgtagagc

SEQ ID NO: 6835280 - DNA, 72 bp, Homo sapiens
gatgctttgtaaagtatacatatattagccttcgctagtaatggtgatgctaacttgtatagctaatgcatc

SEQ ID NO: 6835281 - DNA, 76 bp, Homo sapiens
ttggggatacccttaaacagaatgcgtaagaagtggctataatcaggtgcttccaattcaaatctgtggtcctcaa

SEQ ID NO: 6835282 - DNA, 77 bp, Homo sapiens
ggagctgactttatcctgcctgaccacgcaatgagccatacaatgctcctctgtggatgaggcaggtgaaattctcc

SEQ ID NO: 6835283 - DNA, 115 bp, Homo sapiens
gggctaaagtcaaggtgtcagcagctctgagttccttctggaggctccaaggacagtccatttccttgccttgtccagtttctagaggcctcctgccttccttggctcacagccc

SEQ ID NO: 6835284 - DNA, 76 bp, Homo sapiens
aatattctattctcctggcatgtgggtcatctctcattgacatctggaggtgttgcagtggggaaagcagaatatt

SEQ ID NO: 6835285 - DNA, 63 bp, Homo sapiens
aactgtgtaatgttgttggccaaatgaccccagtcattaagattcctatggcattatttagtt

SEQ ID NO: 6835286 - DNA, 98 bp, Homo sapiens
attagagaaaaagtagaaaaccaccgctgttgtatgttttttaattgcttactataattattatgacaacaattgctgggtggatttccatctctgat

SEQ ID NO: 6835287 - DNA, 61 bp, Homo sapiens
ctttggaagtgaccacaatcctggtccatttgccactccaaggattctggaactttgaagg

SEQ ID NO: 6835288 - DNA, 80 bp, Homo sapiens
tccacttataattcctgctgtttggtgagtgagaaataaagatataatttactggctaagccagtcctataataagtgga

SEQ ID NO: 6835289 - DNA, 61 bp, Homo sapiens
atagcctggagaagatgtgtattgtacacaggaatatgaatgcactgctctcctaggaagt

SEQ ID NO: 6835290 - DNA, 74 bp, Homo sapiens
gccagttttctgctggatgtttaagaagcttacacatatacaaatgtattttatgcatatagcagatacgaggc

SEQ ID NO: 6835291 - DNA, 69 bp, Homo sapiens
ggggtgacaggcctgaggttcctgtgctcaccagcagcgaaggtgacattagaacccaggtgtctctcc

SEQ ID NO: 6835292 - DNA, 74 bp, Homo sapiens
tctctgatcagcaccactcttattccctcagaaatatcacaaacttggcagatgaggaaatagaggctcagaga

SEQ ID NO: 6835293 - DNA, 55 bp, Homo sapiens
agcactatgcaacagggacagctgccgtgatagcaaccctgtaattgttggggct

SEQ ID NO: 6835294 - DNA, 56 bp, Homo sapiens
gtggtgagacgagctccatgtcttatgtagtattcatatatatgtgtctcatctac

SEQ ID NO: 6835295 - DNA, 58 bp, Homo sapiens
ggcacttgttcacctgtggagctggacccaggggtcagatgccaactgaacaacagcc

SEQ ID NO: 6835296 - DNA, 57 bp, Homo sapiens
tttggcagctctacctttttataccaaggcctgtataagttagagagcaatgctaaa

SEQ ID NO: 6835297 - DNA, 55 bp, Homo sapiens
gccgttattctgctggccccgggagcattcccatggatcatgcacgggagcaggc

SEQ ID NO: 6835298 - DNA, 61 bp, Homo sapiens
gccaagatttagcttacctcgttactgactttttgtttcaggtcggtgctaagttttgagt

SEQ ID NO: 6835299 - DNA, 76 bp, Homo sapiens
ttctctgcagccctcagatcagcttgttggcacaggacaattaatgtgttctgggctgtccagagggtgaggagaa

SEQ ID NO: 6835300 - DNA, 126 bp, Homo sapiens
tcagcatcatctggactcctgttagaaacacacattgttgggcccaacaccagatctttactgaaacagaaactctggattggagtccagcaatctgtgtttaacaaactctgcaggtgattctga

SEQ ID NO: 6835301 - DNA, 83 bp, Homo sapiens
gttgtatgaaagcagagtctgtgtgcactttagtttatccttttattttcaaagcctaacatagactctgcaacatcatagac

SEQ ID NO: 6835302 - DNA, 82 bp, Homo sapiens
agggaaacccagttgcttgggtggatccagacaaaatggattttcatccttggattttgtgcccacgcctctgggtcacctt

SEQ ID NO: 6835303 - DNA, 81 bp, Homo sapiens
tttcctcccctcagagcacagtttatgacagttcaagttttgttctctgttctgtaagctgctgttgtgcaagggaggaga

SEQ ID NO: 6835304 - DNA, 77 bp, Homo sapiens
cttctgtgacgtatgtgaggacagcgacgttcccctatatcagttctggtcttcaggcagcattgcatcagcgggag

SEQ ID NO: 6835305 - DNA, 70 bp, Homo sapiens
tggcgggattacaaaactggtgtgtctgagtccagtgctcatgcagcttccatattttgctgattcccta

SEQ ID NO: 6835306 - DNA, 76 bp, Homo sapiens
agatgtgtttaactctgttactgtggactattctcactttgagaaatgtttcaaatatatagagttgtatagattt

SEQ ID NO: 6835307 - DNA, 65 bp, Homo sapiens
tgtagttagtgaagcaggtgaagtgcttaaaacagaatttgacacattaaatgctcacaaacaca

SEQ ID NO: 6835308 - DNA, 59 bp, Homo sapiens
actcctgtgggcatggcaccccctggagttgtgcaaggtggcaaccctgcccatggagt

SEQ ID NO: 6835309 - DNA, 129 bp, Homo sapiens
ttattatatacaagatgtagcttaagtgttctggaaatgagtaaaagtgaatcttatgtctcagatagaatgtaggagtacttttgcatgacaggaacttggcagcttgcatttcttgtgtcaatataa

SEQ ID NO: 6835310 - DNA, 80 bp, Homo sapiens
gaagccactctgcagctcggccagctgttccttgacctcacaggtctgggagagcacgtggctgacagcggtgtggtctc

SEQ ID NO: 6835311 - DNA, 68 bp, Homo sapiens
ccttggaaagaggttctaatttaactatcctggtaaacaagaaggaaataaaggatttctgaccaagg

SEQ ID NO: 6835312 - DNA, 58 bp, Homo sapiens
ttagacactaatgttatcctccgcttttgatcaggccaggctaaatgttagagtctga

SEQ ID NO: 6835313 - DNA, 66 bp, Homo sapiens
tttggccagggaggaatgtccctttgttcttcttccccctgagaagccattcctttgtctgccaaa

SEQ ID NO: 6835314 - DNA, 55 bp, Homo sapiens
caaatgtttgcatcacagggcatttcctttgtccagtggtacatggagacacttg

SEQ ID NO: 6835315 - DNA, 62 bp, Homo sapiens
gcccggggttctcagagtagggggtggcagtgccagaggtcccattgagctctgagaactgc

SEQ ID NO: 6835316 - DNA, 93 bp, Homo sapiens
ctgggtcaaatggtatttctagttctagatccctgaggaatcgccacactgacttccacagtggttgaactagtaaatcatacatttaaccag

SEQ ID NO: 6835317 - DNA, 118 bp, Homo sapiens
ggtcctcagactccctccaggcatgtgcctgcctgtgctgttccctctgccaggaatgcttccttgcagatacacgcatgcatggccagctctcacacctccttcaagtctgctgacc

SEQ ID NO: 6835318 - DNA, 81 bp, Homo sapiens
cagttttggcagggacaggggagaaaagatgaaatcactccctgcagcatcatttcccactgtccgtgtgtgtgagaattg

SEQ ID NO: 6835319 - DNA, 56 bp, Homo sapiens
cagactgcccatgtttgccatttgctgtttgactggtaaattgtttggcaagtctg

SEQ ID NO: 6835320 - DNA, 88 bp, Homo sapiens
ttgcttgtcacaacgcaagagtttcttactggcatctattgggtagagaccatggatgctgctaaaattctaacggctcacaggacaa

SEQ ID NO: 6835321 - DNA, 84 bp, Homo sapiens
acccagcccaggtaccagtcctcctaactgaggttcagggcctgggaccaagccctgtcctggatgggagcactgggggcgggt

SEQ ID NO: 6835322 - DNA, 79 bp, Homo sapiens
aggttaaaacttggtagttcttaaaaggtgataataagaaagtgatcattagagaaatgttgccaagatttagtttcct

SEQ ID NO: 6835323 - DNA, 115 bp, Homo sapiens
gtgcaggctgcttcatgtcctttaggctcttctgtggcagccaagggggtttccttttttcttccctctatttctgggccacagagaggaaagaacaaagatgctttccctgcac

SEQ ID NO: 6835324 - DNA, 60 bp, Homo sapiens
gcctgcaagccacctggagatcttattaaaataaggattctgacttaggaggtttcgggt

SEQ ID NO: 6835325 - DNA, 89 bp, Homo sapiens
atagaattaaaacatgacttttctcttccagagtcctggggctgtctaaggaactatggtgagatagagtgttatgggttgaattttgt

SEQ ID NO: 6835326 - DNA, 72 bp, Homo sapiens
agggcttggttttctcagctggaccatgatcctatttttatgtttgagctcagagaacatgattaatgccct

SEQ ID NO: 6835327 - DNA, 61 bp, Homo sapiens
gctgtgtgttttcagtctgcattgtcacccataatgcagtactgatataaacaaacacagc

SEQ ID NO: 6835328 - DNA, 62 bp, Homo sapiens
atggccagtctattcatggttatgactatcaagataagctgggcatgtgatagattggctat

SEQ ID NO: 6835329 - DNA, 76 bp, Homo sapiens
ggatattgacttaatatatatttggtagaagtctattaaaggaaaaatactgaatatgttttcaagtcttttatcc

SEQ ID NO: 6835330 - DNA, 93 bp, Homo sapiens
atttgatccttgatccagaggagggaaaggaccaatcaccttcactctactgtgaggcaatgtccttcatccttggttctgcttcagtcaaat

SEQ ID NO: 6835331 - DNA, 73 bp, Homo sapiens
ctgttatagtgaagccctctgtattatcttagtaacttgtatttgcagaggaggaagagctttaaaataacag

SEQ ID NO: 6835332 - DNA, 85 bp, Homo sapiens
tggccagagcttagtacaggcccatccgtcacggggctgatttggttcagcaggtgttggctgggccatcgctcatttcaggcta

SEQ ID NO: 6835333 - DNA, 57 bp, Homo sapiens
ggctgaacaaggtcggggggaaagaaatgcttcacatacctttggatttgtttagtc

SEQ ID NO: 6835334 - DNA, 85 bp, Homo sapiens
cttaactgtaaaaaagatacttgctggtggctttaaagaagacactgaagaacatcacctcagagattattttgaacagtatggg

SEQ ID NO: 6835335 - DNA, 60 bp, Homo sapiens
ctcacggaattctcagtgtggttttcaacatcacaaaactacattgtcctttctgaagag

SEQ ID NO: 6835336 - DNA, 84 bp, Homo sapiens
tgtcagactttagaatcatgtgaacagcctatttctttttgtgacagatgtggagtttgcatgataaaggattagggtctcaca

SEQ ID NO: 6835337 - DNA, 56 bp, Homo sapiens
cgggggcgtctggtgagaccatgccctcacacctgcattctctgacaccgcccccg

SEQ ID NO: 6835338 - DNA, 61 bp, Homo sapiens
agacatttcctagacatcaatggctagtccaattgtgtaagatgatgtttgggaaatctct

SEQ ID NO: 6835339 - DNA, 69 bp, Homo sapiens
agatactgaaatccaatggccagtggaacaacttagcaatgccaaaaaccattcactgattcagtatct

SEQ ID NO: 6835340 - DNA, 78 bp, Homo sapiens
gttccagaagcctcaccccagcccccttgctggatcctagggaccagtttctgggggaggttggggagggcggggagc

SEQ ID NO: 6835341 - DNA, 61 bp, Homo sapiens
tgaagcggcagtatttgaactcagacagtggctcttaactgttcttctagattgcctttta

SEQ ID NO: 6835342 - DNA, 57 bp, Homo sapiens
gcttggagatgggggatgagcctgaaggggtatggttcaacccttgcgtcaccaagc

SEQ ID NO: 6835343 - DNA, 65 bp, Homo sapiens
tggccctgtggaggtcagtgagctcctgaagcaacccttccctcctgtcctttcacagtgggcta

SEQ ID NO: 6835344 - DNA, 72 bp, Homo sapiens
ctctaagaatgtaaacagagattctgttgaaactactttcacaggatacattgtctatatctcacactggag

SEQ ID NO: 6835345 - DNA, 67 bp, Homo sapiens
ctttcttcttagacgtatcaggttcctgcagggtaaagacctgactatctgaagtttgagaggaaag

SEQ ID NO: 6835346 - DNA, 87 bp, Homo sapiens
ggagaatcgcttgaacctggaggcagaggttgcagtgagctgagatcgcgccattgtactccagcctgggtgacagggtgagactcc

SEQ ID NO: 6835347 - DNA, 87 bp, Homo sapiens
aacccttcgagatgcacaaggattttgattgtttgaaatgttggtaacatttcatcttcccagagaccttgttcatttatcagggtt

SEQ ID NO: 6835348 - DNA, 77 bp, Homo sapiens
ggctggaatacaagactcagcacagacggcctgaaacccagcctgaggtggtagctggggtttgtggcgtcacagcc

SEQ ID NO: 6835349 - DNA, 61 bp, Homo sapiens
cacaggaagaggtatacaattctgctagtgctgtaaagagggaaatgtgacctcttctgtg

SEQ ID NO: 6835350 - DNA, 56 bp, Homo sapiens
tctgagctctttcatggttctgtgaccctagagtccataatcccagaaagctcaga

SEQ ID NO: 6835351 - DNA, 87 bp, Homo sapiens
cacctttcttttgattgagcagtttcaaaatactatttttgtttaatttgcaaagggatatttgagatctcaatgaggactacggtg

SEQ ID NO: 6835352 - DNA, 79 bp, Homo sapiens
taaatatatcagtgcctggaccccatgacatatcaattaaatcaaaatatctgtggaggggtttaggcattcgtattta

SEQ ID NO: 6835353 - DNA, 87 bp, Homo sapiens
acacagcctttgcttcttcctggggacactgtcttgacccttgagctggaaagaagaggctggtcccagggagggaatgggccatgt

SEQ ID NO: 6835354 - DNA, 74 bp, Homo sapiens
cccagacacagcttgctctgccaaatttgccagttcccccaggaaatgggaagtaggacagtgcagttgatggg

SEQ ID NO: 6835355 - DNA, 58 bp, Homo sapiens
acccaggctggagtgcagtggggcgatcttggctcactgcaacctccacctcccgggt

SEQ ID NO: 6835356 - DNA, 80 bp, Homo sapiens
ctctctgggatacacattttagctttgtctttattggagcaaagacagctaataaatgagtgtgttctcatgaatgagag

SEQ ID NO: 6835357 - DNA, 60 bp, Homo sapiens
ctcttcccttagaagtgataagcatatttaattttagctttccactatcttaggggttag

SEQ ID NO: 6835358 - DNA, 77 bp, Homo sapiens
tgataccatggtatattatttcctcttcattaaagaacagcttctctaaatgttgggggaaatgtccgtagtcatta

SEQ ID NO: 6835359 - DNA, 60 bp, Homo sapiens
catggctgtgcagagattgggaaaggctatatctgccttcccacatcttccacagctatg

SEQ ID NO: 6835360 - DNA, 60 bp, Homo sapiens
gagagagagagagagagcaagcctgagaggctcaggctcagtgcaaatcattctgtcctc

SEQ ID NO: 6835361 - DNA, 76 bp, Homo sapiens
tatgatctaattgtgtgatgaggctactgagaaatctaatgcaatcttatgcttcattaatagaattagtattgtg

SEQ ID NO: 6835362 - DNA, 106 bp, Homo sapiens
ggacctatatttcatgatgatggtggccattctaccgccttcttgcttccccatgggaggagagatgggcacgtggtaatacggcttcatctgatttctgcagtcc

SEQ ID NO: 6835363 - DNA, 57 bp, Homo sapiens
acatggccctgcacccagagcagttccatgagcagtttcatgggagcaggagtctgt

SEQ ID NO: 6835364 - DNA, 59 bp, Homo sapiens
ttctcacaattcttgtatttgctaaaccatgagtttagggaagattccaattgggagaa

SEQ ID NO: 6835365 - DNA, 75 bp, Homo sapiens
gaaggacatttatagtgattaaaattgctcagagattgcttcactgggtaattctgatgctgtagtatgtgattc

SEQ ID NO: 6835366 - DNA, 84 bp, Homo sapiens
gcatttcagagttttgtatgtaaaatgtgtatcagttttctgttggtacataagaaattactacagattaactggattttaagc

SEQ ID NO: 6835367 - DNA, 64 bp, Homo sapiens
gtgttgctgcacgataaataatttctaggaagcttttaggaacatttgcttttgcagccaacat

SEQ ID NO: 6835368 - DNA, 82 bp, Homo sapiens
gtgttcctcagtctttttgatatcatgatgaacagattaagttgatgtgttcatcatgatatcaggtaagctggccgaagac

SEQ ID NO: 6835369 - DNA, 68 bp, Homo sapiens
gcttgcatagaacaggccctgccatttatccagacagactggaaagacttcagtcctgatttccaggc

SEQ ID NO: 6835370 - DNA, 57 bp, Homo sapiens
ggagactgaatgatgctgcttgttttcttgattaaatagtgtttgctcacagtctcc

SEQ ID NO: 6835371 - DNA, 68 bp, Homo sapiens
gggctatgtgtgtcttagtcaacattgcgtctccagtcctagcgcagcaactggggcatcactggccc

SEQ ID NO: 6835372 - DNA, 64 bp, Homo sapiens
aggctttccaggacttcatggctctgaatcagaatttcagaggtgcaagaagttctgaaagcct

SEQ ID NO: 6835373 - DNA, 69 bp, Homo sapiens
gcttacaaggcatcatgatgtagtggaaatctaggctttggagccactcactatctgagtcctttaagc

SEQ ID NO: 6835374 - DNA, 75 bp, Homo sapiens
cagcaagtcctgaggcaggatgggtttcagagttggttaattcagaggctcagttatgtcatcagggtcttaatg

SEQ ID NO: 6835375 - DNA, 63 bp, Homo sapiens
gtctcctttaagatttcctcaggctttctttgtctttatggcactgacatttttgaatgagac

SEQ ID NO: 6835376 - DNA, 92 bp, Homo sapiens
agccatctaactgcaaaggcatctgggaaggttctttgatgccaatgaagaaaactaaatacgctttgcctcatgtctttagcgttatggct

SEQ ID NO: 6835377 - DNA, 62 bp, Homo sapiens
ggcaggcatcctcgttggttactggctaaagaaaattaccatgtgagcagggagatgctgcc

SEQ ID NO: 6835378 - DNA, 72 bp, Homo sapiens
tcctgactgtggctcatcaggctggtgctaccatctgtggttgtaaaggtccaaagagggctacggaaagga

SEQ ID NO: 6835379 - DNA, 66 bp, Homo sapiens
aggcagatggtaactgtgatatctgtgtgatatacagttactcctcatcaaccataagcattgcct

SEQ ID NO: 6835380 - DNA, 76 bp, Homo sapiens
tgcttatagatcttccattcatttaagagaacttcttattactagaaagttggatggattggaatgaagtatagca

SEQ ID NO: 6835381 - DNA, 90 bp, Homo sapiens
cagtgagcggtccaaatggattggggggcatgaatggcacctgacttacagcaggagctcagcacttttactctctttgccgcttcactg

SEQ ID NO: 6835382 - DNA, 67 bp, Homo sapiens
gaggaaagaggagacagtatggcttgtagctacacttagtggttgctatattttttcctattgtctc

SEQ ID NO: 6835383 - DNA, 62 bp, Homo sapiens
gctccaggcagctcaaccttgggagcttcggggccccgagaggtggagcctgtgagtggggc

SEQ ID NO: 6835384 - DNA, 130 bp, Homo sapiens
gtctcaacagccacgggacttggtggccaagcctgggaagagcccattgtcttcttgcatcaccactggctgtgtggctgctggctagcttgcttgttcattatttgttttgtggaggctgccctgagtc

SEQ ID NO: 6835385 - DNA, 55 bp, Homo sapiens
caggacctaactcacctgtctcagagccgtctgtaagtacctgtgagaggacctg

SEQ ID NO: 6835386 - DNA, 67 bp, Homo sapiens
aacaatgtgagatgatcacatgctactacttattaatctgagggttataaatcatcttacatgagtt

SEQ ID NO: 6835387 - DNA, 86 bp, Homo sapiens
tcagaggacagcagctaaataactgactggcagggtagatttatgcaattctcatggggttatttgttgaaggactgtcctgctgg

SEQ ID NO: 6835388 - DNA, 78 bp, Homo sapiens
tatccacagaaattattaggatgcttgaacctttcatttatagttgttaagggaaagtgcctgatgaaattttggata

SEQ ID NO: 6835389 - DNA, 57 bp, Homo sapiens
caggaaattcaagagaggctgccttcttaaatcagatagccattccaagatttcctg

SEQ ID NO: 6835390 - DNA, 73 bp, Homo sapiens
ccacatctggactcagggcctccctcagcctcacgcatctgccaaggccagagggccctggtctcagctgagg

SEQ ID NO: 6835391 - DNA, 61 bp, Homo sapiens
aggtaagaatgcttccttgcctctttcaagcttctggtggttttcatggcattccttgcct

SEQ ID NO: 6835392 - DNA, 65 bp, Homo sapiens
cctgcagaccagattctccgtggcaccaccggggctcacaggagaaagtcatggtccctgcctgg

SEQ ID NO: 6835393 - DNA, 59 bp, Homo sapiens
gcagggcagtaagagctagagtcagaagctcgtctctactcaactctcattagttctgc

SEQ ID NO: 6835394 - DNA, 100 bp, Homo sapiens
atatatatgtatgtaatatatatgttatatatgatgtatgtatgtatatgtaatatatgtatgtttctatatatgacatgagtatgtgttatatgtatat

SEQ ID NO: 6835395 - DNA, 55 bp, Homo sapiens
tgtgttctggctgtgacagctgattacagaggggcagctgggagggcagagcaca

SEQ ID NO: 6835396 - DNA, 57 bp, Homo sapiens
cagcagagatgagattcctatagttatttattgaacttggattttcaatcattgctg

SEQ ID NO: 6835397 - DNA, 80 bp, Homo sapiens
tcgtaaattatttttcatgtcttacatggttaaagatacgtttcacttgagcttgtaacagacataaaaatgacccatgg

SEQ ID NO: 6835398 - DNA, 66 bp, Homo sapiens
ccataagtagataagcgctctgaggatttatttctgtttcagagtgttttactaaacaagttatgg

SEQ ID NO: 6835399 - DNA, 114 bp, Homo sapiens
ttccagttctaacattacaaaactctggggctcctgggagaagttttattacaaagcagatattttgagtacctagtgagtcatagacactctttgtaaggtgggcaacttgaa

SEQ ID NO: 6835400 - DNA, 91 bp, Homo sapiens
gagatactagtaagttaaaaacacttgataggtcaaatcagtctgaactttcatattggtagaagtatgaagtgctaaataactaaatttc

SEQ ID NO: 6835401 - DNA, 55 bp, Homo sapiens
gccagccagagtccatctgagagtttgttttgtgaaaggaggacctgagctgtgt

SEQ ID NO: 6835402 - DNA, 58 bp, Homo sapiens
ctgcccctatggctgatgcgtggagtgcggctgtcccagccatgcagcctgggggcag

SEQ ID NO: 6835403 - DNA, 99 bp, Homo sapiens
gaggcaggagaatcgcttgaacctgggaggcggaggctgcagtgagccgagatcgcgccattgcactccagcctggacaacagagcgagactctgtctc

SEQ ID NO: 6835404 - DNA, 71 bp, Homo sapiens
gaaagggcaaaggcatgcttctactgtcagttcccttcagcatctggcctgagccttccctctgccctttc

SEQ ID NO: 6835405 - DNA, 56 bp, Homo sapiens
gctggattctagctcagtggcccaagtgtggagtccaacaccatctgagctccagc

SEQ ID NO: 6835406 - DNA, 75 bp, Homo sapiens
tgaaatcacctttgactcctttgtgaaaagagtaatgataaaagttttgacttcttcttatcaaggaggatttca

SEQ ID NO: 6835407 - DNA, 117 bp, Homo sapiens
ggacttttgtaaatattgtttgtcagattcagaaaattctctgttcctctgatttgcaaagatggctgtggaatagagagtaggtttcaggagggagagaacagaagcagaaagtcc

SEQ ID NO: 6835408 - DNA, 61 bp, Homo sapiens
gtatattgttgtgtgtatgcgagcatgcaagaacgtgtgtgtacaaactaacaacatatgc

SEQ ID NO: 6835409 - DNA, 116 bp, Homo sapiens
gtgtcacgtgtccaccttcctttcccttgcctcgcatgccctgcctcatccaggcacagcctggaaggtagaggtgagtgacaagcacgcaggaagctttatggaacatccaacac

SEQ ID NO: 6835410 - DNA, 69 bp, Homo sapiens
cagggactcacagcccgttctctggcacacacagccccagcacatgtggcccgacgtggctggcccctg

SEQ ID NO: 6835411 - DNA, 62 bp, Homo sapiens
tagggatgaggatagatttttcactgagccactccttctctcatttagtctcctcatcccta

SEQ ID NO: 6835412 - DNA, 94 bp, Homo sapiens
ggcgcgggcctacagctcactcacagggctagttagcatgcgcccaacgcagccttctccgttgctggcctttgaggaagctgcgggtcttgcc

SEQ ID NO: 6835413 - DNA, 90 bp, Homo sapiens
tgaaggttgggattgtaaatttgtaattatgacaaatggaagccatttgcatgttgtttaatttcgagtgtcacataaactcatccttca

SEQ ID NO: 6835414 - DNA, 93 bp, Homo sapiens
ttctacttttcttccatgaagctcctgttgtctgatgtacatatgctgaacacatattataaaattactggcagggatctgggggtggtggga

SEQ ID NO: 6835415 - DNA, 62 bp, Homo sapiens
ctttctagtaggaagtagatcaacctgcccagaaacctaggcccttctactcctgaaggaag

SEQ ID NO: 6835416 - DNA, 79 bp, Homo sapiens
gtctcagcatattgaatgcccagaaggaagaagttaggcccaacattaaccccaagcctcttccaagggctgctgagac

SEQ ID NO: 6835417 - DNA, 66 bp, Homo sapiens
ggttacatggatgaattgtctagtggtgaagtctgagattttgctacactcttcacccgagtgacc

SEQ ID NO: 6835418 - DNA, 56 bp, Homo sapiens
gcaggtggagcagtagtctggttcctatgagaggcagatgtttaggcaccatctgt

SEQ ID NO: 6835419 - DNA, 55 bp, Homo sapiens
tccaatgctcaggctaaatcacgtgatacatttcatgtgaagctaagtatttgga

SEQ ID NO: 6835420 - DNA, 108 bp, Homo sapiens
gtttcgcagtagtcccgggctgtgtccaccactccagatcacaccccttggctgaggctcagatgtgctagggtgaagatggggtggggcctgaggtctttgtggagc

SEQ ID NO: 6835421 - DNA, 76 bp, Homo sapiens
tgtgcacattattggatatgatatctcatggtatttaattaattaagcacctgttttcctatctagattgtgcaca

SEQ ID NO: 6835422 - DNA, 55 bp, Homo sapiens
ttgccaggagagccacttgcagctcagtggatcacaagttggctcctcctagcaa

SEQ ID NO: 6835423 - DNA, 111 bp, Homo sapiens
tgcgttcagtgttgatgagctgttgtactgggttctgtatgggtgatgggagataagtaagatgtgttccttgccctctgggatcttgctgcagctggcgagacagacgca

SEQ ID NO: 6835424 - DNA, 59 bp, Homo sapiens
tttctccatgccacttacttctccaagagggaaccgtagtgacttggcatgatgagaag

SEQ ID NO: 6835425 - DNA, 95 bp, Homo sapiens
aacttgaatcccataccagtatgtttttcatctatttgctttgtgaagaaaacgtgtgtttttcaaaggccagtggagaacatgggatataagtt

SEQ ID NO: 6835426 - DNA, 104 bp, Homo sapiens
gcgttgccttcgctggatgatgctggtggcgtgtgacttttaaagatgcgtcggaggttgtctttaaaacgtaaatgtccccagctgaatccaaacgacgacgc

SEQ ID NO: 6835427 - DNA, 94 bp, Homo sapiens
ccactcttcaaaagtagagtctatttttcttaaatgtgggttggcctgtgacttgctttggccaagagaatgtgagagaaatgatattgggtgg

SEQ ID NO: 6835428 - DNA, 94 bp, Homo sapiens
gggctcctcgccccctcgcggccgccggctgttggtccttttgtctgcactggggagagggccgggggccagctccggcctaggggggcagccc

SEQ ID NO: 6835429 - DNA, 102 bp, Homo sapiens
gtggggtactgggtcccatgtagggaactaaattcactgcagccaatgaaaagtactgtacagtgaggtggagtagttcccaagacaggatgcatgcttggc

SEQ ID NO: 6835430 - DNA, 84 bp, Homo sapiens
ctgataatattattcggttttgacaattaggtagaaaaagcattcaaagaagtgcttttttattgcagctggtaatactattgg

SEQ ID NO: 6835431 - DNA, 69 bp, Homo sapiens
ttttctattatgaggggcagagggcatctctaggaaaggagatgccaactgaatttccatgatagagaa

SEQ ID NO: 6835432 - DNA, 129 bp, Homo sapiens
aaatgaagcaaagtattatcaaccaaatttacagcaataggaaatacttgcaactgtgtgttatgtaagatttgctatgtgttgtcacagatttatgacaccagcaacttaatactgtgaaagtttcct

SEQ ID NO: 6835433 - DNA, 87 bp, Homo sapiens
gtttacatatatacagtgcatgtgagggtgtgcgtgtgtgtgtgtacacgcgcaaccaggcatgcacatgtatctgtatgtgtctgc

SEQ ID NO: 6835434 - DNA, 82 bp, Homo sapiens
actctcttccccttgagatgagctaatttttttcattttctgaaggcatctatacattatgttcatttcgctggaggggagt

SEQ ID NO: 6835435 - DNA, 83 bp, Homo sapiens
tgggctacttgacggttagggcattctttcatgggaatgtgaaaatagcttctcagaagagtcctgtatccttgagtaggtta

SEQ ID NO: 6835436 - DNA, 57 bp, Homo sapiens
gtgagggtctgtgccggcggggcatgcgacccgccaggcaggtgtcggagccctcac

SEQ ID NO: 6835437 - DNA, 60 bp, Homo sapiens
taggaatgatgtatttttctctatcacagaaatttgagagaaaagtaacactaattcctg

SEQ ID NO: 6835438 - DNA, 66 bp, Homo sapiens
gacatgatctgacattggctctgggactcaactcataagccttgctcaggtcttctccctagtgtc

SEQ ID NO: 6835439 - DNA, 59 bp, Homo sapiens
ggcacatggccaacattctctgccccgtatgcggggtgccagagaccaggccaggtgtc

SEQ ID NO: 6835440 - DNA, 60 bp, Homo sapiens
tctctaacaatgtgaagtgctgttcagcccaggattgcctgcctggacttttataagaga

SEQ ID NO: 6835441 - DNA, 77 bp, Homo sapiens
tggtgtgcctgttgtaggcaagtaatgtattgatgtccagatggattacttgaagcttgcttgatgggttaatatca

SEQ ID NO: 6835442 - DNA, 58 bp, Homo sapiens
tctgtctcatgtcaaggcatgctatttaaatctggtgacttttgaagtatgagacagg

SEQ ID NO: 6835443 - DNA, 77 bp, Homo sapiens
attgctctctgtgtgcctgtacatctgctctcattgcagtcggtacaactgcgagatgtttagccagcagccgtaat

SEQ ID NO: 6835444 - DNA, 80 bp, Homo sapiens
taaacattttataaggacattctgctttaacaaattacatggtgttgaggtggggagtatatgtaattgtaaaaggttta

SEQ ID NO: 6835445 - DNA, 77 bp, Homo sapiens
tggttgtcagtggttaatgttgtgaggcagatctgtgttagggcactgagagatgtgtcacagcaggacgtcagcca

SEQ ID NO: 6835446 - DNA, 59 bp, Homo sapiens
ggctcaggttgggtcacatgaccatctctgccccaatcactgtgactccaacctgagtc

SEQ ID NO: 6835447 - DNA, 100 bp, Homo sapiens
gacttatttcctttggcaagaggggaggagcttttcttgccttctaagaggtttcaggaaaatcctctcttactgtcttcctaagtgtaccacgtgggtc

SEQ ID NO: 6835448 - DNA, 75 bp, Homo sapiens
ggaatagttcagtatttgaaaccataggcaaaaggtagggtcagttggctattaacgtgaaaactgagctaattc

SEQ ID NO: 6835449 - DNA, 66 bp, Homo sapiens
cccaggaacgcctggtgttggcctggctaaactcttggacgaaaaggtctgcacaggctccgaggg

SEQ ID NO: 6835450 - DNA, 55 bp, Homo sapiens
ggagccagagtttaatgtggagctcttccatttaatagaagttactttggctacc

SEQ ID NO: 6835451 - DNA, 67 bp, Homo sapiens
gctcagctgggtgattcttcttttcctcatggtataaacagaggtcacttggtgttattcagctagc

SEQ ID NO: 6835452 - DNA, 104 bp, Homo sapiens
ccaggcacgctccctctcccgctcctccagcccgccgtagctgcactaaccccgagtccagctagcggtgctggcggctccgggacggaacttggcggccctgg

SEQ ID NO: 6835453 - DNA, 66 bp, Homo sapiens
tctagggagaaataatgccagtccaggaggagaagcttcctggccataggctatttcagacctgga

SEQ ID NO: 6835454 - DNA, 58 bp, Homo sapiens
tggtcttgggtggcccgggagacacctgtctccttttggataattctaccccagagca

SEQ ID NO: 6835455 - DNA, 76 bp, Homo sapiens
gaagagtggcctcagagaaatacacacctctttttaaagtgatggattctgtattagatctgagaacttcttcttc

SEQ ID NO: 6835456 - DNA, 59 bp, Homo sapiens
gcctcagctcttccctgtgcacacctattttcagatgaacagtagtgaagggtttgggt

SEQ ID NO: 6835457 - DNA, 90 bp, Homo sapiens
gccgcgcttcaggagcccttcagcccgcagctgcaccgtgggagcccctctctgtgctggctgaggcctgagcgggctccctctgccggc

SEQ ID NO: 6835458 - DNA, 85 bp, Homo sapiens
gagcagggcatgccagcctggagtctccctggctgtggcgctgcagtgcgctgcctcggatgctctcctcggcgtgacccagctc

SEQ ID NO: 6835459 - DNA, 62 bp, Homo sapiens
ctagactgttttaggagggtagagaatatgtctgcttaactcatcctcaccctcagtcctag

SEQ ID NO: 6835460 - DNA, 59 bp, Homo sapiens
gggaccaggtaactgttagtcatgctttgagtcctttgtgatttccagaaaattggccc

SEQ ID NO: 6835461 - DNA, 84 bp, Homo sapiens
ggattgttgtgaggttgaaatgagataattcatgtggaatgctcagaagagtgtctgcacattatcttatattatagcaatgcc

SEQ ID NO: 6835462 - DNA, 107 bp, Homo sapiens
tcaggtctgccctccttctcctcccaggtagtgagaaatggaggtcatgctatgattcttgcttttttcactgctatggtctgtggagctaaaaggcaggcatctga

SEQ ID NO: 6835463 - DNA, 97 bp, Homo sapiens
cccttctgcagcatcctggagtcacttcccgaataaacccctcacatcacctccttgtctcagggtttgcttctggggggacccagcctgagacggg

SEQ ID NO: 6835464 - DNA, 84 bp, Homo sapiens
gcaaagcattgaatgatcctatctagcacaggggagggcaaacttttctgtaaagggcctgatagtgaatattttaagttttgc

SEQ ID NO: 6835465 - DNA, 75 bp, Homo sapiens
tccccttccaagaggaagtgcctttacgcatttgaaacttgacatgccatgaaggtatttttggagggcagggga

SEQ ID NO: 6835466 - DNA, 71 bp, Homo sapiens
caccagatgcccgggctccatcggacttgggtttgatctcagactctagagatggggtctgtttgttagtg

SEQ ID NO: 6835467 - DNA, 59 bp, Homo sapiens
gatgtcctttgagggtatctgtgctttttttatactacggcaatgcttcagaggatatc

SEQ ID NO: 6835468 - DNA, 59 bp, Homo sapiens
gtgaacaaggagactacaacttcagcaagaaagatcatggagatgcagtcaatgttcac

SEQ ID NO: 6835469 - DNA, 57 bp, Homo sapiens
ctgtgcatgctccacagcccattcatccttctggtggaggacttcagagtgtgccag

SEQ ID NO: 6835470 - DNA, 76 bp, Homo sapiens
tcctgccctctagtcttctgtcagtgcttcccattgaccaagctaattggaagccagaggaccagggagcctggga

SEQ ID NO: 6835471 - DNA, 80 bp, Homo sapiens
tctgtttagatgctttatctgttaggattgtatgcattaaaaataaattgtatgcattaagaaaagtatttgaatcaaga

SEQ ID NO: 6835472 - DNA, 83 bp, Homo sapiens
tgggagcagcatcaaccctcccgtgtctacagactcaggggttctgaacgcacagacgcagggaggtggaaggtggtgcccca

SEQ ID NO: 6835473 - DNA, 75 bp, Homo sapiens
ctcctggagagaggcctggaagatgggggggtcattcagagaccccagttgttggggggacctgctttccaggag

SEQ ID NO: 6835474 - DNA, 65 bp, Homo sapiens
gcaggcagatgctgacaagagtttgagaaacattgccatcaccaactcacacaagtattgcctgc

SEQ ID NO: 6835475 - DNA, 61 bp, Homo sapiens
gcaccctcgggcccgcggacaaagggttaacgcgttggcagtgactgcgggccccggatgt

SEQ ID NO: 6835476 - DNA, 68 bp, Homo sapiens
tcatccagatagcaggtcagaagtgcctcgtgagcaggaggtgttcctgcaagctgttctgatcatga

SEQ ID NO: 6835477 - DNA, 70 bp, Homo sapiens
gcaagcatgtagacatcctatgggaagaacaccatggcagcatggtcctttttgcctggatgcagtttgt

SEQ ID NO: 6835478 - DNA, 55 bp, Homo sapiens
tgagtagatgactggcttaggattcacctgtagttcctgggccagaatcagctca

SEQ ID NO: 6835479 - DNA, 56 bp, Homo sapiens
ggctggctgctaggacagctacagagagaagggctctgttggccttgcaggcagct

SEQ ID NO: 6835480 - DNA, 80 bp, Homo sapiens
gtgatggggtaaggacagccagtaggagactcacatctttggcttgtgaggcccctagcggtgtccttggccatggtcac

SEQ ID NO: 6835481 - DNA, 66 bp, Homo sapiens
aattctaagcatccatctcttcttcacctttcagtgagggtggaaagatgaagatgtttaaggatt

SEQ ID NO: 6835482 - DNA, 64 bp, Homo sapiens
gctactaagtagcagaactaagaattgaactaggattcagttccagatttaaatgcttgatagc

SEQ ID NO: 6835483 - DNA, 70 bp, Homo sapiens
tttcaactctaatttgcaatgtgaaattaaagaattaagatttgggattttacattgtatggtgttggaa

SEQ ID NO: 6835484 - DNA, 129 bp, Homo sapiens
gctgaaacttgctctaagttatacaaagagtggagacagagatagccaattggaagccggttacatctaggccatgtgttatttctgtatttacgtagtcttctctgtgtaattagaactgctataggt

SEQ ID NO: 6835485 - DNA, 79 bp, Homo sapiens
ttgatgctgtgtgagacaggatttagagcagttttctgttgcaactgttggaaatgtaaggtctcagataaataattag

SEQ ID NO: 6835486 - DNA, 62 bp, Homo sapiens
gcctggggacagagggaggtcagagtcacgtcccacctgctctgataactctggccccaggc

SEQ ID NO: 6835487 - DNA, 58 bp, Homo sapiens
ttaatctgtggttttatgcagctgtagtttttcactgtatgaatatgccacagtttaa

SEQ ID NO: 6835488 - DNA, 69 bp, Homo sapiens
tctagtgcttcagctcaggcttgagggtcccttggctgagccaatcctcagacctcagcaaagcctgga

SEQ ID NO: 6835489 - DNA, 70 bp, Homo sapiens
ccgcaatcatctctctttgtgcctttctcttctacagtacttgggcagggctgcagggcagctggtgtgg

SEQ ID NO: 6835490 - DNA, 64 bp, Homo sapiens
ggatatgtattccactataaaggttggatggaactcaaaagcctattagtgtagctgtgtatcc

SEQ ID NO: 6835491 - DNA, 63 bp, Homo sapiens
ttccataataggcttaagtgaagtaggtagtgagacacgcatcatatgatgcctatgatagag

SEQ ID NO: 6835492 - DNA, 90 bp, Homo sapiens
gagtatttccagagttccctgggactcagacatggaagtcataggactatatctaggaaccctgagattacccagggacctcaaatgctt

SEQ ID NO: 6835493 - DNA, 55 bp, Homo sapiens
acttctatgtgtccgttgggtggggtgggtcccaccagagcagactactggaggt

SEQ ID NO: 6835494 - DNA, 100 bp, Homo sapiens
cattcgaatatcgtgagctagtttgttttccagtctggaatttggacgtggtctgttagagggccagctggacagcgagcagctcagcgtagttgctgtg

SEQ ID NO: 6835495 - DNA, 60 bp, Homo sapiens
tgaccttctcaagcccattgtaaactgcccactgccttcacagggcttcagggagggtta

SEQ ID NO: 6835496 - DNA, 92 bp, Homo sapiens
atctttttttggttcatagggagaagtgtctaagagattcctgttttactggcttaacagcatttttctccacttctcttgccaacaaagat

SEQ ID NO: 6835497 - DNA, 61 bp, Homo sapiens
cttattagaaagaaaagacatggtgggttttttcccctttattctttgcttttctaagagg

SEQ ID NO: 6835498 - DNA, 98 bp, Homo sapiens
cacacagtacaaaagcagagtggggctttaaaggctcagattctgcacttagacaggcctgagctgcagtcctggctctgccattttccagctgtgtg

SEQ ID NO: 6835499 - DNA, 57 bp, Homo sapiens
tctgccagcaccatgatccttcttggaaaagaagcaaaatctgactgatgctggaga

SEQ ID NO: 6835500 - DNA, 58 bp, Homo sapiens
agtgaggatggcaatggcaggaatttgattttatttcctcccaaatttcagcctcatt

SEQ ID NO: 6835501 - DNA, 104 bp, Homo sapiens
actgatttatgttgtgaggaggaagaattagacatgctttgcttttatgttgacagtatataaactggtattcaaatgtttggttaaattcacatgtgaacagt

SEQ ID NO: 6835502 - DNA, 59 bp, Homo sapiens
ttgttaagggttatgcagcttttgggagcaacaaccaagatgcaacctctgcttaacaa

SEQ ID NO: 6835503 - DNA, 78 bp, Homo sapiens
gcctggtgctttatggagcccatctcattccatcctcaacagcctgaatgaggcagatgttgcatgaggccctgaggc

SEQ ID NO: 6835504 - DNA, 85 bp, Homo sapiens
cttccttttacaacctcacaatgggcaatgtgaagacagctgtttttaaacatgaaagttattctgagttggcactttaggggag

SEQ ID NO: 6835505 - DNA, 60 bp, Homo sapiens
gttgtggaatgattaatggtcgttggtgaagtaaccatcagcttcattgtcttctatggc

SEQ ID NO: 6835506 - DNA, 67 bp, Homo sapiens
gcctttatgtctgaaaatcagcattgagtccaatcttggctgtcgattttaaggcttatttaaaggc

SEQ ID NO: 6835507 - DNA, 66 bp, Homo sapiens
tggcatgctgaggtttcgtctgcttgcacttctacatggtgcaagcatggggcactgggaaagcca

SEQ ID NO: 6835508 - DNA, 95 bp, Homo sapiens
ccatcattatccaggcatggatggaactctgctgtggtgaggaggttgtctcgcccactcacccaagttttccatgcctgttctgcttttgatgg

SEQ ID NO: 6835509 - DNA, 55 bp, Homo sapiens
ttcctctattctaacaaaagtatcacactggtgcaggatgttgatagtgggggga

SEQ ID NO: 6835510 - DNA, 83 bp, Homo sapiens
gggcagctcttctgctcatccccaaccccttcccagcactcgggtttggtgctgagccgggtgggatggcaggagccgctccc

SEQ ID NO: 6835511 - DNA, 74 bp, Homo sapiens
gtcatttaactcctctggacctcagtctactaatttataaaattgtagggctgagtcttgatcagttgttagat

SEQ ID NO: 6835512 - DNA, 68 bp, Homo sapiens
ttggtctctgcatgtagctagtaataaaatgcgtaaactacagggctttggggtgtgcagagatgcaa

SEQ ID NO: 6835513 - DNA, 91 bp, Homo sapiens
gtgaatgggcctggctgcctggcccagggatgggcctggatttgctcaggctcagaggttgaggccggcacttccgtcaaaggcccttcgc

SEQ ID NO: 6835514 - DNA, 55 bp, Homo sapiens
catattccggtgtgtgggtccccagtgctgactggggactacaatttgcagtgtg

SEQ ID NO: 6835515 - DNA, 73 bp, Homo sapiens
ggtcttactgctggggatcctttttgcatctagggccccgtgccttgagaaagtgggtgcctagcaactagcc

SEQ ID NO: 6835516 - DNA, 129 bp, Homo sapiens
ccggccgcggggccccgggtacttcgccggagcgcgcgcggccgccgagagagttgtgggcgaagtaaacttggctcctctcctcggagtcggggagctgcccgcgaagggcgccgaggccgcggccgg

SEQ ID NO: 6835517 - DNA, 129 bp, Homo sapiens
tttatatataatacacacatgcatgtataatacatatgtagacatctagatttatgtgtgtatgtatctacagatataaatacagatgtctgtctgtatgtacacatgcatgtataatacatatataga

SEQ ID NO: 6835518 - DNA, 67 bp, Homo sapiens
gaagtgaagataagctgatgtaaattcactttatttggatttcaatccagctttcttctttgatttc

SEQ ID NO: 6835519 - DNA, 98 bp, Homo sapiens
gggaattctgagatgtggtaggatagtgacttatatgcatttttaagatcatatgcaatattagaacatcattttgcaacttaaaaattataattctc

SEQ ID NO: 6835520 - DNA, 79 bp, Homo sapiens
ttggcgagaaccagtgggcatctccttggaagccagtccccaaggtggctctagatggcttactcctgcatcttgccaa

SEQ ID NO: 6835521 - DNA, 78 bp, Homo sapiens
aaggacatcttgcttgctgggcattttcacttggaaacccattcttacagggagatgctacagttcagctctgtcctt

SEQ ID NO: 6835522 - DNA, 88 bp, Homo sapiens
gagatggataaggagtggggcatatcacagaatcccagaataggagatgcagaatgtctttggaaatgaccccgtctaagtctggctt

SEQ ID NO: 6835523 - DNA, 89 bp, Homo sapiens
tatttgatcaagtaagtttatagataaatgcctatctaatatattaaatcagaagatggggataatgaagtatagcttgcttttaaata

SEQ ID NO: 6835524 - DNA, 83 bp, Homo sapiens
tagttaaagtataaatcagggagtcatctgcgaggaaaatgaatgtcactcacagtagttgttctctgtttctgctgtcatta

SEQ ID NO: 6835525 - DNA, 81 bp, Homo sapiens
gcatagggtatgcctgctaggtgtctgtacatatgagtttctaaaggagaaactactttatagtgccttcaggactcatgt

SEQ ID NO: 6835526 - DNA, 70 bp, Homo sapiens
actaagaattttggcttctgacctgcagaaaatgggaaacatggaaggctcaggagtggagagaattggt

SEQ ID NO: 6835527 - DNA, 56 bp, Homo sapiens
tccttctatcactggaagtgagtttaaaagtattcacacttcagtttttaaaggga

SEQ ID NO: 6835528 - DNA, 60 bp, Homo sapiens
tgtgtaattatagggagatctaacctagtcttttggaggtctccatgctgtagttgaata

SEQ ID NO: 6835529 - DNA, 85 bp, Homo sapiens
catgtgctcaaaatttccaccattctgaggagagtggatggttgatacagcacatccttcttcaaagagggaaaaggagcaggtg

SEQ ID NO: 6835530 - DNA, 129 bp, Homo sapiens
cttagattaaggacagtctgtgcagttctcaagcggctgtctgtcttcacatctcgctgctcaagtgagggacgtgggctgtggggagaggctgaaactgtcaagatggctgcaactggaaatgggaag

SEQ ID NO: 6835531 - DNA, 62 bp, Homo sapiens
caagtgtcaggagaagagaagccacatccatctgtccttgacttctttgttccttacatttg

SEQ ID NO: 6835532 - DNA, 60 bp, Homo sapiens
acaagaagcaaggtcagggcccaggccccatgcaggcttcgggccggccttgctccttgt

SEQ ID NO: 6835533 - DNA, 68 bp, Homo sapiens
caggcacctttgtgcatgggcacctgctaggtgcggcggtgagagtgtatgtgcatagtaggtgtttg

SEQ ID NO: 6835534 - DNA, 56 bp, Homo sapiens
gcctggagttgtggtgaagccaggagctattctgagatctttccactatttcaggc

SEQ ID NO: 6835535 - DNA, 60 bp, Homo sapiens
ggcgaaggagctggcagggcttccaggttcactgtggagcagctggggtgctcttttgtc

SEQ ID NO: 6835536 - DNA, 81 bp, Homo sapiens
tgatatgtaagtctttaccataggatcttgcagtcctatatttcccaaattgaagtgatgactgccattctattactatca

SEQ ID NO: 6835537 - DNA, 57 bp, Homo sapiens
cctgttgctctgcatgagtttagatttatatttagctcgaaagtccaggcaagcagg

SEQ ID NO: 6835538 - DNA, 73 bp, Homo sapiens
agcatacactttagggcaaagtttcaacagttccatgccgagcttagagactttcgcctctgacatgttagct

SEQ ID NO: 6835539 - DNA, 84 bp, Homo sapiens
tcttgatgtttgacagcttgagcataaactcagggacacacagactcttctgtgttcccgtttgtgagtttctgatatgcaaga

SEQ ID NO: 6835540 - DNA, 80 bp, Homo sapiens
tttcattctacattgatgagtcaaaggagacaggcaaaggaaactctgctgactctgaatttatgaaatggcaagtgaaa

SEQ ID NO: 6835541 - DNA, 111 bp, Homo sapiens
gcaccaataatgcctctttttatactgtcttattttagcattaaaggtaagacattatttctcccatagttaatggcatgtctttgatgctaggcagaggggccagggtgc

SEQ ID NO: 6835542 - DNA, 69 bp, Homo sapiens
gcttctgtgctgtaccttccattgaggatacagatatactccttttggcaaagagatagcatgatgagc

SEQ ID NO: 6835543 - DNA, 89 bp, Homo sapiens
ccctcagccctgaagcctatgggaccctgaggcccctgctctgctccaggcccccagcaccaggccatggggtccctgctcagggaggg

SEQ ID NO: 6835544 - DNA, 56 bp, Homo sapiens
gcccagcaggggatggcagctctgcagagagacagggggccttcatcttgccgggt

SEQ ID NO: 6835545 - DNA, 68 bp, Homo sapiens
ggttgctgaagccaggccacgctccctgccccagcaggtccaggctgagctgacctggtttggctgct

SEQ ID NO: 6835546 - DNA, 63 bp, Homo sapiens
gtgctgtcgccaacccctgcccacctttggtttcatctctccagtgcccagttggtgacagac

SEQ ID NO: 6835547 - DNA, 112 bp, Homo sapiens
atgctgcttcagtaagtgtcatggtatggggagataggaattaacccacatcaaccaaactagagctttggtctgattcttgctccccaagatggggcccgcaaagcagcat

SEQ ID NO: 6835548 - DNA, 73 bp, Homo sapiens
cacagatgcaggtgattcacagtttaggctgggctgataacagcccccgccagctgagaatggggcctttgtg

SEQ ID NO: 6835549 - DNA, 71 bp, Homo sapiens
aggctttaggttcagtctttggacccctccccagagtggggagttctccagaggtgaaccccacgaagctt

SEQ ID NO: 6835550 - DNA, 55 bp, Homo sapiens
tccccaagcagcagaacccatggcagctcgagacagcgtctgtgtggcttgggga

SEQ ID NO: 6835551 - DNA, 75 bp, Homo sapiens
gccctctacaatgaattccagatgcttgtatttaaatctgacatgatctgaatgctgtgttgggacagggtgggc

SEQ ID NO: 6835552 - DNA, 67 bp, Homo sapiens
gggtaataagcaaggtattatactcctcagtttccctctgcagggtcataatggatttgctgttccc

SEQ ID NO: 6835553 - DNA, 67 bp, Homo sapiens
tctggctgctggagttgggtctctcctcatgtttgggcgactgagggctcaactactactaggcaga

SEQ ID NO: 6835554 - DNA, 59 bp, Homo sapiens
ctcctgtgtgcaggcactgtgccagatagaaatttgtcagtgccaaaatgcatgaagag

SEQ ID NO: 6835555 - DNA, 117 bp, Homo sapiens
attcctttgatttaagtccacatacatttcagtgatggttcagcttggttagtcttgcaaattaaagtattactgaagccagactgtctgaaaagagatgtgttcttacagaagaat

SEQ ID NO: 6835556 - DNA, 59 bp, Homo sapiens
ggagtccaacgtgcagccaggacattgctcacagtggccccttctgtacattggactct

SEQ ID NO: 6835557 - DNA, 68 bp, Homo sapiens
gattgtaattctactttccgctgacattaaaatttctagagatgtttgtagcagagaggactacagtc

SEQ ID NO: 6835558 - DNA, 57 bp, Homo sapiens
gtggctccagatttcctgctgcaatgaaattatattggggctatcgctggagcacac

SEQ ID NO: 6835559 - DNA, 56 bp, Homo sapiens
gagctctggacgaggggagtggactaaacgcccatccctgaagttcgttccagctc

SEQ ID NO: 6835560 - DNA, 92 bp, Homo sapiens
ggtagagtacaccgagtttgttttattttgtgctaacccaatgagaaagcatattggtacaaaaccatgaaagaaagcggtggttctctgct

SEQ ID NO: 6835561 - DNA, 79 bp, Homo sapiens
ggccagcctgggtcgagagacgagaaacgctaccagaaagatatttctggtctctctgacctaggaggaacaaaaggcc

SEQ ID NO: 6835562 - DNA, 59 bp, Homo sapiens
gctgctgcactcatctcctctcctggcacaagggccagggctggagacaagtgagccgc

SEQ ID NO: 6835563 - DNA, 85 bp, Homo sapiens
gatgcgcatcagccccgggggctctgtgtctcgggggctcccaggtcggaatccctctctctatcgggccccaggggtttgcatc

SEQ ID NO: 6835564 - DNA, 72 bp, Homo sapiens
ggagatggtttaacctctgtagtaggttttgtagttatggtaagctccaggtccagaggttgaacggtggct

SEQ ID NO: 6835565 - DNA, 60 bp, Homo sapiens
agaggtattaggtaattcagtaggcaaaatgacttggcctactgatgtcagatagcctct

SEQ ID NO: 6835566 - DNA, 65 bp, Homo sapiens
cacttgcagggagcatgcctcccatccctttgcaaaaggaggcttcagtgtgggactgcagcgtg

SEQ ID NO: 6835567 - DNA, 79 bp, Homo sapiens
ttttatcaactgagattaaatatttgtgattaaagcatcttctgccttttataaataaattgggcggcagttgaagaaa

SEQ ID NO: 6835568 - DNA, 60 bp, Homo sapiens
cggtgactatgacgaggggacagaggccgagggagaggcttctgccacgtctggtgactg

SEQ ID NO: 6835569 - DNA, 72 bp, Homo sapiens
tcctggtagtgtctgccgaggtcctagattgaggaagaagcctccagagaccttggtagacatttagcagga

SEQ ID NO: 6835570 - DNA, 68 bp, Homo sapiens
aattctgacacttgttataatggtaaggatgactttattcaggactattgcaatacgtgtcagcaatt

SEQ ID NO: 6835571 - DNA, 66 bp, Homo sapiens
gggaagatggcacttgggagcagcagctttgagcatcttgcatctgcttcctgaggccgtcttctc

SEQ ID NO: 6835572 - DNA, 72 bp, Homo sapiens
atccccagggtgtgtgggggatgggagggtgcactttcttagtgcatctgccactctctcccaccactggat

SEQ ID NO: 6835573 - DNA, 61 bp, Homo sapiens
tatggtgggtaaaactggaaatgcacctggagccagactgtaaaccattttgcatcccatg

SEQ ID NO: 6835574 - DNA, 77 bp, Homo sapiens
ttctgtgaccaaatttatattaagattcttgtttcctgtcaaattcaatggagtcatatttatatgttggcacagag

SEQ ID NO: 6835575 - DNA, 64 bp, Homo sapiens
gatcaggagttgattttggatatattatacctgatgttttgatatgtccctcgacatcagggtc

SEQ ID NO: 6835576 - DNA, 56 bp, Homo sapiens
ggctgcacttggtgaggcagcccacagccaggggcccgattgccttgctgtcagtc

SEQ ID NO: 6835577 - DNA, 75 bp, Homo sapiens
ctcagagggatggccagtggcagagaacagagacctggctgagggcaggtttctgcactgtcactggtgaatgag

SEQ ID NO: 6835578 - DNA, 63 bp, Homo sapiens
caagcagaaatcattatatggtattgctgatagggttcacaggctatgtagatgatttttttg

SEQ ID NO: 6835579 - DNA, 73 bp, Homo sapiens
ttggctgctataggtagatctgtctaattgcaggatggaatgaatccatttacagtttatgtaaagctgccaa

SEQ ID NO: 6835580 - DNA, 59 bp, Homo sapiens
aatctttcaatactgcactgtgttttctggtcacagcgtaaatggggtgttgaagggtt

SEQ ID NO: 6835581 - DNA, 67 bp, Homo sapiens
gcagaggcttcagggcttttgagggttacttagccaagtcattgcctctgttcccggagccatctgc

SEQ ID NO: 6835582 - DNA, 73 bp, Homo sapiens
agaggcttctacaaatgcccaagtgttgactggctgatgcctagcctttaagcagcgcagcatttgtgcttct

SEQ ID NO: 6835583 - DNA, 68 bp, Homo sapiens
ccttctcccctaaatccccagtgttctcagtttccagggcacaggagaaggatctggctgggaggagg

SEQ ID NO: 6835584 - DNA, 67 bp, Homo sapiens
gagaaggcttctgggccagtcactcctgcatttctgcagttgccttcccccagagccaacccttctc

SEQ ID NO: 6835585 - DNA, 57 bp, Homo sapiens
gtgcccaccggtgccctgagctgggagcctggcacagatggggtgtgcggtgggcac

SEQ ID NO: 6835586 - DNA, 69 bp, Homo sapiens
gggtacagaaactgaggcttagaaacaatggagcatttgaaccttaccttggcttcagtgtctgtactc

SEQ ID NO: 6835587 - DNA, 66 bp, Homo sapiens
acccatcctgcttctttgggatggttggtcctgaagccaaattcctggcagaagcatcagatgggt

SEQ ID NO: 6835588 - DNA, 57 bp, Homo sapiens
tgctgtccctaagtctcttcaatactaaaatccattggcaaaaagcttagggtggca

SEQ ID NO: 6835589 - DNA, 79 bp, Homo sapiens
ggtagccccggtgcactctgtcctctcctggcttgcccacactcctgggatgcctgaagaacagctgtgaggagctgcc

SEQ ID NO: 6835590 - DNA, 57 bp, Homo sapiens
ggttgcaaactcctgggatcaagtgatcctcccaccttggtccccatccttgcgatt

SEQ ID NO: 6835591 - DNA, 83 bp, Homo sapiens
gagaagcaagggagagcacagtcctcacatccaactaaaggttccctaaggtgcagggctgtgtttgcaccctctgcctgctc

SEQ ID NO: 6835592 - DNA, 100 bp, Homo sapiens
gggaagtggcatgttgtcttgtcttgacatttcagatatggtatttttccagctttactgatgaaaaaccctgaagttcaattaagttcattcgcttccc

SEQ ID NO: 6835593 - DNA, 76 bp, Homo sapiens
attttgctttagtctattgatttggatttttccccctaccctgggagtaatcaatttttcggtggatgggcagaat

SEQ ID NO: 6835594 - DNA, 81 bp, Homo sapiens
ggctgctgggagctaggctgggcaggaaatatgcagatgagcgaagatttgcacatttcttagcctagttccagtccagcc

SEQ ID NO: 6835595 - DNA, 63 bp, Homo sapiens
gtgcttccagcccagcctgcagtctaaggctgcccaaacacccaggagcaggctgggcagtgc

SEQ ID NO: 6835596 - DNA, 126 bp, Homo sapiens
ggacctaagctggtactctgttacatttcatgagaggaggtcaggctgaattgaagatagtatgttcacctcaccacccttatggttctggcagcttaaacctagccttcatttattttggcgtcc

SEQ ID NO: 6835597 - DNA, 66 bp, Homo sapiens
actgaaatttttattctttgcctttcgtgccagggagggcacaggtttgacaaggataaaatcggt

SEQ ID NO: 6835598 - DNA, 87 bp, Homo sapiens
gcgcgcagccttcctcccgagctccctgcgctctattcctgtcccgccgagacgactccctggagccagcgagccgaggcggcgtgc

SEQ ID NO: 6835599 - DNA, 95 bp, Homo sapiens
tgtatatatacatgcatgtaactgcatgtgtgtggcatgatacatgatgaaatatgaatgcatgtgcatacatgcacagtgtatgtgtatatgca

SEQ ID NO: 6835600 - DNA, 88 bp, Homo sapiens
aatcctgtgtatgatcagcacagtagggtgacgaggaggtaatgccgtttatctcacccaacgtgcaatgagtttcgtaagcagtttt

SEQ ID NO: 6835601 - DNA, 61 bp, Homo sapiens
gcccaggggcagcgcatagtgggactggtaccactgttggtatggtgcgctgttgatgagc

SEQ ID NO: 6835602 - DNA, 85 bp, Homo sapiens
ctggaccaacttgggtcaggtgttcattcctaaaccaatcactgaatcactatggctctaggaatggaacactttgattttctag

SEQ ID NO: 6835603 - DNA, 86 bp, Homo sapiens
gcttgctgtccaaacgagttccccacttagagcaacatgaaaatctctacagattccatggggaaacttttgaccttgggagttgc

SEQ ID NO: 6835604 - DNA, 68 bp, Homo sapiens
ccaagtattagatgttggtgagtgctgaggggaagacccagacagcagacaccaaatcttatttttgg

SEQ ID NO: 6835605 - DNA, 76 bp, Homo sapiens
gaaaaggttactctgcaagttgaaggtggcttagaggaccaaaagcactttcaaaaaacatgcagactgctgattc

SEQ ID NO: 6835606 - DNA, 57 bp, Homo sapiens
ctgctgatgtaagccatgctctgctgatctcaacggagtgtacctatgcatctgcag

SEQ ID NO: 6835607 - DNA, 70 bp, Homo sapiens
cacagcagaggaaaagtctgatacttgccttaattttggtttcatcatatcgcttttttccctttgcttg

SEQ ID NO: 6835608 - DNA, 111 bp, Homo sapiens
gaaaatataggatgcccagttcactttgaatctcagataaccaaatgggacaggcttatactataatatgaaactttggatatctgagattcaaacttcctttcgattttc

SEQ ID NO: 6835609 - DNA, 67 bp, Homo sapiens
cgtgtggatcatagcgtttacatgtggattaacatttgctaatccaaaactgaatctgtggcacatg

SEQ ID NO: 6835610 - DNA, 73 bp, Homo sapiens
cctgtggattgctgtttctaaaggccgtctgttccacattaatagcccttgaaatagtctaaaaaaccagagg

SEQ ID NO: 6835611 - DNA, 124 bp, Homo sapiens
cgctggcctttctgtctctgaagcagttgcttagcaatgtgacaagatgccagacagttggagacccaagtaagtgttcacatgctggggggaagcagagggatggctgaatatggggctagtg

SEQ ID NO: 6835612 - DNA, 69 bp, Homo sapiens
atgcagcatcctcagtgtagattcctttatctattttaaagaagaaggcttgattgaggaatgccgcat

SEQ ID NO: 6835613 - DNA, 57 bp, Homo sapiens
gtgtgctgagtgactgtcatcataccacggcataagtgacaacagaactgggcaagc

SEQ ID NO: 6835614 - DNA, 121 bp, Homo sapiens
caggggctcttggctccttgtaaattcagttcttccagatggttctttagctcctgttttggccccgtggctaatgagttcgagatctgctgatgagaatgggagtattggagagcctctg

SEQ ID NO: 6835615 - DNA, 97 bp, Homo sapiens
actgcctcctgtctcttgacccagtttaacctatccattatgtgatatcccttctattatagtatgggctacttaaaaacaagcaggcatgggcagt

SEQ ID NO: 6835616 - DNA, 75 bp, Homo sapiens
gctttgaggtagttccattacaaacatgttaagatttttaaaaattcagtcaggttggtgaggaccacacaaagc

SEQ ID NO: 6835617 - DNA, 69 bp, Homo sapiens
gtctcctagtcttcacttattgagtcttgtactttagatctggatggagatttgtgaaggcaaggagat

SEQ ID NO: 6835618 - DNA, 69 bp, Homo sapiens
aactgcataatatatcatgcagactataccacagttatattaaacagtctgctatattgaagtgcagtt

SEQ ID NO: 6835619 - DNA, 55 bp, Homo sapiens
cctggctcctgcctctgcaggggcgatgcttcccgcggccggtggatgagccagg

SEQ ID NO: 6835620 - DNA, 86 bp, Homo sapiens
tatgcgaacaaattggctggatattgaattgtacctcttaatgaacaggggaaatacagaaggaagtttagctaaatgttaacata

SEQ ID NO: 6835621 - DNA, 83 bp, Homo sapiens
gttgcagagtgaagcagtatggaaaagaaattccactcattttttggaaagtcagtttctcatgcatgctcttacttttcaac

SEQ ID NO: 6835622 - DNA, 103 bp, Homo sapiens
cttaggaacttcagttctgtcagtaccactgaatatctgtagatcatcattatatatctgaatacagatattcagtggtactgacagaataccattgcctggg

SEQ ID NO: 6835623 - DNA, 68 bp, Homo sapiens
gagtaatttccattttatcagaccagctggggcttgtttttgagtctgtgaaaagataggaagtgctc

SEQ ID NO: 6835624 - DNA, 75 bp, Homo sapiens
ggtgaattaaagctatccagtcatgaactgctttcactcttgctcagagttcatcttgatggcttcctaattccc

SEQ ID NO: 6835625 - DNA, 61 bp, Homo sapiens
ggctttaggagtccaaaggttttacaatttaatacataattgctaggctcctcctaaggtc

SEQ ID NO: 6835626 - DNA, 109 bp, Homo sapiens
attgtatgtattatcggacatgtccgtatattttggggacaactgaacttatcccatgacacccaggccttccccaaaatacatggacgtgtcccatcatacatataat

SEQ ID NO: 6835627 - DNA, 69 bp, Homo sapiens
ggccattcagactggccacatctgcactgtgtgaggcgtgcaggcagagacgtcagtgtaggagtggct

SEQ ID NO: 6835628 - DNA, 58 bp, Homo sapiens
tttcccaactgggccctccagtgggtctgtttttctatccaggtgctcaaatgggaaa

SEQ ID NO: 6835629 - DNA, 58 bp, Homo sapiens
gtgttcaattatgcgatgttaatcaagagccctattgaggatatccaataatgaacac

SEQ ID NO: 6835630 - DNA, 75 bp, Homo sapiens
ttgaggctgtcagtggctgtggcattaggtgaggccccttggagggggtggccctaaccgcagcctccgtcttaa

SEQ ID NO: 6835631 - DNA, 77 bp, Homo sapiens
tgttcagtcccctttcatttgctagtggcagaaacccaaccggattagctgttgtgaaaggggtgttgactggttca

SEQ ID NO: 6835632 - DNA, 55 bp, Homo sapiens
ggtgcatggtggaggtgaccctggagaggttggcagggccagacgctagagcact

SEQ ID NO: 6835633 - DNA, 72 bp, Homo sapiens
gcttctttattgactcccagcttttccaactctggttgtgaaccttggtgagtcagtattcattagaggagc

SEQ ID NO: 6835634 - DNA, 121 bp, Homo sapiens
ttgatgctgtatttttccatataaattgttaaattggctttgtggtttctgcatcaatctattgttgcactgatcagggagcctaatttactctggatacactgacaaaaacaaatttcaa

SEQ ID NO: 6835635 - DNA, 68 bp, Homo sapiens
gtcatcgtggtatcaattcattttatgcaaacatgaaggggtgctaagatgcattataccacagagac

SEQ ID NO: 6835636 - DNA, 100 bp, Homo sapiens
tggttgccaccttgtcagcacgcctgcctgtcagtcccccttgagggcttctgttgcctgcagagggactggcaggaagaggtgcacctaggtggatcta

SEQ ID NO: 6835637 - DNA, 62 bp, Homo sapiens
tagacatttggagttttatgacctaagaggaaagaacctttggaatgaaatttttgtgtctg

SEQ ID NO: 6835638 - DNA, 63 bp, Homo sapiens
cagtggcttctcatgtcattcagaggaaaagccaaaggtcttaacagtgactgagaggccctg

SEQ ID NO: 6835639 - DNA, 73 bp, Homo sapiens
gatagctcaaaggttaagtgtggaccctgaagccagactgcctggttccacgctgtgtgaccttgggcaagtc

SEQ ID NO: 6835640 - DNA, 65 bp, Homo sapiens
ccagagtgtggcatcttccaactacatccagggtgttaagtttggttttgaatgccacactgtgg

SEQ ID NO: 6835641 - DNA, 88 bp, Homo sapiens
ttttttaaagcaagatttctggtacattcatttctgagaaggtaaataaggattgacaggtctttgggagtatatttgctttaaaaaa

SEQ ID NO: 6835642 - DNA, 78 bp, Homo sapiens
tcagtggagcattgttttgaattattccttgagttgaagtgttcgattcaagaagatagcttcatgcatttccactga

SEQ ID NO: 6835643 - DNA, 77 bp, Homo sapiens
agccttgtgggttactcaggccccttgtcagctctgtgatcatccttcacacctgaaagcttgtaacccgagaggct

SEQ ID NO: 6835644 - DNA, 82 bp, Homo sapiens
acaaagatggcaatgacatctccctgctctaaacagctgacacagcagcattagttgggttggtggtcacggcctctattgt

SEQ ID NO: 6835645 - DNA, 61 bp, Homo sapiens
acccagtgcctcacccagggatggcggagacttctgtctggctctgcagcaaggcctgggt

SEQ ID NO: 6835646 - DNA, 103 bp, Homo sapiens
ttgaggcaggaagatcccttaaacccagtaggtcgagactgcagtgagccatgttcatgccactgtactccagcctgggggacagagggagaagttgtctcaa

SEQ ID NO: 6835647 - DNA, 75 bp, Homo sapiens
gctcactaattctggagacaactcatttatttttcgggcatctataactgctattgacttgtctttagagtgagc

SEQ ID NO: 6835648 - DNA, 130 bp, Homo sapiens
aagtacagccacatcccctctgatccttttggattctcacagtgtaatattgaacccaacctttggaactgggttatcagatgttgtcatcagtgtgtcttccaggattttaaactctgctggcttgcct

SEQ ID NO: 6835649 - DNA, 73 bp, Homo sapiens
caacttgagagtcggcttcacttatgttatgggagattctgccaactcccttaacaagcccaactttcatttg

SEQ ID NO: 6835650 - DNA, 68 bp, Homo sapiens
gcctgggcaccaagcactaggacttcagtctctagggccacagagggggtccttctgcttagccaggc

SEQ ID NO: 6835651 - DNA, 78 bp, Homo sapiens
gcatgtttccttgtgaacctgagtgagcttctttcaattatttacataggagagaaattcctaaggtacacaagatgc

SEQ ID NO: 6835652 - DNA, 82 bp, Homo sapiens
gctgctgcagggacttgagaccccctgagttatggcctgaagaacgggtccacttcccaggagggttgtccactgacagagt

SEQ ID NO: 6835653 - DNA, 81 bp, Homo sapiens
gggtccctgccaccatgccccagcagagagtgtctgggaaacccctgggctgccctggttggtgccacatggtggccacct

SEQ ID NO: 6835654 - DNA, 99 bp, Homo sapiens
agtggcaggttttctgtcagggagctcgatgcctgagtgtcagacccaccaaagacgttcattccatcacgagctagcccctcaaaggaatcaatcact

SEQ ID NO: 6835655 - DNA, 56 bp, Homo sapiens
gcactgccatcaatgcatgacatttaagagtcatccaaggttttgaaggcagtcgt

SEQ ID NO: 6835656 - DNA, 58 bp, Homo sapiens
gccctgagagcagcttcctgcttaggccaactttagcacaaggtgctgcctgcaaggc

SEQ ID NO: 6835657 - DNA, 91 bp, Homo sapiens
tcttgaaaagtgaatcaatagtgcttacattatcatgaatatggatatatttttctttgctcagtgaagtactgttctaaaacttaagaga

SEQ ID NO: 6835658 - DNA, 75 bp, Homo sapiens
ttcgtttccctgagttgcagtttcctgctcacagcattgttgggatgaagagtgtgactgcacctagttgatgaa

SEQ ID NO: 6835659 - DNA, 128 bp, Homo sapiens
ctcctttttcagcacatttggtttgccttgattttgacaagagtgtgattgctgctaccccattatgaaattggggatagagatctgtggattcattgtcaaggtggaggatgcaggcagggaaagag

SEQ ID NO: 6835660 - DNA, 60 bp, Homo sapiens
aggcttgatggtttcagcattgcttcacagaaatagccctatgcttgagatcacaatcct

SEQ ID NO: 6835661 - DNA, 89 bp, Homo sapiens
catcagaagacagcaggtccaattgcgctaaaatctaaagtcaagtttagagcagcggggccgtggacccatcagctgctgatctggtg

SEQ ID NO: 6835662 - DNA, 58 bp, Homo sapiens
cagtacagcatggtatggaaagaccaaacaatgagctgcctctgccatttgctgcctg

SEQ ID NO: 6835663 - DNA, 61 bp, Homo sapiens
gctggggcaagggcagctgtttctctgggggtaaacactcttagttgccaaaatgccctgc

SEQ ID NO: 6835664 - DNA, 57 bp, Homo sapiens
aagctgaggtcaagtagctagtaagtagtagatttactagctactgaatcttaactt

SEQ ID NO: 6835665 - DNA, 76 bp, Homo sapiens
acctaggattcttgggatgggtgtcacaataatacgaaccagtgtacttctgaccttttcatcaagagaactgggt

SEQ ID NO: 6835666 - DNA, 61 bp, Homo sapiens
acattaacactggtgctggtgtaatggaagcatgagcagtagcataaatagtggtagtagt

SEQ ID NO: 6835667 - DNA, 95 bp, Homo sapiens
ttatgctccctggtgatgctagaaggcagggagagagccgtgataataagattctcaccccgttttctgtgtgacggcaaataacagagacatga

SEQ ID NO: 6835668 - DNA, 73 bp, Homo sapiens
tgatgcaaagcaccacactaagatgagtttctttaaccttcatgtatttattttgttatcagggctttgcaca

SEQ ID NO: 6835669 - DNA, 68 bp, Homo sapiens
ataataataaccttggctagtattgtgccttgatggaaaggcacaataacagccaaggttattattat

SEQ ID NO: 6835670 - DNA, 82 bp, Homo sapiens
ctatgtaaaatggcaagctgaactcagaagacagggtattcacggtcctatttagtttcaggattcatttccatttccatgg

SEQ ID NO: 6835671 - DNA, 75 bp, Homo sapiens
ctgtctttcagctttaactatgtgttaaagattatagcggttatttctctaacacataagctgagaccatgacgg

SEQ ID NO: 6835672 - DNA, 87 bp, Homo sapiens
tcatcttcagtgctgtttcccaaggtttcaacctccccagcctaaccaggatacttgaaacttttcttggagaaacagtcactatga

SEQ ID NO: 6835673 - DNA, 81 bp, Homo sapiens
agcccctggaggctgcagagaagtctgagactggagaaaggaggctcggacagaattctgcttctgtgtgtcccagggtct

SEQ ID NO: 6835674 - DNA, 55 bp, Homo sapiens
tgttgcaggcccctggggtatgtgcctgtctatcgcgcaccgggtcccagcagca

SEQ ID NO: 6835675 - DNA, 130 bp, Homo sapiens
gcattccagctgattctcagcctctcagccctgtgctcttgaggcagctgaagcttcaaagagtcctccagactctgaggagacacttaggctctaacttgcacaggggaggcagaattagattgggtgc

SEQ ID NO: 6835676 - DNA, 59 bp, Homo sapiens
tcaagcagtttttataacactggaatatgaaaacgatatattcattagagactgtttga

SEQ ID NO: 6835677 - DNA, 91 bp, Homo sapiens
ctgggtgaccctgggtgaatcccttcccttctctgggactccatcctgagatcggagagctggaggagatgacatccaaggttccacccag

SEQ ID NO: 6835678 - DNA, 90 bp, Homo sapiens
ggttgggctgaaggaaaccccggtgaaacccacacctgtaaagatgcttctcacagtgggacttttatcgcttgggtcctggtcacaatc

SEQ ID NO: 6835679 - DNA, 57 bp, Homo sapiens
agccacagatgggcaatctttctgtcatgccactgaataaagatgtccttttgggct

SEQ ID NO: 6835680 - DNA, 69 bp, Homo sapiens
ggttttgttgaggttcacaggctatcacagttccgcaaagggctcaggtgtgtgtggaccagaacttcc

SEQ ID NO: 6835681 - DNA, 82 bp, Homo sapiens
agttctagggtacatgtgcacaacgtgcaggtttgttacatatgtatacatgcgccatgttggtgtgctgcacccattaact

SEQ ID NO: 6835682 - DNA, 56 bp, Homo sapiens
tccatggctccatcctgttgctagtggcaatgctacgagctggaaggaggcctgga

SEQ ID NO: 6835683 - DNA, 56 bp, Homo sapiens
ggtatatgctgatgtgatcggttgtacttattgatagccagtctcagtactgtact

SEQ ID NO: 6835684 - DNA, 75 bp, Homo sapiens
ggctggtagcaggacagggattcaaactcccaactgtctgagtgggcctgggctcctgtcctcttgctacctgtc

SEQ ID NO: 6835685 - DNA, 81 bp, Homo sapiens
accattagcctgtatctgctagaattatccccagtatggttagaaggagataatattagaagatacaaattgccaaatggt

SEQ ID NO: 6835686 - DNA, 84 bp, Homo sapiens
ggatgcttttacctaataggcttctgggattgcttgctcttctgggccctccgtggttctcagaggctgctaagtgcaaggccc

SEQ ID NO: 6835687 - DNA, 86 bp, Homo sapiens
ataaggttgccttgagcagagttgtaagaaatctgatctgaaaatccaagttaataatcttcacaattctaacagggcaatgttgt

SEQ ID NO: 6835688 - DNA, 88 bp, Homo sapiens
gaaatggtaaagttgactgttttacttatgtttttgcagtaagaagctaaacatccagtatcagaagcatcagtacttttactctttc

SEQ ID NO: 6835689 - DNA, 63 bp, Homo sapiens
tcagtcagccagctggtgcggcagagcggggctcaggccgggctcctcctcagttgggactgg

SEQ ID NO: 6835690 - DNA, 69 bp, Homo sapiens
ttagtgatattttaggaaaattgcgtaaaagagaatcatacctcttagaagtttccagcatgttactaa

SEQ ID NO: 6835691 - DNA, 79 bp, Homo sapiens
caggaggagctgaggctgaggcctcactgtcaccttctgtgaggtccatgacatcctcactcctgagctcaccttcctg

SEQ ID NO: 6835692 - DNA, 100 bp, Homo sapiens
gagattagttaggactctattggaatagtttagaagaagctaaatatttactgagctttgttatggctttgctttggctgtttcagtcctgcttagtttt

SEQ ID NO: 6835693 - DNA, 104 bp, Homo sapiens
gagatgtcaggtggtggtgatactcagccgaggcagaggctgaaacggctgcgccacaggcagccaaaagtttttgctttgtgtattttcacctcattgctctc

SEQ ID NO: 6835694 - DNA, 71 bp, Homo sapiens
catttcatgtaatcatttaggtggctaatctcatccaaataatttatggcctcttggtgcttgatgaaatg

SEQ ID NO: 6835695 - DNA, 64 bp, Homo sapiens
tgttgggtgcttttggagttgtgaactgtaggcaccgccttctcagagcttccagaaaacagca

SEQ ID NO: 6835696 - DNA, 130 bp, Homo sapiens
aataatgtttccactttctccccaagtgcaccaagaatgtgacaaaccaagtattttggtaaaccttgaaacacaccagactactctgttttatatctttgttatatggttaattacccttaatgttatt

SEQ ID NO: 6835697 - DNA, 76 bp, Homo sapiens
tgttacgccagagtgttaaagtactgtgctgtcttccacagatcctcaggcacagaataacactctgggctgcaca

SEQ ID NO: 6835698 - DNA, 66 bp, Homo sapiens
tgcaagcagttatattcaaaatgaggctgtgcaattatgcacatcagatgaaaatggcagtctgca

SEQ ID NO: 6835699 - DNA, 59 bp, Homo sapiens
cacatatatgggcccctgagggtgtatgggctctgggggtctgcagcccagaatgtgtg

SEQ ID NO: 6835700 - DNA, 78 bp, Homo sapiens
tgttagcctgttttaagtggcgtgtggtaaacttgcccacagatgttagtatacccgtctactttgaacaaaataata

SEQ ID NO: 6835701 - DNA, 129 bp, Homo sapiens
ggttgagagggaaatgactacagtggtaaataaggcggaatcaggatgactgtcatttcagtaagaatttattgaacgcataactttgttctcagcactattggcactgtacaaattccagggaagact

SEQ ID NO: 6835702 - DNA, 58 bp, Homo sapiens
aatgagggagtggggcttgtccgtatttacgttgaggcgggagccgccgcccttcatt

SEQ ID NO: 6835703 - DNA, 70 bp, Homo sapiens
taggtgtctgtggctgcctctgtgctaccatgatagaggtgagcagagaccatatagcccagaaagccta

SEQ ID NO: 6835704 - DNA, 89 bp, Homo sapiens
tcagatttatctcccaagtctggcagaattaaacagtgtgtaatactaactgcttcattactgacagtctgtgactaggtattctctga

SEQ ID NO: 6835705 - DNA, 79 bp, Homo sapiens
aaggctttgctgaattctcattccctggagaaatagccaagagtgttgggcttttccaaagggacttcagcggaaactt

SEQ ID NO: 6835706 - DNA, 63 bp, Homo sapiens
cagctttccagagacctgcccccttttctagctggggtgctgattctactcctggaatagctg

SEQ ID NO: 6835707 - DNA, 62 bp, Homo sapiens
tcataaactgtctgcaaaactcatactcaccacctgggtgttgtgtggaaagcaggctatga

SEQ ID NO: 6835708 - DNA, 92 bp, Homo sapiens
ggggcaccaaccatcttcaagagcttcatctgtgcctgcataccaaagagatgcttacacaagagccttggcaatgagtcctgaagtgcttc

SEQ ID NO: 6835709 - DNA, 59 bp, Homo sapiens
ttctctctctctgtgtgtgtgcgctgcccgtgcatgcttgcatgcttggagagagagaa

SEQ ID NO: 6835710 - DNA, 66 bp, Homo sapiens
gaggaaactaattagtagaataatctttgtttcccagtttgaaagattactgtgattgctttcctc

SEQ ID NO: 6835711 - DNA, 94 bp, Homo sapiens
tgcctgtggccaaatggaagaggtgccacccagcttttgtgatgcagaaacgtttaaaggcttcggagtgcacactttttacaaagttaaggca

SEQ ID NO: 6835712 - DNA, 56 bp, Homo sapiens
agccatatgcacacatacttctcaaaccttgacccaagtttgtgtgtctatgcgct

SEQ ID NO: 6835713 - DNA, 65 bp, Homo sapiens
ttcatttgatcttcacggaaggtcaatcttttcaagattgtctctttttcagaagagaaaatgag

SEQ ID NO: 6835714 - DNA, 130 bp, Homo sapiens
agttcatccctaaccaacagttttccttgaaattagctgttagagaagagtgtagacagaataacattttgctttattcccttctgatgtgtaagaggaggaaatcagggctttacaatgattgattact

SEQ ID NO: 6835715 - DNA, 130 bp, Homo sapiens
tggacccaacacaaatggttcccagtttttcatgtgccctgccaagactcagtggttggatggcaagcatgtggtctttggcatggtgaaggcatgaatatcatggaggccatggaacactttgggtcca

SEQ ID NO: 6835716 - DNA, 69 bp, Homo sapiens
tctggatctgcagtagcacctgtggcttttgagcaccttaaatgtggctagcgcaactgaggaaccaga

SEQ ID NO: 6835717 - DNA, 87 bp, Homo sapiens
aaaatgaggttatccactttccaaaggacaagtttcagaataagacttgaggccacatgaattcttggacagtattttacttctttt

SEQ ID NO: 6835718 - DNA, 87 bp, Homo sapiens
gaggcaggagaatccaggtggaggttgcagtgagctgagatcacgccattgcactctagcctgggtgacagagcaaaacactgtctc

SEQ ID NO: 6835719 - DNA, 62 bp, Homo sapiens
agagaagcagggagtcatctgtgatgctcttctaatttcccagaacaacacccctattctct

SEQ ID NO: 6835720 - DNA, 67 bp, Homo sapiens
gggccggtggtgggcaggggtggggcagcactttgatgttcttcccttcattccaccaccactgctt

SEQ ID NO: 6835721 - DNA, 70 bp, Homo sapiens
ctcagttatcaattctgtgtgcctttagggcagaagttcaataattctgctgggtatcagaatcactgag

SEQ ID NO: 6835722 - DNA, 74 bp, Homo sapiens
cgctgagctttgtggcccgcgccgcgaccagccaacgtgatctctgactggtctgtccgcaggtcaccttcgcg

SEQ ID NO: 6835723 - DNA, 110 bp, Homo sapiens
tcaagaagccatctggagggcttccccttggaatcatcctggtctgcaaaaccagtcaactgttctggagataagaggtagagcccaaagttctctagtcagcatctaga

SEQ ID NO: 6835724 - DNA, 77 bp, Homo sapiens
cttgcagctggatgaggaagtcaggcatacaagccatagtaatgatatgtagcagtgtctaccacattaattgtaag

SEQ ID NO: 6835725 - DNA, 61 bp, Homo sapiens
ttcttgctatgtctttggttttagtgttagggtgacactagctttacagcatgagtgggga

SEQ ID NO: 6835726 - DNA, 67 bp, Homo sapiens
ggccgccagcgtctcgttgtgggcctcgcccggggtccggttggcggccggctcggggcgcacggtc

SEQ ID NO: 6835727 - DNA, 59 bp, Homo sapiens
gagtcttcttttattacttggggataaagattcctcaacagcacgtgtgaaaaagactc

SEQ ID NO: 6835728 - DNA, 89 bp, Homo sapiens
attagcacagtttacatgcaaataaagcaactatacaggtttatgtgtgaatctgcttgtatttgtccctgtaaatgactgcagctaat

SEQ ID NO: 6835729 - DNA, 63 bp, Homo sapiens
gagaattagaaaccaagaggcaggctgggcagacagcaagactttttggctttttgactgctt

SEQ ID NO: 6835730 - DNA, 55 bp, Homo sapiens
gtgaaatgctgtagatcagtgagttggtaaaccaactatggaaacagtgtgttac

SEQ ID NO: 6835731 - DNA, 76 bp, Homo sapiens
gcaaatggcagatttttattggtaagattttataactgattaagttctacctcctagaaaatctggagccaaatgt

SEQ ID NO: 6835732 - DNA, 94 bp, Homo sapiens
aacctgctgacagaagaccctccttcaaggtgggcacttggaattgacttttctctagcgtttataagaagccagggcttggaacagcctggtt

SEQ ID NO: 6835733 - DNA, 91 bp, Homo sapiens
aaaaaaagagaacgtgaattactttagggatgttttgctttttattcaaggcagatggctactttcctgggtcttcaatttctctagtttt

SEQ ID NO: 6835734 - DNA, 87 bp, Homo sapiens
agtaaatatatgactccactgcatgatttagtggtagaaatagtctatttatgttcacattttttagtagagagtcatgtttttatt

SEQ ID NO: 6835735 - DNA, 58 bp, Homo sapiens
gctctgagattgagcctttggtccccaccacttccagtttgagctcaatctccagagc

SEQ ID NO: 6835736 - DNA, 80 bp, Homo sapiens
atctaccattctcctaggcactagagttcaaagatgaattagattggttctctgtttttaagtgcttgagaatagtagat

SEQ ID NO: 6835737 - DNA, 91 bp, Homo sapiens
ctatctgtcgctttcctgaggggtctcatgcccatccttctccaacttttctaatgatgtctgagattctgttcagaaaaatgacagacgg

SEQ ID NO: 6835738 - DNA, 83 bp, Homo sapiens
ccttgcttccttcccgttcttctccttgccctactccaggaggaacatgaccttgctttggagagggacaggaagggaggagg

SEQ ID NO: 6835739 - DNA, 114 bp, Homo sapiens
agaagcctgagtgtggaggatgactagcccagagtcccaattccagccctgttcatcactagctggttgtgaaacttgggtaagtttttaaatttttcggaacctcagttttct

SEQ ID NO: 6835740 - DNA, 73 bp, Homo sapiens
gagctggagcctccatgcccaactctgctctgctcttctatttcctgacagcagctaaggcatgttcctgttc

SEQ ID NO: 6835741 - DNA, 76 bp, Homo sapiens
gcagctataagactggggatcccagcttcttattgtttgtcagcaactagaagccattctcagttcctgaggctgc

SEQ ID NO: 6835742 - DNA, 60 bp, Homo sapiens
ccatatgaaattgccatttttatggaccaaaaatggttgcatatcagaaatttcatatgg

SEQ ID NO: 6835743 - DNA, 83 bp, Homo sapiens
aggaacaggaggcaggaaaggaagagaatccttctcagacaatggtgctgcagggcccctttttccctgagctcctgaatcct

SEQ ID NO: 6835744 - DNA, 78 bp, Homo sapiens
tggggcaggtgaactgctgagttttatcatctctgcacagtgacatgattgatgctgggttgttcccttttgacccca

SEQ ID NO: 6835745 - DNA, 77 bp, Homo sapiens
gagaagtggttgtttccaggtttgaaaaatttcacagtattattttaagctacaagagacatatgcctaacttcctc

SEQ ID NO: 6835746 - DNA, 83 bp, Homo sapiens
gccaatgttatcatgcttcatcatcactgttagaaaccggatgctgactttggagcatggcccaataagaacctagcgtttgc

SEQ ID NO: 6835747 - DNA, 73 bp, Homo sapiens
ggtagtgtcccatcacagaggagactagatgcaattttttcctgcccctggtccctagtgtgggagcttggcc

SEQ ID NO: 6835748 - DNA, 59 bp, Homo sapiens
gcatagctttgatgctgccttaatattacactaatgataccttgggccaaggctactgc

SEQ ID NO: 6835749 - DNA, 66 bp, Homo sapiens
gtggccccagcatcagcacccaaggagcagcccaaaatgggctgggaggggttattttggggttgc

SEQ ID NO: 6835750 - DNA, 65 bp, Homo sapiens
caggtgggccggggtttgttcttgccttccatcagagtgtgttaaacaggcctcaggccttcctg

SEQ ID NO: 6835751 - DNA, 92 bp, Homo sapiens
tgaagctattatttctgatgaagttcactttgtttggatttagaaaatccactcggagggaatgtttacctttcctttaataatatgcttta

SEQ ID NO: 6835752 - DNA, 76 bp, Homo sapiens
gctgcactgggcgcctgcctttttgggggagtttggctttcccccacctggggtacaggaccgtcctcagtgtggc

SEQ ID NO: 6835753 - DNA, 65 bp, Homo sapiens
cacttcaattgcgttaggaggtctttgctggtctcctccctaaagctgccttcgcagttggtctg

SEQ ID NO: 6835754 - DNA, 72 bp, Homo sapiens
gctgagttttactagtgaaatttgcaagtaattatttataatgatatgcaaattatcatcaggcaattcagt

SEQ ID NO: 6835755 - DNA, 84 bp, Homo sapiens
ggttttctgccaaaaatatcagcttgtagactgcttatctgaaaggagagctgctgcccataggtgacatatggcttgaggacc

SEQ ID NO: 6835756 - DNA, 67 bp, Homo sapiens
tcacttgctaacagatattgaggatgagcttgcctttggtgatcatgaacagtgctgttaacagtga

SEQ ID NO: 6835757 - DNA, 95 bp, Homo sapiens
tttggaaaagtgcagtaacttgcccaagtcaaccaactgttaaatgtgcatctggattcaaatatgggcctgggtgactgactttcaagtccaag

SEQ ID NO: 6835758 - DNA, 58 bp, Homo sapiens
tgcctgctcttaccactctcccctctgtgttgctggggctgggatggtgggggaggta

SEQ ID NO: 6835759 - DNA, 79 bp, Homo sapiens
gttggagtgataatgtgtttcaagaggcttaattctggatgaaacatctggaggctaagtcatttgctaccactctaac

SEQ ID NO: 6835760 - DNA, 111 bp, Homo sapiens
gacttccctgaggaattgtacatggtgctctgagagtgcatgatagcacatgactttctcccgtgcttatcaagctgcactcttcccatttgcgcctccacattcatggtc

SEQ ID NO: 6835761 - DNA, 70 bp, Homo sapiens
gtttcgtcatctccaaaatgcagtcaatcatcccaggtggtgctgaggactaaaggagatgacatgaaat

SEQ ID NO: 6835762 - DNA, 76 bp, Homo sapiens
ggtccatttcttccaccactctgtgtacaactactacatgtcaggtaccatggacacagtggtgaaggtacagact

SEQ ID NO: 6835763 - DNA, 91 bp, Homo sapiens
ttgcatcctcacctcactaatgagctaaggaaaagttacgattgtataattttatctttttctcattggatgggagtgacattttttgcaa

SEQ ID NO: 6835764 - DNA, 101 bp, Homo sapiens
tgagacacagtcttgctctgtcacccaggctggagtgcagtggtgccatctcagctcactgcaacctccagctctcaggttcgagcgattctcatgcctca

SEQ ID NO: 6835765 - DNA, 63 bp, Homo sapiens
atatttgtttgggtggtttatgtacagcgttgaactgatttgaaccccgaccaaacactgtat

SEQ ID NO: 6835766 - DNA, 87 bp, Homo sapiens
cttgccttctggctcaggggactctgcccagctgtccccttccccgactgcaccctgcaggtacccctgatctcagtggaaggctag

SEQ ID NO: 6835767 - DNA, 81 bp, Homo sapiens
agagacgatgctggattatctcaagggaacagcagtgaaccatcttgattaaccttgaggagtccatagtatcacgttttt

SEQ ID NO: 6835768 - DNA, 72 bp, Homo sapiens
gtgttttgtactcttttatgttatggtgagtcaggtatggctacaagagacaccagggaggctcagaaacac

SEQ ID NO: 6835769 - DNA, 71 bp, Homo sapiens
agaccaaagagagggatttggtttattgctagtgcagaagttaaaaaccatcttcctttcctgagtggtct

SEQ ID NO: 6835770 - DNA, 56 bp, Homo sapiens
ccttctggaagctctaagggagaatctgtttccttccactttccagcttctaaagg

SEQ ID NO: 6835771 - DNA, 66 bp, Homo sapiens
ctgacagctgaatcgaatggcccagtggtggcacattccccagagggcttcaggttcaggatgcag

SEQ ID NO: 6835772 - DNA, 90 bp, Homo sapiens
gggggcttctgggaaggctttggggccccaacttcctcttcaaatagagcagctgcacttctacctaattgggcttccacagaaggcctc

SEQ ID NO: 6835773 - DNA, 80 bp, Homo sapiens
tcctcagtcacggtagcacatttaagggctcaacagtcacacgtagctagtggctaccatattgtttgatgactgagaga

SEQ ID NO: 6835774 - DNA, 56 bp, Homo sapiens
ccagaccctgcaggtgatgtgtagcgcccagtctcaggcaccaatagggatcgtgg

SEQ ID NO: 6835775 - DNA, 60 bp, Homo sapiens
caaggagatttttttctgaagcctctgtttgtgtttggcttatagatggcgatcttcttg

SEQ ID NO: 6835776 - DNA, 70 bp, Homo sapiens
gccagcaagtatcaccaaagcctgaacctcacacccaccttctaagccatggtgtgtacttaaacttggc

SEQ ID NO: 6835777 - DNA, 106 bp, Homo sapiens
gctggcagtggctctgggtccaggtctgtttgctggctccgttcctgacgctacaggtgggcagctcttggcaggcagttcaggatggtcctgtggtcagtgctgc

SEQ ID NO: 6835778 - DNA, 55 bp, Homo sapiens
tggatgaacagttttggagagatctgcaagacttcccagaagagatgatcatcca

SEQ ID NO: 6835779 - DNA, 63 bp, Homo sapiens
tgtaattggaatttagggaatattcatgattattatggagacttccctgatttccctttgaca

SEQ ID NO: 6835780 - DNA, 64 bp, Homo sapiens
ggtagggctgaatgcatctagggaggaaaggtacctcgcaggccccagaccattttgccttacc

SEQ ID NO: 6835781 - DNA, 64 bp, Homo sapiens
cgccttggaaatttgcaacctatgggctgaattcagctcacagaagtgttttttccacagggtg

SEQ ID NO: 6835782 - DNA, 59 bp, Homo sapiens
aaacaccagcactgtttacaaagagttgaccccaagaaatttaaacagtgttagtgttt

SEQ ID NO: 6835783 - DNA, 86 bp, Homo sapiens
caatataataatgttttgctgtagtgttctgatgtcaaataagaatgcattagagaattaaaggcacgtgacattattagtacttg

SEQ ID NO: 6835784 - DNA, 83 bp, Homo sapiens
ttttaccattgtttgtaattacctcttttgacagagaaaatgttctgagtaggagcaagttacgtctcccaatgaatgtgaaa

SEQ ID NO: 6835785 - DNA, 78 bp, Homo sapiens
atgacaggactgtggcaggctcagcactgctggcatccaaccttcagagcagggcactggcactcttcttcctgttat

SEQ ID NO: 6835786 - DNA, 55 bp, Homo sapiens
ttcttcaaccatctacataaacacatattaattgtgttggggattttttgaagaa

SEQ ID NO: 6835787 - DNA, 60 bp, Homo sapiens
ctgggaagaatccaagggccctcactccatctttaaagagcccaccctggcttttcccag

SEQ ID NO: 6835788 - DNA, 55 bp, Homo sapiens
ctcagtgggaggagtcagttgcctgtcaaacgtagagatgtctcctttcattgag

SEQ ID NO: 6835789 - DNA, 56 bp, Homo sapiens
ggtgagcctggagtcttgctggttatcaaatgttaggagtcactcagggcttcatc

SEQ ID NO: 6835790 - DNA, 77 bp, Homo sapiens
gggtgttttcagtaacatttcaaggtagaggaacatgttcatattcttcatcttgggtgtttttgaagttttaaccc

SEQ ID NO: 6835791 - DNA, 60 bp, Homo sapiens
gaatgcttaggctggttactgttccgcccacttagagaaggtaacaagcactctgcattc

SEQ ID NO: 6835792 - DNA, 59 bp, Homo sapiens
gctgaccttgtgatccacccaccttggcctcccaaagtgctgggattacaggcctgagc

SEQ ID NO: 6835793 - DNA, 57 bp, Homo sapiens
ttgaagtcccaacctccagtacatcggaatgtgactgtttggagataggatctttaa

SEQ ID NO: 6835794 - DNA, 83 bp, Homo sapiens
cctcttgtccttgcagaggtcatatctcagaagagacatcaaatttgcatttcccccagatatgacctttgagcgggtagagg

SEQ ID NO: 6835795 - DNA, 65 bp, Homo sapiens
ggcgggacggggcgtgcacagaattgcatactatccccttgctcagtgcacgggccagtcctgcc

SEQ ID NO: 6835796 - DNA, 93 bp, Homo sapiens
ctgtgtctgtcactgagggctcaggcgggccctgcaggcagataaggccatgggtctggctgcagccctcgcctagccacacatggacaacag

SEQ ID NO: 6835797 - DNA, 81 bp, Homo sapiens
agttttactattcttcctaatggtggtcatgtaaattatagctggacatatggccacagtctctggaaggatgtctgaact

SEQ ID NO: 6835798 - DNA, 64 bp, Homo sapiens
gacaaggtctggatgatgggtgtgctcattgctattgaggcgtcaccgctccccagacctcctc

SEQ ID NO: 6835799 - DNA, 82 bp, Homo sapiens
tttcctatttctaaacaccactcaggtttgtggtcagttttcgagatctagaaatctttcctgaagtgttttcaataggaga

SEQ ID NO: 6835800 - DNA, 61 bp, Homo sapiens
gtatgtctatttcaaatagctgcaagagagtgcagtacgtctatttcaaatagctgcatac

SEQ ID NO: 6835801 - DNA, 75 bp, Homo sapiens
gttcctcagaactcaagacttgacatctgggaggcagccgttcctcagaactcaagacttgacatctgggagagc

SEQ ID NO: 6835802 - DNA, 59 bp, Homo sapiens
tcccaagaggggttattatgccactggttctcatcgggggctaaaggccctctgtggga

SEQ ID NO: 6835803 - DNA, 77 bp, Homo sapiens
gcagcagcttttgcattctcattttgtttatttctggactggagagtagtaattaggatgcagataccagctgctgc

SEQ ID NO: 6835804 - DNA, 57 bp, Homo sapiens
tgaagaggccaaactatcattgaagtgggtgtcaatgagtgatagtttggcctttca

SEQ ID NO: 6835805 - DNA, 58 bp, Homo sapiens
tgaacagcacaatgataaggaatgacaatatgttttaccctttctggagtgctgttca

SEQ ID NO: 6835806 - DNA, 64 bp, Homo sapiens
ggtactggtcatagggcagcatggcgtgtgtctcacacccaaagcagttgatgtaccagatacc

SEQ ID NO: 6835807 - DNA, 79 bp, Homo sapiens
aggggctgaagggtttgctgagtatccccattaaaagcttcaagatttggggaaccttattcacgccatttatccacct

SEQ ID NO: 6835808 - DNA, 69 bp, Homo sapiens
cttcccatctggttctttgtatttccttcagtgactaagtgagaaattctatgggggccaggtgggagg

SEQ ID NO: 6835809 - DNA, 83 bp, Homo sapiens
ttcaaaagtagttttcaaagtcaatgagattgtttaaaagagtaggtacctgacagtctcttgcttgaatactatctagtgag

SEQ ID NO: 6835810 - DNA, 57 bp, Homo sapiens
agaaaggtgaaatggcttattcacattttcatagtaggctaggaatcaagcctttct

SEQ ID NO: 6835811 - DNA, 67 bp, Homo sapiens
gctgcttgttttcttcctaattgctcatttcttttaaatgccaattgcaggaagaaaactaaacagt

SEQ ID NO: 6835812 - DNA, 118 bp, Homo sapiens
gcaccccctctactgttacagcagtggttttcaactagaggtgattttgccccccaggtgacctttggcaaggcctgcagacatttttggttgtcacaactgatggggagggggatgt

SEQ ID NO: 6835813 - DNA, 73 bp, Homo sapiens
gcaatccaagttgtgctgaggatataaaactcagagcagagtgccttgagccttaatccattagccttggtgc

SEQ ID NO: 6835814 - DNA, 56 bp, Homo sapiens
gccacacctttctctagcctaggaattgataacccaggcgaggaagtcactgtggc

SEQ ID NO: 6835815 - DNA, 60 bp, Homo sapiens
ggctgagtgctgctccagaagtcatcaaccccttgacagtagttctggctcactcatgct

SEQ ID NO: 6835816 - DNA, 77 bp, Homo sapiens
ccactttgtcctgcatggctggctctgggtgtaagtgcagtgagtcacacctttcaggtagtggtgaggagagaggg

SEQ ID NO: 6835817 - DNA, 74 bp, Homo sapiens
ggcttccccaagcccacaaacgagcttagaatcaacagattcactgctgggtgattgggtttgaatggacagct

SEQ ID NO: 6835818 - DNA, 69 bp, Homo sapiens
tggttctgcaggctatacaagaagcatgatgccaacatctgcttctggtgaggcctcaggaagcttcca

SEQ ID NO: 6835819 - DNA, 68 bp, Homo sapiens
gcagtttacactatgaaaagactaactacacaggatttttgtttgtttgtttgtatgtgtgaatgtgt

SEQ ID NO: 6835820 - DNA, 111 bp, Homo sapiens
catttcacagtgctggttgaattatttgggctaggttgccacatggtgttccatgtacaattctccttggtaggctgggttaaaaaatgtggctaggtaaaatgtgagatg

SEQ ID NO: 6835821 - DNA, 60 bp, Homo sapiens
acatcacttactcagagatccgaggacaggagggagtctgaacttggctgatgggggtgt

SEQ ID NO: 6835822 - DNA, 62 bp, Homo sapiens
aattctgcttcatcagctctttgattaactggaaacatggttcatagaagagaggcaggatt

SEQ ID NO: 6835823 - DNA, 93 bp, Homo sapiens
tggagaggtatcatgctcagcactttgaagcagaaggatgtctatcttattcacctgtctttaatagtgcctgggacacagctggtgactcca

SEQ ID NO: 6835824 - DNA, 59 bp, Homo sapiens
acccaggaggcagaggttgcagtgagccaagattgcaccactgcaacgccagcctgggt

SEQ ID NO: 6835825 - DNA, 55 bp, Homo sapiens
ccaaggctggagtgtaatggcatgatctcagctcactgcaaactccacctcctgg

SEQ ID NO: 6835826 - DNA, 63 bp, Homo sapiens
ggagacacagctgagctcccaggccatcatgggtgacagggtcagagctgagctgctccctcc

SEQ ID NO: 6835827 - DNA, 115 bp, Homo sapiens
tcagaacctgatttagaaaaataagggtctgtattagcttcctacaactgctgcaatagattgccacaaactgggaggctaaaagcaacaggaatttattcttttgtagttctga

SEQ ID NO: 6835828 - DNA, 82 bp, Homo sapiens
gttggtggggattggggagagctaatattttatagtctttctgtagaatatgattaattttcttaaaaaaaaccccaaaaac

SEQ ID NO: 6835829 - DNA, 78 bp, Homo sapiens
gctttctcttttccctttagtttctgggctcttttccggatgatccgtgtgctaggaagctggggagaagtcggaagc

SEQ ID NO: 6835830 - DNA, 56 bp, Homo sapiens
tgtgacttgatgtttgcaccagaatgaggccagaatggtgttgacatcaagttata

SEQ ID NO: 6835831 - DNA, 78 bp, Homo sapiens
ggggcagtaggtggcactcaaccttttattagcagaaaattgttagtttcaaattagagtgttcaacactgcttccct

SEQ ID NO: 6835832 - DNA, 78 bp, Homo sapiens
tctaggaaacaccaggctttggtacccatggagtcaggtgtcaccctggggaccgagcaagctctggaacattctgga

SEQ ID NO: 6835833 - DNA, 86 bp, Homo sapiens
atccagtccctaccataaagcaggcaaatgagaaactacaaatcctgtggagctcttttcaaacctgtttatggagaatattggat

SEQ ID NO: 6835834 - DNA, 75 bp, Homo sapiens
gtaactggtgagataaattatttaatccttaatttctgatgatttaatagatgatctgtttcatgccatagttac

SEQ ID NO: 6835835 - DNA, 62 bp, Homo sapiens
aggaagccacgagtggcacgggtctgctgtttttgaaggagatggtgcagtcctggtttcct

SEQ ID NO: 6835836 - DNA, 85 bp, Homo sapiens
attccccttattgtcccaataggattgtcaacagctcccagggcctgcatgttttcttaattgtgattagtaagtaagagggagt

SEQ ID NO: 6835837 - DNA, 66 bp, Homo sapiens
aagagttttctataatcttggcaagacttataatccttgtccttcagagaattgtgaaaatctctt

SEQ ID NO: 6835838 - DNA, 130 bp, Homo sapiens
tgagcttgagctagaacttggtgagaggtggtggggatcagtctcagaggcacccagaacttgctcctctctggactggaatgctgatcctctctcaccacctccccacgcccaaggactgtcagcatca

SEQ ID NO: 6835839 - DNA, 57 bp, Homo sapiens
ttgctcactttgactatttgcagattacaaattatttgaggtcaaagaagtgagtgg

SEQ ID NO: 6835840 - DNA, 78 bp, Homo sapiens
atcatttttctgaccctttgcttcctcattgttacaataaggataacaaggctgagcagggtgagtgaaataaatgat

SEQ ID NO: 6835841 - DNA, 129 bp, Homo sapiens
ggcctgccctgaggtcacagcccttgtgcccagctcctagagccagaggaggctggggtcagtagggcctgtgaatgatgccacctcctaggcctggagaagccagggcaggggatggacatggaggcc

SEQ ID NO: 6835842 - DNA, 78 bp, Homo sapiens
taaactggaatccttaggaaagcattgtgtaaaagcatggatgcatatattttttgttattctatgataagcagttta

SEQ ID NO: 6835843 - DNA, 58 bp, Homo sapiens
ctctgagcccgctgcagccccaggtccttggggcaggggtagccaggcgtgctcagag

SEQ ID NO: 6835844 - DNA, 55 bp, Homo sapiens
gctattggtttattgtgtatgagacagaaaactgtttctgagatagactaatagc

SEQ ID NO: 6835845 - DNA, 83 bp, Homo sapiens
tatggtcttctgatgagtcttctgcctaaagaagtaggactacacagctaatttttctaggaagaatttcttggccagccatg

SEQ ID NO: 6835846 - DNA, 90 bp, Homo sapiens
cagcctcctccatgagggacagaccttatttctctattaatataaggaaaatagagcacaaattagttggtcttttagagaaacaggctg

SEQ ID NO: 6835847 - DNA, 68 bp, Homo sapiens
gagtgtctgtattttgggcaagagaaggatcccattgatccaaccacttgccagagggcttgacattt

SEQ ID NO: 6835848 - DNA, 56 bp, Homo sapiens
gtggtccaaggagtttccagcactcagctgcagagggaagcttccttggtgatcac

SEQ ID NO: 6835849 - DNA, 55 bp, Homo sapiens
cactctgcaggccaaaccaaagatgtctgttggcccaatctggcttgcagagctg

SEQ ID NO: 6835850 - DNA, 80 bp, Homo sapiens
gtatctcatatagtatgataggctagacattgtttagatttgtggattgacaggtgtggggctgtggtactcgtgtgtgc

SEQ ID NO: 6835851 - DNA, 63 bp, Homo sapiens
gtctgacttttcagtaggagaaaggaagctgatgaggaatccagttctcctttgaacagtgac

SEQ ID NO: 6835852 - DNA, 82 bp, Homo sapiens
ctggaaaccaggcagttaagaggatgacaggctttaaaaggtcatttttgaataaagaattgtctgtgtgcagtgtttctag

SEQ ID NO: 6835853 - DNA, 60 bp, Homo sapiens
gctccgctattttgtctatgctgtggtggccccagggcagtggcatgtgggtagtggtgc

SEQ ID NO: 6835854 - DNA, 82 bp, Homo sapiens
gttaagaccatcacagagacacttgcatagcagagtttagttaattccatgaagaatcagtgtgtttcatgtaggtcctaat

SEQ ID NO: 6835855 - DNA, 78 bp, Homo sapiens
ggacctgctcgctgtccgctcgggtgcagagggcagaccccggtctctcctccacaccgggtgctggcgggcgggtcc

SEQ ID NO: 6835856 - DNA, 62 bp, Homo sapiens
gccactggcgctgtgcagagtgtgagctggaaacatcgtagttactttgtcagcttagtggt

SEQ ID NO: 6835857 - DNA, 63 bp, Homo sapiens
agcgaagcttaagaggctgtattcttgcttaagcacgcacagcttgaatcttaagctcttgct

SEQ ID NO: 6835858 - DNA, 61 bp, Homo sapiens
aggaaagtcttgtgtagatgtctcttcaaagaatgagaagacttctccaacaagcttggct

SEQ ID NO: 6835859 - DNA, 57 bp, Homo sapiens
ctggctctgctgaacctagtgcaaagcctcttctggataggactcacgcagagctgg

SEQ ID NO: 6835860 - DNA, 94 bp, Homo sapiens
aaaacaatgatgaaagaacatgctataattatctttatgaggctatcacatcccacttaagataggaaagtatgtgtttttcgtttactgtttt

SEQ ID NO: 6835861 - DNA, 57 bp, Homo sapiens
caggtctcccaagggccagggagcaggaaaatctctcagctgcttttgggaggcctg

SEQ ID NO: 6835862 - DNA, 82 bp, Homo sapiens
ggggcagccgtgtggcggggagccggccgggccttcctgctcatcgaggacctgactggctcctgcttcgagccactgcccc

SEQ ID NO: 6835863 - DNA, 85 bp, Homo sapiens
taagaagtgcctaagtttttcagttctgtacaagtccagagagcaaacttatttgtggctgtcgagaattgagggtctcttcttg

SEQ ID NO: 6835864 - DNA, 78 bp, Homo sapiens
ggattcttgtgcctctgggtgacgaaaggtgaagggattgtacgcttcgcccacgccagcctggggctcgggatctcc

SEQ ID NO: 6835865 - DNA, 61 bp, Homo sapiens
gagcagcatctccggcttaaagggaaactctctaagttccgggcagccgggagagtcgttc

SEQ ID NO: 6835866 - DNA, 55 bp, Homo sapiens
tgatctgtatagggactagccatgcagctgaggtgggctggggcctgaccagaca

SEQ ID NO: 6835867 - DNA, 92 bp, Homo sapiens
ggagaatcgcttgaacccaggaggcagaggttgcagtgagccgagatcccaccactgcactctgttcagcctgggtgacaaaacgagactct

SEQ ID NO: 6835868 - DNA, 67 bp, Homo sapiens
gtcgaggttggactggtttgccaccgacagatgacttatcttcagagtaagctactcttttctagac

SEQ ID NO: 6835869 - DNA, 63 bp, Homo sapiens
cattgcttcctcacagcttcctatgtacaaatactgggcatttgggagtctggatgaaagatg

SEQ ID NO: 6835870 - DNA, 82 bp, Homo sapiens
ctctaatactagaacaattctgaggcctgctttgttagcatcaatcagcaagcagagcaaagctcagaaatgctggacagag

SEQ ID NO: 6835871 - DNA, 74 bp, Homo sapiens
cccaccagtgatgtggagcatcagatggcaataaggacgacctgaaatatgctcccattcacttggcattaggg

SEQ ID NO: 6835872 - DNA, 87 bp, Homo sapiens
tgagatcatctagtccagtttttcaatcagggtagtggtcctctctacaatatctcagacagaaagacgtttctgtgatgatactca

SEQ ID NO: 6835873 - DNA, 57 bp, Homo sapiens
ctagaattcataggaagtttcctagggatagctcaatcctttaggaaggtgaactag

SEQ ID NO: 6835874 - DNA, 58 bp, Homo sapiens
ggcgggaggcttgtggtgtaagagcggtgcactgtgcatccactagggctctcccgtc

SEQ ID NO: 6835875 - DNA, 55 bp, Homo sapiens
tcggcctgtgggcactgagcatacagtaggtgctcagtaaatgcttgcaggccga

SEQ ID NO: 6835876 - DNA, 120 bp, Homo sapiens
ggctgctgtggaaaccttaagagactgcgccccctggtgtcagaacgctgtcattgcagcatgggacttccagcctggggaggcagcttctcacctgcagacgagggctccaccctagcc

SEQ ID NO: 6835877 - DNA, 60 bp, Homo sapiens
ccactgtgcatttgaagggatcatttagtggaaaatgttcccagtggaaaatgttcaggg

SEQ ID NO: 6835878 - DNA, 129 bp, Homo sapiens
ttagatgccgtttcatatgtttgcttttcattaaatgcaggaatggttgggactatgttgctgtgattcagtcaacatttattcctatctgtttttcatgtacaaaggctgagggatgccagcaaataa

SEQ ID NO: 6835879 - DNA, 55 bp, Homo sapiens
ctcctggcactgtcttgacccacagccttctctgggatgaggactaagccagaag

SEQ ID NO: 6835880 - DNA, 80 bp, Homo sapiens
tcccttttctatcttagcaggttatcttttgtaatcactgattactgtgattactgtctacttgggatagaaggcaggga

SEQ ID NO: 6835881 - DNA, 112 bp, Homo sapiens
ttacatccgtctcccagggttgcagggctgataaattacccagcatctggcccaccccagagcctgtgattgtcatcaccccagacagcccccgaggaggacaggtaagtaa

SEQ ID NO: 6835882 - DNA, 65 bp, Homo sapiens
tttagatctctcatgtctggagagtgattagactagaattacaacctagaactgagaaatttaaa

SEQ ID NO: 6835883 - DNA, 61 bp, Homo sapiens
caggaggagccagcgcccttcagtggaacaagctatcttaggaagggagggctcttacctg

SEQ ID NO: 6835884 - DNA, 63 bp, Homo sapiens
gccaaaacatcaggtttctttatgctgctagaagtcagatagacttagtgtagaaaccttggt

SEQ ID NO: 6835885 - DNA, 63 bp, Homo sapiens
tatgcaaggttgggtaacagcaggtcctgacctgtaggactggctggcagaaactgaagcatg

SEQ ID NO: 6835886 - DNA, 55 bp, Homo sapiens
ttgcatattcatgtcggctgaaaaagcagttaaatgctggctgaactgaaagcaa

SEQ ID NO: 6835887 - DNA, 99 bp, Homo sapiens
aaactgccgtcttaacggtgttgcttttactgataataatgctatcttttaaaccaaagaagacatcagtgatgacatttgactttaacatggcagttt

SEQ ID NO: 6835888 - DNA, 68 bp, Homo sapiens
tagcagagagattctaaaccaggtctgactttccaatttcaacatctgtgtttgaatctcaaatgtta

SEQ ID NO: 6835889 - DNA, 78 bp, Homo sapiens
gttatagtaatacagtagcttttacacaggaactcaaactttctgttgtgaatttagttaccaatgtattactgtggc

SEQ ID NO: 6835890 - DNA, 124 bp, Homo sapiens
cgcaaattgaaagtagaatcagggtcatctcagttctactttggaggaaaattgaggtcatggtcagattaagcaatgactttttaaatttttttctaaatcagtggctcctgattcttttgtg

SEQ ID NO: 6835891 - DNA, 57 bp, Homo sapiens
cgagatttccaggacgggaggtgggatctgaaccctccacggtccccctggagtccg

SEQ ID NO: 6835892 - DNA, 126 bp, Homo sapiens
gtctgttggattttgctcagagctgccttatgcacttgggatttcagatgctgtgcaataaaactttgccagtttcccaggaatgcattataggagagccagcctacttaagggcgaagtctggat

SEQ ID NO: 6835893 - DNA, 73 bp, Homo sapiens
tgaagtggttggtaattgtgcacagtctaaaccaatacaagctggattgtataattgtattgccaaatcttca

SEQ ID NO: 6835894 - DNA, 91 bp, Homo sapiens
gcaagtcctggtggtgttcctagagatgcaatttgatttgatcaaggactaggtcaaaccacagctctaggcgtggcctccaggggtttgt

SEQ ID NO: 6835895 - DNA, 82 bp, Homo sapiens
gtgttaccatttgattttgccagagacctagtaagaatgtccatgttctcttgctttacatgttctggtaaattggtaatgc

SEQ ID NO: 6835896 - DNA, 122 bp, Homo sapiens
tgcagcctgtttgcaggaatctctgggaaagctatagggtcaagcatttgattcacaaatatttatcaagcgtctaccctttgcgctgttcttcagataagtgattctcaaattttgctgca

SEQ ID NO: 6835897 - DNA, 73 bp, Homo sapiens
gcatctgtgtgccccacaaacatgtatgcaacacccaccatgtctacaagccttgttcggcacctagagatgc

SEQ ID NO: 6835898 - DNA, 72 bp, Homo sapiens
ccaggttgaacccccaagacctatgcctcacccccgacccaggcagcaggaactcagggagttctcacctgg

SEQ ID NO: 6835899 - DNA, 92 bp, Homo sapiens
gtcagtacaatgtaaaattcagttcctcagccacattacaggtacacaattgccacatgtggctagggaataaaatattgcacagtgtagat

SEQ ID NO: 6835900 - DNA, 84 bp, Homo sapiens
acctggaagctggttagaaaacagagctcaggtgccaccccagatctactgagtccgaatctgtattttaaccaggtcccaggt

SEQ ID NO: 6835901 - DNA, 68 bp, Homo sapiens
tgtctgaggtcattagctctcttcaggatatttacaggactgaatgaggtgaggaaggcctcagcaca

SEQ ID NO: 6835902 - DNA, 63 bp, Homo sapiens
accaaaatgctaaatgcagcaagtagtctctggtctccatcttatttgatttggcactttggt

SEQ ID NO: 6835903 - DNA, 130 bp, Homo sapiens
tcttataaagttgtgtaaaacatggttcttttctcaaaatgcttccagattggtaggggtgtcaaacatgttcattcctattatggggtagaaaccagtaagtgaatcaagggttacggaaattcagaga

SEQ ID NO: 6835904 - DNA, 59 bp, Homo sapiens
ggccatgtggtagtgcttaaccttcagagaaaaggtggttgcaattaccataatcggcc

SEQ ID NO: 6835905 - DNA, 77 bp, Homo sapiens
gtgagaaccaaccagctcctcaccccattgtgctctgtagactagctgggacagggcgggggttgggggtgtctcac

SEQ ID NO: 6835906 - DNA, 96 bp, Homo sapiens
agggtagtttccattacctattgttacttcttggtaaaggagacaaagatgtcatccatgaagagtgacagaaggttcttagggaactgggcacct

SEQ ID NO: 6835907 - DNA, 129 bp, Homo sapiens
cactacactgcaccaccttgtgcgtaggggcagatctgggtcctctcccaagagcgcatcgtgatccatggtgtctctggagggacccgtttgcagcttctcagacacgtgcaaaaggcaggtgcttgg

SEQ ID NO: 6835908 - DNA, 71 bp, Homo sapiens
tactgtttgcagtttgcagtattatcatcatccccattaaacagatgagaaaactgaggcttcaagcagtg

SEQ ID NO: 6835909 - DNA, 72 bp, Homo sapiens
tcagagcacagaaagtattgactgaatatatattttaaaataatttgttaactttcatgtgctatagactga

SEQ ID NO: 6835910 - DNA, 74 bp, Homo sapiens
actggtccagacgtcttagattctctaggggcggccagcctggcctctacccaggagactgagctgtaaccagt

SEQ ID NO: 6835911 - DNA, 61 bp, Homo sapiens
atgacactgtcctagtaaggaagtggaactcagtaggggacactgctgcgacagctgttat

SEQ ID NO: 6835912 - DNA, 60 bp, Homo sapiens
ccagtcaggaatgcctccttccttctggggaactgggggtcagtgagttcgtttctctgg

SEQ ID NO: 6835913 - DNA, 74 bp, Homo sapiens
gtgcctatcttcatgtttgtacagagttagcacttaataaaggctaattcttgataacataacaggtatggcat

SEQ ID NO: 6835914 - DNA, 94 bp, Homo sapiens
ggctctcacggctccaggagatgtggggtgtggggtatccagaggctgagcagctgaccttcacctccacaccttgggagaagtgctgggagct

SEQ ID NO: 6835915 - DNA, 59 bp, Homo sapiens
attaaaatagaattggaagcagagttaggaaatttctaatctgtcagttttgtgttaat

SEQ ID NO: 6835916 - DNA, 55 bp, Homo sapiens
ccaggacaagccagagggacaggacaaaccaagggtccacaggggtttgtcctgg

SEQ ID NO: 6835917 - DNA, 57 bp, Homo sapiens
aagtttactgattcttctgtcagctcaaatctgctgttgaagtcctctagtaaattt

SEQ ID NO: 6835918 - DNA, 57 bp, Homo sapiens
gtctgaacagttaagagtttgaactagataatttctatgttcaaacactgattcagc

SEQ ID NO: 6835919 - DNA, 96 bp, Homo sapiens
tgtttagtgctcggctcttagttgagatcaagtattctccactaagaggaatcaattctttggagaaatggctgatcaaaaagctgagactagaca

SEQ ID NO: 6835920 - DNA, 88 bp, Homo sapiens
atcttcagggagttacaatccagggtgtggcctttccacaacacgtatgtgagtgcaaactgcccactactgggaaactcctgagggt

SEQ ID NO: 6835921 - DNA, 57 bp, Homo sapiens
tgtcgaacagcctcatggactaaagcaaaggttagcaaggacaggggttttcagaca

SEQ ID NO: 6835922 - DNA, 94 bp, Homo sapiens
ttgtttagaacaatgccaacagcatgctgggtaacattgtagactcttccaggtttgccatggtagcacttgtggggcattcctttttgaacag

SEQ ID NO: 6835923 - DNA, 66 bp, Homo sapiens
aaatgtgacagcttaattagtgggataaatagaaaatatggtgccacttcttaggctggtacattt

SEQ ID NO: 6835924 - DNA, 59 bp, Homo sapiens
gcttcattttgccctctggtggaaaacgaagttctaaagttccattaggcaaaaaaagc

SEQ ID NO: 6835925 - DNA, 64 bp, Homo sapiens
tgccatggagtattatctgtcatgtactgtaggctaactagagaaacagatagactccaaagca

SEQ ID NO: 6835926 - DNA, 129 bp, Homo sapiens
tggtaaacattcagggaaaagtttattactgacatgtgagagctcggttttcaaggttaataaaataaagttgacagaagtcgtgatgcctcacatgactcagacccatttctcctttccttcgtagca

SEQ ID NO: 6835927 - DNA, 65 bp, Homo sapiens
cctctattgggataatctgtgcctgggggacccactgcctcccaggctgcgtatccacaataagg

SEQ ID NO: 6835928 - DNA, 87 bp, Homo sapiens
gcttgaggcagtagctctaggacatgaatgttatactttattaaattctgaaaataatgatactagttatgttgaagttactgaagc

SEQ ID NO: 6835929 - DNA, 55 bp, Homo sapiens
ctcaggagacagtgtccacatggttttcagagtccatagtggcattattcctaag

SEQ ID NO: 6835930 - DNA, 129 bp, Homo sapiens
attttctgtctctatggatttgcctatttgggacatttcatataaatggaattatgcaatatatggtcttttgttattccattatttcacttaggataatgtttccaaggtttacccatgttgcagcat

SEQ ID NO: 6835931 - DNA, 56 bp, Homo sapiens
gaggcttgtgtggatggtcaggacaagggttcctgtccagggtgtgcaggggcttc

SEQ ID NO: 6835932 - DNA, 56 bp, Homo sapiens
ctttattgtccttcttaggtggggttgggctcagccagtagatcgggaggatgtag

SEQ ID NO: 6835933 - DNA, 64 bp, Homo sapiens
gttgacattccattgttaatgatccagagaaagttcctctggatttcaaggatggattgaaaac

SEQ ID NO: 6835934 - DNA, 88 bp, Homo sapiens
ggatgacctgcttttcttttctacagaggaggtggttgggagtggtttcttcatttgtgagatgcttcctttggtaaagtggttgttc

SEQ ID NO: 6835935 - DNA, 61 bp, Homo sapiens
gagaagccccgtgtgctttctcatttctcagaggagtaagctgaggcagaggggcattctc

SEQ ID NO: 6835936 - DNA, 59 bp, Homo sapiens
gagccagggtttgaaactagacagatcagctctagagactgctctttcagccttggctc

SEQ ID NO: 6835937 - DNA, 109 bp, Homo sapiens
ttgttcaattccaggttacgtgtataatggattcagaaccgtcaacccgtattcagagtacatgtatagttgtttctgaactgttatcaggtatacctgtgagaaacag

SEQ ID NO: 6835938 - DNA, 74 bp, Homo sapiens
ttatccagtaccagagtccttcccaattgcaaaatgttttatagacaggtggcagagggctcgtggatggataa

SEQ ID NO: 6835939 - DNA, 71 bp, Homo sapiens
atttggacctcttccattgaataggctgtgcaacctccttggatgccaggctaagtggaggacttccgggt

SEQ ID NO: 6835940 - DNA, 86 bp, Homo sapiens
ttgcagttggtgctgatctaaatttaggacatcttgatatgtggcctacaaaaagtttagattaaatcatttccaatattttgcag

SEQ ID NO: 6835941 - DNA, 55 bp, Homo sapiens
gggagcaccgctcagacccttgggccatggcttcaccataggtccgtgtgctcct

SEQ ID NO: 6835942 - DNA, 82 bp, Homo sapiens
ggttccaagtctttgctactgtgaatagtgccgcaataaacatacgtgtgcatgtgtctttatagcagcatgatttataatc

SEQ ID NO: 6835943 - DNA, 130 bp, Homo sapiens
gggatgggactgtgagggaggagggcctcaggttctggagaagggccaggtatttccatgtcaaccctgctttttataaccagagagaacatatgaggtagcaccaatgacctccgccaccaatccttcc

SEQ ID NO: 6835944 - DNA, 74 bp, Homo sapiens
ttaggcctggaactttaggatcctggctcattctctatgggggtgagtgagtgtgtgaagtactggatgcctaa

SEQ ID NO: 6835945 - DNA, 77 bp, Homo sapiens
cagagagagagaggcagaaagagagagagagagtaatatatatagttctgttggttctgtttctctgaagaactctg

SEQ ID NO: 6835946 - DNA, 88 bp, Homo sapiens
agagagagtagatttttacttacagacagtagactctgccacagccaggtatcagttgtgtgatatgagtgactaatttaatctctct

SEQ ID NO: 6835947 - DNA, 70 bp, Homo sapiens
ttagctaaaccacagagattctgagtcaccgaccaagaggttgggtttgggaatctgtgtttttatctag

SEQ ID NO: 6835948 - DNA, 59 bp, Homo sapiens
tggaagcttcctgaatgctcatttactaaggagtagatgagtgaattatggggcatcca

SEQ ID NO: 6835949 - DNA, 57 bp, Homo sapiens
tctgatattttgtgaaaattttcctgtaatttgcaggtgatttctacaaatgtcaga

SEQ ID NO: 6835950 - DNA, 58 bp, Homo sapiens
ctaacaatgaaaaaggagctggtggacaaatatgcctgcttccttgcttcattgctgg

SEQ ID NO: 6835951 - DNA, 83 bp, Homo sapiens
tgcttaggaaagaaaggatttaatatcatgtatatatatttgtggtgtgtgtacgtgtataaattcacaacaatctgtatgca

SEQ ID NO: 6835952 - DNA, 61 bp, Homo sapiens
cactgcttgcagtatgagtggaagtttaaacaaggtttcttgtattcataagtgaacagtg

SEQ ID NO: 6835953 - DNA, 91 bp, Homo sapiens
aaactgcacgttcccagcgctttcctccccgcccctttcctgggttttctgtttactgggatgtggagaggaagtgcaaactctgtagttt

SEQ ID NO: 6835954 - DNA, 87 bp, Homo sapiens
cttaagccataatgcatggttttaaggtcactgccggttattatctgaccagtaatgaccacaaaactatacattattgctattagg

SEQ ID NO: 6835955 - DNA, 58 bp, Homo sapiens
gcgcaggtgtcttcagcaggatgagtggaggaccactcagctctacacacacctgtgt

SEQ ID NO: 6835956 - DNA, 61 bp, Homo sapiens
gagcatgtgggggcagtggagttagctaggcctgaaagcctgcagctgccacgccctgctc

SEQ ID NO: 6835957 - DNA, 97 bp, Homo sapiens
caggtggcggggggtgagggggggatgggtaatctgcttaagcaattattttgttttgaagaagctgacctatttttacctcctctatgcaaatctg

SEQ ID NO: 6835958 - DNA, 64 bp, Homo sapiens
cagtgttgtctgatattttagcagtagggacattttcatagcagttggaggtacagagacactg

SEQ ID NO: 6835959 - DNA, 92 bp, Homo sapiens
gctctataacaaatttccttgaaactctgtagctaaacataatgatcatgtcattgtcttttaattttatgggtcagaaatttgggcagagc

SEQ ID NO: 6835960 - DNA, 90 bp, Homo sapiens
ggctagtttaatggagaagggcatggtagttttaaagtttctgttgcttgaattgctgaagctgagtgttcctctgcgtgtgtgctagtt

SEQ ID NO: 6835961 - DNA, 121 bp, Homo sapiens
tctgtttgcaaatatcaatcactttccaaactattatataagtgatctcttacaatttaaatacagttgtaagagatcacttatgtaatagtttggaaggtgattgatatttgcaaacaga

SEQ ID NO: 6835962 - DNA, 113 bp, Homo sapiens
tgccaatgctcctggatcagaggagagactcctgcccacgtgctacttctgagagccagcggctaccacagaggcagtgggctggagccctctgcaaggccgaggggaaggca

SEQ ID NO: 6835963 - DNA, 58 bp, Homo sapiens
gaggcagctgggtccggtcgggagctttcccgttaccttcgccatgacccagccgtcc

SEQ ID NO: 6835964 - DNA, 63 bp, Homo sapiens
ctaaaggctcagcattcttttctgctcattcatttacatttgcaaagtctcctgagcctttag

SEQ ID NO: 6835965 - DNA, 62 bp, Homo sapiens
ctgcaaggacccaaatcttgttctttcaaataggtatcaaagaatagacctgggttcttcag

SEQ ID NO: 6835966 - DNA, 96 bp, Homo sapiens
agttagtgagacttgtgttgaaagaagtagttttatgtgtctaaaatgtagactcatagacaagcctcttttaaaccaaatgtgcatacactaatt

SEQ ID NO: 6835967 - DNA, 60 bp, Homo sapiens
ttgtaagtcacaccagggcaggaagtagaatagagatttgagcccaagtgtacctgacaa

SEQ ID NO: 6835968 - DNA, 130 bp, Homo sapiens
tctcagccccatctgtccatcagagtcacagcagacccctcaccaggctccaccctacagagctcccagatcggatccctgctgggtgggcctgctgggtgtgtattctgatgctcagtgggagttgagg

SEQ ID NO: 6835969 - DNA, 61 bp, Homo sapiens
gcagagagtagaagggtgattgccagggtcttgtggggggacaatcaagtttcacttatgc

SEQ ID NO: 6835970 - DNA, 69 bp, Homo sapiens
taggagggccctgaaaatggcagagacctcaattctcccctccctccctgcccctttatgggctcccta

SEQ ID NO: 6835971 - DNA, 105 bp, Homo sapiens
tcatgccctcaattttgatcttcatgattttgtcttgtgttaataattgataaggaatagttaataaaggtatagaatcagggaagtcatcaaaacggattatga

SEQ ID NO: 6835972 - DNA, 66 bp, Homo sapiens
cagcacataatcagtgattgtgactccagtccaggtccactcaatacccacttatcatatgtgctg

SEQ ID NO: 6835973 - DNA, 75 bp, Homo sapiens
agctgcctgaggaagttgatctcatcagtcagaccttccaggcgagactccagctctaacttgttcaggtaagct

SEQ ID NO: 6835974 - DNA, 87 bp, Homo sapiens
ggtagtggacatcaacagttctgtccaattaatccttggaagcacagtcagaattaattgggaacttgttgaaagttgatcgacacc

SEQ ID NO: 6835975 - DNA, 77 bp, Homo sapiens
ggggtagcccatgtggctgaggcttctagacacatttcacctctcatgggtcagagacagacacatcgggctgctct

SEQ ID NO: 6835976 - DNA, 77 bp, Homo sapiens
tgtgtgtaatggacagcttgcagagccaccctcctggtgtgccttgaagggaggcattctcagtctccatccatgca

SEQ ID NO: 6835977 - DNA, 63 bp, Homo sapiens
cagaaagacctgattggcagtttcactgagagttgcgtcatctgggctgtcgacaggtgtctg

SEQ ID NO: 6835978 - DNA, 78 bp, Homo sapiens
cccagaaaatttaatgacttacctgtgatttcagaccgagacacacagaaatgcaggtatattttattaaagtttggg

SEQ ID NO: 6835979 - DNA, 68 bp, Homo sapiens
gtctccatgtgccttgcagagaggcagagggattcacattccaactccctgtggggtactggggaggc

SEQ ID NO: 6835980 - DNA, 63 bp, Homo sapiens
ccagtaggaatgtggcaggcagaacaatcatgtccccaaagatgttcctgccccaatccttgg

SEQ ID NO: 6835981 - DNA, 82 bp, Homo sapiens
aaactttgataacagacttttccatcatcccccttaaccatttatctgttttgagggtcaaggaaaagttatgttaaggttt

SEQ ID NO: 6835982 - DNA, 65 bp, Homo sapiens
gtctctccagccaggggcttcctgaaagagctgccttctgagcaggccccccaggctaggaagat

SEQ ID NO: 6835983 - DNA, 74 bp, Homo sapiens
cgactcccggcatgcagtgctttgcgccgggcacgctctgcgcctgcgtgctgcgcgctgcccgctggggctcg

SEQ ID NO: 6835984 - DNA, 89 bp, Homo sapiens
cggcttgggctgagctgggtatatggctttatgctgcggcgaatgctgggagcctttagctgaggctgtggactcagtttggccatctg

SEQ ID NO: 6835985 - DNA, 78 bp, Homo sapiens
atttctagactaacagtctccgcttgaaaccctgaaatttaccaatttgggttttaaagtagattattagctagaagt

SEQ ID NO: 6835986 - DNA, 72 bp, Homo sapiens
ctcccttgacattcttaataattttatccttgaacttgtgttttataagtgaagtcctaggggacaagggag

SEQ ID NO: 6835987 - DNA, 59 bp, Homo sapiens
gggaggctgaggtgtggggaactatagctcttgggctgttcctgatgcctcgtcctgtc

SEQ ID NO: 6835988 - DNA, 60 bp, Homo sapiens
tgaatttttcctgtgcttaacaaatattctgtagtgatatggagcagcaggagagatgca

SEQ ID NO: 6835989 - DNA, 109 bp, Homo sapiens
tagccacgggatgggggcatgggaagggaggggtctctagcgaggagactgtctcttgtctatcctgagagcctcttctccccttctacccaccatgaatcctgggcta

SEQ ID NO: 6835990 - DNA, 58 bp, Homo sapiens
gtggggccacacatctctttctaactccttgttgagtagtatcatgttgtggcttgac

SEQ ID NO: 6835991 - DNA, 68 bp, Homo sapiens
ttacatttacctcgtaatatatgtatatatatatattaggagttaaatgtattaggaggtaaatgtaa

SEQ ID NO: 6835992 - DNA, 80 bp, Homo sapiens
tgtgcagtgctaggctctgcaggacactttgttgggggtgaaatttcaagcagggatactgcagggagggatctgctaca

SEQ ID NO: 6835993 - DNA, 65 bp, Homo sapiens
cctggaagaatctctactcaagtacttgttggaagttctttgggtggagtaggggttttaacagg

SEQ ID NO: 6835994 - DNA, 119 bp, Homo sapiens
gaaaacctagctactatttgcataatccttatattttaggaacagacaataatggttctaaagttgttgctctgtgtatgagacgatacatggttattcactgcaatagctgggatttc

SEQ ID NO: 6835995 - DNA, 59 bp, Homo sapiens
ctggctctgcagagggcccagctttgccagccacatggcgaggctgtctgcaagaccgg

SEQ ID NO: 6835996 - DNA, 61 bp, Homo sapiens
gctcctggtgctgtagagatttccggcgcacagaggcccccattccctgccaccaggaagc

SEQ ID NO: 6835997 - DNA, 91 bp, Homo sapiens
aagagtggggagaggaatttgaatgattgggtagttttcattatatagtagccttttaaaaaatcctttaactttcttctttttttctctt

SEQ ID NO: 6835998 - DNA, 60 bp, Homo sapiens
tccttgcagcaggtgatattaattgcatataacatgcatgatactacaagttgtagttga

SEQ ID NO: 6835999 - DNA, 61 bp, Homo sapiens
ggtgcccagctaccattcagtgacttccattagtaaaagtaagaaggggaaggtgggtacc

SEQ ID NO: 6836000 - DNA, 71 bp, Homo sapiens
ctctatgactgagcagcacagggcgccaggggatgtttgtctgcactgctgctgtgttgctgacttatgag

SEQ ID NO: 6836001 - DNA, 77 bp, Homo sapiens
agtagacggggacgtgggctgctttaatagaggcagagtgccccatctggggagggagccacaggtccccgccgact

SEQ ID NO: 6836002 - DNA, 117 bp, Homo sapiens
ggaggggctgcttctgctggtagacaaagttcagggagatttggggactcaaagttctcagctttgtcttgtctgcccaatgtccttatctcctgtcttacagctctgcttctttcc

SEQ ID NO: 6836003 - DNA, 71 bp, Homo sapiens
gtaacttcagtcagacgtcagcctgcatcgtatcgcgtgtgcacaggtggcctgtgttttgtctgaagtac

SEQ ID NO: 6836004 - DNA, 79 bp, Homo sapiens
tttgtatggtgcttttaacttttgaaaggatttttctttatatatccttgatctgaagaggttagaaggatagggcaga

SEQ ID NO: 6836005 - DNA, 76 bp, Homo sapiens
tccccttagttctggccaaggctgccagattagcacggtgagtgtgagtgtggggttgtggccagcatggggagga

SEQ ID NO: 6836006 - DNA, 59 bp, Homo sapiens
ggccatgttcaatgaatcaggctgttgtgcagagcagcctgtgtgctttggacagggct

SEQ ID NO: 6836007 - DNA, 130 bp, Homo sapiens
ttactcagcctccatgatctcttgttaagacccagatgcacacacattatgtctgtgaattcacaaagacgcgagacagctggtggttatcggtttagtcgattaatatagagagaatggtaatgaatga

SEQ ID NO: 6836008 - DNA, 72 bp, Homo sapiens
cccagcccctcaggtacccgtgcagcaggtcccgagtcccacctgtctgtcccctgccttgaggggaacggg

SEQ ID NO: 6836009 - DNA, 83 bp, Homo sapiens
gaggtggggaagggcctgaaaccttcagggctttggaagctggagacaaagaccatgacagggtttcagggcctgggcatgtc

SEQ ID NO: 6836010 - DNA, 83 bp, Homo sapiens
gtctcttggaataaactgcaagatccaggtagggtaaatctatggttactcaccacacccttgcacttgaaatttaagatgat

SEQ ID NO: 6836011 - DNA, 65 bp, Homo sapiens
cattccctctttgaaaccctgagagacaactgctaatgctattggctccagtgttcaggggagtg

SEQ ID NO: 6836012 - DNA, 60 bp, Homo sapiens
cattcaagagtggacataatgctctgctcccagaccacgtcaaagtgtccactctgggtg

SEQ ID NO: 6836013 - DNA, 64 bp, Homo sapiens
acctttaagagcaggtctgtgggctccagataccagctggcaaccgcatggcctgcttcatggt

SEQ ID NO: 6836014 - DNA, 113 bp, Homo sapiens
gccttcagtttccttcctttgtgctcttctttgtgctgtggttttctcagcctggaataccctttttccacctgccagaatccaagccacagtacaaatcccagagcacaggc

SEQ ID NO: 6836015 - DNA, 72 bp, Homo sapiens
ctcagggggcagaggtgtagccccctccatggtgcccctgggcccatgtcgggggctgcagctgccatgggg

SEQ ID NO: 6836016 - DNA, 56 bp, Homo sapiens
taacatttcattggaagctatgttctgcaaacagcacatgctttcttggagttttg

SEQ ID NO: 6836017 - DNA, 95 bp, Homo sapiens
tggagggtccaaggactactggggctatcccatggcagagtcgggttagatggagtccatgtggatcggcctgggtagtgttcacgattcctcca

SEQ ID NO: 6836018 - DNA, 62 bp, Homo sapiens
ggtgatcgagttgtttgttctggggatatgaatcctgtggagctttcagcagctcggccatc

SEQ ID NO: 6836019 - DNA, 80 bp, Homo sapiens
cctacagagctagtcctgtctgctcaggagtttgtcgtcgtgcaacacagcaacttgcagtatggagctgcctttgaagg

SEQ ID NO: 6836020 - DNA, 130 bp, Homo sapiens
aaaggtaagggcagggctgtgggcaggatgaggggtaaaggcgtattgggagtgggatggggagactctaacgccattccacataggccttcatgacacctgcttgggttagccgctaaccccattcctt

SEQ ID NO: 6836021 - DNA, 56 bp, Homo sapiens
cagaaagccgacttacaatggaatatcattcagctgtaaaaacgacggactttctg

SEQ ID NO: 6836022 - DNA, 58 bp, Homo sapiens
tttacagtgagagcttagtgagtcacttaacctgtgcctcagttttctcacctgtaaa

SEQ ID NO: 6836023 - DNA, 72 bp, Homo sapiens
tctctgcgtgtgtgtctgtgcatattgtctttctattttatcatttgataactgaacagattcacaaagaga

SEQ ID NO: 6836024 - DNA, 78 bp, Homo sapiens
tttctttgcatctccgtgccccaatcctggacctgttctggtgcacaggaagctggttacgaagggatgcagtggaga

SEQ ID NO: 6836025 - DNA, 108 bp, Homo sapiens
gagctctagaacttccttcgtggtactcaaggcttcctgggaattccttcgtcgttctcaaggctgtcctggagcttccttcatggtacccagggcttcctggagctt

SEQ ID NO: 6836026 - DNA, 78 bp, Homo sapiens
agaatacaagggaggtctagatcaggttggagggacaccagtgccttgaatctctgctctagaactttcttctagtct

SEQ ID NO: 6836027 - DNA, 63 bp, Homo sapiens
tcactgtaataggtttgaagataggggaagaaaagatccttgctctcaagaacttacagatga

SEQ ID NO: 6836028 - DNA, 129 bp, Homo sapiens
cattatcagagtcgtggggagggtggaccttgattcttcctctctgtcccctgagtccagactctctagggaagaatcagacaggagactggatcatggaccagctccctcaaaactggcctgatgatg

SEQ ID NO: 6836029 - DNA, 64 bp, Homo sapiens
aaacttattaaacatttatggaggcagcaacacaattctgttggtttatgtgtttggcaagttt

SEQ ID NO: 6836030 - DNA, 93 bp, Homo sapiens
aagaactaacctccaagaggctataaaggcaggaatgttgcatgacctccatgcccagagctgtttctatatacctcttgtagagttgttctt

SEQ ID NO: 6836031 - DNA, 70 bp, Homo sapiens
gcttcaacatacacagagagaggcctgaaaaacataacttggtctctatgtctaagtttatgttgttagt

SEQ ID NO: 6836032 - DNA, 73 bp, Homo sapiens
tatgagaaaggagaatgactttcaggaaaagctctttgctataatgatgaataagggttctctttgactcgtg

SEQ ID NO: 6836033 - DNA, 64 bp, Homo sapiens
aaaaattaggccagaggagcagctttggagtttattttctccaaggttttctggcactattttt

SEQ ID NO: 6836034 - DNA, 70 bp, Homo sapiens
ttgcctctcaggaggtgattcatatttcaatatattccagctgaaaaaggatcagattttgagcaggtgg

SEQ ID NO: 6836035 - DNA, 79 bp, Homo sapiens
tgttctttgaataattagtgggacagagaacaatggttgaaagttattgttcagtgtctctctattttataaatgaata

SEQ ID NO: 6836036 - DNA, 64 bp, Homo sapiens
cttccctaggggctttggtatgcccatcagcaagaggtgaatcatgcagagaactccagggaag

SEQ ID NO: 6836037 - DNA, 70 bp, Homo sapiens
gattaaacaatgttggtgggtacagagggattctgactgattcaatctcctgattcacagcaaattaatc

SEQ ID NO: 6836038 - DNA, 90 bp, Homo sapiens
tgcacagatgcttggcagagcccacgttgggggagtgaagacttcaggtttgagctctttgggatgggctctgctggagaatctccagta

SEQ ID NO: 6836039 - DNA, 57 bp, Homo sapiens
cgagcctggatgagtaatgacgcgtttcttttccagaagcaacgtaaatctggcttg

SEQ ID NO: 6836040 - DNA, 59 bp, Homo sapiens
gctcgaccgccagaaacttccttctcctgactcaggccacagtcttctgtgtggtgagc

SEQ ID NO: 6836041 - DNA, 60 bp, Homo sapiens
ccctccagtgagtgagcaggcgaccacggccaccttgttgcctgtggctctgctgtcggg

SEQ ID NO: 6836042 - DNA, 59 bp, Homo sapiens
tgtggacagagcagaaggtcatggcagagcactccagcaggcagaggtttctgtccaca

SEQ ID NO: 6836043 - DNA, 114 bp, Homo sapiens
actggccttggctgtcattgatgaggggtcttctacgtggctcattgccagtcctctgcgggcaactggtctttagaatattctgcaatgttgcatgccatcataggctttggt

SEQ ID NO: 6836044 - DNA, 62 bp, Homo sapiens
cctgtactagggtctcattgcctcagcatagatttagcagctagtgggacatatggtacagg

SEQ ID NO: 6836045 - DNA, 58 bp, Homo sapiens
cccaggagccatctgtcttggcatgccccagacagtgccacagatggaggaatctggg

SEQ ID NO: 6836046 - DNA, 79 bp, Homo sapiens
aatgaagttgggcggaaaagtaaacactaggggtcaggatgcccttcctcttttatctttttcattttcccctttcgtt

SEQ ID NO: 6836047 - DNA, 55 bp, Homo sapiens
gactttcttaggccccctaatacttgacttagatctggtttgggccgaggaagtt

SEQ ID NO: 6836048 - DNA, 57 bp, Homo sapiens
tcctcttctttccttcctccagtggctcaggggcctgctgttgagggaagagctgga

SEQ ID NO: 6836049 - DNA, 63 bp, Homo sapiens
cgctgcttttaagaactgtaacactcactgcaagggtctgtgggttcattcttgaagtcagtg

SEQ ID NO: 6836050 - DNA, 57 bp, Homo sapiens
gtgggagggtaagtggatggaaggaacactctctactcctgcagaatgccttcctac

SEQ ID NO: 6836051 - DNA, 114 bp, Homo sapiens
ctgctcctattacccatcccctcacttcacgctctgcagacatgagaataataatcttcacaagactttttgctgagttgaagtttgaggttgtgcctaactacatagtgacag

SEQ ID NO: 6836052 - DNA, 84 bp, Homo sapiens
tattaggctgttgcaaaaataattgccgtttttgccattgaaagtgatggcaagaaccacaattacttttgcaccaacctggta

SEQ ID NO: 6836053 - DNA, 57 bp, Homo sapiens
cattcgttcttcctcagaaccctgtggactaagctgggttctgggaggggctgactg

SEQ ID NO: 6836054 - DNA, 76 bp, Homo sapiens
acagcatatcccagttcagactacccacattgtcagtgctcagtgcccacatgtgactggtggctaagcatgctgt

SEQ ID NO: 6836055 - DNA, 57 bp, Homo sapiens
cagcatgcttgggggagggagccctgatgggtgattattttccagaaagtatcattg

SEQ ID NO: 6836056 - DNA, 78 bp, Homo sapiens
aggctatgctaagataatgtatggggaagcactatgaaatttgacattaaggtgacattatcattattttaaatgcct

SEQ ID NO: 6836057 - DNA, 86 bp, Homo sapiens
tattaggttggtgcaaaagtaattgcggttttcccattaaaagtaaagaaaggtaaaattgcaattacttttgcatcaacctaata

SEQ ID NO: 6836058 - DNA, 63 bp, Homo sapiens
tgcctgtgtcagcaggtggaagtgctcaccagacattaaatattcagcttgctgactgcggca

SEQ ID NO: 6836059 - DNA, 71 bp, Homo sapiens
tcttttttaaggactgaatagtattctgttgtattgttgtaccacagtttatctattcagctgttgaaaga

SEQ ID NO: 6836060 - DNA, 82 bp, Homo sapiens
gtagtgccatttcactataatatgtcaaaatacttcctttggtaacagagtacatgacgtagttaaagttttctggcagtgc

SEQ ID NO: 6836061 - DNA, 56 bp, Homo sapiens
accctgtcttccctgggcatcacagcggtgtgtcagggatttaaagacacaagggt

SEQ ID NO: 6836062 - DNA, 60 bp, Homo sapiens
atcagctcttgatgcctttcttttaaattaattatagacagagagaggcatttagctgat

SEQ ID NO: 6836063 - DNA, 58 bp, Homo sapiens
ttcactttctatttttgaaatataccttcatgggtggaatttttggtgaggaagtgag

SEQ ID NO: 6836064 - DNA, 81 bp, Homo sapiens
gagtaaagtctgatttagtttagagggcaaagatttattaaagaaagtcatttgcaaaccaacaagatgaagacgatgctc

SEQ ID NO: 6836065 - DNA, 59 bp, Homo sapiens
tgacagaggcacccacaactataccaggtttcatggtggtattgttggtgctgctgtca

SEQ ID NO: 6836066 - DNA, 71 bp, Homo sapiens
tgtggggacggggcaggaatggcatgtgccacctgaggaatggctcagtgacattcctcccacatcccaca

SEQ ID NO: 6836067 - DNA, 65 bp, Homo sapiens
gcctgttaaacatgcggctcaattggacatacactaggtgtcctaacagctctgtttaacaaggt

SEQ ID NO: 6836068 - DNA, 56 bp, Homo sapiens
gctgaaggtctctggagaggtcatgggtcaggtcatgttcatctcctgtcttcagc

SEQ ID NO: 6836069 - DNA, 69 bp, Homo sapiens
gcccctgctgaggtcagccacccaatccccaaggaagctcatgttgggtcttatggctggagtaggggc

SEQ ID NO: 6836070 - DNA, 63 bp, Homo sapiens
cagtggttggtagatacttgagaatgtaatcattgggcatgtctcagggccatcttgccactg

SEQ ID NO: 6836071 - DNA, 63 bp, Homo sapiens
gctactgctgagcatggtgggagcatcgtttcctgttcttactagtatgtttcagcagctagc

SEQ ID NO: 6836072 - DNA, 75 bp, Homo sapiens
gaagcaaagcagcctgcagtgtggacagaaggactgaaccaaaaagtccacactgagagctcagcttccggcttt

SEQ ID NO: 6836073 - DNA, 60 bp, Homo sapiens
caggaatttgttctggagtcaaaggtgtagtgttccctttgaagtcagtgagagctcctg

SEQ ID NO: 6836074 - DNA, 60 bp, Homo sapiens
ctgtgtctgtcacagctgagcaaatttatattagcagctaaactgacagaccccacgcag

SEQ ID NO: 6836075 - DNA, 87 bp, Homo sapiens
gagttgggagaccgttggttaccttcagaaatgagttgcgacagttagtgccgcttgctgaacaggaacctggcagtctccagattt

SEQ ID NO: 6836076 - DNA, 80 bp, Homo sapiens
agtagaaattttctgagctttgcctaaaactagaatctgtgttgaggtttttcaaaattaagtaacgccagagacatact

SEQ ID NO: 6836077 - DNA, 100 bp, Homo sapiens
tgacaggttttgtcctaggaccagccagttgctgagaaggttccagaaagtacatgccctcatcccttagctttgtgtccttgagccaagccgcctgtca

SEQ ID NO: 6836078 - DNA, 84 bp, Homo sapiens
tggctttgacagatgaattgcagtcagcattagcaaaatagatcgtgctgcttgttgattcttgactgattatttgtacttcca

SEQ ID NO: 6836079 - DNA, 58 bp, Homo sapiens
ggccctgtttgatagctcctgataaaagcgagctgtgtctggagcctgagcaggtgct

SEQ ID NO: 6836080 - DNA, 55 bp, Homo sapiens
aacatcattatgtccattaatgagttttctttcaagttgagggcattctggtgtt

SEQ ID NO: 6836081 - DNA, 56 bp, Homo sapiens
gtggccgtagctgcttgaccaggcagtgggtaggcccgtgctcggctatggaccac

SEQ ID NO: 6836082 - DNA, 71 bp, Homo sapiens
cagttttatagctagacgactaacatttcctcttttgctctcagagagtgttggagtcttggctgcagctg

SEQ ID NO: 6836083 - DNA, 65 bp, Homo sapiens
gttgggtttctcctgtaggctgtgagatggcaaggagtccttgctgcctcctacaaaagcccagc

SEQ ID NO: 6836084 - DNA, 76 bp, Homo sapiens
tcacaatttgtattaacaatttagctagctagcatttaagcctgtgggcatggctttgttcatataatttctgtga

SEQ ID NO: 6836085 - DNA, 82 bp, Homo sapiens
agttctagggtacatatgcacaacatgcaggtttgttacatatgtatacatgtgccatgttggtgtgctgcacccattaact

SEQ ID NO: 6836086 - DNA, 88 bp, Homo sapiens
aggcctcacagaagcaacactgaagagcactttcaaagtttactcagatgaggtcacctttgcaagtgctttgtagtcctggaggcct

SEQ ID NO: 6836087 - DNA, 69 bp, Homo sapiens
ggcagaattcagttcctctgttgtgacatgccaaggagcgggctgtcctcacaggaatgaactttcgcc

SEQ ID NO: 6836088 - DNA, 67 bp, Homo sapiens
cctataacagagtgaaaatcagcacacattattcgggtttactgtgtgcgtgatgctttgttgaagg

SEQ ID NO: 6836089 - DNA, 86 bp, Homo sapiens
tccatatgatcttaggaaagttggctgatttctctgacgttttcttcatctacacgtatatgaaaaagttaatttctgtcattggg

SEQ ID NO: 6836090 - DNA, 85 bp, Homo sapiens
caaggaatacctgtccactgggggactggctgaattttgcaaggcatctgcagaactagcccttggtgagaacagcgaagtcttg

SEQ ID NO: 6836091 - DNA, 83 bp, Homo sapiens
cccgctctgcccctcacgctctccctcgccctcggcggggcccctgagtctggcggagggaggagcggaggatgcagactggg

SEQ ID NO: 6836092 - DNA, 77 bp, Homo sapiens
ggggaggcccaagggactgagggtgcacaggcaggcagacgggctggagctgcctggcacctacagggggttcaccc

SEQ ID NO: 6836093 - DNA, 64 bp, Homo sapiens
ccaggtctgttggtaccagtgtggcacatggaaatacatcattcaatttggtcaacagatttgg

SEQ ID NO: 6836094 - DNA, 63 bp, Homo sapiens
gcatttccttgatggctaatgaacttgagaatatggaaatatgtttattggccatttgaatgt

SEQ ID NO: 6836095 - DNA, 79 bp, Homo sapiens
tgttcagcatctggtgagggcctagtttctggttcttagtggcaccttctggctatatcctcacaagatggaatgagca

SEQ ID NO: 6836096 - DNA, 64 bp, Homo sapiens
gggttttagcctagacaacttttaaggaaggtaagtaccttagaagtcatctagtctaaaaccc

SEQ ID NO: 6836097 - DNA, 62 bp, Homo sapiens
tcatctttaccccttgcttcaagttgaagaacttgtctaacttgactcaaggctagaaatgg

SEQ ID NO: 6836098 - DNA, 55 bp, Homo sapiens
ttgcataacagccattaaagtattagtattactttgggggcacttgattatgcaa

SEQ ID NO: 6836099 - DNA, 70 bp, Homo sapiens
cagaacttgttttggaccttgaagaattatggcaggggtgatttcacagtggtccaaggcacaggggctg

SEQ ID NO: 6836100 - DNA, 55 bp, Homo sapiens
agcagtgttctaatctggctagtggagaaggctgcaggactactcgagcactgct

SEQ ID NO: 6836101 - DNA, 68 bp, Homo sapiens
tgcatgatgcacgttaatatggtgttgaatactattttcaagagttatcaatctatgtgcaatttgta

SEQ ID NO: 6836102 - DNA, 63 bp, Homo sapiens
ggcagcacttggtgccattgagtggttgcagctctcagatggctctgaggtgtccagtttgcc

SEQ ID NO: 6836103 - DNA, 69 bp, Homo sapiens
cacgggcggtttaggccaacctccctgcctcctccccagtgcagacgcagcctataaaaccaccctgtg

SEQ ID NO: 6836104 - DNA, 59 bp, Homo sapiens
gtggcagagccaaggctggagctatgggcctccccctcctcccccactgtttctgctac

SEQ ID NO: 6836105 - DNA, 98 bp, Homo sapiens
gcgggagaaacgccggaaggggcacggaccccagggagagcgcggaggcggccacgcgggtccttcctccacctgggcccaggcacttccggtctcgt

SEQ ID NO: 6836106 - DNA, 56 bp, Homo sapiens
tgccccagacataacagcagagaggtgatcagtggcctcggtgggatgttggggca

SEQ ID NO: 6836107 - DNA, 57 bp, Homo sapiens
agggctggagattaccctggagccctccggcttcatctgaccaggtctccttgcttt

SEQ ID NO: 6836108 - DNA, 56 bp, Homo sapiens
ggaagaggagagtgttgcatttcctgattagagtccaaggagaagactctctcccc

SEQ ID NO: 6836109 - DNA, 62 bp, Homo sapiens
ggcaaggctgctgaggatgttgggggagaggacccagcctgtccagccagctggtccttgcc

SEQ ID NO: 6836110 - DNA, 61 bp, Homo sapiens
cactgcagatcagaggctgagagggtaataacggaatatcccgagcagctttatgtcagtg

SEQ ID NO: 6836111 - DNA, 130 bp, Homo sapiens
ctgagtagggaataaatataggataaattgttggcagaaagctttcgatcggatgaattttctctgagcgaaaagccaagctttctctaagtcatttttacccacatagtctttttctctgtatgctcag

SEQ ID NO: 6836112 - DNA, 55 bp, Homo sapiens
gttgtagcctttctggtgtcaaccttcatggtatggtaactagagggctgtcaat

SEQ ID NO: 6836113 - DNA, 63 bp, Homo sapiens
gggaaaaggcctggggcaaagtgtaaggccagcaggggcgacagtcgtaggtatccttttcct

SEQ ID NO: 6836114 - DNA, 63 bp, Homo sapiens
agaaaggcaatattaactacacccatagtatattggatgtgtaagctgaaatgttgccttcct

SEQ ID NO: 6836115 - DNA, 118 bp, Homo sapiens
ctgcttgcgaagtttggtgccacagggttgaagagcataaagtacatcacctcttagtttcactgtccactttctccttcttcagctctttcctgcatcttaacctcttgctctgtag

SEQ ID NO: 6836116 - DNA, 66 bp, Homo sapiens
tgccctgtggccttgcagcctggaggtgtctagactggtcgtcactccgctgcatgtcccagggca

SEQ ID NO: 6836117 - DNA, 61 bp, Homo sapiens
gccaatctgcagggaggctctcagcagtgccctttcagaaccagcccagcagatgaaaggc

SEQ ID NO: 6836118 - DNA, 88 bp, Homo sapiens
gtgttttgtttgttttagtttgttttcctttttctatgattatgtgaatagtttggaagagaaaaatatttagaaaggaagaaaagat

SEQ ID NO: 6836119 - DNA, 116 bp, Homo sapiens
tgtggacctctagaccagccccttcattgacttaaaggctctggttacagaaaaggaaaagctgtgaccacgacatcttgtgagttatgagaagtgtctgcatgtatgaggccata

SEQ ID NO: 6836120 - DNA, 65 bp, Homo sapiens
ttcccttggagccttaagctggcttgggtaaataaatggctaagcataatggtgctttaagggaa

SEQ ID NO: 6836121 - DNA, 64 bp, Homo sapiens
ggaggctgggaagtccaagatcaaggcaccagcagatctggtgtctggagagggcttgctctcc

SEQ ID NO: 6836122 - DNA, 57 bp, Homo sapiens
agcaggattgtgctagggcagtctttcttaagctttgctctatgggacacttctgct

SEQ ID NO: 6836123 - DNA, 72 bp, Homo sapiens
tggggaggttagtttcatcaagttgtcagacgccagcaggctgggagctggtggagaagcagacctcaccca

SEQ ID NO: 6836124 - DNA, 70 bp, Homo sapiens
ggcctctgctcttcaaacctcggcctcactgttggctgctctgggccccagtgtggccaggagctgcgct

SEQ ID NO: 6836125 - DNA, 86 bp, Homo sapiens
taagttctagggtacatgtacacaacgtgcaggtttgttacatatgtatacatgtgccatgttggtgtgctgcacccattaacttg

SEQ ID NO: 6836126 - DNA, 65 bp, Homo sapiens
tcatatcaaattgacatatgctgtacttgcttaaaagtgagtcagccagttaagtcaagaaatga

SEQ ID NO: 6836127 - DNA, 89 bp, Homo sapiens
gagataattccagctcatattttatgtgcagtgccatactatatttttaagtacaatgcatatattgatgggtaatcatggtttttctc

SEQ ID NO: 6836128 - DNA, 76 bp, Homo sapiens
attcctctcaggtgtgagatatttcctatgaaacagtccactggcaggctggagatatcttacactttgaagttat

SEQ ID NO: 6836129 - DNA, 74 bp, Homo sapiens
ggatgccactcatcattttacggagcagccggtggatgccaggctgtggctccaatggtgagcctggccagtcc

SEQ ID NO: 6836130 - DNA, 58 bp, Homo sapiens
ggagctttggtgccaagtatttggtggacctcaccggatcactctaatcaaagtctct

SEQ ID NO: 6836131 - DNA, 66 bp, Homo sapiens
aatgctgagtcctgtgagtcttcctagcaaatcaaatctggaaggggtcttgaggactccagcatt

SEQ ID NO: 6836132 - DNA, 61 bp, Homo sapiens
ccacccagtgaaggagcaagaggaatgggaagagccactccctccctccctcctgaggtgg

SEQ ID NO: 6836133 - DNA, 90 bp, Homo sapiens
gttctggtggcacacctctgtctgccctcacatgcactcttcccaacagaagttagtagcagagagggcagccatgtaagtcaacagagc

SEQ ID NO: 6836134 - DNA, 66 bp, Homo sapiens
taacaagcctacacagttttgctcccatgatggggtatgtttatcaagggtaagctgtgtttgtta

SEQ ID NO: 6836135 - DNA, 73 bp, Homo sapiens
tctctaggtaaatataaatcttactctaatagcaacatttggagaagtaatgttatttgccctgatttagaga

SEQ ID NO: 6836136 - DNA, 63 bp, Homo sapiens
caagatagattgactttgtttgagtaaaatggtttaggtctaaacacagagtgagtctgcttg

SEQ ID NO: 6836137 - DNA, 64 bp, Homo sapiens
cagcattgccctttttctcagagatgtgcatctcctctcagaaaaactttgagggtaggagctg

SEQ ID NO: 6836138 - DNA, 58 bp, Homo sapiens
gtcacagtcttatgatttcctttgtgctttaatcaggaccataagtagggcatgtgac

SEQ ID NO: 6836139 - DNA, 70 bp, Homo sapiens
gggctctggcctttaaaatgaccttataattttgagatgataagtcattcttacaggcttctaaggtccc

SEQ ID NO: 6836140 - DNA, 66 bp, Homo sapiens
aagagggaggtgcgggtgcagactgggttctaaaccccagagttcatattctgcttctcttctctt

SEQ ID NO: 6836141 - DNA, 114 bp, Homo sapiens
catttttaaatttaagttaatgctaaaatgtatttgttaatcttaagcctcatagttcccttaaagaggcttgagtaaagaagtattttaggttctggcttaaatatgaaaatg

SEQ ID NO: 6836142 - DNA, 60 bp, Homo sapiens
ccggcgtctcacttccgcctgcgagccttcgggggccgcgcggctctcgcgagatgtggg

SEQ ID NO: 6836143 - DNA, 57 bp, Homo sapiens
taatgtgtgtcatcagtagagtgggggcaataatctgctttgtctatacacacatta

SEQ ID NO: 6836144 - DNA, 61 bp, Homo sapiens
acatattcacaggttccggagattaggatgttcacatctttgtctgtgtgtgtgtgtgtgt

SEQ ID NO: 6836145 - DNA, 77 bp, Homo sapiens
ggaaataaaacaactcggcaactgcttttctacccgaaagtcgggagcaaggagtgggggcgagaagttaagtttcc

SEQ ID NO: 6836146 - DNA, 62 bp, Homo sapiens
atcagcaagtcctgttaattctaccttcaaaacatctcttgaatctcacaggctttgttgat

SEQ ID NO: 6836147 - DNA, 81 bp, Homo sapiens
cctttggctgtgctcccaacttcaactcccttccccatgggcccatcctgaagttagtcttgaagttagtcagtctttagg

SEQ ID NO: 6836148 - DNA, 59 bp, Homo sapiens
ccaaatagtctttcattgaatttcacatattagttcttgttactatggaagacatttgg

SEQ ID NO: 6836149 - DNA, 71 bp, Homo sapiens
gggactttcccaggcttctggagtaagtgccccagtgcccggcgtccactcccagtgcctgaggccttccc

SEQ ID NO: 6836150 - DNA, 65 bp, Homo sapiens
ctgcaacctaatcccctttgccttgtaatctgacatagacacaggtacaagggattaggatgtgg

SEQ ID NO: 6836151 - DNA, 57 bp, Homo sapiens
taagcctaatgcccaggacacagatgcccaggagacagatgctgggcattaggctta

SEQ ID NO: 6836152 - DNA, 62 bp, Homo sapiens
tgtccatggagaagctcagggctgtcaatttagaaagcagctgtgtgctggcccattgggca

SEQ ID NO: 6836153 - DNA, 55 bp, Homo sapiens
aggctttctggtcagaattgatgttttgtcaagttacagcgctgacagcaggcct

SEQ ID NO: 6836154 - DNA, 65 bp, Homo sapiens
acaaagtgcagagagcaatactctacttcgacaaaagtggttagggctgctttctatatttctgt

SEQ ID NO: 6836155 - DNA, 73 bp, Homo sapiens
gcataattagagaattcatgttactagcacttattaatgctttgcctgtaatgtgacatctctcaattatagt

SEQ ID NO: 6836156 - DNA, 62 bp, Homo sapiens
atccaaacatgtaccacactaaccagtttcctgaggtgaaaagaaggtacattattttgggt

SEQ ID NO: 6836157 - DNA, 73 bp, Homo sapiens
tccacgctgggccaggcatgtgatcagcacagtggacacagtgtaagtgcacagtctgtgcccttgtgctgga

SEQ ID NO: 6836158 - DNA, 69 bp, Homo sapiens
tgccccatctagcaactacaattcccagccttccttgcatctggttgtggtcacgtggctaatggggca

SEQ ID NO: 6836159 - DNA, 58 bp, Homo sapiens
ggccatttcttccttctcaacaagacagcaccttctacagaagaccttagagatggcc

SEQ ID NO: 6836160 - DNA, 65 bp, Homo sapiens
gcacttagctggcaggagaaacggggtgcagctgtgcctgcccttctttctcactgccactgtgc

SEQ ID NO: 6836161 - DNA, 85 bp, Homo sapiens
tccagataatgttaaagaggacagagtgctggatttagtgtcaggaatgctgaaatctttagtttctgtcccttttacctatgga

SEQ ID NO: 6836162 - DNA, 71 bp, Homo sapiens
ttgatggcacatttcagtaagtgttaatttggatttctttagaattcactttatatggaaaaggtcatcaa

SEQ ID NO: 6836163 - DNA, 130 bp, Homo sapiens
gcccagaaagagtgctgaatttttgctgcatatgcttaaaaacgcagagagtaatgctgaacttaagggtttagatgtagattctctggtcattgagcatatccaagtgaacaaggcacctaagatgcgc

SEQ ID NO: 6836164 - DNA, 80 bp, Homo sapiens
gttttaaataaatgaaatcaaggtggattttgggaatatatcctgaagttaacatcttgatgtccttcttgttgtaagat

SEQ ID NO: 6836165 - DNA, 94 bp, Homo sapiens
gaagtaacacattgagagcaaaggggggcaataattctgtatgcaaagtgtcagtgcaacagactttattaactcttgttaaaatgttcacttc

SEQ ID NO: 6836166 - DNA, 79 bp, Homo sapiens
tttgttgagcattatcatttgcttaattcctcagaagatctcaagaggactgtctggtacataagaggtgctcaataaa

SEQ ID NO: 6836167 - DNA, 71 bp, Homo sapiens
gggcagcaacctcctggaccaccttgtggccaggcagttgtcttcacaagaggcccaggggagcaaggccc

SEQ ID NO: 6836168 - DNA, 62 bp, Homo sapiens
ccaagtcctctaccattcctggagtgtatatggttccccaggagggtgcaggaaggacttgg

SEQ ID NO: 6836169 - DNA, 106 bp, Homo sapiens
gtgcccatgtcttccacagagaacagggcctggggacaccaccatgacatctctctgagggttggtctgcatcatggtggttcccaagtttgttttccatgggcac

SEQ ID NO: 6836170 - DNA, 90 bp, Homo sapiens
gaggtggaagtcgtacctttggggtcaggcccttgagccacagcctctttcccaggcctctcagggagcctggacttcaaggcctgcctc

SEQ ID NO: 6836171 - DNA, 57 bp, Homo sapiens
tgggggcctcatgaggtcttttctgttttctgtgaagaacctcacgagattccttca

SEQ ID NO: 6836172 - DNA, 75 bp, Homo sapiens
ggctggctcagagaaggctgaggatccctgtgttctccctgaacaggggtacagggcccctcagcagggccagct

SEQ ID NO: 6836173 - DNA, 99 bp, Homo sapiens
ggcaggaggatcacttgcatctgggaggccaaggttacagtgagtggcgatcctgccattgcactccagcctgggccacagagtaagcctctgtctgct

SEQ ID NO: 6836174 - DNA, 61 bp, Homo sapiens
aagtcttctcaaaactcagggtatctgctatgcatggtagatttaagtttttgggacactt

SEQ ID NO: 6836175 - DNA, 74 bp, Homo sapiens
ccctgcagagatggcagggagagtgattgaattggagttatgggctcaagctctccctggccagctgtgcaggg

SEQ ID NO: 6836176 - DNA, 64 bp, Homo sapiens
tggcacttgtcacctgctttcagtcttttccactaacagctggatgctggatgaacagatgcca

SEQ ID NO: 6836177 - DNA, 84 bp, Homo sapiens
gaaggtatttgttaggacctaggggagcaatttcttaaaataagtacttacaagttgcctgctatttgcctaaagtgatccttc

SEQ ID NO: 6836178 - DNA, 75 bp, Homo sapiens
attctacttgatactacaatgattccttagtagaattttctcactttagaggaaacattgagttgataaaggaat

SEQ ID NO: 6836179 - DNA, 73 bp, Homo sapiens
gtttatatatgctattgcctgtatcttcagaagtctccaacttctgaggatagaggcaataggacatataaac

SEQ ID NO: 6836180 - DNA, 66 bp, Homo sapiens
tatatttttctaattgcattggctaagatttcgaatgaaatgttcagtagtcattgggaaagtgtg

SEQ ID NO: 6836181 - DNA, 128 bp, Homo sapiens
ttgaacttcagtccctcctgactcgggcacccagccctggctttctgctccctgtgtactcaatggtggtcatagcagaggccgtggcaggagaagcacagtggcaggagggctggcacaaggttcag

SEQ ID NO: 6836182 - DNA, 67 bp, Homo sapiens
tgttaactccatactttttattcttgtgttagtcttataatgagcataaaatattagtatggtagca

SEQ ID NO: 6836183 - DNA, 76 bp, Homo sapiens
aactttagggtctgggaagtaaaaagtgacagtgatgaagaatcacttggatatgttcactagacctcctgaagtt

SEQ ID NO: 6836184 - DNA, 56 bp, Homo sapiens
gtggggaggcctaagcaagttgtgttttgagcacaggtgctttagtgattccccat

SEQ ID NO: 6836185 - DNA, 83 bp, Homo sapiens
ggctgtaggaagactgtgcagagctgagacccaaaatctggcctcctgattcctgattcatgctctttgtacttccttgagcc

SEQ ID NO: 6836186 - DNA, 85 bp, Homo sapiens
ctttgctgattatattcccagagggaagtgttctggcagttgggctaatcctgaaacatgagcacttgcttcatagtcatcagag

SEQ ID NO: 6836187 - DNA, 78 bp, Homo sapiens
tctaatgagttattttaacctacatgagaactttaaaggaaaagtggctttgaagataggatgtgggtctcaattaga

SEQ ID NO: 6836188 - DNA, 91 bp, Homo sapiens
ctaagggtgagccccatctgaacacagggccttgtgtgactgcactggctacaggcctgctcagctggccctgctcaggatcacaccttag

SEQ ID NO: 6836189 - DNA, 75 bp, Homo sapiens
gatggcaattgtaattttgtaaagatttatgagttgtaattttgtaaagatttatgaagttcaattagagccatc

SEQ ID NO: 6836190 - DNA, 73 bp, Homo sapiens
atggccctgccaggcagagtgctccagaaagcaaagtctttttcttcatttggagaactgtgctttgggctat

SEQ ID NO: 6836191 - DNA, 68 bp, Homo sapiens
gctttctaatctatttccttacttgttggctgggtaagtgttacatttgggaaatagaagaagaaggt

SEQ ID NO: 6836192 - DNA, 79 bp, Homo sapiens
gaataggaagtttattgagttcaagtacttgaccttttgtggtccgtcattaaattacttgaaaatgtgctttttattt

SEQ ID NO: 6836193 - DNA, 78 bp, Homo sapiens
tccactttttgctgtccctattccttgatggaaaataatgtcaacacttgataattccagaggaggacagtccttgga

SEQ ID NO: 6836194 - DNA, 62 bp, Homo sapiens
cagtagtggaagggagagaaaaaagcaaagataacctcctttggagctcttttttacaactg

SEQ ID NO: 6836195 - DNA, 75 bp, Homo sapiens
tcaagaagggtttattgttaataagtttgaaaccacatttcaaattgtcatcttgataatgttagccttttttga

SEQ ID NO: 6836196 - DNA, 69 bp, Homo sapiens
gataaaatgtgcagggctttccgcccccatttcccatcctctgatagggcctaagtcctgacatggatc

SEQ ID NO: 6836197 - DNA, 90 bp, Homo sapiens
tggaacttgtcaagggaatgaattttggatggtgaagttaccacagcagtgaatctgttgctttcatttgaagtccattcacaggtccca

SEQ ID NO: 6836198 - DNA, 75 bp, Homo sapiens
agcagcagaaacctacttcattcctttgtaaaatgcctacacgtaataggtaccataaaatggagtatgctagct

SEQ ID NO: 6836199 - DNA, 55 bp, Homo sapiens
tgtgacttttcttttgtatgctaaaatctagcagaaacacagggctagagttaca

SEQ ID NO: 6836200 - DNA, 74 bp, Homo sapiens
gggaccccagggctgccagcctcctaagggacagagacattgggatcggccctggtgagccctgggtaggtcct

SEQ ID NO: 6836201 - DNA, 85 bp, Homo sapiens
tagaggtggtttaaaaaggcatctgcctatgaatctattaaaatgatctggaagaggtagcattggcaggtgcaaagcctttcta

SEQ ID NO: 6836202 - DNA, 66 bp, Homo sapiens
gcatgtgcagggccaggcattgccatcaatggagttcattgttttgcagcaggcacctgcacctgc

SEQ ID NO: 6836203 - DNA, 92 bp, Homo sapiens
gatggagtgtggttcaggaggtttggattcagttatattattttcatatgacttaccattttaacttccttagggaatcacttaaattagtc

SEQ ID NO: 6836204 - DNA, 72 bp, Homo sapiens
ttctgctaacattacctgcaactcccatggtgatgctcaaatcccatttgggaattcagtgaactagcagaa

SEQ ID NO: 6836205 - DNA, 59 bp, Homo sapiens
cttctgtgcgcctctattccctactttgtctgatttgtggtgaaggctaagcacagagg

SEQ ID NO: 6836206 - DNA, 88 bp, Homo sapiens
ataggtgctggcagctggaagttgggctggcctcacaaaaatagtaagaggttatggacagggcaccactgacatctgcttcaattgt

SEQ ID NO: 6836207 - DNA, 69 bp, Homo sapiens
aaaatgaggccagatcatgcagagagggccctggcggccaagagatttttgatagtttggatttatttt

SEQ ID NO: 6836208 - DNA, 121 bp, Homo sapiens
ttagtgttcttcttctttactgtacagtcagacatcgtaattacacaattacttgtgggagtgttgtattgattgtgattattgattctgctatttactactaataaatgaacttggctaa

SEQ ID NO: 6836209 - DNA, 56 bp, Homo sapiens
gtatgtcttagggttcagtaacagtaactgactggcccactgagcccaggacacac

SEQ ID NO: 6836210 - DNA, 104 bp, Homo sapiens
cctgacattgttgtaataacccctcttcaggagctgaaagcctgccagcctccctgaggcagcagtcagttctctgactgattggatatgacctgtgtgttagg

SEQ ID NO: 6836211 - DNA, 67 bp, Homo sapiens
gtattgcatagacctgggatgagttactaattcacaatttactctctaccaggctttatgcaaatac

SEQ ID NO: 6836212 - DNA, 69 bp, Homo sapiens
ttagttttgtgtctacattttcattttgactttgacatgcatggtgtcagaagtgggatacaaagctga

SEQ ID NO: 6836213 - DNA, 123 bp, Homo sapiens
ttcaatgaataatctcatattttgtcataaatgggacctgaagcaggttggcaaagccaatgaggctatgcccctgcatttaggcctgactgtaactgacctctctatttattctcagatgaa

SEQ ID NO: 6836214 - DNA, 56 bp, Homo sapiens
gttctggcacctttgccccctggtcaatgagtaccagggtggctctgggtcagaac

SEQ ID NO: 6836215 - DNA, 63 bp, Homo sapiens
gagctgaaatatgaagccaattactaaggggaagatttccagcaaattggctcctgatagctc

SEQ ID NO: 6836216 - DNA, 67 bp, Homo sapiens
ggctgtgacccccacaggggtgtccctaggcacacactctgccctgtcacccatgtgggttccagcc

SEQ ID NO: 6836217 - DNA, 80 bp, Homo sapiens
tgctgtgtgagtttaacacttggagaaaaggaagcaacacaattgcacactttgctgccagtgcctaaactaacagtgca

SEQ ID NO: 6836218 - DNA, 66 bp, Homo sapiens
ggaggagactatcccctttgttctatgagttgcttctaaagtaggagccaaaggaagtttccctcc

SEQ ID NO: 6836219 - DNA, 62 bp, Homo sapiens
ccaaatcaaaagccaaaaggtcaacaaagcagaggtgtcagctgaagtgcttttgaatttgg

SEQ ID NO: 6836220 - DNA, 60 bp, Homo sapiens
ctggggctgggggaggagaccttctaatgacccccccataggcctccctcattttcccag

SEQ ID NO: 6836221 - DNA, 71 bp, Homo sapiens
ggtatatttctcctccagatggtggttgtatatttatagagcacatctgtgatctgggggattgtatgtcc

SEQ ID NO: 6836222 - DNA, 62 bp, Homo sapiens
tgtctttggaggcactgttgagtgaataaaatatatcacttcccgttggcctctagaggtca

SEQ ID NO: 6836223 - DNA, 89 bp, Homo sapiens
tctatcctcctgcacacttggatgtgtggccttgacctgtggagtgggctgcctaaagggagaaggtccatgcctgtcaggactgtgga

SEQ ID NO: 6836224 - DNA, 64 bp, Homo sapiens
agcctgctgtgctctccaccagctggggttctcttctgtcggggctgtggggagtcagggggct

SEQ ID NO: 6836225 - DNA, 80 bp, Homo sapiens
agcagcttggaaagcacccaagatttccttctttagagaatcagaatgaaggcagaacagggtttctttctattgttgct

SEQ ID NO: 6836226 - DNA, 76 bp, Homo sapiens
ttaccagtatcctttgcggaaatttctaagatttgctcatccaatagagacccgagaaaggaagaaatctgagtaa

SEQ ID NO: 6836227 - DNA, 56 bp, Homo sapiens
ggcatgcatgttgttttaggtgtgtttgagatgcctgaagaacatcagtgtatccc

SEQ ID NO: 6836228 - DNA, 80 bp, Homo sapiens
gcacagagccggccaaacgcagcctgtgtttcccatctatggatgccagcacacaggcagcgtcattgctgctcgagtgt

SEQ ID NO: 6836229 - DNA, 60 bp, Homo sapiens
tgtgtaatgctgacttttccttaagatagtaggttatttcacagctgtcagtgttacaca

SEQ ID NO: 6836230 - DNA, 105 bp, Homo sapiens
cagtgaattaaaaattacaggaattatttctcactcacataatagtccaaaactagggaagtatttagaggagaaaagtggctctatgatccttatacattgctg

SEQ ID NO: 6836231 - DNA, 62 bp, Homo sapiens
tggctgagcacttggaggaagagagtggtccacactttctgagctttcttgtgctcaagtca

SEQ ID NO: 6836232 - DNA, 82 bp, Homo sapiens
gaatgattcttaaatgaatggatagatatggggtgtatcttataccagccctaggcctgtttgtccataataggacccattc

SEQ ID NO: 6836233 - DNA, 64 bp, Homo sapiens
gtggtggggagagaccggaatgtttcccaggaagccacaaccctgggggacgctctccagccac

SEQ ID NO: 6836234 - DNA, 83 bp, Homo sapiens
ataataatgttacctccctgtgcctcagtttcctcatttgaaaaatggggacagtagctgcgcatagctgataggattattgt

SEQ ID NO: 6836235 - DNA, 59 bp, Homo sapiens
attcagatgaaattctttggagacaactttgttttcaaagtaaggattttcatcagaat

SEQ ID NO: 6836236 - DNA, 79 bp, Homo sapiens
tggcctctggggaggcagtttctgatattagtttgtgtctgtccttcccaggcacaagaaactgctccccacacctcca

SEQ ID NO: 6836237 - DNA, 79 bp, Homo sapiens
gacttagaattccctgtcactttttctacccttactgatctgactttactgagagttgaaaagggaggacatttaagtt

SEQ ID NO: 6836238 - DNA, 55 bp, Homo sapiens
cttctgttgcttgcatctcccactaagctatatagggaggtcaaatgatgagaag

SEQ ID NO: 6836239 - DNA, 78 bp, Homo sapiens
gtgtgtgtgtgtgtgtgtgtgtgtgtgtgtgtgtgaatgtagccacaggtgcgtgcacacgcatgatgatgcacgtac

SEQ ID NO: 6836240 - DNA, 83 bp, Homo sapiens
tttgcaaaacatggcatgaataatgtgtacattacttgcataattggttttgtgcgtacatatggcacatgctattttggaaa

SEQ ID NO: 6836241 - DNA, 129 bp, Homo sapiens
tgctttagaatgacctgggtgttcattcaaaattctaggctccatccaagatcttctgaatccaaaaggtgtgctgtgagacctggtgattggaagatacagcaaatccccaggtgatttgattgtgca

SEQ ID NO: 6836242 - DNA, 67 bp, Homo sapiens
cctggtcccgcttgtgagggaaggacattagaaaatgaattgatgtgttccttaaaggatgggcagg

SEQ ID NO: 6836243 - DNA, 78 bp, Homo sapiens
ctggttctcaggcctttgaacttggagtggggcttatattatcacctcccaacccccttctcaggcctttggactcag

SEQ ID NO: 6836244 - DNA, 73 bp, Homo sapiens
ggagggaactgcagagtggattaagtggttggaagtaagcagcctcactcagacatccagtgcagtggtctcc

SEQ ID NO: 6836245 - DNA, 80 bp, Homo sapiens
gcactgagctccattccaggggcccctccatggctgactttcggggaaggagctgagggagcgcccttggagcaccttgc

SEQ ID NO: 6836246 - DNA, 57 bp, Homo sapiens
gccctccagggaggagcacgggttcaggtacatgtggcacctgccctccctggctgc

SEQ ID NO: 6836247 - DNA, 66 bp, Homo sapiens
atgaatagagaaagatgaagagtggcgtttacatgaagtgacacttgaacgttttgtctcttttat

SEQ ID NO: 6836248 - DNA, 59 bp, Homo sapiens
gtggaaaaggctggaaactgaagataagtgtcttattcttagccatccggcctaaccac

SEQ ID NO: 6836249 - DNA, 100 bp, Homo sapiens
tgaggcagaagaatcccttgaacccaggaggtgaaggctgcagtgagccaagacggtgccactgcactccagcctgggcacagggcgagactctgtctca

SEQ ID NO: 6836250 - DNA, 64 bp, Homo sapiens
gccctggctctggtctgaggttgcccttgaacgatttcgaggctccctcgggcaaggctgtggc

SEQ ID NO: 6836251 - DNA, 105 bp, Homo sapiens
ggctctggagcttggagtagctgcatggagatggcagaagctcaaagccacttcctccaggaagccttctgtgattcctccagccagctactcctctcccaagtc

SEQ ID NO: 6836252 - DNA, 85 bp, Homo sapiens
ttatctggtacgctgcattacacattctagggcacagttatttcagatgatcttgattagtagtggtgaaacagattccagatga

SEQ ID NO: 6836253 - DNA, 56 bp, Homo sapiens
gcagggagcacagagatgaagataaaaggcgaaatgtctatctttgagtcctctgc

SEQ ID NO: 6836254 - DNA, 72 bp, Homo sapiens
gtagacttctgctgaccagtgccgtcttagaaagtttctttgtaactttctagtcctaggagaggagtcaac

SEQ ID NO: 6836255 - DNA, 76 bp, Homo sapiens
aggttggcgctaaagtatttgtgatttttaccattgaaagtaatggcaaaaactgcaattacttttgcaccaacct

SEQ ID NO: 6836256 - DNA, 58 bp, Homo sapiens
tcagaagtactgtgctacaatattatgctctagtgattctcaaagtattgtcttctga

SEQ ID NO: 6836257 - DNA, 104 bp, Homo sapiens
gtttgggcttttctattcctttaatacaactgttgtcactgggttgggaggacctcgtgtgaaagctggcagttgcctattctgatttgtgggaaaacttaaac

SEQ ID NO: 6836258 - DNA, 61 bp, Homo sapiens
gcaaacagttttgccaaaaggacaaagataacagatgtgttcacttgggagacctgttagc

SEQ ID NO: 6836259 - DNA, 67 bp, Homo sapiens
cctgggctgctttaaaactgatacatgaagcagaaagttcacagttttccttaaagcagaaatcagg

SEQ ID NO: 6836260 - DNA, 69 bp, Homo sapiens
gggttgcggtaaaatagtgtggaggtggcttctaaagatccttattgccactttactgagctgtaattc

SEQ ID NO: 6836261 - DNA, 108 bp, Homo sapiens
cattgcatagtttgcattttgaccacagcatttatcttgtagcaggactaataatttaaggctcttgtcctgaatcaactaagtgttcagagaatgaactatgtcttg

SEQ ID NO: 6836262 - DNA, 101 bp, Homo sapiens
gtttttttgtttcaacgtgttgctagttatcttatctcagtgtattgtatttatataactgcatatttgattgagatacctaacctatgagacatattaac

SEQ ID NO: 6836263 - DNA, 63 bp, Homo sapiens
gaccttgtgtttttacgtgtcatttgtctgtctgagatcaaatgttaagacaggatcaaggtc

SEQ ID NO: 6836264 - DNA, 60 bp, Homo sapiens
cagctcgtggttcagggatgtgggtgatgctgtcgcagcccaggaccctggacagagctg

SEQ ID NO: 6836265 - DNA, 75 bp, Homo sapiens
gacggcacccagcaggtcctgggcgtggcctgccctgtatggcctaatgccccacctgctgagctgggcgccctc

SEQ ID NO: 6836266 - DNA, 99 bp, Homo sapiens
cctgaaaaatagacagtatttgacattgaaagcagaatcgccctggatgactccaccagcacatctgacttccagtgcaggagctgtctgagatttagg

SEQ ID NO: 6836267 - DNA, 89 bp, Homo sapiens
tcgggaggttctactccacgcccagctgaaatctccaggctctcaacagctggaggagaatagcagggctttgggaagaacttaataga

SEQ ID NO: 6836268 - DNA, 55 bp, Homo sapiens
tgtacccctctgtttcccttttgtccctgggctgcctggaacagcagaggggaca

SEQ ID NO: 6836269 - DNA, 74 bp, Homo sapiens
catccctggttcctgtgtttaaattctacattacaagactagatgctgagaaggaagagggaaagccagggatg

SEQ ID NO: 6836270 - DNA, 63 bp, Homo sapiens
tttccttgggtctcttagtggcatggtttaatggtaattcagatcactcttggataaaggaaa

SEQ ID NO: 6836271 - DNA, 64 bp, Homo sapiens
gctccactttggcaagcgagtactttctgaagaccaacttcaagaaatggtgtcacgtgagagc

SEQ ID NO: 6836272 - DNA, 89 bp, Homo sapiens
atcagtattttgtacttgcttctggcagattgcgtaataaagtgattggcattctagtgatgctgctgtcatgagtatagacatttgat

SEQ ID NO: 6836273 - DNA, 61 bp, Homo sapiens
ttaaggggacagattttgtcaggttcagaccttggctccaacactaaatgtgtttccttga

SEQ ID NO: 6836274 - DNA, 55 bp, Homo sapiens
atttatctctggaaactaagcaaacaggaattcctgattctgatccagaatgaat

SEQ ID NO: 6836275 - DNA, 64 bp, Homo sapiens
ttgtttttgagtgcctacaatcaccaaggtttttctctgggctttgggattcagcatgagacaa

SEQ ID NO: 6836276 - DNA, 65 bp, Homo sapiens
cttagggagaatgcctctgcaggtactaaaaaatgagagttaatgcatgaaatattttctgtagg

SEQ ID NO: 6836277 - DNA, 77 bp, Homo sapiens
ttagttctccaaattgactatgttctctggatcatcttgtcttttcttctagaaactctcaatctgggatgtactaa

SEQ ID NO: 6836278 - DNA, 105 bp, Homo sapiens
gaaagtgctgtgttacagagcccttagggtcagcagcctccgaacccctgcacggaaccaggggctggattactgaactgagtctgtctcacatgcaaagctttc

SEQ ID NO: 6836279 - DNA, 88 bp, Homo sapiens
aggttctctaaattgtattgtgtatgttaattctgtaactttctgccactcaagttggatgattcatatgcacagaactcaggaattt

SEQ ID NO: 6836280 - DNA, 62 bp, Homo sapiens
agaatgtagtcttggagatttaataccctagatagtgagtgtgaatttccctctatcattct

SEQ ID NO: 6836281 - DNA, 103 bp, Homo sapiens
ttaggtgtttgccattgtacccccactcagaatgactgatgctgtgccatgcacataataaatgttcctgatgctggggtttgcattggctgggactacctga

SEQ ID NO: 6836282 - DNA, 75 bp, Homo sapiens
gcagcaggcttcattccaggattcccctcccagggcaggaaggagagggctgtggggcatgaccaggcctgctgt

SEQ ID NO: 6836283 - DNA, 94 bp, Homo sapiens
ggagagggctgctggatggcctttggtgagaagagtaagctgaaagtgatacttcaaagaacgtcttccagagcctccatccctagccctgtcc

SEQ ID NO: 6836284 - DNA, 124 bp, Homo sapiens
tagcaacatgtatttcataggaaaaagggaggaaggaaatttgataagccattgttactgtcttttagcagtggggattatatttatattttcttcttacctgtccatatttttcaagttgcta

SEQ ID NO: 6836285 - DNA, 70 bp, Homo sapiens
ggaggtggcaggatcacttgagtccagaagtttgagactagcctggacaacatagtgagacctcatctct

SEQ ID NO: 6836286 - DNA, 82 bp, Homo sapiens
ggatataagcgcagagggactcctcaggatctaggagtgcttcagcctctgaagtacttttacttgggcctctgtggtatcc

SEQ ID NO: 6836287 - DNA, 69 bp, Homo sapiens
cttctagtatattaattctcacggtttaggttatttgaactaagctgagagaacagaataccaaagaag

SEQ ID NO: 6836288 - DNA, 95 bp, Homo sapiens
tatttactacattccaggtactgtggggatattgattgtaatgacatgatcctttattgtcaatatgcttacagtccactagggggagccaaata

SEQ ID NO: 6836289 - DNA, 57 bp, Homo sapiens
tctcagagatctttctgcatgtgatgaaaatcaaggcagtacatgaggaatttgaga

SEQ ID NO: 6836290 - DNA, 75 bp, Homo sapiens
gtcacgtattgtacataaaatgtatgtctttgtctcacaagtcaagggcaagagaaattttgatgtatttgtgat

SEQ ID NO: 6836291 - DNA, 92 bp, Homo sapiens
caggtcagggacacccagctgggccacctccagagccacaccaggccctgagctatttctggaggcctcccagacgctggtgccctggcctg

SEQ ID NO: 6836292 - DNA, 71 bp, Homo sapiens
ccgtgacctcagtactgcagtttggttggtgtcttaaccaagctcaatggtctgagtattcagggttacgg

SEQ ID NO: 6836293 - DNA, 81 bp, Homo sapiens
cccaggggactcagagtgtgccccaggagtcctgtgggaattgccccacccttcctggcacactcctgaatgttctcgagg

SEQ ID NO: 6836294 - DNA, 62 bp, Homo sapiens
ggtggtgtgagtcaaagcctggagtagtgttaacagctctgagtgcacatttacacaacacc

SEQ ID NO: 6836295 - DNA, 57 bp, Homo sapiens
tgactttctaagcttagtatgaggcagtaaatgtactgcagctagttggggaaagca

SEQ ID NO: 6836296 - DNA, 71 bp, Homo sapiens
tcacagtatttactatcaccattaacccatagagtgagtttggtttggtgtcttggaagtaggtgctgaga

SEQ ID NO: 6836297 - DNA, 58 bp, Homo sapiens
ctcagggaaaagggccagggagatgctactgatgctctctgggcagcccagtcctgag

SEQ ID NO: 6836298 - DNA, 101 bp, Homo sapiens
agttttaaaatcatgtatttcacagtaaatccagaagaaattatgcacttaatttttctgggtgaattgtgttatagaggtaatagaggattattaaaatt

SEQ ID NO: 6836299 - DNA, 63 bp, Homo sapiens
actgtagctgccactggatgcaaagcagtacctgtttactttagatccagtgaatcagccagt

SEQ ID NO: 6836300 - DNA, 73 bp, Homo sapiens
gcattatgtcagacagaggggctttgggtcaggtgtgcacttgtacatgtgtacccttcctctggggccttgc

SEQ ID NO: 6836301 - DNA, 63 bp, Homo sapiens
cttgcacagaactcttagaggttctggggccaaaagatttccatctctgagaagtttttcagg

SEQ ID NO: 6836302 - DNA, 57 bp, Homo sapiens
gttttgttcactgccgtatggccagtacctaggacgctgcctggcagtgtacaaggc

SEQ ID NO: 6836303 - DNA, 103 bp, Homo sapiens
acttttatataccatcgaatgttattacacttgtgaaattctcctgtctaacctgaatttacattccatggtggttacatggtatatgtattattattaaagt

SEQ ID NO: 6836304 - DNA, 69 bp, Homo sapiens
tgaatgggcaacctgcaacaactgaaacaggtattatgcctgggccagcttgggtcaggtgcctgctca

SEQ ID NO: 6836305 - DNA, 68 bp, Homo sapiens
tattagaaacacttgcaaaatggttccttactgctgacataagtgaacaagtcgcgatgttttagata

SEQ ID NO: 6836306 - DNA, 72 bp, Homo sapiens
acacaggcagacacctttatgtctaatatctcaactgtagaggttagataatcacagagtgctatactgtgt

SEQ ID NO: 6836307 - DNA, 57 bp, Homo sapiens
ctttagcaaagtttgccatctagtggccaccaggactaaatggggctttgcttaaag

SEQ ID NO: 6836308 - DNA, 97 bp, Homo sapiens
gagaaaaaagctggaaataggtgggtcttatcatgcctgaaaagccattaaaaaggacttcttcaacagtaaacccactttaccccactgatttctt

SEQ ID NO: 6836309 - DNA, 55 bp, Homo sapiens
cagctggactgggatgtagcgacggtccatcagctctctgccttccagccagatg

SEQ ID NO: 6836310 - DNA, 116 bp, Homo sapiens
gccatggttgtcccgcttgttgtagattgctgacaaggggcaataacattcaagtgatccagtctcacaatgtggtttgtcatcttttcagttcctattgtctgacctatcatggc

SEQ ID NO: 6836311 - DNA, 63 bp, Homo sapiens
tcccaagcttggggtgggcagtgtaggcaagttgatcgagcttgcagctgacaccctttggga

SEQ ID NO: 6836312 - DNA, 56 bp, Homo sapiens
ggccagttggatttttagtggtcacttaagtggagtagccactttgcagcctggcc

SEQ ID NO: 6836313 - DNA, 55 bp, Homo sapiens
ggctttgtattccatttagatgtaattcaacatcttcagtgagaccagcaaggcc

SEQ ID NO: 6836314 - DNA, 59 bp, Homo sapiens
cttgcccccttcctgcacgctggcacacaccatggtgtctgtgatgttgccggggtagg

SEQ ID NO: 6836315 - DNA, 65 bp, Homo sapiens
cttagagacttgggggctttggataggcttcagctgggatggtcatccaatccccagcctcaaag

SEQ ID NO: 6836316 - DNA, 69 bp, Homo sapiens
ggaggcaatgctgcaagaggtgaaaagatggaagctccgtctcttctgctgctgcggcagcgtccctcc

SEQ ID NO: 6836317 - DNA, 70 bp, Homo sapiens
gctatattattggaccacagactttaaggccttgggccaaccacctcaatgttctgggtttaattttagt

SEQ ID NO: 6836318 - DNA, 96 bp, Homo sapiens
aagaagtctgaatagaaaaacataaagttaagctgtaagtattttgtccataaaatgaatgctgtaaggctttgtgcttttgactctaggcttttt

SEQ ID NO: 6836319 - DNA, 58 bp, Homo sapiens
ttgagcttgtcactgcctgggaaggagcagctgcatttgtcctcagtgacaacctcag

SEQ ID NO: 6836320 - DNA, 64 bp, Homo sapiens
ccttccctgttccggcataacaagaagacaaacatcttgactgtgcacatctgacgggtgaagg

SEQ ID NO: 6836321 - DNA, 84 bp, Homo sapiens
aaacagctgagtgaagaaacattgcttttattgctgcagggaataaatcagtttaaagcaagttctcatcatttatactcgttt

SEQ ID NO: 6836322 - DNA, 60 bp, Homo sapiens
tggtgctgcctctttgcccgggtctgtgccagctccgactccaggtgcaggaggagccca

SEQ ID NO: 6836323 - DNA, 72 bp, Homo sapiens
cctgtcattgagaagtttgtgaaaggaagtaaacagaagtgttgggatggtcacacatttctcaagtgtagg

SEQ ID NO: 6836324 - DNA, 79 bp, Homo sapiens
gctccctgtggttgggagatctttaggagttggactatcttaaagatagactatcttaaagttttctgatcatttgagc

SEQ ID NO: 6836325 - DNA, 81 bp, Homo sapiens
gggaaggtgagtccttactcgggggcccagatctccccacggaggccacagatctgggtccccgaggaaggagagcccccc

SEQ ID NO: 6836326 - DNA, 56 bp, Homo sapiens
ggtagttcttcatgggtttcattgattgaatttccttggctgatgacagaggtacc

SEQ ID NO: 6836327 - DNA, 77 bp, Homo sapiens
ttgcctcctctcaaaagcacaacattgattttatccacctggaagttactgtctgcctgcttttagatagagagcaa

SEQ ID NO: 6836328 - DNA, 79 bp, Homo sapiens
tgagtctgtaccttcaccactgtgtccatggtacctgacatgtagtagttgtacacagagtggtggaagaaatggacca

SEQ ID NO: 6836329 - DNA, 84 bp, Homo sapiens
attccctgatcttcagtttcgttatctatgagatgggaattaattataaccgtaccttactgacaacgagattgtttgaggagt

SEQ ID NO: 6836330 - DNA, 66 bp, Homo sapiens
gtttctgtaagactgaattgacttcactatgaaataaggctttctcggtatcagtcctgcagaaat

SEQ ID NO: 6836331 - DNA, 98 bp, Homo sapiens
gccctcagagctgagtggcaggctctggcgtccaatggagcgggcggatggagacttctgcaccaatgggcgtgggggaggcggtgccgcgggggggc

SEQ ID NO: 6836332 - DNA, 118 bp, Homo sapiens
tcagatattaccaagatccccatcattctcagacacattttacattaactgtactgacaaacttgaacagaatgcgtagtgcatgttggagaatgttgtgcatgttggagacatatga

SEQ ID NO: 6836333 - DNA, 130 bp, Homo sapiens
gcatggctttgaggctagaatcatgagcaatctctcataaacaagtctgttatgcacctggagatactcaagatttgcctctgttagcatggccacttagagattactctgttctacttcagagaccctc

SEQ ID NO: 6836334 - DNA, 90 bp, Homo sapiens
gcaagaggaacccaactaaactgtagtgcttatagactctgccattccctgtggggagtttattgctgagttgcttgcagttccttttgt

SEQ ID NO: 6836335 - DNA, 56 bp, Homo sapiens
gtagttctctgaagatgtagggtgacatcctagccaatcatcctcagactctctgc

SEQ ID NO: 6836336 - DNA, 63 bp, Homo sapiens
ccagtcacaggtgtgtttatataagtgtatcactggtgtgattatgaatatgcactgttctgg

SEQ ID NO: 6836337 - DNA, 82 bp, Homo sapiens
aggaaatctgtaagcaattgctcagaggaggaggaagtagaagaaggaatttggctgagcatgttttacatgaagtattcct

SEQ ID NO: 6836338 - DNA, 59 bp, Homo sapiens
tttgcttgacccttgtgctgaaccaaaatcttttccaaggttctgaagggttcagtaaa

SEQ ID NO: 6836339 - DNA, 78 bp, Homo sapiens
cagaagggtaagtaagcgctgtgggcgtgcgaggaggcagctctgcctcttcctagtgtgcagcgtggccaccttctg

SEQ ID NO: 6836340 - DNA, 85 bp, Homo sapiens
ggaaagttgagaggagctcgtggccccagaacaaagcttgagaaaagtaaacaggcggctgctgccggcgagcctcccttcttcc

SEQ ID NO: 6836341 - DNA, 57 bp, Homo sapiens
cccgttcagagcctcaccgagccgtgctgaggcctctgtgtagccaggtctggaggg

SEQ ID NO: 6836342 - DNA, 69 bp, Homo sapiens
tcttggaggcagtaactgagcaacatattccccgacaaaaaagggttgttgaagtaactgttacataga

SEQ ID NO: 6836343 - DNA, 63 bp, Homo sapiens
acggaggccacgttctcagccaccgtgccactctgcatgtcagctggctgggcgtgcctccgt

SEQ ID NO: 6836344 - DNA, 85 bp, Homo sapiens
gacagaaggaaacccaaattcttcatatcgggacttgttaccactgaataatgtctttgcaggagggattggtttagattttgtt

SEQ ID NO: 6836345 - DNA, 66 bp, Homo sapiens
ggggatggggggtgtctgagcttttgggtcctggaagacgtagaggaggcaaggccctccctcccc

SEQ ID NO: 6836346 - DNA, 82 bp, Homo sapiens
cttcatggcctgcagtgctgccacagccccgccaccctccacgatgatgcggctgttgtcgggcttacgcagggccaggaag

SEQ ID NO: 6836347 - DNA, 89 bp, Homo sapiens
attatctcttagaaactccagaagctactgggatattaattagttcagtagttaatatcaaggaagtttagagagttgtgagttttaat

SEQ ID NO: 6836348 - DNA, 78 bp, Homo sapiens
ggtaattgaggcactctgtacaaatctgcaggtaaatgtcaagcacactgacagggcatggtgcagagttctgaggcc

SEQ ID NO: 6836349 - DNA, 77 bp, Homo sapiens
gaaacatacagataattagcataaatgctgctggcccttgtgttctgagcattgatgctaattttttggtttgtttc

SEQ ID NO: 6836350 - DNA, 88 bp, Homo sapiens
gggaactgtgtcttagaggaggtccttttctgatgtgggtatcctccagagttggttgacatcctccctttctgggaatatacttccc

SEQ ID NO: 6836351 - DNA, 125 bp, Homo sapiens
accaaagcaggaggccaacaaacgacgggatcagggcatgggcgcccggtggggcctggccatggggctggctctgcgtctgttcgtggggtcctggcacatcccgtccatctccttcttgcggt

SEQ ID NO: 6836352 - DNA, 59 bp, Homo sapiens
cagggtggtggtagttgttttaatatgtgaaaatgtagcttttaaacatcactattttg

SEQ ID NO: 6836353 - DNA, 55 bp, Homo sapiens
gttccaggcagtggcaacagctggtgcaagctctgaggtggccgcggcctggcac

SEQ ID NO: 6836354 - DNA, 117 bp, Homo sapiens
gtctgtctgttgctttttcaggactgcttagtggtgtgcaaaggggtgttcccaggccttaacatctaccctgtggatatcactattttggaagcctattagtagcagcagttagac

SEQ ID NO: 6836355 - DNA, 129 bp, Homo sapiens
gcatgttcaatatcctagcatatggaccagtggttgaggttccatggtataggccattgggggcagctgcatagctcctccctgtaccattcctctgctccattttattatgtattgcgttggacttgt

SEQ ID NO: 6836356 - DNA, 59 bp, Homo sapiens
ttgcacagatgcacatggttgcctggagtctatcgtacaatcatgtgcactgctgacag

SEQ ID NO: 6836357 - DNA, 117 bp, Homo sapiens
ggcattggcaatggggcatgcgccctttgtggtcagaggcctggttctgcaaacactgcctgcagctatggatgccagctgccataagagcagcctttctgccccgttgctattgct

SEQ ID NO: 6836358 - DNA, 60 bp, Homo sapiens
gggctgacaatctctttacttaccttggccaaaagatgtgatggaagtgactgtcagttc

SEQ ID NO: 6836359 - DNA, 76 bp, Homo sapiens
ttgatgtttcagaggaggaaggcagttaggggaatattttcctccctaacattttatccctgctgaaataagtcaa

SEQ ID NO: 6836360 - DNA, 70 bp, Homo sapiens
agctagtaaggaataaattatgattttgaataacaatatcaagaatgttcattcttctaatgtgctagct

SEQ ID NO: 6836361 - DNA, 55 bp, Homo sapiens
ggttaaagtaggtcacatatatacagtagcagctgtaaataagcttacttgaact

SEQ ID NO: 6836362 - DNA, 71 bp, Homo sapiens
cgaggtctacattttgtgattatgaaatattaacatatattttactctctctactgatgtctaggaccttg

SEQ ID NO: 6836363 - DNA, 67 bp, Homo sapiens
tctggaatgcggagagttggagaatcagataaaagtcgaggtatctctctcttcagcagcttccaga

SEQ ID NO: 6836364 - DNA, 68 bp, Homo sapiens
catgaaatcaaccatatatttgatgggggtagggtcagccttcatagattaactggatgaggttcgtg

SEQ ID NO: 6836365 - DNA, 93 bp, Homo sapiens
atatgctttccatttttgtatgatcaaaagaaatgtacttatattttaaaagtaacattttattttaattatgtggtatgtgggggggtgtat

SEQ ID NO: 6836366 - DNA, 102 bp, Homo sapiens
caggtttcctggaggcaaaccctggtgtcaggttctttaattctgcacggctactgtgcagtggaggacactggggccacagtacaatcttgaggtcacctg

SEQ ID NO: 6836367 - DNA, 70 bp, Homo sapiens
cactttgggaggctgaggcggatggatcacttgaggtaaggagttcgagaccagcctggccaacatggtg

SEQ ID NO: 6836368 - DNA, 78 bp, Homo sapiens
ctctctgggtgcagcgctgaccggttcatcattaatcattacaatctgatctcccgggatcagcttgccttcagaggg

SEQ ID NO: 6836369 - DNA, 64 bp, Homo sapiens
ggcaggggagcagtaacaacttggtcctgagcctgagctgctgcaggatttactactacctgct

SEQ ID NO: 6836370 - DNA, 79 bp, Homo sapiens
ctgaggcttaatgagttaaatcacttgccgaatatcatggtttgaaaatggcagaagtgaattaaaaagtgggcctgag

SEQ ID NO: 6836371 - DNA, 67 bp, Homo sapiens
gcatcttgcatgtatctgcctgccgtatgccaagcatgggctaagtacaagggatacagcagtgagc

SEQ ID NO: 6836372 - DNA, 87 bp, Homo sapiens
tcccaatgacttttaagagagcttcatgattgctttgcttccatgggatttggatcaagataaaaaatgagcccaaggttatttgga

SEQ ID NO: 6836373 - DNA, 63 bp, Homo sapiens
caaaggctggattcagagaggtgaattctaaattactttcgccatctggcactagagtcattg

SEQ ID NO: 6836374 - DNA, 65 bp, Homo sapiens
gtggcccaggctggagtgcagtggcacaatctcggctcactgcaagctccgcctctggggttcac

SEQ ID NO: 6836375 - DNA, 73 bp, Homo sapiens
ggagggaggcttgggccacctggagggactgggcactctgagtagtaccctctgggaggctgtaccccctttc

SEQ ID NO: 6836376 - DNA, 91 bp, Homo sapiens
tgctaaaatataaatttgacacagtgaagctcagcataaatttattcaatagatttgtcagctcagtctttattgtcaggttcttgtagca

SEQ ID NO: 6836377 - DNA, 108 bp, Homo sapiens
acaatgacctgctccatcagatgacgtgtcactttgtaagaactggtacatagtaggcactgatttgttgcagagtgagatgtactttttgaacagcaggcttgctgt

SEQ ID NO: 6836378 - DNA, 69 bp, Homo sapiens
ctctgcacgtataatcagtctgtttctccaaattaggaggttcgagcagagtgtttgttacttgtagag

SEQ ID NO: 6836379 - DNA, 59 bp, Homo sapiens
tgtgttggatgtacatatgtctgttagcttttagtggcagacagagtgcagtctacata

SEQ ID NO: 6836380 - DNA, 110 bp, Homo sapiens
agaaatgaattaatgaaaaatactggagtgataagttttatattatgatcccaagagatgttatgatacaagcaaaactaatcaatgtagattattcagttattatttct

SEQ ID NO: 6836381 - DNA, 71 bp, Homo sapiens
agaagaataatttgtggcatgtgaaaatgacaagaaagtcaaatgtcagtgtccataaataaagttttatt

SEQ ID NO: 6836382 - DNA, 62 bp, Homo sapiens
gcagggccagccccaccctctctggttggctgaaactagaatggcgtgaggtttggctgagc

SEQ ID NO: 6836383 - DNA, 59 bp, Homo sapiens
aggagaaatccatcgagaatgggccgtttgctagttcattcgtttggtgactttttcct

SEQ ID NO: 6836384 - DNA, 85 bp, Homo sapiens
gccaggcaagatggactgtttatgctgggctctggatgatctcagaaggaggcctgcagcaggagcaaacccatcttcgtcaggc

SEQ ID NO: 6836385 - DNA, 74 bp, Homo sapiens
ttggaaataacatgctatgtgtctgaatcacatacagtcatctgtgattagtcaatagctatgtgtcaacccaa

SEQ ID NO: 6836386 - DNA, 84 bp, Homo sapiens
catgaggttcttaagtctggatatatctactgacacaatctgtctgcaggtttcagataaatatgggactaaagtagcttaatg

SEQ ID NO: 6836387 - DNA, 60 bp, Homo sapiens
gagtcagtagtcacccagttgcagagagcagaagatttctcactggaatacaattgattt

SEQ ID NO: 6836388 - DNA, 72 bp, Homo sapiens
atgcagccatctttggaagtggttggagtagcaacacaggtgtgaagtcctcctgaccactcctggctttat

SEQ ID NO: 6836389 - DNA, 78 bp, Homo sapiens
caagcttcttgtgtacgttccactcccctgggttcacgttctcagggagaaaattggatgcacaaagaatggagtttg

SEQ ID NO: 6836390 - DNA, 72 bp, Homo sapiens
tctagctgcttgaaataccatagtgaataaggcagacacagttttactcttatggaaattttaactagcaga

SEQ ID NO: 6836391 - DNA, 64 bp, Homo sapiens
ggggacaggatgagaggcccagggaagactaggccctcttctttctccttctctcctctgcccc

SEQ ID NO: 6836392 - DNA, 79 bp, Homo sapiens
gggtgaaactgatgaattttgttactaagggcccagaatatagaacaaaacctcagaggcatcattcatagttacattc

SEQ ID NO: 6836393 - DNA, 56 bp, Homo sapiens
ggagttggtggagaagttagggtttctgtcctgtctgtcctgtacccagcatctcc

SEQ ID NO: 6836394 - DNA, 59 bp, Homo sapiens
ctagagtcctcctggaaaaggtacttctgatgtaaaagacctcagggaaaggtttctag

SEQ ID NO: 6836395 - DNA, 87 bp, Homo sapiens
cccgtttcctaccctggccccgttatgcgtacatggtctataaaagaatcatgtgaagtggggggttgaggattgtacagaaatggg

SEQ ID NO: 6836396 - DNA, 55 bp, Homo sapiens
ggcatacggtttgttcactgaagagaaaaaagttctctgaacaaaatgtaatgtc

SEQ ID NO: 6836397 - DNA, 62 bp, Homo sapiens
cccagaatgcttttccagctcactgctatttaatctaagtcagctggtgtcagagctctggg

SEQ ID NO: 6836398 - DNA, 69 bp, Homo sapiens
gaggaccaagataagagacaagatttatgactagactatatagataattgtttcaatatctttttcttc

SEQ ID NO: 6836399 - DNA, 60 bp, Homo sapiens
gggcttagcctggactggtgagcaggtggccagcagctgctcccttgacagagcaagttt

SEQ ID NO: 6836400 - DNA, 81 bp, Homo sapiens
gccgatgtaagtgacagagccaggtcttgaactcaggccaccctgactccaaagtttgggctcttccctaccaatccaggc

SEQ ID NO: 6836401 - DNA, 75 bp, Homo sapiens
ttggctggggcccggcctgtctccctagacctttttctctgtgagaggagaccaggtctttatggctccaactaa

SEQ ID NO: 6836402 - DNA, 76 bp, Homo sapiens
tttgttttgcagtttgcaaatgacttacagagctcttctggcagggtttctgtttctccacttgcaaataaacaaa

SEQ ID NO: 6836403 - DNA, 89 bp, Homo sapiens
ccatcacatgcggtccccagtgtggctgcaggggccacttaggattcttctgttcggggtcccaggccacacttggggaaccctattgg

SEQ ID NO: 6836404 - DNA, 67 bp, Homo sapiens
gtagatggaggggctgcagggcggccgaggatgaggccggccggctgggcggggacccctccgctgc

SEQ ID NO: 6836405 - DNA, 77 bp, Homo sapiens
tcgctcttgtggcccaggctggagtgcggtggtgtgacctcggctcactgcatcctccgcctcccgggttcaagtga

SEQ ID NO: 6836406 - DNA, 80 bp, Homo sapiens
gtaggatgtcaaggatttaggattttattctaatcccaggaggaatcttaaatcggaatcttaagtctattttcatttac

SEQ ID NO: 6836407 - DNA, 118 bp, Homo sapiens
cctccttcctactgctggggcagtaccaggactactgtccatggtgctggacggtctcaccactgtccatggtgctggacggtctcaccctggtcccccagactcaggcggtcggagg

SEQ ID NO: 6836408 - DNA, 86 bp, Homo sapiens
ggctgcccagtctggtcatgtcagctgttgatgtgcagggagcccctgctgcacagcccgctggcccagagatcatgcaggtagtc

SEQ ID NO: 6836409 - DNA, 79 bp, Homo sapiens
tcaactcatttattcaattttctttaggcttcttcaatgtctttaaagcaaaatgtaagaaaacggatgattgagttga

SEQ ID NO: 6836410 - DNA, 61 bp, Homo sapiens
gcagattggagacagatgggctccagcattatccatgtgtgaggtcattgtcccaggcagc

SEQ ID NO: 6836411 - DNA, 59 bp, Homo sapiens
gcaggatgccagggcagcagcgtgtgttaggacgctgacccaggccttgcattgcctgc

SEQ ID NO: 6836412 - DNA, 63 bp, Homo sapiens
caggtctgcaccattcccaagggttgctgtgcacagccttttctaaggtatggtttatacctg

SEQ ID NO: 6836413 - DNA, 56 bp, Homo sapiens
actacagtaagggaggcagcattggaacccagctctaaccctccatttgctgtagt

SEQ ID NO: 6836414 - DNA, 62 bp, Homo sapiens
gacaggctttctcaggatgagctataaaaagaagcacctgtagatagaagccaacatatgtc

SEQ ID NO: 6836415 - DNA, 59 bp, Homo sapiens
aaggaaatcagggggctctagagtctggctatgtgattttctcaggccccagttttctt

SEQ ID NO: 6836416 - DNA, 67 bp, Homo sapiens
ggagggaccagcgtgagtctgaggcttgggttttgccatctgtgtcaaggacagggctggtccatct

SEQ ID NO: 6836417 - DNA, 55 bp, Homo sapiens
tgagctgtaaggctgtcactgaacataagtggacatgaccagtctggcagagtca

SEQ ID NO: 6836418 - DNA, 79 bp, Homo sapiens
agttcaattaagtttatgaggaaaagttatgattgtcatgttactaattgtatcactttttccttatatgttgtgaatt

SEQ ID NO: 6836419 - DNA, 122 bp, Homo sapiens
gccttttgcatcctagagagcccagaggaatcagagaaggtgtccatcaccaactgttcttggtaacatgcagaggagatgaagatactttccttagggtggtgggaaactttgatgaaggt

SEQ ID NO: 6836420 - DNA, 55 bp, Homo sapiens
gccctaatagttctgtctttggggatgacattatctggggcagagctgacagggc

SEQ ID NO: 6836421 - DNA, 62 bp, Homo sapiens
gtgtgaccttatttggaaatagggtctttgcagatgtaatcaagtttaagatgaggtcatac

SEQ ID NO: 6836422 - DNA, 57 bp, Homo sapiens
ggcaccgtgaccaccctggccctggctctacgtttcggaggctctgggcatggcgcc

SEQ ID NO: 6836423 - DNA, 124 bp, Homo sapiens
tagttccttaggaaagatttccacatgtcaaattactcagtctgaggataggaacagatttaaggcgttatgggaaacctaagaaagtttgtttttatccataagacagtcattcctacaacta

SEQ ID NO: 6836424 - DNA, 125 bp, Homo sapiens
agtgtgggtgtggactccaggctgtcccacagcagaacaggcagggaagcttgtgtaaccccaacaaataaatcaagtactgtgtgcttctgctttgaggcctgttgccatgtggaacccacgct

SEQ ID NO: 6836425 - DNA, 61 bp, Homo sapiens
aagttcagatttgactggtttctcatgagccacatgtgggaatgtagcaaatctgcaattt

SEQ ID NO: 6836426 - DNA, 81 bp, Homo sapiens
gacgtccgtgccccagttgctggcacctgtgagtatgttatgctttgtggcaacaggggctttgcagaaggaatggaggtt

SEQ ID NO: 6836427 - DNA, 73 bp, Homo sapiens
acggtgcccagggactctgagagcctgagggtggcacgtcacctcgggggccattgggagccctggatgctgt

SEQ ID NO: 6836428 - DNA, 56 bp, Homo sapiens
tcagagataatgaacatggctttggaaagctgaaaactgatgtatattaactctga

SEQ ID NO: 6836429 - DNA, 55 bp, Homo sapiens
gttcctgttgatttcccaggaggccctttcttcttctgctgaagtcactgggagc

SEQ ID NO: 6836430 - DNA, 78 bp, Homo sapiens
ctgtcttgggaggctgtctgttagcctgggaggctgtctgttttcccttcccagagctcccaatagcccccagcccag

SEQ ID NO: 6836431 - DNA, 55 bp, Homo sapiens
acctgtacaattcctgcactgaccgacacaggtttagctggtagcagggacaggt

SEQ ID NO: 6836432 - DNA, 79 bp, Homo sapiens
gtagtatttcaggattttatgagatagtttgtttactttaagtagaaatttctcattattttataaacttggattctac

SEQ ID NO: 6836433 - DNA, 63 bp, Homo sapiens
tctgtcttagccatctcaggctgctctaacaaaataccatgtccaggtggctgaaactacaga

SEQ ID NO: 6836434 - DNA, 82 bp, Homo sapiens
ttcttttttccatgtgaacaggtatgtcattccttcccaaggtagtaaacatagaatgttcttcctacctggattgagagaa

SEQ ID NO: 6836435 - DNA, 60 bp, Homo sapiens
aagttaactctgaggaggcagaaaacatgatttgttaactgctggcctcaagggtgactt

SEQ ID NO: 6836436 - DNA, 57 bp, Homo sapiens
tcagattttccagcctttctctcctagcaaaggccagataaggctgtgatagtctga

SEQ ID NO: 6836437 - DNA, 58 bp, Homo sapiens
gcagctcaagagaggtgctatgaggaactgcggaaactcatagggcctaaagagcagc

SEQ ID NO: 6836438 - DNA, 66 bp, Homo sapiens
ctccagtttacagggttgcttttggatgggtgaagccaagtcacaagcatacctgtgatttgagag

SEQ ID NO: 6836439 - DNA, 66 bp, Homo sapiens
agcagctctggcactgtagcatttctgtggtcagggaagagtttgcacagtgtccatacaggtgtt

SEQ ID NO: 6836440 - DNA, 68 bp, Homo sapiens
ctagtgtttgtttgggtagctagactggatgaaatataaaattatgtctagtatgcgaacaagactag

SEQ ID NO: 6836441 - DNA, 69 bp, Homo sapiens
tctgccatcttaattctcttttgtcttgtaacataacacattcgcaggttctggggattaggatgtaga

SEQ ID NO: 6836442 - DNA, 55 bp, Homo sapiens
gtaggtacttaggattagttctcagtttttactgttagatctctgcagtgcctac

SEQ ID NO: 6836443 - DNA, 75 bp, Homo sapiens
gcctcctggcacctctgagcaaacaggggctgcccacctcttggtccctacccagctcgggggtccacaggaggc

SEQ ID NO: 6836444 - DNA, 55 bp, Homo sapiens
taggatgggcttcctgcagctgacatgtgtacacacaacagtgaggcccagcctg

SEQ ID NO: 6836445 - DNA, 66 bp, Homo sapiens
cccttggatttggaactcatagacatgcagaggggcattctgggtggtgtcttccaagaccaaagg

SEQ ID NO: 6836446 - DNA, 64 bp, Homo sapiens
tcaagtgatcaaagtgctggaattacaggcgtgagccactgtgctggcctttggtgacttctga

SEQ ID NO: 6836447 - DNA, 65 bp, Homo sapiens
gagaatatcttggcagtctctgtcaatcacatttggaccatcacaggaactgccaagatattctc

SEQ ID NO: 6836448 - DNA, 130 bp, Homo sapiens
attaagtttcaacatatgaattttggatgacaaattcagaccatagcatatacagttggtgggttgtggtctgctatggactgaatgtttgtatccccttccccctaattttatatattgaagtgctaat

SEQ ID NO: 6836449 - DNA, 58 bp, Homo sapiens
ggctcgctggggccatttcccatctggcagtagcccagtatgtgtccccccaggagcc

SEQ ID NO: 6836450 - DNA, 86 bp, Homo sapiens
gcccctggagtcctcggttcctgcgcccttctcgcccgcggcaccctctcgcgagtccactggggggcgcaggcgggctccagagc

SEQ ID NO: 6836451 - DNA, 64 bp, Homo sapiens
cagagcccctcgtctccaccaccagcttctgctccacggcagggtaataggcgcggggcttctg

SEQ ID NO: 6836452 - DNA, 56 bp, Homo sapiens
gttctgggtgatgaggttggctttggactttaattgcttcccttgttaaccagaat

SEQ ID NO: 6836453 - DNA, 59 bp, Homo sapiens
ccagctagtgaggggtggaggcgggatttgaatccagctcatctgtctccattacctgg

SEQ ID NO: 6836454 - DNA, 63 bp, Homo sapiens
tgtgttgtgtcacctatcatgcgcagggctgctatccatgacctgattttctgaaacagcaca

SEQ ID NO: 6836455 - DNA, 117 bp, Homo sapiens
gagtagtgagggactgctggggccccaggagtaaagtgcccagggaaagcgggcttctgcggtttaaccatcccagaatccctgtccctcttttggggagccatccctcacctgctc

SEQ ID NO: 6836456 - DNA, 78 bp, Homo sapiens
gtgaagactttgattgttagagatctctttcctgtggctgttatggttacagagggcttctctgaacttcagtctcat

SEQ ID NO: 6836457 - DNA, 93 bp, Homo sapiens
gtgtgttattcctacttgcagatgagaaactgaagctccgctaggttaagtaagctgttccaggcctcattgctagttgggatccaaactcac

SEQ ID NO: 6836458 - DNA, 60 bp, Homo sapiens
ggtcagccctgcggaggtgtatactgtggtggcagccactcctcttcagcagggaaaacc

SEQ ID NO: 6836459 - DNA, 130 bp, Homo sapiens
tgggtacggataatctttgttcttaaataaggtttagacagcagagaactttagagggtggctgttagcccgttagccttacgtaagactttgctgtgaaccttttaaagtttttaattcttctggcaca

SEQ ID NO: 6836460 - DNA, 65 bp, Homo sapiens
ctctcctcttggctttgtgccttctttcagcttagctgcaaagcagggatgaggctagaggggag

SEQ ID NO: 6836461 - DNA, 129 bp, Homo sapiens
ttccgcccggctcccggcaagggtcccccgactggcgcccgcgcgtcctccctcggctgctgcaggccgggccgcggcgtcgagcgggggcggcggggcggggcccgcagccattggcgagcggcgggg

SEQ ID NO: 6836462 - DNA, 77 bp, Homo sapiens
ggtggggagaagagctcagcactaaaatcatgtgttccatttggggcacatcgagtctgagttgctatgagaccacc

SEQ ID NO: 6836463 - DNA, 70 bp, Homo sapiens
caggtggcaggtaggccagacctccaagcccagaggcctccccaggttgcctggcccatctaccgctctg

SEQ ID NO: 6836464 - DNA, 71 bp, Homo sapiens
ggcagtgggctgtgtggaggggatggctggaggtggaagtctacgggcagatcacacagggcttgtatgcc

SEQ ID NO: 6836465 - DNA, 83 bp, Homo sapiens
cagtattttatcaatgtggttaaaatttggttgtctgtgtttattcagaaaactcagtagtggcaacagccagaaaaatagtg

SEQ ID NO: 6836466 - DNA, 55 bp, Homo sapiens
tgttccaggctgcaagcatcatgggatcatctgatatacagcaaagtctggagca

SEQ ID NO: 6836467 - DNA, 62 bp, Homo sapiens
ggccttccacggagaacgaccgagggtataaagtgaaggccctgggctttgctggcaaggcc

SEQ ID NO: 6836468 - DNA, 56 bp, Homo sapiens
aaagtgttgggattataggcgtgaaccaccatgcctagcctgtcttcgtatacttt

SEQ ID NO: 6836469 - DNA, 68 bp, Homo sapiens
atggctccccactgccctcatgagaaaggcctcaacacaaagccagccttctccagtgcggtagccat

SEQ ID NO: 6836470 - DNA, 109 bp, Homo sapiens
gtcatagaaagattgtgctttttgacttttatcaaggaagtgatctttgctataaaatcaaattaaccttatgatagaactgtacgagctgtttaatttttcagattac

SEQ ID NO: 6836471 - DNA, 61 bp, Homo sapiens
gctggtaggagagggcttaggggactttatggaattcccagagatttcctctccttcctgc

SEQ ID NO: 6836472 - DNA, 74 bp, Homo sapiens
ttggtactagcctaaatatgactataccaacttaccaatataatccggtacttcaattattttggctatgctaa

SEQ ID NO: 6836473 - DNA, 71 bp, Homo sapiens
cttttttgggttattatctcagtgtctcatcttagccacaggccattgcactggggtcatagcctccagag

SEQ ID NO: 6836474 - DNA, 74 bp, Homo sapiens
gtttggaatattgagaaagtgaatttgagaaaactctcatcacctgaggtttactttttaaaaaatatccagac

SEQ ID NO: 6836475 - DNA, 92 bp, Homo sapiens
ggaggaaagcaacatctccacatatggtgagcagcgtcccgaccatgggcctcgacggcctggagtggtcctgctgcccgtgtgtggcttcc

SEQ ID NO: 6836476 - DNA, 71 bp, Homo sapiens
gaagattaaacaaaataatggatttggggcttagcaagctcctagtacacactattatttgttttatcatc

SEQ ID NO: 6836477 - DNA, 89 bp, Homo sapiens
ggagtaaagcacttttacatgtaggtgacattttaatatagtgcaaagaactgtatgttaggaagacacttaccatggggctttaagcc

SEQ ID NO: 6836478 - DNA, 128 bp, Homo sapiens
ctgtctctgtctaggagaacagctatggtgcagaatggaagcatcaacatatgtgttaagcacatgtgtattaccctttcattcctgtctcacgtagaaggtaaatcacttcttctagacggcaacag

SEQ ID NO: 6836479 - DNA, 67 bp, Homo sapiens
tttactgttacacctaccttcttggaaagggctatgaactcaagacatgggtgagagtgacagtgaa

SEQ ID NO: 6836480 - DNA, 75 bp, Homo sapiens
gagatcataataatagcagtagctgccactgaggcctggccctgtgccagatgctgctttgttttgcatggtttc

SEQ ID NO: 6836481 - DNA, 70 bp, Homo sapiens
gcaggtgagtaagagcaggaattagactcctggtctgccaggggtctggctcccactcttacaaatgtgc

SEQ ID NO: 6836482 - DNA, 75 bp, Homo sapiens
atagtggaaactggagggaagagggcttgaggggacatacgggaactctctgtaattcctgttcagtttttctgt

SEQ ID NO: 6836483 - DNA, 55 bp, Homo sapiens
caatttatagattggtgccaaagtggcttacatattggtatcaattactagattg

SEQ ID NO: 6836484 - DNA, 90 bp, Homo sapiens
ttgattttgttggagtgaggtcaaagccttgggtatataaagcaattaatacctttaggcattttgcatcaatcactggagcatcatcaa

SEQ ID NO: 6836485 - DNA, 79 bp, Homo sapiens
ctgccctgctcctcagcccttctttgcagggtggactctgcctgaattgcataatgaaggctgtcagagaggagggcag

SEQ ID NO: 6836486 - DNA, 80 bp, Homo sapiens
agagacattcaaaattgtggtttagatatgatgaaccagaaaaaaatgttgttttttagtccactttttgaaaagtctct

SEQ ID NO: 6836487 - DNA, 80 bp, Homo sapiens
gttgtggttgccaaagcagtttactgtcaataactcttccaaataattgaagtgttactgatcgtagattcagaaacagc

SEQ ID NO: 6836488 - DNA, 61 bp, Homo sapiens
tatgatcccttttgaaataagcttttacacatttctaatgctttcttcagagcggctcata

SEQ ID NO: 6836489 - DNA, 59 bp, Homo sapiens
gcctagagaaaaagcctctgcagcgtgatgtgatgtggacaggctattttcttacgggt

SEQ ID NO: 6836490 - DNA, 65 bp, Homo sapiens
tattatgggcctagtgcagttaaattgcctgacacagtagggaatctatacttaggctggtaata

SEQ ID NO: 6836491 - DNA, 60 bp, Homo sapiens
atgtgtccattatcagttctggttgttacaatgatcaaattaactggataatggccacat

SEQ ID NO: 6836492 - DNA, 73 bp, Homo sapiens
cgccatagtgaattgtctcagacgttgatagatgaagtgtctgcgtgggagtaatacagcttctttatgaacg

SEQ ID NO: 6836493 - DNA, 62 bp, Homo sapiens
ttcttggcctgctccagaacaaggggcgagtctatgcactcctggagcagcaggcgcaggga

SEQ ID NO: 6836494 - DNA, 65 bp, Homo sapiens
cttggcatgtgtgtgtaggatacaggcaattgtaaatctgtatcaaaaatcaagcacagcaggag

SEQ ID NO: 6836495 - DNA, 71 bp, Homo sapiens
tcaccaagggttggaggtagccagggagggcccactttctgggtttatgtcacagctttgcaccttggagg

SEQ ID NO: 6836496 - DNA, 123 bp, Homo sapiens
aagttaagcacctttggaagctgcattaattcattcaggtcaccagggtacctcagcagtaatgcactaaatggtaccctgctgacctgaaagagggaatgtgcctccctaagcatttaactt

SEQ ID NO: 6836497 - DNA, 58 bp, Homo sapiens
ctttgggcaaagggccaattcgggatgcgtttctctctgatttggagccatgccaaag

SEQ ID NO: 6836498 - DNA, 56 bp, Homo sapiens
ttattcatcagttgctggacgttgggtttctttctattggcggctattatgaataa

SEQ ID NO: 6836499 - DNA, 61 bp, Homo sapiens
gaagggtctttatgcaaatacctttcaggaaggcgtgcgcctcacctgtgtttgctccttc

SEQ ID NO: 6836500 - DNA, 64 bp, Homo sapiens
gttatgtaagtttctgaaaaaactgggcaatggatttgtcttactttttctgggcttccatagc

SEQ ID NO: 6836501 - DNA, 84 bp, Homo sapiens
gagaaagtactttagagtaaaatagacctatattaagatcccgatctacattggctggctatttgaccttggagaccttatttc

SEQ ID NO: 6836502 - DNA, 69 bp, Homo sapiens
ggttgaaaacaaatttctaataaagtatttggtagggcaaagccagttcatacacttagaaattcagcc

SEQ ID NO: 6836503 - DNA, 78 bp, Homo sapiens
ggcttctggtgaaatatactagatgatgacccattttaggacctatttggttgtgttatttaggtgttttcaaaagcc

SEQ ID NO: 6836504 - DNA, 71 bp, Homo sapiens
gagagatgatggctctcttgacctaggcacaagttatacttgctgcctacatttcagtgagccttactctc

SEQ ID NO: 6836505 - DNA, 130 bp, Homo sapiens
ggtgtgagccaggcagccacagtggtcagcaaagagaagtgggcagtgcgctcggatgcggctcagggcaaggggcccggcgctggcacagcccgctcccactgccccgcacaggcacgcggctcacacc

SEQ ID NO: 6836506 - DNA, 63 bp, Homo sapiens
cagggttctgcatcgcctcgaacccgcaggccgtggcgggttctcctgaggaagcagggactg

SEQ ID NO: 6836507 - DNA, 64 bp, Homo sapiens
tccataaagagctgggcttagacaggtgcattggctcaacatctgtaatcccagcactttggga

SEQ ID NO: 6836508 - DNA, 60 bp, Homo sapiens
ctcggtggccacatgcgtctgtgaggcaggacactgcctggagctcatgtgggcattaag

SEQ ID NO: 6836509 - DNA, 75 bp, Homo sapiens
gcctctttctgtccaagcacatactcctacacactcatgcctacccatgggagcatgcccctcacaggaacaggc

SEQ ID NO: 6836510 - DNA, 76 bp, Homo sapiens
gttgtacagcattgtgtcttcactcagcaatgagcatgtgctttcagctgggtttgacatcaatacacctgacaac

SEQ ID NO: 6836511 - DNA, 62 bp, Homo sapiens
ccatccccactgcttctcatcaagtagctctagcctcagatcttgcagcagtgaggtgaagg

SEQ ID NO: 6836512 - DNA, 79 bp, Homo sapiens
tcttcaaagtctggttgctaagatagaggctggtttccttaaatgccactttggatctgatgtaatcagctgtggcaga

SEQ ID NO: 6836513 - DNA, 111 bp, Homo sapiens
gggattagtgagaaggccttgttcaccatgggatgacaacagttgtacaactcgaaaactgttggcttctggtagtgaccatgcatggcgccaagctcaccccctaatccc

SEQ ID NO: 6836514 - DNA, 67 bp, Homo sapiens
ggtacagcatttgaaattactggaatatgacaagtgctgctgtccccatgtctttggaatgctgacc

SEQ ID NO: 6836515 - DNA, 70 bp, Homo sapiens
tcaaaaataatgaggtcatgagggctgtttcaaaattaatacaattctctcatatcttattactaagtga

SEQ ID NO: 6836516 - DNA, 76 bp, Homo sapiens
gttgatggaggagatggcagggtgcaccatgaacttaagcagctgctccaaggctgccttgccctcttcccatagc

SEQ ID NO: 6836517 - DNA, 63 bp, Homo sapiens
tcactatattcatttttggtagatggaggatccagagtgtgacagaaatatgaatgatggtga

SEQ ID NO: 6836518 - DNA, 79 bp, Homo sapiens
catgcacatcttacagatgcagagatcatgacttcggtggatgagactaatctgtatgaagctgtaggatatatgtatg

SEQ ID NO: 6836519 - DNA, 69 bp, Homo sapiens
aggcactgtgcttcttatatgttttcttatttaattcccaagtcctacaagggaagcacattattgcct

SEQ ID NO: 6836520 - DNA, 66 bp, Homo sapiens
cttttctgatattcataggcaggtatttaattttactaattagcatcctgtgtgaatgtattaaag

SEQ ID NO: 6836521 - DNA, 81 bp, Homo sapiens
ggctcctcaacccacccacctgccctttcttgctccaccagcaggagagcaagaaagggtaggtgggtgggttgaggggct

SEQ ID NO: 6836522 - DNA, 58 bp, Homo sapiens
caaatagtatgagcaatgattctgggtttcagcctcattgcctggtttatactgtatg

SEQ ID NO: 6836523 - DNA, 57 bp, Homo sapiens
cgaggtagtggcggccgcggcccaccaccaactgctcgccaccgaccccactactcg

SEQ ID NO: 6836524 - DNA, 62 bp, Homo sapiens
tcaggctaaccctaggcagaagtattaatagtcgctaacgttcgctctgggttaagcactgg

SEQ ID NO: 6836525 - DNA, 95 bp, Homo sapiens
gagacagaactgcttgaacccaggaggctgaggttgcagtgagccaggatcttggccactgctctccagcctgggtgacagagtgagcctgtctc

SEQ ID NO: 6836526 - DNA, 80 bp, Homo sapiens
gcctcctgctctgctgtgccgccagggcctcccctagcgcgccttctggagaggctttgtgcggatacggggctggaggc

SEQ ID NO: 6836527 - DNA, 70 bp, Homo sapiens
agaagaatatataatgattttgtcagctaaaagttgggctgagagagacatcactcatttatgtttgcct

SEQ ID NO: 6836528 - DNA, 55 bp, Homo sapiens
gtgcagtcagtactctgtagcggttaaaagcatagaccctagagtaagactgcat

SEQ ID NO: 6836529 - DNA, 85 bp, Homo sapiens
caccccttccctgggcactcagatggcaccgagtccctcaaggctctgagggcagctaaggtgctgactggaggctgaaggactg

SEQ ID NO: 6836530 - DNA, 67 bp, Homo sapiens
tatgcaccttcctcaagttatttcagataaatgcctggaggatctgattgacctgtgaagcagcatg

SEQ ID NO: 6836531 - DNA, 56 bp, Homo sapiens
tttcataaccagctctagccagttgtagtcacagcatggagtgctgtgttgagaag

SEQ ID NO: 6836532 - DNA, 68 bp, Homo sapiens
cacattgttaatcacaaagataagcctgtttgagagggcactgggctttgtagttagcatcatctgtg

SEQ ID NO: 6836533 - DNA, 58 bp, Homo sapiens
acatgtgctcttgctgtacagccctggctaattagttgacagcattactaatacatgt

SEQ ID NO: 6836534 - DNA, 70 bp, Homo sapiens
gtcacctaattcacatgcatgtctgtgcacacacacatgcgtgcacacacacaaacgttgaggtgggtac

SEQ ID NO: 6836535 - DNA, 70 bp, Homo sapiens
ctgacggaactctggatctcatacacctcataattcctccaagatggctgaggtctggggcttctgcaag

SEQ ID NO: 6836536 - DNA, 57 bp, Homo sapiens
tctccagcatcagtcagattttgcttcttttccaagaaggatcatggtgctggcaga

SEQ ID NO: 6836537 - DNA, 74 bp, Homo sapiens
ggcaagtaatacaggattattttagagtagttactggaaaggtctcctaagtgaattcattgtgttatattgcc

SEQ ID NO: 6836538 - DNA, 62 bp, Homo sapiens
gttactacatttcatggtcttgttcaaagaattgcagagcaaaattgtcgaacagtagtaac

SEQ ID NO: 6836539 - DNA, 85 bp, Homo sapiens
ggaaaatcacttgagcccagagttcaaggctgcagtgagtttgatcataccattgcacttcagcctgggtgacagagtgagatcc

SEQ ID NO: 6836540 - DNA, 57 bp, Homo sapiens
tgtttgtagaaacaaaagagctatccatcactggggcagcttatactttcatagaca

SEQ ID NO: 6836541 - DNA, 59 bp, Homo sapiens
tccagcaggtgtctagcaagggtctactgtgtgctgggctctgtgctgggcctgcagga

SEQ ID NO: 6836542 - DNA, 69 bp, Homo sapiens
tttgcaaataccatgaaacttgagtgctgtgtgtgcatcattatgggcagtttccctgttatttgtaga

SEQ ID NO: 6836543 - DNA, 56 bp, Homo sapiens
caatcttagtggcttacaaagagttactgctctctcatgtgtgtccattgtgattg

SEQ ID NO: 6836544 - DNA, 55 bp, Homo sapiens
cagagcccagattggaatttcccacctaacaggtgggtaagaattgggggctctg

SEQ ID NO: 6836545 - DNA, 79 bp, Homo sapiens
gacgccttaaactttgttcgtccagactcaggcttgggttgggtgcttgagttgcagagatgacagagtttttgctgtc

SEQ ID NO: 6836546 - DNA, 65 bp, Homo sapiens
agattgccaggaaatagtgctgtgatcttacaaatttgagagtgtatctactttctggacagtct

SEQ ID NO: 6836547 - DNA, 72 bp, Homo sapiens
agctctgtcctcacaggcatctcatcaggctcctgaccctcagagttgcagcgtctaagtgagttcagacct

SEQ ID NO: 6836548 - DNA, 130 bp, Homo sapiens
gctctcccggatgtctgcgctgggtcccgcggcagcatgtctatgtctctggaaggagtgtgggcatcaagggcccagacagagatactatgttgtcagggcccagacagagatactatgttgtcagggc

SEQ ID NO: 6836549 - DNA, 73 bp, Homo sapiens
gaaatggttagaatcaagttgctcataactctggaaattaaccaaaggcctgcagcaaccttggaagcatttc

SEQ ID NO: 6836550 - DNA, 75 bp, Homo sapiens
ctcattagtacatgctcagtaactttcagttgtcaaccatgtcattgaaaggttttgagcagatattaggttgag

SEQ ID NO: 6836551 - DNA, 59 bp, Homo sapiens
gcgtgtatctggcatgtcgagtgtgcacatggcatatacggatcaaatcgggtgtgtgt

SEQ ID NO: 6836552 - DNA, 63 bp, Homo sapiens
tagtgcaatgtgaggcagtacccttaatggtaagagaaaggggagggttggaatattgcatta

SEQ ID NO: 6836553 - DNA, 65 bp, Homo sapiens
gtttgcaccatttcacttccattaaatatgtaagcagggttaaaggactgtgggtgtgtggaaac

SEQ ID NO: 6836554 - DNA, 64 bp, Homo sapiens
ctgcattcccaatgctgttctgagtctgcaggcgttgcctggacagggtaggcaggaagtgcag

SEQ ID NO: 6836555 - DNA, 67 bp, Homo sapiens
gtcccatctgatgtgcaaaaggcagacgtgaaggcaggtgctggagctgagagcacatagaaggggc

SEQ ID NO: 6836556 - DNA, 63 bp, Homo sapiens
acactgactgggcagtatagtcaacggttgtttagtgactgccttctatatgcttagtcttgt

SEQ ID NO: 6836557 - DNA, 59 bp, Homo sapiens
ctgcagcagtagtccccaagtgcattcatatattcaatgggaagtcactactgttacag

SEQ ID NO: 6836558 - DNA, 69 bp, Homo sapiens
atcctcatctggttttaggctgatccagaggccaaggtccccatggaacaaactggacaaagtgagggt

SEQ ID NO: 6836559 - DNA, 71 bp, Homo sapiens
acccattcccatcatggcctgagctagtgtttcaggtttactttagaatgctcttggccaagtggaagggt

SEQ ID NO: 6836560 - DNA, 63 bp, Homo sapiens
ctttgaaagttctaaaactctttgtgagctgaagttgcaggaggattttgtggagctggtgag

SEQ ID NO: 6836561 - DNA, 66 bp, Homo sapiens
ctggaagcttgtttgccagtctgttgttcacattatactcaagaccataggcagcaggctgcccag

SEQ ID NO: 6836562 - DNA, 63 bp, Homo sapiens
ataggaaagggagttttgcttatgaaatgcatgtgcctcacaacagtcactccctaagcctgt

SEQ ID NO: 6836563 - DNA, 58 bp, Homo sapiens
ttttcagatattctgctctgtcatcagctatagacactgacaggtatttatctggaaa

SEQ ID NO: 6836564 - DNA, 118 bp, Homo sapiens
gtgtctatctgaaaccacattttcacccttcgccactaagtgctgaattgtgctctttacatgtgagtaataatatagtgttgcttaatttagcaatggcttgtgatttcagagacat

SEQ ID NO: 6836565 - DNA, 58 bp, Homo sapiens
gattgtctgtgatcatgagcaacttgagttttgttgtcatctgtgttacaggcatatc

SEQ ID NO: 6836566 - DNA, 125 bp, Homo sapiens
gtccttgagcaacctggattctggtagtgagtggtgttttgggggtgctaggatcctggggacaattgggagctccccaagatgttgggtgcctccggaataacctgaagacaaggttggaggat

SEQ ID NO: 6836567 - DNA, 57 bp, Homo sapiens
ctgggacttgcagagcaggagggacctcaagaagttctcgttctgcaagcttcacag

SEQ ID NO: 6836568 - DNA, 70 bp, Homo sapiens
tctaaggatacaaggtggagtcaggaaaaggatgtccctttctccgttgcctccttgagcttccattaga

SEQ ID NO: 6836569 - DNA, 66 bp, Homo sapiens
gttcccacatctgttcttagttctgagttgccaggaatctgcagtgggaggataggatgtgagggc

SEQ ID NO: 6836570 - DNA, 57 bp, Homo sapiens
ttcctctaggatctgtggcatgggaacaagggtccagtttccaagatgatagaggga

SEQ ID NO: 6836571 - DNA, 105 bp, Homo sapiens
cttaaagcctgtttcagatttgatgtccacacattatgctcacctggcaacttgtatctttgcttttaagaagtgcagcaggtggcaggacatttaggctgtgag

SEQ ID NO: 6836572 - DNA, 88 bp, Homo sapiens
ggagtctcgctctgttgcccaggctggagcgcagtggcacgatcttggctcactgcaagctcagcctcccgggttcacgccattctcc

SEQ ID NO: 6836573 - DNA, 70 bp, Homo sapiens
agtgagtcagagccttgttccttgcctgtcacgcggatatagcagctttgaaacatggctctagactcct

SEQ ID NO: 6836574 - DNA, 84 bp, Homo sapiens
gatgaaagctgtggatcccttcagaaaaatgtgcaagtgctcatagttttgcatatatttctaaggaggttcatgaattttatt

SEQ ID NO: 6836575 - DNA, 88 bp, Homo sapiens
ggcacaacctccagggattcccagatggggcaaggccatctgtctcaggtgtgggactccctcaccccgtctgggcctggaaccggcc

SEQ ID NO: 6836576 - DNA, 64 bp, Homo sapiens
ggaagagtgcacaggacagggaattcgaaattccaaattagaatcttggctctgtttgtcttcc

SEQ ID NO: 6836577 - DNA, 75 bp, Homo sapiens
gaacagctacacatcaagtcttatggtcactttgaagagaataaagccagagggattcctggtgtgtctccgttc

SEQ ID NO: 6836578 - DNA, 60 bp, Homo sapiens
ctcagatatcttcataaggcagtggctctaaaccctggctgtacattggaattatctggg

SEQ ID NO: 6836579 - DNA, 68 bp, Homo sapiens
gtgtgcagtgtttgtccagtgtccagcttcatcccgtcatgggcagactggttatacacgggcaacac

SEQ ID NO: 6836580 - DNA, 63 bp, Homo sapiens
tcactgtttttcagaaggtaagggataaataatgtttgtcctttttatagttagagaaactga

SEQ ID NO: 6836581 - DNA, 64 bp, Homo sapiens
agtaacttgttttatcattgtatagctcttacattagggaattaaggtgaaaacacaagttgct

SEQ ID NO: 6836582 - DNA, 63 bp, Homo sapiens
agctgagacacggagaggctgtgtgatttttggctgatcacacagcctctctgtgtctctgct

SEQ ID NO: 6836583 - DNA, 72 bp, Homo sapiens
ctcctggggctctttgatgtgattcctgagctcccaagtgagccctcatcacatcctaggagaaccacggag

SEQ ID NO: 6836584 - DNA, 85 bp, Homo sapiens
gtcatgttggttgcttgcaggcctttctagctctatgtcttcgtggaggaagatagcctgcaggtgtaatgccttggaaaatgac

SEQ ID NO: 6836585 - DNA, 89 bp, Homo sapiens
gctttctgaaacacagttatatgttcacaaggactgaccaatcctgatggtctaattcattagtgtcatgtgactgtcagtctggaagt

SEQ ID NO: 6836586 - DNA, 101 bp, Homo sapiens
tgaggcgggagaatcgcttgaacccaggaggcagaggttgcagtggaccaagatcacgccactgcactccagcctgggtgacagagtgagactccgtctca

SEQ ID NO: 6836587 - DNA, 88 bp, Homo sapiens
gcttgtccacactggcctgtcactgcccagggcttggggcaccataggtggtggaggtgtctgggcacgtgctaggctaggaggcagc

SEQ ID NO: 6836588 - DNA, 67 bp, Homo sapiens
agcaaggaaattttgaatcagtgtctctcattaactgtgtgagagagattataacatttaccttgtt

SEQ ID NO: 6836589 - DNA, 79 bp, Homo sapiens
cttgaattagagtgaaatgcaattgtatgtactccatgttgtataacttggatgacacttggttcacactttgttcaag

SEQ ID NO: 6836590 - DNA, 72 bp, Homo sapiens
gctacctggcaagggtcccaggatgtgggtctcatacaccgcttggataagtcctggaaacttgcagaaagt

SEQ ID NO: 6836591 - DNA, 98 bp, Homo sapiens
agtgggaggatcccttgagctcaggagttggaggctacagtgagtcatgattgcaccactgtactccagcctgggggacagagtgagatcctgcctct

SEQ ID NO: 6836592 - DNA, 56 bp, Homo sapiens
tgagcccatgtagcacttccattgatgtctttggagcggccttgcacatgggctca

SEQ ID NO: 6836593 - DNA, 58 bp, Homo sapiens
ttggctgaactgagctccatcgtgggatacatgctgatggtactgctgagttcaccaa

SEQ ID NO: 6836594 - DNA, 86 bp, Homo sapiens
gtggaggtttctttttgagtcagagtctcgctctgtcgcccaggctggagtgcagtggcgtgatctctgctcactgcaagcaccac

SEQ ID NO: 6836595 - DNA, 81 bp, Homo sapiens
atgtgcaaatggaggcaaaattggtttctttcatagtaggggagagaagtcgattgaacctactagacaaaatttgcatgt

SEQ ID NO: 6836596 - DNA, 115 bp, Homo sapiens
aactgaaacattttggaagcatcagttggcaggaaaaacattggagatctcaatcatgaagaaagatcgccagttcattttcctgcttgctttgatcgtttttcaatgtgaagtt

SEQ ID NO: 6836597 - DNA, 74 bp, Homo sapiens
gtgtcagtgaaaaattgtgatagtgttctctgcaaaagaagcagacagttcctagggcagtatttcacagacac

SEQ ID NO: 6836598 - DNA, 93 bp, Homo sapiens
gacacctggtctgtggtattttattatgacagcctaagcagactaatacagagtgggagggtggcagtaattgagttacctggaccaggtgtt

SEQ ID NO: 6836599 - DNA, 57 bp, Homo sapiens
gcctttgctggctttgaagatggtgggaggaaccacactccaaggcttgcaggaggc

SEQ ID NO: 6836600 - DNA, 55 bp, Homo sapiens
ctgagcagctccctgagtggtcctgacttccaaaacagctttctggtctgctcag

SEQ ID NO: 6836601 - DNA, 58 bp, Homo sapiens
acatccaggtgatgtaggggatttagttttgaaagtctaatacatgaaacctagatgt

SEQ ID NO: 6836602 - DNA, 61 bp, Homo sapiens
tgtcagtggtcctcagcctcggctcatgttcaaatcacatggaaggcttggaatacttcca

SEQ ID NO: 6836603 - DNA, 57 bp, Homo sapiens
gactgaggtgacctaggactacctctgccaagtagactgtgtgagggtccctcagtc

SEQ ID NO: 6836604 - DNA, 79 bp, Homo sapiens
tgtctgcttgggtcctggcatgggtttatcattggagtcatttcattcattgttctgccgctgagcccagctgcagata

SEQ ID NO: 6836605 - DNA, 63 bp, Homo sapiens
atgaataggtgtcactggttcccaatatgactttatttaccagtgctgacatttgaatttcat

SEQ ID NO: 6836606 - DNA, 70 bp, Homo sapiens
tgcggctttaaggcttgtcttgcggtttccttaacttaaaccttaaaccaagctcttgagagaagctaca

SEQ ID NO: 6836607 - DNA, 93 bp, Homo sapiens
atgtagttcatatctcttgagaaataagcatgtctagaataagtagtttttgctcagaccacataaatttcttcaaaggtgactgaacaacat

SEQ ID NO: 6836608 - DNA, 70 bp, Homo sapiens
ctggaactaagcaccatgcctgttgggttctgcctgtctgcagccctgggcatgtgtccttcccacccag

SEQ ID NO: 6836609 - DNA, 62 bp, Homo sapiens
ggagctttgcagggaccaaaagaggcagtataatatagtggttaagcggccctgggaagtcc

SEQ ID NO: 6836610 - DNA, 58 bp, Homo sapiens
ctagtgaacgtggtactatggaaggctagaaagcccgccattcaaccatgttctctgg

SEQ ID NO: 6836611 - DNA, 98 bp, Homo sapiens
ggttgcatttcaggagtgtctgtggagttctgctcatcactgacttatcttctgatttagggaaagcagcattcccttggacatctgaagtgacagcc

SEQ ID NO: 6836612 - DNA, 109 bp, Homo sapiens
gattttatccttgtgtcactgagaatagcagactggtaactaattccaaaagagagagagggaagttttgaatgggctgttgttttaaagagctgatacagatggggtc

SEQ ID NO: 6836613 - DNA, 113 bp, Homo sapiens
gccagggcctgcgtgtcctgccatcccccctcctggggggcacttcagcacaatgggcttggcggccccgtggcttcccaggcggatgtgatggcaaatagcaggcacttggc

SEQ ID NO: 6836614 - DNA, 61 bp, Homo sapiens
catggccaaagaattatattttattattaaaatggtatagatgtattcattgtttggcctg

SEQ ID NO: 6836615 - DNA, 65 bp, Homo sapiens
gggagggtctgccatgctccctggcctcagctcaaccagggagaaagtgaggaggaccctatctc

SEQ ID NO: 6836616 - DNA, 56 bp, Homo sapiens
ggtagcagggctgtgagtcagatataacccagatactgatatcaccactctgttcc

SEQ ID NO: 6836617 - DNA, 85 bp, Homo sapiens
atttaaacttgtctgaatacatttctgttacttgcaagtaaataattacaacatatgataggagtctaaagggcataggatagat

SEQ ID NO: 6836618 - DNA, 62 bp, Homo sapiens
agcacttatgtgattaggacaggtccactagataatctccctgtcttaaaatcatctgtgct

SEQ ID NO: 6836619 - DNA, 94 bp, Homo sapiens
caaatctatcttcctaaccatgtccagaatgtgtcacgtctgccagtctggcatctaactgtgattcactggaatgtgttggaaatgtgatttg

SEQ ID NO: 6836620 - DNA, 71 bp, Homo sapiens
ggggagtgaaagagttttagacaaactgattggttcggcaacacagtcttccggcagaattcttactcctt

SEQ ID NO: 6836621 - DNA, 63 bp, Homo sapiens
gctttgacgactctccggagtggtgagaaactcaatctcagtcacatttgggggtgtcaaagt

SEQ ID NO: 6836622 - DNA, 67 bp, Homo sapiens
cccgttttctgtgggtaatacctcataccgtgaccaggcacagaggcggaggagaccccgggatggg

SEQ ID NO: 6836623 - DNA, 61 bp, Homo sapiens
tgcttcaagccgctttctgcagattcctattatctttacctctgctcagtggctaaaagca

SEQ ID NO: 6836624 - DNA, 61 bp, Homo sapiens
tggtggggatacagacatgaaattttttctcagtagaaatagttttccctggttcttgcca

SEQ ID NO: 6836625 - DNA, 87 bp, Homo sapiens
tcctgggccaaatattgcatgaggatttgggcaatgttttggctagttgaacaacaacaatgctcatatttatgccaattggcagga

SEQ ID NO: 6836626 - DNA, 70 bp, Homo sapiens
gcgacatgcctctcctggagaaggcaggggcttcctggaacttgccccagccttatcagcggaggtttgc

SEQ ID NO: 6836627 - DNA, 68 bp, Homo sapiens
gttctgttcttcatcattttagataggctatgtttatttcatttcctgtttattgtgaagaacccagc

SEQ ID NO: 6836628 - DNA, 57 bp, Homo sapiens
gccaggtctcttcttgtacccagcccctgacctgctgctttactgaagagatatggc

SEQ ID NO: 6836629 - DNA, 55 bp, Homo sapiens
cgtttccttttggaattagagctcgaaaacgagaactggtgaagggagggccgcg

SEQ ID NO: 6836630 - DNA, 76 bp, Homo sapiens
gacaccctgcagtggtgtgaccagccatgttcaccgtggagttgttggttttggcatggcaaccctgcagggagtt

SEQ ID NO: 6836631 - DNA, 90 bp, Homo sapiens
ctttgaacagatcccatccagggagctgctctgctgcagagaaaactcggacccagaagcagctcctctaggaacggattagcttcaggg

SEQ ID NO: 6836632 - DNA, 61 bp, Homo sapiens
gcctgagatttgagttcctactgagtcccctacaggggcacagctatgagctgaattgtgc

SEQ ID NO: 6836633 - DNA, 78 bp, Homo sapiens
ctgtactacccagctttcgaagtgtcacaggtgagaaagttaaccagtgaaggacaaccgagcagctgtgggaaacag

SEQ ID NO: 6836634 - DNA, 65 bp, Homo sapiens
ccaggagcctgggccaggctgggcaagcgttgcagagccaagtccgaggcccagcaggctcctgg

SEQ ID NO: 6836635 - DNA, 77 bp, Homo sapiens
acacagtgggcctagcaagcctgctactagagacagccatgggctggtttagctgtaaggttccctctcatttgtgt

SEQ ID NO: 6836636 - DNA, 84 bp, Homo sapiens
tccgactgcaacggactggctatctccatgttctccttgttccggacagagagaagcaatcagtggccacccactgcagctgga

SEQ ID NO: 6836637 - DNA, 68 bp, Homo sapiens
tagtgtaagtgtgggtctatttctggaatctccattctactcattgatctatatatgtctttatgcta

SEQ ID NO: 6836638 - DNA, 82 bp, Homo sapiens
cagtattcttctagcactcctgcccgtaagttagaaaagcatattgttctcagtgtttgtgggtgaggctggaagggtagtg

SEQ ID NO: 6836639 - DNA, 70 bp, Homo sapiens
tgatgctattaatatccagtctgattttactcgtcactgaaattgtattcagaatatattgatggaatca

SEQ ID NO: 6836640 - DNA, 75 bp, Homo sapiens
ccccaccctgtgccaatacagcgtatcagaggtatgttctctgggctgtctacaggttggcttggggtcctgggg

SEQ ID NO: 6836641 - DNA, 102 bp, Homo sapiens
gagagcaacaggtgtggcttccaggtgggatcaaagagtcattcggataggattttgaaaaaacaagttggcccatttgtgagagacacaccacagtgcctc

SEQ ID NO: 6836642 - DNA, 87 bp, Homo sapiens
tcagcttgaggtattatgaggaataactatctgatccaaatctgtggtggacaattagatcattcctttgataatatccatatctga

SEQ ID NO: 6836643 - DNA, 56 bp, Homo sapiens
gatgatctcgctttctgtgctttgaatgatcacgtggacacaggaaggggaatatc

SEQ ID NO: 6836644 - DNA, 123 bp, Homo sapiens
aaccatgagtgttatttttttggcttggatcttggcaggtgtgtaatgtgactcctgatagcaggacagcagattacattctgctataaaaccatttctaaggcttttggcacccaaactgtt

SEQ ID NO: 6836645 - DNA, 58 bp, Homo sapiens
ttgggagtagcccaggttcaggggttgttaatgccctgggcatgggtggggctcccag

SEQ ID NO: 6836646 - DNA, 121 bp, Homo sapiens
ttatgggttggtttatagtgcattgcccatagatgggcccatctgtccaacagtctgtgtgataccataccttctacagacatgggccgctcttgaggagtgcctataaacctgctgttaa

SEQ ID NO: 6836647 - DNA, 58 bp, Homo sapiens
aagtggcagacatatcacaagagtccccagactctgcctagaaacagtgtttgccctt

SEQ ID NO: 6836648 - DNA, 64 bp, Homo sapiens
ggcccccgcgcggccggaggctcggggccgcagcagccagtgcctctgctctgcgttggggact

SEQ ID NO: 6836649 - DNA, 56 bp, Homo sapiens
cactgttcatcaaaactgctcttaaggaaattaacctggcaggaagatgaagggtg

SEQ ID NO: 6836650 - DNA, 59 bp, Homo sapiens
gatgcagggcagctctgggacagtcgctgattgaaacatccctgagttctctgagcatc

SEQ ID NO: 6836651 - DNA, 129 bp, Homo sapiens
cccggtgacttaataggtgagggcctcaggtgacaccgtcgtctgaagtcttggagaaacctttactgtccaggggaggagaggactggcggtcggtggggatcgaggcccagcacacatcactgggtg

SEQ ID NO: 6836652 - DNA, 58 bp, Homo sapiens
ttgatgagtctgactagtaactttggtcaaccaatgacaggttcatgactcctctcaa

SEQ ID NO: 6836653 - DNA, 59 bp, Homo sapiens
gtccccagctgtgacgagagcccatcccagggaggggcacttggatcttagttggggac

SEQ ID NO: 6836654 - DNA, 79 bp, Homo sapiens
gctgcagtgctgggtacaaccatgtcagttcaaaccagattcaatttggttggttaatgtgcccatttcccattgctgc

SEQ ID NO: 6836655 - DNA, 69 bp, Homo sapiens
tggtaaaagcaggtcccagaaagttaattctttataattgaggaagtaactaagggacttgcaattcca

SEQ ID NO: 6836656 - DNA, 66 bp, Homo sapiens
aagaatggagagagatttgatttgtcaggttcatgtcagatgttgacaaagtcatctctccttctt

SEQ ID NO: 6836657 - DNA, 93 bp, Homo sapiens
ctgccatctcaaggtcatagggagctggtatttataatgagcataaagtataatacattcattataaatatcagctcctctcaaggctggcag

SEQ ID NO: 6836658 - DNA, 79 bp, Homo sapiens
ctgcatcccagacattgtcacagacatcccaggtgatgcatgatcacagggagacttgtggctgtggtaggggggacag

SEQ ID NO: 6836659 - DNA, 122 bp, Homo sapiens
tttattaatgagtgtaacctcctacacaatacatcaacatgatttcatgcatttagaggataaaaatttcctagttaagtggaaaattgtggagatggcttctggaggaccttcattctaaa

SEQ ID NO: 6836660 - DNA, 123 bp, Homo sapiens
gaggatgggaacaagaaaggaagaaactggcaaattggcagctgaagaggaactttgggagataaatgccttctgaggattttgattagttgtttgctgtttgatgttaaccgtttcctcctc

SEQ ID NO: 6836661 - DNA, 68 bp, Homo sapiens
cccaagggatgcttgagtagtttctaaggcaagcagaatcttccatctgctcaaatggcacttttggg

SEQ ID NO: 6836662 - DNA, 85 bp, Homo sapiens
agtagattaaataaaatattattagaggttgttttgtaaagagctattcgctttttcttggtgcaacctctggatgaaatctatt

SEQ ID NO: 6836663 - DNA, 66 bp, Homo sapiens
tccatgctttgctatgactcaccagcactgtgaatgttactctgctgtagtcaaagcaaagctgga

SEQ ID NO: 6836664 - DNA, 56 bp, Homo sapiens
aggaatgtgaggcaagttgtgaaattcaattaattctacagccagcccacgtacct

SEQ ID NO: 6836665 - DNA, 58 bp, Homo sapiens
gagtctatgtcttggaacgctgaaatgcatttcttcagatatattcaggatatgactc

SEQ ID NO: 6836666 - DNA, 69 bp, Homo sapiens
tgcagattcctctggtgccatctctgggctaataagcatctagagccctcttcactaaaggaaaatgta

SEQ ID NO: 6836667 - DNA, 82 bp, Homo sapiens
ggttatgttctagacttttgctgtgaaactgagtgtgtaaaatttgctattccttctccactgcagtaactctaggactgcc

SEQ ID NO: 6836668 - DNA, 68 bp, Homo sapiens
gcagggggttggggtgccacaaaattattaaggtgtaatcaaattggcttcccctaccttccaattgc

SEQ ID NO: 6836669 - DNA, 124 bp, Homo sapiens
acatccctgtttcttgtttttcatgattctttgcagctggtggtggccgtgtgacctagttctagactgtgaaacataggagcaatcagctaggaaagaaaacatatggggcttctgggaatgt

SEQ ID NO: 6836670 - DNA, 68 bp, Homo sapiens
tttgtcttggccccacctgtgccagccctaggatggaactgctgacactgttgggaagcccagacaga

SEQ ID NO: 6836671 - DNA, 75 bp, Homo sapiens
tccaaaccagtaggctgggaaggaaggcctggaagttgcgtttctaacaaacctccagcattactggcccatgga

SEQ ID NO: 6836672 - DNA, 67 bp, Homo sapiens
aaggagagagcaagttggtgactgttcccctcactttggacaggctaaaatcaactgctgtttcctt

SEQ ID NO: 6836673 - DNA, 63 bp, Homo sapiens
ggaggtcaagggtgcctcatgtcatccaacccaggagggctttggagctgccacttgtcctcc

SEQ ID NO: 6836674 - DNA, 89 bp, Homo sapiens
ccctgcccccagacactggtgccctcctgaagccatcacagataagaatgctggctgtgtgtgcaggagagcaggtgttgtggcatggg

SEQ ID NO: 6836675 - DNA, 60 bp, Homo sapiens
gagtttccagtgcatggcaaatgcttaataagctgtgattatccactggaatgtaagctc

SEQ ID NO: 6836676 - DNA, 60 bp, Homo sapiens
gcagtgttgtactttaaaatttctggtgcctaatgaggcacgttatagtaacgcgcatgc

SEQ ID NO: 6836677 - DNA, 68 bp, Homo sapiens
tttcatttcctagcctctcttgcagttagatgtgggcatatgactaagctctagctagtggaatgaga

SEQ ID NO: 6836678 - DNA, 63 bp, Homo sapiens
gatctctttccatgtgtgttaaagaacatctcttgtgctaaggagaggcagacactagaggtc

SEQ ID NO: 6836679 - DNA, 84 bp, Homo sapiens
gttcaggtgaggcctgggccgcaggagagggccaagtgaatggacagccctccagccatggacccaggtgcagctcacctggcc

SEQ ID NO: 6836680 - DNA, 72 bp, Homo sapiens
cttacccttccttatgtttaaagtgcttaaaagctaagtttagaacttcatgaactaagggatcgggtacag

SEQ ID NO: 6836681 - DNA, 63 bp, Homo sapiens
acgtagaaatagttagcttagttctgtattatgtttgaaatagaattaactagctactgatgt

SEQ ID NO: 6836682 - DNA, 56 bp, Homo sapiens
agccaacataaaaagctttcaattttccttgaagattctaagtgcttgtggtggtt

SEQ ID NO: 6836683 - DNA, 130 bp, Homo sapiens
aaggttccagcccagctcttcccactcagtgcccgcttcaggtcttccgagaggcctgtgctcctggagacaggtgggcacagagaggccctggaaggacctggacaaactctgtagggggctgaattct

SEQ ID NO: 6836684 - DNA, 55 bp, Homo sapiens
aaagcagcagaatctctcaggggcagcgaggaccttgaggtggtctctgtgtttt

SEQ ID NO: 6836685 - DNA, 66 bp, Homo sapiens
tgcagattcttgggcctcccagaagttctggttcactaggtctgggacaggactggggaacttgca

SEQ ID NO: 6836686 - DNA, 86 bp, Homo sapiens
ctgccaccttcgaatatttaggtttctctcatatgacctggtgctttctctgtggtcctagagggtgagctaggctcgaggggtag

SEQ ID NO: 6836687 - DNA, 60 bp, Homo sapiens
tcaggaacagcagggaggaaagtgcttcacttcatcatctcactctctgacttttgttga

SEQ ID NO: 6836688 - DNA, 59 bp, Homo sapiens
ctttcaggaaggttaaatataactcctttctggaaaatatcctataaccttcccgagag

SEQ ID NO: 6836689 - DNA, 59 bp, Homo sapiens
acccaggaggcggaggttgcagtgagccgagatcgcgccactgcactccagctctgggt

SEQ ID NO: 6836690 - DNA, 61 bp, Homo sapiens
agatgtgaattctgacttcaggttttatgaagtacatagcttgtctagtgaattcatatct

SEQ ID NO: 6836691 - DNA, 99 bp, Homo sapiens
atttttaattgtaaaaacgttcacagctattctcatgtatttttcattaaaaaaacttgcaaagtaagtggctattagctgtgttttacagataagaat

SEQ ID NO: 6836692 - DNA, 79 bp, Homo sapiens
gactggcttcgtttgccaatttctttgttttgcactagaaagcatttctgcaactcagttggcatattcaagcacagtc

SEQ ID NO: 6836693 - DNA, 68 bp, Homo sapiens
atcatgtttgcctcttatttgccagaagaaacatatatgtaaattctgaaataggagatagctgtgat

SEQ ID NO: 6836694 - DNA, 84 bp, Homo sapiens
caggattaaggtgaggggagtaaagccatgttacacagatacaaaaaacattcagtaatcgcaatggttccctcacctcacctg

SEQ ID NO: 6836695 - DNA, 55 bp, Homo sapiens
gagcaggacagcagcttcctggatcccctcagttggacttagttgctctctgctc

SEQ ID NO: 6836696 - DNA, 58 bp, Homo sapiens
ggtatatgcttatgatggttaatttgaaggtgtcagcttgactggagtgaggtatgcc

SEQ ID NO: 6836697 - DNA, 104 bp, Homo sapiens
gccatgtgcagtcaggtgggcctgggcttgcatctgtgctgggtgaccagagccaagtcactcagctcctcagagcctcagttttcccacctctacaatgaggc

SEQ ID NO: 6836698 - DNA, 56 bp, Homo sapiens
tcttgggaaagtgtcttaactttggaagcagtaaaggttgaacactttcttcaagg

SEQ ID NO: 6836699 - DNA, 58 bp, Homo sapiens
gtacaaggttctatggcgtctgtggttcctagatcacttgagccataaaattttatgc

SEQ ID NO: 6836700 - DNA, 68 bp, Homo sapiens
tggttacatagtaaggtcctatttagtggactagatgccatttcttagtgggattttgctgatgacca

SEQ ID NO: 6836701 - DNA, 60 bp, Homo sapiens
agctccttggttggccctgcatgaaggacagtggccttcggtggggtacctaaggtagct

SEQ ID NO: 6836702 - DNA, 55 bp, Homo sapiens
ttcattgtgattcttggctagcttttgacttggagatagtcatgatcacagtgga

SEQ ID NO: 6836703 - DNA, 57 bp, Homo sapiens
tctgtctgtccagggcccccgctccaggaggacatggcaggagcactgggcaggagg

SEQ ID NO: 6836704 - DNA, 64 bp, Homo sapiens
tccttgctgcacctgtcctgtgtgatgctgttactgcatgcaaagcaatcaggagtagcatgga

SEQ ID NO: 6836705 - DNA, 94 bp, Homo sapiens
ctgccaccttccctagtgtcttgtaccatcttcagtgggcagaacttggccagaaaaaggagcccaaaggaaggacaaggcagaggagggtcag

SEQ ID NO: 6836706 - DNA, 65 bp, Homo sapiens
agggagagagggatgtcaggggaccttggctgggtgtccgctcaatgtccacatcccctctgcct

SEQ ID NO: 6836707 - DNA, 130 bp, Homo sapiens
gctggagtgcagtagctattcacagacactaccacagtacactgcagtcctgagctcctgggctgaagccatccttctgcctcagcctccagaggaactgggactacaggcatgcgctaccatacccagc

SEQ ID NO: 6836708 - DNA, 62 bp, Homo sapiens
ctgggtgcgtgagcgcatgcgtgcatgtttgtgtgtgtgtgtgttccacgcacatttgccag

SEQ ID NO: 6836709 - DNA, 57 bp, Homo sapiens
gccagggacagtctggctggaaatattattattcatactggacagctggttcctggc

SEQ ID NO: 6836710 - DNA, 106 bp, Homo sapiens
ttgataagatgacttgtgcaaatgtatggtccagtgtcaggcattgatgctgtttaattcaccattcaactttgtatattacctataactttttcatcaggatcag

SEQ ID NO: 6836711 - DNA, 111 bp, Homo sapiens
aggcaagctaggtgcctagggcacaaaatttaaggaggtgctcacttccagggcatgcgtatgcaagttagtgcctccttaaattttgctcccttggggcctgctttgcct

SEQ ID NO: 6836712 - DNA, 57 bp, Homo sapiens
tgaggacacagtcaagagtggaggaattaagttttgctgctgcttgctgtgttccca

SEQ ID NO: 6836713 - DNA, 61 bp, Homo sapiens
agcgggcactggagactgttatgagagcttcaaggttcctcaccattcctctgtgcctgct

SEQ ID NO: 6836714 - DNA, 74 bp, Homo sapiens
cagtgttggcacagggaggcagccatgctcccgagtcctgggagtgggcagcactgccctgtgggtctgcactg

SEQ ID NO: 6836715 - DNA, 60 bp, Homo sapiens
cccttagctggtgagcccagcgcctcctgtgtggggcggtctgggctgcccagctatggg

SEQ ID NO: 6836716 - DNA, 114 bp, Homo sapiens
tttgggggaaacagaggaggcaatggctcacccctgtcagagaggatcaacaacatgcagacattccttattatgagagatgggtaactggagtctgcttaccctacttccaaa

SEQ ID NO: 6836717 - DNA, 84 bp, Homo sapiens
gtacggctatgagattcctgtggacattctgtgtggaattgctgatactactcagaatgctacaatgaggtctcttggttgtat

SEQ ID NO: 6836718 - DNA, 80 bp, Homo sapiens
gctgtacaacttctgaagtttggagcatccaggtatcagctggctgctagccagagcttcagagcaagtgttcattaagc

SEQ ID NO: 6836719 - DNA, 72 bp, Homo sapiens
acagctaagaagtgcagagctgcaatgtaaacacaactgtgctttattccaaagcttgcacttttgcgctgt

SEQ ID NO: 6836720 - DNA, 64 bp, Homo sapiens
ggggagtaagtcagtgctagctaatggctaagagcttggccaaggctatacactggtggcctcc

SEQ ID NO: 6836721 - DNA, 62 bp, Homo sapiens
gcatgaggccggggactctgcattccacatctgtgctcagagactctccctgagccacgtgc

SEQ ID NO: 6836722 - DNA, 64 bp, Homo sapiens
atccagatcttctgtgcacctagcatcggcagcatgtatgttcagttagcactgaagtctggat

SEQ ID NO: 6836723 - DNA, 81 bp, Homo sapiens
gcatccttgttcttaatggcatgttgcaaaatttacaacagtaaatatgtaatcaatgtgttcatgtttattacaaggagc

SEQ ID NO: 6836724 - DNA, 76 bp, Homo sapiens
tgaacagagcctcctgaattctataagctttaggccccacataaccttcagctatggagtcttagttactctgtca

SEQ ID NO: 6836725 - DNA, 71 bp, Homo sapiens
agttattttagacacatacccttgcccaaaggttaatttagaacctaagctgaaatgtgtgtcagatgatt

SEQ ID NO: 6836726 - DNA, 59 bp, Homo sapiens
gagtgatgtggtccagaatggtcctcagcatgttctaggtggtcctgtcccacccactc

SEQ ID NO: 6836727 - DNA, 57 bp, Homo sapiens
gtggcaggattacagtcatgagccactgcatccagctcatgtgtaacttttgaccac

SEQ ID NO: 6836728 - DNA, 63 bp, Homo sapiens
gtgcatctgggccagatccatggcaataaccttcaggttgaggctagagggcttcagatgggc

SEQ ID NO: 6836729 - DNA, 91 bp, Homo sapiens
aaatgattggagaagggagttgtgctcacatttagaattagggtgttttgtcctgtctactgctgacactaacagtactatccatttattt

SEQ ID NO: 6836730 - DNA, 82 bp, Homo sapiens
atggacaattagttgattccatgtttgggctgttctgaataatgctgctatgaacatgagaatgcaaatatctcattgacat

SEQ ID NO: 6836731 - DNA, 91 bp, Homo sapiens
ttcctcaaagctgagatgctatacattgtaagacacattctgatttcacaggtattgatttataaaatgtgtgcatcttagaattgatgaa

SEQ ID NO: 6836732 - DNA, 56 bp, Homo sapiens
agaacccagacctggaagctagaccccagacataggtcatccacctctcgggctct

SEQ ID NO: 6836733 - DNA, 56 bp, Homo sapiens
atgggctgagaatcaagaatattcctggtggccaccaggcctggttctcagtccat

SEQ ID NO: 6836734 - DNA, 55 bp, Homo sapiens
cactatgtgcattgttttctcctaagtgcttttagtaggtagcaatcaaatggtg

SEQ ID NO: 6836735 - DNA, 60 bp, Homo sapiens
ggcgctgcacagggggaaagggagggcttgcaccccaaccaagctgctttgtgcaacgct

SEQ ID NO: 6836736 - DNA, 95 bp, Homo sapiens
gcaaataaccctgggtctccaggccagggctgcagcgagcaggggtggggccgcgagcttcctgttgttcttggcacggctgcccagctgtctgc

SEQ ID NO: 6836737 - DNA, 70 bp, Homo sapiens
gatgaggagtaagagagtaccatcatcatattcttgtcaaagtaaatgagttggatttatattctttatc

SEQ ID NO: 6836738 - DNA, 63 bp, Homo sapiens
gaacctccaagatggtccatgcacagatatggcaatcaatgctgactgttggctatgaggttc

SEQ ID NO: 6836739 - DNA, 63 bp, Homo sapiens
cagattctgcagtcaacttgctttctactcttccttccagattcaagatctctgcagaatttg

SEQ ID NO: 6836740 - DNA, 73 bp, Homo sapiens
ccttagaaagggggctgtaagcaagcagggggagaagctgagattttgatttgtattgcaggcccctttaagg

SEQ ID NO: 6836741 - DNA, 89 bp, Homo sapiens
cgtcgtctctgatcctcatggcttctctgtgtgagggagacattattgtccccattttgcagatgaggaaactgaggctcagagatgtg

SEQ ID NO: 6836742 - DNA, 115 bp, Homo sapiens
gggctaaagtcaaggtgtcagccgggctggttccttctggaggctctaaggggagaatctatttatttgcctttttcagcttctagaggctgcctgtatttcttgacttgcaccc

SEQ ID NO: 6836743 - DNA, 57 bp, Homo sapiens
accttgtcaatttcgtgatgtcaatggcaacttgatgtcaatgaaaatgtataaggt

SEQ ID NO: 6836744 - DNA, 59 bp, Homo sapiens
ggtctctggctttccttgtctgcatcctcttccagagtgtaggctttatggaagctacc

SEQ ID NO: 6836745 - DNA, 55 bp, Homo sapiens
cttggtcctgcagggtctcttgcctccctcacaggacaggagactatggaccaag

SEQ ID NO: 6836746 - DNA, 67 bp, Homo sapiens
acagagagaaaggataacagctcaactgggttacattaaacaagtactgactggctgtcttctctgt

SEQ ID NO: 6836747 - DNA, 75 bp, Homo sapiens
ggttatggttgactcatctgaaaaatgaggagaatacacttcttttcaccttcagatgtagacaggactaggacc

SEQ ID NO: 6836748 - DNA, 85 bp, Homo sapiens
gattctgtagcagatgctgctcacctgattatgaccttagtattttggctgaaatagtcagtgaagacacaccctgtccagaatc

SEQ ID NO: 6836749 - DNA, 89 bp, Homo sapiens
ggatatggcaattgctggaggtgttccagatctggctgcttccccaggctgaaagatgaaccacttatccatagcgagatgcctgagcc

SEQ ID NO: 6836750 - DNA, 68 bp, Homo sapiens
tgacatgagtgctgggacctccagcagcatccacaaggctctgtggaaggacttagcgatacatgtca

SEQ ID NO: 6836751 - DNA, 76 bp, Homo sapiens
ttttcatagtttaaagagagaagactgtaaatctggtttatcatgttcttatcattctttcggaaacatgtgagga

SEQ ID NO: 6836752 - DNA, 127 bp, Homo sapiens
atcagaatcacttggaggacttgttaaaacacagattgctgggcgtcactcccagagtttctgattcagtaggtctgggaaggagcctgagaatttggtttctaacaagttcccaggtggtgttgat

SEQ ID NO: 6836753 - DNA, 84 bp, Homo sapiens
aatagagtgatttttattgttaatgcacactcatatatgaatatacattatagagctttggcattgattattttgtcagctatt

SEQ ID NO: 6836754 - DNA, 63 bp, Homo sapiens
cagccgccttctccccaccgccccctgtgtgccagcggtaggaagtcagcggagaggtggctg

SEQ ID NO: 6836755 - DNA, 58 bp, Homo sapiens
aagtaaactcagtggtcattcagtttaaccatttttggtctgaaatactgggtttctt

SEQ ID NO: 6836756 - DNA, 77 bp, Homo sapiens
cagagtgcagggtgtgcagcggcatgcagaggacagtcgtcaccatgtcctcagctgctgcacagcttttcaatctg

SEQ ID NO: 6836757 - DNA, 61 bp, Homo sapiens
ctcagtaatgctgagtgctcttgtctaatggggaacgttttctgacactgagcattttgag

SEQ ID NO: 6836758 - DNA, 61 bp, Homo sapiens
agtggtagacaatttaaaaataagccaatctagttaattgattataaagttggctaccgct

SEQ ID NO: 6836759 - DNA, 62 bp, Homo sapiens
tctgaagagtcatctttgggtgaccaatgtcaagaacagagaatttgatcaaaatcttcagg

SEQ ID NO: 6836760 - DNA, 74 bp, Homo sapiens
acatgtgctaagggccagagctgggatttgtacccaggccacctgacccagctctctgctcttagcctctatgt

SEQ ID NO: 6836761 - DNA, 59 bp, Homo sapiens
gaggctgtttgtggcagtgatgcagggtagtgtcgctgtgttccccacaatggtgcctc

SEQ ID NO: 6836762 - DNA, 55 bp, Homo sapiens
tgctcatttatgtaggtattgcttttgtttctcactgcagtggcatagttgagta

SEQ ID NO: 6836763 - DNA, 55 bp, Homo sapiens
tccacttttcttccatcatcattggtaaaaacgatgaaaaagatgtggaaaggga

SEQ ID NO: 6836764 - DNA, 56 bp, Homo sapiens
ggtatcctgaatctcatatgcagtcacagttctggaaagtctggaggtcaggagct

SEQ ID NO: 6836765 - DNA, 129 bp, Homo sapiens
ttttgttaattgcccaaattcaatatcaggtttagaactaagacattgttagtagaccagtggcagtttcttctgctgatgtagactcatagtaatcaaagtatgaaattgatatgcaaaaatccagaa

SEQ ID NO: 6836766 - DNA, 55 bp, Homo sapiens
actaggccctgcctgaaggagggggctttctccctctccagacactgggccttgt

SEQ ID NO: 6836767 - DNA, 55 bp, Homo sapiens
tacagaggaatgcctgtggtctctgaaatggaataacagttgacattgctctgtg

SEQ ID NO: 6836768 - DNA, 65 bp, Homo sapiens
ctggtcaccaagctctcttcccggctctccttctggaggggcagtgggaggagggctggggtcag

SEQ ID NO: 6836769 - DNA, 86 bp, Homo sapiens
cccccattcccgccagaaaccagaagcaactggcggcctctggtccagccagcaggcgcatcccttctcgtgggtggggtaggggg

SEQ ID NO: 6836770 - DNA, 61 bp, Homo sapiens
agagcagcctcagctccctgtggggtgactcatgtgtccccaggcactggctgggttcttt

SEQ ID NO: 6836771 - DNA, 114 bp, Homo sapiens
tgccaggtgggaccacccgtcccaaagactcacggctgtgagcccctagcagcttacggttgcagtgggtgatgagtcctggggagagggatgggagtggagaccctaacagca

SEQ ID NO: 6836772 - DNA, 55 bp, Homo sapiens
ggggtccctgcaccagcatgtcagcatcagcttgtgcacgctgggcgggcactcc

SEQ ID NO: 6836773 - DNA, 82 bp, Homo sapiens
gaacggggcctttctggagcagattggaaaatcccccggagcgggtgggggccttgccagctgcttgggaaaatgtcttttc

SEQ ID NO: 6836774 - DNA, 81 bp, Homo sapiens
ttcctattgtggtttagctagcaagtatgtcaaggctattttagtttgtcatttgtacttctagcatcaccagaatttgag

SEQ ID NO: 6836775 - DNA, 82 bp, Homo sapiens
gcctttgctattgtgaataatgccgcaataaacatatgtgtgcatgtgtctttatagcagcatgatttatagtcctttgggt

SEQ ID NO: 6836776 - DNA, 77 bp, Homo sapiens
gcctacttcttcagcgtatctggagagggcggaggggtgacgctaggatttaggtaagctgaatatgaagtgaaggt

SEQ ID NO: 6836777 - DNA, 60 bp, Homo sapiens
gctcagagagattaaataatttgtgtaaagtcacacacattattagttgtctatttgagt

SEQ ID NO: 6836778 - DNA, 65 bp, Homo sapiens
ggcccagcacagtgcttgggggccggcggctcccagctcccgggccgccctgctgcacaaaggcc

SEQ ID NO: 6836779 - DNA, 59 bp, Homo sapiens
tgggccatttttggaagactggggattctggtaggagaccacatagttgaaatgggcta

SEQ ID NO: 6836780 - DNA, 85 bp, Homo sapiens
gattctcaggatagtgtctgtgtggactgtattttcccctcaaatcaggaaagcagctcatggagtaggcactgcatggagactc

SEQ ID NO: 6836781 - DNA, 94 bp, Homo sapiens
tcttcattgtcatcaagtctcttcctctgccaaagaacaattgatccctgcaacttctagcagagggaagaggctttccaaggacagcagaagg

SEQ ID NO: 6836782 - DNA, 110 bp, Homo sapiens
gccctgggccaggcttgggtggggtttgtggtgcaggcagtccaggtgggcatcgtcccagatgctctgctggtaccagtggccgtcacctatgacctggttccggatgc

SEQ ID NO: 6836783 - DNA, 107 bp, Homo sapiens
tttgggagaaagaaaaggagacagattgctgtggaaatataagatgttatttctgcgaaaatacttgtatctttaccaattttaaatgtcggttttcttctcccaaa

SEQ ID NO: 6836784 - DNA, 77 bp, Homo sapiens
ccatatcacaaatgaggaaatcgagcatcagagaattttcctaactttctcaaatttgctccctcataagtggtagg

SEQ ID NO: 6836785 - DNA, 79 bp, Homo sapiens
gcttctgagtggagtagtgaatgcatttcattttaagaatttaggttattagtgcatagctgcgaagcatttttgaagc

SEQ ID NO: 6836786 - DNA, 77 bp, Homo sapiens
gatgaccctggtgggcactggcacctgaatgataattacaaactcagcaacagagtgctctgccactgtggtcactc

SEQ ID NO: 6836787 - DNA, 80 bp, Homo sapiens
ggcattattactatttttattgtcacaactgttatcaataataaagaaaatggttacagaaatgaaagtaaggaggtgcc

SEQ ID NO: 6836788 - DNA, 68 bp, Homo sapiens
agttataggtggttttgagaatacttctttccagtttgggtcaagagtgatcagagctttatatagct

SEQ ID NO: 6836789 - DNA, 64 bp, Homo sapiens
ggactgaacacttaaatgtccagaaaaatgtggaagttgggcattcttagggaagtgcaggtcc

SEQ ID NO: 6836790 - DNA, 67 bp, Homo sapiens
tttatgttgttccctctacacaggttgggaccacatgtgacattcttccacctaggatcaacataga

SEQ ID NO: 6836791 - DNA, 129 bp, Homo sapiens
attcactacttcttaaaatattgttcttaaatgtgtacttgagggggttagcagtagataaggatgtgactccgactctgagtctacattatcaattttgggaaaaatgatttttaagaaaaagaaggt

SEQ ID NO: 6836792 - DNA, 60 bp, Homo sapiens
gcctggtggttcaggagaatggcttctcttaaggccaactcctctaacctctatcttggc

SEQ ID NO: 6836793 - DNA, 57 bp, Homo sapiens
aatgggaggattttctctcttgcataaatacacagagacctgaagagcttcctcatt

SEQ ID NO: 6836794 - DNA, 100 bp, Homo sapiens
gatttggggtagaaagttctgtagatgtctattaggtctgcttggtgcagagctgagttcaattcctggatatccttgttaactttctgtctcgttgatc

SEQ ID NO: 6836795 - DNA, 83 bp, Homo sapiens
ctgtgagatgaatccacacatggcaaaaaattttcacagattgcttgtttctagtttttgtcatgggatattccatttttcag

SEQ ID NO: 6836796 - DNA, 101 bp, Homo sapiens
agtttcgggtgactggtgcgtggcatgtctgagggaggtttggatgccacacccactcctacccctggatttttatgtaatgcaaagattattcagaaatt

SEQ ID NO: 6836797 - DNA, 99 bp, Homo sapiens
ggagctccagagtatatagactgcttttagctagtaactagtactggggtactagttcccagctaaaagtaactgagtaagaagggggatagtagctcc

SEQ ID NO: 6836798 - DNA, 82 bp, Homo sapiens
acaataagagatgagtggaccaaagataggaggcagtagatagagtggattttgttccctaacttcacttcattgaagttgt

SEQ ID NO: 6836799 - DNA, 88 bp, Homo sapiens
gaggaaaaaacacccagcacagtgattatgagtactaattaggaagaaaaacagtggctttgatgaatctgtgcttggtttgttcctt

SEQ ID NO: 6836800 - DNA, 91 bp, Homo sapiens
gcagctcaggcaatccttcaaggggctgacagctggaggctctgcctgctccctcctagcacagttttcattgcagggttatctgggctgt

SEQ ID NO: 6836801 - DNA, 60 bp, Homo sapiens
ggccaatggcagagccttgccaaactcccgacacggctgtacaaggcctctgccatcacc

SEQ ID NO: 6836802 - DNA, 64 bp, Homo sapiens
taggttctgccaggtaaactgcaggaattgagtatgtcagattttggtatacgtggagatccta

SEQ ID NO: 6836803 - DNA, 88 bp, Homo sapiens
tgtcattaataagcagacaattaagtaattgaggtgatgtatgggaaaaatcactggggttattggattgaatcaactattagcagca

SEQ ID NO: 6836804 - DNA, 55 bp, Homo sapiens
gggccactcagctggtgggccgcagacagagcttgaaccccagcagtgtggtgcc

SEQ ID NO: 6836805 - DNA, 69 bp, Homo sapiens
cagggactgagatccagactgtgccaggcttgacctatgcctgccatggggctgggtattagtttcctg

SEQ ID NO: 6836806 - DNA, 62 bp, Homo sapiens
ggggccacagcagggatgaatggagtggacacgtcgcttctctgtgatttgttgcaggccct

SEQ ID NO: 6836807 - DNA, 86 bp, Homo sapiens
tgaatgttgtggcctccatctgtctgttcaccatatcttagtgccagaactgtatttccaacagacaaatgagacagaatgattta

SEQ ID NO: 6836808 - DNA, 80 bp, Homo sapiens
agtgaattactgcaagagttgacagaatagttatctcaagtaaacaagatttctgtcaaagactttttcaggcaatcact

SEQ ID NO: 6836809 - DNA, 65 bp, Homo sapiens
aggatgctgctctagcccatttcctgcttgccacggggtatgtggatggggctggaggtcattct

SEQ ID NO: 6836810 - DNA, 90 bp, Homo sapiens
cagaatgaaatggagatggctattttagagatcaaggaggtaacttcttgactggctgaaataccatatttagttcctttcaatattctg

SEQ ID NO: 6836811 - DNA, 67 bp, Homo sapiens
gccagatagctcttcacctctaggcactggagcagagaccagtgctaccctgggaggagctctaggc

SEQ ID NO: 6836812 - DNA, 58 bp, Homo sapiens
agaggtagtgcaagtgtgaagcatgtggtcattttggcatactcagtgtataacttct

SEQ ID NO: 6836813 - DNA, 64 bp, Homo sapiens
aagctaggcctcagtttcctgagtgcaaaaatgagtggcagaaatgaactgaggtctgaggctt

SEQ ID NO: 6836814 - DNA, 109 bp, Homo sapiens
gcttggcaccccagcaggaccccaggctaaggagtgtgatgctcaccttgcatctgagggtggcaaccaagttcctggcctgtgggatcaatgctaggactccccaggc

SEQ ID NO: 6836815 - DNA, 61 bp, Homo sapiens
agaaacttctctagcatgtgataagcataccagtctgctcaacatgtacagacaggtttct

SEQ ID NO: 6836816 - DNA, 58 bp, Homo sapiens
gtctctgggtgtgtgatgccaaaccttgccaaggggggcactgtgtacacacagagac

SEQ ID NO: 6836817 - DNA, 70 bp, Homo sapiens
tgggtttttgtttctctggtatgtaaagctattgcccaagaagccaaggcataatatagagacaggccca

SEQ ID NO: 6836818 - DNA, 62 bp, Homo sapiens
ggtctgacagctcctagtgctcactttgtgatatgggtcagtgagtgcttggagcatcagct

SEQ ID NO: 6836819 - DNA, 60 bp, Homo sapiens
cacctcccggcacggtgctcagctgtgacgccgaaataagttagggctggccgggcggtg

SEQ ID NO: 6836820 - DNA, 85 bp, Homo sapiens
ggggtctttcttgtcaccgaggctggagtgcagtggcacaatcttggctcactgcaacctccacctcccaggttcaagcgatcct

SEQ ID NO: 6836821 - DNA, 124 bp, Homo sapiens
tggaatgtcctataataactaaaaatgctgttgttaaaatgcacttattgacatagaaaaacgtttacgttatgctaaatgtttaaagtaaattataacagtgtttatattgtataatgtaaca

SEQ ID NO: 6836822 - DNA, 91 bp, Homo sapiens
atcaagcttgttttgctgttttcccagcttctcatcttccaaaattgtgtaatcattttttgggggaggagctgcaagatacaagtaggat

SEQ ID NO: 6836823 - DNA, 90 bp, Homo sapiens
ggtgtgtaatttgggcaattgtagcagggatcagaatacaccattaggcaggttgttcttgttgattttgttatgcctatgttatgcatc

SEQ ID NO: 6836824 - DNA, 57 bp, Homo sapiens
gaagtccatttcctttttataatatgcaagtttttttaagggcaggaattgggcttt

SEQ ID NO: 6836825 - DNA, 68 bp, Homo sapiens
ttcaacatatgaattttgggtggacacgattcagtccctaccaccagctcaaaattctttctgttgga

SEQ ID NO: 6836826 - DNA, 98 bp, Homo sapiens
ttagctcgagtaggagagcactgttcaagcatgtcgtccattaatcattgataaccagtgtttagtgtgcagacatgcaagactgctaatctggctaa

SEQ ID NO: 6836827 - DNA, 88 bp, Homo sapiens
gccatcacatagtaattgataaatgttaattcacagccaaataaatttgcttaaaattatttgtctggtgagtggacatgtcgtgggc

SEQ ID NO: 6836828 - DNA, 63 bp, Homo sapiens
ccgtgggcaggaggcggcaccagcgtggctcccgggggggccagggccaaggctttcccacgg

SEQ ID NO: 6836829 - DNA, 70 bp, Homo sapiens
atttctcatttagagtggcagggaagagtgaagtgaaatcaaatgcatcctccgattcttaaatggaaat

SEQ ID NO: 6836830 - DNA, 62 bp, Homo sapiens
tacacattacataatactatctagtaaatatgccctagagattgtgtgtgtgtgtgtgtgtg

SEQ ID NO: 6836831 - DNA, 72 bp, Homo sapiens
cgtgagggtcacaggcaagtacacaggctcatggatttgtccagagaacatgtgtacatgcctgcactcatg

SEQ ID NO: 6836832 - DNA, 104 bp, Homo sapiens
gggtgcatgtgtgcgtacatgcttgtggccgcacaactcccagactcaccctggggtctccgggtgcatgtgtgtgccatgtgccaggatgtctgcatgtgtcc

SEQ ID NO: 6836833 - DNA, 76 bp, Homo sapiens
tgaacttatctggacctcagtatcctccattgtaaaagatgaattacaaggttgttctgaggatttaagatatgca

SEQ ID NO: 6836834 - DNA, 60 bp, Homo sapiens
cacagtttggtatagaagtgattgtagcaacttcatgattagatcactcttaccattgtg

SEQ ID NO: 6836835 - DNA, 65 bp, Homo sapiens
aactctttcatctgtggcctggtattctcctgcattttaatacttaccgtgtcgctgaaacagtt

SEQ ID NO: 6836836 - DNA, 63 bp, Homo sapiens
aaaggaagtatgaggtaaagtctatcaaagatgaacaaagtggtagatttcatacttctcttt

SEQ ID NO: 6836837 - DNA, 65 bp, Homo sapiens
ggtgagaatcgtgcattattgctttgagaagtcccacaaccaatatcaatttggcagattctccc

SEQ ID NO: 6836838 - DNA, 101 bp, Homo sapiens
attctgcaataggaggggttcaggctatatttaaagaagaacttcctgcccaggaaagatgttctatgttgagatagctaatcctcccaaaatagcagagt

SEQ ID NO: 6836839 - DNA, 66 bp, Homo sapiens
tatctatggcttcacctcagcatgaaggcaaatgagtttcctttagcttgagtgagtttggagata

SEQ ID NO: 6836840 - DNA, 60 bp, Homo sapiens
ctgattctgaggaccctgtgacgagcaggccctggcttgtcattgtgactacagaaccag

SEQ ID NO: 6836841 - DNA, 68 bp, Homo sapiens
ctcccctcttttagttctaactggagagcaaggcagagacccttcacagatgctgagagggctgggag

SEQ ID NO: 6836842 - DNA, 62 bp, Homo sapiens
ggcagctaacacttgggggcatccttagtgatctcactggggtaccctccagggtacctgcc

SEQ ID NO: 6836843 - DNA, 55 bp, Homo sapiens
actactgcacaccagcaaaagaaaatccctaggaagttatctgtgttgcagtggt

SEQ ID NO: 6836844 - DNA, 75 bp, Homo sapiens
atggttcggccatgcatgcctgtggttgacagacatcccaacatacatcacaaaaatgtccagtgactggaccat

SEQ ID NO: 6836845 - DNA, 68 bp, Homo sapiens
gggcttttgtttctgtgagttcagacttgatcttatttacagttagcagcttattagaaacatcatcc

SEQ ID NO: 6836846 - DNA, 88 bp, Homo sapiens
gtcaaaaagaaactcaagaatgtaaagtataaagtaaggggtttgggctcagatcctgacatttctgctttacatatccctttttagc

SEQ ID NO: 6836847 - DNA, 66 bp, Homo sapiens
tcccttagcaacacttagcaactgcctgctttcagaaagtagttcagttaaggttgtttaaaggga

SEQ ID NO: 6836848 - DNA, 66 bp, Homo sapiens
catttccccctcatgttgcagcggttccccatcattccaaaagcaagatttgacaggggtggaatg

SEQ ID NO: 6836849 - DNA, 88 bp, Homo sapiens
tgagagagacaaagctggaggcatggattaggccagaggtccacaaaccgtggccaccaggttagatccagcctgctgtctattttta

SEQ ID NO: 6836850 - DNA, 55 bp, Homo sapiens
ctggtcccagaggcaagagatggtgggggatttcactctttggcttctggatcag

SEQ ID NO: 6836851 - DNA, 80 bp, Homo sapiens
gcccctcacccttcctagccaggctgcagctgatccgaggtggttccttgatcctggagtctgaagggacattgaggggc

SEQ ID NO: 6836852 - DNA, 68 bp, Homo sapiens
ccaagaggggcagagggctgcaggcactctctccccacccagctgccccatgtttcagcccctcctgg

SEQ ID NO: 6836853 - DNA, 64 bp, Homo sapiens
catgaactgtaacactcatactgaagtgggttctctcctggctgtagtgtgttagagtgaaatg

SEQ ID NO: 6836854 - DNA, 60 bp, Homo sapiens
tgacatgctgacgcccaaggtggcatctgcaacttcccagctttgggtttctcatgtaca

SEQ ID NO: 6836855 - DNA, 58 bp, Homo sapiens
tgtccttggcctgggtagagtggcacctagttggtggtgcccatattagccagggaca

SEQ ID NO: 6836856 - DNA, 59 bp, Homo sapiens
gtaatagtagctggctaatagtatgaatagtattctatatactgttctagctgcttgac

SEQ ID NO: 6836857 - DNA, 67 bp, Homo sapiens
ttatctgaatcagttaggactctgtagctaataaaagaaaggagattcaaactggtttaagggataa

SEQ ID NO: 6836858 - DNA, 65 bp, Homo sapiens
gattgccaactgtagtcaagagctttgagagagtaaaaaggtctaaagctactgagttgccaatt

SEQ ID NO: 6836859 - DNA, 82 bp, Homo sapiens
attgtatgacagattttgatggctaatagaaattttgaaatatggagttagttatataggctattaaagactgtgaaataat

SEQ ID NO: 6836860 - DNA, 92 bp, Homo sapiens
tcgggtgggctgcagggcgccggactgctgcagctgctagcggctgcggcggcggtggcagcggcggcccggcgactgcctgccacgcccga

SEQ ID NO: 6836861 - DNA, 58 bp, Homo sapiens
gctcaggcaggagtgcagtggcgcaatcatagctcactgcagcctcaacctcctgagc

SEQ ID NO: 6836862 - DNA, 86 bp, Homo sapiens
gcgacctccctgagtctcctcccacagctgcaaagctgggtgggctaacctagctctgctggaaggagtcagcccagggaaagtgc

SEQ ID NO: 6836863 - DNA, 84 bp, Homo sapiens
tcctccctccactgtggatctgaagagcaatgaaatatgagatatatattcaattatcaggatgtaaggggaattaagggagga

SEQ ID NO: 6836864 - DNA, 68 bp, Homo sapiens
ggggctctgggctgtggttccactccgtctccaggacacagtgcaatcggccacaaatttaggacccc

SEQ ID NO: 6836865 - DNA, 59 bp, Homo sapiens
tggaagaatgttcattaaactgttgaagacagttatttcaggagtgtagcattttttca

SEQ ID NO: 6836866 - DNA, 57 bp, Homo sapiens
aaatcaaccaaccactccagctagcactggctaggcagagtttaatggttaagattt

SEQ ID NO: 6836867 - DNA, 69 bp, Homo sapiens
ttgtcctggtcagggtagtgttgcagattgagtcagatgatgtctgagaacatgctttgatcattgcaa

SEQ ID NO: 6836868 - DNA, 124 bp, Homo sapiens
tttgtttattaactgatgtttctgggctagtattctgtaaagtctgtgtaaagtctataagggtgtatgtggccactgaagtctttgcttgattagcttagtgatcatctaatgattagacaga

SEQ ID NO: 6836869 - DNA, 73 bp, Homo sapiens
ccagagatgtgatcctttgctgtgtaagttatgttttctaataaaaatgatacagatgggtcagatttcatgg

SEQ ID NO: 6836870 - DNA, 82 bp, Homo sapiens
attaggggtggggtggagttagttttctaactaacagcaaattaggcggagttagttttgtaattccaccccaatttctgat

SEQ ID NO: 6836871 - DNA, 60 bp, Homo sapiens
gaaaaggcactggatagctggggatgcaccacatgcccttgtccttcagatgtctaactc

SEQ ID NO: 6836872 - DNA, 56 bp, Homo sapiens
gtgaccgtccgttcaggttggtcctcagccttgggcaagcctggagggctggtcac

SEQ ID NO: 6836873 - DNA, 67 bp, Homo sapiens
atcactccaagtgctgaggtgacaaggggagcgtcctgttggcactatctcatgttttggctgtggt

SEQ ID NO: 6836874 - DNA, 76 bp, Homo sapiens
aggtggctgtcttatgtatatttggaacgtacatctgtcttggtgtatttttattaatccatgtttattgtcatct

SEQ ID NO: 6836875 - DNA, 85 bp, Homo sapiens
tctgtaggaaattatattgagaaatccagatgtgcagttgtgcaagagcaagctggtgtggatttttgaatggatattctgaaga

SEQ ID NO: 6836876 - DNA, 64 bp, Homo sapiens
cagttgcacccatgtctccacgtacagctcatgcaggctggtgggtggtgcaggagtgtgcttg

SEQ ID NO: 6836877 - DNA, 64 bp, Homo sapiens
aggaggcactcgctcggggatggtttggtggtccccgacccctgcctcagagcgcaggccccct

SEQ ID NO: 6836878 - DNA, 81 bp, Homo sapiens
tagtcaattattttgtagctctgatcttttccccctgcacccgacaggacagaaaggtggtggttagggaatatgtgagta

SEQ ID NO: 6836879 - DNA, 130 bp, Homo sapiens
aggtttatttctcacagttctagaggctgggaagtccaacatcaaggttccggccaatttggtttataacgagggctctcttcttggtttgcagatagccacagtttctcactgtgtcctcccatggcct

SEQ ID NO: 6836880 - DNA, 129 bp, Homo sapiens
cctcccgcagagcctgtactcactcagctgataccttagcaccagctatggatgtgccccctctctaggtttggggacagtggcctggtggtataggatcagctggatcccagcaggaccttgggatgg

SEQ ID NO: 6836881 - DNA, 75 bp, Homo sapiens
aaatgcaggtgctgatacctactcccaatgtttctaatttaattagtctggagtgaggtgtgggcatcagtattt

SEQ ID NO: 6836882 - DNA, 57 bp, Homo sapiens
cttgtggaggcaggcagagtttctgggttgctcccctacctgtctgtcttcagctag

SEQ ID NO: 6836883 - DNA, 79 bp, Homo sapiens
tgtgaatcagaggctgcatttttatccagggcttctggtgacagttttaagctggatgaacaaagcagaccctgacatg

SEQ ID NO: 6836884 - DNA, 76 bp, Homo sapiens
tagttgatttttctttattctgactaatgtataactctgaagttattgagtccacattagttgatgatgtcgacta

SEQ ID NO: 6836885 - DNA, 56 bp, Homo sapiens
catagacattgataggttatatttgttttataacaattgtgtacctaatgtttgtg

SEQ ID NO: 6836886 - DNA, 67 bp, Homo sapiens
gttattcccttgccagaggcttggcttccatcagatgtaacaattcaatttctgggaaggcagtgac

SEQ ID NO: 6836887 - DNA, 60 bp, Homo sapiens
gcatttcctgtgcttggcatatgaggaaaacaacaacaaatgctcagtatcaggaagtgt

SEQ ID NO: 6836888 - DNA, 65 bp, Homo sapiens
ccacttttctgtctccatcacaccggttttctagctggtcagagtggggatagagtctaaagggg

SEQ ID NO: 6836889 - DNA, 72 bp, Homo sapiens
ttgaccacattaagtgtagttgtagactccttccagtttcaggagttcacagatgaattttaattgtgttag

SEQ ID NO: 6836890 - DNA, 57 bp, Homo sapiens
catggcttcgtcacagagggcagcaggcgccagtgcccggcccgtgtggagaccatg

SEQ ID NO: 6836891 - DNA, 84 bp, Homo sapiens
gggggtgaagtgtgtgaaggagccactgttcataagcacctgcctttatggacgcggcactttcatcagcattacaccaatccc

SEQ ID NO: 6836892 - DNA, 60 bp, Homo sapiens
gctcagagatggggaatgaaaactctagtcattgagccataacatatcctctctctgagc

SEQ ID NO: 6836893 - DNA, 108 bp, Homo sapiens
cccttcaatatgttagtgatgaatagctttatagtgcataattaacatggaataatatccagtcttttaagcactgtgatactaaggtaagacactgaagtgaagtgg

SEQ ID NO: 6836894 - DNA, 90 bp, Homo sapiens
tcttttacaattacttacagtagtgaagagcttgcagtgatatggggtaatcagtgaacacagatctttatactgtaataatgaatgaga

SEQ ID NO: 6836895 - DNA, 86 bp, Homo sapiens
ggcgggggctggccgcgcgtcgggcgccaggcccggggctgtgggcaccgtgcccagcccctggcgcacgccgagccgccgccgcc

SEQ ID NO: 6836896 - DNA, 66 bp, Homo sapiens
tcttagagactgtcaaaagagattatattaagcaacttgagtgattattttttgccagttaaaaga

SEQ ID NO: 6836897 - DNA, 65 bp, Homo sapiens
cattttaaatgatttaagccaatgaaaggacactccatttgtttgctcaatagtcaattgaaatg

SEQ ID NO: 6836898 - DNA, 76 bp, Homo sapiens
agtgttaaacagctttcagaatctctcattccttactttaaaaaaaatgagaattccactggagttgtattgcact

SEQ ID NO: 6836899 - DNA, 68 bp, Homo sapiens
tgaagtagatagggctcaggatctactaatccaaccgtgggattagatcctggcaccatcccttgtca

SEQ ID NO: 6836900 - DNA, 82 bp, Homo sapiens
ttgttctaagtgaaatacgttcactgagtcctgtgtctaatttctggttggctatactctcagttaatacacttttgagcaa

SEQ ID NO: 6836901 - DNA, 79 bp, Homo sapiens
tgttttaaaagcagctcaagacttaaatttgagttgaaaatttcttatagcaaatgtgacttttgggcttctaaaaaca

SEQ ID NO: 6836902 - DNA, 65 bp, Homo sapiens
gcctttgttagcagttaaagactccactggacttatcatcagttctggctgctgctgtcagaggt

SEQ ID NO: 6836903 - DNA, 72 bp, Homo sapiens
gaaattctctggtgctgtgatacgaggcactggagttgtaagcaaccatgtctctcatgaccaaagaagctc

SEQ ID NO: 6836904 - DNA, 90 bp, Homo sapiens
atatgtgttttggtatttggcaatgtgtacctgtgtgtgtgtctgtgtgagtgcagaagccatggtatgcaactacatccatgcatatat

SEQ ID NO: 6836905 - DNA, 129 bp, Homo sapiens
ccaggcacctaagggctctgccaattgggacagtacctcagatcagcatcatttgtacccagtgtgcaaatccctgataatgtaggtctgagatcataacttcccagggcagcctcctcagttgtcagg

SEQ ID NO: 6836906 - DNA, 84 bp, Homo sapiens
gcaattcttttccttgggaggttctgttcgcacttgacttttatcaagcggactgagatactctgcttcaacccgaagaactgc

SEQ ID NO: 6836907 - DNA, 87 bp, Homo sapiens
ttgggtgatgcctgctgggaccacactttgaacaacaagtagttctctgcttgtggtctggagaccagcagcttcagtgttacctgg

SEQ ID NO: 6836908 - DNA, 56 bp, Homo sapiens
ggggaaataaaaagctggaatgtgatctacacctgtaccttcagcagtgtttctcc

SEQ ID NO: 6836909 - DNA, 89 bp, Homo sapiens
gctctttgggaggccaaggcaggcggctgggaggtggttgtagcgagccgagatcacgccactgcactccagccttggcaccattgagc

SEQ ID NO: 6836910 - DNA, 59 bp, Homo sapiens
cagaacacacgcctcctccatggggagatcttgcttcttgtggataaccgtgtgctctg

SEQ ID NO: 6836911 - DNA, 71 bp, Homo sapiens
ggattgagtggtttcagtgccaatacagtacagaatttttgtatatgctatatcactgacttacataatcc

SEQ ID NO: 6836912 - DNA, 73 bp, Homo sapiens
gctgcaggtcagctaggcagctgtgatggccttgggatccattggcagttggctagcctgcagtgacctcagc

SEQ ID NO: 6836913 - DNA, 59 bp, Homo sapiens
cccactctccatgaggttcccacgctcttgtggtctggagccagcctgtggggagcggg

SEQ ID NO: 6836914 - DNA, 96 bp, Homo sapiens
cttccagtgtgcctgtggatccttatgggaataggatattaggtgttcatagacccatgtgaggaaggcttgcatttctagcaggctagctggtag

SEQ ID NO: 6836915 - DNA, 67 bp, Homo sapiens
gtgccagggcctgtccgctcccgcccgcctgcacgagggcccgggcagccgggtcagccgctggtgc

SEQ ID NO: 6836916 - DNA, 69 bp, Homo sapiens
aatagacactatgataggtggtatgtacgaacgtgacttgatgccatgcagcttattaaagtggatgtt

SEQ ID NO: 6836917 - DNA, 129 bp, Homo sapiens
caaatctttaagccactataataggtgagagtttttacaaaagtcaagaaacacagatgatgacccctgctgtggctttgtgtctattgtatccaaaaagcttttataccatattatgtgttttatgtg

SEQ ID NO: 6836918 - DNA, 86 bp, Homo sapiens
tcttcacagtgctggataatgcattataagaaattttcgtgaatatacttgaaagtcatttagccttatctcccactcagtgagga

SEQ ID NO: 6836919 - DNA, 86 bp, Homo sapiens
taggtgcctccgggccaaggctttgtaacgctgccactgacggaagttctcataaacgtccttggaaattttggagcggtcaccta

SEQ ID NO: 6836920 - DNA, 73 bp, Homo sapiens
ttttgttctgccttctacgcttggagtaagattttgttgaataaaacattccaggttgtagaaaagtttgaaa

SEQ ID NO: 6836921 - DNA, 72 bp, Homo sapiens
agttgaaagccttatttctctgagcacatttccctttaatcactgtgctttccagagacccaggcttcagct

SEQ ID NO: 6836922 - DNA, 61 bp, Homo sapiens
tcttttgtgattcttcagttacttcaggccatctgggcgtatacgtgcaagtcacagggga

SEQ ID NO: 6836923 - DNA, 112 bp, Homo sapiens
ggcaggaaacaatctgacttacatttttaaagtttcatttctggatgctgagcagagaatgtgctaccagggtcacaagagtggaagcagggagacaagtcatgaaactgct

SEQ ID NO: 6836924 - DNA, 55 bp, Homo sapiens
gcagctcctggcacagttttttccagcctaattgggtaaaatgacaggcagctgc

SEQ ID NO: 6836925 - DNA, 71 bp, Homo sapiens
aggacataaagacacccagggagggactagggtgactcagaacttcgggtctcttccgtgagtgttttcct

SEQ ID NO: 6836926 - DNA, 59 bp, Homo sapiens
gcagcgctgtaggcccaaggcaccagggaatccggtccagctcagccctacagctttgc

SEQ ID NO: 6836927 - DNA, 83 bp, Homo sapiens
ccacccaggcctcctccttcctgtgttgtgcaagacgaggcgtcccctgtgtggaatgggcaggcagctctggcgatgggtgg

SEQ ID NO: 6836928 - DNA, 61 bp, Homo sapiens
tctcgcggcgacgcctgcgagggacccgggccgcgggtcgaggcgggcggcgcctgcgagg

SEQ ID NO: 6836929 - DNA, 59 bp, Homo sapiens
gtgattctgttctggtgctgcccctgggcggaccctacccagcacaaggacaggctcac

SEQ ID NO: 6836930 - DNA, 101 bp, Homo sapiens
tgcatcatggtttccagcttgtcatatttataaaatgtaagattaaaactagatgatctttaggacattccagatttgacattctgtgattccctcatgca

SEQ ID NO: 6836931 - DNA, 61 bp, Homo sapiens
ttgaagtggaagcctactcttgtggttatgttgcttaaccactcattggtttctctttcag

SEQ ID NO: 6836932 - DNA, 62 bp, Homo sapiens
aggaaggggcttatgaagacgtgaggtccttgggcccttgaaagtcacatgcagccctgcct

SEQ ID NO: 6836933 - DNA, 66 bp, Homo sapiens
tgtaatcccagctactcgggagagtgaggcaggagaatcgctggaacccgggaggcggaggttgca

SEQ ID NO: 6836934 - DNA, 61 bp, Homo sapiens
atccaaatttagcaagtatttactgactaactattggttaaaagacactgctagatgggat

SEQ ID NO: 6836935 - DNA, 62 bp, Homo sapiens
ggggtgctgctctcctccatgttgcactcattcagttagtccagttggccagagcaggcccc

SEQ ID NO: 6836936 - DNA, 80 bp, Homo sapiens
gggtatcttgttaaagtgaagatactgatacaataggtcttggctgggatcttagattttgcatttctaacaagctacct

SEQ ID NO: 6836937 - DNA, 83 bp, Homo sapiens
agtgctcccactcaggtgatgatatatttaatcctagagccattgaaagcagtgttcttataaatatattgatgggagacact

SEQ ID NO: 6836938 - DNA, 65 bp, Homo sapiens
ctggaagctttggaaagcccctgggatccatgttctctgagcccactccaagggtttttctccag

SEQ ID NO: 6836939 - DNA, 119 bp, Homo sapiens
accaagccagaggtcaggaggcaaagggagagcatgcgcgtgggagacaccgctgagagggtgggtggtttccaaacacgtctgcaaattctttgacactcttcccatggagaggtggt

SEQ ID NO: 6836940 - DNA, 64 bp, Homo sapiens
taggatgaaaagtgttctttgaaggcgattttctaaacttcctcacggagttctgtttatcctg

SEQ ID NO: 6836941 - DNA, 72 bp, Homo sapiens
ctcgcccgcacaggagcaagagtcctcgtcgtttttaatctggaaatgcactctgcttctgtgacgggtggg

SEQ ID NO: 6836942 - DNA, 95 bp, Homo sapiens
ggggtgaggtttcagtctaacatcaaggtcagggtttagtctataagcagtctcaggacttatctgtgaccttgataaaggctaagtttctgtcc

SEQ ID NO: 6836943 - DNA, 92 bp, Homo sapiens
gcccctttttatggctctggcagctgatattaggacttgattacttctgaactcctgaaaacatgtttgctgtcagttgcaaaagaggtggc

SEQ ID NO: 6836944 - DNA, 60 bp, Homo sapiens
gtattgagctgtgattaactctgagactttagggtctcagagtttacggggctgaagtgc

SEQ ID NO: 6836945 - DNA, 78 bp, Homo sapiens
ctcactgtatcagtatttctaaacattggctgtacatttaactatgtgaagaagttttgggaaatactgatacctgag

SEQ ID NO: 6836946 - DNA, 100 bp, Homo sapiens
cagagctgaggttagatactagagtcccttctggcctctcaggcctcacagtccttgatgggaggcaggtaggtgatgatggtggttcctggaagccctg

SEQ ID NO: 6836947 - DNA, 77 bp, Homo sapiens
gcatagagcctgatacatagtagcatgtcattacattttgtttagtgaagatatagcttgtgttcagaacaatatgc

SEQ ID NO: 6836948 - DNA, 80 bp, Homo sapiens
agaacatcttatccatttcctcttaatccagtttatattcatcctgagcccatcagagcaggagatggaatgagagtttt

SEQ ID NO: 6836949 - DNA, 69 bp, Homo sapiens
gctccatttccatgtttactgggacacaacattgttccacttggttgcatcagaaaatatgggaagagt

SEQ ID NO: 6836950 - DNA, 88 bp, Homo sapiens
gtctctttgctgtattggtgatgacttgaggccagagtttgcaaaacagaaaatgctcatatgtatttccaatgccaaggaaggagat

SEQ ID NO: 6836951 - DNA, 55 bp, Homo sapiens
ctcttttgagacagggaaaggtccatgttggggtcttttaccttcttgagagcag

SEQ ID NO: 6836952 - DNA, 105 bp, Homo sapiens
atccatttatataaaaaatgttttcgcacctctcttggatgtggatgggtgcccaggggtaacactttctagacaagggaataagtgtggacacagacattggat

SEQ ID NO: 6836953 - DNA, 55 bp, Homo sapiens
agagtctgtgagtccctgagcatcgcacagctgcgtgtttctgggcacagattct

SEQ ID NO: 6836954 - DNA, 65 bp, Homo sapiens
tttttgtaacccagaaactgtcaacatcagtttttttatgtgttgacagtctgcagttttaaaaa

SEQ ID NO: 6836955 - DNA, 113 bp, Homo sapiens
gctctaacagagaaggagagaaaggagagagccgacccagttctagccccacctgctgggtcctgagcagaagggctacacgggctctccttccctcgcctcctggttggagc

SEQ ID NO: 6836956 - DNA, 130 bp, Homo sapiens
gatgtggagaaactggaaccctcatacactgctggtggaattgtaaaatagtgtggccgctttggaaaacagtctggccattcatcaactgatagccatagagttaacatatgacacagaaattccacac

SEQ ID NO: 6836957 - DNA, 56 bp, Homo sapiens
cctttgccctggaccgtcctccctagtggctctggaaagaggaaacaaggcagagg

SEQ ID NO: 6836958 - DNA, 55 bp, Homo sapiens
ctgccgttgaagtgtcataacaaggtgttatgcttcccctctcatttcagcgcgg

SEQ ID NO: 6836959 - DNA, 60 bp, Homo sapiens
gaaagttgcaatcatggcttttgcagtaagcactgctatgtgaagtagttgcaaactttc

SEQ ID NO: 6836960 - DNA, 100 bp, Homo sapiens
ggattactcaccagacagatggcagtgaggttcctagcctgatagcagggacctaatagcaggctaggaacctcactgccatctgtctggggaataatcc

SEQ ID NO: 6836961 - DNA, 84 bp, Homo sapiens
gcattgccgtttgtagcaaagcttacttagtgatgccaggagttcattccaatccttaagaaagttttctataatttcaaatgc

SEQ ID NO: 6836962 - DNA, 63 bp, Homo sapiens
agtatgtgaggttggtttccagggcctagtggtagcactactttggggattatttttactact

SEQ ID NO: 6836963 - DNA, 59 bp, Homo sapiens
aggtgggcatagctagaatatttgataccaaatattgtctaaccatgctgtgctagcct

SEQ ID NO: 6836964 - DNA, 76 bp, Homo sapiens
gggctggaccaccagaggccccgaccagcttgtccgaaagggtgggctgctcggagcctcctgtgagtaccaggcc

SEQ ID NO: 6836965 - DNA, 59 bp, Homo sapiens
gcatgatgaaggaggaggagtcagacagccctagactttaatttccacttctatcatgc

SEQ ID NO: 6836966 - DNA, 57 bp, Homo sapiens
cctgtgctggacagggctgggcttggaagcatgaaggcctcaccatgtcaagccagg

SEQ ID NO: 6836967 - DNA, 90 bp, Homo sapiens
agtaggacaatatatgaaaacactttagaaagggacttgcgattaggtagcttttttgaggtgtttgtttgtttgtttgtttgtccctct

SEQ ID NO: 6836968 - DNA, 64 bp, Homo sapiens
tggtatttgcaggaattgtgattttggaactttatttaaataatcaatttttgtagatatgcca

SEQ ID NO: 6836969 - DNA, 64 bp, Homo sapiens
ggcccttgcagcaggcgctggcagggtggaagacctggcagtgcctgatgctgcaggaatggcc

SEQ ID NO: 6836970 - DNA, 113 bp, Homo sapiens
ggacctctggttttcttatacatttagagtggagtctgatcttaagctacttctgctatctggctgtagtagatgagaatctctttatatgcctccaaggaggcccttggtct

SEQ ID NO: 6836971 - DNA, 61 bp, Homo sapiens
tgtcatatgctgtcatagccatacaatttgtaagtcccgtggctggtgtttagctgtgata

SEQ ID NO: 6836972 - DNA, 68 bp, Homo sapiens
tggctttgcaaactcattccacattcatggaatcccggacattttcagtgtggatagttttgtagcca

SEQ ID NO: 6836973 - DNA, 91 bp, Homo sapiens
gagataccagcgtttcagccagcggtgtgagtgagggcaggggccacctctgagggtgcttgctccctcacactgtcctcacgctgccctc

SEQ ID NO: 6836974 - DNA, 82 bp, Homo sapiens
ggtacagacggcatctgctctgcaaggcacagtgatcgggctcagcattgtcactggagctcttgcggttctgtttgctgct

SEQ ID NO: 6836975 - DNA, 76 bp, Homo sapiens
ccctcctaccattcctctagcttctcactaacatgtatgttgtgaaacagagttgaggtacatggtcctaggaggg

SEQ ID NO: 6836976 - DNA, 80 bp, Homo sapiens
ttagattgaaatacataaaattgccatatttgtgggtaaaaattgctcaaatattggcaattttaggtggtttagtctaa

SEQ ID NO: 6836977 - DNA, 85 bp, Homo sapiens
ggatgtctacagacctgattcaagtcttgaatccacaatatacttaactgtggtgtactcaagctgagtctctgttatttcattc

SEQ ID NO: 6836978 - DNA, 56 bp, Homo sapiens
agcacagaatggcttggaagcccctaaacatggtcctccaagtcagagtttatgct

SEQ ID NO: 6836979 - DNA, 61 bp, Homo sapiens
ggtctgtttaatgtaagggttggatagtttcctgacttaacagcaaatcattgggcagact

SEQ ID NO: 6836980 - DNA, 68 bp, Homo sapiens
ggagaaaacagggtggtgaatagctatagtggtagtgaggtaactggccacagcctcttcacccctcc

SEQ ID NO: 6836981 - DNA, 83 bp, Homo sapiens
cattatgataaattcttgttcctttgtattcttagcaatggcaggcttggaatactaaaggaagcaattgacttaaaatagtg

SEQ ID NO: 6836982 - DNA, 66 bp, Homo sapiens
cctcagaggttttcattctgtaggccagtgtgaggcttgcgaagttctgaatgaactctctgaagg

SEQ ID NO: 6836983 - DNA, 80 bp, Homo sapiens
cagaagagagtcgggaggtttcgcctgaggcctgcaggagctagtttatgcaggtacatgctgaaaaagacactattttg

SEQ ID NO: 6836984 - DNA, 63 bp, Homo sapiens
ccattgaataatgtccttgcaaagcggcatcttgctgtctattttcaggtacttaattaatgg

SEQ ID NO: 6836985 - DNA, 70 bp, Homo sapiens
ctggatgttgaggtgctgtgcaggaggcagaatgagctttgcttcaaggccaagacaccttaaggtcaag

SEQ ID NO: 6836986 - DNA, 75 bp, Homo sapiens
ctggggacctctcaaccttctttagaagatggaggggcttccttcttcatggtctggttctccaggggctcccag

SEQ ID NO: 6836987 - DNA, 125 bp, Homo sapiens
ctgtttctgctaagatgaagcattgctagagggataggcacaggaacaggaaaagaggaaaatgaaatcctttcctcatccttaactgtccagtttccctctggtgcttgcatttaaaaaaacag

SEQ ID NO: 6836988 - DNA, 84 bp, Homo sapiens
aggggccccctctactttaacatggaggcacttgctgtgacatgacaaaaataagtgcttccatgtttgagtgtggtggttcct

SEQ ID NO: 6836989 - DNA, 78 bp, Homo sapiens
gaaaatagatactacttagatgtagcaaattggttccttttcctttgcctcttgtatacctttatgtagtttattttc

SEQ ID NO: 6836990 - DNA, 61 bp, Homo sapiens
cccagggcatcacatccagtgttgggctttcaattccatctgcctgcttatgatgcctggg

SEQ ID NO: 6836991 - DNA, 73 bp, Homo sapiens
ggctgaaaatttcgggagtcacctggggtggtttaccagcctgcaggggagagacttctaggaaaacgcagcc

SEQ ID NO: 6836992 - DNA, 84 bp, Homo sapiens
ggacctcccttccccagcccatggccagaaccaagctccactccaaggtggatgtggctgccatggagcctgggactgtggttt

SEQ ID NO: 6836993 - DNA, 75 bp, Homo sapiens
tgcgtttgagatggcattcacatttccagagaggaataaaagaaaccatcttggaaatgttgggggccccatgta

SEQ ID NO: 6836994 - DNA, 60 bp, Homo sapiens
tccttcatcatcaaggtatggttcctggagtagcaggacaggatgctgaagatgaagtga

SEQ ID NO: 6836995 - DNA, 59 bp, Homo sapiens
gcatggtttacagaactcctagcatgctttggcatgcatgtcttctgttgaatgcatgc

SEQ ID NO: 6836996 - DNA, 57 bp, Homo sapiens
tttgctctgacatgccccagcatgttttaggatagtggttggatatgtcagagagaa

SEQ ID NO: 6836997 - DNA, 75 bp, Homo sapiens
agtctctggcatctcctggtacaatagatgttcactagactgtgagctctgagacagtagagatggcacctgact

SEQ ID NO: 6836998 - DNA, 115 bp, Homo sapiens
gctattataatttctgtttaacaagtcaaatttctatttaaccagttaaatttccatttcacaatggagattcaaaggggttaagtgacttgcctaaagtcacagatctggtggc

SEQ ID NO: 6836999 - DNA, 71 bp, Homo sapiens
gtgccttatagtggatgaactccaaaccaacatataagatgcttggtctgtgttacatcatttaaaggtgc

SEQ ID NO: 6837000 - DNA, 69 bp, Homo sapiens
tttagcaggtctgttgattacagtcatatttgggtcataatcatgacatggaaatcaatggatgctaaa

SEQ ID NO: 6837001 - DNA, 68 bp, Homo sapiens
agggccactgtgtttcattctctctgaatggcccctggagctgagcagggaggagatactgtgtatct

SEQ ID NO: 6837002 - DNA, 60 bp, Homo sapiens
tggtgtggaggctgtcctgtataatgtggtgtgtttaccatcatccttggcctctaccca

SEQ ID NO: 6837003 - DNA, 77 bp, Homo sapiens
tcgcttgaacccaggaggcagatgttgtggtgagctgagattgcgccattgcactccagcctgggtgacaaaagtga

SEQ ID NO: 6837004 - DNA, 72 bp, Homo sapiens
gttgctcaagatggtgtggtcaaggaccaacagcagttggcatcacctccacgatcatctggtgatagtaac

SEQ ID NO: 6837005 - DNA, 59 bp, Homo sapiens
tgggaatagtctttactgctgaattgaggtagaatggcctcaaaagacacacattctca

SEQ ID NO: 6837006 - DNA, 82 bp, Homo sapiens
gggacaggtgtatactggggtaggccttggctaggagtcctggatggtaacttagtaggcttcacccctctctatgtgtcct

SEQ ID NO: 6837007 - DNA, 90 bp, Homo sapiens
cagtagcatggtagtagctaggaatacagacactgcccttcacatggcataactttgtttttgtctccttgtctgcttttcatgcaattg

SEQ ID NO: 6837008 - DNA, 72 bp, Homo sapiens
tcttggtatacgcatggcattggttccaggatcgtccatatatgctcaaatccaatccatgcatactcaaga

SEQ ID NO: 6837009 - DNA, 61 bp, Homo sapiens
gacattgatgaagataatagcattggttgaaaattaacccctacacatgtttattgatgtc

SEQ ID NO: 6837010 - DNA, 72 bp, Homo sapiens
gtgtgtcatttgaatgagggaaccacagttggtctcctgagaaactgttctacccttcatttcatgatacac

SEQ ID NO: 6837011 - DNA, 129 bp, Homo sapiens
tccccatgcatacagctcagtcaatgtcctgtggttcctcagggcagctgtactctgtgtcagggacaggtgagatgaggaacacctgcagtgaccaaggcctggctgaggctggtaagaggcaggaaa

SEQ ID NO: 6837012 - DNA, 72 bp, Homo sapiens
tctcaccgttgacagcatccaagagggagggagcttcgggactccagtctgcagggttgtcgagatgggaga

SEQ ID NO: 6837013 - DNA, 66 bp, Homo sapiens
gaaatctgaatcttctgttggtcactcttgggctgaaatgatgttcaagtcagaggtcagcgtttc

SEQ ID NO: 6837014 - DNA, 130 bp, Homo sapiens
tctataaagtcttattctttgttgtgtgtagccattgaagtgtttgttcagttagctcagttgtcagccagtgattgggcagaaatttccttaaatgcctattaccaataggtttcctagtctttgctga

SEQ ID NO: 6837015 - DNA, 66 bp, Homo sapiens
ggggatatataacctggataaggctttcaatttttatatttaagctgttactcagttgttttcccc

SEQ ID NO: 6837016 - DNA, 56 bp, Homo sapiens
ccagccttgcaccgagccagcccagccagggaagagtggagaggaggcaaggctgg

SEQ ID NO: 6837017 - DNA, 55 bp, Homo sapiens
ggggtgcgggccccatctggctagatgatgtgggctgtgtggggaccgaggcttc

SEQ ID NO: 6837018 - DNA, 70 bp, Homo sapiens
aaatttggacttgggtgctagagaccttagccctgcagtgggcagaatttaggccctaagtgatagattt

SEQ ID NO: 6837019 - DNA, 82 bp, Homo sapiens
tctgctgctttcatttcagttttgagatgacctggctggcagtgggctgagccagtctctcagaaccctttgaagcactgga

SEQ ID NO: 6837020 - DNA, 73 bp, Homo sapiens
cctcaatatcagtgcatgaaacaatatgcagtgactaaaagtctctaatttttgttctgcattgaatatgggg

SEQ ID NO: 6837021 - DNA, 55 bp, Homo sapiens
agtgcagctctgacaatgcctggaacaggctttccaactgcatttagagttgcct

SEQ ID NO: 6837022 - DNA, 83 bp, Homo sapiens
tcctgggactctgcctcaggctctcctggctagacacagagcagaagccaggtaactctacagcctaaggaagacccccagga

SEQ ID NO: 6837023 - DNA, 68 bp, Homo sapiens
gtcctgaactgccttcttagtgacctgtggcatgtcctgaatagcctttctgagcaggcaggtaggat

SEQ ID NO: 6837024 - DNA, 74 bp, Homo sapiens
catagtgtaagtcctcaagtcaaaaccgtgtgtgtattaggtacaaatcagtccctcttggaatttacattatg

SEQ ID NO: 6837025 - DNA, 82 bp, Homo sapiens
ctttttctttggtagaaattcacagattctaaaatttgcatgaaaagaaactgtgcgtaagtagccaaaataaatgaaagag

SEQ ID NO: 6837026 - DNA, 129 bp, Homo sapiens
gtttgaaatggagagtttaaaggttttataaaaaggcagtaaagagcagtgctgaagagtaggggttcagaagcaacagacctcaagtctgagtactggctctgctgcttgcatgaccttgaaacttgc

SEQ ID NO: 6837027 - DNA, 88 bp, Homo sapiens
gcctgcttaaagggatttgacttggctgggaggagggcccttttgtacctcccccttcttcctcctgctgttagtcttgaatgcaggc

SEQ ID NO: 6837028 - DNA, 68 bp, Homo sapiens
gtcaattgcccatctcctgtttgctttatggggcgcacccagctgaggaggaatgatgggtagaagat

SEQ ID NO: 6837029 - DNA, 61 bp, Homo sapiens
ggtgatggggagattgtggaatggggcattgcctgagtcccataatgttgccaatgttatc

SEQ ID NO: 6837030 - DNA, 63 bp, Homo sapiens
gttagaagtttccatcatgtgtcaagatgattcttgcataatatgttgtgaaattttagtagc

SEQ ID NO: 6837031 - DNA, 61 bp, Homo sapiens
tctccaaatagttatatttagagcccctgaaggctgggacttcaacatgtgaatttggggg

SEQ ID NO: 6837032 - DNA, 75 bp, Homo sapiens
cgtctgggaggtgaggggcgcctctgcccggctgcccctactgggaagtgaggagcccctctgcccggccagccg

SEQ ID NO: 6837033 - DNA, 55 bp, Homo sapiens
aataagtacttggggataacttgggcatcacccaagttatatactagtatttatt

SEQ ID NO: 6837034 - DNA, 87 bp, Homo sapiens
gacagtggccaggtttgtgggtagaggtgctttgcagaggccttccttccagcttccaaggtttctccagcctcctttaacactgtc

SEQ ID NO: 6837035 - DNA, 72 bp, Homo sapiens
gcccaggcatgtctacctgtgaagacccagatccttctaccccacaatgctgctcttcagtgacagtctggc

SEQ ID NO: 6837036 - DNA, 60 bp, Homo sapiens
gcatggaaaggcctcagtataataagtaccatgaattgatttattgagcacttaccatgt

SEQ ID NO: 6837037 - DNA, 66 bp, Homo sapiens
gcctgatgcttacagctctcctgggagtaaagtggcaagccccagtagtgttgctgagtgtcaggc

SEQ ID NO: 6837038 - DNA, 58 bp, Homo sapiens
ggttgagacagcagggatgtgtgtgtcagtctgtagcaacatctcctctatctcagct

SEQ ID NO: 6837039 - DNA, 74 bp, Homo sapiens
gagtcacttgctgcttcagtgggctctctggggtgtcccagcaggccactgcagctggagccagcggtgacctc

SEQ ID NO: 6837040 - DNA, 62 bp, Homo sapiens
tgggttagcggttgatattttgatttggttactgtggtcatattgtgacagctgctagctca

SEQ ID NO: 6837041 - DNA, 70 bp, Homo sapiens
ctgtgcaatggaggagttcagcagcatctaaactctactcactagatgacagtagctcccccattttcag

SEQ ID NO: 6837042 - DNA, 98 bp, Homo sapiens
ggttatgtagcaaataaatgacagagccagaactagaccttgtattttttaacctacagtctaatcttgtgttctgtatgcttgtttgttttcctgct

SEQ ID NO: 6837043 - DNA, 107 bp, Homo sapiens
ctgttggtcttctgtttagccattattctcagttctgtgcaggagtgagctgaaacaaagttgtatagcccagagagtgagaagctgcatttcatgtctcccaacag

SEQ ID NO: 6837044 - DNA, 80 bp, Homo sapiens
aggaatctccttgaccagttccccaaattgctttatattgtgagttttggaagagaacttggtcaagtgaggaagatcct

SEQ ID NO: 6837045 - DNA, 65 bp, Homo sapiens
gctaggaagatatttgggtaaagttaatacaaggatctcttattaccttggcttagcttcttagc

SEQ ID NO: 6837046 - DNA, 70 bp, Homo sapiens
tgacaataagattgtcatagtatggacatggaatagaatatattcaactggccagtggaattttatgtca

SEQ ID NO: 6837047 - DNA, 75 bp, Homo sapiens
acaaagtgaacagaggaagagtgggggttaaattagattttactaggcagctgccctctccttcctacttaatgt

SEQ ID NO: 6837048 - DNA, 76 bp, Homo sapiens
caggggcaagagcagtgttttactcagctgatgctattagctggggctttgatgaactgatttgcttttgctgttg

SEQ ID NO: 6837049 - DNA, 83 bp, Homo sapiens
aattaatgacctgtgcatctctccctcatctaatgattgcaagctcattgagctgaaggaagatagtgtctctgtcattgatt

SEQ ID NO: 6837050 - DNA, 70 bp, Homo sapiens
gcttcagaaggaatcactcaactgcatttatctggcaggagaaaaatgcaggtagtatttattttggggt

SEQ ID NO: 6837051 - DNA, 70 bp, Homo sapiens
gaatgatgagggaggcaaggagatgctattcattctcacaaatggagtctcattttactccttctcattc

SEQ ID NO: 6837052 - DNA, 58 bp, Homo sapiens
ctgcagggtttttcaaggacaaccaaggtattgatttggcaaccaaaaactcctgtag

SEQ ID NO: 6837053 - DNA, 56 bp, Homo sapiens
tttctcagctttccttgcagttatgtgcagtcatgtagctgatacacagtgagaaa

SEQ ID NO: 6837054 - DNA, 84 bp, Homo sapiens
gcctcgcttccggtcttcctctgcggcgccgggcgcgggcccgcggcggccagcgcttccggtcggcaggaggcggggcgaggc

SEQ ID NO: 6837055 - DNA, 70 bp, Homo sapiens
tgtccccatccctaaggtaactgcttttggctgaaaaccatttaccctagagctagaaactttggggaca

SEQ ID NO: 6837056 - DNA, 74 bp, Homo sapiens
ggagcttgggtgccatgctgagcccaaagaaaattataaaggtgtccaggcttgtttgcatggtccccagctcc

SEQ ID NO: 6837057 - DNA, 75 bp, Homo sapiens
ggatcagattagtcttttgagaagtatatctacagaatgttcctgagtgtattatgcagcggaggtctcaggtcc

SEQ ID NO: 6837058 - DNA, 125 bp, Homo sapiens
acatttgtaggcagcactgtgtaatgagggttgagtgcattgctatattatgactagaggcatatcttttcactatctcagtaaagcactcctagcttttatacacagtgttactggtcaagtgt

SEQ ID NO: 6837059 - DNA, 96 bp, Homo sapiens
gggtgtgtgtgggggtgctgtctgcctgagaagtggggtgcctgacatgcagtagatggcctctagattctaggccagccatcacctgtttgatcc

SEQ ID NO: 6837060 - DNA, 76 bp, Homo sapiens
gacataagcaaaggaattaacaatatatttaggtgcaggcacatttctaaatgtggttgatcagctgactgaggtc

SEQ ID NO: 6837061 - DNA, 93 bp, Homo sapiens
ttttcttgggacaaaatgttgcactaagtgaagagttttttctcttagatagaagagccacattagccaacaatttggaccctatgcagagag

SEQ ID NO: 6837062 - DNA, 57 bp, Homo sapiens
ctttccctttcagaagcaaggtgctgttgtgttagtatgtgctgccaccagggagag

SEQ ID NO: 6837063 - DNA, 71 bp, Homo sapiens
gctggccaggtgtccccgtcactgcagagttctggtcttagactggctgcacacggagactccagggcagc

SEQ ID NO: 6837064 - DNA, 67 bp, Homo sapiens
tgtttttagcatatgtcaaatcagactctaaggattctagaaagctgaaattcagatgctaaagata

SEQ ID NO: 6837065 - DNA, 128 bp, Homo sapiens
atcagcactgactcagaacttgttggaaatgcaaattctcagaccccaccctagaccttctggatccgaaactctacaggtggggcctggcaatctgtgttttaacaagttgtctaggtaacgctgat

SEQ ID NO: 6837066 - DNA, 129 bp, Homo sapiens
aggtgtcagtggcaggtgtttcgtggtgctaccggacaggcagaatgaccgacctcgccgggcgaccgctcccagccgcgagaatcctgtattcgtttatctgggagtgaccatcctcgctactcagct

SEQ ID NO: 6837067 - DNA, 64 bp, Homo sapiens
tgtttggctcattgcatccatgtggattcccacacccctggtggaagcagttccagcacaaata

SEQ ID NO: 6837068 - DNA, 56 bp, Homo sapiens
ctgtctgcattggaagtctggctgggaaacaagtcctgagactttgagttagaggg

SEQ ID NO: 6837069 - DNA, 94 bp, Homo sapiens
attcaatagatctgggttgggacctaagagtctgggtttctaacctgctcacagatgatgcctctgctcttggtcctcagaccacacttggagt

SEQ ID NO: 6837070 - DNA, 98 bp, Homo sapiens
ggccaggccgggcacggcggcttatgcctgtaatcccagtactttgggaggccgaggtgggcggatcacaaggtcaggagttcgagaccagcctggcc

SEQ ID NO: 6837071 - DNA, 77 bp, Homo sapiens
agtctgaatgttacagagccctttggaaaatggcttacctggcttctgtcatgctcatgtaattgtacattcagact

SEQ ID NO: 6837072 - DNA, 56 bp, Homo sapiens
gagggtgggtttcttgcacgtcggcctttcttctggtcagcgtgtccccgcgtctc

SEQ ID NO: 6837073 - DNA, 60 bp, Homo sapiens
caaagggattttaaggggaggggttggtcaaagtcaccctctctaaaaagattctatttg

SEQ ID NO: 6837074 - DNA, 59 bp, Homo sapiens
ctggattagattcacacctgtcttagaacattcttcagagtagatggaagctgatttgg

SEQ ID NO: 6837075 - DNA, 67 bp, Homo sapiens
ggagggcaaagtaatttggagatatatatatatatatatatataatttgaaaatactcatgctcttt

SEQ ID NO: 6837076 - DNA, 69 bp, Homo sapiens
ggtacagaaatggggccccaggtgctgtctgcataccttccctgcaccaggaggccttggttctgagcc

SEQ ID NO: 6837077 - DNA, 85 bp, Homo sapiens
aagaaaagaaatataatttttaggtaactggtgaaatgtgaatatggaccaggcttgataccaagaaattattctttcttttgtt

SEQ ID NO: 6837078 - DNA, 65 bp, Homo sapiens
tcaagggctttaatgattattttctctaacaaccagattttagagactcataagaagccacttga

SEQ ID NO: 6837079 - DNA, 121 bp, Homo sapiens
ccgcgctgccattcttctccatctgcctgggatgcaggggctgtgttttgggtttcattatggtatccagcacctagtgtagccctgggcacacagcagatgttttagagggacgtgtagg

SEQ ID NO: 6837080 - DNA, 75 bp, Homo sapiens
gcaagttagtggaggagccaaagtgaaaatgcaatatcctcactgctaatcttgtactctttccattgtatttgc

SEQ ID NO: 6837081 - DNA, 59 bp, Homo sapiens
gccatcagcgtctgagagactgcccgttgccaaacatgcacaattttaggcctgctggc

SEQ ID NO: 6837082 - DNA, 61 bp, Homo sapiens
tttctaggacatgataggatatttcaatctgtacatgcaagttatccttcatttctggaaa

SEQ ID NO: 6837083 - DNA, 74 bp, Homo sapiens
tgaaactacagtagaggttgtcagggattgtggcaaagattgtgtaggtgacaaacctcactgtaggcgactca

SEQ ID NO: 6837084 - DNA, 78 bp, Homo sapiens
tttttgcaagctgttaaggctgttggtatttcagatattgaaaaatttctatgccaagccagactttaactggaaaaa

SEQ ID NO: 6837085 - DNA, 55 bp, Homo sapiens
ggctctagagctgtgcacacatgttcagacattggagcacatcttgtctagcgcc

SEQ ID NO: 6837086 - DNA, 64 bp, Homo sapiens
cttcagattttgtttactggtagctgttggagatattctgacttcctgtaaatagaattccaag

SEQ ID NO: 6837087 - DNA, 59 bp, Homo sapiens
agagggggttgtcttccaagggtctctgttattaaaagacctgaagagtttctctttct

SEQ ID NO: 6837088 - DNA, 69 bp, Homo sapiens
cttttctatttgtgcttaaagtctgcatgaaattgacattatgcatatgcaatgcacaatttggaaaag

SEQ ID NO: 6837089 - DNA, 90 bp, Homo sapiens
gcccttggcatgcagtgcaggggctgggccagggtagtgacccttcacacctgtgagtctcggcttgcctgattattgggtgccagctgt

SEQ ID NO: 6837090 - DNA, 56 bp, Homo sapiens
agtcaggtggttctgctccacttagtattaaatataagtggggtcactccttgact

SEQ ID NO: 6837091 - DNA, 73 bp, Homo sapiens
tttccttccttactcctttctaccagccatctccagggcagggatgtggcttggcagggaatatggggggaga

SEQ ID NO: 6837092 - DNA, 82 bp, Homo sapiens
aattactcttgaacttacattgaggaattcttactttttcattttcttgaatagaaatcctgatggagtctgaagaggaatt

SEQ ID NO: 6837093 - DNA, 116 bp, Homo sapiens
ttggaatgtggtccttagctttgcaagtctagatcctgtgttttattggtgcagtcagagaaaactggttttctggaattaaactcaggagactcatgcttaatccacaattccaa

SEQ ID NO: 6837094 - DNA, 63 bp, Homo sapiens
gtggattatatgcataataaatcttgataaataaaacagaggaaattatgtgttttaatccat

SEQ ID NO: 6837095 - DNA, 63 bp, Homo sapiens
gtggctggatttagggttccctcctggtgctgtacctgggaggcagacgctggagcccaccgc

SEQ ID NO: 6837096 - DNA, 55 bp, Homo sapiens
aggaaatgccgcggctctctttaggcctagggttggctacaatgtggcatttcct

SEQ ID NO: 6837097 - DNA, 82 bp, Homo sapiens
tttccagtgataaataagactgaattctaaatgtgatgagatacctgtccattatagagggttacagttaataacatggagg

SEQ ID NO: 6837098 - DNA, 55 bp, Homo sapiens
tcgtttgatatttttaatcctgatgttatatgccatgtaacagagtatcaagcga

SEQ ID NO: 6837099 - DNA, 57 bp, Homo sapiens
ggctggagtctacattcaagaatcataaaccaagatttctggctttggacattagcc

SEQ ID NO: 6837100 - DNA, 70 bp, Homo sapiens
tttggcttctctgttttagtatttccagtggtttacacaagaggttagctattagcaggcgatcgttaaa

SEQ ID NO: 6837101 - DNA, 120 bp, Homo sapiens
aggttcacttggggagtttgttaaacagtgcagattcccgggcctctccctagaaattctgatttagtaaatttgggttgggcccagagaatccacaggtttaagcttcccggggatcct

SEQ ID NO: 6837102 - DNA, 67 bp, Homo sapiens
ggtggctggttttataagaggttaactgcttctcagtttgagcaagactcatgtggcaccaggcact

SEQ ID NO: 6837103 - DNA, 66 bp, Homo sapiens
gggcagagggcatgtgaagtaacctaggacctgctggtcaccctgggtgatgtgctgccctcgttc

SEQ ID NO: 6837104 - DNA, 119 bp, Homo sapiens
gggtcaggggtgcaggagcagacatgcctcctagggtcccagataggagccagaaatggcctggctctgagtggtatcttgaaatgggggctgcctagggccactgcaccctgggaccc

SEQ ID NO: 6837105 - DNA, 61 bp, Homo sapiens
gagtaatgctcaaggtctgtttctaataattagtagtattatgaccctgggcaattcactc

SEQ ID NO: 6837106 - DNA, 78 bp, Homo sapiens
cttaatcccttccattaaacttgtggacccagtgcctgtgtgtattgggctaacttttaatgaaataggcaagttaag

SEQ ID NO: 6837107 - DNA, 56 bp, Homo sapiens
ttcaagcagggattggtgatggcaactgttcccattaccaaagttcaggttttgaa

SEQ ID NO: 6837108 - DNA, 95 bp, Homo sapiens
gtgggggcaaggtggactattcaattatggtttaggtaattgggtaattatccataattgggtagccatctgaaaaaaagtaaaattgaacccat

SEQ ID NO: 6837109 - DNA, 55 bp, Homo sapiens
acccagaattcagtcttaggccacaatgataaagggcttatttctggttttgggt

SEQ ID NO: 6837110 - DNA, 60 bp, Homo sapiens
ggtggctgggagcaacttgggaagggggaaatcccctctggccttatctgtccaagccct

SEQ ID NO: 6837111 - DNA, 64 bp, Homo sapiens
ggcttgggggctaccttaacattgcctgtatgaaatgcaggctttgacttggggcaaccaggcc

SEQ ID NO: 6837112 - DNA, 127 bp, Homo sapiens
ggaaattataccttaataaagaaaactaaagcatatgtgtggtcacaaccaatccttgtcattatgccatgaaagccttgggatttgtgatcaaagcaatgagcttatcctgaactgtggtgtaacc

SEQ ID NO: 6837113 - DNA, 60 bp, Homo sapiens
cagccattctaacactgccagtgcagaggggcctcagacgctggagtgtagcagtggctg

SEQ ID NO: 6837114 - DNA, 74 bp, Homo sapiens
ggaagcccatcttatgagacccataaagatcagcctctcagagctgactgttggctcattggcatgaggaaccc

SEQ ID NO: 6837115 - DNA, 65 bp, Homo sapiens
ggctactagactttgatactaggaaacctgcttggtgtgcctgttggctcagactctggtgtgcc

SEQ ID NO: 6837116 - DNA, 88 bp, Homo sapiens
gcgttatcttatcaaagtaaccattctgttgccattttgcagatgaggaaacctatttggaaaagcggtaacttgctcaaagtaatgc

SEQ ID NO: 6837117 - DNA, 98 bp, Homo sapiens
gaggcaggagaatttcttgaaccccagaggcggaggctgcagtgagccaagatcgtgccattgcactccagtctgggaacaaagcgaaactctgcctc

SEQ ID NO: 6837118 - DNA, 80 bp, Homo sapiens
aaagaacaggtggcataggcagtttgaagtcagataaacctgagtttgaatcttagctctgccacttggacaaattcttt

SEQ ID NO: 6837119 - DNA, 129 bp, Homo sapiens
tctggacttgcctgggacaaatgtagtagagggagggggctcgggccccactgagctcagggctattcttggagcctgagtcagcggaggcaaaggattcctgccctgcttgtccaggcagcagttaga

SEQ ID NO: 6837120 - DNA, 85 bp, Homo sapiens
tctcttctgttcaccagtcagtcaatactctttgagcacatactctgtgccaggctgtgggctactgctgaagatacagaaccga

SEQ ID NO: 6837121 - DNA, 55 bp, Homo sapiens
ggagcaggcaggaggctactaagggtcttctttaacaaatgactcttgtctttcc

SEQ ID NO: 6837122 - DNA, 72 bp, Homo sapiens
ccagcatggaccatgtgttgctgacaggaagttcctattagcagttgtatgtgtctgattaataaaagctgg

SEQ ID NO: 6837123 - DNA, 70 bp, Homo sapiens
atgacccatttgcttttcctgtaaaacttgattttattttcattatctcttacaggtgaagagagggcat

SEQ ID NO: 6837124 - DNA, 62 bp, Homo sapiens
ggacatttccaggaggaggtactagagggaagccctttacaaagttcttcatgggagtaccc

SEQ ID NO: 6837125 - DNA, 69 bp, Homo sapiens
cacactgcttctcacttgtcaatcctgtaaaaaagatttgctgtactgggagagaagccgtactgtgtg

SEQ ID NO: 6837126 - DNA, 75 bp, Homo sapiens
tctgctacctgtgcaatcttgagcaatttatttaacctttatgagaatgaattgaatgttgtacagattagctga

SEQ ID NO: 6837127 - DNA, 73 bp, Homo sapiens
gatgaagcttttgtagtgggtatttgaacaaagtccagcatttcaaatgatacctattactaggcaaaacatc

SEQ ID NO: 6837128 - DNA, 72 bp, Homo sapiens
tctttgagagaggcctggatacagaagtgaatattttaaaatattagggtttatcaaggcactttttaaaga

SEQ ID NO: 6837129 - DNA, 71 bp, Homo sapiens
gtggtaccagctgcatgcagatgtagccagcaagataaggcagttcaatgtctgcggctagctggaaacat

SEQ ID NO: 6837130 - DNA, 67 bp, Homo sapiens
gtctctggttgataattctaggttggtagaaaactctgcttccaatcagagctattaatgcactgac

SEQ ID NO: 6837131 - DNA, 61 bp, Homo sapiens
ttgcaaatacttttagcctattgagttaatagtgattcataggatcaaaagctgtttgcaa

SEQ ID NO: 6837132 - DNA, 104 bp, Homo sapiens
tcattagaatttactttgaaagattctaagcataacgaagatactatattttactgtcagtgacagagtatgcatctattgtacctgctagtcagttctaatga

SEQ ID NO: 6837133 - DNA, 81 bp, Homo sapiens
tggatttcattgacatgggagagaaataaatgtacattttatttatgctactgttttgtctgttttatgcaaccaaatcta

SEQ ID NO: 6837134 - DNA, 77 bp, Homo sapiens
gggcctggaatgatgactaggaattgttaaatcagaaggcagggtgattccacgggcatcattagtgtcccaggccc

SEQ ID NO: 6837135 - DNA, 80 bp, Homo sapiens
tgtttcttggagagttcaccccactgatgagtcttccttccctgttggactcagtcatttggggaacagtcttagaagca

SEQ ID NO: 6837136 - DNA, 58 bp, Homo sapiens
caccagccccaccgggactgcagagttaccgtgctctgtccttggtcttggctgagtg

SEQ ID NO: 6837137 - DNA, 83 bp, Homo sapiens
accttaagttgctctaggtgaggtctttaggctatctggtcccataataactagcaaagacacaacaccagggataacaaggt

SEQ ID NO: 6837138 - DNA, 61 bp, Homo sapiens
gtcctccaagtttgactcaggacactacctatgtcagtggtttccaaacttgtctgaggat

SEQ ID NO: 6837139 - DNA, 59 bp, Homo sapiens
aggctctgcagaccccagctgtcaaatccaaatggagctgggtttactgctgcaggctt

SEQ ID NO: 6837140 - DNA, 75 bp, Homo sapiens
tggagaggcaggaagggttctttgtgaaagatgctaactgcatttcttcagagagagctttccccatctgctcta

SEQ ID NO: 6837141 - DNA, 66 bp, Homo sapiens
gtaactttggatttagggtaccattgaaattgatttccttagaggtgtgctagaggcaaagtttgc

SEQ ID NO: 6837142 - DNA, 66 bp, Homo sapiens
ctgatgcccaggttcctctccagatgaaataaattacagtatctgggagtaaggcctaggcatcag

SEQ ID NO: 6837143 - DNA, 81 bp, Homo sapiens
ctgctcccggaggcacagccctggtcggggcccctctggaggagggttcttgccgggctctgctcctcgccggcggggcag

SEQ ID NO: 6837144 - DNA, 73 bp, Homo sapiens
cataatctctctgagcaaagcagcctgctcatcctggacaagatttggggtgaagggttgctttgagattatg

SEQ ID NO: 6837145 - DNA, 59 bp, Homo sapiens
agaggttgtgatcatgaacacccaggtctgacctgagggtatccattatcattactttt

SEQ ID NO: 6837146 - DNA, 75 bp, Homo sapiens
aatactggctttgagactgagtggcaggtgtagaaaaacaactgtaacatctattcagcctctaagacaagtatt

SEQ ID NO: 6837147 - DNA, 85 bp, Homo sapiens
gtctggcatagaatttagaattttagcctgactctgagaggcacactttcatggaggctttggaatcagagttctgtcctgagac

SEQ ID NO: 6837148 - DNA, 69 bp, Homo sapiens
tgtgtcagtaaggaaccggcctcctccctgcaggtcagaccagctacacaggagggtttctctgacaca

SEQ ID NO: 6837149 - DNA, 59 bp, Homo sapiens
tccctgatggagccctgctgcatgctggcctgacccacatgctccacgctctgcaggga

SEQ ID NO: 6837150 - DNA, 64 bp, Homo sapiens
ccacatgaatcttggaagcaggcccagaatcacctgggcagggacttcggggatgtgcatttgg

SEQ ID NO: 6837151 - DNA, 57 bp, Homo sapiens
gccctgtggccccagtgggctcccacccccaaagcccaggggagccagggacagggc

SEQ ID NO: 6837152 - DNA, 56 bp, Homo sapiens
caggacaggctgcagaggcagatgatgctgtccatctctggccccttcctgtcctg

SEQ ID NO: 6837153 - DNA, 55 bp, Homo sapiens
gtgtgtgcagggctgcgagcgctggcaggggcatctggctgcccgaggcacacac

SEQ ID NO: 6837154 - DNA, 61 bp, Homo sapiens
tttgatttgcagttttggtttcatatctttttagaggtgataccctttggctgcgagcaaa

SEQ ID NO: 6837155 - DNA, 57 bp, Homo sapiens
actttgatctaagtttctttgatttaacactgcaattaagaagatttggttcaaagt

SEQ ID NO: 6837156 - DNA, 55 bp, Homo sapiens
ccctctcagagcctcagcttcctgcctcttcagaggcagcttccctctgagaggg

SEQ ID NO: 6837157 - DNA, 80 bp, Homo sapiens
gccatcctggcctccaggcctcctggcagcctctctgcctgcagggtccaggctgtgtggtcatggtggctggagagggc

SEQ ID NO: 6837158 - DNA, 66 bp, Homo sapiens
caaagggaagatatgtccctctgtgaggctttctgtcctcttcagacaaggccatctttcattttg

SEQ ID NO: 6837159 - DNA, 84 bp, Homo sapiens
tcatttacattactcatcggccactgcagacatcagattttgtgactactgatttgaaagaaaccagtgagtgagtgtacatga

SEQ ID NO: 6837160 - DNA, 79 bp, Homo sapiens
tcttgggttattatcagtgtagattcctgagccccacccttgacttactaaatcacatcactgagaatgaggcccaaga

SEQ ID NO: 6837161 - DNA, 95 bp, Homo sapiens
tcattgcccctgctgacagccagtcaacccgtaaaagtagagctgcctagctgactatttcacagcgtggttgactgcaaacacagaagcaaaga

SEQ ID NO: 6837162 - DNA, 83 bp, Homo sapiens
agagaaacttccagtttaacatttacacagcattttattatcctattagccagtgtaaatgcaaactaggaaagttgatatct

SEQ ID NO: 6837163 - DNA, 69 bp, Homo sapiens
ctctgaattccctcaggggactcctttgaactctggatactttcacaaagaagtcctgggatttcagag

SEQ ID NO: 6837164 - DNA, 59 bp, Homo sapiens
gagaaatggcttggctaagatctaagcttagaagcagtgctatggccaggctaagtctc

SEQ ID NO: 6837165 - DNA, 69 bp, Homo sapiens
gctggactggctctgcccaggaaggacctagggttcactaagccctggtgggcaggagtgagacccagc

SEQ ID NO: 6837166 - DNA, 61 bp, Homo sapiens
ccaagtgcatgtgtgttccaaaacatcatgccatgaggctgctgaagatacacatgactgg

SEQ ID NO: 6837167 - DNA, 68 bp, Homo sapiens
aggcgagtacagacggggcctgggagggggcagagatgttccccaggccctgcctgtggttcctgcct

SEQ ID NO: 6837168 - DNA, 62 bp, Homo sapiens
tgtggagttagaatataattatgttaatgctaaaaaaaggtggcatttgtattctaaccata

SEQ ID NO: 6837169 - DNA, 110 bp, Homo sapiens
gctgggagggtcagaagctcacgtcccctgggtttgggcatgaaatcctgtgcaaaactgcatgaaatgttggtcccaatcgcaggcccgtgagttgtggccatcttggc

SEQ ID NO: 6837170 - DNA, 60 bp, Homo sapiens
ggagagtagagaatgggctgcttgcttgactagaatggtcttgcctgttccctactatcc

SEQ ID NO: 6837171 - DNA, 99 bp, Homo sapiens
aaaatctgaaataatatggagttgttttataattgattgcaatttgctcactctgtaagtcgctttcaagtagaatactgacatattcttttaaatttt

SEQ ID NO: 6837172 - DNA, 59 bp, Homo sapiens
ctgtgagatgtttctggttagagtttctctctccaagaatctgacttaaacatttatag

SEQ ID NO: 6837173 - DNA, 78 bp, Homo sapiens
gcatgcacatttgttcatctcttgccaaagtttgacccactggttattctaaaggtaagagaggatccagtttgcagc

SEQ ID NO: 6837174 - DNA, 113 bp, Homo sapiens
gcaagacaattccctttacttttcagactcggcttttcccctgtgaaatggagatgagagtttctccgtcactggcgtgaagtgaggactaaatgagataagtgtaggcttgc

SEQ ID NO: 6837175 - DNA, 103 bp, Homo sapiens
ttgagacggaatctcactctgtcgccgaggctggagtgcagtgacacgatcttggctcactgcatcctccgcctcctgggttcaagtgattcttctgcctcag

SEQ ID NO: 6837176 - DNA, 125 bp, Homo sapiens
atttgaggaaatcttactatagattttgtttacatggaatgtgtactaagttactcccttaaaggagagcatgacttttgttcatttttctgtatatattcatctatatatccatctgttcaaat

SEQ ID NO: 6837177 - DNA, 81 bp, Homo sapiens
aatttccattttattagtgacatttagacttaatactgtcacttaaacattttttgagtgctcactgcgaaggtggaattt

SEQ ID NO: 6837178 - DNA, 97 bp, Homo sapiens
gatcctggttatgctagctctctgcagcacttaatgtttcgtgaatgctacatgataaattaggtgtatgtaaatagtcttttagatagctgggatc

SEQ ID NO: 6837179 - DNA, 65 bp, Homo sapiens
gcagtcagtagctgacttcacaacagagacccgacagaagccctttctgtgataggctgcgacgc

SEQ ID NO: 6837180 - DNA, 90 bp, Homo sapiens
caaattaggtttgtgaagtggagtggtatggtttactgatgataagcagggctttgagatcatactacttgtactaaaaacctggctttg

SEQ ID NO: 6837181 - DNA, 85 bp, Homo sapiens
gtatctggggtgactctggggtgatgtctctgaggtgccactctcatctcaggggacctggctccgagtgagtgagttccagtgc

SEQ ID NO: 6837182 - DNA, 84 bp, Homo sapiens
gaaacaaaggattattggaacattgcacagtaacatctaagcaaagggaatgttacagtgactaatgttttatgtaccagtttc

SEQ ID NO: 6837183 - DNA, 66 bp, Homo sapiens
atcactggggagcactgacatgttccacaaatctacattggatgtgctggtttctctctccagggt

SEQ ID NO: 6837184 - DNA, 55 bp, Homo sapiens
tgtggctgcagacactggagcctgggagataagtcagaccaagtctggagccaca

SEQ ID NO: 6837185 - DNA, 120 bp, Homo sapiens
tctacccacttatctgcctgggaaggtggttatcttagatcaatagttctcaactctgactgcaccttagagtctcttgggattgctttaaattatactgctttcctggccctgtgtaga

SEQ ID NO: 6837186 - DNA, 64 bp, Homo sapiens
tgcctattctgatttgtccattcagtggattttctcctcctgaatgactgaagtcacaattgca

SEQ ID NO: 6837187 - DNA, 101 bp, Homo sapiens
tttgcttaagtagaacgatgcagtgtagcctagtggttaagggcacaagctccccagccttgctctgcacttggcaactctgcctgttttctctctgtaga

SEQ ID NO: 6837188 - DNA, 86 bp, Homo sapiens
agagcagtgaaatgaatgttgtactgagaattaggagaccttttcctaattagtagtgtaaccctgagtaattcgcacaactctct

SEQ ID NO: 6837189 - DNA, 86 bp, Homo sapiens
cgtctaggaatgagttaggaagagctttcaatcactgtgtccatttgtgggcaagtgtttaacttcgtcctgaagcatatttaacg

SEQ ID NO: 6837190 - DNA, 63 bp, Homo sapiens
tcagaaggtttttagcaaaggaaaaggcttaacctcatttgtacttttgtaagatctttctga

SEQ ID NO: 6837191 - DNA, 62 bp, Homo sapiens
gacattttgctggattgcatctatacagcactccactgtaaatggcaacttcacaaactgtc

SEQ ID NO: 6837192 - DNA, 119 bp, Homo sapiens
gagtccaaatacgaaaatccacagagctggggctcaaatctggcctcattgcttataaacccagcatgttttctgcaggaatccagagtgagcctccatgtggcagcacgaatgatctc

SEQ ID NO: 6837193 - DNA, 76 bp, Homo sapiens
cttccccatagtctcttttatgtacaccctgacttcccagcagcagagtgccgagatggaagcggatgaggggaag

SEQ ID NO: 6837194 - DNA, 85 bp, Homo sapiens
gtaggaagtaggactttggcgtcagaactggttttgaagaacttagtcaattgctgatgctaagtggatgaacctgaactcttgc

SEQ ID NO: 6837195 - DNA, 90 bp, Homo sapiens
cctgtgcaggagtcagttgcagtcaggacacagcatgaacatgaggatccccgctcagctcctggccttcctgctgctctgtctcccagg

SEQ ID NO: 6837196 - DNA, 124 bp, Homo sapiens
ggaggcaggtgggagccagcctggctgctgctccactgtggctggaactgtatcacgcaggcagtgccaggagcaaggagctccggccctggaaccaaactttctgggtctcgaccctgtctct

SEQ ID NO: 6837197 - DNA, 99 bp, Homo sapiens
tccccaggggagaggccccgttcccgccagccacattcccacgccggcctgggaggctgccagagagtggctgggtgtcgggggctgcctcccagggga

SEQ ID NO: 6837198 - DNA, 65 bp, Homo sapiens
gagatgatctctgaggacagtcagtgggtggcttctattcacagtgttggaatcagagctgtttt

SEQ ID NO: 6837199 - DNA, 74 bp, Homo sapiens
gctcaaatacaaatgctcttgggaaaggcagtatgttaagcttttatcaatcattaagacatttgtggtagagt

SEQ ID NO: 6837200 - DNA, 68 bp, Homo sapiens
gtagtgcgcatggcctgtttgtcacctgtaaatgaagggttagctcaccaacaggctctgcccactgc

SEQ ID NO: 6837201 - DNA, 68 bp, Homo sapiens
gggtccgttctggggtttgtctcctccctcctggccactgtggggagtctgacccttagagatgaccc

SEQ ID NO: 6837202 - DNA, 92 bp, Homo sapiens
taatcacattttgaagaggcaattatactaggttttggaattttggctaccccagggactcacatctgtgtgattgtcattttctgtgatta

SEQ ID NO: 6837203 - DNA, 78 bp, Homo sapiens
tacagcgtccagtttgctttcattttatattttctgtttctggaaaatgatgattaaaatgaggtagaaaggactgta

SEQ ID NO: 6837204 - DNA, 56 bp, Homo sapiens
tctggctccaagatcattttcccattgcctgcaggaaacaacatctaggggcgagg

SEQ ID NO: 6837205 - DNA, 76 bp, Homo sapiens
atggtcttactgaggctggcagccccttggcgtgatgctgtcgcagtgaggggtggttatgtctgagtaaggccat

SEQ ID NO: 6837206 - DNA, 91 bp, Homo sapiens
tagataaagtctggatagtttgagttcatgatgacagtgaaattttaatataatttatatcattgcaagctcatttatctgcttgactctg

SEQ ID NO: 6837207 - DNA, 104 bp, Homo sapiens
ggggagtactgttggtatagcagaggacagttctttgttgtgtgggagttgtcaggcttgtgcattgcagttaactcagtattcttgccctccacaacaccccc

SEQ ID NO: 6837208 - DNA, 60 bp, Homo sapiens
tgatttcctttgcaaagactgtgcctccaaataaggtcacattctaagcaatggggttta

SEQ ID NO: 6837209 - DNA, 60 bp, Homo sapiens
gttggggaggagattgaacattgcctgtgattgataggtaagtccacctcattcttcagc

SEQ ID NO: 6837210 - DNA, 91 bp, Homo sapiens
tcactctgacttctctgtagcagacagaccctaggtaagcagcaatagaactgtgaaacctgttaaaatgctgttacagggatccaggtga

SEQ ID NO: 6837211 - DNA, 80 bp, Homo sapiens
gctaacccagccaggtgtgtctggccccgaagtccatccttcttggaccttacctggggttcatacttggttgtggatgc

SEQ ID NO: 6837212 - DNA, 90 bp, Homo sapiens
tctctgatagataatttggcatcatattgaggagtgacaaaaacaagcttaaaatagtatgggatgctaagagacaatttttatcagagg

SEQ ID NO: 6837213 - DNA, 81 bp, Homo sapiens
ctgttatgctgggcattggctctcacgtgtgttctccagtctctgaccatacaatccagccattgccacaatcacatatgg

SEQ ID NO: 6837214 - DNA, 88 bp, Homo sapiens
cagtgggcctcccttgccggaaccctgttaggatgatatgggttaatgtgcataaaacaccagcagggtgcccagcatgtgcccattg

SEQ ID NO: 6837215 - DNA, 121 bp, Homo sapiens
ttggcttcacttcaggactggcagcttttccaggaacaaactcaccttattctctgaactggataatctacataaaggctgaggtggtttgtatcactgggtgtgttagttttaaggccaa

SEQ ID NO: 6837216 - DNA, 68 bp, Homo sapiens
tgcttgatcttctggtcaaatttttgcaagcagtagagcccttccagaaatgacagagaagaaatgca

SEQ ID NO: 6837217 - DNA, 56 bp, Homo sapiens
ccctctccattttccccagaaatagttttactgtaggggtgagatgtaggagaggg

SEQ ID NO: 6837218 - DNA, 56 bp, Homo sapiens
ggagaccacaggatgacctggagccaaagaagaagggcccaggtcccagggtctct

SEQ ID NO: 6837219 - DNA, 75 bp, Homo sapiens
aatgaagacacatctttctcataggtttattagacactggggtgtattacactgatagaggttgttctcttcatt

SEQ ID NO: 6837220 - DNA, 87 bp, Homo sapiens
ggtaaagttgacctagacacagtttttgctcccaaggaattctcaattgatcatggaagacaggagatgtgtgtaatcaacagtatt

SEQ ID NO: 6837221 - DNA, 130 bp, Homo sapiens
ctatggcagaagtgattggtctgttaggaggaagatactcagaagttgataaagtagttgaagtaagttctctcttttaaaaaaatgttttagttatttagtcctactaccataccaaatatttttatag

SEQ ID NO: 6837222 - DNA, 66 bp, Homo sapiens
ttttgtgagatgcgtatgaatgggggtgtttaaatataaaacactgttctaacacgtctcacagga

SEQ ID NO: 6837223 - DNA, 80 bp, Homo sapiens
gctgcctatggacagacctctaagatgttgcctggatctctgggtaagtcctattccaggtctctccatcactgcattgc

SEQ ID NO: 6837224 - DNA, 57 bp, Homo sapiens
gaggcctctgggcctgcgggttttacctcacttggaaacgttcaaggcagaggcctc

SEQ ID NO: 6837225 - DNA, 74 bp, Homo sapiens
ctatggtaagagaaatgcatgcatgtcatcaccaaagtgagaactgcctgtatttatctatgttacgcaaatgg

SEQ ID NO: 6837226 - DNA, 56 bp, Homo sapiens
tagtgcaggttaataggacttcctgggatgatggaaatattctataatctgccctg

SEQ ID NO: 6837227 - DNA, 62 bp, Homo sapiens
ctgttgtgaccacaggtctctcctggatgtcttctttcctcctgagcaccagtcactaacag

SEQ ID NO: 6837228 - DNA, 86 bp, Homo sapiens
gagtctttaaaaactatgtgttgaatttgaacgttatctcctctgggtaattttattttcaaaacattcacttttgaataggactt

SEQ ID NO: 6837229 - DNA, 64 bp, Homo sapiens
tggactgcagtgcagctgttaggctgaaattaaacttgtgagcctggagaaaagctgcagttca

SEQ ID NO: 6837230 - DNA, 83 bp, Homo sapiens
ccctattcaaagcaccttgcacagtgactaacacgtagtggaaattatattaggtatttattgtctaaatgaatgagtggagg

SEQ ID NO: 6837231 - DNA, 57 bp, Homo sapiens
gtacatctcagaactgagtaaccggccaagcatccgctgctgggctctgagatgcgc

SEQ ID NO: 6837232 - DNA, 73 bp, Homo sapiens
agtagtgattggttgaaagtagaatactatattaacattttagtcaattcttttcaactcaagcaaaactact

SEQ ID NO: 6837233 - DNA, 117 bp, Homo sapiens
tcaccagcaaggcatcgtgtcctctttgtgtcctgagatgccttctcactaagcctctttccagacctttggtcctggggatctgcagtgagcagagaggcagctccttgcgggtga

SEQ ID NO: 6837234 - DNA, 79 bp, Homo sapiens
ctctgccccaaggagggtggcctcatgtgagtgctcaggttgcgtagtgaacaaggatgccacctctagggggtcatag

SEQ ID NO: 6837235 - DNA, 56 bp, Homo sapiens
ggcccggttgcccacactggccgggggcctggaatgtgctgggacacagccaggct

SEQ ID NO: 6837236 - DNA, 69 bp, Homo sapiens
gttccattatgcttaggaaaatatgaaaaacgagctaagtgtttcagcaattttttaagctaattgaat

SEQ ID NO: 6837237 - DNA, 59 bp, Homo sapiens
tatttgcttggaaacctaatcctaaatccactgtcttggaataggacactaagcaaata

SEQ ID NO: 6837238 - DNA, 103 bp, Homo sapiens
acaggtttctccacttctctagaaggttgggcaggtgctaggaaggtaacctgcaaacacttcccaacacttttgagatgaacagaaagtggagttacctcgt

SEQ ID NO: 6837239 - DNA, 68 bp, Homo sapiens
cacagactctgatgacagtgttacagctccattaaagtggaagagtaatatttattagacacactgtg

SEQ ID NO: 6837240 - DNA, 82 bp, Homo sapiens
gtcacttctgtaggcttcaagaggctactgaaatatcaatggcagctttgcagtgttctctgagatgcttgaagaggatgat

SEQ ID NO: 6837241 - DNA, 70 bp, Homo sapiens
aagcagaccagatcctttttatggcattttaagttggtatttacagttgctacaaaggataattctgttt

SEQ ID NO: 6837242 - DNA, 62 bp, Homo sapiens
tttttccccctctgctgttaggaatttgaatcctacttgtaatgcagcagtggaaggaaaaa

SEQ ID NO: 6837243 - DNA, 55 bp, Homo sapiens
cctgtcttgtctttcagcatgttcagaatacctgtggctgctgtgggcagagagg

SEQ ID NO: 6837244 - DNA, 67 bp, Homo sapiens
cccattattgttccttagaaccatgcctgacacgtaattgtggaaggaaggaaggaacagtcatggg

SEQ ID NO: 6837245 - DNA, 91 bp, Homo sapiens
tcatgagctctctgaatgcaaggcctgtatctgatttacttttgattccctggtccgaggccttagtatataaagagccatcagctcgtga

SEQ ID NO: 6837246 - DNA, 89 bp, Homo sapiens
gcgcaggaccggcagcccgaggcggagacgaagggggcccgcagggactcctggccttgcgtcttgggagagcgcacgctggcctgcgc

SEQ ID NO: 6837247 - DNA, 57 bp, Homo sapiens
tttacactttcctgggaacatctggaacgcaaatttctatccccagggaagtttgag

SEQ ID NO: 6837248 - DNA, 67 bp, Homo sapiens
acttttcttatcagaaaggccacgtccaaacccactgttcacgcgatggtcatctgctgaggaaagt

SEQ ID NO: 6837249 - DNA, 76 bp, Homo sapiens
gtcgccaggctggaggctggagtgcagtggtgtaatctcagctcactgcaacctccgcctcccaggttcaagcgat

SEQ ID NO: 6837250 - DNA, 86 bp, Homo sapiens
acagaggttcatagatactgctcctcaagggaacctgagtggctatggccaccaggacagccctgagggggttcagtaccctttgt

SEQ ID NO: 6837251 - DNA, 59 bp, Homo sapiens
tggcccttcaaattccctagtcttcatttcagcctggctagaaggggagattgaagcca

SEQ ID NO: 6837252 - DNA, 56 bp, Homo sapiens
aggcccaaaagaaaccactgggtgacaaatgagatcagcctcttttggactagcct

SEQ ID NO: 6837253 - DNA, 69 bp, Homo sapiens
catggcttttgcttttgcccataagaagcatactattactccttcaataaggcaagcacaaaagctttg

SEQ ID NO: 6837254 - DNA, 58 bp, Homo sapiens
ggaggctcccacgcagctcacacacgagggaggtgtgagactcagatgtgtggtttcc

SEQ ID NO: 6837255 - DNA, 79 bp, Homo sapiens
aggaacagaaaaaaacaggattcaaaacaaggcacttgaatgaaacaaggtccagttttcagttctcattttctttctt

SEQ ID NO: 6837256 - DNA, 62 bp, Homo sapiens
ggcttggaaatggtaatgagctagctgtgtgacatcagcaaattacttgccatttctgagcc

SEQ ID NO: 6837257 - DNA, 61 bp, Homo sapiens
aattattggcagaattaaccactgaagccatctcagtgttggcttttctttgcgagtagtt

SEQ ID NO: 6837258 - DNA, 77 bp, Homo sapiens
tgtttccctttgtgaacaatacagcatgaaatagcctagttccacccatatggaaggctgttgtttcacaacaaaca

SEQ ID NO: 6837259 - DNA, 74 bp, Homo sapiens
tctgaaatgaccagggctgctcattggctggtttaggtttccaccaccagggaatggggagcttgagacacaga

SEQ ID NO: 6837260 - DNA, 68 bp, Homo sapiens
gagcccatcctcgaggggctgccctaggggggctctcctagaggatactcccctgtgaaggtggcctc

SEQ ID NO: 6837261 - DNA, 59 bp, Homo sapiens
ccacaattctgctttaatttctgtctattccagaaaatcgtaagggtggaattgtaagg

SEQ ID NO: 6837262 - DNA, 67 bp, Homo sapiens
tggacttcagtttcattatccataaaatgggagtatttatttattttaaataaaggactggtgtcta

SEQ ID NO: 6837263 - DNA, 57 bp, Homo sapiens
gctggcactgggaaggactgagtacaatggagcccttcagatctgatacagaccagc

SEQ ID NO: 6837264 - DNA, 58 bp, Homo sapiens
aggatccagtcccacacatgctctgccagcttcttctggtacattttggctggatcct

SEQ ID NO: 6837265 - DNA, 55 bp, Homo sapiens
cagttgtcctttgtaccaagttctgtcaactagcttggtagctgaggacatactg

SEQ ID NO: 6837266 - DNA, 72 bp, Homo sapiens
gttttgagtgctttagagaaatggtgctccaaatatttgaagcattactattctcaaaaacagtatcaagac

SEQ ID NO: 6837267 - DNA, 67 bp, Homo sapiens
ctaggctgtgcattgcatgacatctcttgtggatacctgagcaagaaacagcagtacacatgcctag

SEQ ID NO: 6837268 - DNA, 91 bp, Homo sapiens
tgagccgcagggaaacccttagtttgagaacttgtcttgtgattaacctacacagaaggtcattcaactaatggattcccactgcagtcca

SEQ ID NO: 6837269 - DNA, 55 bp, Homo sapiens
cagctctgttgccaaagtgggcattcagaaaacactgttgctaggcaacaggctg

SEQ ID NO: 6837270 - DNA, 56 bp, Homo sapiens
ggtgaggtggtaagtcaggttgaccttctcgtctcccactcatgactccactcacc

SEQ ID NO: 6837271 - DNA, 59 bp, Homo sapiens
acagaaattcaaactggaatttaggtagctgaaactggacttgaagttggagtttctgt

SEQ ID NO: 6837272 - DNA, 73 bp, Homo sapiens
ttaagtcagaagtttcaatcccagctgattaataagagaaccagttgagattgccaaacttgttcagacttgg

SEQ ID NO: 6837273 - DNA, 58 bp, Homo sapiens
ctttcctccactccctaggcttagaagccccaccctagccttagagctgcttggagag

SEQ ID NO: 6837274 - DNA, 62 bp, Homo sapiens
aagcacctgctgggtgtagaggcttctgctggctccaaacagcctccaccccacagggactt

SEQ ID NO: 6837275 - DNA, 60 bp, Homo sapiens
tcatttagatattaaggtgtcactgtccaataaggcagtatgaacctgggttctggatga

SEQ ID NO: 6837276 - DNA, 55 bp, Homo sapiens
agctgcatggtcagatgggcccagattgaaattcctgctcagacattaagcagct

SEQ ID NO: 6837277 - DNA, 62 bp, Homo sapiens
gtctttttattatagagtggaggaaatcccagtggtcttcttgactcattaaatgagaagac

SEQ ID NO: 6837278 - DNA, 90 bp, Homo sapiens
gcacagaggggaaggggggcacctgcatgcccggctgggtctctgtagacagtggatcatgcgaggcctcccctctccttgaccctgtgt

SEQ ID NO: 6837279 - DNA, 75 bp, Homo sapiens
gagtaactagggagcagccctgccactcctcatgcgatgcaccaggagccagggaagctgcttcctaggggattc

SEQ ID NO: 6837280 - DNA, 84 bp, Homo sapiens
ggcgaagtgtcctttgagcttggccagctctggaaggtggtaggttctccctcatgggttgtagagctggaaggggacagtgtt

SEQ ID NO: 6837281 - DNA, 59 bp, Homo sapiens
actaggtcaacattctaattagcgtccagatggaaggtgcctgttattgttggcttagt

SEQ ID NO: 6837282 - DNA, 70 bp, Homo sapiens
agaaaattccaagagtttaaatcaatggccagagattacattatctctttgttgaggagctgaattttct

SEQ ID NO: 6837283 - DNA, 79 bp, Homo sapiens
agtcaaataaaagtgcatttctaaatggaactgattagactaggttctttgtagcaaaacgtgtattcagtgtttggct

SEQ ID NO: 6837284 - DNA, 55 bp, Homo sapiens
tgggtattaggaggaacacaggcctcggctgctgagggtctgctttctaatccca

SEQ ID NO: 6837285 - DNA, 104 bp, Homo sapiens
ttcaatcagggtctagcccagagggtctggagggttctcacacaagttttgcagatgaggtgagagattttcatgagtgcttcattgttagggcctgattcgga

SEQ ID NO: 6837286 - DNA, 61 bp, Homo sapiens
cactgcacaatgtagcaaagaagaaaagatcaactgcctattttgcaatatttgtacagtg

SEQ ID NO: 6837287 - DNA, 111 bp, Homo sapiens
acttagtctgttttcaaactggcagcaaaaaagtaatatttatctacttggccatccggagaagtgttatggatttgcaattttgcactttagtggggtcatagaacaggt

SEQ ID NO: 6837288 - DNA, 58 bp, Homo sapiens
acccaggctggagtgcagtgacatgatctcagctcactgcaacctccgcctcccgggt

SEQ ID NO: 6837289 - DNA, 65 bp, Homo sapiens
cgtattgtgttcctcctccattgtaagtcatctcaggctgtccttggggaggggacctgattatg

SEQ ID NO: 6837290 - DNA, 75 bp, Homo sapiens
ggaggcagcagcccacagccgacccctcatgccacgcactgagcagggttccgcatggacgctggtcttgcctcc

SEQ ID NO: 6837291 - DNA, 96 bp, Homo sapiens
gggcctggctctgagtcacggacgggacccagcctcccagaaacaaccctgttcagctctggagcgaggtccctgtctgggaaaagacgccagccc

SEQ ID NO: 6837292 - DNA, 79 bp, Homo sapiens
gaattttatctctgggtcccaggcctgatggtaccttcaacctttagctgccttttgcctgggtctagagataagagcc

SEQ ID NO: 6837293 - DNA, 66 bp, Homo sapiens
actgagggtttggaatttcaccctgtctccccacccagcttctccagggttatttctacccttagt

SEQ ID NO: 6837294 - DNA, 87 bp, Homo sapiens
gctcaacttttttattgtgaatttggaagcaatgatctttccagttttctaggtcattcctttatttttaaagtaattgaaatgggc

SEQ ID NO: 6837295 - DNA, 77 bp, Homo sapiens
ctgtgtttgtcttctaatcagttgttcactctgaaaatgtggttcaattctttgagtataactgagaacaaacaggg

SEQ ID NO: 6837296 - DNA, 60 bp, Homo sapiens
aggatataaagtagtcttgctgcttaagcaaatgaggcattaaggctgttttgtattcct

SEQ ID NO: 6837297 - DNA, 112 bp, Homo sapiens
ttgtattggaagggaagaggggtttgaggtcaattctgtttcctggggttttcacgaatttcggggcccacagtaggcttgccaactttaacttttgcctaacactttacga

SEQ ID NO: 6837298 - DNA, 126 bp, Homo sapiens
gagctacatgatggttgttctttcgttcctccattggatccttcaacatttttgaacatctattattttaaaggccttgagctgggtgccagggatataaagatgaaagaacagaattcatatctt

SEQ ID NO: 6837299 - DNA, 66 bp, Homo sapiens
acagaatggaacaggacaggctgggctagactcgagcacgcagtggcccctgtgccaccacactgt

SEQ ID NO: 6837300 - DNA, 79 bp, Homo sapiens
ggggcttagccatttcatacacctgcagcaagcatccgctccttctcccagctgtgtgtgtggaaaggtagcaagctcc

SEQ ID NO: 6837301 - DNA, 98 bp, Homo sapiens
gggtttctatatttcttcttaaagctgcagtatcttaaaatttgtagcctgtagtcccagctacttgggaggctgaggcaggagaatagcttgaaccc

SEQ ID NO: 6837302 - DNA, 73 bp, Homo sapiens
ccagtgacattctctgctgcactgataacacatgagcccacatgcttgttatcagaactagaggtttcgctgg

SEQ ID NO: 6837303 - DNA, 67 bp, Homo sapiens
gcttgtaattggacagccatcaggaactaaaataaaagctgtcttgattgatttccaatttacaagc

SEQ ID NO: 6837304 - DNA, 59 bp, Homo sapiens
tgggtcctctggagcagcagcaggactatttgtcttttgaaaatgccccagcaggccca

SEQ ID NO: 6837305 - DNA, 85 bp, Homo sapiens
aggaaggaggatgtaatgtttgctttgcagaagtaactcttacagagatttgcagcctagacattctggtcatcattaccttcct

SEQ ID NO: 6837306 - DNA, 88 bp, Homo sapiens
tgggagatgagggtagctggatcacggaggaacttgtcaacaacatactgaggcatttggacttgagctagcatgccatcatttctca

SEQ ID NO: 6837307 - DNA, 66 bp, Homo sapiens
ctgcaaattcacttgcctgcttagcttcaagagttgaactgggatggtagggtaagtgagaagcgg

SEQ ID NO: 6837308 - DNA, 67 bp, Homo sapiens
ctggggccaagccaaccagtttgcatccgaatactgttcctcacgaaggcagatgctaggcctccag

SEQ ID NO: 6837309 - DNA, 63 bp, Homo sapiens
gctgggcagtgagtgagtccttttgaaggggcatatctccttccccactcactcctgctgggc

SEQ ID NO: 6837310 - DNA, 69 bp, Homo sapiens
tcagatcttaggtgtgaagtgtgtttagacattaaaaaatcagaacactgaggacactgagaattctga

SEQ ID NO: 6837311 - DNA, 90 bp, Homo sapiens
gacaggctgctttgggagcttttcctttcccagaactttgtagtagcccgattgcaccacatcaatgaggggagcagccccaggcttgtt

SEQ ID NO: 6837312 - DNA, 81 bp, Homo sapiens
ccaggtatgagcaggggcgtttgtggcgcggagagagctcctatccctgccgtccatctacgtctcaggcttggcccctgg

SEQ ID NO: 6837313 - DNA, 88 bp, Homo sapiens
tgcctctctctgaattgtttaagttattttgtgtctttggaatatcaatcagtcttggaggggtgacgcaacagattcggagaaggca

SEQ ID NO: 6837314 - DNA, 88 bp, Homo sapiens
ttctgggcagcacaaggtatgttttgtttggtgtctggtgtgttaatactaggaggcatataaaacattcatttatctgctgtcagaa

SEQ ID NO: 6837315 - DNA, 56 bp, Homo sapiens
gatgggtggaggagaaaggcatcttacacccacggtgcccttcctctttccccctc

SEQ ID NO: 6837316 - DNA, 79 bp, Homo sapiens
gatgcctaaggccagaattataaaatgttttatgttgttttaaaaacatatgtatttctcataattaggtttcggcatc

SEQ ID NO: 6837317 - DNA, 74 bp, Homo sapiens
ccggagccaaagctgccttgctgaggagaaatccaagtgggtttcctcctcccccaaggcatccagcctcccgg

SEQ ID NO: 6837318 - DNA, 106 bp, Homo sapiens
cagcagggtcttcatgataagttttcacataaatattatgcctagaaatatcttgtggctggagtagatttgttgaaggaattattttgctggacagaacttggtg

SEQ ID NO: 6837319 - DNA, 78 bp, Homo sapiens
tgcacagaactagggaaacggcacatagattccaaatggaaacaggagaactgtgtttgtttctaggtctctgtgaca

SEQ ID NO: 6837320 - DNA, 55 bp, Homo sapiens
tctggtgaggaggggctggacagggcctcctggtacttcagtttcctcatctgga

SEQ ID NO: 6837321 - DNA, 57 bp, Homo sapiens
gaggaagaggacagagtggttttgggagttatttaaccactctaaccatatttcctc

SEQ ID NO: 6837322 - DNA, 67 bp, Homo sapiens
tgcatttgttacataggtatgtttgctttgtggagatccattgagctgtatacctatgactggtgca

SEQ ID NO: 6837323 - DNA, 59 bp, Homo sapiens
gtgtgcatatgaatgtgtatacacatgtatcgagcatgtgtatgcacgcacatgcacac

SEQ ID NO: 6837324 - DNA, 92 bp, Homo sapiens
actgagatctaaagatgtattttcaagagcagtagtatggcttaccaagctaagctgaaattcctcctgaaattctatttgtggattttagt

SEQ ID NO: 6837325 - DNA, 115 bp, Homo sapiens
gggctaagatcaaggtattagtagggcttgttccttctggaggctgtaaaggagaatctgtttccttgctttttttcagcttccagaggccaccccattccttggttcatggccc

SEQ ID NO: 6837326 - DNA, 58 bp, Homo sapiens
ctccaaagcttccacttgatagataagtccactatgaacagttgatgtagctttggag

SEQ ID NO: 6837327 - DNA, 82 bp, Homo sapiens
ctgataatcttggaataccccgaaggtcatttcatctaatttttcaaactgtaaatgacttggctaattttaggattattgg

SEQ ID NO: 6837328 - DNA, 70 bp, Homo sapiens
attagtgagctgcacagaacagtcattggccctttataagcaggggctacttctgctggtagccactggt

SEQ ID NO: 6837329 - DNA, 119 bp, Homo sapiens
cgtcgggacgcggccctgggccgggagcgcaggggagtcgggctgcagccgagcgagcgcgggcccctgcctgggtctcctccgcttccccgctggtaccaggaagagtttgagcgacg

SEQ ID NO: 6837330 - DNA, 69 bp, Homo sapiens
actccatatttttcaactggccaaaattaattcctcaaagattccatggctagctgaagaggtatgggt

SEQ ID NO: 6837331 - DNA, 63 bp, Homo sapiens
cagctattccaggagtagaatcagcaccccagctagaaaagggggcaggtctctggaaagctg

SEQ ID NO: 6837332 - DNA, 130 bp, Homo sapiens
agtgacttgatcatgtcccaggtcagggtgttttcactccagacagggagcctgagttggtggtgagtgtgatacaaagctttctgtctggtatagtctaaagatcttgtggcttgatatatcaattcct

SEQ ID NO: 6837333 - DNA, 76 bp, Homo sapiens
aatcaatttggctcccacagattgctttttttcactctggccaagaagaaaagtagtccttggagcgaaatgggtt

SEQ ID NO: 6837334 - DNA, 62 bp, Homo sapiens
gaatttatttgccataagaaacaaaagccattttgctaaatggctgtgaatggcaaataatc

SEQ ID NO: 6837335 - DNA, 79 bp, Homo sapiens
gagagaggaaggcatctctggacttatttccctaaatgtgagcaaatatctccaggaaagataagtctctaaatctctc

SEQ ID NO: 6837336 - DNA, 68 bp, Homo sapiens
ggtttactgggttttactttgttttaactctccctgggtaattttaaagtgtagccaggttaagaacc

SEQ ID NO: 6837337 - DNA, 73 bp, Homo sapiens
ggatatttatgtttgtttagtttaaggacctatgtgctattgaaggttatatggagcaaatataatagtgttc

SEQ ID NO: 6837338 - DNA, 59 bp, Homo sapiens
cagagagtttattctagaactctgagattccactcccaggtcagctagacagctctctg

SEQ ID NO: 6837339 - DNA, 67 bp, Homo sapiens
gggaacaatttttaataaacatgaagttttctgagcttttcagaagaaagatgttattactgttcct

SEQ ID NO: 6837340 - DNA, 76 bp, Homo sapiens
gaattagcacctcattcccaccttccctccagaaaaggggagggagaaatggattgggactgggggaggctgattt

SEQ ID NO: 6837341 - DNA, 64 bp, Homo sapiens
ccctcggtggtcataagtggctggcggattgtttacttgtatatctgttagaggccacggaggg

SEQ ID NO: 6837342 - DNA, 99 bp, Homo sapiens
cttgtctcccttttaaccactagctaatttagcgatggagaatagtttcgcttttattacagctttgattatctggtggttgcaaataagtcagatagg

SEQ ID NO: 6837343 - DNA, 81 bp, Homo sapiens
tgaacttaatataactcatctatggtgttctaacggttattaaatacctagatttgctccaatgagttaaatgaaagttta

SEQ ID NO: 6837344 - DNA, 83 bp, Homo sapiens
gctgtgtatacataaaatcaaatataataattttcgctggatcccaatgtggagagtttgtgtgtgtgtgtgtgtgtgtttgt

SEQ ID NO: 6837345 - DNA, 57 bp, Homo sapiens
gtaaggcccttgctcaaggccacacggccaataagatgtattgagcagagcctgtgc

SEQ ID NO: 6837346 - DNA, 59 bp, Homo sapiens
agataacatttattgaatgtaactagtgtgcttggcatgttacagaaatgatgttattt

SEQ ID NO: 6837347 - DNA, 72 bp, Homo sapiens
actgcttcactgcgtcttatctttccatgcctgttcttgctaaacagatttaagataagagcaactggcagt

SEQ ID NO: 6837348 - DNA, 66 bp, Homo sapiens
gaatgcccctgtttgcttggcagcaacctgtcatggtagttaggattgctgtatgcaggagcattc

SEQ ID NO: 6837349 - DNA, 66 bp, Homo sapiens
gaactgtatgaaattgtcatttttataggttaaaaattgtgaaatgttggtaattttatatagttc

SEQ ID NO: 6837350 - DNA, 86 bp, Homo sapiens
cctccagaaaggattccctggtgccatccagcaggaaacagaaccaagggctgcaggctggcacccttggggataggaagctgagg

SEQ ID NO: 6837351 - DNA, 59 bp, Homo sapiens
atatagccagctcctggcagagttttaatgacaacattctgggagggctggttcagtat

SEQ ID NO: 6837352 - DNA, 55 bp, Homo sapiens
ttaccttgggttaaactggctgcaggtgtggggtaagttagcaaggccaaggtaa

SEQ ID NO: 6837353 - DNA, 71 bp, Homo sapiens
tgtcactgacaagttaccttctgcatggaacttaccgagtcatcttttctttggtaatattgtcagtgaca

SEQ ID NO: 6837354 - DNA, 65 bp, Homo sapiens
tgtacccaaagactgtctggaatacaggactatttggcccctagggttcagacagactaggtata

SEQ ID NO: 6837355 - DNA, 64 bp, Homo sapiens
tcacttgggctctctctgatattagcttaccatcagtgagcatagatacattgagccacattga

SEQ ID NO: 6837356 - DNA, 81 bp, Homo sapiens
gtcatatagccaggaggtggttgaactgagattcaaactgagacagtctgagtccaaattctaccacctcttgtgtgtgac

SEQ ID NO: 6837357 - DNA, 59 bp, Homo sapiens
ccctgtccctgctccacgttcctgggcagaaatgcctctgggtgggaggccgggcgggg

SEQ ID NO: 6837358 - DNA, 86 bp, Homo sapiens
tatatatgttgtgtgtgtgtgtgtgtgtgtgtgtgtgtgcaattttatgttaaaaatctcataaacacacatatatgatatgtgta

SEQ ID NO: 6837359 - DNA, 129 bp, Homo sapiens
ccttctgtggagcttgccaggccttggtgtttgctctgcccctccccaggtggctgggggaaggaaaaggcagtcacatgaggaaggggaaggaaaggcagtcacatgaggcctccagctccaggaaag

SEQ ID NO: 6837360 - DNA, 62 bp, Homo sapiens
ttttcaggctatgccttccatctgcatgtgttactgtcactgcattgctgcatgcctgagaa

SEQ ID NO: 6837361 - DNA, 77 bp, Homo sapiens
cctaattaatgctgagtgatgttgaaagtcctgattgtctaattggcctcttctgacatcacatcagcgtatatggg

SEQ ID NO: 6837362 - DNA, 62 bp, Homo sapiens
gagaacctctccacaagtctggcacagatgttctagcatctctaggatgtgagagtgttctt

SEQ ID NO: 6837363 - DNA, 59 bp, Homo sapiens
acttaatgtggcctctctttcctttcctttttttgagagttttgaggctatcactaagt

SEQ ID NO: 6837364 - DNA, 96 bp, Homo sapiens
gtcagagagatgagctgaaagattcagtgagggtgagaagaaggctcgtaaaaagatttttatgcctacgctgaaaagttcagccatctttaacac

SEQ ID NO: 6837365 - DNA, 61 bp, Homo sapiens
tagttatatttcatgtgcctgcatgttgtgcaaagatgttgtaaaacatgagataatgcta

SEQ ID NO: 6837366 - DNA, 106 bp, Homo sapiens
tcctttgttaagttttcttcttagcaaatactacttagaatgcatttgatcaaaatgatattctgttttctacatggtcataggctgagtcaagagagacaaagga

SEQ ID NO: 6837367 - DNA, 56 bp, Homo sapiens
ctcctccttcagaagacacattctgcatggaaggtgcttatctctcttaaggggag

SEQ ID NO: 6837368 - DNA, 87 bp, Homo sapiens
tatagatagacaaaaatgacagaggattgtaaagaggccccatggttttgggagctattccctggcaatcccttgtgtttgattata

SEQ ID NO: 6837369 - DNA, 55 bp, Homo sapiens
tcacaggcctggggcagagggcctggcccctgccctcgcccctggggccctgtga

SEQ ID NO: 6837370 - DNA, 69 bp, Homo sapiens
tctgggaacagcttagctccagcgcaggacctccatgaggcagcggtcaaggggcaggctgagtccaga

SEQ ID NO: 6837371 - DNA, 105 bp, Homo sapiens
ggggcatgtcttctctgccatgaacttgaatgtctagtgctcctgagcccaagtgttcagggacaggatgggcatttcacaaggacagcagtcccacccaccccc

SEQ ID NO: 6837372 - DNA, 72 bp, Homo sapiens
ggcggaggtccgcggccccccttcagcctcgaggtgtccccagggggctgggaggccgtgctgacctttgcc

SEQ ID NO: 6837373 - DNA, 59 bp, Homo sapiens
aagtgatacgcctgcctcggcctcccaaagtactgggattacaggcagatgttttattt

SEQ ID NO: 6837374 - DNA, 55 bp, Homo sapiens
tgccttaggaagcggggtgtgtccttgggcaaggcagctctttttagctaaggta

SEQ ID NO: 6837375 - DNA, 56 bp, Homo sapiens
ttcagacaaggaaagttttcccagcagaagccctgagatgactcttattgtctgaa

SEQ ID NO: 6837376 - DNA, 73 bp, Homo sapiens
aagcatttaagtccttctttatatctgctcacattccaagtaaattgtagagatcgctttgtgtagagtgctt

SEQ ID NO: 6837377 - DNA, 83 bp, Homo sapiens
cttccagctgtgcaccatctccccaggggcatctctctgctggggctcccagctgggaggctcctctgtgactgcactggggg

SEQ ID NO: 6837378 - DNA, 69 bp, Homo sapiens
ttggtgcaaaagtagttctgctttttgctatgaaaaataatgcaaaaaacacaatcacttttgcaccaa

SEQ ID NO: 6837379 - DNA, 93 bp, Homo sapiens
gcttgttgcagtggcacttcttgggcctcaccccagacccaaagaattggaatctctggggatgaggacctagatggtgcagttttaacaagc

SEQ ID NO: 6837380 - DNA, 102 bp, Homo sapiens
caagaaatgtaaatcagatcatcagctgctttatatttgtcatcttctataattctcacaacggtataaagagtctggtatttggccaatattaattttttg

SEQ ID NO: 6837381 - DNA, 92 bp, Homo sapiens
gcagatcttccctggggctgagggatggccgctgcccaagtacctgggctcctgtggcagattcctcgtcagcaccagcaccagaccgctgc

SEQ ID NO: 6837382 - DNA, 71 bp, Homo sapiens
aaggccaaaaagacaatgtgccagtttcaatttatgttattaaggggcttttatattttctctttggcctt

SEQ ID NO: 6837383 - DNA, 113 bp, Homo sapiens
aggtactgggttaaaaggacttttccaccatctaagagaaaggaagttcagagccttagcttcaacaccacaatttcttaactggaaaaggatcaatctaaaacggtggactt

SEQ ID NO: 6837384 - DNA, 76 bp, Homo sapiens
cagagagaacagcttatagatctctctgatatatagctatatgcatcacagacagcgagagatttatatttctttg

SEQ ID NO: 6837385 - DNA, 71 bp, Homo sapiens
gagaaacactgggatttggtgtacttcctctgctcttttaaacatcagttcttatttggccagtgtctctc

SEQ ID NO: 6837386 - DNA, 114 bp, Homo sapiens
ctttatatcttgtgcactgagtggaatccagtggctgagtcattagacaggaagctcaagagggtctgtgtctgttttgctcaccattttgtttccttggtgcttggtatgtag

SEQ ID NO: 6837387 - DNA, 71 bp, Homo sapiens
tggaatatcagactgagagagtaaagtagaattaagagttggttgtgcttggctactcttatgagcttcta

SEQ ID NO: 6837388 - DNA, 61 bp, Homo sapiens
tgttcacttattgttcctggaccctgagtcatgtcttaggtaaacggcacagtaaagaaca

SEQ ID NO: 6837389 - DNA, 77 bp, Homo sapiens
ttttaagtgacaggtggtaaaatggactgtcttgagtatgtgcttgatactccaaactttaccagtctgcactgaga

SEQ ID NO: 6837390 - DNA, 99 bp, Homo sapiens
cccagtgagtgccggagctgggtggagggcccacggtgacctcaggcgtccagctttccatctgcctgggccttttcagggcccagagtggcaactggg

SEQ ID NO: 6837391 - DNA, 70 bp, Homo sapiens
tccacatctcagggaccttctttgtgctcgttttaaacttatcacacagacagctctctgaagacatgga

SEQ ID NO: 6837392 - DNA, 100 bp, Homo sapiens
tgaaggacttgcagcttcagagcacatgacttctgggtcacccttctgctcagggtcatccctgatgacccaaggtgtcctctggaggcttgttaactca

SEQ ID NO: 6837393 - DNA, 55 bp, Homo sapiens
ggtggggctgcaagcagttcggagtagtcagggccctggcgctggaagcctcact

SEQ ID NO: 6837394 - DNA, 57 bp, Homo sapiens
atgccgtcagcttattaaagaactagtttgggacttgtttcagttggttaatggcat

SEQ ID NO: 6837395 - DNA, 70 bp, Homo sapiens
cccatgaatgtcttgagaagagaaatcttcccatcgttaaggattctcagcttcaagttattctcttggg

SEQ ID NO: 6837396 - DNA, 59 bp, Homo sapiens
ggaaacattccaagagttgaaaaagacaattcattcaactaaataaatggaatggttcc

SEQ ID NO: 6837397 - DNA, 65 bp, Homo sapiens
ccaacctcattgttttttgtatagcttcataagaggggcttctctcaggggcatgagttagttgg

SEQ ID NO: 6837398 - DNA, 64 bp, Homo sapiens
agcgttgagaataaattagcagacatagtaaaaatccatctactgtctgtgcttttttagggct

SEQ ID NO: 6837399 - DNA, 100 bp, Homo sapiens
gaggcaggagaattgcttgaacccaggaagtggaggcttcagtgagctgagaacacgccactgcactccagtcctgggcaacagagcaagactctgtctc

SEQ ID NO: 6837400 - DNA, 58 bp, Homo sapiens
agttgacatccataacaggaagtgaggttaggcctttttctctgtggatgtacatact

SEQ ID NO: 6837401 - DNA, 56 bp, Homo sapiens
ctggggctgcagcgatcttcatcagtcactggtgaccttgagtgaatgagcctcag

SEQ ID NO: 6837402 - DNA, 73 bp, Homo sapiens
aggctggagtgcaatggcatgatcttggctcactgcagcctctgcctcccaggttcaagcgattctcctgcct

SEQ ID NO: 6837403 - DNA, 68 bp, Homo sapiens
gaggcgggtgtatcacctgaggttaggagttcgagacaagactaggcaacatggtgaaaccccgtctc

SEQ ID NO: 6837404 - DNA, 82 bp, Homo sapiens
ggtttccaaggttatggcagattctggttgatacttgcaaacaactgacaagatgaatcagtatgtgtcctagcaggaggct

SEQ ID NO: 6837405 - DNA, 78 bp, Homo sapiens
tgagatttgatgggtgtgtatctaggaaatggtctatttcaattctattacctggaatttatatagctatgtatctca

SEQ ID NO: 6837406 - DNA, 62 bp, Homo sapiens
tgatggtcaggatgcatggagaggtgatggcaagcactcaagtctcagcgctgtgaccgtca

SEQ ID NO: 6837407 - DNA, 55 bp, Homo sapiens
agccttgaaccaattgtttagcttgaagaatgcagctttttgattggccaaggtt

SEQ ID NO: 6837408 - DNA, 58 bp, Homo sapiens
ttgtgaaccattcctggcatgtagactgcacgtgctttaatctgggaatgttttacaa

SEQ ID NO: 6837409 - DNA, 56 bp, Homo sapiens
agtctgagttagtggaaatgtagtgaatgccctaagtatttcacagattcatgact

SEQ ID NO: 6837410 - DNA, 71 bp, Homo sapiens
aagtgttatgagtcaaggagctactggcatttaatctgtagcaggtatgctgttagatttaataagcattt

SEQ ID NO: 6837411 - DNA, 72 bp, Homo sapiens
gttaaattacaactgttcccactgtctgtaaataattgcttaggacagaaaatacagtcctgtattattgat

SEQ ID NO: 6837412 - DNA, 56 bp, Homo sapiens
tcctttctccagctggcattgtcatttttgtgacttgttatcagaggaagagagga

SEQ ID NO: 6837413 - DNA, 126 bp, Homo sapiens
ccaaatatctgcatgttagaggcttatgtgtttatgagtaggcaggtgtcttcatggaactctggtatcttccagatgttcataggtatatctggaacgatgagtatctggccaagtaatatatgg

SEQ ID NO: 6837414 - DNA, 57 bp, Homo sapiens
tacatgcctgtgttgtctccatggctaaatactaagccccctgaggccaggcatgtg

SEQ ID NO: 6837415 - DNA, 124 bp, Homo sapiens
agagaattccttaaaactaatgtagtttcagtaacttaccattgtagcatcatcaatgatggagtaatttgcctggtgcagatagtggtgtagtatattacatagtaaacatgaaggattttct

SEQ ID NO: 6837416 - DNA, 118 bp, Homo sapiens
atatatatacacatatatatgcatatacaggtatgtatatgtgtatatatgtgtgtatatacacacacatgcatacacgtacatacctgtatatgcatatatatatgtgtgtatatat

SEQ ID NO: 6837417 - DNA, 100 bp, Homo sapiens
aggtccttgtgcaagtatcagtgattgctgtatacaaaatagctgcctcctcccctttgctgctttgtatttctctgtagcactgatcagtaactggcct

SEQ ID NO: 6837418 - DNA, 82 bp, Homo sapiens
tggagatggatactcaactttgatggtagggataaactatatgctccctccataacagaggtgagcaatccattgcattcca

SEQ ID NO: 6837419 - DNA, 78 bp, Homo sapiens
tctgttgttcagagaagaaagtgactataatagggtaagctactaaggcacaattttctcatactagtagacaacaga

SEQ ID NO: 6837420 - DNA, 55 bp, Homo sapiens
gaggctgccaatgtgtgcatgtgtgtgtgtgtgtgtgtgcgcacaggtgtgcctc

SEQ ID NO: 6837421 - DNA, 75 bp, Homo sapiens
tcctgcccactatgtggggacaacgtgctgctcttccctcggaaagatgctgcctctcctcacaagtcggttgga

SEQ ID NO: 6837422 - DNA, 60 bp, Homo sapiens
gctttttattcatctccactgctgagaaaaggcagtgtaaacttaagagaatatcaaagc

SEQ ID NO: 6837423 - DNA, 70 bp, Homo sapiens
ggggtctttgtagttaagggtgagcctgggtgcaattcctggctcccacattcaccagctgcacgactct

SEQ ID NO: 6837424 - DNA, 115 bp, Homo sapiens
cttcacattgtttatgaacttagtatgccagctttttaagtgtggtggggtctggtattccacacttatatgtctctgaatcccacccttgtgctgatgctaagatgaactgaag

SEQ ID NO: 6837425 - DNA, 70 bp, Homo sapiens
ctcgagggaggtccatccctgcagagaaaagccagtgctgcctaaacttttgcatggaggctgccccgag

SEQ ID NO: 6837426 - DNA, 61 bp, Homo sapiens
catattgtctattgctgtttttctgccataaaagttagagtccagtagttaggacagagtg

SEQ ID NO: 6837427 - DNA, 64 bp, Homo sapiens
ctgactccctgattctgggttttaagttcttaactattacagaaaagaagaacaggggaggcag

SEQ ID NO: 6837428 - DNA, 96 bp, Homo sapiens
ggcaggagaatcacttgaacccaggagttagaggttgtggtgagccaagatcataccattgcactctagcctgggcaagaagagcaaaactctgtc

SEQ ID NO: 6837429 - DNA, 88 bp, Homo sapiens
gcaggcacaatgacaggcacagctacttgctcactctctagaagctcttagaggcctccagctgagttttgctgtctctgtgccctgc

SEQ ID NO: 6837430 - DNA, 62 bp, Homo sapiens
gagtttaatggcaagaaggctgcagcctgactaaggctgtcggcttgattctgccatggctc

SEQ ID NO: 6837431 - DNA, 79 bp, Homo sapiens
gttcagtttttgacacgtgattatagaagcagtttgtcaatctccacaataaagtctaatccgtttaataatactgaat

SEQ ID NO: 6837432 - DNA, 57 bp, Homo sapiens
ctggatatgttgcaacatttcccactaattacttggtgactggtgtcagatgtccag

SEQ ID NO: 6837433 - DNA, 60 bp, Homo sapiens
gtactgagggctgtgtatgtattcaaatagtcactgaatgcctgacagtcactcaggtac

SEQ ID NO: 6837434 - DNA, 69 bp, Homo sapiens
agcattacaacacagctttcctcaagtttattttatatcttaaataaggatactgtgtgtgttatagct

SEQ ID NO: 6837435 - DNA, 61 bp, Homo sapiens
tcctgagtgtcagatgtccagggcagcattgctgatgttccccaggactctgacctcaggg

SEQ ID NO: 6837436 - DNA, 82 bp, Homo sapiens
acagtgtttgtacagccagctatgcagctgaaggctgccatgtagtagctgctacactgtttggctcctgtacttatactgt

SEQ ID NO: 6837437 - DNA, 78 bp, Homo sapiens
aatctgggttggttgtgtgtatgggaatgtctttgtcaataggacacccagattatgcacacaaatcaagtttagatt

SEQ ID NO: 6837438 - DNA, 101 bp, Homo sapiens
tgtggaacattgacttcatattgctttggtgacagattatagggagcgtttatctagaaggtgttttgtggtctgtctacaatgatgtaaactgttctgca

SEQ ID NO: 6837439 - DNA, 57 bp, Homo sapiens
ggcctgggagggcaagtgctgatgagaacccccatccccacctccctccccaggacc

SEQ ID NO: 6837440 - DNA, 56 bp, Homo sapiens
gagggctgatggggtttggcaggtaagaatttctgaggccacccatctctgccttt

SEQ ID NO: 6837441 - DNA, 68 bp, Homo sapiens
ccttaccccatcctcgtctgcacatcaaagggatttcttgttggctgtggggcggggtcggtgccagg

SEQ ID NO: 6837442 - DNA, 66 bp, Homo sapiens
agtacaaagtgctcctggttctcagggaagcagtgatttattaaaagaacaccagggcattttact

SEQ ID NO: 6837443 - DNA, 90 bp, Homo sapiens
gataaagatactgagttcagagagttacacaaattgttcagtcatatcactagtaaatgacagaactgacctttgcacccatgtctcatc

SEQ ID NO: 6837444 - DNA, 93 bp, Homo sapiens
ttcatgcaaaaattccattttccagtcttcttgcagctacatgtggtcaaattacctcatttagagaataagacataaatggaatttcatgga

SEQ ID NO: 6837445 - DNA, 96 bp, Homo sapiens
caggagtacgacgctgtggtagctatgatcatgccactgcactccagcctgggtgacagagcaagatctagataattacagtctgtcctgctcctg

SEQ ID NO: 6837446 - DNA, 77 bp, Homo sapiens
tctcaggcctatggtgttggaactgatcaaatgtgctgtgcattaagcttggagcttcacacacataggctctaaga

SEQ ID NO: 6837447 - DNA, 67 bp, Homo sapiens
gtggcatcatagccaaggtgctttgcctaaaatcactcatctcttcaaagtccctggcatgagctac

SEQ ID NO: 6837448 - DNA, 83 bp, Homo sapiens
ggttgctccaaacttgtctatctaggaatcatgtactgcaaagctatgaagatacctcagaggatctaagtgtgggagcttcc

SEQ ID NO: 6837449 - DNA, 72 bp, Homo sapiens
tctcccttccctccgaacctcagtgctgcctgtcaaataggccacgctgcggctttgcagggttgttggaga

SEQ ID NO: 6837450 - DNA, 82 bp, Homo sapiens
ggggccaaggcctaggagggggaacaaggcatacctgtcaggcttgatcagtatttctttccctctctttagccttggcctc

SEQ ID NO: 6837451 - DNA, 81 bp, Homo sapiens
ttaaatattgtgtccatctttgtttgtctctgaggtgcgcgtgtaggtcggtttaaagcaaaatggtttgccattatttga

SEQ ID NO: 6837452 - DNA, 67 bp, Homo sapiens
cagatctttactactgccttctctatgaaaagatatagtgtgggggctttggtgtcacatagatctg

SEQ ID NO: 6837453 - DNA, 62 bp, Homo sapiens
ccattctgtcacagcccgcgtctcctctatttccagtggggctgggatctgtgaccctttgg

SEQ ID NO: 6837454 - DNA, 56 bp, Homo sapiens
acagctggacaggggagagtttaagtaaacagacactcatccactgctggggctgt

SEQ ID NO: 6837455 - DNA, 59 bp, Homo sapiens
gttcttcttacttcatacccaagggacagctcctatggaacgctagaggaagaaaggac

SEQ ID NO: 6837456 - DNA, 109 bp, Homo sapiens
ggaggcttgtttttccttttgttggtggaggaagggctggctttgatatcctcagcagcacaatttgggggtgtccttcgtccgctggcattgaggctgccccgcctcc

SEQ ID NO: 6837457 - DNA, 87 bp, Homo sapiens
ttttctctctttctctgtttcttcttctgttatattacaagaaaaaagaattgcctgtgtagctcaagaggctgggaagttaggaaa

SEQ ID NO: 6837458 - DNA, 93 bp, Homo sapiens
gtggggaagacacagccaggccaggaggcttctgcaggccttgggcttccctgagggcctcgcggcttctggtggctgctatagtggccccac

SEQ ID NO: 6837459 - DNA, 72 bp, Homo sapiens
gtggagggttgaagtctggtcctcatccagctctgtccattctgagatgctgcctcctcttcagccgcccac

SEQ ID NO: 6837460 - DNA, 58 bp, Homo sapiens
gcagctggacccacacggcttaccagacttttctgcaagttgtgtgttttccacctgt

SEQ ID NO: 6837461 - DNA, 57 bp, Homo sapiens
caagaacaatggttgtaagaaatctattttaggtttttctaggaccatgtgattttg

SEQ ID NO: 6837462 - DNA, 56 bp, Homo sapiens
caggctccccacctgggagaggagtgcccagctctgatcctgcctggggccgcctg

SEQ ID NO: 6837463 - DNA, 56 bp, Homo sapiens
tcacattattctaaagaggtactgggtcagttcccagtagctcaaagatggtgtga

SEQ ID NO: 6837464 - DNA, 59 bp, Homo sapiens
ctcttcttggcccccatgagggcccacctatcactgccatcgtggttgccaggagtgag

SEQ ID NO: 6837465 - DNA, 56 bp, Homo sapiens
cctccctccattgccatcgtctgatcaaggggctgggcagggcgacacgggggagg

SEQ ID NO: 6837466 - DNA, 55 bp, Homo sapiens
caagacctcaaaatgagagggggggacataatgcttctcaatttcataggttttg

SEQ ID NO: 6837467 - DNA, 59 bp, Homo sapiens
acactgcagccctattgtttgcatagtagctaaaattatgcagatgtttggttcattgt

SEQ ID NO: 6837468 - DNA, 71 bp, Homo sapiens
gcaccagtagaatgagaaagtgtagcaggacatgaacttcttgttttaatgttttctttctctttctttgc

SEQ ID NO: 6837469 - DNA, 72 bp, Homo sapiens
gtctcatacaagccatggaaaaatctggtgagctatctcttctctcagaacacccttctatggtgatgggac

SEQ ID NO: 6837470 - DNA, 92 bp, Homo sapiens
tcaattgaaagtgtttttatgacccaagaagataccaatgctcagttgaacataataactggtgaatttgcttgggcataccacccaaatga

SEQ ID NO: 6837471 - DNA, 65 bp, Homo sapiens
cttattgcaggactaagaacactttgctttccaggaagttctgcattcgatagtcctggaatggg

SEQ ID NO: 6837472 - DNA, 67 bp, Homo sapiens
tgagactgtcacttgggacctgtcacctctagacctgggttcttgcaatggtcccaggtggctttca

SEQ ID NO: 6837473 - DNA, 126 bp, Homo sapiens
acagagacatagagaacaagccctgtttattcattaaattgcctggatttttgtcccagtaggatttggaggcagatacactgtaaaatatgaatggttccagcacattgttctcactgtttctgt

SEQ ID NO: 6837474 - DNA, 91 bp, Homo sapiens
gtctgcacttgggggcaggcgcccaaaattcatgtccatggctgtttttatgccatgctgagactggagcagctggcttccccgtgcaggc

SEQ ID NO: 6837475 - DNA, 58 bp, Homo sapiens
agcccttcccagcttagatttgctcatttgtaaaacggggctatgaagtgggagggct

SEQ ID NO: 6837476 - DNA, 58 bp, Homo sapiens
cagcaggtggcattgtcccgccagcagtgtgctggcgtccgtggtgacaccatagttg

SEQ ID NO: 6837477 - DNA, 81 bp, Homo sapiens
cctgtaagtttcctgggctacgtgttgacagcatacaagaaatttgtcatgtctgactctcacgtacctacagaatgcagg

SEQ ID NO: 6837478 - DNA, 76 bp, Homo sapiens
ctgcatgatcaacaattcattttaaattgagttagcatcaattaacttgtattgaaaatgggtaatgatgatgtag

SEQ ID NO: 6837479 - DNA, 81 bp, Homo sapiens
tgaatgtggctactagaacatttaacattacaatgtgatacatgttatatttattggacagtgttgctgtagacccattca

SEQ ID NO: 6837480 - DNA, 57 bp, Homo sapiens
ctacttagagacatgctaacattgttttatggtacttttggctgtctaattaggtag

SEQ ID NO: 6837481 - DNA, 80 bp, Homo sapiens
tatccccctgtgcatgttgcttgaactcctcattgcccagcaggaggaaaagggaaaacatgtttcttcattggggggta

SEQ ID NO: 6837482 - DNA, 69 bp, Homo sapiens
cttctaagctctttaatagtctaaaaatgagataaacttctgtatttagcctgataagcagcagagaag

SEQ ID NO: 6837483 - DNA, 64 bp, Homo sapiens
tgatgacatgtgggctgtggctagcatgatgccaggtcatatagagtgctcagccatgtcgtta

SEQ ID NO: 6837484 - DNA, 78 bp, Homo sapiens
gatcagatggatcctcttaatgtgtaaggtagatcatgtcacccttctgctcaacaccccctgagaggttcccctgtc

SEQ ID NO: 6837485 - DNA, 65 bp, Homo sapiens
ctgcaggaaagggaagtaaatactctgttctaatagaaaacaatcgttttgctttccttcttcag

SEQ ID NO: 6837486 - DNA, 83 bp, Homo sapiens
atgctttctaatatccttttgcctggtggctcttaggtagtcttgcaagcagccagtgggagtgatacagagtttggaagcat

SEQ ID NO: 6837487 - DNA, 66 bp, Homo sapiens
tgctgtttagcaataaaaacacatgagtacaatcagcttactgtaacccattattgctgcatagta

SEQ ID NO: 6837488 - DNA, 63 bp, Homo sapiens
atctggtattatttcacatgtgaagtacagacttgatgttattctcacaatatgatgccagat

SEQ ID NO: 6837489 - DNA, 119 bp, Homo sapiens
gctctgcaataaagaagtgactgaaaactatagcactggtttttcttggttggatgaattaatgcacattctgaaaaacagtgttttagatttcaagttccaggtcttccagaaggagc

SEQ ID NO: 6837490 - DNA, 57 bp, Homo sapiens
ggccaggaggggcgtcctgagtgggcctgtggaatgggccccgcgtcctgcctggct

SEQ ID NO: 6837491 - DNA, 76 bp, Homo sapiens
caggcagaagcaatcacagagtccagcagatgaaaaccgtcaactgctttattctagtgatatagatgtatacctg

SEQ ID NO: 6837492 - DNA, 81 bp, Homo sapiens
ccatgatctgaaattggtccatgtcataccccattagggtcagtgggcagtgacaaaggggatgaacgttgtaatcagtgg

SEQ ID NO: 6837493 - DNA, 68 bp, Homo sapiens
tctcaaattctcatctttctggtcaaaaaatggttggaagattttgtccaactagaaaggttttgaga

SEQ ID NO: 6837494 - DNA, 57 bp, Homo sapiens
tcaagtctggagatctggaacttcttcctgaagctccatgtttagccagataattga

SEQ ID NO: 6837495 - DNA, 96 bp, Homo sapiens
catggtatgtgaaatgactctgctcagttcaaggaaggtggaatctgagctgattttctcattttctgaactgaaaaagtcaggcacagtaacctg

SEQ ID NO: 6837496 - DNA, 92 bp, Homo sapiens
tcagtgctttgctgtccagagccactgtctgccaggcaccatgtgagcactattttattgctgaataagacgtggcttgtggggcacactga

SEQ ID NO: 6837497 - DNA, 62 bp, Homo sapiens
tctccagccagccctgtcttctaaactcattcatccaagtgtcagaaggctcctgttggaga

SEQ ID NO: 6837498 - DNA, 70 bp, Homo sapiens
taaagtagaatgacttctctgctggacttcaagactctgagatccaggagctatgtacacactatcttta

SEQ ID NO: 6837499 - DNA, 67 bp, Homo sapiens
agtgtgatgtcttgtgaaagttaaaggagatacaaaatccctgagaactaaaccatgacattatatt

SEQ ID NO: 6837500 - DNA, 73 bp, Homo sapiens
cagaggagttcagtacacagcccctggaggaagggctggggctgggtttgcactgaagttctagctcttactg

SEQ ID NO: 6837501 - DNA, 129 bp, Homo sapiens
gatacccagttaaatgggaatttcagataatagacaatggttttttagtataagtacatcccaagtattgtacaagatgtactaaaaattattctgtgtttatgtgaaattcaaatttaactgggtgtc

SEQ ID NO: 6837502 - DNA, 59 bp, Homo sapiens
agactagctccaaagttagtgttgtttttcttgatggcattagcttcaaaagcttgtct

SEQ ID NO: 6837503 - DNA, 77 bp, Homo sapiens
actatttatagagctacaacctcaaaccattcaatgaaatttgatcttatgagttggtgtactgcttgataaatggt

SEQ ID NO: 6837504 - DNA, 74 bp, Homo sapiens
gactccacaggtgtactgtaccttccgcaggtgacaggaggaccctggctgaaggtcagtcacactgtgggctc

SEQ ID NO: 6837505 - DNA, 61 bp, Homo sapiens
agctgtgttctggttgattcacccttctcagcacagtgtgtagttaatcagaggacacgtt

SEQ ID NO: 6837506 - DNA, 82 bp, Homo sapiens
gggcagtgggctttctcattctttcacagtctgtggctcccaatttaaagctgaggaattggaaagatggaatgtcttgttc

SEQ ID NO: 6837507 - DNA, 62 bp, Homo sapiens
tcgacgtcattttttaaatgcagtaattgtttgattagttgcagtgtttaacaatgacttga

SEQ ID NO: 6837508 - DNA, 65 bp, Homo sapiens
gtggtttctcctgagttccacgctacacatgacagcaaccaacgtggtgatggtcttcagactac

SEQ ID NO: 6837509 - DNA, 85 bp, Homo sapiens
acctttatagcatttatagacaaactcagaggctcacaaagagtattctgagctctctggcagtctaacaatggattatattggt

SEQ ID NO: 6837510 - DNA, 79 bp, Homo sapiens
accaggcacccctctgtgggcctgtgctttagtcctttttcactctagaccctggtactactgaggtggcttgcgtggt

SEQ ID NO: 6837511 - DNA, 68 bp, Homo sapiens
cctgacttaagtctcctgttgggcaacaggtgcagaaatttcagttagacaggaggcataaattcagg

SEQ ID NO: 6837512 - DNA, 64 bp, Homo sapiens
gggaatggcgtcgtccaaatgcctgagcaatgacacggcctcagatggaatgatgccactgccc

SEQ ID NO: 6837513 - DNA, 60 bp, Homo sapiens
acttacacttctgaaagcctaggtccgactatagggctgataccgggagagaagtgaagt

SEQ ID NO: 6837514 - DNA, 68 bp, Homo sapiens
tgtggtttagttttgcaaaagttgggctcaaaacattgaaaacagcatttgaaaactatttaattaca

SEQ ID NO: 6837515 - DNA, 57 bp, Homo sapiens
caggcaggggccctgctgagtacatacagctcacccacttggccaggcccccacctg

SEQ ID NO: 6837516 - DNA, 69 bp, Homo sapiens
tcacttgaggctgagaggttgagggtgcagttgagctgagattgcaccactgcactccagcctgagtga

SEQ ID NO: 6837517 - DNA, 73 bp, Homo sapiens
gtggagggaaagcaggatgctgaaaacacgaggattgactgaaagtctttgtgggggcattttgaccttatgc

SEQ ID NO: 6837518 - DNA, 55 bp, Homo sapiens
gcaaggaaatctgaataattgtgtttctggggcacaataacttctgtttccttgc

SEQ ID NO: 6837519 - DNA, 68 bp, Homo sapiens
tgttgcatttatattctgttcggatatatgattttgtttctttatctggatgagttgaattctcaaca

SEQ ID NO: 6837520 - DNA, 82 bp, Homo sapiens
ctggataacccggcgtagctgtccaggagtgcagagattgggaaccagatcctgggctcttggcagcttcagctttatctgg

SEQ ID NO: 6837521 - DNA, 81 bp, Homo sapiens
tttgtggcttttgctagttttgcactatcaagaaatgtattttaaaaaaatcttttctgcaaagctagcaaaagccacaaa

SEQ ID NO: 6837522 - DNA, 62 bp, Homo sapiens
ctgccggaggcgtcccctctttctgcactccaacttggaggaggagggttggccttaggtag

SEQ ID NO: 6837523 - DNA, 69 bp, Homo sapiens
gatgttagaaacaagtttctctttgggacaatgtgtattctccttgcagagtttttgtttccttccatc

SEQ ID NO: 6837524 - DNA, 70 bp, Homo sapiens
ggaccaccgcagacactgagggtccggggtgctcaccgctcccgtcttgctgttgtctgcgttacagtct

SEQ ID NO: 6837525 - DNA, 67 bp, Homo sapiens
ctcccaaagtgctgagattacaggtgtgagccagcacgcctgggtaatttttgtatttttagtagag

SEQ ID NO: 6837526 - DNA, 57 bp, Homo sapiens
tcaactggtggtcaaccttctgtacatgctgtacaaggtttaaatagccatcagtga

SEQ ID NO: 6837527 - DNA, 90 bp, Homo sapiens
caggtattccatggttcatccattctacaaggtagcagggaagaattctgaagttcctttgttatctgtaaatggttagtgtgagacctg

SEQ ID NO: 6837528 - DNA, 64 bp, Homo sapiens
tattaatgtggagtgattcaggctttctgatctcagcctgaacatttctgctccagccttgata

SEQ ID NO: 6837529 - DNA, 62 bp, Homo sapiens
tagcaggaggcagttcctcgcttcagtctacatgtagcatctaaggagactacttcttgctg

SEQ ID NO: 6837530 - DNA, 66 bp, Homo sapiens
tcctgaaattctttggagttttcttaaaaggaatttctgacagaaactctggaagaacttttagga

SEQ ID NO: 6837531 - DNA, 74 bp, Homo sapiens
tctaggcagccaagaagccaacagggcaggagagaataaagacatttttagctgcctggtttccggctgccagg

SEQ ID NO: 6837532 - DNA, 88 bp, Homo sapiens
ccacagatcctactttctgagcttagagcctccaagttcagtcctgtctctctgaactcagagcctgagctaggagacagattcgtgg

SEQ ID NO: 6837533 - DNA, 62 bp, Homo sapiens
tgagtccccccacgctggccccgtagctacatccagaggctgtcagtgtggcggggacctca

SEQ ID NO: 6837534 - DNA, 57 bp, Homo sapiens
cttgctaggtatatgcaggtctatgtttctgtaggtcttcagcaaatacttggcagg

SEQ ID NO: 6837535 - DNA, 76 bp, Homo sapiens
acacacacatgtatagacactcatacagttacttctgaacttggctgtgctgcatttgtttgttgcatgtgtctgt

SEQ ID NO: 6837536 - DNA, 102 bp, Homo sapiens
gaattataacatggaaggagtcatcactggggccatgtgagggactgtgtatcaccacagaccttgcccttaggaagcttaaagccttttatattataattt

SEQ ID NO: 6837537 - DNA, 73 bp, Homo sapiens
aaattttagaccaggcaaaactaacatatggcaggaaaaaaagtcagaaaagtgattgcctggggtaaagttt

SEQ ID NO: 6837538 - DNA, 68 bp, Homo sapiens
ataatatgttaagtctttagggatatagaatacaatagtctctgtccttaaggagcttaatgtcttat

SEQ ID NO: 6837539 - DNA, 101 bp, Homo sapiens
gccgcgccccgcagtccccagggcctggctggctccacctgctgccagggaagaccctcggccggagagccaagtgctgctgggaggtggccgggcgtggc

SEQ ID NO: 6837540 - DNA, 60 bp, Homo sapiens
aatggtgtatctatccttgttctgtgtcccaagcagagaacaggttcagggtataaaatt

SEQ ID NO: 6837541 - DNA, 72 bp, Homo sapiens
gctgggcaacagcagtgggttgccagtgggcaagaatgatctcctctctggcacttcattgctgtgccctgc

SEQ ID NO: 6837542 - DNA, 71 bp, Homo sapiens
ttagaggaagatgttgactcaagggaagacggggccaagcctcaagtctgatgggttaggttagcctccga

SEQ ID NO: 6837543 - DNA, 83 bp, Homo sapiens
ccaaagcatcttggacgtgagcgtgcagtagtgttggtaggatggtaactcctacaacattgtgttgcttcatagtgctctgg

SEQ ID NO: 6837544 - DNA, 108 bp, Homo sapiens
agatggggtcttgctatgttgcctaggctagagtatagtggctatttaaatgtgcaatcatagcgcattacagtcttaaactcctgggctcaagcagtcctcccacct

SEQ ID NO: 6837545 - DNA, 100 bp, Homo sapiens
gaggagttaagagttcattcggctgtccagatgtatccaagtaccctgtgttatttggcaataaatacatctgggcaactgactgaacttttcacttttc

SEQ ID NO: 6837546 - DNA, 125 bp, Homo sapiens
gtgcactccatctagggtaccaaccatctcagtgtgcccgagactgatggggctcccagaaggcaagactttcagtgctaaaaagtctcaagcaaaccgagatgagtcactcgctggctgtgcat

SEQ ID NO: 6837547 - DNA, 69 bp, Homo sapiens
cagatgtgctttgaagttcaatgttcccactttgtaatccacaagtaacacggaacttgaagcaatctg

SEQ ID NO: 6837548 - DNA, 62 bp, Homo sapiens
cttgtggtagatagccttggttgagagtcaatattcactattcccacagttgtctacctaag

SEQ ID NO: 6837549 - DNA, 130 bp, Homo sapiens
aggagcagcactgtcatttacttgctttccagtgtgccttcctgggagacccagctgtggagttacagctcacagaggtgactgggtcccaaggagtaggtcaggtgggtggatgccaacctgtccttct

SEQ ID NO: 6837550 - DNA, 71 bp, Homo sapiens
ggcaaggcgagggcgctgcttcaagaagccgggttcattcaaaccccgaggacagcaaaccccgcctcccc

SEQ ID NO: 6837551 - DNA, 57 bp, Homo sapiens
gggactcctgcatttcaagtcccacttcactaaattgggataataagagggagtcct

SEQ ID NO: 6837552 - DNA, 56 bp, Homo sapiens
taaaggagtaactgccggtcaccacttggaggtcatcagcaggaagggcaccttta

SEQ ID NO: 6837553 - DNA, 78 bp, Homo sapiens
aagagtaggcctatgggcacaggatgagcacaaaactgtatgtgtcttctaacatcagtgttcactattccttctttt

SEQ ID NO: 6837554 - DNA, 83 bp, Homo sapiens
tgagcagtaatgactgaggtgtgagccacttccccaggattaataaagagccggggagttgacagtttagaccattaggctta

SEQ ID NO: 6837555 - DNA, 63 bp, Homo sapiens
agattgcttcatgtcctttgccggcagtccctaagattcagcgaagtcagatgtgaggtttct

SEQ ID NO: 6837556 - DNA, 66 bp, Homo sapiens
gcctttttggcaggaatattgcagaggtgatactgggttctcactcactgcatcctgtcaggtggc

SEQ ID NO: 6837557 - DNA, 55 bp, Homo sapiens
gctgagggtctgttcatgttgctctgaatttgtaaggctaagtgaaccccttagc

SEQ ID NO: 6837558 - DNA, 68 bp, Homo sapiens
caacagcctggtccccaacagcatggctggcagtgtggctgagagctatgacacggggagcggctttg

SEQ ID NO: 6837559 - DNA, 73 bp, Homo sapiens
agaagagggaaattaccacattcagatatcgttacagcccttctgtttgaaatggaggttttttctctctgct

SEQ ID NO: 6837560 - DNA, 72 bp, Homo sapiens
tatccatcaacacctgcaggtctactctgaaaaaggctttgcttcagtggaactgtctgggtgaggaggatg

SEQ ID NO: 6837561 - DNA, 71 bp, Homo sapiens
ggctgtttacttgtaagtaacaagtgagaaatgaaaactaagttatctcattgcttacatagttatgagcc

SEQ ID NO: 6837562 - DNA, 55 bp, Homo sapiens
gcaggagacaactgtaaggagaagaaacctcattggctctttaatttgctcttgc

SEQ ID NO: 6837563 - DNA, 92 bp, Homo sapiens
caagatctcacagactttagaaaagcatccatagatagtacattatttatttgattgcttttctgaaccgtgcctttgagaaaaactctttg

SEQ ID NO: 6837564 - DNA, 123 bp, Homo sapiens
tgttagccttccataacacattaaacattttatgtatggatggctgaaagtattgagaaaagctgaaaaactgttagccttccataacacattaaacgttttgtgtatggatggcttaggaca

SEQ ID NO: 6837565 - DNA, 80 bp, Homo sapiens
agggtagtatactatgtgaaaatactatagtgcctcatataaaaaagcacagtgataaaatttcacatgtaaaatagcct

SEQ ID NO: 6837566 - DNA, 80 bp, Homo sapiens
atagtttagcatacatcttcaggatctaagacctaaaaagatcaatcttgcccaaggcctgaaaatgtatgcaaaactgt

SEQ ID NO: 6837567 - DNA, 66 bp, Homo sapiens
gctagatggaacccgttgaagaaaccacatatttcttttgtgtggcagtcggacttctatctcagc

SEQ ID NO: 6837568 - DNA, 68 bp, Homo sapiens
ggattcacgtgagggacctgtgtctgtctatcccactagcttaggggcaggatcctttgagcctatcc

SEQ ID NO: 6837569 - DNA, 65 bp, Homo sapiens
ggcatggcacgggaaacaccaggatgtgttggggtgtcagtagttggtgttttcgatgtcctgcc

SEQ ID NO: 6837570 - DNA, 55 bp, Homo sapiens
tagaaaagtatgggactgacatacacattaaagtatggtccctcactaaattcta

SEQ ID NO: 6837571 - DNA, 80 bp, Homo sapiens
tttctaatgaaattgggggcactttgagactgtcagggtttgttcctgtctcagaatggctcataataaactcactgaaa

SEQ ID NO: 6837572 - DNA, 105 bp, Homo sapiens
ttttgtttctgtgtgtcatttgaaagcatttttatgccttaagattgtggccaacacaaggaatgtaacaggagtaaaaatcaagagaaacaacagataacagaa

SEQ ID NO: 6837573 - DNA, 68 bp, Homo sapiens
ttcacaaagggaatgtgtaggacatgttttcttttgacagaccagctttcattccctttgttcacgaa

SEQ ID NO: 6837574 - DNA, 74 bp, Homo sapiens
aggtgccaagggctaagggttatacatgaaccggaaggttttcattttattcattagttccttcctaggcacct

SEQ ID NO: 6837575 - DNA, 62 bp, Homo sapiens
gattagtatccttattaagagaaagagaccagagcttcctctctaccatgtgaggatacatc

SEQ ID NO: 6837576 - DNA, 69 bp, Homo sapiens
gatgggctcttttgaatatttatgtcaggacacatctgttctgggcttgaaagtttaataaagcttttc

SEQ ID NO: 6837577 - DNA, 64 bp, Homo sapiens
tgggaagttagtgaaccagtacatgctcataccttaggaaagcaaatacttttcactgagccca

SEQ ID NO: 6837578 - DNA, 55 bp, Homo sapiens
ctggcttggcttattcatggaaaatatttgatgactaaagtaggaccgagctcag

SEQ ID NO: 6837579 - DNA, 73 bp, Homo sapiens
gggatgacagctatggaactctacagaacatcacccctgcaattaactagtgttaccaaggcaaagtcatccc

SEQ ID NO: 6837580 - DNA, 61 bp, Homo sapiens
aactcttcaacttctaaatgtgatcaaccatggtatgagccaccttggaaggtggagagtt

SEQ ID NO: 6837581 - DNA, 85 bp, Homo sapiens
gggtccccgaagcccaggcttccttggcttttaggtaacctcacctctgaatcagggcagggaagcctgaggtgctcgggggttt

SEQ ID NO: 6837582 - DNA, 56 bp, Homo sapiens
atttcccaagtgtaaacatggcaaaagactgctggcctgcctttattctgggaaat

SEQ ID NO: 6837583 - DNA, 128 bp, Homo sapiens
taaagaacaaaggaaaacctgaataaaaggacaatggccttcaggcttagtgataagaaaaattaacagtgacctgaatgtcaattttttggcctatttgttctttgaggtttttatttttttctttg

SEQ ID NO: 6837584 - DNA, 68 bp, Homo sapiens
gtggtgatcagtgttggttctatctacacattttgctgggaatagaaaagagctaatattatttctat

SEQ ID NO: 6837585 - DNA, 80 bp, Homo sapiens
ttcagtggcacagatttattgaagctgctgccagcaacaatttgctctgattcgctgcagttttaatagttcctgctgaa

SEQ ID NO: 6837586 - DNA, 119 bp, Homo sapiens
gctggtgtccaagcagctggtgggcctgagggctttggcccaggagccaaggtccagctgtgaccttggggcactgggcccagaaccataccagagccagggctgcgtccttcaccagc

SEQ ID NO: 6837587 - DNA, 79 bp, Homo sapiens
agcaaatgggccgccagcctgtgcttggccaggcggacatgacgagccgcctgtggggctgaggctgcctggccctgct

SEQ ID NO: 6837588 - DNA, 58 bp, Homo sapiens
ttgtcctggcccaaatgtcaacattttgttaacattgatagtttgatggttaggagag

SEQ ID NO: 6837589 - DNA, 68 bp, Homo sapiens
tgcctgagaagcgcggcgtcggcgtgggtcctgcgcagcctgccccgcgagcgcccgctgcaagtgcg

SEQ ID NO: 6837590 - DNA, 57 bp, Homo sapiens
tcaactcacaagaatgagcaagttctttggacttaagttgttgacattctgagttga

SEQ ID NO: 6837591 - DNA, 55 bp, Homo sapiens
ttaccatgggcctgaatggagcttcacaatcatctccaacctaggactcaggtag

SEQ ID NO: 6837592 - DNA, 81 bp, Homo sapiens
atgtttgctttttatagtgtctttcttcacaggcactaaaggtgttgtgagaaaaggcattaaagtcagagctattaacat

SEQ ID NO: 6837593 - DNA, 73 bp, Homo sapiens
actgcggccaggagaagcatctgagtgtaatagcccagccaagcaaagtagattccaatcttctctccatagt

SEQ ID NO: 6837594 - DNA, 76 bp, Homo sapiens
gtgaagcagagtgtggaagcaataaaaccctattaagatcagtttaggcctttaaaaattccatgattcctttcac

SEQ ID NO: 6837595 - DNA, 80 bp, Homo sapiens
tactttaaccttttgacttcagcagattcaaaagtttgttttattctttccaggtctagatgaaattaaatgttagggta

SEQ ID NO: 6837596 - DNA, 73 bp, Homo sapiens
gacgtctctggagtgtgtgtattcagctttctcattctctttgaaatctagctatttgcactccaaagaagtt

SEQ ID NO: 6837597 - DNA, 68 bp, Homo sapiens
gcacccttggctggcatccagggaaatccagccagagaggtcaatgccctttcctggaagccagctgc

SEQ ID NO: 6837598 - DNA, 80 bp, Homo sapiens
cacaggtgtggaggccagaagtcaaaaactctaggctgctgacaccttgatttttttgacttctggcctccagatctgtg

SEQ ID NO: 6837599 - DNA, 94 bp, Homo sapiens
cagggctttcatctggtgttcagggccctgtctgtctgcccagctggacatctctcctcccagcacctggatagacatgggctctccagccctg

SEQ ID NO: 6837600 - DNA, 66 bp, Homo sapiens
caatttagtaaatttttcatcttgcctgcacttaaaggttggctatgaagtcgttactaccaattg

SEQ ID NO: 6837601 - DNA, 59 bp, Homo sapiens
cctccatcttctcagtctcttggatctaccccaaggtgtcaaactagaagatgtgtagg

SEQ ID NO: 6837602 - DNA, 70 bp, Homo sapiens
ctatcagcctgatgaccttggcaagtcacagaaacctctctgtgactcaatgttctcatctgtaaaatgg

SEQ ID NO: 6837603 - DNA, 118 bp, Homo sapiens
ggagagtccttaatcaggacaaggatgacaaccttctaagcacagtgtttaccccatgcacacatgcacagatgggcttgttcatacattcatacactgtcctggtcgggtcctctcc

SEQ ID NO: 6837604 - DNA, 98 bp, Homo sapiens
gcctgatgacacctcaactttggacttagcctgcagaattatgagatcattaatatctgttgttctaagccacccagtttgtggtgctttgttatggc

SEQ ID NO: 6837605 - DNA, 74 bp, Homo sapiens
gttgtgtggtaaccacacttacagttttataagaaatcaccaaattgtttttcattgtgactgtgccacataac

SEQ ID NO: 6837606 - DNA, 92 bp, Homo sapiens
agatctcattctgagtcattccagggttgtactggtacaagaacaactgcatttttactataacccatggaatataagaacattgcagatct

SEQ ID NO: 6837607 - DNA, 68 bp, Homo sapiens
gagccctcgggcgagcccgcgcggggctgcactccaccgggccggcgctgggggccgcgcgggggctc

SEQ ID NO: 6837608 - DNA, 69 bp, Homo sapiens
agtgttttattgtcgttgtttttgctgttgttaatgaacctactcagagagcaatgagatgtaaacact

SEQ ID NO: 6837609 - DNA, 99 bp, Homo sapiens
gaaggtggtagattctgcaatgcggcctgaggtagtaaaatgggcaggtaagggtgtgattccatttgtatctgggctgctgtgggatgctgttgattc

SEQ ID NO: 6837610 - DNA, 71 bp, Homo sapiens
tttattgttgcaagttttataggcagattaatgggaagcagccccagtcttatcctgaaaacaacaataaa

SEQ ID NO: 6837611 - DNA, 84 bp, Homo sapiens
tctcagttgtaacttttatgtcagcaattcaagagctcttatgttctaataagatagcctagtggatggctgtggcaacagaga

SEQ ID NO: 6837612 - DNA, 68 bp, Homo sapiens
ggtaggtacttagtagtggaattgctaggtcttgtgatgagatgctgtaccatcttactgagtttatt

SEQ ID NO: 6837613 - DNA, 62 bp, Homo sapiens
gtgagggtgagggcacagcagtattaggccttgctgcctttgtaattctgcctcatcttcac

SEQ ID NO: 6837614 - DNA, 84 bp, Homo sapiens
acagcttttaacttgacctgtataaaacactgaatttaggagcttgcatgacgtgtttacgtaccaggctaaggaaaaaattgt

SEQ ID NO: 6837615 - DNA, 62 bp, Homo sapiens
ttctgccctaattcagtgcttagggtagtgttcttgccattaggcacttagtagggccagag

SEQ ID NO: 6837616 - DNA, 79 bp, Homo sapiens
ggtggagctggacgcccttgcaaccgccacccctcctgctcattaacagtgaccactggcgctgcgagacccactcccc

SEQ ID NO: 6837617 - DNA, 72 bp, Homo sapiens
ggtatgacactaactgacttcttgatttaccattatccatggaatcttaggatagtctgttagaaaagtact

SEQ ID NO: 6837618 - DNA, 67 bp, Homo sapiens
cattctatggcccaaggctcccacttgccaaactctctggcataggtgttcccgtgggtcacaaatg

SEQ ID NO: 6837619 - DNA, 85 bp, Homo sapiens
gggacactggcaaggcttagataaattgcaacttgattgaatccttttaatgcaagaaacatttattaaatgcctactgtgcacc

SEQ ID NO: 6837620 - DNA, 60 bp, Homo sapiens
ggccctccctgagccaggtgggacagattcctgctgtgtccatctggtgagtgaggagcc

SEQ ID NO: 6837621 - DNA, 55 bp, Homo sapiens
gagagcgtgggctttagagtttagcagacttaggctaggtcttgactctgttctt

SEQ ID NO: 6837622 - DNA, 109 bp, Homo sapiens
ctcctcctcctctgcgggcccgggcctctcagggacccagccagcctcttcctttacgtctggggggctgagatcctgagaggagggggctccagcagcggaggccgag

SEQ ID NO: 6837623 - DNA, 70 bp, Homo sapiens
ggaggctgaggttcagtcctgctctgtcatgaattggctacatgactgaggaccaaggacttgagttttc

SEQ ID NO: 6837624 - DNA, 81 bp, Homo sapiens
agcttagaaggatcagacaagtagctctgtttgtctaaattccataggatttacagatggttattgtcatttctggtagct

SEQ ID NO: 6837625 - DNA, 65 bp, Homo sapiens
ccaccagcgtcttcctcttacgatgcgctccgttgaaatttagcgtgttgggaggagctgcaggg

SEQ ID NO: 6837626 - DNA, 92 bp, Homo sapiens
tatttgttaaccagtagttattgctctactcaatgttactagatacagtaaattaagctagggcaatattgcacttctgtgttgaaatgata

SEQ ID NO: 6837627 - DNA, 64 bp, Homo sapiens
ttctgttttagaaataagtagtcttagcaatatgagaaaaaacggacttgttctaaaatcagga

SEQ ID NO: 6837628 - DNA, 59 bp, Homo sapiens
atgtgtaaaaaaatgcctttgacaacaagcatagtgggtcaaagcacatatttgcacat

SEQ ID NO: 6837629 - DNA, 98 bp, Homo sapiens
tttcacagttttagtttcataattcaatcaaatgacagctgttctaaagataaaatgatgtaaggacttcaattgatttgtgtaattacaactggaag

SEQ ID NO: 6837630 - DNA, 80 bp, Homo sapiens
ttctcctgacaaacctgcttctggcttcatctgacaagcccctctggggaggtcggccccagccagctgggtttagggaa

SEQ ID NO: 6837631 - DNA, 82 bp, Homo sapiens
tcacaagatttacgtgtactcatttctgtatgtcatgcactcatctgtgcacatgcacatgtggctatgtaattctgtgtga

SEQ ID NO: 6837632 - DNA, 61 bp, Homo sapiens
tcttcttgaagcagagaaatacttgaacttttgtttagattatgctctgcttcaatcaaga

SEQ ID NO: 6837633 - DNA, 95 bp, Homo sapiens
ttttgtttttaattgaaggaataacatcatttttgtaagctggtaggaataatttaatagcaaggaaaaatgagatcttccaatagagaagaaaa

SEQ ID NO: 6837634 - DNA, 77 bp, Homo sapiens
gctctgtcctgccagcccggactgtgggaaagatgtggaaactgctccggacccattcctggcctgcaggacacggc

SEQ ID NO: 6837635 - DNA, 88 bp, Homo sapiens
agaattgaagtgaatggcttttattagaagaaaatccatattgcttttaaagataatgtgccgataatttctagcccacttacaatct

SEQ ID NO: 6837636 - DNA, 59 bp, Homo sapiens
gatgtctgtctgagccgctggactccgaatgcctagagggcaggggctttgacaggatc

SEQ ID NO: 6837637 - DNA, 57 bp, Homo sapiens
ggggagtgtttcatagcatcctattttatatgacaggatatttatgactcattcctt

SEQ ID NO: 6837638 - DNA, 129 bp, Homo sapiens
cagttttttagcaatgtgatctcacacctggaaggcttcccacctgatatttcaatagactcattatgagaatcaggactgttgaagtttctctctagtagtgacactacatgcctgaaagaacatctg

SEQ ID NO: 6837639 - DNA, 93 bp, Homo sapiens
gaacaatactcaagacatggtgtttgccctcaaaatacttgcaatctaaaaaggaaaagaccaagtatgcagggtaggatcatctatattttc

SEQ ID NO: 6837640 - DNA, 79 bp, Homo sapiens
ggtgaaaatgcacattcctgagcttcgacctgcagtgtcctggaggggtaggtgtgggctcaggaatgtgcctcttacc

SEQ ID NO: 6837641 - DNA, 76 bp, Homo sapiens
atagatgtggtcaggctgggccttccctgccttgcctgtccatgggttccgggaggctggctctggccacagctat

SEQ ID NO: 6837642 - DNA, 61 bp, Homo sapiens
cttcctccccaagtcatggagccagggccaaaccttcctgccccaggatgaggggggagag

SEQ ID NO: 6837643 - DNA, 58 bp, Homo sapiens
tgctgtctgtgttaaagtgttttttaatgaattatagacattataacacagagctgta

SEQ ID NO: 6837644 - DNA, 56 bp, Homo sapiens
tatccctcccacctggaaatgctgtattccctggctccaggcctcaggaagggatg

SEQ ID NO: 6837645 - DNA, 65 bp, Homo sapiens
ggaaacattagcttgtggcttaacagccttaaggttgatgatcttcccatcagctggttgtttct

SEQ ID NO: 6837646 - DNA, 90 bp, Homo sapiens
ctcagaggttggcatctgctgttccttggactcaggactcactagaagaggctcagtgccatgggcagacaggccactaaagcctctggg

SEQ ID NO: 6837647 - DNA, 65 bp, Homo sapiens
tcctctagaaagtagccacttacagagggaaattccactttttaaattctgttattttcaaagga

SEQ ID NO: 6837648 - DNA, 114 bp, Homo sapiens
ggtttacaaatctgtagggtattccttcatgcacccaaggtattaaacttgttagcttcatggatatgacagtgcctgggggtaatgtaggattaactctacctgatttgaacc

SEQ ID NO: 6837649 - DNA, 68 bp, Homo sapiens
agaaatcaaggctacattcaggttcaactgccaaggcaagcacagaccagattgtagtctgggtctct

SEQ ID NO: 6837650 - DNA, 58 bp, Homo sapiens
gaaaggggttaggctcggagatagttgactaaccaactgctctggtagaaactctttc

SEQ ID NO: 6837651 - DNA, 60 bp, Homo sapiens
gcttgcacaggatctgaagtgggcttggagcatccaagaatcccaaggccctgggcaggc

SEQ ID NO: 6837652 - DNA, 76 bp, Homo sapiens
agtgcttggagagaccatgacatgtaatgacatgaaagtaatttcggtgtcacaatttatttctcttgaattcact

SEQ ID NO: 6837653 - DNA, 67 bp, Homo sapiens
cctgtactttctctctctcctctgtcactggctcattccatgtgacagagagatgggaaagggcagg

SEQ ID NO: 6837654 - DNA, 60 bp, Homo sapiens
tgttagatgttccacatatatatgtagaagaatggctttctaggtgtggagtttctagca

SEQ ID NO: 6837655 - DNA, 55 bp, Homo sapiens
gacagtgctatggtaggacattcaagaaaaatgtatgctaccaatagtcactgtc

SEQ ID NO: 6837656 - DNA, 55 bp, Homo sapiens
agcatatgtggggcgggaccccctggagggcagggtccagcccctgcatgttgct

SEQ ID NO: 6837657 - DNA, 65 bp, Homo sapiens
cccgtgcccagtcctgccttgacagagctcaccactgcttcccaggctgtccctgggcaatcggg

SEQ ID NO: 6837658 - DNA, 101 bp, Homo sapiens
tgaggcaggagaatcacttgaacctgggaggcggaggttgcagtgagctgagatcatgccactgcgctccagcctgggggacagagtgagactctgtctca

SEQ ID NO: 6837659 - DNA, 82 bp, Homo sapiens
ggtcccggccttgtctcatgtagaagagatggttccaggccacataggcctgagctggtctgctgcatggagtggcctgacc

SEQ ID NO: 6837660 - DNA, 66 bp, Homo sapiens
tgagatacaagtgttgtgcctcatcacaaatgatagaaagtgagaggtacaataacttgtctttta

SEQ ID NO: 6837661 - DNA, 112 bp, Homo sapiens
ggtgcaggagcattgtatgcgaggcacttagactttcccatggctcatattttaaatctagaaaagctctaaggcctctcccagcagcaagggctgagattccacctgtacc

SEQ ID NO: 6837662 - DNA, 63 bp, Homo sapiens
ggatgacattgacagacctgctgctctgcgttgcaattgtgcagttgtctctcaatatcattt

SEQ ID NO: 6837663 - DNA, 69 bp, Homo sapiens
ggctaggggagccgagccacattcaatctgcatcctgctccgcgtctgacaggctttgctccttctgcc

SEQ ID NO: 6837664 - DNA, 67 bp, Homo sapiens
tgaacaggtgccttcagggagtgtaaagaattagggaactgccctgtccctcagaagctcttggtca

SEQ ID NO: 6837665 - DNA, 69 bp, Homo sapiens
ctgcataagtggggctattgagccctgatggccaccgggagccacagtagcagctactttatggggcag

SEQ ID NO: 6837666 - DNA, 62 bp, Homo sapiens
atctccatttgcagtttcaatagtgtcgtctatgaaacttttgagcaatgctgcaaagagat

SEQ ID NO: 6837667 - DNA, 74 bp, Homo sapiens
gttatttattgcattttcaatttgtacatcagctgttggctgtgtcagtcacaaatttggtgagagtaaataac

SEQ ID NO: 6837668 - DNA, 89 bp, Homo sapiens
ctgcactgttggggcaaagatgtgctgtcttgccactcatctgctgtgtggtcttgggcaagcgctgcagtctctggttctatctgcag

SEQ ID NO: 6837669 - DNA, 105 bp, Homo sapiens
ctcatttgatacctttatgaaaacctgaattatgccatcacttatgcattggtgtatatagctacccatcaagtaggtcctttcaagattctggtagagaatgag

SEQ ID NO: 6837670 - DNA, 91 bp, Homo sapiens
tctttaggataaggtatatttgtttcattttgatcctgcatatacattactttaattatgagaattaggttcaggaaacacctcttaagga

SEQ ID NO: 6837671 - DNA, 63 bp, Homo sapiens
tagaatagtgttttcattatgggctaacctgcaaagctaaccatgatttaaaatattattttg

SEQ ID NO: 6837672 - DNA, 61 bp, Homo sapiens
ccgttggaaagctccgagttgacaagtctcatccacgcacatgctcggtgcttccaatcgg

SEQ ID NO: 6837673 - DNA, 76 bp, Homo sapiens
taaaataaattggctttgtgagagggcttggcaagaacttgactgtctaagcttttcaaaaatctgctttgtttta

SEQ ID NO: 6837674 - DNA, 95 bp, Homo sapiens
gcttgttttaagttaggggtgataacagatataggcagaactttgcaatgtaaatgtttagtcttatttgggcactgctgaatttgtttccgagc

SEQ ID NO: 6837675 - DNA, 94 bp, Homo sapiens
gtcccattttcctgataactttgttaatgtgctttgaaagactgaaaatttgagtgggtagagtatatgatattaaattgtgaattggtgggac

SEQ ID NO: 6837676 - DNA, 55 bp, Homo sapiens
gatcctgtttcatgggtttctgggtataccccttgaaacaccagagtcaggagtc

SEQ ID NO: 6837677 - DNA, 70 bp, Homo sapiens
attcatgaaacaaacctctatggagtctttgctctttgtaagggactttccgtgtgtttgttcatgcaat

SEQ ID NO: 6837678 - DNA, 66 bp, Homo sapiens
ggctagtggtgtggaaggggcagggaatggaggagcccaagccttccttcaagcacacatctagcc

SEQ ID NO: 6837679 - DNA, 68 bp, Homo sapiens
agggagcgaaaggatgaatgagtgggccgatcacttgccggtggctccagatctgtctcctgttccct

SEQ ID NO: 6837680 - DNA, 113 bp, Homo sapiens
gtaccctcttttctagtctcatgttgaagatctttatgtagaaggacttcctgaaggaattccttttagaaggccatctacttacggaattcctcgcctggagaggatattac

SEQ ID NO: 6837681 - DNA, 75 bp, Homo sapiens
ttcaagcacaggattagtggatttgtcttgctgaacatggtagagatgaaaaatactggtctgcaacagcttgga

SEQ ID NO: 6837682 - DNA, 56 bp, Homo sapiens
ttttttctgggggagttggagtgggctacaggcctctcccaagtgaccaggaaaga

SEQ ID NO: 6837683 - DNA, 63 bp, Homo sapiens
cttttccaaggatgtggtcaattggaataacagcatttctctgattacactatttgggaatag

SEQ ID NO: 6837684 - DNA, 90 bp, Homo sapiens
gcttcctgtggtaataagactgtgttacaccaaaggggaatgtatgaagcaacagatcttcttgggtgtgaccagtctgagccttgaagc

SEQ ID NO: 6837685 - DNA, 56 bp, Homo sapiens
ggcacaaggtttaaataacatcaaaatggtgtttgagctaaaagtaagctttggcc

SEQ ID NO: 6837686 - DNA, 57 bp, Homo sapiens
tgaagtcttggctgaaaaccctcaattaccctttgggggcagtttgctaagcctcca

SEQ ID NO: 6837687 - DNA, 91 bp, Homo sapiens
cacagtgcgggcactcagcaggtgctcattaaatattagctgctattgtcagttgctatcgtgaagcacgtggcaagtgcctgatactgtg

SEQ ID NO: 6837688 - DNA, 56 bp, Homo sapiens
actagaaagcactaagctaggctgccaggccggggctgtgtggaggtgtttctagt

SEQ ID NO: 6837689 - DNA, 67 bp, Homo sapiens
gactgttggctcacagatgggaacggcaactgctctggaagtgctgctcctggggtaagccatggtc

SEQ ID NO: 6837690 - DNA, 122 bp, Homo sapiens
ctgagctatcttccagatgattgagtttattggacatgtcagggcttcctcctctcctgttaatccccatgcagagagacctctgatgtccctggggcatgtctttgtttactgtggctcag

SEQ ID NO: 6837691 - DNA, 55 bp, Homo sapiens
gtctttaattaaatcctggtgcctagacatctgaatctaggagataatagagggc

SEQ ID NO: 6837692 - DNA, 59 bp, Homo sapiens
catgctttctgtccaaatgttacggcagaagtcaaatattgtatttttcagaaagtatg

SEQ ID NO: 6837693 - DNA, 79 bp, Homo sapiens
atcactggagccttcggaggttgaggctgcagtgagccatgatcgggccactgcactccaacctaggtgacagagtgat

SEQ ID NO: 6837694 - DNA, 71 bp, Homo sapiens
tttccaaccccatggatgacctgcttgtttcaaacagtatttgtaaaacaagctttatggttccctggaga

SEQ ID NO: 6837695 - DNA, 55 bp, Homo sapiens
gagtggccaaactgaggacctgctgcaccagctcctgggtctctgttggcttctt

SEQ ID NO: 6837696 - DNA, 60 bp, Homo sapiens
agtgtttgtaaactacagatctgaggtattacctgggaatatgtattgttaacaaacact

SEQ ID NO: 6837697 - DNA, 64 bp, Homo sapiens
ccaggtagaagacctgtcagccatatcatctcattcaagtggcctgcaaagtcttcttgcttgg

SEQ ID NO: 6837698 - DNA, 69 bp, Homo sapiens
ggttccaagaggtaactctttctgaggattgggagcaaattgtttgcagctcaaggagagcttctggcc

SEQ ID NO: 6837699 - DNA, 57 bp, Homo sapiens
gcgccgggagccaaggatgctgttgctcccagggagagggtgtcctggctgcggcgc

SEQ ID NO: 6837700 - DNA, 89 bp, Homo sapiens
aacatcaggatctgcaaataggggtgtgaataaggacgaatcgataggctctaatttatggcatattcctcattgtagagttctctgtt

SEQ ID NO: 6837701 - DNA, 97 bp, Homo sapiens
ttatctccctcccctgtatagcctggaccaggggcctcagaagttgcagactcttacccaaatacctcttccctttgtccaggcatcacagagatga

SEQ ID NO: 6837702 - DNA, 68 bp, Homo sapiens
ggggcaggcagagaaggaacatttactcagtatctactttgtaagtgacacattttgctaagtgcttt

SEQ ID NO: 6837703 - DNA, 67 bp, Homo sapiens
taaaccaggtaaagaagctctctggttcctcatgctgcctcttcctgctggctttattctgcgtttg

SEQ ID NO: 6837704 - DNA, 61 bp, Homo sapiens
cagtgactttgggcaagtgggtggtctgagtgtggtctaatccaaagccctaagttaactg

SEQ ID NO: 6837705 - DNA, 65 bp, Homo sapiens
gcccaatgtttttcaaatattgctctgtcttcccagtattcctagcagagacatgaaaaacaggc

SEQ ID NO: 6837706 - DNA, 80 bp, Homo sapiens
ttgtaaaatgtcagcagtatctctatctcagagtcgttgtaaggatttcctgagatgggatgtgcacttggcagtgtcga

SEQ ID NO: 6837707 - DNA, 64 bp, Homo sapiens
tcctttttggtccaaggtgaccatattcttttgactttgacatcgtttgtggatcaggaaaggg

SEQ ID NO: 6837708 - DNA, 84 bp, Homo sapiens
ttggtgtaagactccttgaaccataaaatgaatgttaaagtcccatgcagtttgtatctatgagtacaaggaatcttccagtaa

SEQ ID NO: 6837709 - DNA, 107 bp, Homo sapiens
ccaggactcctgtccctctgtggtgaggggatttgggtggaagagtttgagaagctctgctgtggaatcctctcctttttaaataaagagggacactccaagcctgg

SEQ ID NO: 6837710 - DNA, 56 bp, Homo sapiens
gctgccaaattttctcagagatgctgaacacagcttttgctgagagatttgggggt

SEQ ID NO: 6837711 - DNA, 64 bp, Homo sapiens
agcccccacacatatgcagatcccccacaaactctcactgtgtgcgtgtgtatgtgtgtgtgct

SEQ ID NO: 6837712 - DNA, 77 bp, Homo sapiens
tcaaagttccttcctgtttctcctgcaaaatccttgcatgtgtgctgggggtgtgtgtggaggacatgagcctttga

SEQ ID NO: 6837713 - DNA, 80 bp, Homo sapiens
ggttctgagcctgtaccgcgatctgctgcgcgccgggcgtgggaagccgggcgccgaggcgcgagtgcgggcagagttcc

SEQ ID NO: 6837714 - DNA, 78 bp, Homo sapiens
aaggtgagtgtctagggagctgctcaggctccgtggtgatcccagagggctcgggtccttctctagagatcaggcctt

SEQ ID NO: 6837715 - DNA, 63 bp, Homo sapiens
atcaggtgtcggtcaggcggtttttaaaggtttctctaaaatggtctcagctggcaccaggat

SEQ ID NO: 6837716 - DNA, 62 bp, Homo sapiens
tcatgcccatgttggggttctttgaactggccccagattatagtgggcccaacatggcgtgg

SEQ ID NO: 6837717 - DNA, 64 bp, Homo sapiens
ccggaggccgcctgggagaagccagaaaccgcagggcttcctgcctcgggctggccgactccgg

SEQ ID NO: 6837718 - DNA, 64 bp, Homo sapiens
aaggtaacagcttcagcttcagaatcggagcgaaaattcttctgcccctgactgttgtgacctt

SEQ ID NO: 6837719 - DNA, 69 bp, Homo sapiens
gggattgtgtaaaggaagggaacctaatggaaggtaagggccttcattctctttagatttacattactc

SEQ ID NO: 6837720 - DNA, 77 bp, Homo sapiens
gtaacagagctgagtggctccatgcagaagtctgtgttcaacatctgtcatgctggagatcattaatgttcaattgc

SEQ ID NO: 6837721 - DNA, 87 bp, Homo sapiens
cctgggacattctccttttggggctggaggccactaagcaaatgtcagtttggttacagactcttctctaaagtggtagtgcctagg

SEQ ID NO: 6837722 - DNA, 119 bp, Homo sapiens
gtgtgcatgcaataaatacattatatattttttctggcaataggcagtgtcccaatagtaacaccctgttgtgctcttattgtgcagggaatatattatttggttaattattagcacac

SEQ ID NO: 6837723 - DNA, 71 bp, Homo sapiens
ctgtataacaggtggatatgcatggtccctggtacctagtaggtgctccttaaatatttactgttaaccag

SEQ ID NO: 6837724 - DNA, 72 bp, Homo sapiens
gagctagaattaggccaatttcataacacccaacaggtgttataaatgtaatagattgcctaacttctgctt

SEQ ID NO: 6837725 - DNA, 58 bp, Homo sapiens
gccagagcatcgcaccctccatggccgacatgtgggagctggagattgcgctactggt

SEQ ID NO: 6837726 - DNA, 63 bp, Homo sapiens
tattacccagggtaggaattcctgttaatcttacctaagtagttatttctttattgggtaata

SEQ ID NO: 6837727 - DNA, 92 bp, Homo sapiens
tagtgatactgtgattagtcaaaggtgttagtaatatccctttatccaacatattatttccattatcatgacaaattaaaatgtgttcatta

SEQ ID NO: 6837728 - DNA, 64 bp, Homo sapiens
aacctaggaatcatcaaaacagatatgagacaagaacttgtacctcatgcaggtgttctaggtt

SEQ ID NO: 6837729 - DNA, 100 bp, Homo sapiens
tcctgattatttcctttgtgttatcgtacgcttcagaaatttccattggagagtgttatttgggaatttctgggtgagaagcataaatgattaaagtgga

SEQ ID NO: 6837730 - DNA, 73 bp, Homo sapiens
agtcattgtgctttttttccctggtgaattcgagaagaatttatgttcatttaggaaaggaagagtattgact

SEQ ID NO: 6837731 - DNA, 59 bp, Homo sapiens
ggaggtaacacaggcactgtgctaatataagtggctacacagtctgcagtgtttccttc

SEQ ID NO: 6837732 - DNA, 58 bp, Homo sapiens
ggcagctttcacctgtcttcctcagtgaaaactctgtgagggcagagctgggcttgcc

SEQ ID NO: 6837733 - DNA, 63 bp, Homo sapiens
gcttggcagtgggtcctgcctttaatgctgatgtcccggtcaagacaggactgcactcttggc

SEQ ID NO: 6837734 - DNA, 62 bp, Homo sapiens
catggagcggtagttggcaaactacagcctacgggcaagatttagcctgctgcctgtttgtg

SEQ ID NO: 6837735 - DNA, 68 bp, Homo sapiens
ccaggtgcaataggattattgacaaccttgttgaaagcagctttagagtggaagttctgttgcattgg

SEQ ID NO: 6837736 - DNA, 82 bp, Homo sapiens
gggtgggtgggagagctacctgtgcattataggatgttttgcaacatccctggctgctaccaggtagctcccctccccactc

SEQ ID NO: 6837737 - DNA, 55 bp, Homo sapiens
tcctggtggtttgaaaactgaaatatttatcctctcagcagaaggaccactaggg

SEQ ID NO: 6837738 - DNA, 64 bp, Homo sapiens
ccggattgtcatctcctggcgcctggatggattcacggccagagcaccagtgggagacaagagg

SEQ ID NO: 6837739 - DNA, 77 bp, Homo sapiens
tttgcattgctgactgctttgatctctgcttgccctccctcaaatgttgttatcaaagtgattagcatttctgcaga

SEQ ID NO: 6837740 - DNA, 84 bp, Homo sapiens
ttgcaactcatttcccctgtattctttagatgtaatcattatcctgcattctgtatttggatataaggggaagactctatgcaa

SEQ ID NO: 6837741 - DNA, 58 bp, Homo sapiens
tttaccttgtgagatgtcagtgagttaatacacgtaagagctccattttacaggtgag

SEQ ID NO: 6837742 - DNA, 62 bp, Homo sapiens
tgtgatgctgactgtttagtggagtgataccaaacaaccatggacagggtttcagggtcaca

SEQ ID NO: 6837743 - DNA, 86 bp, Homo sapiens
taagttctagggtgtatgtgtacaacgtgcaggtttgttacatatgtatacatgtgccatgttggtgtgctgcacccgttaacttg

SEQ ID NO: 6837744 - DNA, 58 bp, Homo sapiens
gatatgctgtagtctctacagctggtattgtgatatgctgtagtctctacagctggtc

SEQ ID NO: 6837745 - DNA, 69 bp, Homo sapiens
tacttgtaagctattcctgaagaaggttgcctcagcaggggaaaactttctgaaaagcttgatcaagta

SEQ ID NO: 6837746 - DNA, 70 bp, Homo sapiens
ccaccgactctgcagggatccgggagaacctaagtgacttgtgcgattccgtggaccctggggagaatgg

SEQ ID NO: 6837747 - DNA, 129 bp, Homo sapiens
tttcttttttgttgttgctgtttctaaagagtaaatgcctttttagttcttggatcatgcagactctgctgtattgcacatgcgctagaaccaggcactgtttagtaatggagtgacagttatttatta

SEQ ID NO: 6837748 - DNA, 55 bp, Homo sapiens
gcacaagccagcttttaaattctgctcaattccaatttaagagtaggcattgtgc

SEQ ID NO: 6837749 - DNA, 65 bp, Homo sapiens
gacctacaacctaaagagatcatcagcctagatggagaggtggtcagttaaggttgaaacgggtt

SEQ ID NO: 6837750 - DNA, 78 bp, Homo sapiens
tctcaccttcctagaatgctatttccttgtgttttgctttttagcagaagagatgaaatagtattaaagactgtaaga

SEQ ID NO: 6837751 - DNA, 55 bp, Homo sapiens
tcgctttgtatctaaatatcttgaaatgaggcttacagggtataggtacagatga

SEQ ID NO: 6837752 - DNA, 57 bp, Homo sapiens
tcaaacattgcactttctgctatgttgagaagtgacataagttgtgcaactgtttga

SEQ ID NO: 6837753 - DNA, 59 bp, Homo sapiens
ctgttcctccacctcaacaaacctttacatcctcactggtttgtgaggccagagaacag

SEQ ID NO: 6837754 - DNA, 63 bp, Homo sapiens
ctgggcatggggctggaaaggtgggtgggtctggcacctgaatatccctgagttccagcccag

SEQ ID NO: 6837755 - DNA, 70 bp, Homo sapiens
gatggctgaggagagggcggaagtgtccgcacgtcgggcctccgaggcttctctttctcccctggcggtc

SEQ ID NO: 6837756 - DNA, 58 bp, Homo sapiens
gtccagagctggtgttacaagtccacagtgtgaagaaccatggagccagctctaggat

SEQ ID NO: 6837757 - DNA, 59 bp, Homo sapiens
atgtgacccactggtgtggtgttaggttggacatatgacactctttctgtgggtcacat

SEQ ID NO: 6837758 - DNA, 58 bp, Homo sapiens
agtgtcatcccatgctcagagactggcacaaaggacacctctgagctgatatgacatt

SEQ ID NO: 6837759 - DNA, 79 bp, Homo sapiens
ctcttttggttcacactaagcttaagtggtccacacgattgtgtgaatttgtacaagtattatgtgaacaactagggag

SEQ ID NO: 6837760 - DNA, 77 bp, Homo sapiens
taagtattataaatatgtgcatgaaaatgcaatttgatattgtatttcgatgcacgtgtagtttatattgttgctta

SEQ ID NO: 6837761 - DNA, 72 bp, Homo sapiens
ctagcagcttcaagatactttttctcgatttcattggtcttcccagagacagtgtctttagaagactgttag

SEQ ID NO: 6837762 - DNA, 84 bp, Homo sapiens
catttgtctttgtctttgtgttccttctgcgcctagaacaagggcacatgatattttaaggagccaatctgataaagccatttg

SEQ ID NO: 6837763 - DNA, 56 bp, Homo sapiens
caggggtattcaaggtagtttacctcatcaagttgtgaattatcttctgaccgctg

SEQ ID NO: 6837764 - DNA, 61 bp, Homo sapiens
agacttcaaagcctttgttcatcacactgtttgacactgctggaaagaggctctgagattt

SEQ ID NO: 6837765 - DNA, 62 bp, Homo sapiens
tcatgtgtcctctggcaggtttagaagtatgtactttgaaacctcaaccaaaggttacctga

SEQ ID NO: 6837766 - DNA, 109 bp, Homo sapiens
tgctgtacaggagttacatgtagcacagggctcctcaacccaccaccatctggggctggagaattctatgttgaggggtgccttgtgcactggagcatgactagcagca

SEQ ID NO: 6837767 - DNA, 106 bp, Homo sapiens
gctaagcacatgtcatatattcgctaatttagtccttacagtgcagagtcttaccatcccccttttacaaatgaggagctggagtcagagaattaagacacttagc

SEQ ID NO: 6837768 - DNA, 77 bp, Homo sapiens
ctcactctgctactggccagctttgcagcatgaattatgaagcctcatgtctgttggcttcagtgcagagaagtgag

SEQ ID NO: 6837769 - DNA, 84 bp, Homo sapiens
tacatgtcagtgctctatgagtttctcagtttagcatgtcacaaaaaagtatttcatgaactcagaactgagcagtgataagta

SEQ ID NO: 6837770 - DNA, 76 bp, Homo sapiens
gtctcctcctacatgtaagactagcttaaagttatttaacctctagacttttagtttctacatgtgtgaaacagac

SEQ ID NO: 6837771 - DNA, 85 bp, Homo sapiens
accaggcctctgtgtgtcatttgtcaatccttttctgtagtgggaagcagggagcaggaacataattgattgcacagctctgagt

SEQ ID NO: 6837772 - DNA, 71 bp, Homo sapiens
ttgctggcatccatcacaactctgaagtgacctggagactcagtctgattcagagttggagaaaatggcaa

SEQ ID NO: 6837773 - DNA, 57 bp, Homo sapiens
tggttgcctctcagagattccgaggctgggccaggcggagcctctggcagggggcca

SEQ ID NO: 6837774 - DNA, 55 bp, Homo sapiens
ggtatttcagtattatacaactgctgtgaccagacttgtatactggctgaatatc

SEQ ID NO: 6837775 - DNA, 58 bp, Homo sapiens
ccacaatctaaagggctgtatctcatacccttaagagtatgcaaaccctgctttgtgg

SEQ ID NO: 6837776 - DNA, 62 bp, Homo sapiens
agaacattcacagactcaccattattgtacaatgataatgtagtgtatagtgtgtgaagtct

SEQ ID NO: 6837777 - DNA, 57 bp, Homo sapiens
agatttgccatggatgttctttggttaaaatttgatagagcatttagagctgagtct

SEQ ID NO: 6837778 - DNA, 64 bp, Homo sapiens
aggcactcttcttaacaggtgtggtttaaattaacccagacaagcacagtaagaaaagctgcct

SEQ ID NO: 6837779 - DNA, 82 bp, Homo sapiens
ttacttcaaatagacaggcttaaataggactgttatctattctatatcacttaactcttttgcctcagtctagttgctgtag

SEQ ID NO: 6837780 - DNA, 77 bp, Homo sapiens
gtgggtacttgaacaagtgagtcatttaaactctgcaaagacagggaggaatagcttatcttgcccaggaaaaccac

SEQ ID NO: 6837781 - DNA, 72 bp, Homo sapiens
ggtttttaccactgataccttggagttcttaggcaaggtttagaatatcatgtgagtcagggttcctaaacc

SEQ ID NO: 6837782 - DNA, 64 bp, Homo sapiens
tgcttagtgagtgtctaccatgtgccaggcaccgtgttaggtgttgggagtacaatcatgagca

SEQ ID NO: 6837783 - DNA, 62 bp, Homo sapiens
cattgagtctccatttgggctagcagattcccggcagaatctctggttaggggagattggtg

SEQ ID NO: 6837784 - DNA, 80 bp, Homo sapiens
gcactcaattttctgcctagcaaaaactgtgcggttatgccagttctcatacagttttagttaaaatagaagattattgc

SEQ ID NO: 6837785 - DNA, 62 bp, Homo sapiens
ggcctggctgacaccttgatagcagcctcatgaaggactgaagcaaaggatcgagctaagcc

SEQ ID NO: 6837786 - DNA, 57 bp, Homo sapiens
atctaccaactcctctctggccaccaccagcctaggtaggccacatgggttggagat

SEQ ID NO: 6837787 - DNA, 129 bp, Homo sapiens
cataggattgcactcactgcttcccacctctcctcacttttcaggttaggcatggccatgtgattgctctagcctgtaaaacatgagcagaagaggcatgaagcacttggtgagtgcttctaagagctg

SEQ ID NO: 6837788 - DNA, 60 bp, Homo sapiens
ggctatacttctttgatgttcacagggaggacctctctgaggaataagaaggaagtggcc

SEQ ID NO: 6837789 - DNA, 64 bp, Homo sapiens
atcacagggcttgcttattggatcagcctgcagcttccaaagaaattgaccaagactcctggat

SEQ ID NO: 6837790 - DNA, 65 bp, Homo sapiens
tgtcatttgtttaggcaataattcgcacatcattctgtgagatcattgtattgacatttatgaca

SEQ ID NO: 6837791 - DNA, 64 bp, Homo sapiens
gggttgtggtagagcttaaatgaggtaatgcatgcacggaccccagctctgagccacaccactc

SEQ ID NO: 6837792 - DNA, 56 bp, Homo sapiens
aggggcctctttgttgcccaggttagtactgaactcctggttcaagtgatgcccct

SEQ ID NO: 6837793 - DNA, 77 bp, Homo sapiens
ggcttggtactcagccagtggtgtgttgagttcccttctctaacttcccctctggcagaaaaccctgtgaccaagcc

SEQ ID NO: 6837794 - DNA, 61 bp, Homo sapiens
cacacactggtatgactgttccagttgttaaaacattgaaatactcctgtaccagtaggtg

SEQ ID NO: 6837795 - DNA, 68 bp, Homo sapiens
gagcagggtgcctcatacatcataaaaggctacatggtgcgtcttccaggagggtgggcaaactgctt

SEQ ID NO: 6837796 - DNA, 73 bp, Homo sapiens
atgagactcatggccagtctgttggacagcacttgtctggagtgattgtcctttagatggctatattactcat

SEQ ID NO: 6837797 - DNA, 116 bp, Homo sapiens
atgaaattttagtctttataacctttccaagtaggctggagtttaacatcccaacaattcaggagactgattttctccattgtaaattctgtggaagttctggagaataatttcat

SEQ ID NO: 6837798 - DNA, 56 bp, Homo sapiens
aagatgttactcaaccaggataaatcttccagtgtctatacctgtggtagcatctt

SEQ ID NO: 6837799 - DNA, 110 bp, Homo sapiens
gaaatgatatgatcaagtacatctgccttaagaaatagcatttaaatcaagatctggatgaatttgaagtagttttttaaaagtagagagcattttattaactaagtttc

SEQ ID NO: 6837800 - DNA, 65 bp, Homo sapiens
caggttgcgtgtgaccgtttccctcccctcatcaacttgaaggttggaaatggcacacagacctg

SEQ ID NO: 6837801 - DNA, 128 bp, Homo sapiens
ggagaaatgggacgcaggagatctggggtcaggggaatgtggatcacaggggtgtgtccagatccctggacctgccacgtttgtgatctcggaaacatgattccatctctccaggtttgtatttctcc

SEQ ID NO: 6837802 - DNA, 70 bp, Homo sapiens
ggctactgaaggctcaggttttctaagagatgactggaggccaagtcctcaggcttgagtgtttatagcc

SEQ ID NO: 6837803 - DNA, 55 bp, Homo sapiens
gcctggaggcgagaacccaatgtctttgttatcgggccctctcgttcttccaggt

SEQ ID NO: 6837804 - DNA, 57 bp, Homo sapiens
tcctgcttcttcgagcttctggtagccccaggtattccttagcttggagcagcatga

SEQ ID NO: 6837805 - DNA, 67 bp, Homo sapiens
gggaaacacaagagcaaggtgctgaggtaaaaaacacctgaggcagctttttctgtgtgtttttccc

SEQ ID NO: 6837806 - DNA, 69 bp, Homo sapiens
gacgcttaagttgtccaagaggctgaggttgcaaagtgatagtattagatcttggcaaatgggagtgtc

SEQ ID NO: 6837807 - DNA, 77 bp, Homo sapiens
ggaaaggatgcataattcatccttctgggagtgatcattccatcctctgagttcgtattgcattttgtatctttacc

SEQ ID NO: 6837808 - DNA, 94 bp, Homo sapiens
gttagttaggccaacagtacatagatctctaccctcagatctattccttctacatctatcttagggtagcttatattgctcttgtgtctgtgac

SEQ ID NO: 6837809 - DNA, 67 bp, Homo sapiens
ctggggacgagctgtgagcacttggcgtgtcgtcgttgagaagtgatttgcatgcttaattccccag

SEQ ID NO: 6837810 - DNA, 59 bp, Homo sapiens
ttgtcacacccttttttatacctgtggctatatactaaatgtaatctgggtgtgtgcaa

SEQ ID NO: 6837811 - DNA, 125 bp, Homo sapiens
gccatatgtggcactttaggttggcatatatctgaaatggcatgtttaatgtactgtattactaggattagtaattttacagtggaaggctgctacttttatgatatagtctcctgctgctgggc

SEQ ID NO: 6837812 - DNA, 56 bp, Homo sapiens
tccctctccttttttcttgaaatgatctacattcccttctgaaagcagcagaggga

SEQ ID NO: 6837813 - DNA, 75 bp, Homo sapiens
tagatgcctgtgacagtctctgtcatataaataagaatatgctacaatttatatgaactggactttaggaatctg

SEQ ID NO: 6837814 - DNA, 107 bp, Homo sapiens
gggaatggttgatacatgacatgtgacagcaggattactttatcaggtaaaggaattactaaatgaactattaatacttggagttattgagtcaggttaaagtttcc

SEQ ID NO: 6837815 - DNA, 104 bp, Homo sapiens
ttcgcagcgtcttccaagtctctgttctctaaggaaatatgtcacttgctgagcgagggtaggggaagtgtggtttctttacagaaccgggaagattctccgag

SEQ ID NO: 6837816 - DNA, 100 bp, Homo sapiens
ctgccccaccccttgctcaccctgtggccccctgcctgcagactcggcaccagcctttcatctcctggcgggtgataggatgagcaggggaaggtggcag

SEQ ID NO: 6837817 - DNA, 77 bp, Homo sapiens
ctttgcgagctgctccctgtattccatcctatgtcagttacaaagatgaggaaaacagaccaaggagctcgacagag

SEQ ID NO: 6837818 - DNA, 77 bp, Homo sapiens
cagccttcttgtcttttttggttttgctttcttttaacacatgaggaaactaaagcccagagagggaaagggacctg

SEQ ID NO: 6837819 - DNA, 69 bp, Homo sapiens
tcaatatgaaattctgcctgaatgaagccctaaaatctttagggacaaatttgcagaaccagatattga

SEQ ID NO: 6837820 - DNA, 64 bp, Homo sapiens
tatgtatctagaagggaaattactgagtcacggatatgtaaatttctaaactttttgatacata

SEQ ID NO: 6837821 - DNA, 73 bp, Homo sapiens
ggggctgccctgtgcattatagtacgtttagcaacatccctagcttccacctactaaatgccactagcactcc

SEQ ID NO: 6837822 - DNA, 70 bp, Homo sapiens
gccataggctgggggagcaggacctggtgtgccccagagaggtgcggccagccctccaccagctctaggc

SEQ ID NO: 6837823 - DNA, 112 bp, Homo sapiens
tcatagaactcagtagacaaataggatttgcttttggaggttcgttttatagccaactttgctgaaatgcacatattccataaagtgaagactttctgtttatgttgtgtgg

SEQ ID NO: 6837824 - DNA, 130 bp, Homo sapiens
agatttcttgaagtgctaagggaatagctcaaaatgtaagatggaagctcccaatcaggtctgtgttccctggatttctccagctctccatttaaattcttgatccttaaaacaatacattttaaaatct

SEQ ID NO: 6837825 - DNA, 107 bp, Homo sapiens
tccatttttatctgaaatatgattcttctgagctttatagccctattacatgatatcctatcacatgaaatgctgtaaagaagaatgagatcatgtaggtgaaagga

SEQ ID NO: 6837826 - DNA, 59 bp, Homo sapiens
ttttctgagcatgctttgggttatattccttctgggttttcctttagttgctcagagaa

SEQ ID NO: 6837827 - DNA, 86 bp, Homo sapiens
tattttcttacagttttagaggccagaagtccaagatcaaagtgtctgcaggaccatgttccctctgaagctgctgagctaggatg

SEQ ID NO: 6837828 - DNA, 57 bp, Homo sapiens
agaaactgaagtaggaattctatgctgcaatcttgaggcagaattgctgcttcttct

SEQ ID NO: 6837829 - DNA, 112 bp, Homo sapiens
gcgatgacctggtcggccatgtccgtgtcggtggtctcctgcgacatgaagtcgatgaaggcttggaaggtcacaaggccgctatggttggggtcgaccaggctcatgatgc

SEQ ID NO: 6837830 - DNA, 66 bp, Homo sapiens
taggcacttaaaaggtttgttagtacaatgaaagaaaagtattttcggacacctgtgatgtgcctg

SEQ ID NO: 6837831 - DNA, 83 bp, Homo sapiens
ctgtgttttagaacacagtaggatagtttgaggatgaaccttgaattccagttttctcagattttctattgtgctagatatgg

SEQ ID NO: 6837832 - DNA, 65 bp, Homo sapiens
gctgtaaaatacctggagtgcttggccctcacaaggcgaggcctcaagacagtgtttgacgaagc

SEQ ID NO: 6837833 - DNA, 56 bp, Homo sapiens
agagacaagaaatacctgggacagagactcactgttcatgggtagctgcttgcttt

SEQ ID NO: 6837834 - DNA, 76 bp, Homo sapiens
ctactcatgagggatattagtatgtcattttaaaaaagaatttgacattagagttattgtctcataacatgagtag

SEQ ID NO: 6837835 - DNA, 68 bp, Homo sapiens
ctgggaggccttcagcaactttggaatgtttaaagtagaaatatgtaaccaaggtgaagttgttccag

SEQ ID NO: 6837836 - DNA, 68 bp, Homo sapiens
gctccaccccgtgccggtgctggtgccggagcaggggcgccaaggccttgaaggcgcgggggcagagc

SEQ ID NO: 6837837 - DNA, 68 bp, Homo sapiens
ggtcttctgattggacttggacagagattcttgcttttctctttaatccagggacagtatagaggatc

SEQ ID NO: 6837838 - DNA, 77 bp, Homo sapiens
gtttctggcatacagtagctactcaataactatttctggaataaataagtgaatgttggctactgaacactagagac

SEQ ID NO: 6837839 - DNA, 73 bp, Homo sapiens
tacctgtgttatcttcttgactgatggaaatagtaaggaattcaatctatcagagtagaaggcaacgttggta

SEQ ID NO: 6837840 - DNA, 72 bp, Homo sapiens
cagtctattttaaatggttgaattgtgtgatatgtgaattatatctcaatacagctgttttaaaaagttctg

SEQ ID NO: 6837841 - DNA, 83 bp, Homo sapiens
ggaagctggctgtgctgtaaaaatggcctaaatctgtttttcaccttcagatcattggcctttctgcagtgcacacaagctct

SEQ ID NO: 6837842 - DNA, 126 bp, Homo sapiens
tcagaatcacttggccagtttgtcgaagcacagattcctgggtcccacccccagagtttatgattcaagaggtctgggatggggcctgaaaatgtgcacttccagcaagtccccaggtgatactga

SEQ ID NO: 6837843 - DNA, 76 bp, Homo sapiens
ttattttatagatgaagaaacagaccaagaggatcatttaaatatgatcatcttagttttttcagtaaagaagtaa

SEQ ID NO: 6837844 - DNA, 106 bp, Homo sapiens
tcctgttatgcgctggtcctccatgtggatcaggcagtgcttctggcaagcttagggatgctcttcacagctgttttgtccattaattggaggctcagccacaggg

SEQ ID NO: 6837845 - DNA, 130 bp, Homo sapiens
ggggattccagacgaggctggagttggaagacagagggcatggccgggaggacgacctcggctgcagcggtggctgtggagcctcctgggctcctgtctgcacccctggtcctggcttcacaaacagccc

SEQ ID NO: 6837846 - DNA, 119 bp, Homo sapiens
gtaagattggaggatctaacaaggttcagaaaatggaactgggctactaggtatttggagagcaactaccttctttcagtttcgttttcttcccaaatttttcaaattctcccccttgc

SEQ ID NO: 6837847 - DNA, 69 bp, Homo sapiens
aaggacaggagaaaacgggatcctagttccggaagagaaaaaggagcaaattcacctttcttctgcctt

SEQ ID NO: 6837848 - DNA, 66 bp, Homo sapiens
aagtaaagagtcctgttacacatgagtgcatgagcaattgatgtgccgaaatagaggctaagactt

SEQ ID NO: 6837849 - DNA, 95 bp, Homo sapiens
aaccagagtaattggaaagctcttcaaaagatgtattagaaagtggtcatatattctatacaaaagcttttgagaaatatcagtgattttaggtt

SEQ ID NO: 6837850 - DNA, 112 bp, Homo sapiens
gtgcttggtgcttcttctaattctttgctgccctcctttgcttctcctagttcttgaaggtattaggaagggcaaaagagatggagatgattcagcaattggaaccgagcac

SEQ ID NO: 6837851 - DNA, 58 bp, Homo sapiens
gctgagcaactcaggctgcaaggggccactcatggtggtctagagcttgattggcagc

SEQ ID NO: 6837852 - DNA, 56 bp, Homo sapiens
gggtgtcctgggtcaaccaggtcgagtgcacagtattgtgggggacccaggacccc

SEQ ID NO: 6837853 - DNA, 67 bp, Homo sapiens
gtcacgttaacagctaacagatgaagttacagattaactcttcactgccattagttggttaatgtac

SEQ ID NO: 6837854 - DNA, 85 bp, Homo sapiens
caggtaaaatattgggtaggtcctttggagttctagactcagtttgagattacagaagatatgctcaacatcctcctttgacctg

SEQ ID NO: 6837855 - DNA, 69 bp, Homo sapiens
ggttgattcttgggccttctgaagttcggggcacatgcaggcgagcattacagatcctaagaataaatc

SEQ ID NO: 6837856 - DNA, 56 bp, Homo sapiens
gcagtgtgtgtccccacactggcagagggactgtctgtgaacaatgacagcactgc

SEQ ID NO: 6837857 - DNA, 87 bp, Homo sapiens
tggtagctctttctttcaaatcagtctatgtttccaggaagtagaaaatactgcttgctggaggcagacagaatgcaagtgagccca

SEQ ID NO: 6837858 - DNA, 77 bp, Homo sapiens
catattgtacagtattggtgttagtagcatattgagtttatgctggatttttagtgttaccaagtactttgcaagtg

SEQ ID NO: 6837859 - DNA, 76 bp, Homo sapiens
tacgtatattctttgagtcagtaattccatttctagatatgtattctagaaaatctggcaagggaataatattgta

SEQ ID NO: 6837860 - DNA, 56 bp, Homo sapiens
cgggggcagcaacgtgcctgatgactctattgtttcaggaggcggtgctgcctttg

SEQ ID NO: 6837861 - DNA, 63 bp, Homo sapiens
ccagccagagaggaaggaatgcacagtttccctttgacggtgagatttcctgcttcttgttgg

SEQ ID NO: 6837862 - DNA, 87 bp, Homo sapiens
ctcaccagcccagccaccacatctagattgcagccctgggacacactctgcaaaagagggtgtgggaagcggggtcatggctatggg

SEQ ID NO: 6837863 - DNA, 130 bp, Homo sapiens
tattagtgataggaaaaaagacctctgggaccttatatgtcagttataaaagacagattgttaaaactataaatttatctctcgtggaactgacatccaaggttccagagcctttttcccttcactgagg

SEQ ID NO: 6837864 - DNA, 71 bp, Homo sapiens
gttctaattaggagaaaactgttgtcttgaaactggacaaattgaggataaataccttctccgattagggc

SEQ ID NO: 6837865 - DNA, 59 bp, Homo sapiens
atttctaaagagggtggtttggcagacagcttactttcatgagctatcctcactgaaat

SEQ ID NO: 6837866 - DNA, 60 bp, Homo sapiens
gctgcagcagaagttctcagaggggcaggtatcataatcccctggagggcttgctgcagc

SEQ ID NO: 6837867 - DNA, 80 bp, Homo sapiens
agggagactgggaagtgtgcaatattgggctggggacggaatcaaattcacacagctcagtgatgccttcacagctcctt

SEQ ID NO: 6837868 - DNA, 63 bp, Homo sapiens
ctggagttaaagaggcaggttaaataatagagacgggctattctttagttggcttcttgccag

SEQ ID NO: 6837869 - DNA, 59 bp, Homo sapiens
gcctgttttctcttggggtggagcagccttggtgttggatcacaggagggaaggcaggt

SEQ ID NO: 6837870 - DNA, 91 bp, Homo sapiens
acactgaatgattgcttttgcagcttgtcagacctttactgggcacctaatctcagtattgtctgacatggttttaagaagctcttcctgt

SEQ ID NO: 6837871 - DNA, 77 bp, Homo sapiens
tcgcttgaacccaggaagtggaggttgcaatgagctgagatctcaccattacactccagcctgggcaacaagagtga

SEQ ID NO: 6837872 - DNA, 89 bp, Homo sapiens
tcatctgggacatgttagaaatgcagaatctcaggcctcacccagacctactaaatcagaatttgcattttaacaagatctccagatga

SEQ ID NO: 6837873 - DNA, 130 bp, Homo sapiens
catacatcagaatcccctgggagcttatttaaaatgcagatttctgggcttcaccacctctgaccaggaggtccaaggtagggcccagacatggacgtttctgtcaagatcccagggaatgctgatgctg

SEQ ID NO: 6837874 - DNA, 110 bp, Homo sapiens
ctgatgaagaattttttttcattgtggggccctctggtgagtatcacatgggacctaaaattttcctatgtgccaatttatagaggctcattcacatacctcttcttcag

SEQ ID NO: 6837875 - DNA, 57 bp, Homo sapiens
ttctatgtacctagcgttgtatctatttcctaaggtgcaatgaatggtatgctggaa

SEQ ID NO: 6837876 - DNA, 95 bp, Homo sapiens
gctcaagaaatagacttacacttgctgaagttaatgcttgcaaggctaaacttgaagcaattttagacacagagtacaaagagtctgcaatgagt

SEQ ID NO: 6837877 - DNA, 56 bp, Homo sapiens
ggacttgagcgtttttataatgaacttgaagttcattataaacatatgctaaagcc

SEQ ID NO: 6837878 - DNA, 65 bp, Homo sapiens
gattcaaaagtttgagctccaagagtctagtgtgatcctgagagtggagctgaatttttggcatc

SEQ ID NO: 6837879 - DNA, 63 bp, Homo sapiens
gcaaggcaaggaatatttaagaacgtcagattcattgacatcagcttttgtattccttgttgc

SEQ ID NO: 6837880 - DNA, 79 bp, Homo sapiens
gtctgattatgagaataatctggtaaatacttggtttatatatgtgctagtgtttttatatgttattcttatggcagac

SEQ ID NO: 6837881 - DNA, 125 bp, Homo sapiens
tctacgtgaatatttatttatgcagttgtgttatttccttggggtacagttcttccagtgtcattggcatcaatgaatatgtgactttgatttcaagtgtaaacaaaccactggttcacggcagg

SEQ ID NO: 6837882 - DNA, 60 bp, Homo sapiens
gaaatggcaagaggccacttaacaggtttagtcaaccctcctgatgaggccagccatttc

SEQ ID NO: 6837883 - DNA, 86 bp, Homo sapiens
tgtagattgcttttaaaggccttgctgagccactctagagttctcctatgtggactcacaacacgagggttataattccagtcaca

SEQ ID NO: 6837884 - DNA, 62 bp, Homo sapiens
agcaagttgctgacctagaagctgatgtttactgaaacccacctgtagggcagcaccgtgct

SEQ ID NO: 6837885 - DNA, 56 bp, Homo sapiens
agcctggctgtcacctggaaagagaaggactcagtctccccaggctataccaggct

SEQ ID NO: 6837886 - DNA, 79 bp, Homo sapiens
cgttcccatctttcccccctaccttccccttaggcacgtctgagaatggtggatgtggtggagaaagaagatgtgaatg

SEQ ID NO: 6837887 - DNA, 56 bp, Homo sapiens
ctcattgtttctggagggatctgtgttttaggcaacagcgttaaggaaaggatgag

SEQ ID NO: 6837888 - DNA, 76 bp, Homo sapiens
gtatggttactacagagagagctccagtgacctggagtggtctagctggggaccagctgtctctgagtaggcatat

SEQ ID NO: 6837889 - DNA, 85 bp, Homo sapiens
gagtctcgctctgtcaccaggctggagtgcagaggtgcaatctcagctcactgcaacctctgactccctggtccaagcgattctc

SEQ ID NO: 6837890 - DNA, 76 bp, Homo sapiens
tgattctaagagggtcaccccacctgctggccatgagtgattggtcagaggtgagcatgtgaccaaaggtgggtca

SEQ ID NO: 6837891 - DNA, 75 bp, Homo sapiens
agaaactcagaggggactggtgtggtacaaagggcatgagttcagagccataaaaccgggttccctcacttttct

SEQ ID NO: 6837892 - DNA, 76 bp, Homo sapiens
tggttttccatggtagcatgtttacagtacttgaaaaatgttgctttcaagtcatgttaactgcttcttaagacca

SEQ ID NO: 6837893 - DNA, 58 bp, Homo sapiens
ttcacgcatttattcacgtattcgatgaaatttattgagtacctgaaatgtagtagaa

SEQ ID NO: 6837894 - DNA, 82 bp, Homo sapiens
ggaagcaaggtggctagggacacagattgctcattaattagcatccttctgtgttcagccttagaagaacaagccttcttct

SEQ ID NO: 6837895 - DNA, 117 bp, Homo sapiens
ggaagttaagaaactatagttttccagcctttggactcccagagctgctctcctgttttttctccgcagtactcagcctggagagcattcttagtctgtttggagaatattaactcc

SEQ ID NO: 6837896 - DNA, 64 bp, Homo sapiens
ttctttccaaccagatattggtttgtagttaatcagttattattattattttggttggagaggg

SEQ ID NO: 6837897 - DNA, 76 bp, Homo sapiens
ttggtcacaggccacggtgatttcctagcaaaggctcaaagaccttgggttccaagtcactgaagcctgtgactga

SEQ ID NO: 6837898 - DNA, 59 bp, Homo sapiens
ggaaagtgctctctctatacacattgccagaagttgtgtgtcatggggaaagactcacc

SEQ ID NO: 6837899 - DNA, 77 bp, Homo sapiens
tttagttgggctgagctggttctcttgtgaaattgtgctggttatctttaagcttatcagttatttgtccaattaaa

SEQ ID NO: 6837900 - DNA, 82 bp, Homo sapiens
caaagaaaaccatatgtcttgtttacagccttgtctgatactatctgtcagggtaaagtaaaaagataaatgtgtttatttg

SEQ ID NO: 6837901 - DNA, 71 bp, Homo sapiens
tttcttaaaagtcattgaaaaatgtatagctagagttatgtctctatgtgcaaattaattgctagaagaaa

SEQ ID NO: 6837902 - DNA, 60 bp, Homo sapiens
ctaaagccacagaggtttatgctatagataaaatttaaccccaaatctcagtggcttaag

SEQ ID NO: 6837903 - DNA, 65 bp, Homo sapiens
ggtgccggtcttaagctgactgtgaccacgttaaattaaggattcataggaaggaaggcggtgtc

SEQ ID NO: 6837904 - DNA, 66 bp, Homo sapiens
gagtagaactagaacaaggatttgattttgccttaaatcaaaaagcctctcttttggttttgcctc

SEQ ID NO: 6837905 - DNA, 123 bp, Homo sapiens
tggctttggctgtgctgttcctcttggaggtgagtggggtctccagggtgagcgaggcattggccatctcctggggcttgtcgctggccagaaagcggagcaggttgtgcagggccttggcca

SEQ ID NO: 6837906 - DNA, 67 bp, Homo sapiens
gaaaagatggttgaccatagaacatgcgctatctctgtgtcgtatgtaatatggtccacatcttctc

SEQ ID NO: 6837907 - DNA, 130 bp, Homo sapiens
gcatgagaatcctctggaaggcttgctgaaacagatggctgggcccgatcctcagagtttctggttgagcaggtctgaggcgaggcctgagaactggtatttctaagaagcttccaggcgatggtgatgc

SEQ ID NO: 6837908 - DNA, 56 bp, Homo sapiens
aacttcagggggcacattcaagcagactgcaatgagaatggtgccccctggaagtt

SEQ ID NO: 6837909 - DNA, 76 bp, Homo sapiens
gtcagttgtcagtttgatttgctccatgaggctattgttcttctataggagccataaataaaatctgttgattgac

SEQ ID NO: 6837910 - DNA, 57 bp, Homo sapiens
tactacatacagaatttagagaagatcaaacaagcttttctgagttcggtatgagtg

SEQ ID NO: 6837911 - DNA, 55 bp, Homo sapiens
acagatggcacctttttgctgtgttgtcacacaatagaaagaaagggctagctgt

SEQ ID NO: 6837912 - DNA, 129 bp, Homo sapiens
ttaataataaagatgagtttttggatgcttgagcagagggtagctgtccaccaaaatggattagcctggtccaccgggtgtggccctggagggacagctgctctatgttcctccaggaaccttgtttag

SEQ ID NO: 6837913 - DNA, 57 bp, Homo sapiens
tatgttttcctctggcacttatggagcttataaaccagtgacagaggaaggtgcata

SEQ ID NO: 6837914 - DNA, 99 bp, Homo sapiens
gagagcaagctagtggatttgcctctcagagtctacacagccaagtgtcacaacttagagggtgagtgcctttgattgggcatgttcctggccagcctc

SEQ ID NO: 6837915 - DNA, 118 bp, Homo sapiens
aaactccagctgctcatgaatatagggtcagggagggccggctaaatgtttctctgtgctttctctccagcacagccagcagagctgtttcctgttctttgtttcaaggctggggttt

SEQ ID NO: 6837916 - DNA, 56 bp, Homo sapiens
ctgtgtagattctccttccctagggcagtcctcaggagaacttccttctaccccag

SEQ ID NO: 6837917 - DNA, 63 bp, Homo sapiens
aagaacggacagattttgcttacataaaaattatacagtaaaatgcatcatttgtctcttctt

SEQ ID NO: 6837918 - DNA, 55 bp, Homo sapiens
agcagcaaagaataggccctctgctaattaccccaggggccagctttctgctgct

SEQ ID NO: 6837919 - DNA, 69 bp, Homo sapiens
cccatattttaagagctcagtagccacaagtggctgagtggctgctacataggatagctcaaatatggg

SEQ ID NO: 6837920 - DNA, 56 bp, Homo sapiens
tctgctggaaaaccagggaattggtccaaaccaactctcaggttctttccagcagg

SEQ ID NO: 6837921 - DNA, 100 bp, Homo sapiens
cgtgaagctgttttgaaaaatcaggttgtggaagcagatggcaacatgccttctagatttttgtgcacctttgggagtgtttattaagacagagttcacg

SEQ ID NO: 6837922 - DNA, 111 bp, Homo sapiens
aggcatggcatcctggaaagtttgcttcttttaccgaatgtgtcaagatggaaagcattaatgatacttggtctgaacacattttaggtaaataaattcctgattcagctt

SEQ ID NO: 6837923 - DNA, 55 bp, Homo sapiens
ggagacatgcagactgagatacttttaaaggtttcaaatgaatcagtatgtctct

SEQ ID NO: 6837924 - DNA, 65 bp, Homo sapiens
ctacactggataaaaatttggaagtcagatatactaattcattgattttcattaattcagtgtgg

SEQ ID NO: 6837925 - DNA, 70 bp, Homo sapiens
ctggggctcccggctgctccggctcccggccccctgagctggagccagagcgcagcctgggccgcttcag

SEQ ID NO: 6837926 - DNA, 83 bp, Homo sapiens
cttcctcagatgtcactgcagccccaagcgggttcccctgtcaaattcctgaccggtccttggggacgctgacatcgtgggag

SEQ ID NO: 6837927 - DNA, 56 bp, Homo sapiens
gctgggagttactgtctcctttatcaccattttgaaaagcagaagctgctctcagc

SEQ ID NO: 6837928 - DNA, 62 bp, Homo sapiens
caggttgcagagagctgggtgaagcaggatgtgccctgactttggagtggttctgctgcttg

SEQ ID NO: 6837929 - DNA, 64 bp, Homo sapiens
agggagagcctcaggcccaggacagggcccagccaggcctgacccagaggttctgggcctccct

SEQ ID NO: 6837930 - DNA, 68 bp, Homo sapiens
ggccactatgcaggtgctggggatgcgatggccataaaaactgacatgcttccacagagcttgcagcc

SEQ ID NO: 6837931 - DNA, 76 bp, Homo sapiens
ctgccggaagtttaccagctcactttcggcgtcgcgcccgcctccgtggagcaggccggaagtggctttccggcag

SEQ ID NO: 6837932 - DNA, 74 bp, Homo sapiens
agcctcagtttcttcatattgtaggatggggatgactatacctgccttacagtgttgagggaattaaatgagct

SEQ ID NO: 6837933 - DNA, 84 bp, Homo sapiens
cctttacagcttgttatcattttgctaagaaaatagagctactggcaacttttatatggcgaagctgaacataggctagaaagg

SEQ ID NO: 6837934 - DNA, 66 bp, Homo sapiens
tcaggttgcagaggagagaagtggctctgctgttttactgggccaggaactcagctctgcacttga

SEQ ID NO: 6837935 - DNA, 86 bp, Homo sapiens
aagggtgctggactggctggcgggtgacacacctggggttcctgggcccctcctggccacactgtcagtgggcctcaagctccctt

SEQ ID NO: 6837936 - DNA, 74 bp, Homo sapiens
gtgtttacatcagaaggaaacagcgtgctcacgtgtctacccgcacacgcttcgcctccttctccgtgcagcac

SEQ ID NO: 6837937 - DNA, 79 bp, Homo sapiens
tggaggataatggccctcttatcacagctccactagtcagtgctccagtggggacactgtgtggggggctacaacccca

SEQ ID NO: 6837938 - DNA, 59 bp, Homo sapiens
tgagcagcttgttccgagtgttatttggttccaaacccaatactattttcaactgctta

SEQ ID NO: 6837939 - DNA, 101 bp, Homo sapiens
tgggctccccaggctttgggtgtcctctgggcctggtctcatggagtagttcaggctggagactcaagactgcagaagacgctatggcgaggggagatcca

SEQ ID NO: 6837940 - DNA, 56 bp, Homo sapiens
catggtcatttcccatcagtgtgaactctctgagggtgtctgaggggagtgctgtg

SEQ ID NO: 6837941 - DNA, 59 bp, Homo sapiens
gagggtggaaaatggggagaatgaggccccttggtgctcttatgttttcatcacatctc

SEQ ID NO: 6837942 - DNA, 82 bp, Homo sapiens
cctttaaatttgcattttcaccagagacacttaaaactaagatagagagaagtcaatgatgagagtgctttgttatagaagg

SEQ ID NO: 6837943 - DNA, 71 bp, Homo sapiens
tcttacagttttgtaaacctctcctgagtgtctcccatagtcaggagctgtgaatacaaaggtaagtaaga

SEQ ID NO: 6837944 - DNA, 55 bp, Homo sapiens
agggctagagtttgagaaagggttctgaactggaatcagtttaaatcctggcttt

SEQ ID NO: 6837945 - DNA, 69 bp, Homo sapiens
ttgtatgtaaagttatagtgggcttgcttagagatttttctgctaagttacacttaacttactaggcaa

SEQ ID NO: 6837946 - DNA, 60 bp, Homo sapiens
agactgggtccaccaaggaaaatagcaggactcccactgtcacctctgtggacccactct

SEQ ID NO: 6837947 - DNA, 98 bp, Homo sapiens
tctgagattagagagccagagttctttggagtattttctagctgaattggaaaaccttgattctgcatgtgtttcaaatactgaggctttttaacaga

SEQ ID NO: 6837948 - DNA, 72 bp, Homo sapiens
ttatagcattaaagtccaaaatctcataatctagatcatctaaattagatatgtgtgagactctggctatga

SEQ ID NO: 6837949 - DNA, 69 bp, Homo sapiens
ggtcgggatgttctcaaaaaacgtgtgcatcgctggaaatgtgaggtcctgcatgttgaggtcttggcc

SEQ ID NO: 6837950 - DNA, 74 bp, Homo sapiens
acatattaaagttctcaaggttaggaaaagtcactatatttgtatacttccttaatttggggaaaataaaatgt

SEQ ID NO: 6837951 - DNA, 55 bp, Homo sapiens
caagctggctcttatgcaaaaagccacacacgctaggtgtatgggagtcagtgtg

SEQ ID NO: 6837952 - DNA, 85 bp, Homo sapiens
cagggcacagcctcgacactcgtgccagggtctgggagggaggcacttctgccacctgaccccagcacttgtcccttgagccctg

SEQ ID NO: 6837953 - DNA, 59 bp, Homo sapiens
tttactgattggtcttttagttagcacagtttactgctgactgaaatggcgacagtgaa

SEQ ID NO: 6837954 - DNA, 79 bp, Homo sapiens
gccagaacatatgttgtaggggtgtgggatggctttccttccaccatcttacaccattcaaatattttcttaccagggc

SEQ ID NO: 6837955 - DNA, 69 bp, Homo sapiens
tcaccctgcctccaggaggggcagctctggtgcattcacactccagagtccaccctggggtcaggctga

SEQ ID NO: 6837956 - DNA, 66 bp, Homo sapiens
gccaatattcagcaagctgagtgcccatttgttttaagatgaggaacagacttgctggataagggt

SEQ ID NO: 6837957 - DNA, 55 bp, Homo sapiens
gcaaatgtattgcataggatattttaatataaaataatttatggaatacatgagt

SEQ ID NO: 6837958 - DNA, 82 bp, Homo sapiens
ctatagatttaatacagcctgagtcagaattccagcagtcttttaaatggaaattgacaggctattattaaaatgtatatag

SEQ ID NO: 6837959 - DNA, 58 bp, Homo sapiens
ggccccaggtgagctttatttggccgtgaagctgaatgtacaggctggctatggggcc

SEQ ID NO: 6837960 - DNA, 77 bp, Homo sapiens
acctgatgggtctctccctactgcaatgatgcttcagggcatgtctctcactgctggggagtgattgaccatcaggt

SEQ ID NO: 6837961 - DNA, 79 bp, Homo sapiens
cacatctacgccaggagcagaggtctagttgccatgcatatgctgctcctctagaggtctactcttggtagtaggagtg

SEQ ID NO: 6837962 - DNA, 78 bp, Homo sapiens
tgggattatctagattattcatgagtctgcttaaaaggaaattttttaaggcaggactggatagctatggctttccca

SEQ ID NO: 6837963 - DNA, 63 bp, Homo sapiens
ccagccaccgcttgtttgcactcacaagtaaattgatgccgacaacctggagcggagggctgg

SEQ ID NO: 6837964 - DNA, 100 bp, Homo sapiens
ggccgggaccgagggggagaggctgcggtggggaaaggaggtgctggggagaagggaagcccagaccgctacccctcacccccttttccccagcctggcc

SEQ ID NO: 6837965 - DNA, 57 bp, Homo sapiens
ggcagtatgagttcaaataattctgttattagaaatagagttttgaatatatatgcc

SEQ ID NO: 6837966 - DNA, 71 bp, Homo sapiens
agtgaaaggctccttctcccatgacctttgaaataagaaggtcactatctgagaaaggagggtctgtagct

SEQ ID NO: 6837967 - DNA, 84 bp, Homo sapiens
ggttatgacgtatccttgaatgctatgtttggactttgttcagtgtcaggcaaaggaaggtatttgaaaggagaagtgatgatt

SEQ ID NO: 6837968 - DNA, 95 bp, Homo sapiens
aaagacacagctttctctcagccaggctgcatgaattcaggatttgcattctcttggttggggctgggctgagagaaggtggaatgcgtgttttt

SEQ ID NO: 6837969 - DNA, 72 bp, Homo sapiens
acgttttgatagcagtgacattttaatgtgatcatcttatcttggacacataaagcagctgcttcaaaatgt

SEQ ID NO: 6837970 - DNA, 59 bp, Homo sapiens
gtcccctgctgtggatctgtggctagtaacagcctgggagcagcagacagacaggggac

SEQ ID NO: 6837971 - DNA, 82 bp, Homo sapiens
ggctgtccatgcgaatgtaacaggtgaagctctgagagtacataaccctccagtgcaatgatacattctcatatgtgtagcc

SEQ ID NO: 6837972 - DNA, 82 bp, Homo sapiens
gcacgggccctagagttagcttcatatccagactctaccacttgctgtatgtccctgggcaagtttactcttctctctgtgc

SEQ ID NO: 6837973 - DNA, 68 bp, Homo sapiens
caaccagattgtgagataacatggtgtggtggtgtacagccacatttaaaaaatccacgatcttgttg

SEQ ID NO: 6837974 - DNA, 63 bp, Homo sapiens
tgaattggtgtcttttgccctgttgccacagagtggagtccagaggcatcggattcaacatca

SEQ ID NO: 6837975 - DNA, 75 bp, Homo sapiens
ctgtgtttggtgtgagttcataccacaccccgttgtcccgagggtttctgcggattgaagtcacactgagctcag

SEQ ID NO: 6837976 - DNA, 83 bp, Homo sapiens
acaatactgctgtgatatgtgcttgtaatatttataaaggctaagctatgaaaacagtacatgccaactgtcagcagtgatgt

SEQ ID NO: 6837977 - DNA, 77 bp, Homo sapiens
tttaaatgtggcaatggaaaagtgaaaatagcttttaagataaagcaattgtctctgaatttccagctgcatctaaa

SEQ ID NO: 6837978 - DNA, 61 bp, Homo sapiens
gggtttggatgtgtagtgaggggagggccagcctcctcctgtgcactgggatcacagcccc

SEQ ID NO: 6837979 - DNA, 83 bp, Homo sapiens
ctaaggacagagaaggcacttaggattttaatctgagatgagatccatgggaagattttgagtggtttagtctcatgctttgg

SEQ ID NO: 6837980 - DNA, 75 bp, Homo sapiens
ggctagaggcagagtgcaccccaggagtgacaaacacctctgttagtgactgggaatgtgggcttgcctcctgcc

SEQ ID NO: 6837981 - DNA, 67 bp, Homo sapiens
ttgccaacagggaagcttgggctgcagctgcagcagcaggtgctggctgccaggttccctgtggcaa

SEQ ID NO: 6837982 - DNA, 55 bp, Homo sapiens
ctacctttcacagctgtgcaggtttctctcagctccatgccagaatgtgaggtag

SEQ ID NO: 6837983 - DNA, 94 bp, Homo sapiens
taaggacctgagaggaaagagtggacaagcagaaatgtctgaaatcatcaggcagatactaagctgcttcctcacttctttaaggatttccttg

SEQ ID NO: 6837984 - DNA, 56 bp, Homo sapiens
gaacaaagtttcaggaagatagacacagcttacagtttatgactggacctttgttt

SEQ ID NO: 6837985 - DNA, 71 bp, Homo sapiens
gacagagaagagactcatgcgggccatgtgcaggggatcccttgggccagcactgggtgctcattcgagtc

SEQ ID NO: 6837986 - DNA, 96 bp, Homo sapiens
ctgggactatcaggagttgtgcagtgtagaaaaagagtgagtgccaccagcttggcttctttatgctctgccttacacagtcctgaatgttcctgg

SEQ ID NO: 6837987 - DNA, 77 bp, Homo sapiens
tacacctacctggctcagcaaggcattctgtggattatcttattagtaattataacatgctttctggctatagtgta

SEQ ID NO: 6837988 - DNA, 68 bp, Homo sapiens
tcctgttgctgtagtggttaaggggaaacatagtttattatttcctagggcaatgccagatgacagga

SEQ ID NO: 6837989 - DNA, 64 bp, Homo sapiens
ggttcatgaaatgctgcagttaaggtgctggtctatctgaggggggccacaccttctgcagacc

SEQ ID NO: 6837990 - DNA, 76 bp, Homo sapiens
ggcaggcctgtgtgagagatcccccactcatctcccctagggaagaagtgaggaaatcctctttaaattgcccgcc

SEQ ID NO: 6837991 - DNA, 75 bp, Homo sapiens
cctctcatggtcagaaagaaatcaaatgaggattcaagtaggtgcctgatacttttcttttagactaaccagagg

SEQ ID NO: 6837992 - DNA, 102 bp, Homo sapiens
tatcttaatttggcttcaccatgcttgatttgtaatgtgttctgagacccaagagaagctctgacattgcaattaggtacctatgaacgttatattaggata

SEQ ID NO: 6837993 - DNA, 89 bp, Homo sapiens
tggatgctcctcaaaggcaagagctgcatctaagccatgagagagtcaaaatcctcaggaacccaggcaggttttctttaggacatcta

SEQ ID NO: 6837994 - DNA, 63 bp, Homo sapiens
ggcccgcagctcgctctggttctgcagctggaagacagaagccaagagatgaggctgcaggct

SEQ ID NO: 6837995 - DNA, 85 bp, Homo sapiens
ccacaagtgtttggttgttactcagcagttgttttgtgtgcagtagcactgatggcttgcttagtgacagcaacatcccacatgg

SEQ ID NO: 6837996 - DNA, 55 bp, Homo sapiens
gcaagagcagcttcctttattactggaagaaaatcagtgagattgctgctctagc

SEQ ID NO: 6837997 - DNA, 120 bp, Homo sapiens
tctgttttccatgtcagccatactgatttggtgagaaagcacagaaattgtcatgtcagctgtgtccatcattctgttctttatttaccatattatgttaatgttgattaagagaaaaga

SEQ ID NO: 6837998 - DNA, 77 bp, Homo sapiens
ggaatcagaaagatcttgatgagaaataaatatacgtagaagcacttgcgttttcactcctggatcatctgtgctcc

SEQ ID NO: 6837999 - DNA, 69 bp, Homo sapiens
acctgctccaagagagaagtgtagttactctgatagttcactagaccacatttttctaggaggcaaggt

SEQ ID NO: 6838000 - DNA, 59 bp, Homo sapiens
ttgaacacttactatgttccaagtattaatccagatgcttaatgtacgtgagtgtacag

SEQ ID NO: 6838001 - DNA, 97 bp, Homo sapiens
ttttgtgcaaagttagtgacctttggtctcttctaaagaatgacagagttaccgtattaacagacttgaaagagactcagttgtcaaacccacagaa

SEQ ID NO: 6838002 - DNA, 64 bp, Homo sapiens
ggatgaggcagaaaaaagtcggagggctggttaactttttcttcctcttgcttcagtttcatct

SEQ ID NO: 6838003 - DNA, 84 bp, Homo sapiens
gcctttcagccctctctcgtgcaggccttgctcggagtcccaggagatccacaggtccggcatgaacagtgagaggtcagaggt

SEQ ID NO: 6838004 - DNA, 66 bp, Homo sapiens
ggggagaaatgtctggcctgctgtgagcttggtttctgcagtaggacccaggatattttcttcccc

SEQ ID NO: 6838005 - DNA, 64 bp, Homo sapiens
agcaggttgttttcttcaatatgcagcacacattgaaaatgtgaaatatgaggaagacaaagct

SEQ ID NO: 6838006 - DNA, 63 bp, Homo sapiens
ccagtgctggactctgctgctgggccttggtgggcaggggcagcaagagaggttcagctttgg

SEQ ID NO: 6838007 - DNA, 79 bp, Homo sapiens
gagtggcaaatgctatgattttgagtttccttattttatttacacacagggaaattctaaatcgtaacatttaccattt

SEQ ID NO: 6838008 - DNA, 74 bp, Homo sapiens
atcccagtcagccctctaccttggctatagaacccacaggagggtttccccagtttggagagagcacttggggt

SEQ ID NO: 6838009 - DNA, 61 bp, Homo sapiens
ccaatggggaagctgctcctggttttacagtttagtttgaaatcagatgcttcctagttgg

SEQ ID NO: 6838010 - DNA, 130 bp, Homo sapiens
gtatctggtgtggtgaggtagatatcatagcccaaatttgtgccctgcatgtgccttttggctgacagagccaatgcatcaattaggggcagacaaggctgtgttgcttcatcaccaccactgactgtac

SEQ ID NO: 6838011 - DNA, 71 bp, Homo sapiens
ggccagagaacttagctagttttccctcggtcatatctctgggattcaagcccagctaagtgattcatgcc

SEQ ID NO: 6838012 - DNA, 81 bp, Homo sapiens
ttgtgtgaacctagaatggacatttctgggagaacctgtcaaggttttggcagccgtgttcacataaggtaattcatgcaa

SEQ ID NO: 6838013 - DNA, 65 bp, Homo sapiens
caacagtggacggggcacgttgggaggaggccctgaacctctggctctcatactcgccagtgttg

SEQ ID NO: 6838014 - DNA, 61 bp, Homo sapiens
cagtgattgtgtgatgatgaagattcattcattcattcattcattcagcacatatttattg

SEQ ID NO: 6838015 - DNA, 120 bp, Homo sapiens
aggcagggaaggagggttttgtggcttctacgcccacaggctactgctgcctgaactggcaaaagtatctcaaaggtggctgtttgaacccagaggtcccagagtgccccctccctccct

SEQ ID NO: 6838016 - DNA, 60 bp, Homo sapiens
cctcctttgcattctttagaggtcacattggctgctgtagggagaaagagttgaaggagg

SEQ ID NO: 6838017 - DNA, 72 bp, Homo sapiens
gtcagggctcaggagaggcaggcgctgcaatggttaacaaccgggatggggcctgccttcctctctcttgac

SEQ ID NO: 6838018 - DNA, 73 bp, Homo sapiens
gaggggcagttgattgtgctatgaaagcccaacagggctaagcccagccacagtcaacctgtccatagttctc

SEQ ID NO: 6838019 - DNA, 57 bp, Homo sapiens
ggagcctgagggccctcttggaaggtctgtctgtccaaagagtttgcccgaggcttc

SEQ ID NO: 6838020 - DNA, 77 bp, Homo sapiens
ggactagatttcttgggagcttggccgagatgtaggatggacctgggtgtctgtaggttcttaaccatctggactct

SEQ ID NO: 6838021 - DNA, 68 bp, Homo sapiens
tgaatagtgccttgtcttcttgctggaacacactttgcagtacaagagctttaggcagttgttattca

SEQ ID NO: 6838022 - DNA, 63 bp, Homo sapiens
cacatactattttggttgggttgtttcttgtcatcataaacccaatcaatttgcttgtatgtg

SEQ ID NO: 6838023 - DNA, 66 bp, Homo sapiens
gcctgagaagcgcggcgtcggcgtgggtcctgcgcagcctgccccgcgagcgcccgctgcaagtgc

SEQ ID NO: 6838024 - DNA, 64 bp, Homo sapiens
gcttcccaggcgcctgacctttctgagctgctggcaggagagggcagtgggagtcagggatggc

SEQ ID NO: 6838025 - DNA, 63 bp, Homo sapiens
ttccagatttgaagtaagtaatgagtatttgaagaaaatgctcattcattttcaggtagtgaa

SEQ ID NO: 6838026 - DNA, 77 bp, Homo sapiens
agattctacaaaggcaggattgacttagttaaaggatacaaaccgataaccctcactgagtttttactgcaggattt

SEQ ID NO: 6838027 - DNA, 67 bp, Homo sapiens
gcctttgtcttttgccaaagatcagttgaccgtagttatgtgagtctgttctgcgggggaagggggc

SEQ ID NO: 6838028 - DNA, 86 bp, Homo sapiens
cgtatgaaaaagttacctgctgacttacactgtttattactaattaagaaatgcagacagtactgttagaactggctttttgggcg

SEQ ID NO: 6838029 - DNA, 78 bp, Homo sapiens
gggagcaccaaggctctgccatgggatgcccagttctctttataaaacttgacagtccacagggctctaggcgcttcc

SEQ ID NO: 6838030 - DNA, 82 bp, Homo sapiens
tgttacttctctacttaagcttaagtactttctcccagcatccatttccgaagccacttgggctggagtgccgaggaagaca

SEQ ID NO: 6838031 - DNA, 82 bp, Homo sapiens
gtggcatcagaattttctggaatggagcaatgtttatgtgaaattaagttttaaaaacttcatgagtgattctgatgcacat

SEQ ID NO: 6838032 - DNA, 61 bp, Homo sapiens
tcagtgtcagtcttttagatatgtgttagaaaagaggcatatttaaattgtactatgctga

SEQ ID NO: 6838033 - DNA, 69 bp, Homo sapiens
ggcgccctcagcagagccctgcagttcttcaggaggctctcttctctgttggcaaggtttctgaggccc

SEQ ID NO: 6838034 - DNA, 90 bp, Homo sapiens
ttttagagagcttcactctgggcctcatccagccacaaccttccctaaggatgagctgtccatgaggccaagggaatgtgccctctggga

SEQ ID NO: 6838035 - DNA, 70 bp, Homo sapiens
tggtccagtgtcttctacataacaaatactcagtaaaccatatctgttatgagaaagacattaggtaaca

SEQ ID NO: 6838036 - DNA, 75 bp, Homo sapiens
cagccggaaactcctttgagagcctcaacccaatctcacaactgttgacggactttagaaagagtttcttccctg

SEQ ID NO: 6838037 - DNA, 67 bp, Homo sapiens
gggttgagaaataggtgctgtcagggccaaaacaagcttggtctctgtgttccctgttttctctccc

SEQ ID NO: 6838038 - DNA, 83 bp, Homo sapiens
tgccgcacacgatggccttgtagaagagcttgtgggccctgcccttcatgccacgctgctgcaaggacacgtgtgtcacggca

SEQ ID NO: 6838039 - DNA, 64 bp, Homo sapiens
ataagcttccaaagggctctagactcagcagtgaaattgtcgcctgccttgccctgaagtttat

SEQ ID NO: 6838040 - DNA, 74 bp, Homo sapiens
ttggtgcaaaagtacttgcggatttgccatcacctttacctttaatggcaaaactgcagttacttttgcaccaa

SEQ ID NO: 6838041 - DNA, 74 bp, Homo sapiens
acttcctcattgctctgtggttggtggtggtggtcagcaggctgcaggcgtcactgccacgggtatctggaggt

SEQ ID NO: 6838042 - DNA, 83 bp, Homo sapiens
agatttgtcatctacagtgcgatttttaggcctcttgactttttgttgagccctaggcttttgtgactgcctgtgacagctct

SEQ ID NO: 6838043 - DNA, 99 bp, Homo sapiens
gagacaggagaatcgctagaacccgggaggtggaggtcgcagtgagctgaggtcacgtcactgcactccagcctgggcgacagagtgagactccgtctc

SEQ ID NO: 6838044 - DNA, 63 bp, Homo sapiens
ctttcagaaggtactgaagacatggaatttctgagggccagtttttccagtgctttctgtgag

SEQ ID NO: 6838045 - DNA, 62 bp, Homo sapiens
gcccgggcagctcggcactggggcgaacccactcccgctctttcctcgatgggctcctgggc

SEQ ID NO: 6838046 - DNA, 83 bp, Homo sapiens
ggcacattagtatgtacaagtgtttgctattatgatgatgaaatgcttacaggaagcaaagcactttgcatacatattatgcc

SEQ ID NO: 6838047 - DNA, 67 bp, Homo sapiens
ttcaataatttaagaggctgacagctgtatcatagcagctctatcatagcatttttgtattgctgaa

SEQ ID NO: 6838048 - DNA, 86 bp, Homo sapiens
gcataggcctaataattagattttattttggagagccgttggtctaatgggggagatagagtctgatggtggaggcaatactgagc

SEQ ID NO: 6838049 - DNA, 67 bp, Homo sapiens
ggttaagattgttttggatgctaactgttaatgtcaaaaccaagttagcgatgtaaaataacaagcc

SEQ ID NO: 6838050 - DNA, 59 bp, Homo sapiens
accaggataataggttgggatgggacacacttccagtccaatcttgctgtccacttggt

SEQ ID NO: 6838051 - DNA, 67 bp, Homo sapiens
caagccccaaacaccaggattactgtttacaggggttcctgtttacagtagtttagcacagggtttg

SEQ ID NO: 6838052 - DNA, 103 bp, Homo sapiens
attttgtcctggggcccataggtcactcacagcagactatgagggatataaacatgaataaatggagtccttagctgtctgtgctggaagtcctaggctgaat

SEQ ID NO: 6838053 - DNA, 88 bp, Homo sapiens
tggcataataaagtataagcattggagtattccatgcacttgtctatcaaacagtggtccatactcccaacccttttgcattgcgcca

SEQ ID NO: 6838054 - DNA, 94 bp, Homo sapiens
agctgagtggtctggctcagagtctctcatgcagttacagtctgatgatggttggagctggcattgcagggagctgcccaggtatctctcagct

SEQ ID NO: 6838055 - DNA, 122 bp, Homo sapiens
tgaatcctctgggacttggttaacatgcgaattcctgggtctcttccttagttcttttgattcggtaggaatggtgtgaggccctggagcatgcactgttaaaagcacccaggtaaggttca

SEQ ID NO: 6838056 - DNA, 58 bp, Homo sapiens
ttttatgctacccaacccgtcagtggaaactcttgaagaaatggtggggtagttagaa

SEQ ID NO: 6838057 - DNA, 66 bp, Homo sapiens
tgagaaatgctttagaaaaccagctttgatcaatttaattaggagtagttttgaaagcaattctta

SEQ ID NO: 6838058 - DNA, 63 bp, Homo sapiens
aagatggttgccaactcaaggatttccgccttctggaggccgcgtagtctgagcatctgtctt

SEQ ID NO: 6838059 - DNA, 62 bp, Homo sapiens
acagagaccagcatcttctgcctgtagtcagcatttcagaaagacaattgttggttatctgt

SEQ ID NO: 6838060 - DNA, 61 bp, Homo sapiens
tgaagtatccatcttgttctaggtgatgaaagaaaccacagcatggagctctggaacttca

SEQ ID NO: 6838061 - DNA, 61 bp, Homo sapiens
gtgagcagtccttatggggccttgattcattggataataaggtttgaagaagactgagcac

SEQ ID NO: 6838062 - DNA, 64 bp, Homo sapiens
gtcacctagctcatggtggaattgccaactataaaatagcatttccacagcccaagctggtggc

SEQ ID NO: 6838063 - DNA, 126 bp, Homo sapiens
acaaactgccacacattaggggacaaaaacagtagacattaattttcttataattctggagactggacgtccaagatcaagatgtcagcagggttggtttcttttgtgcctctctccttggcttgt

SEQ ID NO: 6838064 - DNA, 74 bp, Homo sapiens
gccggcccatggtggcttggaccagtcacagtggtccgggggcccagatgaggtctgagcagagtggggtgggc

SEQ ID NO: 6838065 - DNA, 81 bp, Homo sapiens
gcccgggctgcagaagccagtgtggtctgcccattgggcagcaatgggcaggtggcgttggctctgtggtcattggtgggc

SEQ ID NO: 6838066 - DNA, 74 bp, Homo sapiens
gtgccagcattcacactggttccttcagtcccaaatcctaaaaagtaaggcagagggccaagtgatgcttgcac

SEQ ID NO: 6838067 - DNA, 59 bp, Homo sapiens
ggcaaacacacctcggtgagaaactggtccttcacagcatgggcacccaggtgtgtgct

SEQ ID NO: 6838068 - DNA, 69 bp, Homo sapiens
gattctaggttcatgggattcagtgttgaacaatcagacaatgcccctgtccccatgcaacctacattc

SEQ ID NO: 6838069 - DNA, 80 bp, Homo sapiens
cagtagtgaagggtctatttgcagggaagggcagaaggggttcctaaaagaggcctgcccatccctgtggccccctgctg

SEQ ID NO: 6838070 - DNA, 73 bp, Homo sapiens
tcggtggacgccggggcctaccgctgcgtggcccgcaatgccgcgggccacacggagaggctggtctccctga

SEQ ID NO: 6838071 - DNA, 65 bp, Homo sapiens
gagcacttgaagtttgggggactctggtacaaaatcccaatccatttacctttgcttgaaggctt

SEQ ID NO: 6838072 - DNA, 68 bp, Homo sapiens
agcatacttgacacttctctatttgcaatgattgccatgataggccgtggagagagaagtgtgtagct

SEQ ID NO: 6838073 - DNA, 70 bp, Homo sapiens
tgggatggttgttgagggagatgaaaatcttagactctgactgcaagtcatatcttcttcaaaccactca

SEQ ID NO: 6838074 - DNA, 55 bp, Homo sapiens
ctctgtgggcaattattaactctgcacaggaacgggaaaatagctgctcagagag

SEQ ID NO: 6838075 - DNA, 63 bp, Homo sapiens
ctgccagcccttctgacatctggggaaaagggctcagcagatgtgcctccagggctttggcag

SEQ ID NO: 6838076 - DNA, 59 bp, Homo sapiens
gcccccagacctcagtgggctgccttggggtgcaggggtacagccttggtctgtggggc

SEQ ID NO: 6838077 - DNA, 89 bp, Homo sapiens
aggcctgtgcaatccatataggcagatggcacagaagagccctacagtgtgcctggtactgcctaaggtgtggcttgtaagccaggcct

SEQ ID NO: 6838078 - DNA, 123 bp, Homo sapiens
gtgaaaatgtctatgttaaaagtaaaaagtaggaaagcacagagagctctaggtaaaatattttgttattgcttataatttgttgcaatttgaacttatttatttgacacaaatacttttcac

SEQ ID NO: 6838079 - DNA, 84 bp, Homo sapiens
atccacagcccacagccaggcgtggcttcagcagcccctggaccctgagggcatggggcccatgccgggctttgtgggcaggat

SEQ ID NO: 6838080 - DNA, 106 bp, Homo sapiens
gtgaagttaaatgttaaaaatgtggtctagaaatgttctcaggggtttgtctgtatcaaatccctaagaacattcctagatatattttatatatatataattttgc

SEQ ID NO: 6838081 - DNA, 65 bp, Homo sapiens
gcccagatgcttgttggctggtctccatcttttagcactggaagaccatattcagcaggcatggc

SEQ ID NO: 6838082 - DNA, 64 bp, Homo sapiens
gtgctgtatcagtacatattgatctccctcattctaatggaattcttttgtatgaatatagcac

SEQ ID NO: 6838083 - DNA, 56 bp, Homo sapiens
gccttgctgattaccttcctttaaaccagtccatctaaaggttggtgttaagaggc

SEQ ID NO: 6838084 - DNA, 83 bp, Homo sapiens
taggctgtgcgaggtctcagagtctctgacaagtccctcattagctcatccttgtttgcatgctctgtgacctgtacagtttg

SEQ ID NO: 6838085 - DNA, 55 bp, Homo sapiens
ctgcaaggtcttctctctggaggaaactaccttgggaaaagaaaaggccctgtag

SEQ ID NO: 6838086 - DNA, 73 bp, Homo sapiens
aagatgttagggtggaagggatgaatggttcagcaaccctggctcctaacagaccttacttcccctttgtctt

SEQ ID NO: 6838087 - DNA, 58 bp, Homo sapiens
tcctgagggcttccttgtcccggggaaccatttctttgggtttcagaaggtttccgga

SEQ ID NO: 6838088 - DNA, 107 bp, Homo sapiens
tgctccttcaccagttatgcaaattttcaacttatttaatgtgatctgaagaggtgagtcttccatctctgggttgcagttagatagggcatgatggtgtacaagta

SEQ ID NO: 6838089 - DNA, 56 bp, Homo sapiens
ttctgcttgctgcgtgctctaaaatggacatacttgaggcaaacatgtaagtagga

SEQ ID NO: 6838090 - DNA, 88 bp, Homo sapiens
gaaactgggaaatttcccttatcttgtcaagctcatgggactcccatcatttcctaaccccaaagccaggggagggattcccaatatc

SEQ ID NO: 6838091 - DNA, 83 bp, Homo sapiens
gttcttcagcgtggcgttagtattctttctgattttttctaatccctagacaggtgttgatactaatcgtggcctaggagggc

SEQ ID NO: 6838092 - DNA, 80 bp, Homo sapiens
gctggtgaggatggtgagctgttaagattgcaagatgatacagccactttggaagatagttcggcagtttcttacaaagc

SEQ ID NO: 6838093 - DNA, 58 bp, Homo sapiens
tggacctagagaaaaatgtctggagcaatgttttgccgttcaaagaccctcaggtcca

SEQ ID NO: 6838094 - DNA, 61 bp, Homo sapiens
tcttctgtgattcttcacttgcttcaggccacctggatgtatacgtgcaggtcacagggga

SEQ ID NO: 6838095 - DNA, 86 bp, Homo sapiens
ccttcaagatcacagtttgggaacctgagaactcaaagagccccagctctcctgcaggcctgttcccagtatcggtggtctcaagg

SEQ ID NO: 6838096 - DNA, 88 bp, Homo sapiens
gccccttgggatagagtggcttgctcagctagcagaatagtttatctagctcctggtgagcctactctttcctcccaccttggggagc

SEQ ID NO: 6838097 - DNA, 70 bp, Homo sapiens
gctctcctctccctcacaggccactgtaggccttggaggccttgctcaagctagtgacgggctaggatgc

SEQ ID NO: 6838098 - DNA, 62 bp, Homo sapiens
taaggaagattttttccaaatattagaggtttctgaaagtggagggaatgaatcttctctta

SEQ ID NO: 6838099 - DNA, 79 bp, Homo sapiens
ttttttctctgacccccttaaatatttcctatatgttaaatcagattaaaatgaaggtgggtacaacattgagaagaaa

SEQ ID NO: 6838100 - DNA, 60 bp, Homo sapiens
cctggcattggctaacatgttaaacttcagcttctcattgctcattgttggtttgtcggg

SEQ ID NO: 6838101 - DNA, 58 bp, Homo sapiens
ccacagggactgttaaaaccctgggcctatcccggagtttctgattcagtctgtgtgg

SEQ ID NO: 6838102 - DNA, 69 bp, Homo sapiens
aaatagacgtgaattccctggcttcccttaacacttagattcctaaggtcagggtattcacgtctgttt

SEQ ID NO: 6838103 - DNA, 58 bp, Homo sapiens
tcaggcaatctgacagctggagccaatgggaaatgggtagcatgtcagaggagcctga

SEQ ID NO: 6838104 - DNA, 75 bp, Homo sapiens
gtgaagcggccctggctgccctcttggggttattctaattggctccaatcagggaaagccaggtctgggctttat

SEQ ID NO: 6838105 - DNA, 79 bp, Homo sapiens
gctttggaagactacatatgccacatgaagaatacattagtggaaattgacttctgtgttaaatgagtcttttaaaagt

SEQ ID NO: 6838106 - DNA, 113 bp, Homo sapiens
gaggctgaggcatgagaatcacttgaacctgggaggcggaggttgcagtgagccgagatcatgccaccgcactccagccttccagcctgggcaagagagcaacaccctgtctc

SEQ ID NO: 6838107 - DNA, 55 bp, Homo sapiens
ctgagggagctatgaatagaagaaccctgtgttctcccctgtccagctcccctgg

SEQ ID NO: 6838108 - DNA, 86 bp, Homo sapiens
gccttgttgcgaaggtatgctttattattattgggttgcgtttcattgtattgtaatccctactagagcataccgtacggcatggc

SEQ ID NO: 6838109 - DNA, 59 bp, Homo sapiens
gagtctgggctgtctgcaggagtctggatgccccttcccaggctctgcagctgaggctt

SEQ ID NO: 6838110 - DNA, 56 bp, Homo sapiens
tgggtactcctattagttcagtggttctcaaacttgagctgcatcggaatcaccca

SEQ ID NO: 6838111 - DNA, 67 bp, Homo sapiens
gtctgtgtgggatagtttgaggaatgtaaggaagatttccctctctcctgaatttcccagcatgaac

SEQ ID NO: 6838112 - DNA, 81 bp, Homo sapiens
ctgcttacactttgttcttttagaaggtattttaggtgcccacacttttctgtatcaaaaggattattgaatgctgagcag

SEQ ID NO: 6838113 - DNA, 84 bp, Homo sapiens
aggtcttctgggctcacagagcagcagatgagaaggccctaaaggcagggatggtgcctggtgcctggagaatcccagaggcct

SEQ ID NO: 6838114 - DNA, 66 bp, Homo sapiens
gattgctctgataagtggtgtatactgtttaataaatttttaagcatgcaacttgcagtagtattc

SEQ ID NO: 6838115 - DNA, 129 bp, Homo sapiens
ctcctgttggtggcaacaataaagagtgagagaccgccagggcgagatgaagcttaggcgacagggatcaaggtcgaaaaggctgcagcttgtctcgtggggaacctcgctctactgccaaccacagag

SEQ ID NO: 6838116 - DNA, 55 bp, Homo sapiens
tttgtttttggaagtccccttagggtttcaaggccccaaggcttcaaagagtaga

SEQ ID NO: 6838117 - DNA, 87 bp, Homo sapiens
ccttggctttcccttatactatttgcacatgtagcatgcagatctccactgtagccctgggtcctgcaaatattattagggacaggg

SEQ ID NO: 6838118 - DNA, 71 bp, Homo sapiens
gttttagctttagaaatattctcagaggttttctgaactgaatctttgatggatgcttctgaagcttatgc

SEQ ID NO: 6838119 - DNA, 56 bp, Homo sapiens
gggtggcttcttgtcattgtccagcctttagatagaaacacagtgagaagtcatct

SEQ ID NO: 6838120 - DNA, 60 bp, Homo sapiens
ctctactctgctttcagttcaacaattccttcctagttagaaggactgaggtaaggtgag

SEQ ID NO: 6838121 - DNA, 76 bp, Homo sapiens
gtttgaataagtgtgtaataggtccttcttttgtcctatactcctgggaggatactttgttagcatatttttagat

SEQ ID NO: 6838122 - DNA, 69 bp, Homo sapiens
tgttatttatttcacctccagaataattttaatttaagatatatttggaattggtggaggaagggaaca

SEQ ID NO: 6838123 - DNA, 81 bp, Homo sapiens
ataccatttttattgattctaagatgcattttgcccaacatttaaaaatctctgaaattggggtgtgtctgacaatggtat

SEQ ID NO: 6838124 - DNA, 72 bp, Homo sapiens
tgttaacacagagtaagtggtcaataatatttgctaagaacaaagctccattgatgcactgcttgtttaaca

SEQ ID NO: 6838125 - DNA, 67 bp, Homo sapiens
ttgtgtgcatatgtacctgtgatcatgtatgtacatgcatgcatgtatgtgtgcatgtgtatctcaa

SEQ ID NO: 6838126 - DNA, 58 bp, Homo sapiens
tggctcagccattcgtgttgcccgtagccatcaactaccagacaggtgggtgagacca

SEQ ID NO: 6838127 - DNA, 95 bp, Homo sapiens
tgaggacttggctttgcagaggaccattgtcctggagacagtcctgaccctggtttccaggaggttgagtgagttccttcatggtaaagttttcg

SEQ ID NO: 6838128 - DNA, 68 bp, Homo sapiens
tgttaaggctcttgtttatgtcttagtatccctgaattaggacgtgtcacatgaacagggctacagca

SEQ ID NO: 6838129 - DNA, 80 bp, Homo sapiens
cctgtgtatgtgtgcagctgtgtgagagctccagaatttctgcagggaacttggacagctaggggttacatctgcatagg

SEQ ID NO: 6838130 - DNA, 63 bp, Homo sapiens
atccaaactctgagttccattcccctcctgaaatgagagaggattggccccaggagtatgggt

SEQ ID NO: 6838131 - DNA, 59 bp, Homo sapiens
ggcatggtacagtgcactgaatggagtcaggaggcctgggatctggcactggccgtgcc

SEQ ID NO: 6838132 - DNA, 60 bp, Homo sapiens
gggtcagagtcccgcctgcagaggtaccacgtgcgtccttctgtggcggactctaggccc

SEQ ID NO: 6838133 - DNA, 89 bp, Homo sapiens
gatggccatccttgttcttcctcagcagggctgcctgagtatctttgagaaatgcccaagggtcctcttgaggaaggggatcgtccatt

SEQ ID NO: 6838134 - DNA, 78 bp, Homo sapiens
ggtgtccctcgaggtcagaggtcccagaagaagcaggcacctatgttcgctgctctccaagcctccttgagtgacacc

SEQ ID NO: 6838135 - DNA, 82 bp, Homo sapiens
ccttagacatttattgagcacctactttgtgccaggcacactctgcttgatgccttaatggttggtgttctatgtcttaagg

SEQ ID NO: 6838136 - DNA, 70 bp, Homo sapiens
agctgaggccagtgaggtcaagtcatctccctaagccaggctggagctggctctgcacccaggcctcgct

SEQ ID NO: 6838137 - DNA, 56 bp, Homo sapiens
gctctacgaacatgaaggtcaatttgaaaccaagaccattgctgtatttgtagagt

SEQ ID NO: 6838138 - DNA, 75 bp, Homo sapiens
aaccattttaaggcaaggggcatgtactttgtaaaccttttgttacatattgccaaattgccctataaatgagtt

SEQ ID NO: 6838139 - DNA, 75 bp, Homo sapiens
cttgtcccattcaggtacttgttttggctagttaacgtaatttcccctagcacagatgtactttgaggggacagg

SEQ ID NO: 6838140 - DNA, 87 bp, Homo sapiens
gagtattaaatgagtgagtccatagaaagcatatatctgccaggttctatgctgaaaattggatttgaatagtctcatttaatcttc

SEQ ID NO: 6838141 - DNA, 75 bp, Homo sapiens
tgccatctccatcatccagggccggtggtccactttgagatgtctgtgctgtctgcctcaggatgagggtgagca

SEQ ID NO: 6838142 - DNA, 57 bp, Homo sapiens
gtggtatgctttgaagaatttctctgttgtaaaatatcttcctccacagcgtgccac

SEQ ID NO: 6838143 - DNA, 65 bp, Homo sapiens
ttcttgccctgcgtgtctctgtctcatggccaccttcctgagccgtgttcaactgctggcaagag

SEQ ID NO: 6838144 - DNA, 99 bp, Homo sapiens
tgttttacaaactcactgcccttttcttttccaatatccctactatttgttttgctggtggttatggtgatgggaaaggatgtaattgagaatggaaca

SEQ ID NO: 6838145 - DNA, 61 bp, Homo sapiens
ctcacagcattcatgcgaaatggaatttttatctctatttttatagttgaagtgctgagag

SEQ ID NO: 6838146 - DNA, 92 bp, Homo sapiens
gctgcttattgtgatcttgacagtgatgccgggcgagaatgaatagaccgtgaggccgttcatattcctggcactgacgagcccactgcagc

SEQ ID NO: 6838147 - DNA, 58 bp, Homo sapiens
gtctaagccaatcatggtggtttcattattcttgtcatcacacttgattggcttagac

SEQ ID NO: 6838148 - DNA, 55 bp, Homo sapiens
ctaggctagaaggaagactggaatccattcacaactccttcctgactagctctgg

SEQ ID NO: 6838149 - DNA, 70 bp, Homo sapiens
cagaatgcacccagtgtctggactataacactgatgtcatgggccataccaacttgggctgccttttctg

SEQ ID NO: 6838150 - DNA, 56 bp, Homo sapiens
tcctcaggatgtggggtagaatctggttgtggttttggtttctacctccctgatga

SEQ ID NO: 6838151 - DNA, 59 bp, Homo sapiens
tgtcaggttcagtgattttactgtggaatagttcatcagtgagtcaaaaaacttagata

SEQ ID NO: 6838152 - DNA, 74 bp, Homo sapiens
aatagagcttattctgctcattttatttccagcaaaaattgactgaagtataaagggcaggttgccagtctgtt

SEQ ID NO: 6838153 - DNA, 69 bp, Homo sapiens
gtccctagctttgctggcaagcatgtcagggaaatggtgggactggcagccagcacgcagttgatggat

SEQ ID NO: 6838154 - DNA, 103 bp, Homo sapiens
gcagagctctggggttggggccagggtccccgggtctcctgtgcccccagcactgtcgggtatgaggttaaccgggctcaccctgtcctggcccttgttctgc

SEQ ID NO: 6838155 - DNA, 66 bp, Homo sapiens
gtatccactaggttgattgttagtcagggtgagaaggaccttggccaaatcctccatggtggctgc

SEQ ID NO: 6838156 - DNA, 64 bp, Homo sapiens
tcagaaaggttctatgttttactcaatacagtgggtagatatcagaaatagaatttagatctgg

SEQ ID NO: 6838157 - DNA, 110 bp, Homo sapiens
gacgcatgaaatgatgggcatgttagtccttttgttattgtgagagtcctgcatagtttgttctgtgactcacttaatttacaagtccctagccccacattattggtatc

SEQ ID NO: 6838158 - DNA, 64 bp, Homo sapiens
ggaaaacaattcactccagtgaccccacagtcactgtttcactggcagaatgaattacctttcc

SEQ ID NO: 6838159 - DNA, 80 bp, Homo sapiens
tagttttttatccccctttctcaggaagctttgagtcttagaatgttgcctataaagagaatttgggatcattaaaattg

SEQ ID NO: 6838160 - DNA, 87 bp, Homo sapiens
atagtcacaggcttctgccgtcttgatgctcagccatgctcagcgggtggttttcatcaagatggttgctcaggctccggtcactgt

SEQ ID NO: 6838161 - DNA, 56 bp, Homo sapiens
aaatgatagtatggaactaggatggagactccatccatactctaaacatgttattt

SEQ ID NO: 6838162 - DNA, 58 bp, Homo sapiens
taggcttggttattggggtgctgtgggcttggtcagtcattcccaagggcctggctta

SEQ ID NO: 6838163 - DNA, 70 bp, Homo sapiens
atccaagtgttgacaaccacagagcaactacagaaggaactttgttctctgaaggttgtggaactatgat

SEQ ID NO: 6838164 - DNA, 83 bp, Homo sapiens
tggtaaaatatatatgaagaagtcttgattacgtgaagatcacttgactcagaatacttcaatgtattttgttcacattacca

SEQ ID NO: 6838165 - DNA, 79 bp, Homo sapiens
atgaatgaggccttcagaaggcattagtcagtgtgtgcctgcgctggctcagacagtgcctggtgagggtttgagtcat

SEQ ID NO: 6838166 - DNA, 64 bp, Homo sapiens
gttcaccatctctctatgcactgaggactcactacggggctccagggagtggagagaaggaaac

SEQ ID NO: 6838167 - DNA, 71 bp, Homo sapiens
ggggaaagaatctgaattgcctggggaccttttaaaaatgtaggtctccaggcccactgatttatatcttc

SEQ ID NO: 6838168 - DNA, 62 bp, Homo sapiens
aagaaaaatcttggcgcttgtctggctaggtaaatagccagacaagggccaagatttttttt

SEQ ID NO: 6838169 - DNA, 63 bp, Homo sapiens
ccccctacagggacagcacagaggccacttcctggctttacacagctggttcttgtgtccggg

SEQ ID NO: 6838170 - DNA, 68 bp, Homo sapiens
tcagcactcacaagagtaagttcatgcctctgtgtatacagttagagctgaatatgcttttgttctga

SEQ ID NO: 6838171 - DNA, 127 bp, Homo sapiens
cctattattaacatcttgcattagtgtggtacatgtgttacaattaatgaaataatattgatacattattgttaactatagcatctggtttacactaaggttcactctgcattgtacattctgtggg

SEQ ID NO: 6838172 - DNA, 71 bp, Homo sapiens
ttactactgctttactactgggaaaagggaacattaagggttcctagcatccatgtcaagtactgtggtga

SEQ ID NO: 6838173 - DNA, 87 bp, Homo sapiens
ggggaaaaggctgggcggtggcgggtctggggttggtggtggtggcagcactgctgggctgggcttgcacacagcctcagtttcccc

SEQ ID NO: 6838174 - DNA, 98 bp, Homo sapiens
gggtggcgtggactgggctggaggctggtaacaggcgatgaggacaggtcctgggcgggctctgagctgccttttgagcttccagctcagtgctcccc

SEQ ID NO: 6838175 - DNA, 78 bp, Homo sapiens
tttctcttgttctggatgttgcggagtacagatgtcacgtctggaactgctgcagtcattttgctaccatgagagaga

SEQ ID NO: 6838176 - DNA, 82 bp, Homo sapiens
aaaggaaggacaaagagttttgagactgtggattgcaacaaagaacttcagttttatctataatgttttacttcctttcttt

SEQ ID NO: 6838177 - DNA, 57 bp, Homo sapiens
tagaggggaagacttctggacagtggcttgactttgctcactgggcatttccttctg

SEQ ID NO: 6838178 - DNA, 93 bp, Homo sapiens
tgctggcacttagaacattctgcctgggaatttccttagccaaattcacaagttcattaggtccatgttctatcttctatgttcctgctagta

SEQ ID NO: 6838179 - DNA, 104 bp, Homo sapiens
gctgtcccatcctctcctgcttttatttcatgcccagtgtgcctcagagtgttacgaagtgtgagaaccactggtagagagaagacaaggaggagagggagagc

SEQ ID NO: 6838180 - DNA, 62 bp, Homo sapiens
aagtggggacaatgagagcaggtctattcagctgtgagacctgtgctctttgctccccattt

SEQ ID NO: 6838181 - DNA, 75 bp, Homo sapiens
agggtgagcacccaacaattatatcacctaggaaactacatgctccagggttgacaaattattgggaatccccct

SEQ ID NO: 6838182 - DNA, 61 bp, Homo sapiens
cacacatcttatcccagttattcaaacactgaatagtttaagtcaggggattcggtgtgtg

SEQ ID NO: 6838183 - DNA, 66 bp, Homo sapiens
gatccttacaaccttctccccaaaagctgcaaatacaatgagaactgatttgaaggttggggggtt

SEQ ID NO: 6838184 - DNA, 60 bp, Homo sapiens
agttacttgctgagatgcaattcctcattcacacagaaaaccaaattgtcagcagtagct

SEQ ID NO: 6838185 - DNA, 84 bp, Homo sapiens
acctggaagctggttagaaaacagagctcaggtgccaccccagatctactgagtcagaatctgcattttaaccaggtcccaggt

SEQ ID NO: 6838186 - DNA, 91 bp, Homo sapiens
agtctagagtgagctgagagtgagggtgaattgtaactcaggttttcagactccagagcctgttcagtccactctccaagttcccatggct

SEQ ID NO: 6838187 - DNA, 55 bp, Homo sapiens
caggagggtgtggaaaactggggacaacaatccactctatccacactccctcctg

SEQ ID NO: 6838188 - DNA, 88 bp, Homo sapiens
gtgtctccttggtgccttggctatgcttgtgttcagttttgaagcaacaaaatgtggagataatgctagctttatagtaagggtacac

SEQ ID NO: 6838189 - DNA, 91 bp, Homo sapiens
gccaggatggtctcgatctcttgacctcgtgatctgccggccttggcttcccaaagtgctgggattacaggcatgagccaccactcctggc

SEQ ID NO: 6838190 - DNA, 127 bp, Homo sapiens
acttccttagggcctaatgttccttatctgaacaatggtaaatgtaacagcattctatttgtagaaatggcgaagtgagtgtgatatgtttgtcattgttaggaaaagtcatcagtacctaggaagt

SEQ ID NO: 6838191 - DNA, 70 bp, Homo sapiens
aagcagtaaaggcacacactccttgttatattcctgggagatgaaaggaatactgtgcctcctgactctt

SEQ ID NO: 6838192 - DNA, 69 bp, Homo sapiens
cgccaggagcagcaggaggaggaggcagcgacaaggtaagagaagcggtttcttgttcttctcttggcg

SEQ ID NO: 6838193 - DNA, 88 bp, Homo sapiens
gaatctacttactgttttcaagtgtgtttgggaagtcatttcgtgttactctgataaataacatttggaaaatatgacaagtagattt

SEQ ID NO: 6838194 - DNA, 68 bp, Homo sapiens
ggtagatagttggaatatttgtgaataagttgttggtattttacaaagtatatttctagctgtcagcc

SEQ ID NO: 6838195 - DNA, 66 bp, Homo sapiens
tcagtgaataacacaatcttccagtttgctgtatgcattgttgcactgatggtctggaagaactga

SEQ ID NO: 6838196 - DNA, 58 bp, Homo sapiens
aatcacattaagccctgttcagtgaatgacaaacttgactctgggagtttatgtgatt

SEQ ID NO: 6838197 - DNA, 64 bp, Homo sapiens
tgtctggccctttctgtctcagctgccaaggggatgacctttgtggccaggagagggtgggaca

SEQ ID NO: 6838198 - DNA, 57 bp, Homo sapiens
gttacttgggacagaaagaatgacccagagccctggaacaaactgggtcccaatgat

SEQ ID NO: 6838199 - DNA, 74 bp, Homo sapiens
ttttcatttgttttgtgtgtgtttgtttgtttcaagctaggagtgactcaaagatgcataaatgccaatggaag

SEQ ID NO: 6838200 - DNA, 67 bp, Homo sapiens
tacactttatggatcctactttatatgtaatatcaaaaaatcataatagtgagatacgtgaagtgta

SEQ ID NO: 6838201 - DNA, 75 bp, Homo sapiens
ttgttttttacatgcttctatatgtgaagtttagaataggaactttagcttatatagtaagtctgtgatattcag

SEQ ID NO: 6838202 - DNA, 129 bp, Homo sapiens
catgaacaggaagagaacagggtctgggattggggtaaagaagggagtcgtttttctctcagtccccatttcttccccacccgtccgtctcagactccaccgtttcctctccacttttccagaattgtg

SEQ ID NO: 6838203 - DNA, 60 bp, Homo sapiens
cccctaggggtctggatttgctggttaacaagataacctgagggcaggaccccatagggg

SEQ ID NO: 6838204 - DNA, 60 bp, Homo sapiens
ggagggatgggctgaaaggtagccccaggccagagctggggtagctgacagtcatctccc

SEQ ID NO: 6838205 - DNA, 56 bp, Homo sapiens
ggcacccttggggggccacagcagcgtgagcagcctgggggaccaaggagggtgcc

SEQ ID NO: 6838206 - DNA, 63 bp, Homo sapiens
gctcagagtgggcctagctgtaaaaggacaggggtccttctccagccacgcccactcccgggt

SEQ ID NO: 6838207 - DNA, 79 bp, Homo sapiens
ggggtcattatcattgagggtctctctgctgcctggtcctgttatcagtgtgcatttgcagaagaccctctccagcccc

SEQ ID NO: 6838208 - DNA, 79 bp, Homo sapiens
atggaacagatgcctgattcataggaggttccccaggactctcctctcatggggtctgagggtcaggaatctgtgctgt

SEQ ID NO: 6838209 - DNA, 61 bp, Homo sapiens
gagtaattagagcaatgacttttagagacttcatttcagaaaagttcatgctttaatattc

SEQ ID NO: 6838210 - DNA, 61 bp, Homo sapiens
gccactgaggctggagtgcagtggtgccatctcggctcactgcaacctccacctcccgggt

SEQ ID NO: 6838211 - DNA, 64 bp, Homo sapiens
cacatgcagtgagtagttctccatcctcctgctctgcacagttggagcacagctcatttgtgtg

SEQ ID NO: 6838212 - DNA, 79 bp, Homo sapiens
ctgccatgcagatttgcattgtagaccctctaaatgccttttgcttagaaatctgctgccatgcaaatttgcattgtag

SEQ ID NO: 6838213 - DNA, 57 bp, Homo sapiens
atccattattgggccaataaagaaattagcactcaaatatttgctcaataagtggat

SEQ ID NO: 6838214 - DNA, 55 bp, Homo sapiens
ggctaggtatttgggtaaggatcaggaatttattggtcccagcacaaaccttgct

SEQ ID NO: 6838215 - DNA, 61 bp, Homo sapiens
ttgagtctgcaatacataacacacctgtatcagtctgtatttgtagatgttgcagcctcaa

SEQ ID NO: 6838216 - DNA, 85 bp, Homo sapiens
cctttcctggggcaagcagtgaggacagcactgagtggcttaaatgagtgtttatcccagctgccgcccgccccagctaggaagg

SEQ ID NO: 6838217 - DNA, 72 bp, Homo sapiens
ctgaataaggcttctttagtgtcctaatgattaatgatcactgaacacttttgaaagattagcatttttcag

SEQ ID NO: 6838218 - DNA, 66 bp, Homo sapiens
ctgaaaggctgacatgtcaatgaatgaagaaatgggagtgtttcataaagcatttcagcttttgag

SEQ ID NO: 6838219 - DNA, 61 bp, Homo sapiens
cagactgttatagtttgcactggtaattaataattaatacatttcagactgttatagtttg

SEQ ID NO: 6838220 - DNA, 55 bp, Homo sapiens
tgcagagggacagccacagctcagagggcagctgaggtgctggttcttccctgca

SEQ ID NO: 6838221 - DNA, 80 bp, Homo sapiens
ttaataaggtgagctccttacttgtggatatgttcaagcggatctagccatgtatctgtgatgtaggggtttcctgttga

SEQ ID NO: 6838222 - DNA, 58 bp, Homo sapiens
agcttctggaagcctggcagcagcacacttgacctctctctctgggcttcccgaggct

SEQ ID NO: 6838223 - DNA, 61 bp, Homo sapiens
ggtgaaggcacttgcctaggggcacatagtctgtgcacctgtagtgagctgtgcctttgct

SEQ ID NO: 6838224 - DNA, 68 bp, Homo sapiens
atcgagctgtgtttccagatggtagcttccatgccatcttggctgcataccatgaagcacacctggat

SEQ ID NO: 6838225 - DNA, 124 bp, Homo sapiens
gtgatgttaacctgggccctacttccttgataaaccttagtgagccttttggctgctcatctacatcaggctcagcaaagcaggctcctagaaccaaggaagtccctccccaccataatcctac

SEQ ID NO: 6838226 - DNA, 91 bp, Homo sapiens
ggtttaagtttttcttgttaaatggctggctgagcctggttataaagcaggacaatataaggtacagctattgccatgagaactctaaacc

SEQ ID NO: 6838227 - DNA, 74 bp, Homo sapiens
tgctgcaatcttcccggtgtgcttaggggatgtgatttcacttttattcttaagccactgagaaaataatagca

SEQ ID NO: 6838228 - DNA, 93 bp, Homo sapiens
gcctggactagctcttgaagttgtagtcagatgtcagttacagctgcagttagctgaaagcttgactggggcttgaggatccatgtccaaggt

SEQ ID NO: 6838229 - DNA, 94 bp, Homo sapiens
gacattttttaagcgaatttataataaatagggctttttcaattatacagtaatgtaggttccaaagtgctattttgtgggttttctgtgtgtt

SEQ ID NO: 6838230 - DNA, 57 bp, Homo sapiens
tagcacagtatttctcaactgggggctattttatctcccaggaggaagttgtagcta

SEQ ID NO: 6838231 - DNA, 62 bp, Homo sapiens
ggcattgctttttataccgtgccagttgagcgttactcgggtgtgggagtagaaagtgatcc

SEQ ID NO: 6838232 - DNA, 70 bp, Homo sapiens
tgagagactcaggaggaaggttccatgtagcaaatgccccttcgtccaggcagcccttcctgactcttca

SEQ ID NO: 6838233 - DNA, 64 bp, Homo sapiens
tgtatctaatggagcatgtatggtgttgagtttcatgtagatcaccataaatgtacaagataca

SEQ ID NO: 6838234 - DNA, 102 bp, Homo sapiens
ccccactagcgctgcccaagtccattaggcccctgcctgatctgcccactaataatcccggctgtcaggtgcctcaggatgagacaagcagaggggatgggg

SEQ ID NO: 6838235 - DNA, 76 bp, Homo sapiens
tgggggtcgcgccctcctcaccaacgtgtcctcagtggcactgggctcacgccgggtcggggggctgctgcctcca

SEQ ID NO: 6838236 - DNA, 76 bp, Homo sapiens
gtgagccaagagagaggcactcatatctgttccacctgtttgtgaacagaatcttgggttcttttcacttgatcat

SEQ ID NO: 6838237 - DNA, 67 bp, Homo sapiens
ggaactgagttgtccgggcttcagtatgtgctgacttaccctgtggccttggaccagcatcttttcc

SEQ ID NO: 6838238 - DNA, 70 bp, Homo sapiens
agcccttagtacatttctcaagtttccaggacattctataaggattaggttgagaattactgacttggct

SEQ ID NO: 6838239 - DNA, 79 bp, Homo sapiens
acttcagtgtcttctagttttcatatgttcctttgaatgaatgaagcaagacatctgaatattagagagaacctggagt

SEQ ID NO: 6838240 - DNA, 74 bp, Homo sapiens
gctactctctgtgtttctgagaatcccacctgtgcagcgcagggactggacacttaagaagcccagaaaacagc

SEQ ID NO: 6838241 - DNA, 59 bp, Homo sapiens
atggaaatgtgaagctggcacttagatatgaaagtctgagcttccagagcacattccat

SEQ ID NO: 6838242 - DNA, 83 bp, Homo sapiens
cagcaaggttctgtggaggtttggaacattttggccttgaccaggtcacaatgctcctataaatctttaacaaaacatagttg

SEQ ID NO: 6838243 - DNA, 60 bp, Homo sapiens
agatgagctggccaagtggagtccttctggggactgggaaacacagaggctgagctcact

SEQ ID NO: 6838244 - DNA, 65 bp, Homo sapiens
gtgtgtgtgtgtgtgtgtgtgtattggggcaaggagaagacgggagcacacatagaaatgcatat

SEQ ID NO: 6838245 - DNA, 64 bp, Homo sapiens
ccttcaggtcatatatgtcagaatttatatatatatagagagagagaaatatataacttgaagg

SEQ ID NO: 6838246 - DNA, 57 bp, Homo sapiens
ctcaataaattgtagttgttatgctactagtattagcaccattacagtttgattggg

SEQ ID NO: 6838247 - DNA, 81 bp, Homo sapiens
gtaggagataggacccatgtaggagaatgcatttcaaaagcacattctgaatagttctactacttgacacttattttttgc

SEQ ID NO: 6838248 - DNA, 58 bp, Homo sapiens
gtgtgagtgggacagtgtgggactactgggaagataagtctgataaaaactactccat

SEQ ID NO: 6838249 - DNA, 130 bp, Homo sapiens
cttgtaaagaagttacagattaaggagagagagaatgagtctttgaagaaatcagtcaccttatgaggctggtctaatgagtcaagtattatattctcattttacaaatttagtaattttgtcataccag

SEQ ID NO: 6838250 - DNA, 83 bp, Homo sapiens
acttcatatttttacacgtgtgtgtatctgtatttgtgtatatatatggatatatgtatatacacgtgtgtgtgtgtgtgtgt

SEQ ID NO: 6838251 - DNA, 78 bp, Homo sapiens
acactcttgcaccaagatgcaacacatttgatgagcgatctcatttctgcatcatgatgtttgcaaggagaagagtgt

SEQ ID NO: 6838252 - DNA, 68 bp, Homo sapiens
ttgtaactttacttcagcctctgattggtcccctcccacaaccagtcagatgtttgcgtagggtataa

SEQ ID NO: 6838253 - DNA, 61 bp, Homo sapiens
cagcattcactgaggcttccttaggcaatgggatattttttcaccagggacttcagggctg

SEQ ID NO: 6838254 - DNA, 62 bp, Homo sapiens
attcaaagtaagggttaatctacttttggtaggttaaaagtagaacattttcttatctgagt

SEQ ID NO: 6838255 - DNA, 57 bp, Homo sapiens
tgtctggatttaaatctcaatgctgccactggaagctttgtgactttgagctagtca

SEQ ID NO: 6838256 - DNA, 83 bp, Homo sapiens
gaagagacttggttgatgtcataaggtttctcagcggttgtaaagtcctttgttttcagcctgtgactcagcctgtatatttc

SEQ ID NO: 6838257 - DNA, 62 bp, Homo sapiens
aaaacagtttaggcatcacagtagattctattctgggtcactttgcatacccaaattgtttt

SEQ ID NO: 6838258 - DNA, 79 bp, Homo sapiens
gtgtccttctctggcatagcaagcaggtccacagcagtcccgggaaggtttacacccttcttgctgccggaggagccac

SEQ ID NO: 6838259 - DNA, 88 bp, Homo sapiens
ggagaatcgcttgaacccaggaagtggaggttgcaataagccaagatcacaccactgcactccagtctgggtgacagagtgagactcc

SEQ ID NO: 6838260 - DNA, 129 bp, Homo sapiens
tcagaggtggatgcatgttgctttctctggagtcatctcagctgagaggcagcttctccatccttgcctggtctagttttaggtggcttattctagagacaggcattcatgttgtcatgatccactaga

SEQ ID NO: 6838261 - DNA, 57 bp, Homo sapiens
gcactgctttgcagcttaagagcagggtttgaatcccagctccactaaagcagctgt

SEQ ID NO: 6838262 - DNA, 79 bp, Homo sapiens
gctggatggagtgcagtggcgtgatctcggctcactgcaagctccgcctcccgggttcacgccattctcctgcctcagc

SEQ ID NO: 6838263 - DNA, 72 bp, Homo sapiens
gctgtgtcgcccaggctggagtgcagtggcacaatcttggctcactgcaatctccgtctcccgggttcaagc

SEQ ID NO: 6838264 - DNA, 123 bp, Homo sapiens
gactagaatatttacaaggaaggtagaggccagcaccagagtcaagaaatgcagtttccgcagcttctcactgcttctggctgtgttactaccagagctcctaggtgtctgtctgttctggtc

SEQ ID NO: 6838265 - DNA, 130 bp, Homo sapiens
aatctccctgttgcacatgtctgccacccttggctgcttagcagtgtgtgcttttgacaagcattgtaaggtcacagctggacacgttggcatgcctcaagcctggcttccagtcatttgggaccatgtt

SEQ ID NO: 6838266 - DNA, 81 bp, Homo sapiens
ccttgcagagataagaagccggtaggggattcataggcttggccctaggagccccctggactgagctccttgaggccaagg

SEQ ID NO: 6838267 - DNA, 55 bp, Homo sapiens
ttcgagtctagtgcacttaagtgttcagaattttacagaggcaaggagacttgga

SEQ ID NO: 6838268 - DNA, 63 bp, Homo sapiens
gtttcaagtagctgctgattatgacttacaattcatctccctagatcctgcagctaatggaat

SEQ ID NO: 6838269 - DNA, 55 bp, Homo sapiens
aagtggtggttttggagttagttcacttgagttcagattccagttctatccactt

SEQ ID NO: 6838270 - DNA, 57 bp, Homo sapiens
gtgtgccaaaacaaattggccaagatccttcatataggccaatttttctatgtatac

SEQ ID NO: 6838271 - DNA, 76 bp, Homo sapiens
tgggggaatgcaagggtttggctggagaggtctagcccttatgtatactccagacagatcttctagcaggtcctta

SEQ ID NO: 6838272 - DNA, 92 bp, Homo sapiens
caggggagaggcacacaggctaggggcagtgccagcatgggcagagcgtggccgtgactggcctcactgccctgctgctgccgtctctcctg

SEQ ID NO: 6838273 - DNA, 80 bp, Homo sapiens
gggacttgctctgtttctcatggcccttggcttttcatgcatacacaagaagtttcaggagtcagaggagggtaagcacc

SEQ ID NO: 6838274 - DNA, 58 bp, Homo sapiens
gcataggcttctcattggggaagtcaggggaagcccatctttctcaggaagtttgtgt

SEQ ID NO: 6838275 - DNA, 57 bp, Homo sapiens
ctgaaagagtgtttggtccctcccaactttgggttacactgcaaagtactctttcag

SEQ ID NO: 6838276 - DNA, 55 bp, Homo sapiens
ctgctctggctgtgtacttcagtgtcattcacacttaagtactcagcaagagcag

SEQ ID NO: 6838277 - DNA, 104 bp, Homo sapiens
gtctctcctatttctgtgtatgttataaatagagacactggctgcatttattcttaattgttttttcaacgtatttatatagcagagccatggaagctagagac

SEQ ID NO: 6838278 - DNA, 73 bp, Homo sapiens
gaagtctgaagataagtggagatatttttgccacagtgaaattctggcatttgtagccacttgccttgatttc

SEQ ID NO: 6838279 - DNA, 66 bp, Homo sapiens
tgaggaggggccacagagcagaaggctgtaagtacttggtctccagtgttctgtcgtctttcttca

SEQ ID NO: 6838280 - DNA, 117 bp, Homo sapiens
agttttttatcacatctccaaaaaaggaagatcaatgtgtcagaagagatgctagtagtcaacttttatccatttgtaaatgttagagtcttcattttttcttctgtgtaaaatact

SEQ ID NO: 6838281 - DNA, 85 bp, Homo sapiens
cagatgtttaaatgttactgtttcctgaagcagatgcaatacatcatttactgttctatttcagtaagcaggcaacatcatcatg

SEQ ID NO: 6838282 - DNA, 95 bp, Homo sapiens
agataatctccttgtcagggattcattgaagcccttgacaagccttccttgtagttaggcttttatccatttcagttttcttgattaggttatct

SEQ ID NO: 6838283 - DNA, 63 bp, Homo sapiens
tttagagggtttcaaaccatgttccaggaagccccagtggacttgcagagaagcccttctgag

SEQ ID NO: 6838284 - DNA, 71 bp, Homo sapiens
taaacaagctgtctgatattctgtatgaaagggcattggcaacagtagagtttcagtttatagtttgtttg

SEQ ID NO: 6838285 - DNA, 67 bp, Homo sapiens
gtcagtggggaggccaggatagaactagagctggtgtcccaggttccagtctgggctcttcactgac

SEQ ID NO: 6838286 - DNA, 87 bp, Homo sapiens
tattctaataacaaacagcgttcggacagaaatattagcttttggagatcaatgaggtaatactttcagtcctttgttaatatgata

SEQ ID NO: 6838287 - DNA, 83 bp, Homo sapiens
agagtgggagaggatttctgggctcccacatatttcattaggattgctttggaaatgagggcgcttagattccctgctgctct

SEQ ID NO: 6838288 - DNA, 64 bp, Homo sapiens
ggtactttgttagggcagacccaagaaactactacaatggggatggccgagaagacagcgtacc

SEQ ID NO: 6838289 - DNA, 59 bp, Homo sapiens
ggacccagctctgagaccctgcctctctggccagggctgtggtgtcagtgctgggctcc

SEQ ID NO: 6838290 - DNA, 59 bp, Homo sapiens
atgttagtgaagttgctcaaatctgctcaaaataagctttttggtccacttactaacat

SEQ ID NO: 6838291 - DNA, 81 bp, Homo sapiens
ccgatattgctgacaggctctgtgtatgctcctaatggagtggaccataaattctgagctatgcagactgcagcaaggtgg

SEQ ID NO: 6838292 - DNA, 93 bp, Homo sapiens
gagaggttgggtgctttgctgagggttgcacagcaaatgagtggcagggcagaatctgtcccctagtctgctggccccaacacacaacctctt

SEQ ID NO: 6838293 - DNA, 99 bp, Homo sapiens
gccaggtaacacttactgggaaattttaggtttgtctcggaagccaatccctatcattttgacacaaaagaggattttcttttatctgagcatcttggc

SEQ ID NO: 6838294 - DNA, 87 bp, Homo sapiens
cagggacaggctttactttctctctgaatgagaatgtagccttgctgatattacattggtttcagagaaaggaaagccggatatttg

SEQ ID NO: 6838295 - DNA, 62 bp, Homo sapiens
ttaaagtgttaactgaagcttaggtgggggctaccttctgtatgtaacagtggacattttag

SEQ ID NO: 6838296 - DNA, 65 bp, Homo sapiens
gacctatttttttccctgtcttattgaaaacaggatttacaggacaaggggaagaagataaagtc

SEQ ID NO: 6838297 - DNA, 90 bp, Homo sapiens
gttcgaggactctgtgggtggtagccatgggcaaatgcagagctgctgctgttgctttgcagtgcctataggacttagagggcctggagc

SEQ ID NO: 6838298 - DNA, 130 bp, Homo sapiens
tgccttctgggtaagaaaggtgattctttctttctgtgactttttaaatcttcggcttattcagtttctaaggtgcctagtgtttggaagtcatagcctttggaatcactcattgtctacaggtgggaca

SEQ ID NO: 6838299 - DNA, 61 bp, Homo sapiens
tttcttgtttcatggtgtctcagctccccaaaaggagatctaggacgcccaggacaagaaa

SEQ ID NO: 6838300 - DNA, 59 bp, Homo sapiens
ggcacccaggccggcgactgcagcgggggcctccctactgccagttcccggccgggtcc

SEQ ID NO: 6838301 - DNA, 55 bp, Homo sapiens
gaaggacaagcaaaaccacaacaagcagaaaactggatgtggtggagctgccttc

SEQ ID NO: 6838302 - DNA, 73 bp, Homo sapiens
gtccaaggcacttccttctcttcatcaaaccaagtcctggtttcactagaagaaggaattgagcctttaggac

SEQ ID NO: 6838303 - DNA, 84 bp, Homo sapiens
gttttggtatgtaattggcatagcatacaattcacccatttaaaggaggtgagtcaatgtcattcagtatgttcatatcaccac

SEQ ID NO: 6838304 - DNA, 66 bp, Homo sapiens
gaacccagaggccactttgcctgtgatgtttatctgaatattcaggtcacagtggcttctcttttc

SEQ ID NO: 6838305 - DNA, 61 bp, Homo sapiens
gccctcctgcaggggcttctggcctggatggtggcaatcaaggggccatggcaggggaggc

SEQ ID NO: 6838306 - DNA, 56 bp, Homo sapiens
cttttgcacccagagttatttggtttgacagactgccaaatcctgaggttcaaaag

SEQ ID NO: 6838307 - DNA, 77 bp, Homo sapiens
cacaggcctcagtttctccatcgctccagtgacgggctggatccaacacctgtgggccaggaggctgagtctctgtg

SEQ ID NO: 6838308 - DNA, 60 bp, Homo sapiens
gggatttgtgggatggccagtgtatgcacttccagtgactgctggcattaccacaaaccc

SEQ ID NO: 6838309 - DNA, 63 bp, Homo sapiens
tgtagaaatgttggtattaacattttaattgatgatagaaatgttggtattaacattttaaca

SEQ ID NO: 6838310 - DNA, 129 bp, Homo sapiens
cgcacgtaggaccagcggccgtgcaccagcaggaggcgctgcaggaagcagaactggccgagcacgaagtcgctgttctgaactgcctgcatgccctcctggcccgccagccccacgcccacgtccgcg

SEQ ID NO: 6838311 - DNA, 73 bp, Homo sapiens
ggtaactaaggggtggagagtgttgccagttctgcccagtgaagctgctggcaaaccattcccagctcagacc

SEQ ID NO: 6838312 - DNA, 89 bp, Homo sapiens
tgcaaagagagcttgcctaggcccagcttcagcacacaattggagattagaactaggtgcctggaactgggtaggctggcactcaggca

SEQ ID NO: 6838313 - DNA, 72 bp, Homo sapiens
ggggaagaggcgtgatggatccaagacaggacgttgacctcaccctggagatctccctcatgcccattccct

SEQ ID NO: 6838314 - DNA, 68 bp, Homo sapiens
tgaacaatttgggatcttaaagagttttagtcatgtgttctctttttaaaaagctcttaaatggttca

SEQ ID NO: 6838315 - DNA, 64 bp, Homo sapiens
ctcaaggtcttggctccaaccaaaacgctttgaagtacttgggccaggatttcaagaccctgag

SEQ ID NO: 6838316 - DNA, 64 bp, Homo sapiens
ggccaggagaggagggcactgatagggactgaattagaaccccggttctcgcctctgctgctcc

SEQ ID NO: 6838317 - DNA, 64 bp, Homo sapiens
acagcagccctcagatgggaaaggaggggcttggggctctgagcttccctctgaggcaggctgt

SEQ ID NO: 6838318 - DNA, 58 bp, Homo sapiens
gggttgtgggatagagaaggagacaggttgttttcattcctgagcccatatttaaccc

SEQ ID NO: 6838319 - DNA, 56 bp, Homo sapiens
ccagagctgaggagatgggcttgagtgcctgctcatcttagcttctaaggttctgg

SEQ ID NO: 6838320 - DNA, 61 bp, Homo sapiens
ggaagcttctgtgcgtaggcgatgcagtttgagaggctgaaaacgtcacgacgcgaaatct

SEQ ID NO: 6838321 - DNA, 61 bp, Homo sapiens
atagaccttctacacaggacaataaattcataaagcttttctcttgatgataggaggctat

SEQ ID NO: 6838322 - DNA, 74 bp, Homo sapiens
gagtccaaagaaatgagtcaaaacagcatatagagttctgcaattcaagagctgtgacctcattcacaggattc

SEQ ID NO: 6838323 - DNA, 117 bp, Homo sapiens
gatgatctataagcctggaataggacagttttggaccatggtagggaacttggaaatgttagttggtctaaattcctggttatggaattaaaacaagttgtatctactttagttatt

SEQ ID NO: 6838324 - DNA, 57 bp, Homo sapiens
aggtggtctctcatttgtcagcagcctgactgggctacaaagtatgagaagacccct

SEQ ID NO: 6838325 - DNA, 63 bp, Homo sapiens
ggaggaagctagagccaccggactgggtcctcttttcacaggaggcaggcatagcattcctcc

SEQ ID NO: 6838326 - DNA, 76 bp, Homo sapiens
aagtcagagaatgtcagggccagaagaggcctgagaaatcagagccccgcatctctctgccattccatccccactt

SEQ ID NO: 6838327 - DNA, 58 bp, Homo sapiens
gtgtgtgtgtgtgtgtgtgtgtgtgcacgtgtgcacatgtatgtgtgcaaacacatgc

SEQ ID NO: 6838328 - DNA, 80 bp, Homo sapiens
gctttctgtcccccttgacttgcctcgggccctatctcctctggtgggggtggaaaggcaagttgtcgggagcagaaggt

SEQ ID NO: 6838329 - DNA, 62 bp, Homo sapiens
taatatggatctttccaatgtttgcctgatttacacaggataacatttcaggatccaaattg

SEQ ID NO: 6838330 - DNA, 60 bp, Homo sapiens
ctcctgaccttgtgatccgcctgccttggcctcccaaagtgctgggattacaggcttgag

SEQ ID NO: 6838331 - DNA, 72 bp, Homo sapiens
ttactatttttgcaacgtatacacttctaaaattgtcattagtgtttgtaccagtgttgggaagatgtgtaa

SEQ ID NO: 6838332 - DNA, 125 bp, Homo sapiens
gtgggatgacctccatactcccatggggcagtgctgagcacaccttggagcaggagcctgttctgcacacccaatagtgtgtgcagaaatgccagctgggagcctatttaacggagccatttcat

SEQ ID NO: 6838333 - DNA, 89 bp, Homo sapiens
gaggctaaagatctgagagtggtagccagtccattacatgtagatgtattttttacttcgtaattgtggctggtatttctcttttcctc

SEQ ID NO: 6838334 - DNA, 56 bp, Homo sapiens
tctccttctatgttccatttttgtcatcagtaggctagggacagaaagagggtaga

SEQ ID NO: 6838335 - DNA, 68 bp, Homo sapiens
gggaggcagggaggtaggagcttctagctgttcacagatttccatcagctataaccccttcctctccc

SEQ ID NO: 6838336 - DNA, 58 bp, Homo sapiens
ctgcaatagcaagtagttgttagagagagactcgaaacctagactacttactatgtgg

SEQ ID NO: 6838337 - DNA, 65 bp, Homo sapiens
cgcgggccaattccaggagccggcggcggcgagccgcgccctggctgataccggaaaggcctgtg

SEQ ID NO: 6838338 - DNA, 94 bp, Homo sapiens
tgtttgttcttcagctgaggtattttattgggctagcagtcatctggataggtggaaagtttggttccaataatttacttcagttttataaaca

SEQ ID NO: 6838339 - DNA, 55 bp, Homo sapiens
ctggaagggagatagtacatgggtgaatgagttgcccaaagactgccccttccag

SEQ ID NO: 6838340 - DNA, 58 bp, Homo sapiens
tcaattggctattctgacacctgaggagtcagctccccaggctcagctgagctcttgg

SEQ ID NO: 6838341 - DNA, 81 bp, Homo sapiens
gatatgggaagaccctgtgtacctgttcccttgcaaggactgtctttcatggaaggctaggtgctaggccctgcctgtgtt

SEQ ID NO: 6838342 - DNA, 72 bp, Homo sapiens
agcataagtttggatggtatccaccaggaggaaaatgctttataattggtaaatactataatcaaatatgtt

SEQ ID NO: 6838343 - DNA, 74 bp, Homo sapiens
cactgggcacatcctgaagaagccgcactgtttacaaagtactgtcacccacagcgccttcttttgtccatgtg

SEQ ID NO: 6838344 - DNA, 105 bp, Homo sapiens
tgtatgtgggaccaaataggacagaatgtgtgcaagcaagtgtgttatgctgcacgtttgatataagtttttcgcatatctgagctcttacgttccccaaatgca

SEQ ID NO: 6838345 - DNA, 63 bp, Homo sapiens
tgagacagtttttctatttccagcctgttgctgggaagatgtattaggaaagttgatgtctca

SEQ ID NO: 6838346 - DNA, 71 bp, Homo sapiens
gcttcagttctgggaaaggggaagctgcctgtggcctgggctggtggcacagcttcctctttctctgaggc

SEQ ID NO: 6838347 - DNA, 74 bp, Homo sapiens
tggacctggtttggaggactagttaagagaccttttggaggtctctgcagctcccggccccttattggagtcca

SEQ ID NO: 6838348 - DNA, 55 bp, Homo sapiens
ttgtgtgactcctagagtagagggaagcctccgctgctcggaaggtgtcacgtgg

SEQ ID NO: 6838349 - DNA, 61 bp, Homo sapiens
gtttccccaaccattaaagaggataatagtagttcctacttcattgtagtgttggggagat

SEQ ID NO: 6838350 - DNA, 68 bp, Homo sapiens
gggtatttactgtgacattcttggtgttggcaaaaaagctggtgacaaagagaagtaacagtaccccc

SEQ ID NO: 6838351 - DNA, 79 bp, Homo sapiens
caaaaaataagattgacacaagtacctgggaggatgtgtgtgcatacatacaggtcttgtttagtaatttataaatttg

SEQ ID NO: 6838352 - DNA, 76 bp, Homo sapiens
gcggacaggtggggcgcgaggtcctggctccctcggagacctgcgggagggaccgcgcgccccagcaaggcgccgc

SEQ ID NO: 6838353 - DNA, 68 bp, Homo sapiens
gctggtttgtcctttccaaaggacaatcttatcctacataagactgagactggggaaagacaggaagc

SEQ ID NO: 6838354 - DNA, 58 bp, Homo sapiens
gatgagaatgtttatcaaatgcctaccatgcaccaggcaattgataaacaatttcatt

SEQ ID NO: 6838355 - DNA, 63 bp, Homo sapiens
gagagttccagtaagtggattcaggcctttcctttaggccctaagtcctgcttctgaacactt

SEQ ID NO: 6838356 - DNA, 56 bp, Homo sapiens
cagacttgacggcagctgctttcatgggtgatacccgggttctagccctcaatctg

SEQ ID NO: 6838357 - DNA, 61 bp, Homo sapiens
ggtgggtgctgggaacgaggaattcaggacatgccctggcctaccctgctcagcacccatc

SEQ ID NO: 6838358 - DNA, 65 bp, Homo sapiens
agaggtcagaggtcgccaggtcaccctcttttggaataagagtaccagggaactcttgactctct

SEQ ID NO: 6838359 - DNA, 69 bp, Homo sapiens
ttcaaatggggttcatagactcttagatactccaaggaggagcattaggaggtctatggacatcctgaa

SEQ ID NO: 6838360 - DNA, 58 bp, Homo sapiens
ttcagtctctccctatgtttctccctgggcttaatgccaggaggtagagagaactgga

SEQ ID NO: 6838361 - DNA, 62 bp, Homo sapiens
aggagtgccttttcatgagtgtgcccaggaggaggatggctgtggacatgggcaggcgccct

SEQ ID NO: 6838362 - DNA, 89 bp, Homo sapiens
tgaatgaaagcagcaattggacagactgattcattgctcagggaaactcctgaaagcaactcatctgtgtaaatgtgtctctccattca

SEQ ID NO: 6838363 - DNA, 56 bp, Homo sapiens
gcggagcttcccttattattgagttgaagctcagtaatatctgttgaagctattgc

SEQ ID NO: 6838364 - DNA, 60 bp, Homo sapiens
atgctacagccctctttgcatattcatctctgatatgcaccaaaaggagctgtctgtcat

SEQ ID NO: 6838365 - DNA, 58 bp, Homo sapiens
tttatgttatattttgtcaattgtgagtttatttacagtgggacatttgttacatgaa

SEQ ID NO: 6838366 - DNA, 130 bp, Homo sapiens
ttgtttctgattctcactccagccacgggctcccccagctgctggctccgggctaagagaaggctcagcccggactcgctgggcttgatgggagggggctctgtgggctgttgggctgaggggcagagga

SEQ ID NO: 6838367 - DNA, 81 bp, Homo sapiens
cgctcaaggttccctctctggaagccttcctcaacccaaacaaaaggaggctcagggacggggccccttctcctctgagcg

SEQ ID NO: 6838368 - DNA, 67 bp, Homo sapiens
cggtttttaaaagatattgttttcctcagcctttggctttctaacaatgttcttttagcttgaattg

SEQ ID NO: 6838369 - DNA, 55 bp, Homo sapiens
aaagtcacgctgatgggaaatggcaacatcaggattcccacccaagtgtgtcttt

SEQ ID NO: 6838370 - DNA, 62 bp, Homo sapiens
cctaaagtgctacagcagaagtcttcatgaaccttctgaaatgtgagcaaaatctctttagg

SEQ ID NO: 6838371 - DNA, 98 bp, Homo sapiens
tggaaatgttttgaatgcttgaagagctatgttaaggaagagaatcaattcaatctttcatggtggctccacaggggaaatttaggacaaagacacca

SEQ ID NO: 6838372 - DNA, 56 bp, Homo sapiens
tcttttttcataatacctggcatggtgctacctgcacaggaggctgtggagaagga

SEQ ID NO: 6838373 - DNA, 69 bp, Homo sapiens
tggagaatgctgtttactgagaacacttcacaaaagtcatcattgttttctctgagaagcagttctcta

SEQ ID NO: 6838374 - DNA, 85 bp, Homo sapiens
gcagccatggtgtttagtttctgtctctctgaggaaggagctttactggcttaatcagaaacagaaactaagaacccatgactgt

SEQ ID NO: 6838375 - DNA, 122 bp, Homo sapiens
ttaactgtagccatcaccacatcacccacaccagcagcggagagtctgttcagccatcccttgattcccttcactgagaaaatacacagatttttcagctcctgtgttgtcagcacagttga

SEQ ID NO: 6838376 - DNA, 69 bp, Homo sapiens
ctgtttttaaacactggagctgggtgttcctgtgagagtgagctgctatctccagatgtttgcaagcag

SEQ ID NO: 6838377 - DNA, 64 bp, Homo sapiens
gaagataccttgagtaagtggaattagccagacactcttcaaatgacacctcataggtaacttc

SEQ ID NO: 6838378 - DNA, 66 bp, Homo sapiens
gctgctaaaaagtgggtgagcagctagggactctatttctgccagctcctcccccacctttgcagc

SEQ ID NO: 6838379 - DNA, 74 bp, Homo sapiens
tcttgtatttcacacttttcatttattaagcaagcaatgacgtaattgctctgaagagctttggaagtatgagg

SEQ ID NO: 6838380 - DNA, 78 bp, Homo sapiens
aggtttgaaaactttcaaatgtatgaggcaactttaaatttagttagtcttactgcttctgaaagataatggaaacct

SEQ ID NO: 6838381 - DNA, 67 bp, Homo sapiens
gccctcccagcccccatcgagaaaaccatctccaaagccaaaggtgggacccgtggggtgcgagggc

SEQ ID NO: 6838382 - DNA, 64 bp, Homo sapiens
cctcttactcgccctcatgtaccaggacctactgatcaggccccatgctgggcgcagtgaatgg

SEQ ID NO: 6838383 - DNA, 76 bp, Homo sapiens
ccttcttctggccatcctcccttgactcctgcttttccagtgggagatggagctgggaggtggtggtagaagaagg

SEQ ID NO: 6838384 - DNA, 67 bp, Homo sapiens
atagcaaatttctaagtcaagaagaaccagactattccttgttaggcttatcttttcttagggctat

SEQ ID NO: 6838385 - DNA, 85 bp, Homo sapiens
gaagtaagtaaataatagagtattttgattatcctggaggtttttctccagaaaaagtaatttatttgatgaatttggttacttc

SEQ ID NO: 6838386 - DNA, 76 bp, Homo sapiens
ctgatgatgcaggaggcaggggaactggagtgagtcctcatttttcatcaggaatcctatggcttttgctcattag

SEQ ID NO: 6838387 - DNA, 67 bp, Homo sapiens
tgaattgtttgtgtggttgaacaaaccaaacatgatgagtgcatttttccacacagtgtgcaattta

SEQ ID NO: 6838388 - DNA, 68 bp, Homo sapiens
ttcttcttaatgtcctgggaactatctgtgcagactaagaataatttgttccttaggcattggaagaa

SEQ ID NO: 6838389 - DNA, 81 bp, Homo sapiens
ccatctctactaaaaatacaaaaattagctgggcatggtggcgggcacctgtaatcccagctatttgggaggctgagatgg

SEQ ID NO: 6838390 - DNA, 85 bp, Homo sapiens
gactgagcatttgtttttgtgatgctatgaacaggatataagagagagtgtcatgtcagcaaatatcatagacatagccccagtc

SEQ ID NO: 6838391 - DNA, 106 bp, Homo sapiens
gaaggcgtgtcctgccagaggtgaggggatctgggcccactcaacttcactgatgtaggcagtggggtccatcccttccctctggcatgaggaagtatgcatcttc

SEQ ID NO: 6838392 - DNA, 60 bp, Homo sapiens
tagcctgggcatgggacgggagggctcattaaccatcctcccttcctccatcccggcctg

SEQ ID NO: 6838393 - DNA, 55 bp, Homo sapiens
cacagggaggcggtcactggcttgaggaggtctcaattgaccctttctccctgtg

SEQ ID NO: 6838394 - DNA, 77 bp, Homo sapiens
gagaattaggggtttcagggtgaaattgtatgcctcattcacaggcatagaatgtgctgtgacaaccaactaagctc

SEQ ID NO: 6838395 - DNA, 60 bp, Homo sapiens
gcgggtggggagaggggctgcaaggaggaacagcttctcactgtgccccctccagcctgc

SEQ ID NO: 6838396 - DNA, 58 bp, Homo sapiens
ggaaggagagagacatcgtccctggttttaatgataggcagtgtctcttatcctgtcc

SEQ ID NO: 6838397 - DNA, 55 bp, Homo sapiens
tactagtaagggtggtttggctccccaggctgtcctgccatcaccctaactagtg

SEQ ID NO: 6838398 - DNA, 55 bp, Homo sapiens
tgagaataggcatagaacctgggcctcctgtgtcctggccctgtgctcattctca

SEQ ID NO: 6838399 - DNA, 55 bp, Homo sapiens
tagcttatggataatttgcctgcagatcttaaatctggcagaattttatgagctg

SEQ ID NO: 6838400 - DNA, 129 bp, Homo sapiens
tgtcctgtgagcctctaaagcagtggttttcattccggagtgattttaacttccagcaatgtccgaagacatttttagtcgtcaaagcattccgggaagaggagcatgctactgacatctagtgggtag

SEQ ID NO: 6838401 - DNA, 81 bp, Homo sapiens
gaggccagggtgggggcaggtgcttttagaagttgctctattgggtgagagccctgctcctatcccagaaacaccagcctt

SEQ ID NO: 6838402 - DNA, 81 bp, Homo sapiens
actagaagatttccattttaatattagcacagggacaagccttgtttcacaattaaattagagccaggtaagttttctagt

SEQ ID NO: 6838403 - DNA, 73 bp, Homo sapiens
gggtggggcgcaggcccgggtcagggccgcagccggctgtgcgccgtgcccgcccggggcgctgccccctccc

SEQ ID NO: 6838404 - DNA, 59 bp, Homo sapiens
ccagttgatgtttagactctgcatggacactcaatgacattctctctaggcacagctgg

SEQ ID NO: 6838405 - DNA, 113 bp, Homo sapiens
gaaggagaaatgttttgtaaccaaaggatatgggcaaattggcttttcagagtacaatattttgacagactactgcctctattgctgagtgttcacaaattcatttctcagtc

SEQ ID NO: 6838406 - DNA, 77 bp, Homo sapiens
gggcggagctaccagcccaggctcagatgttggggtgtgaaagcctcaagtgactcagcctggttggagaactgccc

SEQ ID NO: 6838407 - DNA, 69 bp, Homo sapiens
cacccttcccccacacccctcggtttaagctgaaactcgatccgtctaccctgtgggtgtgcaagggtg

SEQ ID NO: 6838408 - DNA, 59 bp, Homo sapiens
gctctgggtagccactgcctggaaacatgagtgtctattggtagaaccttgcccagggc

SEQ ID NO: 6838409 - DNA, 73 bp, Homo sapiens
cagttctcaataatttggacatttttggcatgtaactttgtacatgtaagtattcaaaatatttcatggactg

SEQ ID NO: 6838410 - DNA, 74 bp, Homo sapiens
tttctccctggagccctgaagcatctctgtgatataagcagttacatgttttatgttccactcaagggatgaga

SEQ ID NO: 6838411 - DNA, 59 bp, Homo sapiens
aagccaggaagggagctgtccccagaaactgaatttgctgacaccttaatcgtggactt

SEQ ID NO: 6838412 - DNA, 61 bp, Homo sapiens
gctctgagttgtacatgttggggtaccttgggtcccccaggggttcaggatgtacaagagc

SEQ ID NO: 6838413 - DNA, 84 bp, Homo sapiens
gccacctagttgtatactttgaaagggttaaagtggtaaattttatgttatgtgaattttactacaatttttttaaacgttggc

SEQ ID NO: 6838414 - DNA, 82 bp, Homo sapiens
gaatgttattttttcctacagttatattcttgattggaccacaaagtttttcataatactgtacatgaaaaataggacattc

SEQ ID NO: 6838415 - DNA, 83 bp, Homo sapiens
tggtttttcatgttggattcactgtgagttcttaaaaaaaaggatcacccactgatggattcaaatctacctttggaaaatta

SEQ ID NO: 6838416 - DNA, 78 bp, Homo sapiens
ttttctcacagttctgaagactagagcctgagatcaaagcgttggcagggttggtttcttctgggggctgtgagggaa

SEQ ID NO: 6838417 - DNA, 63 bp, Homo sapiens
aggaatatagttggaatgtaggtcttttggtcttaggtagttggtctattctaacatgctcct

SEQ ID NO: 6838418 - DNA, 68 bp, Homo sapiens
agtggtttggggctgtgtgggtggagaaaaatgaatttctgagatgttcctcagggccccagagcact

SEQ ID NO: 6838419 - DNA, 94 bp, Homo sapiens
ccattttaatgttttgtgaaaagtttgctacactgcaggttaaggagatacatttttagcatgtgtgccatgtggcagtataaaattaaaatgg

SEQ ID NO: 6838420 - DNA, 60 bp, Homo sapiens
ctggcatgcccagggtatgtggaatcaaagatgctttgagaaatacttggtgctgcacag

SEQ ID NO: 6838421 - DNA, 66 bp, Homo sapiens
agaataacagcaagtttgcaggcaagttggaaaagagatcagaagccctcagcttgatgttgttct

SEQ ID NO: 6838422 - DNA, 72 bp, Homo sapiens
gtcaccgtagtgcctctgagctctgctacagatgaaattaattcctccagagctgagggagcctgagcaggc

SEQ ID NO: 6838423 - DNA, 80 bp, Homo sapiens
gccccaggtccttagccaccagaaaggttttcaggggaagtgtgcaccctcagcagctgctgctggtgggcaggatgggc

SEQ ID NO: 6838424 - DNA, 78 bp, Homo sapiens
cttaagtcttcctggaaatgtcgcgtgtagaaatgccaacatacatttccatactactggttccatataagatctaag

SEQ ID NO: 6838425 - DNA, 99 bp, Homo sapiens
cagagcgagagatttattgtggtttttagggggcgtttaggagccgacgtgataatgtctgtgaacgcactttgtaaactgtaacgggggagtgctgtg

SEQ ID NO: 6838426 - DNA, 70 bp, Homo sapiens
agattttgaggttagtgatttgtcattgaagcttgtatgtaatcattgagacacatcattgaccaaatct

SEQ ID NO: 6838427 - DNA, 65 bp, Homo sapiens
tgttgtgttcactattgcaaccctggttcccagaacagggtctgaccaccagtagggattcaata

SEQ ID NO: 6838428 - DNA, 100 bp, Homo sapiens
catgcatgtgtgtatagatggattcatggacttatggatgcatggctatatggctacatacatggattcatggattcagtgatgcattgccacatgcatg

SEQ ID NO: 6838429 - DNA, 64 bp, Homo sapiens
tggtctgattgccagagccacagatatcacctgtcctctcctgtgcctgcattctatcagacca

SEQ ID NO: 6838430 - DNA, 68 bp, Homo sapiens
caggaatcccaggcctggtctgggccagtaaggtttctgccattggcaccaaggcaggcctttacctg

SEQ ID NO: 6838431 - DNA, 58 bp, Homo sapiens
tgcatttaactagaatattaatgaaggaaaaagcctcagtattattgtggttactgca

SEQ ID NO: 6838432 - DNA, 67 bp, Homo sapiens
acctcacaagatactcagtggatatgcatcccttaaactggagaagcacactgtgttttgttctggt

SEQ ID NO: 6838433 - DNA, 74 bp, Homo sapiens
tcatctcttcaaccatgaaatcacaagctgaggacttaggggagtcattagagattggtttgtggtaagagtga

SEQ ID NO: 6838434 - DNA, 73 bp, Homo sapiens
cctggcaattcctcagctgccccataaatcacagtgcctggctgctgtgctttaggggtgccggggagccagg

SEQ ID NO: 6838435 - DNA, 88 bp, Homo sapiens
attctccttccagcttgttctcatgcctttctcatcacctgctgaggccttgatcacggacagagcagacgagcagcggggggacaat

SEQ ID NO: 6838436 - DNA, 58 bp, Homo sapiens
ccaaggacaacttcatattgtggacccagggggaccgaaagtatccagttgttcaagg

SEQ ID NO: 6838437 - DNA, 56 bp, Homo sapiens
agtttttgctgatagcatgcttacgtggtagtgtagcttactgggcagtaaagatt

SEQ ID NO: 6838438 - DNA, 98 bp, Homo sapiens
ccttctcctttctcagtccttccagcccctcctgagccaagcctttttaccatggctagcttctgaggggctgggcaatactgggtggggaggcaagg

SEQ ID NO: 6838439 - DNA, 105 bp, Homo sapiens
ggaaaggaaaggggaggtgacaactgctagtgagaaaataaccaggggaaagattaggaagttttggtgtgcagtatgcagtgtaaccacattctcttcctctcc

SEQ ID NO: 6838440 - DNA, 129 bp, Homo sapiens
tctttcaactctccctgtcgtaagttttgcccttagaaaagtcctggagaagaggggcttggacggacagaatcctccatccctctcctccaagccgtcaggggcctatttaaaatgaggaaggacaga

SEQ ID NO: 6838441 - DNA, 59 bp, Homo sapiens
gctcatgctgctgtatactgtgaatgcctctgatacacagtgaaacacgcagtaagagt

SEQ ID NO: 6838442 - DNA, 67 bp, Homo sapiens
tcacagaaggcatcacagaagacatgattaacaagatcttgagttagaaaggtgggttttcttgtga

SEQ ID NO: 6838443 - DNA, 57 bp, Homo sapiens
tggagcccaggagaggataaacagtatctgttatcatactcattatccttggcttca

SEQ ID NO: 6838444 - DNA, 73 bp, Homo sapiens
cattgcagcattgtagcattttaaatgagcattcgtaaggagtctgcttaaataaagttacattcatgcagtg

SEQ ID NO: 6838445 - DNA, 85 bp, Homo sapiens
gttcaagacaaaagagcatttgcctttagataagaatatatttatgtttatcatctagcaccaaactagcttttttccagtggac

SEQ ID NO: 6838446 - DNA, 61 bp, Homo sapiens
gcctggcactgtgtctgcggagggccaggcctggggtcttcctaggatgcacggtgctggc

SEQ ID NO: 6838447 - DNA, 76 bp, Homo sapiens
ggtcaaggcgggcggatcacctgaggtcaggagttcaagaccagcctggccaacatagtgaaaccccgtctctact

SEQ ID NO: 6838448 - DNA, 62 bp, Homo sapiens
gcccctctttctggaaggcagagtgggccacaggggtttatggagactttcagaagcggggc

SEQ ID NO: 6838449 - DNA, 73 bp, Homo sapiens
gaagctgccctgggtcttgctgctgcctctccccttcaaagcagctgtctccagatacaggattgccagcttc

SEQ ID NO: 6838450 - DNA, 57 bp, Homo sapiens
ggctgatgacgcctgagtctgaaccattaggaaggacgggctctgcatccatcagcc

SEQ ID NO: 6838451 - DNA, 72 bp, Homo sapiens
gcaatctttgtgtaagtatctttgtatctttgtataagtgcaaagcactgcacatatatttgcaattgttgc

SEQ ID NO: 6838452 - DNA, 73 bp, Homo sapiens
tggagccttactagaatgtgagctacaaaacagtagagctattctctattcaatgctgcatctgtagggccta

SEQ ID NO: 6838453 - DNA, 56 bp, Homo sapiens
gggccctctggtggtttcttcctagacttacttcatggggacttccaggggagccc

SEQ ID NO: 6838454 - DNA, 82 bp, Homo sapiens
tcactgtggctcttacttgaggtcttcagctgacaccttctccagggaggctggcagccacctcagcagaaagccaccttga

SEQ ID NO: 6838455 - DNA, 67 bp, Homo sapiens
agtctgcagctgatagtcagatatcagagacaaaaatctctgaaataaatgcactgttaggcttact

SEQ ID NO: 6838456 - DNA, 74 bp, Homo sapiens
gtttgaaccccaggaagtggaggtcatggtgagccaagattgcgccattgcactccagcctgggcaacaagagc

SEQ ID NO: 6838457 - DNA, 64 bp, Homo sapiens
ttatgtgcagaggcttccttgactctgtctcctaacttggtgagtcttagagtctgtgtcatga

SEQ ID NO: 6838458 - DNA, 88 bp, Homo sapiens
gtttttccatctcagagctctttaatcccagcaataactgcctgacacagcagatgatgacagtgattagactgggagagggaggaac

SEQ ID NO: 6838459 - DNA, 55 bp, Homo sapiens
gttggaaggagcctaaaagagaccttgagaaaaaaaggtccagacttctatcagc

SEQ ID NO: 6838460 - DNA, 85 bp, Homo sapiens
cagaagcctgggagtctgggtttcatgggcactggctctctgccatatcagccggtcccatcttaatccaagcatccagggactg

SEQ ID NO: 6838461 - DNA, 74 bp, Homo sapiens
tccactgtgcattataacaataaggcttacttttaatacaaagactaagcgtttgggagttatgaaccactgga

SEQ ID NO: 6838462 - DNA, 87 bp, Homo sapiens
tgtccttgtttaccccttcctggatgaacagtagaaaaagaaagactcgtttcaatctgcattcaggagataggaggcctgagggca

SEQ ID NO: 6838463 - DNA, 85 bp, Homo sapiens
cttcctgtactcctggctcaggcccctggtgcctttgggtccccacgccatctgcccatgggcctgaggccctaggcctggggag

SEQ ID NO: 6838464 - DNA, 63 bp, Homo sapiens
cagagctgtgtcctgtgcactaggccttctgcagttaaagaaactcacagtcatgcagctctg

SEQ ID NO: 6838465 - DNA, 65 bp, Homo sapiens
aggaagcctcaccttttagaagctactcaggtaaatctgtacatggtagtagggtgaggtttctt

SEQ ID NO: 6838466 - DNA, 60 bp, Homo sapiens
tttgttgagcctcagagggaagagaagcttttttccaaggtgggactggggtgcagcaag

SEQ ID NO: 6838467 - DNA, 55 bp, Homo sapiens
ctgtgttgggctgggctgggctaagctgggctaggctgggctgagctggacggag

SEQ ID NO: 6838468 - DNA, 61 bp, Homo sapiens
ccagtagttgacactctcgaaccacaggacaggtggtttggcagctcttgactgttcttgg

SEQ ID NO: 6838469 - DNA, 64 bp, Homo sapiens
gttattgctatgatgatgtgtagttattgatatgataatatattgttgttagcaaacaggtaac

SEQ ID NO: 6838470 - DNA, 105 bp, Homo sapiens
gtcagtcctctgggccttgctgaatcccaccctccagtggactgtctgtgtctaggtccatgggggtcttgggatattagaaaagaatcaagaataaggaaggac

SEQ ID NO: 6838471 - DNA, 57 bp, Homo sapiens
gctctactcatcctaatgaaggctctacccttcattagctgtggatggagtgggagc

SEQ ID NO: 6838472 - DNA, 56 bp, Homo sapiens
aagagtcgtttcaggacagagggcttgccttgaagtctgacttcctgatgattttt

SEQ ID NO: 6838473 - DNA, 76 bp, Homo sapiens
cacctgagtgggaatgtcagtctaattctgggatgtagtatttttcccagacataagtggcattttccaatagctg

SEQ ID NO: 6838474 - DNA, 95 bp, Homo sapiens
aaaaaattcaagatggcgccagcagagcattaaaaccagctctgggacttctaggacaggatcatgatgctggctctgcccatcttgggtgcttt

SEQ ID NO: 6838475 - DNA, 56 bp, Homo sapiens
catctttatgtgtgtgtgtatgtgtgtctacccacatacacatacacataaatgtg

SEQ ID NO: 6838476 - DNA, 81 bp, Homo sapiens
gtggctgtaggataagcattgtttctgaggatggtcattatatgaatgttatgtcatctgcactcattgtcctctcgccac

SEQ ID NO: 6838477 - DNA, 55 bp, Homo sapiens
gccagcccgctgcagaacaccttgctcatcatgctgctgtaatgcagcgggtggc

SEQ ID NO: 6838478 - DNA, 57 bp, Homo sapiens
agacctactggcacattggtatcatccttattttacagatggccagtttagaggttt

SEQ ID NO: 6838479 - DNA, 105 bp, Homo sapiens
gaggctggatcattctccgtggtggctggaggtagggaggtcctgtgcagtgtagaatgtttagcagcatccttggcctccacccactgagtatctctagcactc

SEQ ID NO: 6838480 - DNA, 59 bp, Homo sapiens
ggccggggagagcactggctcctactctgcagagaaccccactgctcttccctagggcc

SEQ ID NO: 6838481 - DNA, 56 bp, Homo sapiens
gctcagctgcacctggagagccccatgtgagtgtggcacttctgttgctgctgggc

SEQ ID NO: 6838482 - DNA, 55 bp, Homo sapiens
tctaggctgtgtgtgggcaggggcagatactctgctcctccttgcagagcccaga

SEQ ID NO: 6838483 - DNA, 58 bp, Homo sapiens
tacagcctcgttctggtagggcagatcccacatgatgtcgccctgagatgatgctgtg

SEQ ID NO: 6838484 - DNA, 55 bp, Homo sapiens
gaagggagagggagctgggaacctttatccaggccttcagtctcctgcttccttc

SEQ ID NO: 6838485 - DNA, 99 bp, Homo sapiens
gggctggaggtggtggagctgccctgggatggtctgtgcgcagagggcgctggagaccctctctgggtgttcttggagctgccatagctggtccagccc

SEQ ID NO: 6838486 - DNA, 124 bp, Homo sapiens
taattggtaggctgaggcaggaggatcacttgaacctggaaggtggaggttgcagtgagctgagatcatgccactgcactccagcctgggcaacagagtgagattccatctcaaaaaataatta

SEQ ID NO: 6838487 - DNA, 65 bp, Homo sapiens
ggccgcggttgaggatgcctgggtcggggaaggtcgacgccggcccgcccggtcgcctggcggcc

SEQ ID NO: 6838488 - DNA, 104 bp, Homo sapiens
tagtattttgttccttgaggaggttgtgtggataatattacttgagcttcattttgggtgatttatattcaccagtttgtctcctcctgggtgaacactgtcta

SEQ ID NO: 6838489 - DNA, 81 bp, Homo sapiens
ccctaggaggtggcctaaggtggcactggatagggactttctgaaccagtcaaagccactcttgggggatttgaactaggg

SEQ ID NO: 6838490 - DNA, 66 bp, Homo sapiens
aggcctgctgtgtagcctgttgtctgacttcctcgtgctttgttctcccaggcacgctgcaggcct

SEQ ID NO: 6838491 - DNA, 74 bp, Homo sapiens
tggagcatgaggcaggtggaggctgccatttatagctcaggagtgagcttccctcctgcactacaacctctcca

SEQ ID NO: 6838492 - DNA, 77 bp, Homo sapiens
ctgtcctcagcccagcccttccgtacccagcatccactgtcctggtgggagtccgctgtgctgctccaagaagacag

SEQ ID NO: 6838493 - DNA, 66 bp, Homo sapiens
ttttgcccagctccctgaagcctggtcttggttaactgggagcgtgtcgtagggagtggggttagg

SEQ ID NO: 6838494 - DNA, 130 bp, Homo sapiens
gctgggattcggtctcttttagggatgggattcagggcaaaagggaaaccattctgtgaagattggccctagaatggcacctttgtcttagttcctcttgatttactttgggatccttcaagtttctagc

SEQ ID NO: 6838495 - DNA, 82 bp, Homo sapiens
agttgtatcagtccttgaagaatgattcttggaaatgttatcaaattatctgggaagatgtttcaaaggtcctatgccaatt

SEQ ID NO: 6838496 - DNA, 106 bp, Homo sapiens
tgagacggagtttcgctcttatcgtccaggctggagtgagtgtagtggcttgatctcagctcactgcaacctttgcctcccgggctcaagcgattctcctgcctca

SEQ ID NO: 6838497 - DNA, 86 bp, Homo sapiens
tctgggttatctgctcctatgtcctccaccacagagtgttcacagcgagtgctctgtcattggtgggatgagacagatttcccaga

SEQ ID NO: 6838498 - DNA, 129 bp, Homo sapiens
ctgcatcctgccttgatttcccatctgtgacaagaggcctgaggctgcctggagcccatgtctccctggaggtggttccgcttggcacccagcctctgcgggcggcggggaggagccgaggtggtggcg

SEQ ID NO: 6838499 - DNA, 92 bp, Homo sapiens
ctgtggtaaacaagactaatgctaacatcatatcactgtgtgttacatagtatatgatgtatagtgtatgccagtggtgtttataaacatag

SEQ ID NO: 6838500 - DNA, 88 bp, Homo sapiens
gcatctagagaggcacacacgcagcggcgctctgcgaaacgtctgtgtttcacatggtactgcctgtttgcctgtcggctctcaatgc

SEQ ID NO: 6838501 - DNA, 67 bp, Homo sapiens
gcagaaagaatagggtatttgtcaaaaaggaaacatgcttctggttagactcaccttatagttctgt

SEQ ID NO: 6838502 - DNA, 62 bp, Homo sapiens
gggatgggccagctgctatgtgacccctggagaagaaacgtcccgtcagcagggcccctcct

SEQ ID NO: 6838503 - DNA, 62 bp, Homo sapiens
actactctggttctacctccctgttcctctgatggaagtaggaagaaaagaggcagaatggt

SEQ ID NO: 6838504 - DNA, 87 bp, Homo sapiens
gactggcaaatgcggcatgctgcagggaatgcttgtctcatgcagaaggcagagaacgaccctggcagtactgcctggagcacagtt

SEQ ID NO: 6838505 - DNA, 70 bp, Homo sapiens
acaaggctttcagctaacttgattgcatcagctctttacatctctgtaatttggttgatgaaagcattgt

SEQ ID NO: 6838506 - DNA, 87 bp, Homo sapiens
taccaccaaacgaggatatatttgtgactgttattatgctgagtgatattgcatcatatatttctacaagtgcctcatttgttggta

SEQ ID NO: 6838507 - DNA, 107 bp, Homo sapiens
aacctgtggttcattaaagatgaatatagatttcagaaaaccaggtaatctatgttgtttttgttctctggaaactatgattcacctatgtgacataaacccaggtt

SEQ ID NO: 6838508 - DNA, 88 bp, Homo sapiens
gccagaaataaaacagaactggaagagtcagccatctgtctggaagcacacacagtcccagatggcatttcctttctggctttctggt

SEQ ID NO: 6838509 - DNA, 55 bp, Homo sapiens
caggcggcaagcagcaggggctccggcatcagccccccagcaccttgccagcctg

SEQ ID NO: 6838510 - DNA, 104 bp, Homo sapiens
gacagaactgaatgccatttcttcttgggtactttcccgctgcttttaacatttgggtgaccccagaagaggatccaaattggcgtttttcaggtctaaaggtc

SEQ ID NO: 6838511 - DNA, 65 bp, Homo sapiens
ttctgtgttgctttatcattaaatgatggtcaatgccgaccatctgcttgaatgagcaacaggaa

SEQ ID NO: 6838512 - DNA, 74 bp, Homo sapiens
ggcttttgttttcagaatgtggattcacaagtgctcaaggaatatgacttcagcactatacattttgaatagcc

SEQ ID NO: 6838513 - DNA, 55 bp, Homo sapiens
agctcagaactgcagacatgtgcgtgctcatgtttatgtcagtagcctttgttct

SEQ ID NO: 6838514 - DNA, 69 bp, Homo sapiens
tcaggagcttagatgctttgaccttttatttactctgtcctttgggctaattgtcatcatggctcttga

SEQ ID NO: 6838515 - DNA, 65 bp, Homo sapiens
agaagaggggacatgtgagctgggtcttagaaaaggcaggaagtagcttaaaatctctagattct

SEQ ID NO: 6838516 - DNA, 62 bp, Homo sapiens
ttagagctgtcagcgttttggccattgtgccaagatcagtggaaagacattgcagattttaa

SEQ ID NO: 6838517 - DNA, 64 bp, Homo sapiens
gcagatggcccgctagctggcctctagttcatgggtgttaagaggctgggtacgggccacctgt

SEQ ID NO: 6838518 - DNA, 66 bp, Homo sapiens
ctatggtcatttcaatgatcaagtgttcaaagctccttcactgactacaagttaaagtgactatag

SEQ ID NO: 6838519 - DNA, 71 bp, Homo sapiens
gagagaggtggtctctgagattccaggacaatgatgataatggcagttctgactcatcccaccacctcctc

SEQ ID NO: 6838520 - DNA, 61 bp, Homo sapiens
ggagaaaggcatagcagaacctggactgagacctacgggagacaggtattgctttttctct

SEQ ID NO: 6838521 - DNA, 58 bp, Homo sapiens
agctgggcaccccgctgcgtctaggctgaaaggaccgaggtgcacgggtgtgcctgct

SEQ ID NO: 6838522 - DNA, 110 bp, Homo sapiens
gattaaagacttttgaaagatatgcgtactatatactgtgtattttgagtgaaaaaaatcagagagcacaattatttatgcagtatgactttagttttattagttttttc

SEQ ID NO: 6838523 - DNA, 59 bp, Homo sapiens
gagtgaggcagggaaagaggataatttttggaggattatctgttttctgtgcgtttctc

SEQ ID NO: 6838524 - DNA, 59 bp, Homo sapiens
aggatgattggatgcctgctcaaacacatgtttctctgtctgcacccaatcaatatcct

SEQ ID NO: 6838525 - DNA, 87 bp, Homo sapiens
gatagaaccctctgaagactcatttgagacgatgatggagcataagaatccatcatcaaaacaaatggagtcctccgagggctcatc

SEQ ID NO: 6838526 - DNA, 83 bp, Homo sapiens
gcctcttctcagccatctaggatttgaatgcacagtagctgctgcattgtggacccaaatcctagatggctgaggaggttggt

SEQ ID NO: 6838527 - DNA, 76 bp, Homo sapiens
gggcatctgtctgcatgctctgggtcctggacttgccttaaagtgcagaactgaggctgctgcatgacagaagccc

SEQ ID NO: 6838528 - DNA, 84 bp, Homo sapiens
gctctttagcttgtgccatatgaaactaccagtggtaaatcattcctgaccaaaaatggcagttttatggctcaacctaatagc

SEQ ID NO: 6838529 - DNA, 63 bp, Homo sapiens
ggccactgagaggtctcatttccaatcctgctagtccagtttgaagactgatcttttagggtc

SEQ ID NO: 6838530 - DNA, 106 bp, Homo sapiens
ttagatttgactgccttttagtttacaggtgaatgctcacattctaatcagagaagatgattgggatataaagcattctcagaaaccaggaagtatgcatttctga

SEQ ID NO: 6838531 - DNA, 65 bp, Homo sapiens
gacgatgtagacagttgtgtaggtagcaatggtctggcggacctagaacacaacctatattagtt

SEQ ID NO: 6838532 - DNA, 58 bp, Homo sapiens
gagagtccaggtctgggtcctttagaaacaaggctactctgttaggcctgtgactgtc

SEQ ID NO: 6838533 - DNA, 59 bp, Homo sapiens
gatgtcacaagcagaactaggcactggtcttattatgcatattttctgttggtgacatc

SEQ ID NO: 6838534 - DNA, 66 bp, Homo sapiens
aggttttttcactgttgatattttggctccttcaatgttgaaacatcttaaacagaggaatgactt

SEQ ID NO: 6838535 - DNA, 101 bp, Homo sapiens
ggggggctactgcagtttgatgcaatcagaaaggctaaggaagcatcacctctgtgccctgcagcctgcttttgctgaaccctcaacctgcagagataccc

SEQ ID NO: 6838536 - DNA, 130 bp, Homo sapiens
cacctgcattctgttacccggcttctcagcagggcaggaaacattcccataacacatggagtgctttggttttggggggtttctgcatttccctgctgaggatccagaaatcaggtgatagaatattttg

SEQ ID NO: 6838537 - DNA, 101 bp, Homo sapiens
cccattatggacatccgacgacctgggttcagacccacatttgcccctctgagatagtggtgatggtggactcttgattcaggcagtctggattcaagggg

SEQ ID NO: 6838538 - DNA, 100 bp, Homo sapiens
ttccatttccagggcatattgattttgaatattaaagaagagctgcatccattcattcatcaaatgtgttctgagtcagtgccctgttctgggtatggga

SEQ ID NO: 6838539 - DNA, 77 bp, Homo sapiens
gagcatttccaggctcgcttgcgtacagtgaaaagtgatgacagtaagtgatgtcttggttaatgaagaaaggtctc

SEQ ID NO: 6838540 - DNA, 84 bp, Homo sapiens
gtgtgcttccatatctgtctttgtgagttcactttaaatacatgcataagattgtagtgaatttaaaacactgaggaggtccac

SEQ ID NO: 6838541 - DNA, 68 bp, Homo sapiens
cgatgccagctagtcacatattagagattctatatacaacatatctgtaaaagtgagaagttggaccg

SEQ ID NO: 6838542 - DNA, 59 bp, Homo sapiens
cttcctctctaagaaactctcagcctaggcaggtccccagttttccattagggagggag

SEQ ID NO: 6838543 - DNA, 56 bp, Homo sapiens
gaatgcaaagctctctatgttatttcctaatggatgtttaacatcggctatgcatc

SEQ ID NO: 6838544 - DNA, 89 bp, Homo sapiens
ctgtaaagtgtgtgagctcgggtcccagcgtcccctgccaacacacacagatcccaggacaggtgcaaatttgacttcacacatcacag

SEQ ID NO: 6838545 - DNA, 64 bp, Homo sapiens
tcccagagggaagaggaagcgctgagatgagtcctcactcacggatgcttttttcccactgggg

SEQ ID NO: 6838546 - DNA, 83 bp, Homo sapiens
ctcaatgatcggcacggtgggggctgagggccaggagcaatgagcacctggctggctggaccacacctgcagagatcaatgag

SEQ ID NO: 6838547 - DNA, 128 bp, Homo sapiens
gaatgcttttacttaggaagcacgagacctgtgctgcagaccgtctgttggagctggccgcggcaggacggcgatcaccttcctggcaggcccctcctggattctgccctctgcttctgaaagcgttt

SEQ ID NO: 6838548 - DNA, 78 bp, Homo sapiens
gtcactgtggtgagtgtagtacctctcctcacagagctttccctctgacagacgtcaaatgcagttatcaatagtcac

SEQ ID NO: 6838549 - DNA, 109 bp, Homo sapiens
gtaaactgaaaagcattctgtggggacgggcttttggaagacttctatgctcttgatgaaagcacaagttctaacaggaggtctcttgcagagctggacttcaggaagc

SEQ ID NO: 6838550 - DNA, 118 bp, Homo sapiens
catggatttatgaaatatgagaattctattgtgtgctgtgtgtgtagataaaaaaagtaagtgcctacaaattagatgtgcagcaaaatagaatcttttaagttttctataattgatg

SEQ ID NO: 6838551 - DNA, 70 bp, Homo sapiens
gcttctctcattcaaattaaagtgaatggaagcccattcccttagactactaatatgagctgggagaggt

SEQ ID NO: 6838552 - DNA, 77 bp, Homo sapiens
gaagctagaagaggcaagaaaggactttctagagcctttggaaagcatgattctgccacatcttgattttggacttc

SEQ ID NO: 6838553 - DNA, 89 bp, Homo sapiens
agtttcatgtatttaagtataagctattcttcatgatgtttgagtaatgtcagttcactctagccttatgcacaaatatgtgggtaact

SEQ ID NO: 6838554 - DNA, 58 bp, Homo sapiens
ggggatcagaacaaccaaagtcagtagtgtccttccagctgatgttgactctgaccct

SEQ ID NO: 6838555 - DNA, 82 bp, Homo sapiens
ggcgtttgtacagtttgtatggtcaggaatgtttgtgaggcattaattgaatatttcttatgaatattgactgtgcaaggtc

SEQ ID NO: 6838556 - DNA, 109 bp, Homo sapiens
cacaaagttgactcatgaaaatccaagtaacacatttgggacaggagataaattaactgatgtattttgtctttccaaatgtaggattttgcaatgaattaaataagtg

SEQ ID NO: 6838557 - DNA, 65 bp, Homo sapiens
tagcttttgggacatctggcatacagttataataactgcctttatgcctttgtcttctaattcta

SEQ ID NO: 6838558 - DNA, 96 bp, Homo sapiens
tccctaccctgtaattgttttgggcccagtgtatggcagcgtgcctgtttctaagcttgttttgccactggacccagaactcttttagggcttgga

SEQ ID NO: 6838559 - DNA, 58 bp, Homo sapiens
ctgggtcttcagcagcaggcggggtgggacttttcaggctctctgcatggtggctcag

SEQ ID NO: 6838560 - DNA, 76 bp, Homo sapiens
agccaaaattaagcctcttatgttgccttggattctgttactttaaataggcactcaccagattataattttggct

SEQ ID NO: 6838561 - DNA, 88 bp, Homo sapiens
ggagtctcgctctgtcacccaggctggagtgcagtggcgcgatctcggctcactgcaagctccgcctcccgggttcacgccattctcc

SEQ ID NO: 6838562 - DNA, 83 bp, Homo sapiens
gttcaaaagcaagtatagaatccacctacacaagagactttgttcagagttatttgatttggattcctactgtgcaatgacac

SEQ ID NO: 6838563 - DNA, 74 bp, Homo sapiens
tgggctctggagggcctaggatcctgggacacggtggggtttgcgaactctgggagccgggcctgccaggctca

SEQ ID NO: 6838564 - DNA, 69 bp, Homo sapiens
agaggcttggcaggtgtctgcggctccccaggggtggggtgctgggaggctgacatctgtggagtgttt

SEQ ID NO: 6838565 - DNA, 61 bp, Homo sapiens
cagacctctatggggtaaatctggggatttcttggaagaaagtgcactcatggagggtctg

SEQ ID NO: 6838566 - DNA, 89 bp, Homo sapiens
ggttcaaggaaaatggctctcagttcacagttaaagttatcatcagactactgaaggacttgagggtttcgttttcctggctttgagcc

SEQ ID NO: 6838567 - DNA, 56 bp, Homo sapiens
ggcgtaaggataatgatagctcaggctctgcactctcccctgttgttacctgcgcc

SEQ ID NO: 6838568 - DNA, 86 bp, Homo sapiens
ggcgctggcaggtagtgatgaaaggccagccaactgggattaccagcatgggggagctggctctcctcacagtacaggccagtgtc

SEQ ID NO: 6838569 - DNA, 67 bp, Homo sapiens
acataggtgctgagagatttaaagggccataaaacacatctggtccgatatcttcttatacaaatgt

SEQ ID NO: 6838570 - DNA, 85 bp, Homo sapiens
cgtggtagcacatagaatgttggagtggggttaggggagtggggatactcatccagccccggcttccttacagtttgatattacg

SEQ ID NO: 6838571 - DNA, 61 bp, Homo sapiens
actgaccagatctttgagcttagagttgattttctaatagagctgataggtctgttcttgt

SEQ ID NO: 6838572 - DNA, 81 bp, Homo sapiens
gctcctcccactgccttcacctgccctatcagcagcttcctccttttggaggccgattcgggtgtgggcggtgggcacagc

SEQ ID NO: 6838573 - DNA, 83 bp, Homo sapiens
tggaggcacactgggtccactggtcctgcccagaggctgtgggacagccaagcttggccttccagggacctatgataccccca

SEQ ID NO: 6838574 - DNA, 69 bp, Homo sapiens
aagctgttttcttctcctgaaatcaggctctgtgtttcggagctatgtgttgtgagaaggaagccgttt

SEQ ID NO: 6838575 - DNA, 55 bp, Homo sapiens
tggcagcagcaaatggcatatcatcttccgtgatcttggagtcatcatgctgcta

SEQ ID NO: 6838576 - DNA, 66 bp, Homo sapiens
ggcaagtatttgtgcatctacacacatctaaacatagaaaaggtacagcataaatacactattgtc

SEQ ID NO: 6838577 - DNA, 63 bp, Homo sapiens
aggagaaggaagtgcatcactagcagaaaagttggtaaagagtacttttcctattagtttctt

SEQ ID NO: 6838578 - DNA, 75 bp, Homo sapiens
gccactgcagccatgggaacaccatgtcgagcgatgaatgttcatctggaagttcccaaggctgagttccatggc

SEQ ID NO: 6838579 - DNA, 90 bp, Homo sapiens
gggtttaggctaatctgacttgtctctttgggagacatttattttattttcttttatatttccttgagacggagtctcgctctgtagccc

SEQ ID NO: 6838580 - DNA, 88 bp, Homo sapiens
ttgggtgaaacactgggagaagtggagctgctaggtaataggataaatgtgcactttacttttcaaaaactgccagagttttccacaa

SEQ ID NO: 6838581 - DNA, 72 bp, Homo sapiens
gagtttctttccagggcttctgggcagccagtacccctcactgtcctgaaggagcccaaggagaggtaactt

SEQ ID NO: 6838582 - DNA, 80 bp, Homo sapiens
ggcccatcccagcatgccccatccccttcctgggtgccccaggcagatcacaggagggcctgactgctgggctttgggct

SEQ ID NO: 6838583 - DNA, 71 bp, Homo sapiens
ctgttgatgaggtcacactgtatttctcatgttctttgtacgtaggtgtatattatgtgactcttcaccag

SEQ ID NO: 6838584 - DNA, 103 bp, Homo sapiens
tcaaggagcatgaacggtggctggccatgtgcatccaggccctgcagcgggaagtggcagaggaggacctggtgcaggtggacagagccgtggacgccctcga

SEQ ID NO: 6838585 - DNA, 120 bp, Homo sapiens
gaccctgtcacccaaaggctgcaggcagtgtctggagtggaggtgccttgggctgacagcccagcctggccctgtcccccactcagtgcagcctgccccggtgcccccagtggcagggtc

SEQ ID NO: 6838586 - DNA, 79 bp, Homo sapiens
gaagtgggagctaattcagtcattaatcttagcctaaaccaggctgaattacacagatatgctgggatcttccactctc

SEQ ID NO: 6838587 - DNA, 56 bp, Homo sapiens
gctgtgtcggactatggttcacagtgtgggagacactgctgtggcccccgacatgc

SEQ ID NO: 6838588 - DNA, 82 bp, Homo sapiens
agttgcctgtgtactttgggttgggtgggaaggtattgtgaaaacaaaacttcattttcaactgcaaaatttatgggtaatt

SEQ ID NO: 6838589 - DNA, 76 bp, Homo sapiens
atcacagaagtcccttattttgacctgtgaattgttcatcctttaaaaactccaggaaacttaggggaaatgtgat

SEQ ID NO: 6838590 - DNA, 64 bp, Homo sapiens
gtgatgataggaaccctggaacgaaaagcatctcccgttgtctccttgttcgttcctgacaggc

SEQ ID NO: 6838591 - DNA, 94 bp, Homo sapiens
atcagtagtgagcatctgcatgaatgtattgatgtgtgtgtgcacgtgcgcagatgttcgcgttaatgcatgcaattctgtgggtattactggt

SEQ ID NO: 6838592 - DNA, 69 bp, Homo sapiens
ccctgttcccagaaactttctttactgagcattctttatgttgggtagtgaaagattctacacacaggg

SEQ ID NO: 6838593 - DNA, 63 bp, Homo sapiens
ctgtggcttctggcctgctacacccatgaacagagtgggcttctgcagccaaagaagccgtgg

SEQ ID NO: 6838594 - DNA, 124 bp, Homo sapiens
taggatgtttaagttcatgttgggtttctggaggaagtctctctacaagaaaaaatatttggagtgttttctgtaggggatatctttgaagattaaccttcattcatcacttcaatttgttctg

SEQ ID NO: 6838595 - DNA, 63 bp, Homo sapiens
gcctatcttgctaactacagctggtgacattctgttgcagacgttgtgggggcaatggtatgc

SEQ ID NO: 6838596 - DNA, 59 bp, Homo sapiens
gtttggtggtagcattggctatgcttgtaatttgcaaagaggaagtgctgctggcaaac

SEQ ID NO: 6838597 - DNA, 71 bp, Homo sapiens
ttccaggactcgttctggctcatctgcagccatggatgaataaaaactcgatcaggacgctggtctttgaa

SEQ ID NO: 6838598 - DNA, 60 bp, Homo sapiens
tatttagcacctcaattttgcaaatagggaagttattttatatgcaatgaggtgggagta

SEQ ID NO: 6838599 - DNA, 118 bp, Homo sapiens
cagcgtagaaacaagccagcagacatgaggccagggtgccatgaaatgaaggaacaggttcatttgatacaactcaggcatcacctgagcctttggaagatgggtgggatttacactg

SEQ ID NO: 6838600 - DNA, 70 bp, Homo sapiens
gggatggttgaagggggcagagaaatggcatatgcttttctcaaggcagggcctctgtcccccagcactc

SEQ ID NO: 6838601 - DNA, 75 bp, Homo sapiens
cagaatttggatcatagggtttttgagctacaagggatatgagttgtcattgagttcaaatccttcatttttctg

SEQ ID NO: 6838602 - DNA, 76 bp, Homo sapiens
atgttctgaataatgtgcattacaaatgactgataataattcatgcaaagaggatcgcatattgaattcagaatgt

SEQ ID NO: 6838603 - DNA, 76 bp, Homo sapiens
tactaaatatcagaacacatgttttgcagcctaaactttaaatggtggcttgtgtgtgtgtgtgtgtgtgtgtgtg

SEQ ID NO: 6838604 - DNA, 61 bp, Homo sapiens
gccatagggttagtgcagtaccctgagctaataaaagcacagctgttaccaatcttagggc

SEQ ID NO: 6838605 - DNA, 55 bp, Homo sapiens
tctctctgcgaattaggtttgcattaagttttctatctttattacgcagagaaga

SEQ ID NO: 6838606 - DNA, 69 bp, Homo sapiens
atgtataacaaatactcatcccaggaactggctccaagtagtcattcaataaagggtatctgttgtcat

SEQ ID NO: 6838607 - DNA, 78 bp, Homo sapiens
tttgcttgaacccaggaagtggaggttacagtgagctgaaattacaccactttactccagcctgggcaacagagcaag

SEQ ID NO: 6838608 - DNA, 85 bp, Homo sapiens
ctacttagttatgactcagtgaagatgtgggaactgctgaaatcttgatttatggtagtactcatgtttaaggttttaattgtag

SEQ ID NO: 6838609 - DNA, 63 bp, Homo sapiens
tcagcactcgctacctagtaaattgactgatgatgcatcaaagctagttagaagagtagttga

SEQ ID NO: 6838610 - DNA, 60 bp, Homo sapiens
ggggcatttgtattctaacttagtgaaagaagtttgtaatagtggaatttcagatacccc

SEQ ID NO: 6838611 - DNA, 62 bp, Homo sapiens
tgaagatattttaaaatactgacagttcttgtgaagaaaatcagtgaggttgagatatgtca

SEQ ID NO: 6838612 - DNA, 67 bp, Homo sapiens
gctctgtgtgccagagggctccatggcagagcaggtgtgcatgctcaggcctcggacacacaatagt

SEQ ID NO: 6838613 - DNA, 74 bp, Homo sapiens
cagagataagcagccacttgtccagggacatgtggggccacctggcatccctgtcgtcaagtctctgccctctg

SEQ ID NO: 6838614 - DNA, 96 bp, Homo sapiens
agctggatacagatgcagaaactgcttcttaccttttgaaatggaaataagcctatttcatgagtggaagaagtgtatgcagagatgtgaatagtt

SEQ ID NO: 6838615 - DNA, 66 bp, Homo sapiens
cctgggctcaagcgatcttgtcacctcagcctcccaaggtgccaggattataggcatgagccatgg

SEQ ID NO: 6838616 - DNA, 80 bp, Homo sapiens
gtgattccataagtagggttcaccatatggtaatttaatgagaaattattgaattgaatttcatggtgcttatgggaaac

SEQ ID NO: 6838617 - DNA, 59 bp, Homo sapiens
agcatctggtcatgagtgagaagaacatgacagcattgtctctggtgtggccagaagct

SEQ ID NO: 6838618 - DNA, 57 bp, Homo sapiens
cctccctccctgcagaagccacatggcacaacctgggcccttgacaggagtggatgg

SEQ ID NO: 6838619 - DNA, 83 bp, Homo sapiens
gtacagatgaaccatatatttacagttgacattgggtctgcttgggcaattatctgctgtgattgttagttcctatactgtac

SEQ ID NO: 6838620 - DNA, 108 bp, Homo sapiens
gtgcggtctggagcctctggatggagccattcctgaagacttcaccaccagtggagttttcattcgtgtgctccaggttattccctttgttggttaatccagatccac

SEQ ID NO: 6838621 - DNA, 71 bp, Homo sapiens
caccccaaggagagcgcttcctgcgtgcctgttgttgcaaaaacataacagggctttggaagtctccggtg

SEQ ID NO: 6838622 - DNA, 76 bp, Homo sapiens
gggattgctatatttcttggctttaaacactgatgagagtgaaatgtttaaggaagaaataattccagttttaccc

SEQ ID NO: 6838623 - DNA, 69 bp, Homo sapiens
aggttggtgcaaaagtaattggggtttttgcagttattgcaaaaaccccaattacttttgcaccgactt

SEQ ID NO: 6838624 - DNA, 66 bp, Homo sapiens
tttctcatcaaccttcccatacctctctgttccccccttcccggttgctgaggttgttttgaggag

SEQ ID NO: 6838625 - DNA, 61 bp, Homo sapiens
tggagcattgtgctaagacacacccccccggtgtggggatgtaagaagggccagagctcca

SEQ ID NO: 6838626 - DNA, 89 bp, Homo sapiens
tttgaaagtgcacttgatctagacagattcccttgcctattaatatgcaaatcagcctcagtttttctttgtttattgcaactttcaga

SEQ ID NO: 6838627 - DNA, 67 bp, Homo sapiens
gtctgtcactcaggggctggaggctggagctgaggatgcagggagagccaaagccccgaaggcagat

SEQ ID NO: 6838628 - DNA, 69 bp, Homo sapiens
aggcataagtgtgtaaggcattctgtcaactatcattccttctctttgacaggcaccatgcctgtgcct

SEQ ID NO: 6838629 - DNA, 60 bp, Homo sapiens
ataacattttgacaactggtgatccaggcacagtggaggatttcattgtcagaatcttat

SEQ ID NO: 6838630 - DNA, 82 bp, Homo sapiens
ctgtgatggaacgtgtttacacttcaaggttaaggttagttctctcttctcttcgcttactgtgtaaggagttttatgacag

SEQ ID NO: 6838631 - DNA, 62 bp, Homo sapiens
aaatctgtgacctgaccaacctaatacaaccaaagtgctataggaatccagttcgcaggttt

SEQ ID NO: 6838632 - DNA, 69 bp, Homo sapiens
cttttcatggcacaggattttaatcagtccttgaaatcatctttgacctggtccttgtcacaaggagag

SEQ ID NO: 6838633 - DNA, 62 bp, Homo sapiens
tgcctttatggccattttcattgccctcttgtggttttgcagttatttggctatagatggta

SEQ ID NO: 6838634 - DNA, 130 bp, Homo sapiens
ggaagcatggaaaagatattgacaatctggaattgggagttacaaagttctgagttcaaacagtgcaaagcactgttcactggctgtgtgactctgagtgagttaattcacttttctgactcttattttc

SEQ ID NO: 6838635 - DNA, 66 bp, Homo sapiens
gctgtattggaacacatccatgctcattcatgtatgtattgttcatggctgttttcacactacagc

SEQ ID NO: 6838636 - DNA, 114 bp, Homo sapiens
atttttgaactggactttgacagatgcgtaggagtttgctggatggagtaacagcttcaggcccaacgcacagcttctgacagatccccatgttaagggtctattctcaaaggt

SEQ ID NO: 6838637 - DNA, 58 bp, Homo sapiens
aaatccaagctttggtaactgagctcctcactgctccaagttcctggatcttggattt

SEQ ID NO: 6838638 - DNA, 89 bp, Homo sapiens
tgatttggtatatttacagaattatcaggaaatgttataggagttgtattgctttgtgacagctcttgtatttctgacataccaactca

SEQ ID NO: 6838639 - DNA, 96 bp, Homo sapiens
gagtagatgaaatcagatttagagtggggcttggaattctctgctcaagtccacagaaatctgaaagccctagtttgtaatctctaatatctggtc

SEQ ID NO: 6838640 - DNA, 56 bp, Homo sapiens
gagagagaaccccgtgcccttcatagcacagtgcctgggtcaaatgttctgctttc

SEQ ID NO: 6838641 - DNA, 86 bp, Homo sapiens
gtccaaatccattaggttttttgttgtgtttgaaagctgtaatccagagagagtttgaaagcatatgctaaagaccatttttaggc

SEQ ID NO: 6838642 - DNA, 76 bp, Homo sapiens
agcaaacaagatttggcattctgaggagtctaattatctctccaagaagacttagcagaattccaagcttgaagtt

SEQ ID NO: 6838643 - DNA, 88 bp, Homo sapiens
gacccatgccagcagcagagctgggcagaggagccaggcatcatcctctctctccccacaccctctgcatgcacttggcctccctgtc

SEQ ID NO: 6838644 - DNA, 91 bp, Homo sapiens
gtccactggatttccttcatggagagagctgttttactcagaaacatatcttcaggtttgtttacaaaaatcaggtctttgggggatggat

SEQ ID NO: 6838645 - DNA, 94 bp, Homo sapiens
gaaaaggaagttgctgttgctgcattttttttaagctgtaaaatctaatatgccccagctctgatgaaatgtaccaggaggaacctgccttgtc

SEQ ID NO: 6838646 - DNA, 108 bp, Homo sapiens
cagcctgttctatatgccagagggcactgggtttcaatgtcagtatttatgttcttttgatagcttgttagaatttagttgctcgtggatttctgtagaactctgctg

SEQ ID NO: 6838647 - DNA, 70 bp, Homo sapiens
agctacccgaggacaggctaaggagtgatcatagttaggagcagcccaatagcactgtcatctggcagct

SEQ ID NO: 6838648 - DNA, 58 bp, Homo sapiens
gctgacacttagaagtgccctgtctatagccctctgaccttgacttctaattgccagc

SEQ ID NO: 6838649 - DNA, 83 bp, Homo sapiens
ggcattgggattgggaaagttaaattaaagattggagaaggacctcttgctaggtctttctttattttggtgtccttaatgcc

SEQ ID NO: 6838650 - DNA, 74 bp, Homo sapiens
ctccaggtccccagtggaggtgagggtccttcagaccatgtgtcctaagactctcactctgcagatggctggag

SEQ ID NO: 6838651 - DNA, 79 bp, Homo sapiens
taaactttgtaactctgaatacatcctacttgcaagtctctatgtaatgtagtatccggagtttgatagaattggtttg

SEQ ID NO: 6838652 - DNA, 78 bp, Homo sapiens
atgtattatggtgtatattgctgggccaaaggctatgtaagtcttcaacttccctagatgtcataccaactcatacat

SEQ ID NO: 6838653 - DNA, 78 bp, Homo sapiens
caggaatcagcaggcccagagtttcatggccttgagcaattgctgggcagtggggtttctgtgggtgctaattgcctg

SEQ ID NO: 6838654 - DNA, 63 bp, Homo sapiens
ccctcttctgtgatctatgtgttttaagtgaggtttaccccaggtccaggttacagaggtggg

SEQ ID NO: 6838655 - DNA, 55 bp, Homo sapiens
gcatttcatgtaagtcagaccagagttaaatggtttttaaaatgcatgacagtgt

SEQ ID NO: 6838656 - DNA, 73 bp, Homo sapiens
tgctccaatattaggttccattcttctatctcacctcttcaatgggtaggtcctggagctgtggtaaggagca

SEQ ID NO: 6838657 - DNA, 67 bp, Homo sapiens
gcttttgtcatttccctgattaaagcctttctatggctccatgttaggcaatgatgcaattcaaagc

SEQ ID NO: 6838658 - DNA, 79 bp, Homo sapiens
caggctcagtttgggctcttcttgtctctggttagaatgtattattctttatagctattggatgagtacttgcagtctg

SEQ ID NO: 6838659 - DNA, 58 bp, Homo sapiens
ggggcctcactatgtggtccaggctggtcttgaactcctgggctcaagtgatggtccc

SEQ ID NO: 6838660 - DNA, 55 bp, Homo sapiens
tctggagggggatgcctcatccctgacagatgtgggtcatggctgtccctccagg

SEQ ID NO: 6838661 - DNA, 86 bp, Homo sapiens
ggctctttgggaatcttaggggctttcggggtcttgggttccttgggctcttttttctccttgggttctttcggttccttcgggtc

SEQ ID NO: 6838662 - DNA, 55 bp, Homo sapiens
tatactgtcgcattacactcacatgaatgtgtgaaagggaattgaagacagtgtg

SEQ ID NO: 6838663 - DNA, 81 bp, Homo sapiens
gtattttaaagtaggtggctgcagtagtgtagggtctgggcaatcagacacctcactggcagcttcactgtattagaatgc

SEQ ID NO: 6838664 - DNA, 75 bp, Homo sapiens
gagagtcagaagaccaggggttgagtcctagctctgtccctgacttgctaggtcactgttggtgggtctggcctc

SEQ ID NO: 6838665 - DNA, 74 bp, Homo sapiens
ggatgattatggcccaggtaccacaggatgtggagtttctgggctcagcatcatggtatctggggcccacgtcc

SEQ ID NO: 6838666 - DNA, 72 bp, Homo sapiens
ccattatgaatccccatgccaggccacaatgtggttagcccacaggtggaaacatggtgttgggtttttagg

SEQ ID NO: 6838667 - DNA, 61 bp, Homo sapiens
cagccttagcagataaaaaccttcagaaaacatttttgaaaggtgctgtgtgctgattctg

SEQ ID NO: 6838668 - DNA, 89 bp, Homo sapiens
gagggttcattgtggtggcactttacttcctcaggagagtcttccctggcactctcttgtggggtgaggtgcctcttcaatgttccctc

SEQ ID NO: 6838669 - DNA, 61 bp, Homo sapiens
ggggcccacagggacttgtctggaaccacatggctggcagggcacagcccagtggggtccc

SEQ ID NO: 6838670 - DNA, 83 bp, Homo sapiens
gtgtccttggagaagtgacagagcctctaaacttcctgctgcagtcagttacagtgttctattactctgctggtcaaggagat

SEQ ID NO: 6838671 - DNA, 79 bp, Homo sapiens
atccaattataccaatgataagacagataatgctaaaattttctactggtaccctctgtctattcaattggttcaggat

SEQ ID NO: 6838672 - DNA, 85 bp, Homo sapiens
gctttgccacttactagctgtacaaacttgtgcaagtttcttccttttgccaagtctgtttttcagtaaagttaggtagcaaagc

SEQ ID NO: 6838673 - DNA, 57 bp, Homo sapiens
ggcaggtcatcgattcataaacactgagagtgttttcatgtgatagttgaacctgcc

SEQ ID NO: 6838674 - DNA, 56 bp, Homo sapiens
agagggggaaaatagaggtgttctgactagacttaggattcctggcctctgcctct

SEQ ID NO: 6838675 - DNA, 95 bp, Homo sapiens
ggtggcgggcgccgtccctacctggcagctgcgctccaggtggctgtcccacgccggtctccgcgcctgcccggtgcgcgggtggcgtccgctcc

SEQ ID NO: 6838676 - DNA, 56 bp, Homo sapiens
gaaggctggcaaagatccaacacggcagcatttcttgcttcggtttgccaggcttc

SEQ ID NO: 6838677 - DNA, 61 bp, Homo sapiens
gtgcccttataatagagacccaagagagctccctcactatttttctaccttatgaggacac

SEQ ID NO: 6838678 - DNA, 64 bp, Homo sapiens
gctctatcgtcaggcatagtgagactcttgtcagagcaggctcactctgtttggctcacagagt

SEQ ID NO: 6838679 - DNA, 65 bp, Homo sapiens
cagtaactgctgatgacctcaaactctttccatcgttggagtgcggtcaacatcagcagttgatg

SEQ ID NO: 6838680 - DNA, 72 bp, Homo sapiens
cagctaatgcattgtgtggtatatggttggcaattaaataattgctaaataacttacatagtggctgagctg

SEQ ID NO: 6838681 - DNA, 63 bp, Homo sapiens
tctgtctgcaagctaaggaagcatctgaccctaatattgtcagggacctcttcttgcagctga

SEQ ID NO: 6838682 - DNA, 81 bp, Homo sapiens
gtataattagcatgttgtgttgttaaaatctcagtgataaacttgcatattagcaacagagctcttgtttccacattatac

SEQ ID NO: 6838683 - DNA, 62 bp, Homo sapiens
gggggaaattcacagttttagctgtccagggattagcttcagaggaaaggctgattttccct

SEQ ID NO: 6838684 - DNA, 67 bp, Homo sapiens
gcccaatacattcttcatacctactgaggttggcaacagctccaaggttgaggagtgagccctgtgc

SEQ ID NO: 6838685 - DNA, 122 bp, Homo sapiens
gctgaccagatacaatttccctctcactggtcttccatgcagtttcccatcacctgtctaatcagagaaggaaagctgacatgggcacagacttttcagtacagagaagagaatattccagc

SEQ ID NO: 6838686 - DNA, 88 bp, Homo sapiens
agaggcattttataggcattcttgatcccatttctgtgagtaacatgcactcataaaatagattctaggatgtcttatctctgctcct

SEQ ID NO: 6838687 - DNA, 75 bp, Homo sapiens
gagcattccaatcctggatcagtcactgttgctggctttatgctctcagaatggttactgaatcctttgaagctt

SEQ ID NO: 6838688 - DNA, 58 bp, Homo sapiens
gtgctgctgagaagtctagtaagatgaaaactcccaatcccactggttttggcagcat

SEQ ID NO: 6838689 - DNA, 76 bp, Homo sapiens
gaggggagtggttgggggctggggagatgctggctgtgctgcttctctgttctaacccttgcagcctattcttctc

SEQ ID NO: 6838690 - DNA, 56 bp, Homo sapiens
attagtcagtatttgtttgccatcccttgaagtcatggcataacacactggctcat

SEQ ID NO: 6838691 - DNA, 76 bp, Homo sapiens
aaatctcagtaaggcaatgccactaagatgggtttttaaataagtgtattccatctccctgcctcaacagagattt

SEQ ID NO: 6838692 - DNA, 99 bp, Homo sapiens
ctttaatttttttcccccactgagatcctgtaggcagctaagaatgtatgatagggccttttggatgctttaggacttgatgtaggataaagaaaaaag

SEQ ID NO: 6838693 - DNA, 61 bp, Homo sapiens
gatgctgctgatggcacctaggcagaagtcccaaaggacacctgttgccccttcacagatc

SEQ ID NO: 6838694 - DNA, 55 bp, Homo sapiens
ggagctgcacgctctgaagcctcctggctctgaggactcagaggctgctggctct

SEQ ID NO: 6838695 - DNA, 58 bp, Homo sapiens
tgtgtttctctgaggggtccctttaaaggaatgcccttaatccccctcaggaagtaca

SEQ ID NO: 6838696 - DNA, 74 bp, Homo sapiens
cagctacatggcatgccttgtcagacagtgaatccttgctcacatatgcactggatgaaaaggtgcctgagttg

SEQ ID NO: 6838697 - DNA, 101 bp, Homo sapiens
ctttctcagcagtgaagactgattattttttaaactcatggtattctgtatccaagacagtagtttataaaaatgttgtttacagtccattgctcatgaag

SEQ ID NO: 6838698 - DNA, 69 bp, Homo sapiens
ggaaggccttgccgaaggatgccacccaaccagcatctaacggacatggcatttttggcaatgccttct

SEQ ID NO: 6838699 - DNA, 65 bp, Homo sapiens
gactgaatgcatgagcaggaagagcacaaagaggatgcctctgagctcctcctgctctgtaagtc

SEQ ID NO: 6838700 - DNA, 59 bp, Homo sapiens
gaggccaggggcctggagatgaaggagaccagacgtcgtgctgtagagcccccggtttc

SEQ ID NO: 6838701 - DNA, 83 bp, Homo sapiens
ctaaggtacttggcctttggccccagctgagctccttgccaacaaccaaagccagcacggcgccatggagtgagtcatcttgg

SEQ ID NO: 6838702 - DNA, 55 bp, Homo sapiens
gctgccagcacacaggtgttagagagctggctaatcaccactgtgttctagttgc

SEQ ID NO: 6838703 - DNA, 60 bp, Homo sapiens
gctgggattacaagcatgagccaccgcagctggtcatgtttatgacttctaatctgaagc

SEQ ID NO: 6838704 - DNA, 58 bp, Homo sapiens
cctctttgagattcagttttcccacctgtgaaaggaaatgtatgattctcatcagagg

SEQ ID NO: 6838705 - DNA, 89 bp, Homo sapiens
tgtgttactatgagggtggcactggtggctctatttatttattcatttatttagacagagtctcgctatgtcacccaggctggagcgca

SEQ ID NO: 6838706 - DNA, 89 bp, Homo sapiens
atggacttctcgcacgggctggcgctctcccagcgctgccccaacgccgtggagccgctgtgggtggagggcgccgggcacaaagacat

SEQ ID NO: 6838707 - DNA, 91 bp, Homo sapiens
gaagtcaagacactatttctcctccactgtaggatcctgttcactgaggagccacagtgcaagagagaaaagtttcttccaacctgacttc

SEQ ID NO: 6838708 - DNA, 74 bp, Homo sapiens
gcaggaaaggctgacttcatgaacatgtggcctgtgtagccacagagggccccaagttcagaaaggcctcgtgc

SEQ ID NO: 6838709 - DNA, 84 bp, Homo sapiens
gcggggtctatttctctaccccttgaatctgagcagggctcgtgccttgctttggccactagaattcagggggatggcccgtgc

SEQ ID NO: 6838710 - DNA, 74 bp, Homo sapiens
tcatgcggttaggaaatgtaaaagtagataagaattacgggttttcttgtacaaatgcatattcctgggcgtgg

SEQ ID NO: 6838711 - DNA, 123 bp, Homo sapiens
cccctttcctttcgtctggccgtgctggcggggctggctctgggcctcagacactctggaatcgccaaggtctgagctcagggcctggcccccttcccaggctaacagccgggaggacggggg

SEQ ID NO: 6838712 - DNA, 79 bp, Homo sapiens
gcattaactgtaatctaaacttgaggccaggttctgaactagagtaatggccgtaggttgggaaggaaggagttaatgt

SEQ ID NO: 6838713 - DNA, 82 bp, Homo sapiens
ggccatagctacttcgtaagtctgtgtacaaaaacataataaaactgttgtctgtacaaattttctgtgtcagctgtaggct

SEQ ID NO: 6838714 - DNA, 109 bp, Homo sapiens
tttgctacaaagctttcttaaggtgctactaggcatagatgacatccacaacctaaaagaagagtgtcagtgccttgggtattttgagtatgtgtttacattgtgcaga

SEQ ID NO: 6838715 - DNA, 79 bp, Homo sapiens
cactcttcccatgggcatgttcttagccagtgactgagtgtggcagggatactaaggcaggtccattccaggaaacgtg

SEQ ID NO: 6838716 - DNA, 56 bp, Homo sapiens
caggttgaaagtggaggagctagaaaagcccacaagaaattcctcactgtagcctg

SEQ ID NO: 6838717 - DNA, 65 bp, Homo sapiens
gggggatttcagccctgggggtcattggaaatatcactcaaatgactctgctgcagagacacccc

SEQ ID NO: 6838718 - DNA, 72 bp, Homo sapiens
ccccagaatacttcctgtgttgcatcgttaaatatcaactgagcaggagcagctcaagagtagttcgagggg

SEQ ID NO: 6838719 - DNA, 78 bp, Homo sapiens
ggtagtaccagatgagctgagatcatgtacactagtggttgctccctacattaaattggcttacttatctatgctgct

SEQ ID NO: 6838720 - DNA, 55 bp, Homo sapiens
tgactgtgcctgttgaatgaattgacaaggagattcatgaaacatgacacggtca

SEQ ID NO: 6838721 - DNA, 129 bp, Homo sapiens
atgtaattcctgtcttcagagagcttgcagactgatggggaggtgcaatctgaatgtaatgcagtttatgtttacatagtagctgccctgtattaggccttgagctaagcacatttatgcaggttatct

SEQ ID NO: 6838722 - DNA, 57 bp, Homo sapiens
aatatggtagttactttttacgtcttcctggtggaggaaaaaagaggctataatatt

SEQ ID NO: 6838723 - DNA, 80 bp, Homo sapiens
tggctgtgaattattcttaactggctcaaggatgagaagaggaggaattgtgtgggtgaggaagattctttatgcagcca

SEQ ID NO: 6838724 - DNA, 92 bp, Homo sapiens
tcaaaagcgggttttgtgaatgtaggttgtccatgacacccacaaacagatgtgttttctacaaacctggttctcataccttgcaattttga

SEQ ID NO: 6838725 - DNA, 62 bp, Homo sapiens
tttacacttattatgaagcttttcctgtgaagttatacaacctgagttttaatgagtgtaaa

SEQ ID NO: 6838726 - DNA, 101 bp, Homo sapiens
gggccccgttgtgtgtccatttgggctttgctggggtccctggtctttttacccaggaggcccagaaggaagcccagactctcagggcctgcccggggtcc

SEQ ID NO: 6838727 - DNA, 59 bp, Homo sapiens
ggtcagaaggagaaatgtgtgagtgagcagtagcagctacatgacactgttcctctgcc

SEQ ID NO: 6838728 - DNA, 69 bp, Homo sapiens
gtcttagttttgaagaattaacagctgtggatgagagtctttgcacacagcgattcttctctttaggat

SEQ ID NO: 6838729 - DNA, 61 bp, Homo sapiens
attatactgtaggtgcagaaagaaaataggatcttaagtttgccctgcaatatagtgtagt

SEQ ID NO: 6838730 - DNA, 69 bp, Homo sapiens
cttgacattggtcacatgtttcaggccatatttgctattttttagcaagcctaatcatccagtgtgaag

SEQ ID NO: 6838731 - DNA, 91 bp, Homo sapiens
ggcctgcgcacctgttccccagggcccaagccgccttccagagacccataggtttgggaagcaggggcttggtcaccggggtgcgcaggtc

SEQ ID NO: 6838732 - DNA, 73 bp, Homo sapiens
ctacatagtgttagctgctgattaaatatgttgttggggcagcaggtaggaggggtcatagttgatgggtgag

SEQ ID NO: 6838733 - DNA, 67 bp, Homo sapiens
aaattatttcactctgctggacctcagtttactcatatgagaaacaggtggtcgaatgaaataattt

SEQ ID NO: 6838734 - DNA, 64 bp, Homo sapiens
tacctgatctcctgctgtgttgggatcatcctctgcaatgtccctgcactaagaggagaaggtg

SEQ ID NO: 6838735 - DNA, 63 bp, Homo sapiens
tggactccatggcttacaaacaatagaaatttatttctcacagttctggagcctggaagtcca

SEQ ID NO: 6838736 - DNA, 61 bp, Homo sapiens
tttgacaacagcaaatgtcacacaactaaaatgagttggatggttcatcactgatgtcaga

SEQ ID NO: 6838737 - DNA, 63 bp, Homo sapiens
cccatttatgactacacaggtgatccatggaaagaatggattatgtgtggatacatacttggg

SEQ ID NO: 6838738 - DNA, 67 bp, Homo sapiens
ggcctcagaccggagctggccagtgtccttctcaccacattccactggtcagtgcagtcatggggcc

SEQ ID NO: 6838739 - DNA, 70 bp, Homo sapiens
atctagactttctgggtcagtattttggcttctccagaatccgcttgactttgaagtatcaaacctagat

SEQ ID NO: 6838740 - DNA, 105 bp, Homo sapiens
gggaagctgatcttacatctttcactcagtaaaaacaggcagcactcagattcccctctatgggtgttgtttctggtactgaatatagaagtatatcggcttttt

SEQ ID NO: 6838741 - DNA, 59 bp, Homo sapiens
gtgtgggcagctggagctgttcagtcaagaaggaagctgattcagcccagctcccacac

SEQ ID NO: 6838742 - DNA, 58 bp, Homo sapiens
aacccacttgtttgattattgcctgaggagacattcctctatatggaataggtgggtt

SEQ ID NO: 6838743 - DNA, 80 bp, Homo sapiens
aatcttaaaatccataatgttgtggggtttgtaaaaattgtgtcaaatttagtttaatattatgtgaaaattttaagatt

SEQ ID NO: 6838744 - DNA, 82 bp, Homo sapiens
tgttgaggttaagtttgctgaatggtaaagaagtataatttttgaaattgttttctgtcgtcagttagtaaatcaatcaaca

SEQ ID NO: 6838745 - DNA, 55 bp, Homo sapiens
tcctagctcaaggttttccatatatttaatagtcagtatatgcttgagctaagga

SEQ ID NO: 6838746 - DNA, 101 bp, Homo sapiens
aaactatgatttaagaatatgacattgaatatgttaactagactcacttgagatggatagtcactaacagttcattgtagccctattcagatcacaggttt

SEQ ID NO: 6838747 - DNA, 75 bp, Homo sapiens
gtgttcatttaatccgtatttattgatcactcgtcttacacagtgtacttaggaatacagagataaatagaacac

SEQ ID NO: 6838748 - DNA, 70 bp, Homo sapiens
ttagattggtgcaaaagtaattgtggttttggctgaaaagtaaatgcacaaagattttgcactaatctaa

SEQ ID NO: 6838749 - DNA, 96 bp, Homo sapiens
aagttatcattctctgggcaaaggcaaagttcacacagcaacatccttgcatgttctggaggacaactgttttcactgttccagactgggtaattt

SEQ ID NO: 6838750 - DNA, 97 bp, Homo sapiens
tatgcttactgtatgccaggtggtgttctacaccgtatcttgtgaggattgagttcatataaagtgtttagaaagctgcctgtactcagtaaacata

SEQ ID NO: 6838751 - DNA, 75 bp, Homo sapiens
gagaagagcctgggcttttgagtcacaagggccttgggcaagtcccttaagctcttggaggctcagtttcttctt

SEQ ID NO: 6838752 - DNA, 67 bp, Homo sapiens
agaaggccctggttgctcacccttccagcaaaggcttttgctaggagaggcagcacagcggccatct

SEQ ID NO: 6838753 - DNA, 83 bp, Homo sapiens
ttttgtgatgcatttgtcttgtctcatgaactaacttgtaaactctatgaagtccaggaccaaagacacatgtaatctcaaga

SEQ ID NO: 6838754 - DNA, 95 bp, Homo sapiens
tactgtgcagcagaggtctgacactgaatggtactaccagtcagaaggctggggaacaatcatacatgctttagacctctaagagcctagcagta

SEQ ID NO: 6838755 - DNA, 72 bp, Homo sapiens
gaggcggaggctgcagtgagccaagatcgtgccattgcactccagtctgggaacaaagcgaaactctgcctc

SEQ ID NO: 6838756 - DNA, 97 bp, Homo sapiens
tgcaaaggagaatgagaagagtgtggttcttgcccgcatggagctgtgtcaggcatcatgctaaatgctgggggtacatcctcattttactcttgca

SEQ ID NO: 6838757 - DNA, 112 bp, Homo sapiens
tatgtacaaatgccaagtagacatgggcagaagtggcatcattaacatctactgtatcatagttaaccatccactcatgttcattcttcactgccattggttctttaaagta

SEQ ID NO: 6838758 - DNA, 80 bp, Homo sapiens
cttttcagaatgccaggagagtgcatgcagggattccatctgatcaccctcagtgctctctctctggtcctgctggatag

SEQ ID NO: 6838759 - DNA, 81 bp, Homo sapiens
cccttcctggcgcaaggctggtcacctccttcccagctactgtcttgtctttggggctgaggttgaacctgccaggaaggg

SEQ ID NO: 6838760 - DNA, 67 bp, Homo sapiens
gagctgcattttctttcttctttcccagtgatgggccattggtcaccataaagaagaacatcagctc

SEQ ID NO: 6838761 - DNA, 80 bp, Homo sapiens
tggcaaagtttgcttctctacttcctggaaggggttttgtgagaacctgtgctcctctcaaaagtaggttgacttttcta

SEQ ID NO: 6838762 - DNA, 61 bp, Homo sapiens
ctggcttttggaggagggtcagagttcacgccgctctctggaaataactgctcaaagccag

SEQ ID NO: 6838763 - DNA, 94 bp, Homo sapiens
atgactatttttagctgcatatgagaataggagaaagtccatacagaaattttatactttctctctcctccatgtgcaagagcaaagatcccat

SEQ ID NO: 6838764 - DNA, 75 bp, Homo sapiens
gttccattgccattgccattggcccagccctgctggttgggacctggagggctggactaaggaaagcaaggggac

SEQ ID NO: 6838765 - DNA, 74 bp, Homo sapiens
agcctatgctgaactgagatgtaacttttctcattgctagaaaaagtcatgtaaaccagtttgctcccaaggct

SEQ ID NO: 6838766 - DNA, 68 bp, Homo sapiens
tacttctttgagactcgatattctcatatgtataaaaaggagatgatgatggtagcctcatagaagta

SEQ ID NO: 6838767 - DNA, 67 bp, Homo sapiens
gaagatggtgagcaattcagttccaggaaacaaccctcttcctgagttctaggctgccaccttcttc

SEQ ID NO: 6838768 - DNA, 55 bp, Homo sapiens
tgaaaactccaagtttcatcagttagcctacatctgatgaagattggtaaattca

SEQ ID NO: 6838769 - DNA, 79 bp, Homo sapiens
ttcttgggagtatttatactggctagtgtttgttcttatagcggtccatctctgcccagtttgggagcctttccaggaa

SEQ ID NO: 6838770 - DNA, 69 bp, Homo sapiens
tgcaacatactccctggggctattatgaggctcctggggctattatgaggcttagggatgacatctgcg

SEQ ID NO: 6838771 - DNA, 74 bp, Homo sapiens
ttcaggggagtagacagacccatggctttatgcttctgttgttgaggtccttcttctgctctatggaccctgaa

SEQ ID NO: 6838772 - DNA, 126 bp, Homo sapiens
ttcccttcaattactgctccctgcccgtcttggcacagcttgtcataaactcatttatactaatgtgtgagtggctaagtgtgccttcgaacttggccggcagaggggtgaatctgatggagggaa

SEQ ID NO: 6838773 - DNA, 90 bp, Homo sapiens
ttaatacaattagctttagggaggacagttacaacaggaagcaaattccttgcagcatccggtcctctcttagccatgttagttgattaa

SEQ ID NO: 6838774 - DNA, 84 bp, Homo sapiens
gcctactagatatgtatgaggagtatgtattttccacacattttcccaggacacgaatgcttttcctctgtaaatatttgtagc

SEQ ID NO: 6838775 - DNA, 88 bp, Homo sapiens
cctccagaatcaatgctatgtaactggcagatagattgtcattatgctgaatttgtcccaggacttgcatagatatcttctttggggg

SEQ ID NO: 6838776 - DNA, 62 bp, Homo sapiens
aaccacactggctagtgaagaagcaggagcttcttgttttaattgctcaccaatggttggtt

SEQ ID NO: 6838777 - DNA, 59 bp, Homo sapiens
accttaagatcaaacattctttgggaaatacttctaatctcagagtgagattatagggt

SEQ ID NO: 6838778 - DNA, 96 bp, Homo sapiens
agaaggggctggctgccaatgtgataattgagaaacacctggtgaaaatgtctctctattaattgacaatggctttctcctccctagtcctcatct

SEQ ID NO: 6838779 - DNA, 80 bp, Homo sapiens
gttatttagcaagagtacaaaataaaatctgaatttacatggctcttttaagaaattgttttgtagatttgataagtagc

SEQ ID NO: 6838780 - DNA, 85 bp, Homo sapiens
tttgactagatggttctctggcataaaatctacactttcaggcaaaatgagagtctgaatgctcagagttggatatctggtcaaa

SEQ ID NO: 6838781 - DNA, 68 bp, Homo sapiens
actaagatgcaggaaatgctagagaaattgctacaatggtggctttagctttggatttccagatcagt

SEQ ID NO: 6838782 - DNA, 74 bp, Homo sapiens
ggcctctgggctgctgacaattttatagctacagatggtaaagaaatgtcagggcagtcctctttatggaggcc

SEQ ID NO: 6838783 - DNA, 88 bp, Homo sapiens
ggttgtaaattacccttttaattctctcctcttcagaggtctccagactgagcctctcttggggaaagagaagaatgtggcatgcacc

SEQ ID NO: 6838784 - DNA, 60 bp, Homo sapiens
ttgaggccccatggatgagaacattctgtaattctctgtgtacttgtttatagggcccag

SEQ ID NO: 6838785 - DNA, 65 bp, Homo sapiens
aggcttttttctccgagtggtctgtcttaggaaaatgtttgattatcttggcttgaaagatgctt

SEQ ID NO: 6838786 - DNA, 72 bp, Homo sapiens
tggagaaaaaggaggcagcaaatgtggagcttccttgatctgtctctcttgattgcttgcctgcctttccca

SEQ ID NO: 6838787 - DNA, 62 bp, Homo sapiens
tcctgcatgtcactctgctgtccctgaggtgcacacactgggggtgctgtggtcatgcagga

SEQ ID NO: 6838788 - DNA, 68 bp, Homo sapiens
cgccactcagcccacccactggactgcagcagaggagtcggctgccagccagggtgggatccaaggcg

SEQ ID NO: 6838789 - DNA, 101 bp, Homo sapiens
gtttaagcaacatggaatggttgcatgtggcgtttctgctgacaggccaaattaaggccccagccaacagccagcatcaaccaagatacctgtgcatgagc

SEQ ID NO: 6838790 - DNA, 60 bp, Homo sapiens
tccagagggacgttaccagttcatgtacacctcccattctggatttatgctccttctgga

SEQ ID NO: 6838791 - DNA, 80 bp, Homo sapiens
ccaagccatgaaggggatcggtgagtgggtgttggcagccttgccacctctgctcaagacccctccgctcacagccctgg

SEQ ID NO: 6838792 - DNA, 105 bp, Homo sapiens
gagctgtggactatcatgaaagggagagaactgtcaagaagatgggatatgagatgtcaaatttttattgcagtataattcctgtatgattttgatgcccagttc

SEQ ID NO: 6838793 - DNA, 86 bp, Homo sapiens
ggctgggggagcagccggcccgtgctgggttctctctgatggatcacagtgagcaacagaagcgtgggtgggtatcaccttcagcc

SEQ ID NO: 6838794 - DNA, 59 bp, Homo sapiens
tgcttggtaaatcttcactaagactgagtagtaaatttgctctgaagaattagagagca

SEQ ID NO: 6838795 - DNA, 69 bp, Homo sapiens
tgacttcttacagtgatcaacacaaagattatccagtagtctttggttgaatttattgtcttgacttca

SEQ ID NO: 6838796 - DNA, 69 bp, Homo sapiens
tcttttcaggaatggctctagtcctattcctagggattgattttacctcagggccagatcttgcaggga

SEQ ID NO: 6838797 - DNA, 93 bp, Homo sapiens
aaaatttgtagtctgaacctttttagatgcagaatagttacaaaagtattggctttgatatctaaagggataaagacattatttgcatatttt

SEQ ID NO: 6838798 - DNA, 70 bp, Homo sapiens
ccagggtgggtctgtgtgcacagcgagtgcctgggccaggcatttgactcagtgactgggtttgctctgg

SEQ ID NO: 6838799 - DNA, 87 bp, Homo sapiens
gggtggcacagttagggactcctgtaagtgttctgccttggctagacagacttcacctacagcagtctcttgaaaacttggttgccc

SEQ ID NO: 6838800 - DNA, 87 bp, Homo sapiens
tcctagcacctagcctggtgcactgcacatcgtcaatatcaacaagtgcttgctgacgaatggagtgtgaaatggcatggggcagga

SEQ ID NO: 6838801 - DNA, 84 bp, Homo sapiens
ggcaggcatagcgttaaggtttcaaggggtggaaagcttattctccacacctctaaatttccttgagcattttggcggcctgcc

SEQ ID NO: 6838802 - DNA, 79 bp, Homo sapiens
cctgagtccctagggccccccaaaagcccagaggtcaccgggcaggtggagggcagtgtcggggcccagggatgagagg

SEQ ID NO: 6838803 - DNA, 73 bp, Homo sapiens
ccaggatgcgactccccagagggcccctggactgtccatccctgggacaggaggcctctggagacatctctgg

SEQ ID NO: 6838804 - DNA, 78 bp, Homo sapiens
gggcacccaaggagagagagcaggccgggcgcaaggactgttgaccgctggccagccctcttcctccacacggagccc

SEQ ID NO: 6838805 - DNA, 129 bp, Homo sapiens
gatggggttggggtgggagtctgtgtgtgaaagcttgtcctctgtagctcactggatctcagcccagactgctcctcagaatcacctggcagctttcaaaaaactctgatgtctgcccctcacctcctc

SEQ ID NO: 6838806 - DNA, 80 bp, Homo sapiens
gctagacaacctctggagtaactctgtttctggtcatggatatgtaaatgcgagttacagttattccattaggtatctgc

SEQ ID NO: 6838807 - DNA, 76 bp, Homo sapiens
ggctcaccaagcagagactctgggaagaggcccagtggcctcccagacagaccagaggtcctgctcactggtgtcc

SEQ ID NO: 6838808 - DNA, 95 bp, Homo sapiens
tcttgtagaattagaagcgcaggtgaccagaagtcggcggtgttaaagaagccacatcacttctctggctatctgtttctatgtcttacactaga

SEQ ID NO: 6838809 - DNA, 67 bp, Homo sapiens
agaattaaggatgtccattagaaggtcaaggtcagcatccaggccagagttgatggcatcttggtct

SEQ ID NO: 6838810 - DNA, 61 bp, Homo sapiens
ctcccttgacagagactgccttttggagccaatcacaatggaggtttactctgcagctgag

SEQ ID NO: 6838811 - DNA, 96 bp, Homo sapiens
tcatgccaatgggaataaagtagggattcttctcactgagctggaataacctgcttaggggttaaaggatccaaacttgcttcctttggggcatga

SEQ ID NO: 6838812 - DNA, 82 bp, Homo sapiens
tattgtggctttctctttggatatatatttcagtctcccccgagagaaaagaaatgtcatatttaagtaggaacatacttta

SEQ ID NO: 6838813 - DNA, 55 bp, Homo sapiens
ttattgtgcatctactgtgtgcaggccctgcctggacactggggatgcgcagtgg

SEQ ID NO: 6838814 - DNA, 72 bp, Homo sapiens
caaatttaaacatgtgatatatgatcctgctggaaactgttttagcaacatggttatcacattagaaatatg

SEQ ID NO: 6838815 - DNA, 57 bp, Homo sapiens
gaagctgacggcccggcagcgccgccttccatctggtccacccgagcctgcagcttc

SEQ ID NO: 6838816 - DNA, 65 bp, Homo sapiens
acatataatgggtgtggcagaaggcttggtatttatggcatttctgtcatttagcattgtcatgt

SEQ ID NO: 6838817 - DNA, 76 bp, Homo sapiens
tggagagggcaaagtcagggaagagtggctggcatattgctagagagtcccttccgatttacctctgctttctcca

SEQ ID NO: 6838818 - DNA, 62 bp, Homo sapiens
actcccttgtgaactcattcttggtgcatctctagcttccatacactgtgggcacagggagt

SEQ ID NO: 6838819 - DNA, 68 bp, Homo sapiens
tgggttgctggggcagagcctttagcaaaggggtatccaccttgaggacctgcccctgtaaaaaccca

SEQ ID NO: 6838820 - DNA, 60 bp, Homo sapiens
gcagcccccatggggaggtcaagggtctgccctgcccttgggccagcccagggggcatgc

SEQ ID NO: 6838821 - DNA, 63 bp, Homo sapiens
aagaggtaggagctgaggtgaggctgaaagataaggccagaccactgagtgtcttgcctgctt

SEQ ID NO: 6838822 - DNA, 97 bp, Homo sapiens
tgttcctatttggaggaagcccaagccagcagtttaatgactcagcatcaacctgagttttgactgttggtcttaccttgtccctcagatccaaaca

SEQ ID NO: 6838823 - DNA, 69 bp, Homo sapiens
gttaaccctggaaagttaaagagaattagaagttttcaatgtaacatttccaggcaggaaagtgttagc

SEQ ID NO: 6838824 - DNA, 61 bp, Homo sapiens
gggtccttgggtctcctgtgtttggactagcctgtccataccccaggagcccaggtggcct

SEQ ID NO: 6838825 - DNA, 80 bp, Homo sapiens
caagagctccctgtcacgagaggcacagaatagagctttgtctcttaaaaaggcttgattgcttctacgtgactgtcttg

SEQ ID NO: 6838826 - DNA, 55 bp, Homo sapiens
tgtttgcaggaactctggggagagtgccgtggcttctcccacatttcttcaaata

SEQ ID NO: 6838827 - DNA, 75 bp, Homo sapiens
agagtgttcctgctgcacgggcgcccccagatgcacaacgttcagcagattgaagcctgggggtgctcacgctct

SEQ ID NO: 6838828 - DNA, 58 bp, Homo sapiens
gtcttgggatcacctcctggcttgtccatcatcatcaagtactttgggattctaggac

SEQ ID NO: 6838829 - DNA, 55 bp, Homo sapiens
aaagagtctggcgttttaatggagaggttctactcaccaaccttgccagttcttt

SEQ ID NO: 6838830 - DNA, 60 bp, Homo sapiens
ttagtggcagcagttattaatgtgatgctagtctatgtgtcacaaatgatgttgcactga

SEQ ID NO: 6838831 - DNA, 80 bp, Homo sapiens
aaaacagaggtgcctgggcccatcctagatcaattaactcaaagtctctgcagttggagcccagacactggcattgtttt

SEQ ID NO: 6838832 - DNA, 59 bp, Homo sapiens
aacttccttgggtatgaaaacacttaagttttcttttctccccaatgccccaggcagtt

SEQ ID NO: 6838833 - DNA, 64 bp, Homo sapiens
aggttgccctgagaagacttcataacacagggctgtcactcataagctcttctcagggtcacct

SEQ ID NO: 6838834 - DNA, 59 bp, Homo sapiens
tctgcctaggtttccaatgtgcttattaattaatgatcacatttctgtacttaggtaga

SEQ ID NO: 6838835 - DNA, 78 bp, Homo sapiens
cctgggaccaggtacacggtgtttccatggcctggacatcatcccagccctggcaagtgctgtgtagcttcttctagg

SEQ ID NO: 6838836 - DNA, 68 bp, Homo sapiens
ctgctcctggtgactcccagataaactacctgcactttggtctttatcttgggctcagcattcagcag

SEQ ID NO: 6838837 - DNA, 127 bp, Homo sapiens
ttattatttattttgagacggagtctcgccttgtaacccaggctggagtgcagtggcgcgatctccgctcactgcaagctccgccttccgggttcacgccattctcctgcctcagcctcccgagtag

SEQ ID NO: 6838838 - DNA, 86 bp, Homo sapiens
tcaatgagttatgtctcccagaagtcatgcccttgagaaatcacaacctacattgactctggggttgaccagatgacttgctttga

SEQ ID NO: 6838839 - DNA, 70 bp, Homo sapiens
ttgtctatttgttcaggtaagggacagcattattattattagcacctcttaccctggagcaaatgttcaa

SEQ ID NO: 6838840 - DNA, 59 bp, Homo sapiens
gatgaaatagcaaaggcatttgagattagagtccaaagggccttgaatgctattctgtc

SEQ ID NO: 6838841 - DNA, 66 bp, Homo sapiens
agactgtaatttgtggcctccttatcagatgccatgcaaaatgttttctgtgggtcacaacagttt

SEQ ID NO: 6838842 - DNA, 88 bp, Homo sapiens
ttgcattcttctaaatgtagccgccttgtttcagcatgctgtgatttcctcatattgttgactataagagtaactatttcaggagcag

SEQ ID NO: 6838843 - DNA, 66 bp, Homo sapiens
gccctctgcctgtgtcgccaccacagcccacagggctcagatgtggtttcacagacccagatgggc

SEQ ID NO: 6838844 - DNA, 69 bp, Homo sapiens
cttgaacccgagaggcggaggttgcagtgagctgagatcgcgccactgcactccagcctgggtgacaag

SEQ ID NO: 6838845 - DNA, 70 bp, Homo sapiens
tcctcctgtccatctccaccatctgggaggacaggtcctcctgggagcagggatggatggtctaggagga

SEQ ID NO: 6838846 - DNA, 83 bp, Homo sapiens
atatgagcacatttcacatgacaggctcttaaatgcaagtgtgtgtgcgtgtatgtgtctgtggtgtgtgtgtgtgtgtgtgt

SEQ ID NO: 6838847 - DNA, 78 bp, Homo sapiens
gcgtggccaagcggccctgaccagaccttagttgctgtcaccaaacaaacaaaggtgggctagggctggttgcctggc

SEQ ID NO: 6838848 - DNA, 62 bp, Homo sapiens
tggccagattcatgcatgtatcacccagcagttagcgatgagcactcatgagctctgggcta

SEQ ID NO: 6838849 - DNA, 68 bp, Homo sapiens
tcccctcgttggtcaaactgcttatagggcactattttcttaagcaaatagctagatcagagaggggg

SEQ ID NO: 6838850 - DNA, 121 bp, Homo sapiens
ttctgtctggacttatctgagtcactttctattctctgcagctgaatgtttcctaggtttctacactccagacatctctctgcaaaacgagattgaaagagactcagtcttctacccagaa

SEQ ID NO: 6838851 - DNA, 100 bp, Homo sapiens
aaaatctgaaatccaaaatgccccagtgtgtgcttcctttgagtgttatgttgttacccaaaaagcttttgattttggagcattttagattttggatttt

SEQ ID NO: 6838852 - DNA, 85 bp, Homo sapiens
attgtctaaattgactttctagactgtccagatgatcgctcaagcctctgaattattgacagtttagatgtgagtttatgataat

SEQ ID NO: 6838853 - DNA, 63 bp, Homo sapiens
ttcctcaactcaaggaagacccacgcagatatgctctatgtttgccctcttccatgagaggaa

SEQ ID NO: 6838854 - DNA, 88 bp, Homo sapiens
gggactacaggtgcgtgccaccatgtctggctgagttttgtattttttgatagagacggggtttcgacatgttggccaggctggtccc

SEQ ID NO: 6838855 - DNA, 56 bp, Homo sapiens
ggagctaataagtggcagatgcagtctatttgactccagtgcctatcattaattcc

SEQ ID NO: 6838856 - DNA, 67 bp, Homo sapiens
gcttgtcaggtgtttattgaagctagcttgggttgttctgtgagagtgtctaaacacagggacaagc

SEQ ID NO: 6838857 - DNA, 64 bp, Homo sapiens
caggctctggaaaaccactagcaggaaattacgttttcccgttaggttcatccatgattatctg

SEQ ID NO: 6838858 - DNA, 64 bp, Homo sapiens
ggtcttctcccagagtttgctgcacattggccatggatacaaatgtgcagagggtaggaaggcc

SEQ ID NO: 6838859 - DNA, 64 bp, Homo sapiens
agtgactggatgctaagcgttggagacttgtccacattctccacgtgatggagtccaggccact

SEQ ID NO: 6838860 - DNA, 56 bp, Homo sapiens
tcttccagctccccacggtgtccacaaccccctgagggcagatgggagatggagga

SEQ ID NO: 6838861 - DNA, 55 bp, Homo sapiens
gcacatttttgttgcctctagttatactcttaacttgggcctcacaaatgttagc

SEQ ID NO: 6838862 - DNA, 59 bp, Homo sapiens
gtctctgacaagctgagcgaacagcacttgacagttggagcacagctgagttcagggtc

SEQ ID NO: 6838863 - DNA, 55 bp, Homo sapiens
ccatggctaactttgaagtgtgcgtgcctctttgagcacatcagcagggctgtgg

SEQ ID NO: 6838864 - DNA, 69 bp, Homo sapiens
cccggagtcccgggtcctgcttcctgctcaggttttggtctggaatcttcagggtcctggggctccggg

SEQ ID NO: 6838865 - DNA, 66 bp, Homo sapiens
gatttaaagagttatagttggtatgtggtgaagtttgccaagtatgggctgtacacactgaggatt

SEQ ID NO: 6838866 - DNA, 83 bp, Homo sapiens
ggcataaaaatatatctctgtaattacatgatatttagtgattagataattatggataattgcatggggtagttctaagtgct

SEQ ID NO: 6838867 - DNA, 61 bp, Homo sapiens
gggcactgggaagactggaattgctcagcacagcagaggagaatctggcttcccagagtct

SEQ ID NO: 6838868 - DNA, 59 bp, Homo sapiens
aaggtttggattttgtttatttattggtttgtttcaacctgttccaaaggccagacctt

SEQ ID NO: 6838869 - DNA, 73 bp, Homo sapiens
gttagcctaaaaatgttgttttcatgcataatgtagctgttaaatagtacagtgtttaaaataatatgctaat

SEQ ID NO: 6838870 - DNA, 82 bp, Homo sapiens
tctaaatttggcaagtttcactaaacaaatgtttctgtaagaatttcatagaaaagtgctctagtgagagcttatctttaga

SEQ ID NO: 6838871 - DNA, 106 bp, Homo sapiens
gccgctgggtgcgcgtggccgccaggtcctcgtccaccttggtgcgcacaaagtagaacttcttgccctggcacaggatctcagcggccaggcgggtctcgacggc

SEQ ID NO: 6838872 - DNA, 55 bp, Homo sapiens
tttaggactgtgacttttatggtttgtttatctagatagaatcacaagtcctgaa

SEQ ID NO: 6838873 - DNA, 61 bp, Homo sapiens
ggtcatgaaaccagcaaggatgagacacaaaattttaacccatgcttctggaaccatgatc

SEQ ID NO: 6838874 - DNA, 59 bp, Homo sapiens
gagcttcctggatgaagcccagcataaatgtcttgtgcttatccccattctggaggctt

SEQ ID NO: 6838875 - DNA, 58 bp, Homo sapiens
ggctcatgcctgtaatcccagcactttgggaggccaaggtgggaggattgcttgagcc

SEQ ID NO: 6838876 - DNA, 59 bp, Homo sapiens
tgtggataagacaagtcaggtatataggtaacgcccatgtcctggaggcttcatccata

SEQ ID NO: 6838877 - DNA, 66 bp, Homo sapiens
ggccctgcctgctgccctccagagcctgagaacacatgacttcagccttaaacatcaggcagggtc

SEQ ID NO: 6838878 - DNA, 88 bp, Homo sapiens
gtaattttatttgtatttcatgcagtaaaattggaccagtgattgtgtttgacctggcctatttattgtgttgaaactgaattattac

SEQ ID NO: 6838879 - DNA, 75 bp, Homo sapiens
tttttcctctgtgccagcagttatggtgatttgtagttatgctataaaagcttaaggtttggtagtagagaaaga

SEQ ID NO: 6838880 - DNA, 65 bp, Homo sapiens
gtcgcccaggctggagtgcagtggcgccatctcggctcactgcaagctcagcctcccgggttcac

SEQ ID NO: 6838881 - DNA, 56 bp, Homo sapiens
catgtttatggagcaggtattaggtgtcttgcactgtaccaggccctgtggacatg

SEQ ID NO: 6838882 - DNA, 64 bp, Homo sapiens
agaaaatgtgtgtgtgtttgtgtatgtgtgtgtacatgtgtgcataaacagatacttcatgtct

SEQ ID NO: 6838883 - DNA, 75 bp, Homo sapiens
gttccttcaagatgccatctttatttctgaatcccccatgccctgtgtgatgacattcagagatgaaggaggaac

SEQ ID NO: 6838884 - DNA, 68 bp, Homo sapiens
gctgaactgtttctggtgaaagagtagccttccttcgcgggcactgacactgagggaagcagctcagt

SEQ ID NO: 6838885 - DNA, 64 bp, Homo sapiens
ggagaaggcgaagtcattctttgtcagctaactcatgggaagggaaaacagactttctttctcc

SEQ ID NO: 6838886 - DNA, 62 bp, Homo sapiens
aaatcacagggtctctaagtattctcatgtgtcattggtttgtatagaggcttgattgattt

SEQ ID NO: 6838887 - DNA, 62 bp, Homo sapiens
ggtcaataagtggtcatttgtttttgcatttaacaaatgttgagaaatgactactctatacc

SEQ ID NO: 6838888 - DNA, 75 bp, Homo sapiens
ggactgatgtcagcctttggttatcttggacatgaaggattacaatagctgagtcatcaaaggctgattcagtcc

SEQ ID NO: 6838889 - DNA, 113 bp, Homo sapiens
acacacagatagaagctgaccttcacctctgtcttacctggtactgtttaggacgtagctgaactaggtccctggtaggtatggaaaaggaggttgagctctcttttgtaggt

SEQ ID NO: 6838890 - DNA, 66 bp, Homo sapiens
accatgcttccaaatgtctattaggtcaattgaaaatgttcaaaggccttaaagagcatgcctggt

SEQ ID NO: 6838891 - DNA, 74 bp, Homo sapiens
gggttttcaaaataattgcagttctgtgttatatcccatttgggggaggtgacaggatgcagataaacaaaccc

SEQ ID NO: 6838892 - DNA, 108 bp, Homo sapiens
taatttgaatttcagattaacagtgtatcattttttgatataagtatgtcacaaatattgcatagacatactgaaaaatgatttgctgtttacctgagattcatatta

SEQ ID NO: 6838893 - DNA, 130 bp, Homo sapiens
cagtagattgtataagattcaagcctgtgattgattaagtatgaaagttaatcaatttaatttatgtgattgatgttgattctttcattttgaaattgcctgtttgtatcttatttttatcaagatactg

SEQ ID NO: 6838894 - DNA, 74 bp, Homo sapiens
ctctggcaatctgattctgcatctgtcttggttgcatcttctctagaacttgattcaggattagttgtccagag

SEQ ID NO: 6838895 - DNA, 68 bp, Homo sapiens
gtgatcagtgttttgtgcattcttgaaagggcaagggttgtcataagaaagagcagaaagcacttcat

SEQ ID NO: 6838896 - DNA, 57 bp, Homo sapiens
agggcagagggagggcttctgagagctgacactgttctattgttctattttcgtcct

SEQ ID NO: 6838897 - DNA, 65 bp, Homo sapiens
tgggacctgctcctggaatgaggccgcccatgggaggccacatgcccgtgatgcctgggtgccca

SEQ ID NO: 6838898 - DNA, 58 bp, Homo sapiens
tgacatctgggccctcagctaaaagatggagtcctctaccggttggtgcccactgtca

SEQ ID NO: 6838899 - DNA, 57 bp, Homo sapiens
cccggggctgctatttttagctcccacgttgggagcctccaaatgtcaggtcccggg

SEQ ID NO: 6838900 - DNA, 66 bp, Homo sapiens
gtgattcaagaggaacaatgaagatccttggaaagtaacagcaatctttaaccctcttgaattgac

SEQ ID NO: 6838901 - DNA, 77 bp, Homo sapiens
gatggtggaggggactggagcaggagggagggggcagccctgtccactctccagagcccttccggccccaccccatc

SEQ ID NO: 6838902 - DNA, 58 bp, Homo sapiens
ctcaaggttgatatgtgttttcaaggaactagttcttgaaaaccatttgcatcatgag

SEQ ID NO: 6838903 - DNA, 73 bp, Homo sapiens
tggcctgtactgtacacagtggtgtactgtacacagtggtgtactgtacacagtggtgtactgtaaatggcta

SEQ ID NO: 6838904 - DNA, 63 bp, Homo sapiens
ttatgcatttattttcatgtgtaagaagaaaaacgtaactagcacgtgaacatgactgcatgg

SEQ ID NO: 6838905 - DNA, 77 bp, Homo sapiens
tgcagtcatgaagggggagaattaccaaaagcgcttccagaagtgttctaaaattctcccccgggggtgacacagca

SEQ ID NO: 6838906 - DNA, 72 bp, Homo sapiens
gagagcctacttctagggagacaacctgtctgatacagttagagcatccagaaaactctcagaagagctctc

SEQ ID NO: 6838907 - DNA, 101 bp, Homo sapiens
gcaattgtgtaaaacaactcagcacaatacctggcacttaataattactgcatgtaattataatgtatagctgtgcctgagaagtgaatgtacatgaaagc

SEQ ID NO: 6838908 - DNA, 75 bp, Homo sapiens
cggctgtcggcgcctcctgcgtgtccattggctccggaaacgggtgctcaccgtcgggggtcgctgtctcggccg

SEQ ID NO: 6838909 - DNA, 69 bp, Homo sapiens
agatgaattgttatggctacgagaggcataaagacttacagaaaattgtcctgtagatagcattcgttt

SEQ ID NO: 6838910 - DNA, 70 bp, Homo sapiens
agcgaacttcttggaatctgacggctgtgccttcaaccacaggctgctgtatttattttctagggttgct

SEQ ID NO: 6838911 - DNA, 83 bp, Homo sapiens
gagtagttgttgggattaactttttacttagagctaaataactttggatgagtattttaagttctcaatccctcgattccctc

SEQ ID NO: 6838912 - DNA, 61 bp, Homo sapiens
ctaccacacacacgtcttaggagtcattcagaagtataacactcttggctgggtgtggtgg

SEQ ID NO: 6838913 - DNA, 90 bp, Homo sapiens
ggggtggaggaggtattcctgcttcaggtagagggggtggaaggggtattcccactccgggtacagggggcagagagggtattccagctc

SEQ ID NO: 6838914 - DNA, 60 bp, Homo sapiens
atgttgtcctgaatttggagacttgtttaccaaggaagtcctcaattttcagtattccat

SEQ ID NO: 6838915 - DNA, 88 bp, Homo sapiens
tgtacatgatgtgccatcctgcaggacctccatatatagcttgtattttgtacagtgtggtggtctcaggatagtcacatttcttaca

SEQ ID NO: 6838916 - DNA, 107 bp, Homo sapiens
cttagttttaatgcagaagtcagatggcataggttggaattcagtttgaccctgtactgcggttattaatttccttatgcctcgagttcctgatctataaaagtgag

SEQ ID NO: 6838917 - DNA, 94 bp, Homo sapiens
ctgctctgccttctgtgctcagcagttgtttcggattgggagtcaggaggccattcccacacttgaaacaaggctgcaagaggaggctgagcag

SEQ ID NO: 6838918 - DNA, 70 bp, Homo sapiens
cagccagtgctcctcctccatgccacactgcacctcctagccctggcagtggataggggagcggttgctg

SEQ ID NO: 6838919 - DNA, 67 bp, Homo sapiens
tgaatgaagtaacagagggggtgttgctggttttatgactagaagcattgatctttttattaattca

SEQ ID NO: 6838920 - DNA, 63 bp, Homo sapiens
ggttcttgtttcaagctctgcttttggaaaaacctgaagacagagactctgcaacagggaacc

SEQ ID NO: 6838921 - DNA, 72 bp, Homo sapiens
gaactcaaacaggctttggcgaggcccatcatccctaaatggtgtgtgtcacggcagagcactgattgcttc

SEQ ID NO: 6838922 - DNA, 75 bp, Homo sapiens
gggggcgaaagttcattcctgtgaggacagcccgctccttggcatgtcacaacagaggaactgaattctgcctcc

SEQ ID NO: 6838923 - DNA, 56 bp, Homo sapiens
gagagctttcgggaggtgctgcagtgtctggcccgtgcttaccgccccagggctcc

SEQ ID NO: 6838924 - DNA, 100 bp, Homo sapiens
catttgagtttatatggtagataagatataaatccacagagtcgtccaaatttagagagtttgtgatttgtgatctttgaagatatcaaaacttattttg

SEQ ID NO: 6838925 - DNA, 74 bp, Homo sapiens
tgattgcttctggcacttgagggggtctggtaatggccatgtgtactactccgtgagaaccagaaggcagatca

SEQ ID NO: 6838926 - DNA, 130 bp, Homo sapiens
aaagagtgtagaaattatctaaatgtacatagggtattactaggttgatgcaaaaggaactgtggtttttgccagttgtttctgtaccaacctaatgttagattacatttaagtgggaaaaggacctttt

SEQ ID NO: 6838927 - DNA, 76 bp, Homo sapiens
ggtgcagcaactgtggtgcacggcctgctccagaggttcccctggggtcaggctgaagcccacatcagctgagacc

SEQ ID NO: 6838928 - DNA, 69 bp, Homo sapiens
gcatagcaatctgactgactctgatgctctaaattttgcacagcttgtctaccccagaggtgctattgt

SEQ ID NO: 6838929 - DNA, 56 bp, Homo sapiens
cagctactcctcccatgacttccctctagggacggtcatgaggacagagtgagctg

SEQ ID NO: 6838930 - DNA, 77 bp, Homo sapiens
accaaactagcctgtcccattttctactatggaatggtgtcccattttctactatggaatggaatagttaggtgggt

SEQ ID NO: 6838931 - DNA, 66 bp, Homo sapiens
gcctgagcttgcagcactggtgaatggccaaatggcttggcctgactgtcaggctgtatgtggggc

SEQ ID NO: 6838932 - DNA, 59 bp, Homo sapiens
gggcttcccataaggacttaagttgcccactgtggtaactttcttcatatgtgaacctc

SEQ ID NO: 6838933 - DNA, 62 bp, Homo sapiens
gattcctgggcaggacgagagtctgggctggctcggacttaatttttgtcctctcagggttc

SEQ ID NO: 6838934 - DNA, 81 bp, Homo sapiens
acaagggtggagacgggacagaagctaactcactgctactgggttttgtttgttgtttcctgtcccttgctctatttctgt

SEQ ID NO: 6838935 - DNA, 58 bp, Homo sapiens
gtaagtctgaggcagcatggtggaggtttctacttaatcatctggcattcagattggc

SEQ ID NO: 6838936 - DNA, 75 bp, Homo sapiens
ggccggcacggggcagctcccgagggcaggagagtgccgtgcttttcagtctgatctgagctgagagtggcggcc

SEQ ID NO: 6838937 - DNA, 60 bp, Homo sapiens
tagaaagtagagaacaagaggatatccttttaagaagtcctcaattttctctgctaccta

SEQ ID NO: 6838938 - DNA, 130 bp, Homo sapiens
ttgaaccaagagaaatggctttccctaggagtttgttagaaatgcagagtctcaggctcccggacctgctgcctgggaagctgcattttaacaagatactcgggtgatttgtgcacaccttagagttcaa

SEQ ID NO: 6838939 - DNA, 80 bp, Homo sapiens
atcaccagctttgtctgattcctctttttttgtaatgctaccaagaagtagaagagtaaaatttgagcaaggtaggtgat

SEQ ID NO: 6838940 - DNA, 77 bp, Homo sapiens
acattgcttgggcttgttcccagagactcagtgaaatgcccctgatatgtctccaggagcaagtcacccaggtgtgt

SEQ ID NO: 6838941 - DNA, 68 bp, Homo sapiens
gccaccatagaggccttcctgtaggtttagcatatccatctgctaccaggaatgcattctagaatggc

SEQ ID NO: 6838942 - DNA, 61 bp, Homo sapiens
aagtgtgaagtcaatcaatacattggggcaagcagtttatttcaatgttaatttcacattt

SEQ ID NO: 6838943 - DNA, 77 bp, Homo sapiens
cctaagggatctagatgtcctctgaatagcccatgggaaggttttcagaggagagctggaccaaacatgcccttagg

SEQ ID NO: 6838944 - DNA, 109 bp, Homo sapiens
ccatcaagatagggttagtctttacaagtcacattttctgtgaagtggctattggggacaatcagttgtcagataaatgcttctaaaggaagaattactgtttaaatgg

SEQ ID NO: 6838945 - DNA, 84 bp, Homo sapiens
catgacttctagattcttcttttgagtctctgagtgagtggtggtgtcatgaaaggagacggttaagagggagtgaggagcatg

SEQ ID NO: 6838946 - DNA, 56 bp, Homo sapiens
atggctgttggacttgattttagcacagatccagctgattccaaagccaaagctat

SEQ ID NO: 6838947 - DNA, 82 bp, Homo sapiens
tttcacttctccaacctcagccagacatgacccagtctggcagaggtctgggtcatgtctggctgaggttggagaagtgggg

SEQ ID NO: 6838948 - DNA, 75 bp, Homo sapiens
tgggagatgatcaacatgtatttaagagtttactaagtgctagggcctgagaatacaatgttgaaaacagtccta

SEQ ID NO: 6838949 - DNA, 76 bp, Homo sapiens
gtgaatatgatcttatttggaaaaaaggactttgcagatgtaattgttgagaaacttcaggtgagatcatgttgac

SEQ ID NO: 6838950 - DNA, 129 bp, Homo sapiens
tttatgtatattagtagttcattttgtttattgctgaatagtgttatatgggtgaatacaccacagtttatccattttcctattgatggacatctgggctgtttccaattctttgctattacacataaa

SEQ ID NO: 6838951 - DNA, 63 bp, Homo sapiens
tccccgaagaggaaggggcagggggagcctatatctctctcccaccccttgactctttaagga

SEQ ID NO: 6838952 - DNA, 60 bp, Homo sapiens
cctggatggtggagaagttcactgggttgcccaggccagagctggtccacaatctgcagg

SEQ ID NO: 6838953 - DNA, 81 bp, Homo sapiens
ccgctcctcatgccacttgaagccttatcagtcacttatactttggtgtgaatgaaggaagggggctagggagtgaagtgg

SEQ ID NO: 6838954 - DNA, 65 bp, Homo sapiens
gggtctacttggccttctctgacactgccccaggggtgaggaggggagagggctattggttacct

SEQ ID NO: 6838955 - DNA, 66 bp, Homo sapiens
ctggatgtagatgcaccaagactgctgaagaagattgcaggagttgattacgtttattttgtccag

SEQ ID NO: 6838956 - DNA, 65 bp, Homo sapiens
ttgtgtgtccactgaatgtgtattaaaattgtttcccaagaatgatgccaagcatggagatacaa

SEQ ID NO: 6838957 - DNA, 55 bp, Homo sapiens
aggcctgggtgttcaccagaagctaacttagctgcggggtgggaagccagggcct

SEQ ID NO: 6838958 - DNA, 58 bp, Homo sapiens
ccacctgcagctaaagatgtaggggggttcccagtctcccctccaatcttgtagatgg

SEQ ID NO: 6838959 - DNA, 97 bp, Homo sapiens
aggcaggaagatcacttcagcccaggaggttgaggctgcagtgagctaggatcacatcactgcactcaagcctgggtgacagagtgagaccctgttt

SEQ ID NO: 6838960 - DNA, 55 bp, Homo sapiens
ctgtcattgagcctgtcagggcccaaccaacatggccccatgtgctcaggggcag

SEQ ID NO: 6838961 - DNA, 59 bp, Homo sapiens
gcccacgtcgaacttgctccagagctgcagcggcttctgctggaagggtcggcgtgggc

SEQ ID NO: 6838962 - DNA, 73 bp, Homo sapiens
tgaaatccatgaaaatgtcaagttctgctgaattaggtaataatggtaatacctgaaatttgtatggctttca

SEQ ID NO: 6838963 - DNA, 98 bp, Homo sapiens
agttcagattagctgtggaagcttcagccatttctgcatggagatgcatctgtgaaacctgtggctaggctccaagagctggaatactactctgtact

SEQ ID NO: 6838964 - DNA, 96 bp, Homo sapiens
tgagatctgctcaaggctgggtgcaggagctcccgcagtggtggggacagtaattcaccatcattagctcctgctcaggtctaaggtgacttctca

SEQ ID NO: 6838965 - DNA, 81 bp, Homo sapiens
accctaaggtattattgtcatgaaataatatttctctagtacttgggctatattaacattttatgaaaataaacttggggt

SEQ ID NO: 6838966 - DNA, 82 bp, Homo sapiens
ttgtttctcagaccaaattataaggtggaaagtcaattatttaaattctgtcttattgcctttgtaatttagaaaggaacaa

SEQ ID NO: 6838967 - DNA, 68 bp, Homo sapiens
tacttcattgagcttttctgaaatgaatttatctaatttaaactgtaggtcaggaagttgatgaggtg

SEQ ID NO: 6838968 - DNA, 82 bp, Homo sapiens
ttgagtacacggcaaggaatgttggcgagttctcaagttggaatatttaacattgaaatatttgcaatagtggtgtactgag

SEQ ID NO: 6838969 - DNA, 65 bp, Homo sapiens
actggtaacaatggaagcttctatggatatcatgtctctactcaaaagagtctattgatatcagt

SEQ ID NO: 6838970 - DNA, 90 bp, Homo sapiens
gcaacttgaactcgtgagtgttcccagagaaggatgaaaaagcaagtgaaaggacttgtaaattactctgggaagatgagttggagctgc

SEQ ID NO: 6838971 - DNA, 81 bp, Homo sapiens
cattttttaggaagaaggaggcagtattaatttttagttacacaagtgatatataagtacagtctgcttttttaaaaagtg

SEQ ID NO: 6838972 - DNA, 62 bp, Homo sapiens
ttcatttcctgatctgtaaaatagcgacctgcctcagagagctgttgcaaggattgaatgag

SEQ ID NO: 6838973 - DNA, 65 bp, Homo sapiens
caaagtcacatcgattataaaatttggactctgagttccccgagttatggtttggtgtgactctg

SEQ ID NO: 6838974 - DNA, 88 bp, Homo sapiens
ggagtctcgctgtgtcacccaggctggagtgcagtgactcaatctcggctctctgcaacctctgcctcccaggttcaagcgattctcc

SEQ ID NO: 6838975 - DNA, 129 bp, Homo sapiens
ggcagcccgcaaccacctttagctctgggccccccaggccagcctggagcatggctgggtggggccaccagcccatgctctcaggcgggcctgtgatctttcccagggcacatggactgtaggctggcc

SEQ ID NO: 6838976 - DNA, 67 bp, Homo sapiens
tactcccttgttgcagctgacagatacatatacctaagtgtatgtgtcccttggtgtagcaacagta

SEQ ID NO: 6838977 - DNA, 65 bp, Homo sapiens
gtgtggtgacagctgggaggatgacataaggagctccttgtggcacctcccagatgtctctgctc

SEQ ID NO: 6838978 - DNA, 129 bp, Homo sapiens
gacaaatgactagaattctggagcctgcaccttcattttaggcagctattgcttcagaagtcacagtctgttccaccagcctttgccaaggatgcaggtgccacagcatctcaagagaagtcaccaatc

SEQ ID NO: 6838979 - DNA, 95 bp, Homo sapiens
tgtgacaaagcaaattgatggcagtgataggctagtgatgtcattgtgatgtcagtcctcctgcttatcctgcacatgcttgctaatttggaaca

SEQ ID NO: 6838980 - DNA, 66 bp, Homo sapiens
cagtccagccagtagggtgtggcagagtttaaatcgagtggcccttactaccttgctgggggactg

SEQ ID NO: 6838981 - DNA, 69 bp, Homo sapiens
gtgcctggcagttgacagtttgctaaaggtgcacctttaattaatgagtaagagtccctgtccatccac

SEQ ID NO: 6838982 - DNA, 56 bp, Homo sapiens
gcggagcggagctgccggtgatttccagaatgcactcacctttctcctctcttcgc

SEQ ID NO: 6838983 - DNA, 86 bp, Homo sapiens
ggagctccagccgctggggtgagcagaaacaggggtaagcagctccggtcttcagcagcgcttctgtggcctgggcatacagctcc

SEQ ID NO: 6838984 - DNA, 69 bp, Homo sapiens
gggggtgcactcagctgccactgtccgccgcctgtccctggggagcatggcagctgagggcaggcccct

SEQ ID NO: 6838985 - DNA, 55 bp, Homo sapiens
tgtgggtggagtgatattagcttgattccaattgctgacttcatgaccactgatg

SEQ ID NO: 6838986 - DNA, 58 bp, Homo sapiens
ggtagtcagtgttagtttgatttggcaatagcaccagactaataaaacagtgacagcc

SEQ ID NO: 6838987 - DNA, 57 bp, Homo sapiens
cctggtgtatcgtagtttggatttctgaatataaagagcatttaaactactacaagg

SEQ ID NO: 6838988 - DNA, 72 bp, Homo sapiens
ccttttgtgtctgttgagatttttttagtttcagctgttagaaactaaacctggcttagtaagcagaaaagg

SEQ ID NO: 6838989 - DNA, 76 bp, Homo sapiens
gcggccggggcatggcgacttcctcttcactggccacatgcacttcggggaggcgcggctcggctgtgccccacgc

SEQ ID NO: 6838990 - DNA, 98 bp, Homo sapiens
gtccttgttttaactttccagctctgttgccctggaaacgtggtgaaggtggaatgtcagctgtgttaccaggcagtattgcttatagtagaaatgac

SEQ ID NO: 6838991 - DNA, 57 bp, Homo sapiens
cctgctcctctgaggtagccacacactgagatctgggtcaccacttcagaggagagg

SEQ ID NO: 6838992 - DNA, 60 bp, Homo sapiens
gccaggaggcttaactggacaggggcttcttgaacattctctgtgcctaaacctccgggt

SEQ ID NO: 6838993 - DNA, 130 bp, Homo sapiens
cgagcttgtcacagcaggagaagcagctctgaggaatgcttgggtaagctcaggaagaacaactttgggaacactttcaggggcttgactccacagtccccaaagggcgctctctagcggtgatagcttg

SEQ ID NO: 6838994 - DNA, 80 bp, Homo sapiens
ctagagacagtctatactggactgttgtgatttcaaagggaaatatttacaactctgtcagtatagctgttccagtttag

SEQ ID NO: 6838995 - DNA, 115 bp, Homo sapiens
tgagataatgttctgaagagtattaaaggtgtctattaacacaagaaaggaaaggagagtgtggtccccctcctttactttctggaagtgtcaacagacaactgtcaggacatca

SEQ ID NO: 6838996 - DNA, 72 bp, Homo sapiens
gaattatgaatctgtcgaatgcagtcctataggtcttccctacatactccataatgacagcatctgtaattt

SEQ ID NO: 6838997 - DNA, 65 bp, Homo sapiens
gatgtaatagatatagattgctccttgacactcaaagtgcaagaaagatcctatttctttatatt

SEQ ID NO: 6838998 - DNA, 83 bp, Homo sapiens
cagatattttctcactagtcatcatatatttttattgttgttgttccttaatagagaaatgagactggtgatatgagcttctg

SEQ ID NO: 6838999 - DNA, 72 bp, Homo sapiens
gaaggaaataaataatttgtggccacattgtggaacgtgataaattgtttcatggccacagattcttccttt

SEQ ID NO: 6839000 - DNA, 60 bp, Homo sapiens
tcagcacaggtcttgcaaaacatttcacttatagttcagtatcttgggctctgtgcttga

SEQ ID NO: 6839001 - DNA, 86 bp, Homo sapiens
gtactttaattaaattggttgaaatgaaaggtggtgattgtcaagcctgacaaactaaaattctttattgaatctaattagggtgc

SEQ ID NO: 6839002 - DNA, 81 bp, Homo sapiens
ggggtgggaagagcctaggagacaagcgtgaaagtcccacctctgcaaccatcaggtatgtccttggagtcacctcatctc

SEQ ID NO: 6839003 - DNA, 85 bp, Homo sapiens
gctacagccagctcacaccagcttacaagacttggttgttaaatactcaggagttttgcaagctggttgttgaaccattggtagc

SEQ ID NO: 6839004 - DNA, 68 bp, Homo sapiens
gctgggctacagcttcttgtttcccaggagggaaacccctgccccactcaccgagctgtggcccatgc

SEQ ID NO: 6839005 - DNA, 60 bp, Homo sapiens
gagaatgatgatttccaatttcatccatgtccctacaaaggagatgaactcatcattctt

SEQ ID NO: 6839006 - DNA, 80 bp, Homo sapiens
ttgaatgagttactagggatattctgtacaggcataggctatatatgtgttttgaactcatctactgctgactcattcag

SEQ ID NO: 6839007 - DNA, 60 bp, Homo sapiens
tcttaaatgattgtgttttttgattttgcacagagcgaagtacctacacattatttcaga

SEQ ID NO: 6839008 - DNA, 59 bp, Homo sapiens
gagaaggtggatgatggtctccaggtaagagataatgggtgaaattattcttccttttc

SEQ ID NO: 6839009 - DNA, 71 bp, Homo sapiens
acaattgaatctggttcttgacatgggcatgtagaggctgcatgctagcctcgtgaataattttcagttgt

SEQ ID NO: 6839010 - DNA, 81 bp, Homo sapiens
tgtaatgctttgaaacttcacaagtctgattttaagataatggaatgaggcttgcattgtgaactttcttgatgctttaca

SEQ ID NO: 6839011 - DNA, 64 bp, Homo sapiens
taactttggagaactggcatttttaatgctgttgagtcattaaatatgtgttagtttcctgtta

SEQ ID NO: 6839012 - DNA, 73 bp, Homo sapiens
ctcttgaaaagtttcttacaggtcatgggttggtctcaaaccaaacatgtctttagagaaacatttataagag

SEQ ID NO: 6839013 - DNA, 73 bp, Homo sapiens
tgcagtttgggagaaggctgggactttaatgttagtaccataatgtcttgccttcctcccccacctccttgca

SEQ ID NO: 6839014 - DNA, 101 bp, Homo sapiens
ttttcattaaggattattgagggtggccatataattttcttgaacactcttgggcaaacaagatatttggttattatggtacccaataactgatttgaaga

SEQ ID NO: 6839015 - DNA, 109 bp, Homo sapiens
ggcacctctgttcaccctccatgtgcatgtctttggaggcctcccagaacttgagccatgatggtctgccctgcagacatgcctcagctggaggatggatggaggggcc

SEQ ID NO: 6839016 - DNA, 82 bp, Homo sapiens
aggggtgatctggtcaggattgaagcccatgaataccttccttccaaggtatttctgagaaccaacttacccagatccctct

SEQ ID NO: 6839017 - DNA, 88 bp, Homo sapiens
ggagtctcagtcttttgcccagggtggagtgcagtggcatgatctcggctcactgcaacctccacctcccgggttcaagcgattctcc

SEQ ID NO: 6839018 - DNA, 62 bp, Homo sapiens
agtatttgtggacattgccaaacgtcccttgaggggcaaaattggcctttgtctcagacact

SEQ ID NO: 6839019 - DNA, 113 bp, Homo sapiens
gtactttatgctgcatcttcagaagcacctttttatatgtattgactttgatgtttaattattaccaagcaatcataatacaatgaaattgtgttgatgctttcttaaattgc

SEQ ID NO: 6839020 - DNA, 73 bp, Homo sapiens
caatgaatcttgctgtttgggagggctctgtcgtataaatggaagctggctcttataaatatttggttaattg

SEQ ID NO: 6839021 - DNA, 74 bp, Homo sapiens
ctagataagcttgcacttgccatttcatgcaacaggaagaacttccccatcaaatggcaagtgaaagctggtag

SEQ ID NO: 6839022 - DNA, 75 bp, Homo sapiens
tttaaagcacactacagttaaaggactggttgctatgttttggagcagcatgctatattgattgtagtctttaaa

SEQ ID NO: 6839023 - DNA, 70 bp, Homo sapiens
agctcccagggtagatgaccaagcctctcaaaaggacacaggacttttcatcagctatcctgtcacagct

SEQ ID NO: 6839024 - DNA, 97 bp, Homo sapiens
gggactaggctaaggcaaacaaagcacaggatcttgaggagcgagtgccttcttaaattttgtaccttaggtgccttgcttgcctcacactagtgct

SEQ ID NO: 6839025 - DNA, 55 bp, Homo sapiens
gaatttcacaaggtgaggataaagagaacattccttatcctctcctgattaattc

SEQ ID NO: 6839026 - DNA, 103 bp, Homo sapiens
aaggtaatggattgtttcacaagtaaagtcctaagtgttcagctatttcagctcttctttgccatttggggcttcttacttgttaggtgatttctccggcctt

SEQ ID NO: 6839027 - DNA, 74 bp, Homo sapiens
aggtgaaggcccactaatctccagaaagaatttttgtttgcttcttctaggcttctcagggggcactttcacct

SEQ ID NO: 6839028 - DNA, 122 bp, Homo sapiens
caaaatgataccgaatataaggagcaatagtcacgtgcatctttccatatgtggttgcagaaacacaattcagatgtcagcaagaggtgttaatattgctctttatctaaaatctcattttg

SEQ ID NO: 6839029 - DNA, 73 bp, Homo sapiens
ttgagtcagttttctccagggggctaaattactttttggaagtaaactcagagcaatggaagaattgatttaa

SEQ ID NO: 6839030 - DNA, 78 bp, Homo sapiens
gtctttggctgctcttttggttccccgctatcagcttgaattttttgagagcagggttccaggagttgcagaaaaggc

SEQ ID NO: 6839031 - DNA, 120 bp, Homo sapiens
ttttggaaaagaacttacactacctgatttcaagactttctgtaaagctacagtaatcaagacactactgttggcattaagatagtcatgtagatcagtaaaacatactagagtccagaa

SEQ ID NO: 6839032 - DNA, 73 bp, Homo sapiens
tggggagactgagcaggagaatcactttataaaaagtaaagtagaggttcctcttcaaagactttcctcccca

SEQ ID NO: 6839033 - DNA, 87 bp, Homo sapiens
ttatttgagactaattaaaggactgatgactgcatgcccgattttatgattaagtcagttattcaattggtttaaagcatcaaataa

SEQ ID NO: 6839034 - DNA, 73 bp, Homo sapiens
acctggcctcgctgcaggaacaggtggctgtgctcaccagacagaaccaggaactgatggagaaggtccaggt

SEQ ID NO: 6839035 - DNA, 59 bp, Homo sapiens
tcccaggcaggtgacagggggacagattcacactccaatcctcacctttttgcctgggg

SEQ ID NO: 6839036 - DNA, 56 bp, Homo sapiens
tttggaggagtagacacaaacctttcaggcatttgcttatgtctactctgactaaa

SEQ ID NO: 6839037 - DNA, 82 bp, Homo sapiens
gtactggctttgagggaatagctacagaacaaatgggcagaatttcactaatcactagtatttcctgtaagctatagggtac

SEQ ID NO: 6839038 - DNA, 56 bp, Homo sapiens
ttctgaaaccactgaccaactaagctgcaagtgaaaagttgaggtggttgtcaggg

SEQ ID NO: 6839039 - DNA, 69 bp, Homo sapiens
cccgggccagccttcacctgctctggtcccagctgcccttgcttgggagagctgtggggcctggcaggg

SEQ ID NO: 6839040 - DNA, 62 bp, Homo sapiens
cctctgtttgtaagctgttcatttgcataggtcggaaccgcgcaccacagcttgaagctagg

SEQ ID NO: 6839041 - DNA, 69 bp, Homo sapiens
tcccttctaggttgctgagggaccggctcctgtcacattatgagctgtttctttggcaaactgattgga

SEQ ID NO: 6839042 - DNA, 83 bp, Homo sapiens
cagtctctggctgggagcgagctgctcacagggaggcaggggccggaccccacctgatcagcatcttcccagctcggctcctg

SEQ ID NO: 6839043 - DNA, 59 bp, Homo sapiens
gcactgggggcagcagtgagggcctcttagcagcccagcgcactgactgcccctattgt

SEQ ID NO: 6839044 - DNA, 58 bp, Homo sapiens
atccctgccctcatggagcttacagaataatgaaccagggactcaaggaagcaggggt

SEQ ID NO: 6839045 - DNA, 102 bp, Homo sapiens
atataaatgttttctaatgttaatttctttagaagtggaataaaagcattattgagacttggcactgaggaactagttaatagaatgaaaataatgttatat

SEQ ID NO: 6839046 - DNA, 84 bp, Homo sapiens
ctctgctgtggcctatggcttttcattcctatgtgattgctgtcccaaactcatgtagggctaaaagccatgggctacagtgag

SEQ ID NO: 6839047 - DNA, 130 bp, Homo sapiens
gtaataaattattatttacattagtcagcagccctgtttatgccacatcatgagcctttcctcatgtaataatatagtgagtataatgattagtggctgcataatactgcagtaagtagatacatcatac

SEQ ID NO: 6839048 - DNA, 70 bp, Homo sapiens
aagagcttattaatttttctgcatgtgaaagctttgacttcctattagaaagcttaatatcgtggctctt

SEQ ID NO: 6839049 - DNA, 69 bp, Homo sapiens
cttctatattctggattgagtgactgggttagtgatgatgccatttactgagattagaagcactggaag

SEQ ID NO: 6839050 - DNA, 72 bp, Homo sapiens
agaaaggagagttgtgttcatttagtcagattccttgaattccactgatgtgaacattgattacttatttct

SEQ ID NO: 6839051 - DNA, 69 bp, Homo sapiens
aaaataagtggtctagtctcctcatttagattgcaaagtctctggggaaaaggctgatacttttatttt

SEQ ID NO: 6839052 - DNA, 64 bp, Homo sapiens
gtgaagtcagatcagactccagagcccacatgccatggagccttggagacaggtttgctttcac

SEQ ID NO: 6839053 - DNA, 130 bp, Homo sapiens
ttgagaaagagaacgtctatgcactttggcttggcttctttagtcagtttggaattctctcaaataagagaataaccagaaaacccaaaatgacaaaggtcaagtatagcatatttttttcttgcatcaa

SEQ ID NO: 6839054 - DNA, 88 bp, Homo sapiens
gacgcacgcaaattgtccacctcgtgttgctaagcgattgtttgtcggccccgcacgcacagctcagcatgggaggaccgcgagcgtc

SEQ ID NO: 6839055 - DNA, 56 bp, Homo sapiens
ttcagtagggccctcacacagtcactcatgctgtgaagttattttggggcactgga

SEQ ID NO: 6839056 - DNA, 57 bp, Homo sapiens
agcattggtggccagagtgcctggttccaagtgtggctctgctgtctaccagctgtt

SEQ ID NO: 6839057 - DNA, 61 bp, Homo sapiens
ggggtcagtagcaaagtcagaaatggagacactcaatccatttctccaagtgactgattcc

SEQ ID NO: 6839058 - DNA, 62 bp, Homo sapiens
agatgttgattcttactctcaatagctgtcctaagaagttaatgggttgaacatcaaggtct

SEQ ID NO: 6839059 - DNA, 82 bp, Homo sapiens
gctgggtcagggatgcccaggagtaagtgacattgttctcatagcagagccatgttgtgctactgctgccagatgacccagc

SEQ ID NO: 6839060 - DNA, 65 bp, Homo sapiens
ggtcccaaggaggatgaggctagacagtgaatggttcatcacaactcattcctatcctggagacc

SEQ ID NO: 6839061 - DNA, 100 bp, Homo sapiens
ctttgcataatgcctctaatgtgaaagatgctcaatgaatggtggtttcaatcccaaccaccattcatagcatcttccatattagaggcattatgcagag

SEQ ID NO: 6839062 - DNA, 72 bp, Homo sapiens
gagtttaaaaagcctggtttgttgatttttcatttagagaggaataaaaaactataggcatttttgaggctt

SEQ ID NO: 6839063 - DNA, 125 bp, Homo sapiens
tgagcatctagagaggggagtgttttcaggaagggatagacggtaatatagtagggcgcatagacttgccatattgcaaagtgtctgccaagagtcctcctgaataattcttcatttaggtctca

SEQ ID NO: 6839064 - DNA, 76 bp, Homo sapiens
tagctgcactggtttctttccactctccaccctcatttccttggaaggttttagatatagaagaaacagatagcta

SEQ ID NO: 6839065 - DNA, 58 bp, Homo sapiens
cgggtctcccagaattacccctccccatagccagggagggggtcgtccggaagacctg

SEQ ID NO: 6839066 - DNA, 55 bp, Homo sapiens
tgatggtgatggttgcacaatggtgtgtatgtacttagcgcgaccaagctataca

SEQ ID NO: 6839067 - DNA, 98 bp, Homo sapiens
agattttgacacttgcctccattccatgtcccctaggatagagctggagagcgtttagggtccatatggatgaatggcaggatgaaggtcaagcatct

SEQ ID NO: 6839068 - DNA, 91 bp, Homo sapiens
ttctcaggttggctctgttcctatgtttgggcagacattaatttaatcagagctagaatctgcctgcagcaaagactcagcagcttgggaa

SEQ ID NO: 6839069 - DNA, 81 bp, Homo sapiens
gacctgacctgacagtttagtgtaatagttacccagtgattgggttttatacacatgaacatgcagatctttattagggtc

SEQ ID NO: 6839070 - DNA, 99 bp, Homo sapiens
ctacttacattggatatcatttttaatgacctggaagaagtgataaaaataatttgattattcttgcaggcagtaataggaaattatccataaaagtgg

SEQ ID NO: 6839071 - DNA, 83 bp, Homo sapiens
tccctacagctgagggccattcccggctgggaaatatcagcagctggcagtcccatcagctgggaagggtgtctgatgaggga

SEQ ID NO: 6839072 - DNA, 67 bp, Homo sapiens
gggtcgggcaggcgccctcgtctccctggaaacagatgcggacgaggaagcgacccttgcccgggcc

SEQ ID NO: 6839073 - DNA, 102 bp, Homo sapiens
ggctgtaattcaatagaaaatttctgataaacgtaagctgcaagaatctagttctagccagggtacattttgtcagagcctcctgtgaattgaattacagct

SEQ ID NO: 6839074 - DNA, 71 bp, Homo sapiens
agtggctcctggctgggaagtagagtaggtttctctaaggaaaatgacacctgctcaccacccgccccact

SEQ ID NO: 6839075 - DNA, 73 bp, Homo sapiens
ccctgccctgccaccctggcggcagcctgctcccctggggggcctctctgggctgccgaggctgtgggcaggg

SEQ ID NO: 6839076 - DNA, 102 bp, Homo sapiens
ggcccgtgggcagctggctgaggccctgcagctttgcctcctgaactcagagctcaccaggtggggctgttgggacatcctcctgccgatgccatctgagcc

SEQ ID NO: 6839077 - DNA, 92 bp, Homo sapiens
atgttgaatgggattgaattcaggctatagaccaatttgggaataatgtatttaaattcttcaaagtatcgagtcttccaatccatgaacat

SEQ ID NO: 6839078 - DNA, 55 bp, Homo sapiens
gcaggccagcagggcctccgtggcgtcttgggccgggaggcagatgctggtgtgt

SEQ ID NO: 6839079 - DNA, 64 bp, Homo sapiens
gagtctgagtctaatggccccaggattaacgagaagctacatcctatccccatatctcaggctc

SEQ ID NO: 6839080 - DNA, 130 bp, Homo sapiens
ctgccgcgcaacttccactctaattcagcgaccaagggccctggcagcggtttgcagcctgggggccacgctccccaggctcaggcctgctcgttggcctgctcctagtgcctggacccagttgggggag

SEQ ID NO: 6839081 - DNA, 83 bp, Homo sapiens
gggtatttctgctcttgctgcttcacctgttgtacagtttccctgatcttgtgctatgcagttggggtagcaaagaagtgtcc

SEQ ID NO: 6839082 - DNA, 61 bp, Homo sapiens
gattagaattgaggagtgacctttgcattcatcaatatgaaggtcaacactgattttagtc

SEQ ID NO: 6839083 - DNA, 91 bp, Homo sapiens
aaaattgcttgactattttgaaacataaagttatcttcagtccaacaggactgcaaggtatatgttatcataattggaaattggtaatttt

SEQ ID NO: 6839084 - DNA, 55 bp, Homo sapiens
tacctcctccaactgttggtctcagctgagtgagattcccatgtctgaggaggtg

SEQ ID NO: 6839085 - DNA, 78 bp, Homo sapiens
gagatgttagagcttctttggcaaccctgacatccccacagatgatgacccaggcccagggagaagaaggacgttctc

SEQ ID NO: 6839086 - DNA, 100 bp, Homo sapiens
ccagttaactttcatgtacgttgtcttgattagaatgatgggctctgctctacttagacgttctgctcagactttatagtacgtggagtgtgcagcttgg

SEQ ID NO: 6839087 - DNA, 63 bp, Homo sapiens
aggaggtcagagccccatgctgggaagcataggttgagctcacggatggggttctgtccttct

SEQ ID NO: 6839088 - DNA, 64 bp, Homo sapiens
ggcagtgcaaggctggcacagtggttttatgatatattcactgtcccagataacttctactgtt

SEQ ID NO: 6839089 - DNA, 84 bp, Homo sapiens
aggacttgagattgatttcaaggatgttagaggtggtgtgctgggagaagtcttcctttgcattcttaaaccctttcaagtctt

SEQ ID NO: 6839090 - DNA, 79 bp, Homo sapiens
atctctcctggaatgcagaagtgtggcccaacaggatcttctaagcctttgcaacacaaagtttgattcccagcaagat

SEQ ID NO: 6839091 - DNA, 76 bp, Homo sapiens
gccacatcattgtagtgcttcatctgcacagcacagccgcatcattgtagtgctagaagatagctagaagattggc

SEQ ID NO: 6839092 - DNA, 77 bp, Homo sapiens
agagttaaaaaagaatctggccctaccctggtttcagtacttgaagggccagggcagggttgtgaagttgaagctct

SEQ ID NO: 6839093 - DNA, 94 bp, Homo sapiens
gtgcaggaggctggagctcccaggcagggctgcccactccgctcaacgggagtcagatgggggtggcccctcagggcattttaccatcctgtgc

SEQ ID NO: 6839094 - DNA, 66 bp, Homo sapiens
tctgggtacttgcaagattttctccttatctttggtttttaggaatttaattatgatgtgcctaga

SEQ ID NO: 6839095 - DNA, 60 bp, Homo sapiens
ctgtcactacctctgagagaatcatagggtcatataaacctgtggatgaggtaaggatag

SEQ ID NO: 6839096 - DNA, 66 bp, Homo sapiens
gggacattagcatgtgggatgcaagcacaatcttagtaaatgcttgcacattggagctggtcttct

SEQ ID NO: 6839097 - DNA, 66 bp, Homo sapiens
ggggccgggaaggggaattggcaaagaaggcaacaaactgcctcctgggtggctctgcccggctcc

SEQ ID NO: 6839098 - DNA, 116 bp, Homo sapiens
taacctttgttttatttctaggacccaaacagttcctgtggtacttctctttcttccttctcactagtgacagttgtagtatctcataggaccgtttttccaaaagacaaatgtta

SEQ ID NO: 6839099 - DNA, 118 bp, Homo sapiens
catctcaatagctaccattgtttcctctgcccactaggagctcattgtggatggatgggccttcctccagggtccataatgaactctgggcaggtggaggtaaaataagccctggatg

SEQ ID NO: 6839100 - DNA, 60 bp, Homo sapiens
ttatttggtctgtaattacatggactttatttggaggtcagtgaaggaacaactaaatag

SEQ ID NO: 6839101 - DNA, 59 bp, Homo sapiens
tcctctgctggtgagtcctgcctgccctcaagcagtccagagcccaccagaggaatgga

SEQ ID NO: 6839102 - DNA, 66 bp, Homo sapiens
gctgtggctgctgtcctctctggttgggctacttttcataagagaaataaagcagccagtcaccgt

SEQ ID NO: 6839103 - DNA, 77 bp, Homo sapiens
gaaaagtgattagctcaaagccttcatttttttctcccaaccacatatatgacagaagtgtctgagctgtatttttc

SEQ ID NO: 6839104 - DNA, 61 bp, Homo sapiens
ggatcagatggtcagggggcaaggtaagtctcagactcccagggcccctacaccactgtcc

SEQ ID NO: 6839105 - DNA, 74 bp, Homo sapiens
ccatcttcagttcctaagcactgtgcattctttactgtagaagaataaatgttggacttaggaaagaagaaagg

SEQ ID NO: 6839106 - DNA, 77 bp, Homo sapiens
caggccaggcagagcccctgctgggtgtagctcagacagaccctacactcacccagcttggggcccaggcctgtctg

SEQ ID NO: 6839107 - DNA, 85 bp, Homo sapiens
agatggactgaggggtacacccggtgcaccagttccttttggtggatggagcttcctgccctgcctgtgccacttcttatcattt

SEQ ID NO: 6839108 - DNA, 84 bp, Homo sapiens
cctgtcctaccactttcttcatctgcaaaatggggatcatgatagtaccagcttgcagggttaaagtaaggtagtgggtgcagg

SEQ ID NO: 6839109 - DNA, 117 bp, Homo sapiens
aggggaacaggttaggatcccgcttgatggcctcagcatggagcttcggggattccagttgcagttcctccagagcttcctgctgggcttctagcatagccctgatggtgtccctct

SEQ ID NO: 6839110 - DNA, 59 bp, Homo sapiens
cttcagtatacttcataacatttgttggaaagcaggaaatgaaaacgaagtatttgaag

SEQ ID NO: 6839111 - DNA, 66 bp, Homo sapiens
ggataagcaacaagtggctggaggagggacaaatcgggctctccgcgtcgctccccgcctgcttcc

SEQ ID NO: 6839112 - DNA, 82 bp, Homo sapiens
tagcaggaagcataatggaacaactcttagttatcattattttgttgatgtttcaagagtttctttattaacctttgtgtta

SEQ ID NO: 6839113 - DNA, 83 bp, Homo sapiens
ggtaattttagagacattgacaaggacggtctccatggagtagttggagccaaagtccaaatgcagtgtgtttgagagagact

SEQ ID NO: 6839114 - DNA, 58 bp, Homo sapiens
tttgatgagtttaataacagccactatttattattcggctgaggaactccaagtcaaa

SEQ ID NO: 6839115 - DNA, 73 bp, Homo sapiens
gaaaaagttcattagtgagcttctctcctgatgtgttattattaactggaagctaaaattaatgaattttgtc

SEQ ID NO: 6839116 - DNA, 73 bp, Homo sapiens
ccagatttctacatgtcaatccaaaccatgaaatatatgacatgactgggtctactgatatttaggagcctgg

SEQ ID NO: 6839117 - DNA, 57 bp, Homo sapiens
gctcagcccatggtttgtggccagtgtctgtacaaggctccgtgactggggctgagc

SEQ ID NO: 6839118 - DNA, 64 bp, Homo sapiens
ggttttctgaccctatagtccagttatttcaactttctacatctgagctgttggttggaaaatt

SEQ ID NO: 6839119 - DNA, 79 bp, Homo sapiens
ttgaagtcaggactgtgatccgtagtatatcgagctatattagtgatacatgatgggtgtatagttttgaaaactttga

SEQ ID NO: 6839120 - DNA, 97 bp, Homo sapiens
ggacatggggctgtagcttgtttggatgaagagcatgggctctgcagtaatgtggggttgagtcttctgctctgtcactaactaggggcccatgttc

SEQ ID NO: 6839121 - DNA, 93 bp, Homo sapiens
tttgcgggggttgtgggaggcacaggaggatgcctagtattctgatacttttcaaagggcatgcttctgagatgtctcctccctcaatgcaga

SEQ ID NO: 6839122 - DNA, 56 bp, Homo sapiens
gctctttggctccacttggaacgattcctcattcttccagaaggaagccggggagc

SEQ ID NO: 6839123 - DNA, 63 bp, Homo sapiens
cctatcaatacctcctgctgctaaaaagcagcagctaaaaagcagcaggaggtattgataagg

SEQ ID NO: 6839124 - DNA, 66 bp, Homo sapiens
ccagtgtttataagtactttgtctgctttattaattttgaagaggaatgaccacttgtgatattgg

SEQ ID NO: 6839125 - DNA, 74 bp, Homo sapiens
ggtccacactgcctttatgagctgtaacacttaccgcgaaggtctgcagcttcactcaggaagccagtgagacc

SEQ ID NO: 6839126 - DNA, 61 bp, Homo sapiens
agactcagaaggtacagaagggaagtatctcccagccaccctgttgctctctcctgagttt

SEQ ID NO: 6839127 - DNA, 130 bp, Homo sapiens
ggattccctcagcataggtaggttctgggcagtcaaaaatgaggagagatgttctctagaggtggctagcagagcacatcttcattctgcactctgactcctcctattagttggaaataacagggaatcc

SEQ ID NO: 6839128 - DNA, 85 bp, Homo sapiens
ctgttagaccgagaccaaagccatctgtatttaggacatgggctgaacccagatgtcacacttggtggttttggtctcctgatgg

SEQ ID NO: 6839129 - DNA, 108 bp, Homo sapiens
cggagccctggcagccactttgagctgggaggctgaaggacagctcctctccaagcctccctcagtttccccagctccaagcatggccacctacaacacatggctctg

SEQ ID NO: 6839130 - DNA, 78 bp, Homo sapiens
gcattctgaatgatttgtagattttttgctgttgtttttacttaggcttcataaagtttgcaatttatgttaatatgc

SEQ ID NO: 6839131 - DNA, 77 bp, Homo sapiens
ggaaattcgagtcacctactgaccaaattggataatccagatgattccagagcaggtggtcagaaggtataatttcc

SEQ ID NO: 6839132 - DNA, 56 bp, Homo sapiens
tcttcctcaccatcctccatccctccagctaacaaagggcagaaggtgtaggggga

SEQ ID NO: 6839133 - DNA, 84 bp, Homo sapiens
ctggtaatgaagggacctgggccagagctcttaaacttctcaaaggacaagcagccacagcccacaggactctttatttttcag

SEQ ID NO: 6839134 - DNA, 63 bp, Homo sapiens
gagtggttttcaaattgccttccgtggagctggaggactccaaggaggagctggagattgctc

SEQ ID NO: 6839135 - DNA, 72 bp, Homo sapiens
tggactgttacaagagagagacatgatcttccttaaggcattgatttgtcatgagtctctttgttatagcca

SEQ ID NO: 6839136 - DNA, 58 bp, Homo sapiens
gagaaggcaccatgagatgctggttttcctctgaagcttgctgctaggtgcctgcctc

SEQ ID NO: 6839137 - DNA, 83 bp, Homo sapiens
cagaggcatcatggcgagccccgactgagtgttcagtgaagagggaaaacagagacagtggggcatcccgagaagatcctctg

SEQ ID NO: 6839138 - DNA, 66 bp, Homo sapiens
agctgcagaatttagggaggcagcataccattgaccaacttggaatgtggccagattattgcagct

SEQ ID NO: 6839139 - DNA, 58 bp, Homo sapiens
ggctttagggagccccctcccaagcccatctgctgggacagggccctgccctatggcc

SEQ ID NO: 6839140 - DNA, 60 bp, Homo sapiens
ttaaagagtaatcataggtcaaaatttaaaattgcctattagaacatgattgctctttga

SEQ ID NO: 6839141 - DNA, 77 bp, Homo sapiens
gaatgagtcgatctgggggtgcaatggtctgcagttagctaatacgaaaatagatctgtttcccagcccttttattc

SEQ ID NO: 6839142 - DNA, 58 bp, Homo sapiens
cttccttcatgggagctccttaacagtgatgtagatatgatgattcccagggaggggg

SEQ ID NO: 6839143 - DNA, 56 bp, Homo sapiens
tgtattcatgtgagcctaggaaaaatattgctatttgtatcaggtgaatgaataca

SEQ ID NO: 6839144 - DNA, 64 bp, Homo sapiens
caacagagactcttgggctttagagctagacacatcccagttcaaactctgagtagttctgctg

SEQ ID NO: 6839145 - DNA, 108 bp, Homo sapiens
gctcgaactcaggcagttcagaggctcctagccactggcctgggcagctctgggctccagaggctcctagccactggcttgggcagctctgggctgctggtggtgagc

SEQ ID NO: 6839146 - DNA, 78 bp, Homo sapiens
cctgatggcaagagctgcaaatagcgtgacatcatcagtaaccaataatgcagtcattggtgcagtctcttaccaggg

SEQ ID NO: 6839147 - DNA, 62 bp, Homo sapiens
gtggtgtgtaaagtgagacccacgaatggctgggtttccagagatcatttacataacatcac

SEQ ID NO: 6839148 - DNA, 83 bp, Homo sapiens
tgagctgggcagggccagagagggctggctggggtctctgccactcctaagccccctcaccctggcttcccctgcagtgctca

SEQ ID NO: 6839149 - DNA, 66 bp, Homo sapiens
ctataatactgaaagtattttcaaatctaggatgaccaggatagaggaattgttcagtgttcatag

SEQ ID NO: 6839150 - DNA, 58 bp, Homo sapiens
gaaggatggataaaacattaatgggcaaagatctatttggaaagtttatctatctatc

SEQ ID NO: 6839151 - DNA, 71 bp, Homo sapiens
gaggctgagcctggaggcttgaatctggccccagatgaccggtcagaagcaggcagatttcagctcatttc

SEQ ID NO: 6839152 - DNA, 72 bp, Homo sapiens
gtgtgtgtctcctctgtcctgtcaggaataataattactccccacacagatacagagtagcgcagttcacac

SEQ ID NO: 6839153 - DNA, 129 bp, Homo sapiens
gtgatcgtgatcctgttttcatttatgtgcaaatcttggaagacatttatttgaatcaatttgccatgctaatctagtgaaaacagttatttaagtagtgtcttagagcaaagtatttgaagaatacac

SEQ ID NO: 6839154 - DNA, 70 bp, Homo sapiens
ttgttttgagatggagtcttgctctgtcgcccaggctggagttcagtggcaggatttcagctcagtacag

SEQ ID NO: 6839155 - DNA, 59 bp, Homo sapiens
gatgatgctttgtcagtatgtttttggtgtttcaagtttatagtcacttgagcattatc

SEQ ID NO: 6839156 - DNA, 79 bp, Homo sapiens
ccatcatctagaactcttcaaaaatacaggttttcagattccagtctggatgattttcatttgaaaaggtccatgatgg

SEQ ID NO: 6839157 - DNA, 56 bp, Homo sapiens
tggtagtgttaacggggccagttgtcacattgacagggccaatgttagcattgaca

SEQ ID NO: 6839158 - DNA, 59 bp, Homo sapiens
tctctccaggtattactaagtgttaactgttgagtagatggaagtgaaatctgggaaga

SEQ ID NO: 6839159 - DNA, 74 bp, Homo sapiens
atacaagtagatttctgctgaagcttttctgtcaaaatcagcaagtgaaaaagagtgcagagatatgcttgtgt

SEQ ID NO: 6839160 - DNA, 130 bp, Homo sapiens
tccagagacaataagatgttgtagctagttaatacttttaagatccttttgctgaagtcatattgatgctagcagtgccaggattttgctgaaggattgaagttctgtggagttttgttttttttttgga

SEQ ID NO: 6839161 - DNA, 57 bp, Homo sapiens
ctgactttgtgatccacctgccttggcctcccaaagtgctgggattacaggtgtcag

SEQ ID NO: 6839162 - DNA, 66 bp, Homo sapiens
gaccctgtggctgccacttgggtgaagtttggaataaacctcacttgagatgtaccacaaactgtc

SEQ ID NO: 6839163 - DNA, 89 bp, Homo sapiens
gcttaccatgatgaccccttgaggtagactgaacaccttacagcagactcaagacacaggtgtgactcgccctcagggacacatggtgc

SEQ ID NO: 6839164 - DNA, 63 bp, Homo sapiens
tctctatgagttatgaagtaaatgatttcttacagaaatcagatcttacacaattgtgagaga

SEQ ID NO: 6839165 - DNA, 64 bp, Homo sapiens
gcgggccgcgcggggggcagaagctgcggccgcccccgtttcctctcttcctccgcgccgccgc

SEQ ID NO: 6839166 - DNA, 78 bp, Homo sapiens
tggaccaagtcatacatcccattttttgcatttatttctcatagaaatcttgaagagtttggggtatgattgtttcta

SEQ ID NO: 6839167 - DNA, 63 bp, Homo sapiens
gaggcacatgactcaccaatggaatattttctcattttgaatattgggtcatatatttgcctc

SEQ ID NO: 6839168 - DNA, 57 bp, Homo sapiens
ctcgcctgagtttgaatgctggttttgccactgactagcattgtgatcttaggcaag

SEQ ID NO: 6839169 - DNA, 129 bp, Homo sapiens
attgaagtaatgaaaaaaaatcaagaatgctctgtatagggctgctgcagatgacaggaagcttatgctgcctagtgcagatggctgcgtcccttgctgaggtcttgattttgtttgcatttaagaaat

SEQ ID NO: 6839170 - DNA, 55 bp, Homo sapiens
aaggcttgttgtcacgctcttgtatagccagaatgggaggtgagaatttggcttt

SEQ ID NO: 6839171 - DNA, 56 bp, Homo sapiens
gtattctcaggtggttcctcgaggcctttgggctcctgggttctggatgaggatgc

SEQ ID NO: 6839172 - DNA, 60 bp, Homo sapiens
tgtgtaggggcagtctaggatacctccatttcttggcacatcctagcttctctctgtaca

SEQ ID NO: 6839173 - DNA, 63 bp, Homo sapiens
tcataagagctttagagactcttaggcttctttactaggacagctgagctctaaagcatgtga

SEQ ID NO: 6839174 - DNA, 110 bp, Homo sapiens
atatatgcagaaaagttgaagaattgtgaaggtagcaatcgtgtatatgccatctaaatcctaccattaacactttgctacatttcatattcttgctttttttcatttat

SEQ ID NO: 6839175 - DNA, 84 bp, Homo sapiens
cagtgtcagtggtccaggcagggctgactcagccaccctcggtgtccaagggcttgagacagaccgccacactcacctgcactg

SEQ ID NO: 6839176 - DNA, 79 bp, Homo sapiens
gctgcttgcctgattagtctcagattgtctatctgataactgagttggcagttctgagattaagagctaggcttgccgc

SEQ ID NO: 6839177 - DNA, 70 bp, Homo sapiens
gtttaacagatttttccctctttagaaatcaaaaatgtaatttaaatgagtggggagaaattggttaaac

SEQ ID NO: 6839178 - DNA, 64 bp, Homo sapiens
agagtgagggtgggggctcaggcatgccagcactgggcatctctctgtgcctcaaccctcatct

SEQ ID NO: 6839179 - DNA, 72 bp, Homo sapiens
atttgggagttgtcagagtgtctgttggtgctacatactagtattacaactatgtgctctgcaagcctttat

SEQ ID NO: 6839180 - DNA, 68 bp, Homo sapiens
ggtgacaaggaagatgctggcctggggagtcctctctcctccgtgcctgtaacttctactctggcact

SEQ ID NO: 6839181 - DNA, 123 bp, Homo sapiens
gccgatgggctggcgctatggctcacgtgggcgcaggaagggaagctggatggaatactcgggaagcaaattttctgtgacagttctggcgcccatgagcagagttgctcagtatccttcggc

SEQ ID NO: 6839182 - DNA, 73 bp, Homo sapiens
gaaggctttccttgggcggttaccatccgaagctttaattttaagtataatggcaagctgttggaaagctttt

SEQ ID NO: 6839183 - DNA, 57 bp, Homo sapiens
gatgctgactggtgtttgccttctgtcatatcctcaggattagcaccagatcatatc

SEQ ID NO: 6839184 - DNA, 77 bp, Homo sapiens
aagatatttgggggagaggatgatttcttggtctagggagtcctttataatttgaatcacttccctccaaatggatt

SEQ ID NO: 6839185 - DNA, 56 bp, Homo sapiens
ctcactggggcctttggtcaggaaaggcggccattccatgacaagaaacccaggag

SEQ ID NO: 6839186 - DNA, 62 bp, Homo sapiens
gtattgctgggttcccggtatgttactctcatcgtgtacatatctgttagacacagcagtat

SEQ ID NO: 6839187 - DNA, 90 bp, Homo sapiens
gaggtacagccaggacagggcagctcgctccgagatttttggctctcgaaggccttgagcgctgtggttctgcagaacgctgtctgcctc

SEQ ID NO: 6839188 - DNA, 57 bp, Homo sapiens
gagcgcggtgcagcccctggagttgagcacgctttgttttcccctgctctggtgctc

SEQ ID NO: 6839189 - DNA, 69 bp, Homo sapiens
ggtgcttccaggcctccatgaagggttcattggcagcagaggacgggcttcatggggcctctcagcatc

SEQ ID NO: 6839190 - DNA, 129 bp, Homo sapiens
tagtttctgtttccagatagaaatgggggataatactggaaatagtaatgcataagtggacagggtctgaccattaaaatgtttaccatttccagaatgatgcctgcagatgttacaaaattgaaactg

SEQ ID NO: 6839191 - DNA, 60 bp, Homo sapiens
ggtgacttgaaggcaactgaagactctagaaatgtggatgatttcagctctcaagttact

SEQ ID NO: 6839192 - DNA, 74 bp, Homo sapiens
gcaaagatgtcagatcctcagaaagtctagctcagtgtcaccagttttccaaatgaaggatttgagttctttgt

SEQ ID NO: 6839193 - DNA, 80 bp, Homo sapiens
catgcagctacgctccacttgagtaggcctgatctcttatcctgcctcttcagctcagctggaccatcgtgttttgcatg

SEQ ID NO: 6839194 - DNA, 60 bp, Homo sapiens
ggacccaagagatcgcatgtagttgatagtaatctccttttgtctatttcttggttttcc

SEQ ID NO: 6839195 - DNA, 61 bp, Homo sapiens
gtgcctgcagcaatccatggcacagaccagctgttggtagctgccaggatgctgcacgcac

SEQ ID NO: 6839196 - DNA, 74 bp, Homo sapiens
agaaagctgctgcaataacccatgagatagaagctggtggctttgatctcagtggtagttgttgtggagcttct

SEQ ID NO: 6839197 - DNA, 61 bp, Homo sapiens
ggtcagcctggcaggatggcctgggtcagctcatggggccacagctgccagccccgctgcc

SEQ ID NO: 6839198 - DNA, 61 bp, Homo sapiens
ctggtatgtcctgagtcttttatattctttcaaaagatatgctctatttgggatatgacag

SEQ ID NO: 6839199 - DNA, 61 bp, Homo sapiens
ccatagtggtcatacagacttgtattagttcttggaactctcactagctctgtgaccttgg

SEQ ID NO: 6839200 - DNA, 72 bp, Homo sapiens
atatggtctccattctcataaatcctgagacctattaatagtagcatgtccaggatactgagatttccatat

SEQ ID NO: 6839201 - DNA, 94 bp, Homo sapiens
ggagtgagtaggttctctgacttcttcatccttgccattggggtgacctaattacctggcatcggaatgagggacagaaaagtttcaccactct

SEQ ID NO: 6839202 - DNA, 94 bp, Homo sapiens
gctcttaggtaagagaggagcaaatgtattgctagtgactttttggaggactccccctcctgcggttcatgctcattctaaattgcctgagagt

SEQ ID NO: 6839203 - DNA, 66 bp, Homo sapiens
cagagcaggctggacatagacatagccattccaagggacagtgggtcagtgtccagcttacatctg

SEQ ID NO: 6839204 - DNA, 130 bp, Homo sapiens
tatgtgagctccatgagggcaaagactttgtctatttccgtcacagtgcctgccactcagaaggtgcttcagaaatgtcaggtgtgtgaacaaggaatgagcaaggcaaatgcttcaggagttcaaagaa

SEQ ID NO: 6839205 - DNA, 66 bp, Homo sapiens
tgtgtcccaggcctctggaattagaatctgcattgtaacaagatcttcaagagacctgtggacaca

SEQ ID NO: 6839206 - DNA, 110 bp, Homo sapiens
ccttttgctcggctttgttgccaatttcatgccatgtattgctccatgttttgtgcttcatgaagctgtcacaggcataaaagtggtctgaccagggtcgtagtaaaagg

SEQ ID NO: 6839207 - DNA, 83 bp, Homo sapiens
gctctcctgtaagttcttggcaatttgatctcagtttgcagaaggcagctggcatactttgctaggaagtgcagctggagagc

SEQ ID NO: 6839208 - DNA, 62 bp, Homo sapiens
atgcaccaggacttaacacattcccattaaagaagtgtggacttgctgtcctggacttgtat

SEQ ID NO: 6839209 - DNA, 56 bp, Homo sapiens
gggttagcagcatccaccaggtgatctgacagtgacaccaggtggctgatgacacc

SEQ ID NO: 6839210 - DNA, 55 bp, Homo sapiens
gcggtattgcagagaagtcaatgctattgtttacatgacagatgctgcagatcgt

SEQ ID NO: 6839211 - DNA, 59 bp, Homo sapiens
attgctcttttaaatcaatcactgtgactgaaatgtgcaggacagtttggaagagaggt

SEQ ID NO: 6839212 - DNA, 70 bp, Homo sapiens
agggcatctctaacagtctccttcccccttagatagtgacgagaggctgcgagactgtggaaatgaccct

SEQ ID NO: 6839213 - DNA, 56 bp, Homo sapiens
ggtcagactgattcctctgtgtgcctgttgctctgaccacaggagtccagtcgacc

SEQ ID NO: 6839214 - DNA, 59 bp, Homo sapiens
tgacttgcctgcactgagcctattctgctgataagataggcttttgtgcagagcaggca

SEQ ID NO: 6839215 - DNA, 84 bp, Homo sapiens
tcctgaattcatatgggtgagccatgatcagagatgtaactaggaggatttgtttgcagggttaatttaatgtgagaggcagga

SEQ ID NO: 6839216 - DNA, 68 bp, Homo sapiens
gttatgaagtcattcacaaataatttgttactgataatgattaaatctatgtgtgaatgagttttagc

SEQ ID NO: 6839217 - DNA, 56 bp, Homo sapiens
gatgctctttgctgcctcagtttttccaactggaaaacggaatgagtaagagtatc

SEQ ID NO: 6839218 - DNA, 99 bp, Homo sapiens
tttttcttgcttctttagactttcctgtattttgcgaattttctataatgaggctgtaggacttttaggatgaggggataaacaaaggcagcagaagag

SEQ ID NO: 6839219 - DNA, 105 bp, Homo sapiens
tcatcgtaggtgtataactaattttgcattaccatttatgagtgatatagttgtgttctttttaaagtgtgtatgcaattagtagtggttatattcatttcgtga

SEQ ID NO: 6839220 - DNA, 76 bp, Homo sapiens
taaaggaggtgaagttggccagtttagttttttcagtttacttggggaactcattagcctgctttcagcccttttg

SEQ ID NO: 6839221 - DNA, 56 bp, Homo sapiens
gcacagtctcgaagccaagctccagcacgctggggcactcggccgtgaactcgtgc

SEQ ID NO: 6839222 - DNA, 55 bp, Homo sapiens
gaagttgggaggagaaaaggttttgagtatctcccctagcctcttacccagcttt

SEQ ID NO: 6839223 - DNA, 115 bp, Homo sapiens
ctgccccataactctggtcacagtttcccactaagtctgtgctgttggtgaggatttgcaataggatctgcagtaggacttggttgtttattatgagccagagtccctggtttgg

SEQ ID NO: 6839224 - DNA, 72 bp, Homo sapiens
cagaggccatggaggcagagtcgaggctctctgctgaccacagacggagcctgtggctgcttgaagcctctg

SEQ ID NO: 6839225 - DNA, 68 bp, Homo sapiens
actagaagacattcatctagtcagtattccatagttgtcaaaaatactggagatggaatgcttttggt

SEQ ID NO: 6839226 - DNA, 67 bp, Homo sapiens
ttgaattaagggccaatcctccagcctgtgcacacagtttgatagtaatgtgagctcttaatatcag

SEQ ID NO: 6839227 - DNA, 65 bp, Homo sapiens
acagacccagttccacaaactggaacttctacaactcttgcttccagttaatcactgagtcctgt

SEQ ID NO: 6839228 - DNA, 66 bp, Homo sapiens
gcctttctgactcccaggcagatatggacacagcatcagaggtgtccggggctgggagggagaggt

SEQ ID NO: 6839229 - DNA, 90 bp, Homo sapiens
ggttcatatgaagaaggcaggcagggctcactgtctcctagaactcatcaggggattggcacctgcagcctgggtgtttatatttgaatt

SEQ ID NO: 6839230 - DNA, 61 bp, Homo sapiens
agcctctgtcaagcttttcaaagacacccacaaactgtcaccaagagcttgtacaggggtt

SEQ ID NO: 6839231 - DNA, 83 bp, Homo sapiens
tctggggtaatgtctctacaggtggataggcatagctctgtggacatataaatcagttagtgccccactgaggcagctccgga

SEQ ID NO: 6839232 - DNA, 102 bp, Homo sapiens
tgtagtcaacaaaaatgtgtttagaactcaattactggggctccaaagatgaataatgagatcagataagttttgagttttaaatatatgttttttgttata

SEQ ID NO: 6839233 - DNA, 92 bp, Homo sapiens
ttggtgaatgtcttgtgagtctgtatgtcttccatgcacaggcattttaacctgtgcatgaaagacatacagattcagggctatgttttcaa

SEQ ID NO: 6839234 - DNA, 82 bp, Homo sapiens
gttatggctcagggtaggaatcagatgcggtttagcttagggaaagacaactcttagctctgtcactgcctgagccgatgac

SEQ ID NO: 6839235 - DNA, 93 bp, Homo sapiens
gcaggtgggtgtaagaaacagctagaaagccattgggaacctagaatgtcctctttctagcccttgtttttctttctttgcagactgacttgc

SEQ ID NO: 6839236 - DNA, 76 bp, Homo sapiens
tatttccagctcttgctcatacaattgttggtcagtctttctgagctgcactgacctgtatgaagtgctgtggata

SEQ ID NO: 6839237 - DNA, 77 bp, Homo sapiens
cagtgtgggacggtgattggggccacaggttgtggaatctgacctggttcccagccaggctctaccacttgacgctg

SEQ ID NO: 6839238 - DNA, 60 bp, Homo sapiens
gctgggagccccgagccagcgccctcggtggaggcagccggcattccgagggctcccggc

SEQ ID NO: 6839239 - DNA, 93 bp, Homo sapiens
gaattaacagggagggaacacagaagggctgaaaaatgaggtgctgttctccttcttttacctcagctgctgtgattcctgctatcccaattc

SEQ ID NO: 6839240 - DNA, 60 bp, Homo sapiens
gtccttgcttgagacaggcagtactagaagtatcagaacatgtggtgctgaagcaggcac

SEQ ID NO: 6839241 - DNA, 79 bp, Homo sapiens
aatggttctgcaggtggtttggacactgctcaagagtccccttggctggcaggcaacggaccactagtcagaaataatt

SEQ ID NO: 6839242 - DNA, 56 bp, Homo sapiens
tgcttaggtgttatgtaatatctgatatctgcttaggtgttatgtaatatctagta

SEQ ID NO: 6839243 - DNA, 55 bp, Homo sapiens
cctccctaggtcctattgccctccagataatatcatgaagggggaacctgggagg

SEQ ID NO: 6839244 - DNA, 130 bp, Homo sapiens
tccccacactacactgctccaggctgggtgccagagtgaccctgaagcaggcactcagcttgtgacaaggctgggggcagctgggggtagcttctggcctgagagagactaatcagatgtacagtgggaa

SEQ ID NO: 6839245 - DNA, 60 bp, Homo sapiens
gctgtctgggagactgatcacccgataggcattcctgttccagtcggataactagacggt

SEQ ID NO: 6839246 - DNA, 90 bp, Homo sapiens
ggtcgtatggaggtttagtcactggaatagcattgattcttgattaagtggagggtctaacaatctgttctatctacatctcatctgagt

SEQ ID NO: 6839247 - DNA, 86 bp, Homo sapiens
gtctggtaggggctgctctctgcttctgggatggtggcttgctgctacatgctcctgaggagaagagtgctaggttctcacatgac

SEQ ID NO: 6839248 - DNA, 66 bp, Homo sapiens
cagattatagttttcaaggattggagctggaaggagttgcctgtttgagagctgtgttaaggtctg

SEQ ID NO: 6839249 - DNA, 85 bp, Homo sapiens
gattctatatttacctttgcctctgctttttccttcagtgataagagtgcagggattatgtaggggttgagatggggaatgaatt

SEQ ID NO: 6839250 - DNA, 66 bp, Homo sapiens
ttgcacaatgtaggatatgtacttgtgtgagatttctctacatactttagcactgcattgttgcag

SEQ ID NO: 6839251 - DNA, 63 bp, Homo sapiens
tggccctggagagggatatggcatattaggggtgagataatgccctcccattcctggtagtca

SEQ ID NO: 6839252 - DNA, 56 bp, Homo sapiens
cccttctacctgtgccttggtgggtgcattcaccatgaggcatgtgaggagaaggg

SEQ ID NO: 6839253 - DNA, 78 bp, Homo sapiens
tggacttttcatgctgacttttgattggaaagattggggtcagtaactacagggaagagccagctagtgaagaggcta

SEQ ID NO: 6839254 - DNA, 64 bp, Homo sapiens
aggaagaagcctgctgttagtgtgaactctatttgaactaggtgtgacagcaggtttcattctt

SEQ ID NO: 6839255 - DNA, 56 bp, Homo sapiens
cctcagtgcgtactgaacagtgaccatgtgctggatgctgtgtgaggcactagagg

SEQ ID NO: 6839256 - DNA, 90 bp, Homo sapiens
gagcaaacaaaacaagggctgagcacagtgagccaacagccttttgctgactgtggtttcacatggctcagccaagtcttagtcctgctc

SEQ ID NO: 6839257 - DNA, 58 bp, Homo sapiens
attaggcaattctgggcatctcagtctagaatgaaatgtccaaagggattcgtctgat

SEQ ID NO: 6839258 - DNA, 96 bp, Homo sapiens
tgttgctgcaggcaatgccataaaatgtcacagaagaactccccagcatctcagggctggggcagctgtggcagtggctctgtgatgtcagcagca

SEQ ID NO: 6839259 - DNA, 80 bp, Homo sapiens
gggaaggagccataaagcactgaatcaccgatgccctctcctacccagctcagtagtttctgctttgtgttttcctttcc

SEQ ID NO: 6839260 - DNA, 72 bp, Homo sapiens
gagatgttcatgtggctgctggcagcctcaaactcatatcctcttgaaacttcagcagaaacataaattctc

SEQ ID NO: 6839261 - DNA, 59 bp, Homo sapiens
tatatatgcgcaggcacccagctgtgagggggagcactgggtggggctgtgggtatgtg

SEQ ID NO: 6839262 - DNA, 71 bp, Homo sapiens
ctgaaaccacagaataactcttgcttgagttattactaactcgataactcttgtgtttttttgtgggacag

SEQ ID NO: 6839263 - DNA, 87 bp, Homo sapiens
aacttgttaaataattatctgcaatggttaatatttgtaatatgcaaacatgcattagttttagatatatggccaatgcaatgggtt

SEQ ID NO: 6839264 - DNA, 88 bp, Homo sapiens
gcccgggcgtccccgaaccctcgcgcgcgggcggctccggacgcagtgtccccggcctctgccccgcggggctcgggccgcgccaagc

SEQ ID NO: 6839265 - DNA, 92 bp, Homo sapiens
gagacagaggcggacgcagagacatggcgacagagaggatccgtctcccctgctccggcgctcatgtttccagccgtgtgcactcaggtctc

SEQ ID NO: 6839266 - DNA, 117 bp, Homo sapiens
gacttatcaaagtgcttccttgtgcacacattctatggggctgacttaatgaatgtacaaaacccattcgcaattagcaacacccatttgtgtgccaacaactcacatgcaaaagtc

SEQ ID NO: 6839267 - DNA, 61 bp, Homo sapiens
gtctggaaattcaatttaatgctatgattatagtcagaatgctttatttgaaattgcagac

SEQ ID NO: 6839268 - DNA, 58 bp, Homo sapiens
ctcaacacagccattcccctagaagttacagcacttctagggtcacctgtgttcagag

SEQ ID NO: 6839269 - DNA, 59 bp, Homo sapiens
gacctcagattttcccaggccaggtctaccacgaaggggcctgaaatagctctgaggtt

SEQ ID NO: 6839270 - DNA, 79 bp, Homo sapiens
gttttatgaggagtcaaggctgtgacatggagcccttccaaggcgtctttcacacgtccttgctactcctctaataagc

SEQ ID NO: 6839271 - DNA, 69 bp, Homo sapiens
gcgctatgctacttcaaccttctctattagataaagtaactgtcagtaactgggttgaagctagagcgc

SEQ ID NO: 6839272 - DNA, 79 bp, Homo sapiens
ctgtgacacatgccttaatttccctgttttgtttcactccatgagcataagacctagaaattacaggctatgtaagcag

SEQ ID NO: 6839273 - DNA, 99 bp, Homo sapiens
ctcggctctttgggaggccaaggcaggcggctgggaggtggttgtagcgagccgagatcacgccactgcactccagccttggcaccattgagcactgag

SEQ ID NO: 6839274 - DNA, 86 bp, Homo sapiens
gggtaccaggctggggggcggggggagctggaatgaattaacgccattaatgtctggaaaccaccccgtttctccagaaactgccc

SEQ ID NO: 6839275 - DNA, 105 bp, Homo sapiens
gagatttattttcttacagttctggaagctagaagtcctagataaaggtgctgacaaatttagttcttggtgagggcttcctggctggcagacagacatcatctc

SEQ ID NO: 6839276 - DNA, 67 bp, Homo sapiens
tttgcaaaagctgctgccaatcaggcttgcctatctttgcagggctaattaacagcacttgggcaag

SEQ ID NO: 6839277 - DNA, 72 bp, Homo sapiens
gcccacacatggttccgcaggatgcaggagggtctttcccaggagtgggttttgtgtagccagtgagtgggc

SEQ ID NO: 6839278 - DNA, 79 bp, Homo sapiens
ctctctgcgtgcggatgaggaggttgaaccccctctgcgtggggatgaggaggccgacccctctctgcgtggggatgag

SEQ ID NO: 6839279 - DNA, 82 bp, Homo sapiens
catgggtatcagccatattagacacagggctcagggctgtgtgcaacctgcatcagtgactgaatatgagtgacaacccatg

SEQ ID NO: 6839280 - DNA, 67 bp, Homo sapiens
tcccactagatcttggggggatcaccatggtggacttgctcacacatgagagcccccaagagcagga

SEQ ID NO: 6839281 - DNA, 99 bp, Homo sapiens
tctgttccaagagggaagccaggcggggctggcagaagcccccagggcgcccagagctgcagcagcctccagccttgggtttccagagtagagagcagg

SEQ ID NO: 6839282 - DNA, 74 bp, Homo sapiens
gatttttgacagttttaggaaagggaagagatctgagatgtcattgggcccctcctaaatacatatcaaagatc

SEQ ID NO: 6839283 - DNA, 96 bp, Homo sapiens
cctggcaatccaactgctgctgtttgccgtcattgccttgatgtcattgttcaggtgggaggcaggaagggtaaggagaaagtagtgaatgtcagg

SEQ ID NO: 6839284 - DNA, 64 bp, Homo sapiens
gtgctgtatcagaatctgctctggtccctgagagaaaccagagagattttctgagagatggcat

SEQ ID NO: 6839285 - DNA, 122 bp, Homo sapiens
taactaatttaagcctcataacagcattatgagaaaattactataattgtcatcattttatagaccaagaaatgaaagggcagaaggttgaagtaatttgctcaaggtcacacagttagtta

SEQ ID NO: 6839286 - DNA, 57 bp, Homo sapiens
ttccagagcatgtcaactagctttatgctttgcattaaagttaaccattctctggga

SEQ ID NO: 6839287 - DNA, 64 bp, Homo sapiens
gtcagcacctctttggggagctgcttccaaaagttctggatgaggctcaccgggggtgtggggc

SEQ ID NO: 6839288 - DNA, 74 bp, Homo sapiens
ctggatatttcccatttcccccaaatgcagcctggtaaccactgtatttgttgttaaatggagaggatttctag

SEQ ID NO: 6839289 - DNA, 72 bp, Homo sapiens
cctgagctgcagacaggcaggtgctgctttgctgtcactggtgcaggcagctcgatgccttgttgaggctgg

SEQ ID NO: 6839290 - DNA, 64 bp, Homo sapiens
aggtctgggagttcattccctggagaggggaacagaaatctctggaggaaaagctgccaggcct

SEQ ID NO: 6839291 - DNA, 125 bp, Homo sapiens
caattagtatctgggcaaaaatatttttaactgtatttaggataatttccttggaatattattcccagaagtgaaatttctagaccaaaaggtatgaaagtttttgaggttcctgatacaaattg

SEQ ID NO: 6839292 - DNA, 77 bp, Homo sapiens
agatgtgtgcattttagtgtctcagactaaattcgagaatcattagtttaagtttcagaagctaagaagtgccatct

SEQ ID NO: 6839293 - DNA, 69 bp, Homo sapiens
ggggcttggaaggctgaatggcctctcttaagacccacaggcagagaacattggtcttcctatggctcc

SEQ ID NO: 6839294 - DNA, 95 bp, Homo sapiens
ctcaattagcacctgggcatggtttggtctttgtagtggataatgtctggccacacaaagatggggcacgggccaggtcagttctgctgactggg

SEQ ID NO: 6839295 - DNA, 61 bp, Homo sapiens
ccttggtgacagaaagacctgggttcaaggcttacctctgtaccttattctgtgaccttgg

SEQ ID NO: 6839296 - DNA, 55 bp, Homo sapiens
agtgtctgagccagaattagaagttacaggtgtctaattctgtgtttcagccgct

SEQ ID NO: 6839297 - DNA, 82 bp, Homo sapiens
atctaagtctatttcatccttgaataaaatgggaacaatagtaatcataggattgttgcaagggttaaatgagaaaatagat

SEQ ID NO: 6839298 - DNA, 77 bp, Homo sapiens
tccacgtggcctctccttgaggcttggacttctcacaatatggcagctggatttcaagagggagtgcaccaagtgga

SEQ ID NO: 6839299 - DNA, 65 bp, Homo sapiens
ctgacaaacagggagtttgctcacctggccaagacccccggtgaggcagaaattcctgttttcag

SEQ ID NO: 6839300 - DNA, 104 bp, Homo sapiens
tgaggcggggggatcgcttgagcccaggaggttgagggtgcagtgagctatgatcgcgtcactgcactccagcactcagggcgacagagcgagaccctgtctca

SEQ ID NO: 6839301 - DNA, 106 bp, Homo sapiens
ctatgagaatgctgggaaccaagaaacaagcccaaggatgggaggttgaaaatgtaaaattagtctccagcttagggtttgggttgtttctctagcacctcaatgg

SEQ ID NO: 6839302 - DNA, 117 bp, Homo sapiens
gtcacatatgtactttctggtatgattctacatttaaaaggaaaatctgggctgtagatatagatttggcaatgttttagcatgtagataatatttaaagacataaaactggttggc

SEQ ID NO: 6839303 - DNA, 62 bp, Homo sapiens
ccattttgcatagagatgaggcaagattagctcagatcatgcaatatgtcagtgcaaagtgg

SEQ ID NO: 6839304 - DNA, 71 bp, Homo sapiens
ccagttgccctgcctccctgaggtgatgttacctttttgatcatcttccatcacttcactaggggtattgg

SEQ ID NO: 6839305 - DNA, 85 bp, Homo sapiens
ttatacagctctatctgccttgctgcttgtaagtaaaacaaagatgttttgttttggttttagtgtcactggagaagctgtctga

SEQ ID NO: 6839306 - DNA, 98 bp, Homo sapiens
ggggtccaggcctgtgtccacctttcacctcccatcctgttttccagagaggccccagaacaatggacgggaggctggagcctaccagtctgggcccc

SEQ ID NO: 6839307 - DNA, 64 bp, Homo sapiens
tggtgaagagggaataagcgttggtgattaaccagactggtcactggaaatttcctttgttcca

SEQ ID NO: 6839308 - DNA, 92 bp, Homo sapiens
ctttgggaaacgctttgaagtgattaaccatgctctgctttgctgcttctgggggagcagcagtgtgtggtcatgtttgaagtaggccaagg

SEQ ID NO: 6839309 - DNA, 61 bp, Homo sapiens
gggcggtcggggagaagagcggggaccctccccaacggcccgcttgtccccgttatcgccc

SEQ ID NO: 6839310 - DNA, 55 bp, Homo sapiens
tttcttctgcctcccacctgataaataatcttgtgtagtgcctgggcagaaggaa

SEQ ID NO: 6839311 - DNA, 57 bp, Homo sapiens
gacataaataatttaagcaaatggccttggacaccagaggctgccaattattgtgtc

SEQ ID NO: 6839312 - DNA, 59 bp, Homo sapiens
tggtgtcagtgtgaggtcttccacccgggtctcctggctatgacttcgtactgtctcta

SEQ ID NO: 6839313 - DNA, 68 bp, Homo sapiens
acaagtaatagatcttagctagcctgtacccacttgctacttgccaagttctgtgctgttttgcttgt

SEQ ID NO: 6839314 - DNA, 97 bp, Homo sapiens
gttttctctttttggaagctcttctgtattcagctttgtcagttgaagagttagttcttcaggacaggttcgggtgggtacagaaagtagggaaaac

SEQ ID NO: 6839315 - DNA, 87 bp, Homo sapiens
caactggacattgagtatttcttttctctgatatatggattgtgaaaatcacagagagaaataacatgagtcttaatgtgtatgttg

SEQ ID NO: 6839316 - DNA, 74 bp, Homo sapiens
ctgatcaaatcaccaaactcactggcacacactgagtggcaacaccgggggcctggagtgttggtatttctcag

SEQ ID NO: 6839317 - DNA, 81 bp, Homo sapiens
ggtatggtttagtgggtttatacaatttaaatggcttatataattatttgaaatgaaaagaaaacctagtcagccagaacc

SEQ ID NO: 6839318 - DNA, 64 bp, Homo sapiens
gttatttgtgttgagtatatagtaggtctacagaactgaaataaatgtactccccacaagcaac

SEQ ID NO: 6839319 - DNA, 82 bp, Homo sapiens
taatttactaatgcccagtctcttaaagtggagtccatttcactccactttagcaatgattgaatgttggctttttaaatta

SEQ ID NO: 6839320 - DNA, 57 bp, Homo sapiens
ccttttgctctcccatccagaagggcacctaaccaggcccctggagcagacaaaagg

SEQ ID NO: 6839321 - DNA, 60 bp, Homo sapiens
gaaccaggaagcaggccctcaccagacactgaatctgcaggcacctggatcttggaattc

SEQ ID NO: 6839322 - DNA, 70 bp, Homo sapiens
ggctaggctcacctggagagttgagaatagaatgacaaacctacagattcccctgggtggggtctaagtc

SEQ ID NO: 6839323 - DNA, 87 bp, Homo sapiens
tcatttccagttgtgcctctgatctggaagtctggagtacttgcgaacgaacagatgaacttccttagagaaacacttggaaaatga

SEQ ID NO: 6839324 - DNA, 73 bp, Homo sapiens
gcgattttcattattcatgctagttatgctctatatataaagttgcaagcactgaattagtgaaaactgacgc

SEQ ID NO: 6839325 - DNA, 76 bp, Homo sapiens
catttgtttcaacactgatcgtttacacagcactactctatgccaggtaatgtgatgggcaagtgtgaaatgactg

SEQ ID NO: 6839326 - DNA, 62 bp, Homo sapiens
ggccaggtggctgcctccccgcgcgggccatgcctgcacagtgggtggggcgtcaggtggcc

SEQ ID NO: 6839327 - DNA, 77 bp, Homo sapiens
gctggctcaggtggcttggcaggtaagcaacaggcagggtcttaggttaagagctcttatctctaagcacagccagc

SEQ ID NO: 6839328 - DNA, 91 bp, Homo sapiens
gatgcaggaactaattgcaagagctctcaatggtcaatgctggaacaatttgagcaacgcaagagagtttatgtagcattggattctaatc

SEQ ID NO: 6839329 - DNA, 71 bp, Homo sapiens
catgagcaagctggccttccagccttgcctctacatgccaccgtaggccacagttgaggccagcaactctg

SEQ ID NO: 6839330 - DNA, 84 bp, Homo sapiens
agctttttgaaataaagtagcgtttaaggtgcacagatttatcctttctttggggcatcttaaggtctactgatatcaaatgct

SEQ ID NO: 6839331 - DNA, 59 bp, Homo sapiens
gggaccaggccagcctccctgcggagcctaagggccctctcagagacagggccggtccc

SEQ ID NO: 6839332 - DNA, 64 bp, Homo sapiens
gagaggttcctcttcctccatcctgttagaaggcagccatctgcaggctaggaagagagccttc

SEQ ID NO: 6839333 - DNA, 69 bp, Homo sapiens
gattccacagtctttgcttttaaccagaggttagcaaactacttctgtaaagggaagacagtaggtatc

SEQ ID NO: 6839334 - DNA, 70 bp, Homo sapiens
ggcggagctcagtggggggactgtgggaagaagatgcacccgcagacaccgcacctcccctgggcctgcc

SEQ ID NO: 6839335 - DNA, 58 bp, Homo sapiens
gaacaaacatttttggcagtatgtacccatttagcacactgcctatatatgttagttc

SEQ ID NO: 6839336 - DNA, 58 bp, Homo sapiens
tgactcaactcaataggggcttattgtttacatagactaagaagtccagagttgagca

SEQ ID NO: 6839337 - DNA, 80 bp, Homo sapiens
tgctggggcaggctgggggctggctaggggcacggagagacaggcactcagcccagcagtcttagcctgcagcccagaca

SEQ ID NO: 6839338 - DNA, 66 bp, Homo sapiens
tgtgagatgatagatatgttaatttgctttaaagtagcaatgattttactgtctgtgtatctcata

SEQ ID NO: 6839339 - DNA, 58 bp, Homo sapiens
ggcaccatgctgtccatgacgtacagcgagagtctgcggagcgtgagcagcaggtgcc

SEQ ID NO: 6839340 - DNA, 82 bp, Homo sapiens
gaagccattgagatacatgtgtgaccaaagagtgatgaggtggatatttctttgtgtcctatatgcatgttctcattacttc

SEQ ID NO: 6839341 - DNA, 72 bp, Homo sapiens
tctgccgtgcgaggtcccaccacaacaatcccggggccagggtgctgcgcttggtggggcctgagaggcggg

SEQ ID NO: 6839342 - DNA, 67 bp, Homo sapiens
gtgacgtgcaggtgtggccagcagcttgtgtttgtcaatggtaggtggtggctatggctgtgctcgc

SEQ ID NO: 6839343 - DNA, 87 bp, Homo sapiens
gggttcaaaggcttgcagggaaacagtttaggaagtgcccccttttaggatagcttgatctctctgattccccagtgcctccagccc

SEQ ID NO: 6839344 - DNA, 79 bp, Homo sapiens
caggctgcagggcactgtggggcccatgctgagggacagacgagtgacttgcagccagctgtcccaagtgcctggcctg

SEQ ID NO: 6839345 - DNA, 96 bp, Homo sapiens
cccctgtcctcggtgaccctgggccttgcatcccagagccagcacgcacgccgggctccccccatgcaggtgcccctgggacactgggtatctggg

SEQ ID NO: 6839346 - DNA, 82 bp, Homo sapiens
cttcatgtttattgcaaaccattaagcatgttgagtacattactgacttaacaaaaacaagtgttttggaaaagaaatgaag

SEQ ID NO: 6839347 - DNA, 77 bp, Homo sapiens
tctcatcttcttcatctgtaaaacttggataataataggacctacatcacagggttgttgatggggattacatgaga

SEQ ID NO: 6839348 - DNA, 88 bp, Homo sapiens
atggactgctaggaaatatgatagtgtgagtagagcacagaggaaagaacactcaggtctctaattgacattacttgactcagtccat

SEQ ID NO: 6839349 - DNA, 83 bp, Homo sapiens
gcagattcctggcagcagagctcaacatagataccaaaaataaatgaaagtggtttgctgtgactgctggccagcaatgatgc

SEQ ID NO: 6839350 - DNA, 62 bp, Homo sapiens
atgcatgaaagaatccaagccttaagatttcttcagtgtcttgtactgtctttcttgtgcat

SEQ ID NO: 6839351 - DNA, 61 bp, Homo sapiens
tgttgacctagaaaatgactgctctttagcacaacattgaaggcagcaggatccagggaca

SEQ ID NO: 6839352 - DNA, 108 bp, Homo sapiens
ggcctcccaggcagtggatgttcacagctgggacaagactggggggctacaaaaatggctgccaatagctggtctttaagcatgtaacaaataccttccagggactcc

SEQ ID NO: 6839353 - DNA, 78 bp, Homo sapiens
agttacctgagtgctacccagtctctgtcaatttcgtacatcagagtctcccagcacctggtgtagcactcaggtgct

SEQ ID NO: 6839354 - DNA, 62 bp, Homo sapiens
tggtgaacaaataattgcagttttcccattattttcaatgaactgcaataacttgtgcacca

SEQ ID NO: 6839355 - DNA, 60 bp, Homo sapiens
tacagatgttagttatgggagggtgcagaaagtcttttcttcctctaattttaagctgta

SEQ ID NO: 6839356 - DNA, 78 bp, Homo sapiens
gggcagcaggttgcagatggatgtggacggcgccaaggacccccactgggtctgtcttcccaatcgtggcctctgctc

SEQ ID NO: 6839357 - DNA, 78 bp, Homo sapiens
tattatattttggaattatgcttaaagtttcactgctgaaattactttgaaggaaatggcgtcttccaaaataaagta

SEQ ID NO: 6839358 - DNA, 59 bp, Homo sapiens
gggcagggacagagtgttgtggccaggaaggtctgatgagcagctactctgtctcgctc

SEQ ID NO: 6839359 - DNA, 68 bp, Homo sapiens
gttggatggcatcgtcctgggcatagggagggatgagttctcctgccaggagatggtagccatcctgc

SEQ ID NO: 6839360 - DNA, 90 bp, Homo sapiens
tcttgagtttccttgacagctagacctcctcctcggggccagccctgcagtgtggtcctggggtgtgttttgctgctcaggggctcggga

SEQ ID NO: 6839361 - DNA, 55 bp, Homo sapiens
gggtggctgcactaggcagccagtgcacgcaagcagctgctcgctgcagtcactc

SEQ ID NO: 6839362 - DNA, 70 bp, Homo sapiens
ggaagggaggactcggagggtgacagggagcaggtgtaccacccaccccacaccctacggcctcacctcc

SEQ ID NO: 6839363 - DNA, 71 bp, Homo sapiens
atagataaccctgcacttcctggattttaaacaatcggtagttggatggcagggagttgcaggatttctgt

SEQ ID NO: 6839364 - DNA, 78 bp, Homo sapiens
ttttagtagtgtggaaatgacttctaatggaaggcgggataccatctttacagaatgtcaatttctatacttctcaaa

SEQ ID NO: 6839365 - DNA, 57 bp, Homo sapiens
tctgtccagtggctctcagggaagggttggatgcctctccagggtctcctggccagg

SEQ ID NO: 6839366 - DNA, 77 bp, Homo sapiens
gccttgtttgctgccagggtgaggcgcagcagctgtttaacagccctgtgagtgaccctggtcagcactttcaaggc

SEQ ID NO: 6839367 - DNA, 76 bp, Homo sapiens
cagtcttgaccttgtcctctgcttgctggaagccctgctgtggcttctcctggcctttaggttaaggttcagactg

SEQ ID NO: 6839368 - DNA, 77 bp, Homo sapiens
agatggccaccaagtgcaaattctgaattcttatatttttataagaggagtagatgtggttggtaaaaggttatgct

SEQ ID NO: 6839369 - DNA, 77 bp, Homo sapiens
atatgttgtttctgggagattcatatgaaaaaggattttttttcatctccgtttttatgttgtcctcagtgttatat

SEQ ID NO: 6839370 - DNA, 78 bp, Homo sapiens
taaatcatggggatgagatctttaagaagaagaaaaccaagttgtcttccagaagtgttttcagaaccccctgttttg

SEQ ID NO: 6839371 - DNA, 99 bp, Homo sapiens
ggagtccctgccagctgcttctccagaatttgcttctctgccttctcctactggggtggagatgaagagtatctaggatggccagttggagcagataac

SEQ ID NO: 6839372 - DNA, 76 bp, Homo sapiens
ttgaacctttttccaagtaaacaaagaagggataatgagtgatgccatccgacttgtttacatggagaatcttcaa

SEQ ID NO: 6839373 - DNA, 82 bp, Homo sapiens
ttgaatgtcacaagacttatttgtgtagaaaacagaacactcaccaaggtgtattctttacagtgggttttgaatcatttaa

SEQ ID NO: 6839374 - DNA, 63 bp, Homo sapiens
agaaagtctgtccttattcctcattctcccccaaaaaccccagtgaggaggcttcagctttct

SEQ ID NO: 6839375 - DNA, 58 bp, Homo sapiens
gtgaggatgcatatgatggcaagaaaatggcagctctgcctggatgtgctggcctcac

SEQ ID NO: 6839376 - DNA, 89 bp, Homo sapiens
ctgggctcaggtcatgcttctgccatactgaggacacattgtgattttcattacagttggaattttgggtgtcagaggcctgggcccag

SEQ ID NO: 6839377 - DNA, 129 bp, Homo sapiens
tcttagatagcatctttcaaaacatctcccttgatgatttatagatttttatgaagtctggtgactagattagatgatttatgactatacctctagcagggtgcatgagtgaacacaagatatttttga

SEQ ID NO: 6839378 - DNA, 70 bp, Homo sapiens
agatgaattacagataatacctactgcctttctccaaactgaagggttaccagttctgtcgttttaatct

SEQ ID NO: 6839379 - DNA, 78 bp, Homo sapiens
gccccttcacccagttgttgccggctctggactggccaaacacgaagttgtccggccgaaagatctgaccgaaggggc

SEQ ID NO: 6839380 - DNA, 87 bp, Homo sapiens
gtcattatttaatgtaggctaacagccacagtcttcattaatatattaacctatggctcacaaaggccttgcagtaaaccaaatgac

SEQ ID NO: 6839381 - DNA, 115 bp, Homo sapiens
catgtgtttcctgtcccttattctaaatcgattgggccatttgtctaatttaaacactctataaattatacacatcctccaaagatagggatgaggtagaggcccttgatgtatg

SEQ ID NO: 6839382 - DNA, 64 bp, Homo sapiens
tcggaaattcactgtcagcttgcatggggtagaagccccatcagagctgaaggcggtttgctga

SEQ ID NO: 6839383 - DNA, 67 bp, Homo sapiens
aatcttgcctagcttagggaaactgacagagtagatttcttggcagtatctttgtggttgttagatt

SEQ ID NO: 6839384 - DNA, 117 bp, Homo sapiens
taaattcaaattgattagcccatttaccaatcttccagtgtagacatctgccttgtatccccagtgattaatacacggcctgcctggagggtaagcaataaatatttgttgaattta

SEQ ID NO: 6839385 - DNA, 78 bp, Homo sapiens
agctccagattaacacggagcttaacatgagagagaaatgaactacgtatcttatttgagccattgttattttgggct

SEQ ID NO: 6839386 - DNA, 93 bp, Homo sapiens
ttcttttggcactgtctcaatatgcaaagcgtgttatctgcaaaatacctgtgcagaaaacattgtgtgtataagatctaaagcctaaaagga

SEQ ID NO: 6839387 - DNA, 58 bp, Homo sapiens
gcagctttcttgccctaatcttatcacctgccattaaagatcagaatatgaaagctgt

SEQ ID NO: 6839388 - DNA, 57 bp, Homo sapiens
gcaagacagtgacagtcacaattggaatttaagtttccaacactgcccattgtttgc

SEQ ID NO: 6839389 - DNA, 62 bp, Homo sapiens
aacttgaattcaaagcgaaagcactggaccctttagtctgtgtgagcttgggattctgagtt

SEQ ID NO: 6839390 - DNA, 66 bp, Homo sapiens
agcactgctgaccttcagggctgcttccatccctggtgggggccgtcctggggattatagagtgtt

SEQ ID NO: 6839391 - DNA, 55 bp, Homo sapiens
ggaagctattgagtcttggacaagttacttcgttcttctaagcctcaatgttttc

SEQ ID NO: 6839392 - DNA, 83 bp, Homo sapiens
gaccttgaatgagattaataatatcgctcctttttttgagaagattaaaatctcatcagagcgataaatacttataaagggtt

SEQ ID NO: 6839393 - DNA, 95 bp, Homo sapiens
gcctcctcagtgccccaggctgagttagaggtgtcttctgggcccctttggcccccagtgattcccatgatcacagccctgagcactgtagcggt

SEQ ID NO: 6839394 - DNA, 62 bp, Homo sapiens
ttgtttattgcttcctttgctgcacagaagcactgttttttgcaaagtgtgggcataaacag

SEQ ID NO: 6839395 - DNA, 57 bp, Homo sapiens
gattgcatttgacaaacaacattgagttatccaagactagatgtttgcaaagcaatc

SEQ ID NO: 6839396 - DNA, 81 bp, Homo sapiens
gtttaaaagcagcagctatatagaagcaggggaaagggtactcattctgttttctcctctacatagactgtgcctctaagc

SEQ ID NO: 6839397 - DNA, 76 bp, Homo sapiens
cactagagtacactgtacacacaattgacttaaaaatggtggtgtgaatatgtttgtgtgtatgtgtgtgtgtgtg

SEQ ID NO: 6839398 - DNA, 59 bp, Homo sapiens
cacagacccagcatacaggaccttccccgggaggggcaggctgatgactggagttggtg

SEQ ID NO: 6839399 - DNA, 102 bp, Homo sapiens
aataagtctgtggatatttaggagaccaggcacaagaagcaaatgttagctatgctcaaatgctgcctttgtgtgcccttttcccactgtctatatcttatt

SEQ ID NO: 6839400 - DNA, 95 bp, Homo sapiens
ctttttaataggcagtgctttgatcaagtgggaaatagtaatggacaaataaaatcaatgatcattatctaacttgatgcctgcttttcaaaaag

SEQ ID NO: 6839401 - DNA, 55 bp, Homo sapiens
tgcagaggtgtgcattcttaagggtttttctcattgagaatggaactttctgaca

SEQ ID NO: 6839402 - DNA, 98 bp, Homo sapiens
gtgctgtctcacttccggaggcggcccagggaggctggccgccctgcggggcctcgcctgctcccagttggcgcctccagaccctaaggggacagggc

SEQ ID NO: 6839403 - DNA, 58 bp, Homo sapiens
caggcagctctgcttttcctaaatatcagaggacactaggaatatgcagggtcacctg

SEQ ID NO: 6839404 - DNA, 79 bp, Homo sapiens
gagcttgtgtgggtcaactgggataaagagctaaagaggtcccttttcttcctgctttgtcccatgtcaaccacaactc

SEQ ID NO: 6839405 - DNA, 57 bp, Homo sapiens
cgggaagccatcagtcaaaaagcctgtgtggtcacagatgcttactggtggttcctg

SEQ ID NO: 6839406 - DNA, 55 bp, Homo sapiens
catattctttaagcaatgctctctaaattggggcatgttcaccttgggggatgtg

SEQ ID NO: 6839407 - DNA, 81 bp, Homo sapiens
ttgcaaaggcttcctgggccctgcttaagcaatgtctgagatttcagaatgtgttgtgggagcctcagggaggctgggcaa

SEQ ID NO: 6839408 - DNA, 63 bp, Homo sapiens
gtggttaattggatgtctactttcctccatggattctttatgatgggaaggaacgactaccac

SEQ ID NO: 6839409 - DNA, 67 bp, Homo sapiens
cccttgcaagcaaggattagccatctctagcacacctctggcatgatcaactactttgcaatgaggg

SEQ ID NO: 6839410 - DNA, 73 bp, Homo sapiens
tctgggcagtgggggccagagggaggtgtagtgttaacgccccagtacttctagcctgccccttgtgctcaga

SEQ ID NO: 6839411 - DNA, 128 bp, Homo sapiens
catgtacatccagagacacacagtcatcatgctgggtgccaatccccaaaccctgcttcactgcaacctcagagcaggagtggaaggagggactgggatgctgagtgcttctgtctcctggatacatg

SEQ ID NO: 6839412 - DNA, 79 bp, Homo sapiens
cacattgcacacacgtgtacacatcattcacatatatatggttgcaacatgtatatgtgtgtgtgtgtgtgtgtatgtg

SEQ ID NO: 6839413 - DNA, 71 bp, Homo sapiens
cttcatgcctgtttttaaattttataagtggggatttgttgcttaacgaattgtgggactgggtcatgaag

SEQ ID NO: 6839414 - DNA, 74 bp, Homo sapiens
tcagcatgacattacagtagcatgacttttagatttctgcctaaaagacatataactgtaggaatcattactga

SEQ ID NO: 6839415 - DNA, 65 bp, Homo sapiens
gggctccaggctttggggcaggagcgcttgcccctgggtgccctgccctcgcggcctgcatgcct

SEQ ID NO: 6839416 - DNA, 68 bp, Homo sapiens
ctgtcctcagcctcttgcactttgaaggcccagggtttcttccgcctccagggacaggagtgtgtcag

SEQ ID NO: 6839417 - DNA, 75 bp, Homo sapiens
gtttcttctgtttcatgctcatggaacacagcacaatctttggggctcagtttactgagtatgagacagcaggac

SEQ ID NO: 6839418 - DNA, 57 bp, Homo sapiens
gaggactgggggaattcgggacccagggtcccgggtgtttctctttccctggccctc

SEQ ID NO: 6839419 - DNA, 88 bp, Homo sapiens
agttttcttggaggcctgcaaacaaggacttctgagccaaaaccatggctaagtcctggctggtttgaagcagcctcttagacaaact

SEQ ID NO: 6839420 - DNA, 57 bp, Homo sapiens
tgtggcttgaaaggcacgctcatgaggtcatttcctttgagtggccactgggtcgca

SEQ ID NO: 6839421 - DNA, 65 bp, Homo sapiens
ggaatcagcagaggcgattgctatcattttttattactgttcagtgtttgatttctgctgtagcc

SEQ ID NO: 6839422 - DNA, 56 bp, Homo sapiens
ggtgggatgccattgctgttctagagggtcatccatggagctccctgcatcccact

SEQ ID NO: 6839423 - DNA, 64 bp, Homo sapiens
gccaggcatttattgattgaataaatattgtactatattcagtgtatcaatgaatgcttttggt

SEQ ID NO: 6839424 - DNA, 78 bp, Homo sapiens
tgacagtcttccctgtgccagagtgtttaataagacctaatgacctttacacactttggagggcagggagagacacca

SEQ ID NO: 6839425 - DNA, 64 bp, Homo sapiens
tatgtgatagctgtagaatgtatacacatatttttctgtgtgtgtaatacctatgttttacata

SEQ ID NO: 6839426 - DNA, 93 bp, Homo sapiens
tccacacctggcaaagccctggctcagctcaccagagagaagagacctcacagcctgggtggggctgaggtaggggcagtgcccagaggagga

SEQ ID NO: 6839427 - DNA, 85 bp, Homo sapiens
tttgcttcccagttttaccctaggtccagattgtagaatcctggagtcaccatgttctgcaggagccctagtgtatgggagcaga

SEQ ID NO: 6839428 - DNA, 79 bp, Homo sapiens
tatttagccctacgtctacatgcaattcttatatttggaacttcttaatcagaaactaaatgtggatttggtttgaatg

SEQ ID NO: 6839429 - DNA, 58 bp, Homo sapiens
tgtccatctgtcttagtacaaactcccacaggctgcctgatctggggcagtgtggaca

SEQ ID NO: 6839430 - DNA, 63 bp, Homo sapiens
tctgcctgtctccttgaattgtggccagtttcacatgggaagcaacgtcgagggacagggaga

SEQ ID NO: 6839431 - DNA, 97 bp, Homo sapiens
gttacttaacttctctgtacttctacatctgcggaatgggaaaaattatagcacccatttcactgggtagttgtgggggttaaatgagttattatac

SEQ ID NO: 6839432 - DNA, 60 bp, Homo sapiens
agtgggcttcagaaagcatggcatctatgctgttgacgtgcctggatctgaggacccatt

SEQ ID NO: 6839433 - DNA, 112 bp, Homo sapiens
agtactagggaaaggatagggcaggtaactatagacatagccgtaatttattttgtaaaagacagatgtaaacaaggttattgtccatataatttgctattcaccaagtact

SEQ ID NO: 6839434 - DNA, 59 bp, Homo sapiens
atgctatcttcagcacctagggaagaattgatctttgcttacaggaaagaagaaagcat

SEQ ID NO: 6839435 - DNA, 85 bp, Homo sapiens
cggcggcaaagactgagacagctccgctgcccgctgaactccatcctcccggcggtcgggcggcggcggctgcggtcggtcgccg

SEQ ID NO: 6839436 - DNA, 74 bp, Homo sapiens
gggagggccaggggctgttgcttggctgggggaggccagtccaggtgacctcagcgcctgcagaagccaggccc

SEQ ID NO: 6839437 - DNA, 59 bp, Homo sapiens
atggtcattcagtcaaagagtcatgatttgaacataagtagactatctctggagaccat

SEQ ID NO: 6839438 - DNA, 69 bp, Homo sapiens
ttgtcccgtgtcttaacagattgtttaaagacctacatcgtgaaaacagtcttgtgggcttggagataa

SEQ ID NO: 6839439 - DNA, 79 bp, Homo sapiens
tgctgaattagtagtagttagcagcctcctagaggaagtgaggtctagcatattactagaaaagaataaatattcagta

SEQ ID NO: 6839440 - DNA, 65 bp, Homo sapiens
agtctcagtttccatgtctataaagtggagatgccattaaatttcctatagatatggtgagtatt

SEQ ID NO: 6839441 - DNA, 92 bp, Homo sapiens
attttagttccttttacagattataggatttttttatggggagagacctcagagattaatactctataatttatagctgtggaaactgaggt

SEQ ID NO: 6839442 - DNA, 77 bp, Homo sapiens
cttatcctgtaaacttagtgatgttcctccatctgcaagcacgcttgcaggaaaaccaacacgccttgcaggaaaag

SEQ ID NO: 6839443 - DNA, 73 bp, Homo sapiens
catgaaacagctgtgatttctatcatgatttgttatttttatatgttatggtagaatttatagttttgtcttg

SEQ ID NO: 6839444 - DNA, 69 bp, Homo sapiens
ttgttttatgcctcctcaaatctgccacaaggaagccacatgtgagacctgaggaggcaatctaaacag

SEQ ID NO: 6839445 - DNA, 56 bp, Homo sapiens
ggtccctattgtataaattagattgaatgagtcttatttttatatggatagagacc

SEQ ID NO: 6839446 - DNA, 62 bp, Homo sapiens
ttccaggaggcattcttagtttaaaggtttctttgtcttttctaagtgatctccagttggaa

SEQ ID NO: 6839447 - DNA, 62 bp, Homo sapiens
agttctttgtaaaaggtctctaagagcctttcacctctctgaaagtgccttttatcaagact

SEQ ID NO: 6839448 - DNA, 80 bp, Homo sapiens
agatatgatgataaagtatttggcacttgggtcaacaatctagtttattcagtagttcagcaaatattttaaatatatct

SEQ ID NO: 6839449 - DNA, 55 bp, Homo sapiens
gagccattatgtatggtatatgctaaaatcctagaatatagagtcaaaatggctt

SEQ ID NO: 6839450 - DNA, 76 bp, Homo sapiens
gggtcccagcttcccactagcagcctcagaagacagagagtgggtgctgctgcagctgtggggtggcctggggtcc

SEQ ID NO: 6839451 - DNA, 58 bp, Homo sapiens
ccagtgcaggtgagcaccaggtgcaggtggctgtgccaggtgtcagggccatgcctgg

SEQ ID NO: 6839452 - DNA, 79 bp, Homo sapiens
gaagctaatgaagtcagggattccatgaagccatccaagcatatagagctcatttccctgggtcccttttccttagctc

SEQ ID NO: 6839453 - DNA, 81 bp, Homo sapiens
gtgtgtgtgtgtgtgtgtgtgtgtgtgtataatgcctatatatatggggatagacagatacaaatatacaaatacaaacat

SEQ ID NO: 6839454 - DNA, 126 bp, Homo sapiens
ggggctgcttgatgattttgtaaatttagactttcaaggatagtgctccaagagctgtatgtttccttcttgataacactcttgcattacctgaatatctcttaggccttaccagcatgcagctcc

SEQ ID NO: 6839455 - DNA, 65 bp, Homo sapiens
gataatctattggtctccacttgttttagagacaactctctgagctatgtaagacttggattttc

SEQ ID NO: 6839456 - DNA, 67 bp, Homo sapiens
gcgggtttgatgtgctaatgagggcatcagttagggagcatcattagcattcattacaataacaagc

SEQ ID NO: 6839457 - DNA, 62 bp, Homo sapiens
caagggctcttttgaggaatgtcctatcagttgcaggagagcatttaccactggagcccttg

SEQ ID NO: 6839458 - DNA, 57 bp, Homo sapiens
ctacgctgtttggtccaggcataggagatgagccctggccgggaagggacagtgtgg

SEQ ID NO: 6839459 - DNA, 114 bp, Homo sapiens
ggataataacaagaatgttaccaggtggatctcagctcatctaatttggataatcctaatctcatctaaattttagagttcagttgggtttatagacattctattcttttctct

SEQ ID NO: 6839460 - DNA, 60 bp, Homo sapiens
cttgaacattgccagccaccatgttgaaaggaaaatgggccctgctttggcagtttcaag

SEQ ID NO: 6839461 - DNA, 70 bp, Homo sapiens
gacgatgcgacagagtggggacttctcaggctggacagggccctagaagccagtcgctctcccgcagatc

SEQ ID NO: 6839462 - DNA, 63 bp, Homo sapiens
ctgaattgtgcttgctagagccttaatgagatgattaatgatctgagcagagcatcatttcag

SEQ ID NO: 6839463 - DNA, 57 bp, Homo sapiens
acttcagtagctcagagctgcctggtaccacagaactggccatgggttgcctgaggt

SEQ ID NO: 6839464 - DNA, 77 bp, Homo sapiens
attctgatatattccatttttattggttcccctcaaaaataaattaggatgagctatatagatggtgtgtttggaat

SEQ ID NO: 6839465 - DNA, 71 bp, Homo sapiens
ctgagattcagcccacagtgggtagtattgagagagggctgggagctgccccagctgggggctggactggg

SEQ ID NO: 6839466 - DNA, 61 bp, Homo sapiens
ccccatgtgaagaaactgaacggcttttatgcaggtaaaagccagttcttttatattgggg

SEQ ID NO: 6839467 - DNA, 86 bp, Homo sapiens
tggaaggaaaggaagaggagttctggaaattgaaaagaagaaaagtaaagttttcagagacaccattttctttctaaacttttcca

SEQ ID NO: 6839468 - DNA, 61 bp, Homo sapiens
catgcattatgcatttgtgatctgggctcaaactgcagctgccagtgtggcatgatgcatg

SEQ ID NO: 6839469 - DNA, 55 bp, Homo sapiens
tcagtctttcgaattcagccagccagccagaaggggcgtgttgaggaaagggtga

SEQ ID NO: 6839470 - DNA, 66 bp, Homo sapiens
tacacttcagggccctcacttgcataggccccactcatggtcctgagagggggccctagaaatgtg

SEQ ID NO: 6839471 - DNA, 66 bp, Homo sapiens
tcactttaagagatcaccaatcacacttgcacattcaagtatctgtgaaggtgctcctgaaaatga

SEQ ID NO: 6839472 - DNA, 73 bp, Homo sapiens
gacaatacacaattgtgtttttatgactgattaaatttcaaggtgattacttcagaatagattgtgtgttgtt

SEQ ID NO: 6839473 - DNA, 69 bp, Homo sapiens
gcccctcacctggaccctgggaggagggcgggggaccgcatctgcgaagcgtccgaggacaagaggggc

SEQ ID NO: 6839474 - DNA, 69 bp, Homo sapiens
cagagaattaattgtggctaagcaaatctggcatgagccagtatacctaggcctatagttgagtctttg

SEQ ID NO: 6839475 - DNA, 73 bp, Homo sapiens
taggttggtgcaaaagtaatttggtttttgtcatttcagtgacaaaacctgcaatcatttttgcaccaaccta

SEQ ID NO: 6839476 - DNA, 75 bp, Homo sapiens
agaaccatcgtccagactctgctcacatgcctctctccttgcttcacagaggatctgggcatctggagtggtcct

SEQ ID NO: 6839477 - DNA, 61 bp, Homo sapiens
gcccagccctgccattctctggagctcagccagattgagcgggtgccaggcagggctgggc

SEQ ID NO: 6839478 - DNA, 63 bp, Homo sapiens
gagtggcctggaaaggctggtctgaagacctctcttcccatgtctgccgaccaggctttgctc

SEQ ID NO: 6839479 - DNA, 69 bp, Homo sapiens
ggaagattcggaagttgttttatagatagaatagtcaaaggctttttcagtcttggcttctgattttcc

SEQ ID NO: 6839480 - DNA, 83 bp, Homo sapiens
ccagcactggcctggctccagcagcgaggtccctggagagtgacacttcttcaatacctgcgttgctagtcccgtagtcctgg

SEQ ID NO: 6839481 - DNA, 81 bp, Homo sapiens
tctgaatgctcagggtctgagcatctcttcatcatatgggacattcatcaccatgaggtatctcatttcctgaaattcggg

SEQ ID NO: 6839482 - DNA, 78 bp, Homo sapiens
gtatgtttttcttgaatagggattgataaatggaagtgcttaccagcccaactttgccagccttaataagaagcatgc

SEQ ID NO: 6839483 - DNA, 57 bp, Homo sapiens
tgctattgtgaacagtgccacaataaacatatgtgtgcatgtgtctttatagtagca

SEQ ID NO: 6839484 - DNA, 57 bp, Homo sapiens
atgcatatttcttgggcttaccatataaatgctgagggtgaggctaataatctgcat

SEQ ID NO: 6839485 - DNA, 59 bp, Homo sapiens
ttgtattcagaaggatgatctagtagtcatttgacatttaccattgcttttgaatacaa

SEQ ID NO: 6839486 - DNA, 60 bp, Homo sapiens
gtcttacctctgctccatgatgtctggggcctcaactggagcacatgagggctgagggac

SEQ ID NO: 6839487 - DNA, 76 bp, Homo sapiens
cagtggcctttgtcattttcagctgggccccttactctgagtgggctgactctgcactgagccatgatatacactg

SEQ ID NO: 6839488 - DNA, 124 bp, Homo sapiens
aagcaaagaaaagtaaaattttaagtaagcagtagagcagatgtagcttaaaacctccaaattatttcaggcctcaagctgctttaaggctgtattttaagattcagtacttttttatttgttt

SEQ ID NO: 6839489 - DNA, 59 bp, Homo sapiens
gcagagcaggcagaccaaggagttcatcttctcagagctgctgtccaacctgcactcgc

SEQ ID NO: 6839490 - DNA, 86 bp, Homo sapiens
ccagttgtgctcaccagagctcagtgcaagagaccagggaaccaggaagggtctgagcttcagtgcactgggagctgagcacctgg

SEQ ID NO: 6839491 - DNA, 64 bp, Homo sapiens
gttgacacaggcaggctctgggtatgtgcatcgagagatatttcccagagtctgtttttttgac

SEQ ID NO: 6839492 - DNA, 81 bp, Homo sapiens
cagcagctgatcttagacatttctagcccataaaactgtgagaaatatttggaggctgggaagtccgagatcacaatgctg

SEQ ID NO: 6839493 - DNA, 88 bp, Homo sapiens
acaagtggttattgagcagttaaaatgtgctataagaaactgaatttttaatgttatttaagtaatttaaatgtaaatagccatttgt

SEQ ID NO: 6839494 - DNA, 85 bp, Homo sapiens
atgaaggcaccaacaatatttatgacaggaagtagcatttatttttcatgcattttcttttatatatgtggcaaatcattttcat

SEQ ID NO: 6839495 - DNA, 130 bp, Homo sapiens
ttcttcttgctcctgataatcctgggcagtctggaggtgggggcaagagtgtttgtggccacacattcacagacagacactgcactcccaccttcccagcatctgcccgcacccaaggcagagagaagag

SEQ ID NO: 6839496 - DNA, 73 bp, Homo sapiens
tggcatcagtgttaacatgaatggtttcctggacagcaactactgtcagtaaactgtccacatgtggcaccca

SEQ ID NO: 6839497 - DNA, 60 bp, Homo sapiens
gcttggaaataattctgtgtctgaacatttctcaatgtctagacaagaagtattgcctgc

SEQ ID NO: 6839498 - DNA, 74 bp, Homo sapiens
acacatatacgtacatgtatttgcatatatgtgtctatgcatatttgtatgtgtgtacatatatatgtatgtgt

SEQ ID NO: 6839499 - DNA, 76 bp, Homo sapiens
tgctcaagcttgtaatagataggatcaaatgagtaattaatcattaatttggcttctctaatactatagcttgaca

SEQ ID NO: 6839500 - DNA, 81 bp, Homo sapiens
gagaaattttaggcaggctgaatgtagatttctacctctgctggaggaggaaatttgcttgagcctttttgggcggttctc

SEQ ID NO: 6839501 - DNA, 70 bp, Homo sapiens
tctagtgggctcaggcctctgtggggcctgggaatctggggccctgcaggggacctgcagcctccgtaga

SEQ ID NO: 6839502 - DNA, 58 bp, Homo sapiens
tgatttgtttagtgccaagtttccagaagacaacaaagtgtggtactaaatgaaatca

SEQ ID NO: 6839503 - DNA, 59 bp, Homo sapiens
ctgtcagtaggctcccatcattaaaagcaggtttacagagaggcagcattacttggcag

SEQ ID NO: 6839504 - DNA, 76 bp, Homo sapiens
caggccttcactccttcacctgccagcctgtttccctcttccaggcaggcatgtggcccaggggtgagaagaattg

SEQ ID NO: 6839505 - DNA, 129 bp, Homo sapiens
tgtgcatgcctgtgtcttaagtttttatatatgtatataaatgttgtagcatatgaaatatatgcctacctatgtgtttatgtaatagcattaaaatttgcatgtatggcctgtgaacatacttgcata

SEQ ID NO: 6839506 - DNA, 124 bp, Homo sapiens
ttccagtatgtcactatggtagaaaaagagatgggtaaaattctagcatctgaaaggaaataatctttgccaggcttgcatgaatttgatcctagcttatcttacatattgtacagactgtgag

SEQ ID NO: 6839507 - DNA, 74 bp, Homo sapiens
aagctgacagaattaggtaagttcatctgaaattcagggcagaattcagaactatagtagtttcatgtcagttt

SEQ ID NO: 6839508 - DNA, 58 bp, Homo sapiens
tcctcatcaataaaatcaggatgataaccgtatctccttggaagagttgttgagagga

SEQ ID NO: 6839509 - DNA, 66 bp, Homo sapiens
tcaacaataatgtattgccaaaagtcagccatattgttgtgtgtagctgcagttcgttagtgttga

SEQ ID NO: 6839510 - DNA, 78 bp, Homo sapiens
gcttgtgatatctgatgttcaacttaatatgtaagttttatgagcttttaatacgtaagttgaacatcagaaacaagt

SEQ ID NO: 6839511 - DNA, 59 bp, Homo sapiens
atttctgccatagccaggggattcactttatgacggattgttttctggatggttgaagt

SEQ ID NO: 6839512 - DNA, 55 bp, Homo sapiens
tcaaagtaccagagtgaactgacctcttgagctccatcaactctgtgtgccttgg

SEQ ID NO: 6839513 - DNA, 78 bp, Homo sapiens
gtcctgggacttgaaagctggcttcacatggaggaaggaacactccttgttgctgcagtcacctgaaaatcccagcac

SEQ ID NO: 6839514 - DNA, 67 bp, Homo sapiens
catgcagacaattagtgaacatgggccccactacaggcaaactgcatttttacaagttctttgtatg

SEQ ID NO: 6839515 - DNA, 68 bp, Homo sapiens
ggtgcgggggcaggtcaggaccgggacctgggccctccggggacagcaggtccgacttgttcagcacc

SEQ ID NO: 6839516 - DNA, 88 bp, Homo sapiens
acagagcataacagtgagcaatgttaggtctctttagatcactaataagggaaccagtggaatgatatgctcattcaaatgagactgt

SEQ ID NO: 6839517 - DNA, 64 bp, Homo sapiens
cacagcattgccttccaaaaggaggagctgaggcctatccgccttttgcggcaggtgtgccgtg

SEQ ID NO: 6839518 - DNA, 56 bp, Homo sapiens
ggctctctcttggggattcagcagtgaacaaagcagtgtggcctctagagacagcc

SEQ ID NO: 6839519 - DNA, 129 bp, Homo sapiens
atgcatctccagataagtttcaaaatttgcatcataactgtaattcatctaccattgggacaataatggctaggaggatagacagcttattaagtaaaatgttggtactagttttaataatcttggcat

SEQ ID NO: 6839520 - DNA, 58 bp, Homo sapiens
gtgcaggcattgggctagccatgcctatggcgttagtgcatggcccagtgctttgcac

SEQ ID NO: 6839521 - DNA, 65 bp, Homo sapiens
tgcaatgcagagacaattctaaggtagctcactttattggctaaaagaatgctttttgcattgca

SEQ ID NO: 6839522 - DNA, 128 bp, Homo sapiens
caataatctgagtctatttctacgtacttattagatacacagatttccacttagtttcctaacagaagtggggatggtgtaggtgatgtagagtcctgggtaggagtatattttagaaacccctattg

SEQ ID NO: 6839523 - DNA, 80 bp, Homo sapiens
accagcatgtcagtggacctggagaggccagttcttgaaataggatgaggaccctcttaggtttctgacgatgtctgtgt

SEQ ID NO: 6839524 - DNA, 66 bp, Homo sapiens
cgcagaacgtggtgcagcgtgtggtggctctgcccctggtcagggccacgtgcaccgcggtctgcg

SEQ ID NO: 6839525 - DNA, 56 bp, Homo sapiens
cctccccagctacagggcacggggctttccagggtccagaacccaggctggggtgg

SEQ ID NO: 6839526 - DNA, 56 bp, Homo sapiens
tgtgttcttaaaagcagtgatattaacatgcttgtaatcagacttttaggaacata

SEQ ID NO: 6839527 - DNA, 90 bp, Homo sapiens
cacagtcatatttccctttgtctttgtggtgagcctgcgtgaaataaatgaatgcatcagcacacactggagcaaggagatgggactctg

SEQ ID NO: 6839528 - DNA, 64 bp, Homo sapiens
accttgcttagcgactccccttcctctaccttcaaatagagggaggcaacctgcaaagctgggt

SEQ ID NO: 6839529 - DNA, 74 bp, Homo sapiens
gggaagctggcagttattaatcaagtcttggccattttgggccaatggctagaggggttattgtttagcttcct

SEQ ID NO: 6839530 - DNA, 76 bp, Homo sapiens
tcccagtggcttctattttctcagtgagacaggaagtgacatcatcagctgagagtagaaatggaggctccaggga

SEQ ID NO: 6839531 - DNA, 77 bp, Homo sapiens
gaatggtttcaaattaaagtcttaagagacatgacaaccaaagcaatgcatcttcaagattaaatttgagattgatc

SEQ ID NO: 6839532 - DNA, 88 bp, Homo sapiens
ggagtctcgctctgttgcccagggtggagtgcagtggcgcgatctcggctcactgcaagctccgcctaccgggctcacgccattctcc

SEQ ID NO: 6839533 - DNA, 83 bp, Homo sapiens
gccagccctcccttcctcccaggcttctgtgcaagcccttggaccacgtatgccagtagccattggagggcaggaggggcggc

SEQ ID NO: 6839534 - DNA, 84 bp, Homo sapiens
tggtcactttcaaataggtttactttggactggcgagatttttaaaaaattctcagctttcaaatagacacgtgaatgatgcca

SEQ ID NO: 6839535 - DNA, 62 bp, Homo sapiens
atcattctctgcttgagcactcttctgtaatctcatgaggtgtccagggaagagacaatgat

SEQ ID NO: 6839536 - DNA, 95 bp, Homo sapiens
gtattaaatttttttaaaggtagagtggaatgtccttgatcataagaacattaatgttttgatatttatttgcttttattattaaaatgtaatat

SEQ ID NO: 6839537 - DNA, 61 bp, Homo sapiens
gaaatgtctgccaggcacatagtaggcactcagtgagtatgtgttatttggtatacatttc

SEQ ID NO: 6839538 - DNA, 77 bp, Homo sapiens
gcctgggaagggggttgggctgtggtctgattgttttgctatcagagccaggcccagcccagcccttcgatcctggc

SEQ ID NO: 6839539 - DNA, 61 bp, Homo sapiens
tgggccaggatgtggttcattttaaaataccagtgttttaggaagcctggagtcctgccca

SEQ ID NO: 6839540 - DNA, 101 bp, Homo sapiens
cagggtttcaccgtggtgtcaatctcctgaccttgtgatccgcccgccttggcctcccaaagtgctgggattacaagcgtgagccaccgcgcctgaccttg

SEQ ID NO: 6839541 - DNA, 63 bp, Homo sapiens
atgatttattactaaaaactgcagaaattcaagtaatttctcgggtttaggtgatagtattat

SEQ ID NO: 6839542 - DNA, 79 bp, Homo sapiens
cagtggggataacgaaggctgatgcgggattaaaagcataatgttgatggtgttgagttagttctggttattccttctg

SEQ ID NO: 6839543 - DNA, 122 bp, Homo sapiens
gctggtcagaggcttttacaatgtttgggcagctgttgtggattggaaagagaactaggtttggaatccaaagagcttcatttccatttattctcctatgtaagagctgtacgaccttaggc

SEQ ID NO: 6839544 - DNA, 62 bp, Homo sapiens
tgactgaaaatgtgtcatccctactgtgacttagtcatactggatttgaaacatttcattca

SEQ ID NO: 6839545 - DNA, 71 bp, Homo sapiens
gggcctgcctgctgccaccctggctccgtcccagctgtgagccgtgcgggagttaggatggctaggaaccc

SEQ ID NO: 6839546 - DNA, 57 bp, Homo sapiens
gtgagcttcctgagtggtggccacttggcaaagtgagtccatcgcagggaagtgggc

SEQ ID NO: 6839547 - DNA, 86 bp, Homo sapiens
catagataaagtgtttcaataatttggaccttatttcctaaactgtaaaatgtggctaaagttctgttggttactttacctctatg

SEQ ID NO: 6839548 - DNA, 68 bp, Homo sapiens
agacctggaagaactgaggccttgtggcttgtacataaggggatactcttggttcttgcccaaggttt

SEQ ID NO: 6839549 - DNA, 76 bp, Homo sapiens
gagtcacatagctctggtttcttgactatggataggatataaagtcatcttaaagggagactagtgctatgttttc

SEQ ID NO: 6839550 - DNA, 60 bp, Homo sapiens
tccagggcccctaacatctctcaccaagcccccgctccagggagaggggaggggcagggg

SEQ ID NO: 6839551 - DNA, 73 bp, Homo sapiens
ttacagtcagtgaatggaagggtctggattccaaaccagaacgctcattctttaccattctgctgtactttaa

SEQ ID NO: 6839552 - DNA, 58 bp, Homo sapiens
tcctgtgtgccttaagctctatagacaaagatgctatggaaacagagggcatttggga

SEQ ID NO: 6839553 - DNA, 59 bp, Homo sapiens
ggcccagcctcagacatgccctggcccctccccaacagggcacagtctaaagtcgggcc

SEQ ID NO: 6839554 - DNA, 94 bp, Homo sapiens
aaagcattaggtcagtcccatgggtccttgctggcttcaaaggagtggcctctatttgatcagtgagggcagaggtacagaacctaagttcttt

SEQ ID NO: 6839555 - DNA, 58 bp, Homo sapiens
ccagcaagtgtgcacatacatggttactgataatcaggagtgtgcactttgatcctgg

SEQ ID NO: 6839556 - DNA, 57 bp, Homo sapiens
gccagctgctcgcgtagggtagagcatgtgatgctttacttctgggggcaaggtggc

SEQ ID NO: 6839557 - DNA, 72 bp, Homo sapiens
cctgcatcacaggagagctgatgctggtgatctgttgaccacattttgtaaaagcatcttgtgtcttgcagg

SEQ ID NO: 6839558 - DNA, 84 bp, Homo sapiens
caacatatataaggatttactatctgaaaatagagaccatataaatgtttcttgaggtctccttggggatttttatacttgttg

SEQ ID NO: 6839559 - DNA, 55 bp, Homo sapiens
agctgactgagtgacttgggaatgttttaaaaatttctttgagtctcagtttgct

SEQ ID NO: 6839560 - DNA, 57 bp, Homo sapiens
cttgtcattatcttcccctttcttggggagcagtaacagaggggaggaattgacaag

SEQ ID NO: 6839561 - DNA, 61 bp, Homo sapiens
gatggggttggcacttccttcgctaccctggtacaaagttcacagagatgctaatctgatc

SEQ ID NO: 6839562 - DNA, 57 bp, Homo sapiens
cctgcgtctggccttgctccaagtacgtgatgcttgagcagctaaaggtgatgcggg

SEQ ID NO: 6839563 - DNA, 59 bp, Homo sapiens
gcatccagtcttggctcctggaaggctcatgtggccaagagggagagagactgaggtgt

SEQ ID NO: 6839564 - DNA, 79 bp, Homo sapiens
acacttccagctctctgcagaaaggactaagaggctccaatagcctgatgacagtctcgctgcaaagagtcataggtgt

SEQ ID NO: 6839565 - DNA, 56 bp, Homo sapiens
ttttcctgcctttaaactctttctgtagataagatgatggaggaagggcaagagaa

SEQ ID NO: 6839566 - DNA, 59 bp, Homo sapiens
tgaagcaggtgaatggatgtcgggtggcaaaaaataatcgacgtccaatacccgcttca

SEQ ID NO: 6839567 - DNA, 79 bp, Homo sapiens
cttgttgttttcttattgtgctaagggatttattgagattcatcgaaagtccttggagaatagaaaggaaagtaggaag

SEQ ID NO: 6839568 - DNA, 65 bp, Homo sapiens
ctgcacacattctagccttttgtgactcattccaaattagcagctcacattggcaatgtgtctag

SEQ ID NO: 6839569 - DNA, 76 bp, Homo sapiens
cactgtgtagcagcactaagggcagggggaagaaattactatcctcttcactttgtttattgtgcagttacaggtg

SEQ ID NO: 6839570 - DNA, 129 bp, Homo sapiens
cccagttctttagttctaataataaaggtgaacacaaatgctactaataggcaagtgatattttaacttcttcattttagtaaattgtagtatttttaagcattttatttcattctgggaaatactgag

SEQ ID NO: 6839571 - DNA, 62 bp, Homo sapiens
tggaggaaggcctgccaggctgcactctcaggcaaaagtctgcagagggaaggcttcagcca

SEQ ID NO: 6839572 - DNA, 63 bp, Homo sapiens
gtgccaggtgatgaggagacatactgtctgggctcttcagacaggcttctttctccctggaac

SEQ ID NO: 6839573 - DNA, 99 bp, Homo sapiens
atgcccagcccgtgggtgttactttattcaaagtaccttcattgccactgtatcttcaggccatgattgtccttgaaaaatgttatattttggcttcat

SEQ ID NO: 6839574 - DNA, 69 bp, Homo sapiens
ccatgtatgaggtaggacatcaggaaatgctggacaggttaatttcgtgtgtgttctacttaagtatgg

SEQ ID NO: 6839575 - DNA, 86 bp, Homo sapiens
tatatgttgtttttataagattaagggaatgataattatgcctatgtaagcattagtctactgtctaataaatgagattacatgtg

SEQ ID NO: 6839576 - DNA, 62 bp, Homo sapiens
tcatttcttctaggactaataagagagcttcattgctgatacctctggtctcagaaggatga

SEQ ID NO: 6839577 - DNA, 109 bp, Homo sapiens
gtgatgtgttccatacatgcaaatgccatgcgtggagctttgcactgtggcaataaagtaaaagggctgagttccatgtctgggtttgtgagatgcagaacacagcagc

SEQ ID NO: 6839578 - DNA, 67 bp, Homo sapiens
aggggaaatgccttggtggtaccatggtccatgaaaaccaagaggtctcaggagggcggttccacct

SEQ ID NO: 6839579 - DNA, 89 bp, Homo sapiens
acaatatgtttgggattaacaagtttcatttatagaatgaaccacatggtttggaggtagaatttgaatttgtttcattcacgtattgt

SEQ ID NO: 6839580 - DNA, 63 bp, Homo sapiens
atgtggaggggatggtgaagccggccctgcccgctggattttatcagcatgctcctcagacat

SEQ ID NO: 6839581 - DNA, 76 bp, Homo sapiens
agagattcattcctcaggaagggatttagctattacaggtgtctttgtataacagccttcctgggaatgagtttct

SEQ ID NO: 6839582 - DNA, 55 bp, Homo sapiens
aggagagtgggggaaacagatgagtggtttagtcacatgtttgctacatttttct

SEQ ID NO: 6839583 - DNA, 62 bp, Homo sapiens
gcaacctcctctccctgtcagctcctcacagcctctgtggacacgagctgagaagaggatgc

SEQ ID NO: 6839584 - DNA, 118 bp, Homo sapiens
ggaggtggcgcagcgcatcacggcggagctgaagcgctacagcatcccgcaggcaatcttcgcgcagcggatcctgtgtcgctctcagggcacgctctccgacctgctgcgcaacccc

SEQ ID NO: 6839585 - DNA, 60 bp, Homo sapiens
tgactgccacaaaattgctagaccaactgaagtcatggtgtaattatttctgtgcagtca

SEQ ID NO: 6839586 - DNA, 67 bp, Homo sapiens
tgtcaggtcattgccatggaaacgggttgtaatgcctgggtgttgccatggcaatggtaaactgaca

SEQ ID NO: 6839587 - DNA, 128 bp, Homo sapiens
tgccacatgcttgaagctttcactgccccattcagcttctcagcatgaaggtttccagttcctggcacttgatctggaagccgtagggtttgggaaatgaggacagatgatgaagcggctgagtggta

SEQ ID NO: 6839588 - DNA, 65 bp, Homo sapiens
aagtccagtatgagaaacctgccttctggggatttcttcatatagctgttctttcagctggtctt

SEQ ID NO: 6839589 - DNA, 55 bp, Homo sapiens
gggctgtaccaagtgcccgctgccgaggtcgctgtgacgggcgcgggtagagccc

SEQ ID NO: 6839590 - DNA, 82 bp, Homo sapiens
ctgaactgatggaggagcaaggagtcctgtggaaatggcgaatgtgctaacgacagaggctctttgcttgttcttagcacag

SEQ ID NO: 6839591 - DNA, 55 bp, Homo sapiens
ggagacatcatgtaggtttcttgatgcttctgtttcattccttgcatgtgtcttc

SEQ ID NO: 6839592 - DNA, 63 bp, Homo sapiens
tgcctcaggcaagtcacttaacatctcttgctcccccaggatgttgggagaatttgtgaggta

SEQ ID NO: 6839593 - DNA, 79 bp, Homo sapiens
gccgtggccgtggggggccgtcgtccctggttgggggtcttggcccagaggctggcggccgccccgagcaggtccaggc

SEQ ID NO: 6839594 - DNA, 59 bp, Homo sapiens
gaggtgtcatgagggcctgctcatcacttgcttagtgcatagacccttgggggcatctc

SEQ ID NO: 6839595 - DNA, 93 bp, Homo sapiens
tggcacccaagagggcccaggatgcaagaactgaacccaacctgtgggtttggagctgagatgtcactgctggccttactgggagcagtgcca

SEQ ID NO: 6839596 - DNA, 59 bp, Homo sapiens
tgctgcatcactccccgactagaaagcaagatttctgtatgcagggcttgtatgcagta

SEQ ID NO: 6839597 - DNA, 68 bp, Homo sapiens
gctccaagtcttggttctgtatcttttaccatcttttaggtggaatgataggtaataatatttgaggt

SEQ ID NO: 6839598 - DNA, 57 bp, Homo sapiens
cctgcctatgtaagtggtttctcagggagggcagaggttctgtttgtggtgggcagg

SEQ ID NO: 6839599 - DNA, 98 bp, Homo sapiens
tgagttatggtacaattcactgtaaatgtgttttatggtcgcctaaaatgtgtttaggtgaccataaaacacgttttatgaaagagttgcataatcca

SEQ ID NO: 6839600 - DNA, 101 bp, Homo sapiens
ataatcccttttctgtgtctgggggatccctggacatgtctgcacaaagccccgagtcactgggtccttggcagcagtccaccccacacagaactgattgt

SEQ ID NO: 6839601 - DNA, 59 bp, Homo sapiens
gcccttgagtagcaaaaagggcttattgtccatttgtccctttgtgctcttataagtgc

SEQ ID NO: 6839602 - DNA, 62 bp, Homo sapiens
ggacctggtgactggtgctctaggacacttactcatgattattagagcatgaagtcctatcc

SEQ ID NO: 6839603 - DNA, 64 bp, Homo sapiens
ggatagccacggtctaagcatggttatcaataaacagattagatgttcaaagatcgtgctatcc

SEQ ID NO: 6839604 - DNA, 78 bp, Homo sapiens
ccctgcaatctaagcctgcttggcttctgaagaggtaatcacaatgcccactagaatcaagcagtagagcagactggg

SEQ ID NO: 6839605 - DNA, 115 bp, Homo sapiens
gaagccaggctgcaagcagccgcgtggcaggtggatcatatactagaccaggactcagctgctcctggctctagtccagctttaccactaccagctgtgtagccttggacaagtc

SEQ ID NO: 6839606 - DNA, 61 bp, Homo sapiens
ctagtttatgcgatgggaacattttagttggggcttttgttcattcatcacatgcagctgg

SEQ ID NO: 6839607 - DNA, 65 bp, Homo sapiens
agcttgaggtcctgggagttctagtgtgggattctgggcctgagctcaccaggggcatccaagct

SEQ ID NO: 6839608 - DNA, 77 bp, Homo sapiens
cggagcgcagagagaggggctgcctggccaggcagggtcagcgggccccagcagaccctcctctgctcccagctctg

SEQ ID NO: 6839609 - DNA, 105 bp, Homo sapiens
ccttaggtgcctggtcccatcaattggccaaggagcagtccctgtgctctcaagggtggctgtttctcttgagtcaaaatgaaaatggagtgggaaccttttagg

SEQ ID NO: 6839610 - DNA, 79 bp, Homo sapiens
gtagaagagcatcaaaattagacattgttgagaaattcactgctgtttctgaattatcttgtaattttgaaccttctgc

SEQ ID NO: 6839611 - DNA, 70 bp, Homo sapiens
ggaggtataggggcacatgagtgaggttattgcacactgcagaccggtgcactggttcctgaatgccttc

SEQ ID NO: 6839612 - DNA, 68 bp, Homo sapiens
tcccactggcttctgagttaacagtagattttggggaaacaagagtataggcaggatgccagttggga

SEQ ID NO: 6839613 - DNA, 76 bp, Homo sapiens
caacttgccacctagagaactactgatctgtttaggaatagactttatcagcagtagtctctgtggctttaggttg

SEQ ID NO: 6839614 - DNA, 56 bp, Homo sapiens
ttccccagagaccttaaaacttgcacatcgtgagactttaagaagtttctgaggaa

SEQ ID NO: 6839615 - DNA, 100 bp, Homo sapiens
cattagcctcctgaagcccctttgtgtgggttgtagtgtcctctgtgagggtgataaatagaaggcaccgtggccaatatttgggggaaggagccttgtg

SEQ ID NO: 6839616 - DNA, 116 bp, Homo sapiens
gatttgggggaagctgatatctgctcacctctttgggtcttttctttctcccagcatggggctctcatgagtgtgtggtaaataaagcacctaatcctacctcattcccccaattc

SEQ ID NO: 6839617 - DNA, 79 bp, Homo sapiens
ccttttttaaagtttgtattaaatataaccctgagataattcttcataaagttgttttaatgggaacatcactggaagg

SEQ ID NO: 6839618 - DNA, 89 bp, Homo sapiens
ctttaagagtcttatagaccaggcattagagaattgtgataggtttttgagcctgtgataaaagctgtgtttggggaagatttttctag

SEQ ID NO: 6839619 - DNA, 124 bp, Homo sapiens
gaaccacctgggatgattgttaaatataaagatttccagcctttatccatccagaccctcgacagcagagcctctgggtgtagggcctggcaactggtattcagacaagctccccaggtgattt

SEQ ID NO: 6839620 - DNA, 61 bp, Homo sapiens
gctggaccctgaaataaggaaatggtgtggatactgtctctctagcagttcagggaccagc

SEQ ID NO: 6839621 - DNA, 60 bp, Homo sapiens
tagttgacttgttcctatgaaatggtgctttggtgtcatgtcattggtacaaattgattg

SEQ ID NO: 6839622 - DNA, 78 bp, Homo sapiens
gaggaaagagcatggatctggggctctgctgctcaccagttaggtgacctgggcaatccccaggcctctctaagcctc

SEQ ID NO: 6839623 - DNA, 63 bp, Homo sapiens
ttcttattgtcactgagtgaaaaggtaattctcgttgaatttacgaaaagtgactaataggaa

SEQ ID NO: 6839624 - DNA, 55 bp, Homo sapiens
agctccccaggtgcatctagtaatcagccatggttgcctatatgaaaggggtgtt

SEQ ID NO: 6839625 - DNA, 59 bp, Homo sapiens
tggttttaagacatggctttgctgtattactgtactgctttgtgatagtgttaagacca

SEQ ID NO: 6839626 - DNA, 130 bp, Homo sapiens
cttggtgtgtctgaatccacaaggctggttaaacattgcagggcaggaccatggacagggccccgaggcacttgtaggggtggttttcggcttatgctgtattgaccgagacccgtggaaatatattttg

SEQ ID NO: 6839627 - DNA, 103 bp, Homo sapiens
tcctataatcaagctgtccatctaaagaagagcaaatttgttgtatattagcaagaaaatatatcagctgccttcattagattagagacagaaatggtcaggg

SEQ ID NO: 6839628 - DNA, 61 bp, Homo sapiens
gtgggagccatttccagtatgctcccaatgtctatggcaaatgtgggtaattggctcccac

SEQ ID NO: 6839629 - DNA, 58 bp, Homo sapiens
tctgtctgggatgtaattcctgcctgagctccatggggcagcttttatccctgacaga

SEQ ID NO: 6839630 - DNA, 69 bp, Homo sapiens
ggttgggcgaaagcaattgtggtttttgccattaaatggcaaaaaaacacaattactttcgcgccaacc

SEQ ID NO: 6839631 - DNA, 95 bp, Homo sapiens
aggactgcctagctttatgaggagaccttagtatccatcagagaaatctatgttcactctgctaggtttctgccatgaggttgtggaaatgtctt

SEQ ID NO: 6839632 - DNA, 76 bp, Homo sapiens
agagccagtcctctgggtcaggacacaaaagttcctgggaggggatttatgtctgatacccagaatgcctgcctct

SEQ ID NO: 6839633 - DNA, 76 bp, Homo sapiens
gggagattgagcaggaactagaagatagcagaaccagcattcaaagtggacttcagagttcatgcttgtgactcct

SEQ ID NO: 6839634 - DNA, 91 bp, Homo sapiens
gtatagaatgcatttattctttatgttaatgaatctatttgaaatattttgtggaatcttaaatgtgaagggtaattgtttatttgattac

SEQ ID NO: 6839635 - DNA, 60 bp, Homo sapiens
tggcttcagggttgtcttcagctacctgggactgacgattagccctggaactgaccgcca

SEQ ID NO: 6839636 - DNA, 60 bp, Homo sapiens
gtaaatatgttgatgtgctggctagtagagcttttggtagatagcacactgacatctgac

SEQ ID NO: 6839637 - DNA, 111 bp, Homo sapiens
ttgactgcagctgtaacagatgcgtttacacatgtaaaagataaattaacaaagatgtttattgaagttttgcatgaaatagatgataactgacaacaatgtaaatgtcaa

SEQ ID NO: 6839638 - DNA, 65 bp, Homo sapiens
gaggctcactttcatcctcttcgatgtagttcactatgggcctggagctggtgaaagtgtgtttt

SEQ ID NO: 6839639 - DNA, 56 bp, Homo sapiens
ccttttgaaggtgttgttaagtgatatctcctaggtgtagtaacatttttaaaagg

SEQ ID NO: 6839640 - DNA, 73 bp, Homo sapiens
tggcctatgctttgccctcaggagttgtgatctgttttagtaaagacctcaattcaatggcaaagtattgtca

SEQ ID NO: 6839641 - DNA, 89 bp, Homo sapiens
ggtcgcatggctaacttgtggcccagccctacagaggacaattacttcctgctctccgtgaagctgggccagtctttaccctgtggatc

SEQ ID NO: 6839642 - DNA, 59 bp, Homo sapiens
agggcttgtttcctgtttcatagaaggtgtcacatggtggaaggggcaaacaagctcct

SEQ ID NO: 6839643 - DNA, 95 bp, Homo sapiens
ccttaaaatgtaaatgttaccaccggtcataataagttatgcaaaagcaccagtacagtgcctggcatgttatagacacatttatatttttaagg

SEQ ID NO: 6839644 - DNA, 57 bp, Homo sapiens
ccttccacgtcagctgtttcacggtgtgccctgtgctacaacctgacgtgtgacagg

SEQ ID NO: 6839645 - DNA, 64 bp, Homo sapiens
agtcacatttcagtgagctattgaagattaagaagagttatgtagcttatctgaaatggcaact

SEQ ID NO: 6839646 - DNA, 57 bp, Homo sapiens
gctgcctcccagagccctgcagcttccccagcccgcaggggccttttgtgaggaagc

SEQ ID NO: 6839647 - DNA, 61 bp, Homo sapiens
agctcccagctcctttgagagagaaaagcctaaagtgtttgcagggagctgagatggagct

SEQ ID NO: 6839648 - DNA, 64 bp, Homo sapiens
tcagtgataggtggttgttggcaaaattaagtctgaaatactgccaaagtttacctaacactgg

SEQ ID NO: 6839649 - DNA, 60 bp, Homo sapiens
cagcatctcccaggcatttgccccttcctgccaggaacagggcagaggcggaggtgactg

SEQ ID NO: 6839650 - DNA, 84 bp, Homo sapiens
acctacagacccagaatccgcattttaacaagatgtccagatgattcatatgcacattagtgtttgagatgccctggtctaggt

SEQ ID NO: 6839651 - DNA, 81 bp, Homo sapiens
ggaaatttgtgataggcagaagagaggtgaaggaacaaaaggaaccatgagcctgcacagttctttttgccaacaaattct

SEQ ID NO: 6839652 - DNA, 56 bp, Homo sapiens
tgtggctgccaccctgaagccgtgaggggacccagccttcagaagaagcagctaca

SEQ ID NO: 6839653 - DNA, 58 bp, Homo sapiens
ctctccaggagagcactttgagatatgaaaagaccatgtgtgtgtgctccttgtagag

SEQ ID NO: 6839654 - DNA, 107 bp, Homo sapiens
gggagagggagccccctgcctgagcagcagagaccccaggaaggaggccaagccctcctcacacaggaggtctccagctgccctctgaggtgaggggtgcctctccc

SEQ ID NO: 6839655 - DNA, 57 bp, Homo sapiens
gggctctgcgctcagctccagcgagaccaacaatagctcccgcggggagcggagccc

SEQ ID NO: 6839656 - DNA, 57 bp, Homo sapiens
tctatttggccatagtgcagttacatgtccatatttagctgcaagagggtccaagga

SEQ ID NO: 6839657 - DNA, 105 bp, Homo sapiens
atggagaacggcttctgtcctgcataagttccttttttaatcaacacagggtaaatttcttatctctgtgggaggaggagtaggcttcagaagttattgcttcat

SEQ ID NO: 6839658 - DNA, 57 bp, Homo sapiens
ttgtttccagtgggaggtgcagtgtgaattcctagcctgccatatacctggaaacag

SEQ ID NO: 6839659 - DNA, 64 bp, Homo sapiens
ggtggtagtcggcctcggtggctccccgggtgacccaggaggcccggcgcaggcggactttgcc

SEQ ID NO: 6839660 - DNA, 57 bp, Homo sapiens
tctagtcagtgcacagacacttgtgagcacccactgtgtgccaggcgctggtctagg

SEQ ID NO: 6839661 - DNA, 59 bp, Homo sapiens
tctctggccttaggattcagagcctggttgcaaaccattctgacagctgaggtcgtgga

SEQ ID NO: 6839662 - DNA, 58 bp, Homo sapiens
ttgcattagaatcagacagaactgcattggaatctcagctctgttattttctatgcag

SEQ ID NO: 6839663 - DNA, 65 bp, Homo sapiens
tgctaacccctcctcttctggcagctgggcaatgatgagcgctcccaggaagagaagggccagca

SEQ ID NO: 6839664 - DNA, 60 bp, Homo sapiens
gaaaatgaacagaacaatggggagctgttgttcccaggcttatttatttgttcgtctgtc

SEQ ID NO: 6839665 - DNA, 103 bp, Homo sapiens
cacagttgtggaggctggcagtgcaagatcacggtgttgagagggctggtttcttctcaggcctctctccttggcttttgggtggccgcgtcctctccctgtg

SEQ ID NO: 6839666 - DNA, 63 bp, Homo sapiens
gtctggagcctgggtccctgctcccataccttgaattcctgagatggccttgaggctccacac

SEQ ID NO: 6839667 - DNA, 130 bp, Homo sapiens
tgtttaaactagcattaaatcatggaagtcaagtttctctttgatgggagtcagtgggaaataaactctacttgttctttcaagagatagcaaaatatttgtttccaatttaaatgcaggaagttaaaaa

SEQ ID NO: 6839668 - DNA, 80 bp, Homo sapiens
cagtcacccaaagcagcagttccatcacctgacttgcgggtacagacagggatggagagactactggcccatgggggctg

SEQ ID NO: 6839669 - DNA, 99 bp, Homo sapiens
tttgctgttgttgctttttaattaggaggcagaggaataaacttctgttacctggaattgccccctaagtggaaaacatcctttgcctacaatagcaga

SEQ ID NO: 6839670 - DNA, 77 bp, Homo sapiens
taaggtgtatctagcattgtgtagttatgtaatgagttatattcagtattctgctgcataatacttttaatgtctta

SEQ ID NO: 6839671 - DNA, 57 bp, Homo sapiens
gaacactgagagagatgggcagggcgccagtgcctgccacactctgccggtctgttc

SEQ ID NO: 6839672 - DNA, 70 bp, Homo sapiens
gctttttagaggaggaaactgaggctctgtgtatttgagagacaacctcagggtcatcctagtaataggt

SEQ ID NO: 6839673 - DNA, 99 bp, Homo sapiens
gaggcaggagaatcacttgaacccgggaggcggaggttgcagtgagccgagatcgcgccactgcactccagccttggcaacagagcgagactctgtctc

SEQ ID NO: 6839674 - DNA, 66 bp, Homo sapiens
cagtctaatctgttactcattagacctctttgtctgaagcattcaagtgagtaacaggttgcactg

SEQ ID NO: 6839675 - DNA, 67 bp, Homo sapiens
gcagagcaccaaagtgaaagatgtagctttccccgctccaggctatcagcattaggtcctgctgtgc

SEQ ID NO: 6839676 - DNA, 86 bp, Homo sapiens
gcagcagtgctatggccagggtgcctgtcctcagcaaacctcatggtctgactggagaatcagggcccagttcttagcaaggtggt

SEQ ID NO: 6839677 - DNA, 71 bp, Homo sapiens
cctgtgtaccctctgccctacagctcagcacaaatcatagtgctgccctgtctgcagcaggacccaccagg

SEQ ID NO: 6839678 - DNA, 56 bp, Homo sapiens
cgtgagtgttaacccactgcttctaaacccgtgaagcctgtcatgtgacgctgatg

SEQ ID NO: 6839679 - DNA, 64 bp, Homo sapiens
gtgacacagttgtgttattggcagtgataagacagaattgcacagaaacaggcaacgtgtgcac

SEQ ID NO: 6839680 - DNA, 86 bp, Homo sapiens
ccagggtgttcttgggcaaacgtaggggtcaggtagggactctgctccagagacccagactgatcattgctctaaggttaccctgg

SEQ ID NO: 6839681 - DNA, 85 bp, Homo sapiens
cagatattatcacatcaatgttttaaaatgcatggttcagtcaggtaatccgaacaaattttaagagattgaaatggtaaatttg

SEQ ID NO: 6839682 - DNA, 57 bp, Homo sapiens
gggctacctacagagctgaggactaaatgatacagtgcctggcaactgtggtgggct

SEQ ID NO: 6839683 - DNA, 87 bp, Homo sapiens
attcagaagtttccagtctagtaaggagacaaggtatgaatcagaagaaatgcccctcactagctcactgaaactctaatcatgaat

SEQ ID NO: 6839684 - DNA, 95 bp, Homo sapiens
tccaggtaccttctccaatcctaaagcagacagcaggttgaataaaaccaatacacaacctattttctaggcaggaggggaaaaggcccttagga

SEQ ID NO: 6839685 - DNA, 77 bp, Homo sapiens
ggaatttcgacgtgatccacttaatgcatggtagcagggccagagtgaaataggggatcaagctgtggggataatcc

SEQ ID NO: 6839686 - DNA, 58 bp, Homo sapiens
gagcgacgcccatcgcgctacctccagaccaggaggtagggctaggctgcgtctgctc

SEQ ID NO: 6839687 - DNA, 69 bp, Homo sapiens
gcagaggagggcttgctggatggggcgcaagtagcttgaggccctgtggacccaggaactcttctctgc

SEQ ID NO: 6839688 - DNA, 64 bp, Homo sapiens
gcagaagggttgcaaaaggatagtacgataagatcttggtccttacaacttgttatttttctgc

SEQ ID NO: 6839689 - DNA, 55 bp, Homo sapiens
gctggctttaaccctacaaacctgttggtacaggtctccactggggttggtcagt

SEQ ID NO: 6839690 - DNA, 63 bp, Homo sapiens
tcatctctcaggataccagcagtgtctctgaccatgggcagtgttgggaattgtgagtaatgg

SEQ ID NO: 6839691 - DNA, 55 bp, Homo sapiens
gctctctaattaagcattgtatggctacatagagtcattgcaatgttggagatgc

SEQ ID NO: 6839692 - DNA, 56 bp, Homo sapiens
tctgacttatgctaaaggggaggggtacataatctctgtcctaatagacaagcaga

SEQ ID NO: 6839693 - DNA, 55 bp, Homo sapiens
gctgtcacatcaaggcactaaacagctgacctggttggtcctaattattgatagt

SEQ ID NO: 6839694 - DNA, 62 bp, Homo sapiens
tcctgttattgactctcttgtggcttctttcttcatcagagaagcaagtggctcaaccaggg

SEQ ID NO: 6839695 - DNA, 61 bp, Homo sapiens
tgtcctttaagtagaagagatatttttataagtaggaatattactttgcttttattggatg

SEQ ID NO: 6839696 - DNA, 80 bp, Homo sapiens
gatattgtgtaaggttaaacttatttgtgccctcaaatgttagacattttatggagcaccaaagtaactagcacaaagtc

SEQ ID NO: 6839697 - DNA, 57 bp, Homo sapiens
gcaagagtttctggagcagagtgaggcaaactatactttgctagacaagactctagc

SEQ ID NO: 6839698 - DNA, 59 bp, Homo sapiens
gatttcagtgcacgtagtttatttgggacttgatcccaaggagactggaagcattggtc

SEQ ID NO: 6839699 - DNA, 66 bp, Homo sapiens
taatgaaagagttgagttgaggtcatttgatgtcggtttgtcctgcaaagttcagcttgcttatta

SEQ ID NO: 6839700 - DNA, 76 bp, Homo sapiens
ttagattctactaaaggcagttggagttgaggaaattagttgaatgcttcctcggtaattgtcggtgaggatgtga

SEQ ID NO: 6839701 - DNA, 55 bp, Homo sapiens
gcgcggggggaggcgcctccggatctgctccccggctcccgcctccctccctcgc

SEQ ID NO: 6839702 - DNA, 56 bp, Homo sapiens
tgcccatggtaagtctctgagctcgtaaggccttaatgaaaggttgcacatgggca

SEQ ID NO: 6839703 - DNA, 57 bp, Homo sapiens
acacatttgctaaaatgagctctggtagatatcagtttgcgcacaggcacaatgtgt

SEQ ID NO: 6839704 - DNA, 76 bp, Homo sapiens
aaggcatcatctggcttttagaaaaaccaggtacaatagagaagaactgttttattatcagagttaggggtgcttt

SEQ ID NO: 6839705 - DNA, 87 bp, Homo sapiens
ctcagggcaagcgggaagacagccagctccatgggatccacatcatgtgcagtcaccatcggctgagctttcttgttctctactgag

SEQ ID NO: 6839706 - DNA, 130 bp, Homo sapiens
gcggggatgggcccgtgcggctccgggtgtgggacgtaccctcagagcgcccggggttattcccactgactccagggaggtgagtgtgcgcccttcgctccctgccgtgtctgtgagggtccatcgttgc

SEQ ID NO: 6839707 - DNA, 62 bp, Homo sapiens
cccaggagatggtgcgtggtctctaagtgattagcagaatgtaatcacccatctgccgaggg

SEQ ID NO: 6839708 - DNA, 89 bp, Homo sapiens
cttgtcagaaatgcaatttcttgggccccacccagttgagactagatcagggactcagagtgaggcccagcaatctgtgttttagcaag

SEQ ID NO: 6839709 - DNA, 76 bp, Homo sapiens
catatgtgtgtgacaaccttttgctgaatttacaaacttaccctgaaatgatacaaagggttttattttatatatg

SEQ ID NO: 6839710 - DNA, 65 bp, Homo sapiens
cccgcagggccttagcagcggctgccgcagctcaatcgcggagcaactagccgggcgtctgcggg

SEQ ID NO: 6839711 - DNA, 55 bp, Homo sapiens
gcagagccaggagagacccttgggcttccttccttcaaggcctctggtctctagc

SEQ ID NO: 6839712 - DNA, 57 bp, Homo sapiens
ggattctgacctgcaatctagttaaggagtcctggctgagggggcagttcaggagcc

SEQ ID NO: 6839713 - DNA, 107 bp, Homo sapiens
ccagtccttgcccgctcttggccttactctcctacactgctcatttcggagacccttctggtctgcatgtctggagcttggggccgacagcaagccagcagatctgg

SEQ ID NO: 6839714 - DNA, 77 bp, Homo sapiens
gaagttctggcctaattcttataattaaaagtattctgtaatgttagaaaagaacttaagaaattaggctagacttt

SEQ ID NO: 6839715 - DNA, 88 bp, Homo sapiens
ctgaaaggagtcttagatggacgtcaagtctactctctaatacttaaagcattgggggtagatggatgttcatttaaaattataacag

SEQ ID NO: 6839716 - DNA, 56 bp, Homo sapiens
caatgctgtgaatccacaagcctcactttcagtgacaaggctctggcacaggattg

SEQ ID NO: 6839717 - DNA, 87 bp, Homo sapiens
ccagcgtggggctggcccatccggaaggcagtgggcccagggacacccctgagaagcccaagccgggtggtcaccgcctcatgctgg

SEQ ID NO: 6839718 - DNA, 97 bp, Homo sapiens
tgctctggcaaaaccttttcagttgatcattatcaaactggtcatgtttcaaagataatgatcaggatgattagtgctccagaaactgtgccatgcg

SEQ ID NO: 6839719 - DNA, 57 bp, Homo sapiens
tcagcccgggttcgcaaacactcggccccgcacaaagatggcgtggagccgggctgg

SEQ ID NO: 6839720 - DNA, 92 bp, Homo sapiens
aggctgccaggggacgctggggcaaggctgggtaacctgtccactgcctgatgtcagagtggcagagaccccagccagccctctctggccct

SEQ ID NO: 6839721 - DNA, 102 bp, Homo sapiens
ttattacttccaaatataaaaagggtcttagaggttcatttttttcagacactaaaattgaaaatgatgggaatctaattttggtatggatggttgttataa

SEQ ID NO: 6839722 - DNA, 81 bp, Homo sapiens
gaggttttgcttcctgggtctggagactggagccaagccctgggtccaagcctccctgacccagacaggagacagggcctc

SEQ ID NO: 6839723 - DNA, 55 bp, Homo sapiens
ctgtgtcccagccaggataatgagggggaggctgtctggttgcctggggacacag

SEQ ID NO: 6839724 - DNA, 65 bp, Homo sapiens
cagaagtgagcatgtgacctagttcttttatttgagctaaagaaaagcatgcttggtggcttctg

SEQ ID NO: 6839725 - DNA, 63 bp, Homo sapiens
tgcaggccattcaggagatgtgcctttcagagaaggattcacctcaaaagagtggacgctgca

SEQ ID NO: 6839726 - DNA, 60 bp, Homo sapiens
tccatggtcttacgtaaattggaatttaaatcctgcaaactacattgtgagactaatgga

SEQ ID NO: 6839727 - DNA, 91 bp, Homo sapiens
cctcagctgtgactccagcagcatcttctaagtaaggctctcagaagcatgaagcctgcaagatggctggtcacttgtaaagcaaatgagg

SEQ ID NO: 6839728 - DNA, 68 bp, Homo sapiens
tcgcctgaacccaggaggcagaggttgcagtgagccgagatcttgccactgcactccagcctaggcga

SEQ ID NO: 6839729 - DNA, 62 bp, Homo sapiens
gtcagagaaggtagggggtgtggctaagggacacctcgttgcagccccacccttgtcctggc

SEQ ID NO: 6839730 - DNA, 63 bp, Homo sapiens
catcagtcagtctcttcagtattgtgctagatactgtgaatagaaagatgactaagactagtg

SEQ ID NO: 6839731 - DNA, 81 bp, Homo sapiens
aaataattaggtcatttttttaagagctttgtttgaatgggaaaatatttacatggatgtaaaaaagttatttagttattt

SEQ ID NO: 6839732 - DNA, 78 bp, Homo sapiens
gcatctatagattgagttctcaagttacagtagaataatgctggagtaacaagacactcagacactgaagatccaggc

SEQ ID NO: 6839733 - DNA, 69 bp, Homo sapiens
agagggaaagagaggaggctgaggactgggggctccagctcatctgaagccacctctgcttgtcccttt

SEQ ID NO: 6839734 - DNA, 124 bp, Homo sapiens
ggggacgctgggggctcaggatccagcaaggggcggcaggagtaaaggaggaaggaatgacaggtgcaaataccttcccaccaaagcccttgttgccctctggctcctccccagagctgtcccc

SEQ ID NO: 6839735 - DNA, 87 bp, Homo sapiens
gggctgttagtgaataatattgtttataaaacaatgcacccagataaatgtcaaggtattataaaaagtattgtttattatcagctc

SEQ ID NO: 6839736 - DNA, 60 bp, Homo sapiens
ggcgaagggtcctcactagatgccaaatctgctggcacctgggtcttggagttttcagcc

SEQ ID NO: 6839737 - DNA, 62 bp, Homo sapiens
tggaactggtttgcttcagacttcaaaaccacttgtgacatctgtggcaaacacagtgacca

SEQ ID NO: 6839738 - DNA, 64 bp, Homo sapiens
taggtgcagtggctcatgcctggaatcccagtactttgggaggccaaggcaggcggctcacctg

SEQ ID NO: 6839739 - DNA, 71 bp, Homo sapiens
tgggtcagtttgggggccagccaaagaaagctttcccactgcttgctgcctggaagaccccccaggactca

SEQ ID NO: 6839740 - DNA, 59 bp, Homo sapiens
ggcaatggctgatggagattttaggacacctgaggtgccctttctctattacccaagcc

SEQ ID NO: 6839741 - DNA, 58 bp, Homo sapiens
atgtccagagttagaaatgaatatagataaaactatacatgagctgagttctggacat

SEQ ID NO: 6839742 - DNA, 72 bp, Homo sapiens
gagaattttaacacatagaggaagtttgctattggctcacatgtagaaatcttgttactatgtgtttttctt

SEQ ID NO: 6839743 - DNA, 64 bp, Homo sapiens
gctttatccagagtggccttctttccatttattgtggaataatgaagccatggaatctcaaagc

SEQ ID NO: 6839744 - DNA, 57 bp, Homo sapiens
gcgttatttcctgtctgatttcccgaggggagaaatctctggagggggtagtaaagc

SEQ ID NO: 6839745 - DNA, 97 bp, Homo sapiens
gaattgtcataatttactgtttcagaacttcttaaaaacgtgttttaattaattttgctgtatttaaggccctggagcaagctttttgtgatgcttc

SEQ ID NO: 6839746 - DNA, 70 bp, Homo sapiens
ggaggtgaggccgtagggtgtggggtgggtggtacacctgctccctgtcaccctccgagtcctcccttcc

SEQ ID NO: 6839747 - DNA, 56 bp, Homo sapiens
cgaatcactgttattgaccataagccacaaagttgtctggtcagcattaggatttg

SEQ ID NO: 6839748 - DNA, 86 bp, Homo sapiens
gctttggtgactcccaggataggatctggaagtcccatgtccacgtgggcccgccagaagctagtcctgttggaggctgccatggc

SEQ ID NO: 6839749 - DNA, 61 bp, Homo sapiens
ttggggaagagttgactttggattaccaaatctagtcctccatattcagtaacttcctcaa

SEQ ID NO: 6839750 - DNA, 81 bp, Homo sapiens
aagtcagaagcatttgtggctgaacactcctgtctgtctgtgccaaaggaattttccaagctacagtgcttttgttagctt

SEQ ID NO: 6839751 - DNA, 68 bp, Homo sapiens
gcctggagacctgatggcagcggcggcctttcccagccctgaacccgctggccgccgggtctctcggt

SEQ ID NO: 6839752 - DNA, 56 bp, Homo sapiens
ggggcagacgcgagcaccggggcagagagacccactgcctggagtcgcgctgcctc

SEQ ID NO: 6839753 - DNA, 84 bp, Homo sapiens
cattcttctctggtctgccaccttcatcctccacttgcagcctcctttgcagtgaccatacaggtgcagagcatgagcaggatg

SEQ ID NO: 6839754 - DNA, 69 bp, Homo sapiens
gggcagaggtcaggttggacattatagggtcttctgtttctagtctccccagtcttggcttctactccc

SEQ ID NO: 6839755 - DNA, 76 bp, Homo sapiens
cgctttaacaccagggcagcagcctagtcttgcagtgactcctgatgggcattagtgctgtttgctgaggagggcg

SEQ ID NO: 6839756 - DNA, 61 bp, Homo sapiens
gaggacagagccgcctggcaagcccaaaacattcccaactggcctgttagacggagttctc

SEQ ID NO: 6839757 - DNA, 75 bp, Homo sapiens
cagctcctcctgtgccaggccagcagcccacagcacggccaggtgaggcctgggcacataacctcgagtgagctg

SEQ ID NO: 6839758 - DNA, 85 bp, Homo sapiens
acatataaagctaattttagagcgatagatcacaaagtaagattttctagctttgtattatcagcattggcttggctttctgagt

SEQ ID NO: 6839759 - DNA, 82 bp, Homo sapiens
gagtgacataagatgctaatatctggtaggagcacatttataattggtaagtactaatattagtaactcaatattgtcattc

SEQ ID NO: 6839760 - DNA, 65 bp, Homo sapiens
gacgcttgggaggaggagttgataggtgacttaatgttaaatctgggttccctcccccaattgtc

SEQ ID NO: 6839761 - DNA, 66 bp, Homo sapiens
agcgtggctggggcgactccacggtgcgccttcccgagggacctgtggctgtctctttcccatgct

SEQ ID NO: 6839762 - DNA, 61 bp, Homo sapiens
tcccatcacttttgccatattctattggatactaggtccagctgacacttaaggggaggga

SEQ ID NO: 6839763 - DNA, 65 bp, Homo sapiens
tctattgtaggcatgtagcttggtgccaccagttgatggagattgggctagtttgccattttagg

SEQ ID NO: 6839764 - DNA, 63 bp, Homo sapiens
gggagtttactggaagatactatttttgttggttaacaaagggctgtaagccaagtaaagcct

SEQ ID NO: 6839765 - DNA, 72 bp, Homo sapiens
ctcagggtcccaatggtactggggtcccggagttgaatcgaagctcctgaaaatccagactgggggggtgag

SEQ ID NO: 6839766 - DNA, 70 bp, Homo sapiens
ccctgagcgggttccgccccagagcccgaccctcctgggggctctaggcggagtcccgcgagccgagggg

SEQ ID NO: 6839767 - DNA, 72 bp, Homo sapiens
ggagatggctcaggccagaccacgactccgacatgagaatgtgggggtcctgagaaggccttggcatcctcc

SEQ ID NO: 6839768 - DNA, 101 bp, Homo sapiens
gtgccctctctgtgccccagtagtcctggattggtggaggcagagccatgggcttattccctgtctctccacacagccagtgcctaacacagtgacagcac

SEQ ID NO: 6839769 - DNA, 116 bp, Homo sapiens
gtaccctgtgtgttgcggggaggcagtggagaagcacctggctggaagttagagaacttgccatcggcaagaacagattcagcctgaactccagccatctggccacacaccggtac

SEQ ID NO: 6839770 - DNA, 61 bp, Homo sapiens
cttatcagcacagggacaatagcagatgtaattacagctttctgtcacctgtgcttgaaag

SEQ ID NO: 6839771 - DNA, 72 bp, Homo sapiens
cacaattgtcagtgctgtttaaattgtatcctctctctctcttaattgaacttttgtcactgacatgttgtg

SEQ ID NO: 6839772 - DNA, 62 bp, Homo sapiens
attgcatccttaatccacatcagagttctaaacagagaatttctgggaggtagaggggtagt

SEQ ID NO: 6839773 - DNA, 64 bp, Homo sapiens
ggaatcaatttttgagatttgtcagagagggttgcaaactgtttatcaaattctcattgatttc

SEQ ID NO: 6839774 - DNA, 73 bp, Homo sapiens
gacagaaggaacccggtcccagaccaaaagacgcctggctctgtggtggctgctgcttggtcttcttccagtc

SEQ ID NO: 6839775 - DNA, 130 bp, Homo sapiens
agcaagaggaatagcagccacaagactctactcatgtacatgtaagtcagaaaaagaatcccagttcatatttctgtgcctacatttgggatttgagaagtaacaagagtcatgtgctcaaccccttgtt

SEQ ID NO: 6839776 - DNA, 57 bp, Homo sapiens
ctttacacatcctaaccagtgtccaggatgattccagcacaggggaggagtgtgaag

SEQ ID NO: 6839777 - DNA, 77 bp, Homo sapiens
gctatgtccttagatcagaggctcttcctatgtggcatttctgtgtattggagctgcctctcttgaggttacgtggt

SEQ ID NO: 6839778 - DNA, 64 bp, Homo sapiens
gtagaaatgagatttcaccatgttggtcaggctggtttcgaactcctgacctcaggtgatctgc

SEQ ID NO: 6839779 - DNA, 66 bp, Homo sapiens
ggcaatggccactcctccctgcaggctggcctcggcatagcagaggggcaggtggtggccatggct

SEQ ID NO: 6839780 - DNA, 82 bp, Homo sapiens
ggtactcatgccttaagattcatggaatcctgtgaatgtcatggacaaaaatttgggttccttgagcttaatgaatgaaacc

SEQ ID NO: 6839781 - DNA, 59 bp, Homo sapiens
cttcccaagctccgggcttctgaagacttgcctcaggggctccaaggaagtttgggagg

SEQ ID NO: 6839782 - DNA, 99 bp, Homo sapiens
taggacgaaggaataaagacaaagggtctatgtgctgtctctgaaggatgattcccagaagttgccacatgacccttctgctttgagccctctggcctg

SEQ ID NO: 6839783 - DNA, 93 bp, Homo sapiens
atggaagtgttttagacatggatgctgagtggagaatggttaagtcaatcagtcatcccagctttcatctctagtgtcctgatagcactccat

SEQ ID NO: 6839784 - DNA, 55 bp, Homo sapiens
ggcaagggacggccgtgagacaggatgaatggcacactgctggctgacccatgcc

SEQ ID NO: 6839785 - DNA, 75 bp, Homo sapiens
gctctgccatggcctggggaagaccatgggcaaacctcagcgaccaggctgctcatgggtcctgccccgcggagc

SEQ ID NO: 6839786 - DNA, 62 bp, Homo sapiens
gaaggcctgtgtgtatacataaaaatattaacattaaataaaatttgtatgcatatgctttt

SEQ ID NO: 6839787 - DNA, 65 bp, Homo sapiens
gttgtaatgtagacaggatctagttaaaaagcatcaaaatgaagtttttctgtctgctttgcagc

SEQ ID NO: 6839788 - DNA, 92 bp, Homo sapiens
gaaggcctaaatgtccagtgaaggtgttaaattctgaaagtattaaggagccatgaatctatagcttcagttggcatttgccaccaaccttc

SEQ ID NO: 6839789 - DNA, 75 bp, Homo sapiens
gcctgtcagttttttgggacttaagttctccaatattctgtattgaggactgtggtccccaaagatgttacaggt

SEQ ID NO: 6839790 - DNA, 71 bp, Homo sapiens
cttagcagcttattcagtaagcacatacttggcttttaatgagtattgcttaaattgatgagttgaattag

SEQ ID NO: 6839791 - DNA, 64 bp, Homo sapiens
aggctggtgtctctgtcctgtcaagtatatgttaaagttgcttacagccacaagagatcagctt

SEQ ID NO: 6839792 - DNA, 73 bp, Homo sapiens
tttcttcctttattacatggatactctgtatccttctatgtatgaggtacagagatgaataatacaggtgaaa

SEQ ID NO: 6839793 - DNA, 70 bp, Homo sapiens
ctggaaaacaaagcttttcagtatgttcatgaacattatttagaagatgctgattggcttttgaaagcag

SEQ ID NO: 6839794 - DNA, 126 bp, Homo sapiens
agtacataattgtctcctcttaaggcaaggatgttaggtatagcactgcagcgatgggacctggacccagctgcctgcatttatatcctgctcaatttgaccttgagagggttgctgaattgttct

SEQ ID NO: 6839795 - DNA, 61 bp, Homo sapiens
tctatgaagtgcgaagaggcacagccagggagctctcctagcctccagtgggcttcgtaga

SEQ ID NO: 6839796 - DNA, 55 bp, Homo sapiens
ttattgggtcccaacaagttgccacagtatcagacacctagttgggacccaataa

SEQ ID NO: 6839797 - DNA, 83 bp, Homo sapiens
gggaactcaagatgggtatagactttctgaaatacattttcacagagaactataatccatcttccagaagagccagagattcc

SEQ ID NO: 6839798 - DNA, 87 bp, Homo sapiens
tcatggagtcaccttgtcacagtcaccgcctggggcagtgtgtcaggaaggaggtggcaactgtcgacaggagactcagaagcatga

SEQ ID NO: 6839799 - DNA, 57 bp, Homo sapiens
tgcctatgcctacctccagaaaatgttgattcattggtctggagtagagcacaggca

SEQ ID NO: 6839800 - DNA, 60 bp, Homo sapiens
caagaccaggctcctggagtccacctcgcccctagctgcatggtggccagcctggtcttg

SEQ ID NO: 6839801 - DNA, 73 bp, Homo sapiens
ttctaggaattcgctcacttggttatgaaggtcaacaaattccatgacctgctgctaagtggggaaccaggaa

SEQ ID NO: 6839802 - DNA, 123 bp, Homo sapiens
gccgcatggaggactttgtcacctgggtcggctcatccaagatcaagcaacacatgccatcatacaacggggagtgcaatgacttcgatctggaagcctagctggtctcctagtctccacggc

SEQ ID NO: 6839803 - DNA, 73 bp, Homo sapiens
ccctggctgggatatttggattggagtacatggtttacgtgggctgcttctcaaatgtctccattggtcaggg

SEQ ID NO: 6839804 - DNA, 80 bp, Homo sapiens
gactcaagtcataggcttctttcagtctttatgtcacctcaggagacttatttgagaggaagccttctgtacttgaagtt

SEQ ID NO: 6839805 - DNA, 91 bp, Homo sapiens
tctgcctgcatgctcagaatgtgcagaggaacagtgggtcctcaggctagaatcagactgtcccatgcaagtattcctgctccaggcaaga

SEQ ID NO: 6839806 - DNA, 65 bp, Homo sapiens
gtgcccggaaagcttctctcagctcacccggcaggcttttcttgcccagagcctagggagggcac

SEQ ID NO: 6839807 - DNA, 69 bp, Homo sapiens
tggatgtgcaggcagactgcaaaaatcgcttacttcgcaagtgtacattttgtaatttcctgacgacta

SEQ ID NO: 6839808 - DNA, 55 bp, Homo sapiens
tggaaaaactgagacttagacacaggtaagctggtccagagtctactttttttta

SEQ ID NO: 6839809 - DNA, 64 bp, Homo sapiens
attgtgagtagtgccacaataaacatatgtgtgcatgtgtctttatagcagcatgatttacaat

SEQ ID NO: 6839810 - DNA, 59 bp, Homo sapiens
gcggtgtagtgggctggggccgggcaactttgcagcctaatctcagtgccgctgaccgc

SEQ ID NO: 6839811 - DNA, 79 bp, Homo sapiens
gacaagcagtgggtctggtctaggtggccaggtcagatttaggtgaggtggcttcagagacagaatctatctgtttgtt

SEQ ID NO: 6839812 - DNA, 78 bp, Homo sapiens
aggccatgagcagggttgctgcagactttcatgtttacatgtgtgtatgtgaatgcagttatctataactctgtgcct

SEQ ID NO: 6839813 - DNA, 59 bp, Homo sapiens
gtagttagagttgtgctggagatgacgggaaacctggattagcacagacttttgcttac

SEQ ID NO: 6839814 - DNA, 61 bp, Homo sapiens
tctttttccgaagaacatgtgcagcctagaaacagaaagggcaaatgttcaggaaaaaaga

SEQ ID NO: 6839815 - DNA, 85 bp, Homo sapiens
tgataagctgtgctttaaaattagctttaaaccacagcagtcctaaaatgaggattctgtgagttctagttaatagtcagcatca

SEQ ID NO: 6839816 - DNA, 79 bp, Homo sapiens
tctggatttgttgattgactttagaatagcactgctgtcactcctgcagtgctgtgggaggagtcagagattatgcaga

SEQ ID NO: 6839817 - DNA, 56 bp, Homo sapiens
gctagtttcttgaatactctaagatattagctggggagtatttatacagagactgt

SEQ ID NO: 6839818 - DNA, 63 bp, Homo sapiens
tgccctctgttgatatccactcactgacataccacagtgtgtgcccttgttcagcagagtgca

SEQ ID NO: 6839819 - DNA, 55 bp, Homo sapiens
aagcctgtttataaactctacatggatcttttgtgtaatggttctgagcaggttt

SEQ ID NO: 6839820 - DNA, 87 bp, Homo sapiens
gctagctaagatttcagagctttgcagctaattactatgtaccttacaggacagttaaattgaagttgagtcctctgtctttgctgc

SEQ ID NO: 6839821 - DNA, 84 bp, Homo sapiens
ccctagggggctctactccagactggctggcaggtgtcccctccccaccagccatctgagagtgtccccaagtccccctcaggg

SEQ ID NO: 6839822 - DNA, 55 bp, Homo sapiens
gtcctccctgggagcttctgagtgcagaggggactcagagaccccgggaagtgac

SEQ ID NO: 6839823 - DNA, 92 bp, Homo sapiens
aaatttgtttgaacagtatgaagatgatgaaaaatagcatgtaaaaataaggtgttgttttaattaagtttatgctttattttaataggttt

SEQ ID NO: 6839824 - DNA, 56 bp, Homo sapiens
cctttttcctccttggtgtcttcaactgaacaagggcttgaagggaggaaagcagg

SEQ ID NO: 6839825 - DNA, 87 bp, Homo sapiens
gaggtgcactgggcaccaccgggcggtgggaggagggaccgtctccattgctcccacactactcggaggcattcagaaaggctcctc

SEQ ID NO: 6839826 - DNA, 70 bp, Homo sapiens
accccttcagcctcaagatccttcatctccgatacacaccagagatgggggatcttgaggctgaagaggt

SEQ ID NO: 6839827 - DNA, 56 bp, Homo sapiens
cttatttcagccctgggcaccctgtaagcagggttggccagagatgctgatataag

SEQ ID NO: 6839828 - DNA, 95 bp, Homo sapiens
ggtcttagagctaagaccaaggggcaacagagctcccttccttctgcaagctgtagggaaggctctgttccttgacttttctggcttctaaggcc

SEQ ID NO: 6839829 - DNA, 71 bp, Homo sapiens
tggaagcaacactcagctttacatattatctcaagggaaaaaagtcaggaaattaaagctgattgctttca

SEQ ID NO: 6839830 - DNA, 79 bp, Homo sapiens
tattttgcagatgaagagactggggctccaggaattgactttcccagaatcccattgtcacttcagggctctcaagatg

SEQ ID NO: 6839831 - DNA, 107 bp, Homo sapiens
accctgagattgacatatggggagtctgggctagactcctcgagggtgagaaactatgtgaagcaaggtctggccaatagacagccccaaatgccagaattgggagt

SEQ ID NO: 6839832 - DNA, 61 bp, Homo sapiens
ggccaccagagtgaaaagctgggagggcatctcctgctcctccagcttctcttttggggtc

SEQ ID NO: 6839833 - DNA, 68 bp, Homo sapiens
ttgagtaaagggccagatagtaaacactttaggtgttgaaggatatgtggtctttcctaactgctcag

SEQ ID NO: 6839834 - DNA, 74 bp, Homo sapiens
gttggatgtttattatggcagttttctaggtgagagttgattctgacttgggccagggtcatagaaatatagat

SEQ ID NO: 6839835 - DNA, 67 bp, Homo sapiens
tctctgtctgcctgcaatccagagactggctatgactgcttgccagtgtcccacagggagacggggg

SEQ ID NO: 6839836 - DNA, 80 bp, Homo sapiens
atagatatgctgtgaaaagcaggctactttctattctgcctccctagaaaagagtacttttctgctttttaattatttgt

SEQ ID NO: 6839837 - DNA, 65 bp, Homo sapiens
ttcacagaagaggtcacatttccctctttacagcactagcagaattgtatacctcttcctgtggg

SEQ ID NO: 6839838 - DNA, 114 bp, Homo sapiens
tactatttacaagattttatttgcttcattttaaataaagacaattttatacagaaaagacgttggtaatagtgaagtgaagttaattgtaagaatttttctttgcaaatagtg

SEQ ID NO: 6839839 - DNA, 55 bp, Homo sapiens
cctcgggcacaagagatccttacagctcaagtgcagaccctctcagtgcctgagg

SEQ ID NO: 6839840 - DNA, 97 bp, Homo sapiens
ccccatagcacaggcagcaagtgtgaggcacagcacagagcacatgtacacgagtatttgtgtgcgtgtgtgcgcatgtgtgcgcgtgtgaaggggg

SEQ ID NO: 6839841 - DNA, 97 bp, Homo sapiens
tagaggattatgatttattctcatcaggaattatcctaattattatggattttggcagtttgaggttttctgatgtagaataacatcatgtctttta

SEQ ID NO: 6839842 - DNA, 95 bp, Homo sapiens
ctctctccttgtttatgttcctgtggggttaaccctgactagaaaagtgcaggacattctgccatcacgtgtagagggaacatcggggaagagag

SEQ ID NO: 6839843 - DNA, 55 bp, Homo sapiens
agtgggatcctcaccccagcaatgcttgatgatagtaggggtagagtgtcctatt

SEQ ID NO: 6839844 - DNA, 66 bp, Homo sapiens
ttcagtgaacttgagtacttcattcctttggcaggctggataaatgagaagcctaggtgtactgga

SEQ ID NO: 6839845 - DNA, 83 bp, Homo sapiens
gaggggcgtccagtctgcatgaggactcagagcttctcaggcagagagccatctgagccatcatgtgggccataacgtgactc

SEQ ID NO: 6839846 - DNA, 78 bp, Homo sapiens
ctgaggcatccactgagcagaccatggcagaggtcttcttaaagcacctactgtgagcatggctgccccagtgcctag

SEQ ID NO: 6839847 - DNA, 61 bp, Homo sapiens
tctgtcctcagcatttggattggatttggcttacttccacccactctgagtgttgaacaga

SEQ ID NO: 6839848 - DNA, 63 bp, Homo sapiens
gaaaccgcaatttcagtgctgagaactttgtgtgtttacaaaggctgaggtccctgtggtttt

SEQ ID NO: 6839849 - DNA, 105 bp, Homo sapiens
gtaatgggcatagccaagattgtggcagaccttcccttctccttccatgtcttgaaggtcgggagcaagccggaggtactgttcataatagggggcagcctggac

SEQ ID NO: 6839850 - DNA, 129 bp, Homo sapiens
ggccatggctggcgctctgcatggacgtgtgagccgccctggcctggcgcgttgtcagctagcactgctgagtgccgtgggccggggagatgtctcacagccccgtctcgtttattttccgccattgcc

SEQ ID NO: 6839851 - DNA, 74 bp, Homo sapiens
ccaggaccccatttagataacagttcaaagacattctctttgaacatgacatttaaacttagatctggggatgg

SEQ ID NO: 6839852 - DNA, 58 bp, Homo sapiens
tcagccatcacattccaccctcaatgtgtatttgctgaaggaatgaatggatggatga

SEQ ID NO: 6839853 - DNA, 56 bp, Homo sapiens
tgggcaactactgtgtgtcaggctggattccagctgctgggatacagtagtgaaca

SEQ ID NO: 6839854 - DNA, 68 bp, Homo sapiens
gctccacagagtggaggcttggcctgactcctgtagctccagctaggctcttgccttctctctgcagc

SEQ ID NO: 6839855 - DNA, 81 bp, Homo sapiens
ggcccagcctggagcctcagcaaggaggtggttatgtgaggcgagcagccctccagatgcaggggctctcaggccagggcc

SEQ ID NO: 6839856 - DNA, 94 bp, Homo sapiens
cctgtagtagaggttgttagctctttgcttgaagatatactacttccttgcctaagggagacacgctgcaggcataagttagcaccctgcttgg

SEQ ID NO: 6839857 - DNA, 65 bp, Homo sapiens
ggtcaagccggctgggccgaggctgcccacacctggggtcctcgcggcgcgaagccagtgcggcc

SEQ ID NO: 6839858 - DNA, 65 bp, Homo sapiens
tggacatagttagctaccacacagaaagagctcaccctctacctgtgtctatgcagccatatcca

SEQ ID NO: 6839859 - DNA, 56 bp, Homo sapiens
accaagggcagagcctacatagacctgcaggcagcccctgaggctcagctcctggt

SEQ ID NO: 6839860 - DNA, 119 bp, Homo sapiens
gtccccgctggcccagacttgcagcctcgtctaaaacctcccgccccaggttaaaaggcaaaataacggcacctggaggggcaatggagcgcggacgggctgttcgagggcagcggggc

SEQ ID NO: 6839861 - DNA, 63 bp, Homo sapiens
ttgtaacagtagctgtcagctcataactcattggagaagggctgaatttgttgcatgtaacag

SEQ ID NO: 6839862 - DNA, 64 bp, Homo sapiens
gtcctcagaagccttcacagttactgatcctcccactctgttaaagactgttccttcagaggac

SEQ ID NO: 6839863 - DNA, 77 bp, Homo sapiens
gtttaatgtgggctcatctttaaatttatgacgttaactacgtacatcattttggagatgagcattgctatagaaac

SEQ ID NO: 6839864 - DNA, 55 bp, Homo sapiens
cagtttctcagacttcccttgttttttaataaccttggtaggtttgaggatactg

SEQ ID NO: 6839865 - DNA, 128 bp, Homo sapiens
ctcagggttagttaagctttttatttttccttctgtgaacttcacgatagccaaagctataaacagtagctttgacatacgtgaggtttttcagcagtgggctaccagatcagaaatctaggattgag

SEQ ID NO: 6839866 - DNA, 128 bp, Homo sapiens
actaggcaattgttgttatttccctgtacactattaaacctgctcattagggatgggtgcattgggtaacccagggtgacggctaggtttaatagtgtgatttattaaacatttcatatttacctagt

SEQ ID NO: 6839867 - DNA, 58 bp, Homo sapiens
ctgccctgtggctctgagtcatgagaaaaccagacataagcgagcatcacagggacag

SEQ ID NO: 6839868 - DNA, 75 bp, Homo sapiens
gttgatggcagtgtttgtgatgaacagacaaaggtttgtacagaccaatctgtccatttacagatatgcagcaac

SEQ ID NO: 6839869 - DNA, 71 bp, Homo sapiens
gtgagatctgttttgagaaatgcatgctcgggcgatatcactgtcgtgcagacctcacagcattcactcac

SEQ ID NO: 6839870 - DNA, 87 bp, Homo sapiens
aaggatgcggcagggaggctttgaatgcacggttcacaaacctcttaggttatgacttgactttcatggactgtttgttggatcctt

SEQ ID NO: 6839871 - DNA, 85 bp, Homo sapiens
gctctgtgctgcctggaatggtcttcttcctcctctcagtctttgagggagaggctgaactatcctaacaaggccagctcagggc

SEQ ID NO: 6839872 - DNA, 111 bp, Homo sapiens
gtagatggtgtaggagactgagctgaaaatgtattgcacccagtagtttaaattctgagctcttgagagaagagactgggtgcattttgttcaatcttctatcctggatgc

SEQ ID NO: 6839873 - DNA, 72 bp, Homo sapiens
agcggggcgatgggggcctgggaggcggctggggggccccgccgccctccgaggactccttcagcgctcgct

SEQ ID NO: 6839874 - DNA, 76 bp, Homo sapiens
ggagccctcacctctgcattcgctttatgactgagtttctcctgaaacagtggagaagcaaatgcagtgaggatct

SEQ ID NO: 6839875 - DNA, 64 bp, Homo sapiens
gcctgcttccttttcatagatggcaccctctagctgtgtcttcatgtggtgggaggggcaaggc

SEQ ID NO: 6839876 - DNA, 76 bp, Homo sapiens
aagtgactcagcctggctcttggggccctgcccagagtccccccaggctcctaagagctgaggcattgggacattt

SEQ ID NO: 6839877 - DNA, 65 bp, Homo sapiens
ggaggaggccgagggcgaggcgccgtggacgtggaccggcctctgcatcttcgccgcactcttcc

SEQ ID NO: 6839878 - DNA, 58 bp, Homo sapiens
ctgaaggcctatgaccttgaaaaatgaacagaaccacattagcaaggggaggcctcag

SEQ ID NO: 6839879 - DNA, 79 bp, Homo sapiens
agcttgcagagcagccagccccagcctctgatgttataaatgtagatgtgctggtggtgggccagttctgtcgtgggct

SEQ ID NO: 6839880 - DNA, 68 bp, Homo sapiens
cgtgtgtgccaaatcccataataaatcctgttatatgagaggatttattatgggatttggctcatatg

SEQ ID NO: 6839881 - DNA, 64 bp, Homo sapiens
gtggaattagctgcctaggaaattagctgcatagactgagagtgcatagggagttaattcccac

SEQ ID NO: 6839882 - DNA, 61 bp, Homo sapiens
agggatcttgttaccatttcaggcctgatgggacaaggtagagagtgattgcagggaccct

SEQ ID NO: 6839883 - DNA, 55 bp, Homo sapiens
cttttccactgagcctcacaaaaggtggcagagacctgagggctccttggaaaag

SEQ ID NO: 6839884 - DNA, 57 bp, Homo sapiens
atgcaaagtgctccagtgatctaagcaaagtagtttgttttggagtggactttgcat

SEQ ID NO: 6839885 - DNA, 59 bp, Homo sapiens
ttggcaaaaccaggtagcaaaggagacatgtgttatgcagagtcccatcctggtgccag

SEQ ID NO: 6839886 - DNA, 93 bp, Homo sapiens
gaggcattcagggtggctgaattaggtggaggaggatggtggggggcgacagtgtcgtcccctcctctccctaagagtcaccagccatgcctc

SEQ ID NO: 6839887 - DNA, 64 bp, Homo sapiens
tctacctggtacatagaaatgtttagagagcacatttattaatatatcccatgtactctgtgga

SEQ ID NO: 6839888 - DNA, 61 bp, Homo sapiens
tctgcacataggtaggctggaagcgtgggtccgcctaaggcaagccagatctctgtgtagg

SEQ ID NO: 6839889 - DNA, 68 bp, Homo sapiens
tgtagaagtaggagtcatctcattgattgtcttgagtaaaaggaaatggctcatgcatcttttctaca

SEQ ID NO: 6839890 - DNA, 79 bp, Homo sapiens
ggataaaagcatgtagctgggaatgggctgctgagtagcctctactcccagcccagacttctccagtatgttttcattc

SEQ ID NO: 6839891 - DNA, 125 bp, Homo sapiens
gtttctaggtcacactctcagtatttctatttcagtagtaggtctggaatggagtaggggtggagaaaaaggatttgcatttttaacaagttcccagatgctgctgatgctgctggcctaggaac

SEQ ID NO: 6839892 - DNA, 83 bp, Homo sapiens
ggggttcctgcacccggggcccctgaacccgagactcctgcacccgcagctcctgcaccaggggcccctgcacccgggacgcc

SEQ ID NO: 6839893 - DNA, 57 bp, Homo sapiens
gcgtccaggacgtgggtttcttccctcttccaggcgagaggccctcggactgggcgt

SEQ ID NO: 6839894 - DNA, 104 bp, Homo sapiens
tggggatggctgcatgactttgtggatatactaaaaaagtattgaattgtacttaaacagttgatttttatggtgtgaattatatttcaataaagctattacca

SEQ ID NO: 6839895 - DNA, 61 bp, Homo sapiens
cagcatgcatttttggactgtgcacagcttaggtaaaagatggcagagtcaagagctgctg

SEQ ID NO: 6839896 - DNA, 87 bp, Homo sapiens
tcctggagaaggtcgcagcagcgggacccagcctcccttcctgaatctgagggtggaagagctgggaccgtctggaagttcctggga

SEQ ID NO: 6839897 - DNA, 83 bp, Homo sapiens
atatactgtagtggtttagagcaaaaactctggtgcctggatgcctgggttcaaaaaccagctctgccacttaatagctgtgt

SEQ ID NO: 6839898 - DNA, 58 bp, Homo sapiens
gttatggcacttgatatttgatttgccccaatggcacatactccatcaaggccaaaac

SEQ ID NO: 6839899 - DNA, 57 bp, Homo sapiens
ggcctgaatgcctgagtgtgggctttccaaattgagttctcactggcacatcaggct

SEQ ID NO: 6839900 - DNA, 89 bp, Homo sapiens
tctttgctattgtgaatagtgccgcaataaacttacgggtgcatgtgtctttgtagcagcatgatttataatcctttaaaaagtcagga

SEQ ID NO: 6839901 - DNA, 64 bp, Homo sapiens
tcctgagggtaggtccatctgggataccaaattgcagatcactggttacttaatgaacttagga

SEQ ID NO: 6839902 - DNA, 57 bp, Homo sapiens
tacagggtcacagaggacctgtgctcaaggccctgcccactttctctgttccttgtg

SEQ ID NO: 6839903 - DNA, 61 bp, Homo sapiens
tacctgctgtgtgacgggatgttagagaacccaactctgtatctattttaacagcatggtg

SEQ ID NO: 6839904 - DNA, 59 bp, Homo sapiens
gctactagtacagcaaggactacagtggacatggctatggccttggtggttttggtagt

SEQ ID NO: 6839905 - DNA, 80 bp, Homo sapiens
actaccacacagacctattaggggttttaaatgaccaacatctataaaacacctgtagtgtctgccatgtaataggtagt

SEQ ID NO: 6839906 - DNA, 93 bp, Homo sapiens
ctgctaattttaaattttcactttttttgtgttgaaggggagtgattttcatataacctttcaatgacacaaaagagaaactagagttttcag

SEQ ID NO: 6839907 - DNA, 55 bp, Homo sapiens
tttccaataaggtcaccttcctaggttctgggattaggacatatcttattggaga

SEQ ID NO: 6839908 - DNA, 92 bp, Homo sapiens
gccccccagtccccttcaggccctgagggacctcaccccatgcacctgctgcactgggccctgaggcctcagccctggaccctggctagggc

SEQ ID NO: 6839909 - DNA, 70 bp, Homo sapiens
ctccctttctccctgtcccaaactggactgagcaagtgaaagaaccagtctgagatggaagaaaaatgag

SEQ ID NO: 6839910 - DNA, 71 bp, Homo sapiens
ccttaagtatatctgcaaagaccctttttccaaagtcacatttacaggttctgggtagatgtatcttttgg

SEQ ID NO: 6839911 - DNA, 56 bp, Homo sapiens
cctgcctgaggttgcacagccaacaaacggctgcgctggggctcaaacctcacagg

SEQ ID NO: 6839912 - DNA, 57 bp, Homo sapiens
gttgtgtgtgagccttcaccacaagaaccctggttctgtgggaaggacacgcagagc

SEQ ID NO: 6839913 - DNA, 60 bp, Homo sapiens
ctttattatggaactgaagatcctcttaggaatgttaggttcacagtctacatagtaaag

SEQ ID NO: 6839914 - DNA, 63 bp, Homo sapiens
agatcaactcagaatcctgctgatatggtttgaatacctggatccagttgagactgaagatct

SEQ ID NO: 6839915 - DNA, 74 bp, Homo sapiens
tgctactcaacagggccaagctgcagcatctgtcctaaccatgcaagggtctggtcctgcagtgagttaaagca

SEQ ID NO: 6839916 - DNA, 69 bp, Homo sapiens
agccttcttgagaatctggtgaactgtccaaacataaagactacatcacttaattcttagaatgatgct

SEQ ID NO: 6839917 - DNA, 75 bp, Homo sapiens
tgccatcagggaggaagagagaagatggtgtttcctcctctgggaatgtccttctcctcttacctgcctgaggca

SEQ ID NO: 6839918 - DNA, 66 bp, Homo sapiens
aaggtgacaaaaattctgaatggttcgaaagaggtagaatatatttctagaatccttgtctacttt

SEQ ID NO: 6839919 - DNA, 77 bp, Homo sapiens
gccataaatatttcacctcacccaggagaatcaaagcattttcacattggttcttactggggagttgagatatgggt

SEQ ID NO: 6839920 - DNA, 58 bp, Homo sapiens
gcactggagggtgtagttgctgtatcttccctgctgttaaactacacttttcagaggc

SEQ ID NO: 6839921 - DNA, 62 bp, Homo sapiens
gctcctgatttgattttggtatatcgaaccagggatattccagttatatcaaatcatgaagt

SEQ ID NO: 6839922 - DNA, 65 bp, Homo sapiens
cagggaggcggctgagagggcgcgccccgagtccacaggggaccagtgccctgcccgcagccttg

SEQ ID NO: 6839923 - DNA, 75 bp, Homo sapiens
agggtgcagctttctgcaatgtcatccagccagtcaccacaggggcaggatgaacagggcaggcaagagcctcct

SEQ ID NO: 6839924 - DNA, 92 bp, Homo sapiens
tggcaaaatctctacaaatcaatttgattaataccatacttggtttaaaagtctaagaaatgtgaatattgaatagatatttgattttgcta

SEQ ID NO: 6839925 - DNA, 68 bp, Homo sapiens
gagacagggtcttgctacattgcccaggttgatctcaagctcctggcttcaagcaatcctcctgcctc

SEQ ID NO: 6839926 - DNA, 99 bp, Homo sapiens
gaggactggtttatatgtgtttggtgagtaagatagagaaaaagtgtttaatcttacaattacaagacactctagagatgaatataatctagtggcttt

SEQ ID NO: 6839927 - DNA, 90 bp, Homo sapiens
ccttggggcggtcgctctgcagatttcatgcgaaatggggtcaaaaggccgcgcagaagcgtggagtctgcaggggaaggctccccgggg

SEQ ID NO: 6839928 - DNA, 56 bp, Homo sapiens
tcagctctgttttgagtggaactgaacactcagtgatggctaaaaacagcagttga

SEQ ID NO: 6839929 - DNA, 59 bp, Homo sapiens
ggctgaagaactgggagtctcatttattgagttgtgaccatctttcagtaatttcagcc

SEQ ID NO: 6839930 - DNA, 71 bp, Homo sapiens
agaggcattcttcagcaggggacactatctgcctcattccagatagtagcacttctgctaagtcttcctct

SEQ ID NO: 6839931 - DNA, 63 bp, Homo sapiens
tggatttaatgctttctttgtattgctgatccttaagcatgattagagaaagaattgagtcta

SEQ ID NO: 6839932 - DNA, 59 bp, Homo sapiens
tggtgcctgtgcatgaagagacagcaggctctctgatatctcttcccatcaggacacta

SEQ ID NO: 6839933 - DNA, 75 bp, Homo sapiens
cgtagctctgagccattgattaccagcagcagtttacagcaactgcagttttgtaaacagtagcttaatgtcatg

SEQ ID NO: 6839934 - DNA, 69 bp, Homo sapiens
gaggtcagcaagtggaccatcctggggttcatgattgtctgattcccagacctctccccttgctatttc

SEQ ID NO: 6839935 - DNA, 56 bp, Homo sapiens
ctcacctgcaatcccttccaggaagcatgtcccctatgggagggtccaggctagag

SEQ ID NO: 6839936 - DNA, 64 bp, Homo sapiens
agaaagatgggattagtcctgatcatctgttagagaatgatctgagagcagatcaccatcttct

SEQ ID NO: 6839937 - DNA, 64 bp, Homo sapiens
gttctgaatgtgcctgtactctgttcgtgcttctctttgcagctgtgcaagttcattcgcaaac

SEQ ID NO: 6839938 - DNA, 62 bp, Homo sapiens
tgtttgttgagtgtctcccgggtgccaggcatttctaggcactgtgaatatactagcaaacg

SEQ ID NO: 6839939 - DNA, 75 bp, Homo sapiens
ttgcttccagttttagtcatctattgtcatttatccaccattctggtgaaggacagcagtggctccaacgaacaa

SEQ ID NO: 6839940 - DNA, 58 bp, Homo sapiens
tcacttccaggccccccacgctaatggctggtgaaaccttagccaggtggggctgtga

SEQ ID NO: 6839941 - DNA, 65 bp, Homo sapiens
acaggagtggctctaccagacccaaagggaatttaatttcttcaatctgtctttgctactcttgt

SEQ ID NO: 6839942 - DNA, 57 bp, Homo sapiens
acctgctataaaatgggcatagaaagcaaacattccaatgcttaattcctagtaggt

SEQ ID NO: 6839943 - DNA, 73 bp, Homo sapiens
cccagagctggtcaatgttttcaactccaaaaaggtattccattttggtagaatcaacaatgtacgtttaggg

SEQ ID NO: 6839944 - DNA, 82 bp, Homo sapiens
tgtcaatggatcttcgtgagtgttttgcttggtatgaaatctgtatacacataaaatgctcatggtataacactaagtgata

SEQ ID NO: 6839945 - DNA, 66 bp, Homo sapiens
tcatgtgtctgccagtgtttatgcaaaatattactttgacctgtgtgccttggcaaatgaccatga

SEQ ID NO: 6839946 - DNA, 114 bp, Homo sapiens
ttggaaatgtaatgaaacaaaattgaagctaccaggatttgctaatatattacagaaaaacaatactgtgtttattgttcttcactggtcttattttgttggcctcaattccaa

SEQ ID NO: 6839947 - DNA, 84 bp, Homo sapiens
ggtagttgctgggggcttctcttgctgggctggtttagtgcttccctgagtaactggcccgggagcagaggcctgagtaatgcc

SEQ ID NO: 6839948 - DNA, 60 bp, Homo sapiens
gatttggctaacacgcgttttgttctgattgatcagtgggaaccggcagtttagctaatc

SEQ ID NO: 6839949 - DNA, 92 bp, Homo sapiens
gctcctagggacgctgtgggtaattctagtcattgcatcacaaagcccaaaggtgtgatgcaatgtctgggaggtgtgtgcagtctgggagt

SEQ ID NO: 6839950 - DNA, 83 bp, Homo sapiens
ccctgcttctgtggtcttctgtctcagcaggctgtcaagtcggagactgagtgcctgagcaggcgtggaccatgaaggagagg

SEQ ID NO: 6839951 - DNA, 63 bp, Homo sapiens
acagatctatggttctctgtaaatggctgggccaaagagtacgaacagggccatagaaactgt

SEQ ID NO: 6839952 - DNA, 101 bp, Homo sapiens
cccatgctgctgggctaggacgacacgtggagaacaattgctctaaaaattgagcagatcaacactctctttcaagtctgcacctggcccagcaccatggg

SEQ ID NO: 6839953 - DNA, 58 bp, Homo sapiens
ttttctaaaatatccaggacagtctttggtgaataggtcttggtatgtatttaggagg

SEQ ID NO: 6839954 - DNA, 73 bp, Homo sapiens
gatgcgactgttcatggcccgaggccaccaacaaggagatctggctgcctcatggccttgagctgagggcatc

SEQ ID NO: 6839955 - DNA, 58 bp, Homo sapiens
acttatctgcaattagtacatagacactaaatagtttatgttgctttatgtagtaagt

SEQ ID NO: 6839956 - DNA, 59 bp, Homo sapiens
tggtgctgagatgaagtgctccaaatagctaatggcctgggcttgttcactcagtacca

SEQ ID NO: 6839957 - DNA, 59 bp, Homo sapiens
gttgcagggcacttaagcttggtggagaccgtcagtgcctccttgcctgtccctgcagc

SEQ ID NO: 6839958 - DNA, 55 bp, Homo sapiens
cttgtctgagtttggccacacacagcaatccgggctggtccagacttcagactag

SEQ ID NO: 6839959 - DNA, 80 bp, Homo sapiens
gcagatcccggtgcagctgaaggctggccagctgcagtgtatccgcttagcccagtctgtatcaggcacccacgttctgc

SEQ ID NO: 6839960 - DNA, 92 bp, Homo sapiens
gtccttttcaggccaaggaggcagagagcatagtttgagtttgcagttcttatagtaaagcaggcatctctctcctctgcctgtaaagtgac

SEQ ID NO: 6839961 - DNA, 98 bp, Homo sapiens
gtccaaagtcaagtgtcagcatggttgggttctggggagggctctcttcctggtccccagatggccagctacatgttgtgtcctcacatggctgggac

SEQ ID NO: 6839962 - DNA, 70 bp, Homo sapiens
gagtgtggtttctcccttcgcagtgagatgctcccgacgtttttatttcagccaattagaagccccactc

SEQ ID NO: 6839963 - DNA, 58 bp, Homo sapiens
tgtctacttgggctctacagcagaacggcgaattctgagttcggccctctagtggaca

SEQ ID NO: 6839964 - DNA, 65 bp, Homo sapiens
gactattttcccatatggttgacagagcttcaccaggtcctggtcggtggtgtggggaggcagtc

SEQ ID NO: 6839965 - DNA, 84 bp, Homo sapiens
aggggtccgtggctgggctccgagcggcttgctgctccctcctcagcctgaggccgccggagcccaggctagacgcgctcccct

SEQ ID NO: 6839966 - DNA, 116 bp, Homo sapiens
gcagcatttgtggcagtggctaaaagctgttccagggcttggctgggacggtatctgctgaataactaggccagtcctagagccaagatccacagctcagctgctgttgctgctgc

SEQ ID NO: 6839967 - DNA, 76 bp, Homo sapiens
cagaagtgaagaggtacaagtcctcagataacattctgtaaattgtgtctgaacaaactctgcctcctgccatctg

SEQ ID NO: 6839968 - DNA, 67 bp, Homo sapiens
agtcagtgtgattctcaggaggatacccagatattgctggaagcttcgctgattatcacagctgcct

SEQ ID NO: 6839969 - DNA, 77 bp, Homo sapiens
gctgacctctgaggcttcagactgtactggtcgccagctggccccagcccagaacctctgtaggccccagggagagc

SEQ ID NO: 6839970 - DNA, 56 bp, Homo sapiens
gctaggttggggaagttctcctggataatatcctgcagagtattttccaacttggt

SEQ ID NO: 6839971 - DNA, 69 bp, Homo sapiens
gcagggacctgggctacaacaggtgaggaggtggtagccccaccctttaccacatgtgctgtcccctgc

SEQ ID NO: 6839972 - DNA, 74 bp, Homo sapiens
gcatgggaatttagtctggagtgaaaaagccatcaagaggtaattatcaagttctccaattaaaaattgtatgc

SEQ ID NO: 6839973 - DNA, 89 bp, Homo sapiens
gtctggctaaattggcagattctgaacaaagcctggccctgacaagtcttcagaaaaaccggttttcacctccagaatgtgccccaggc

SEQ ID NO: 6839974 - DNA, 83 bp, Homo sapiens
ttgggagcgaggcagggtcagctggctgtcaggggctgaaagaggcttggccactggcatccagctgccatcccagctcccaa

SEQ ID NO: 6839975 - DNA, 74 bp, Homo sapiens
ggaccttgaacaagaagctgtagggattaactccctcccttgggcagtctgtccctgcccttctatcagggtcc

SEQ ID NO: 6839976 - DNA, 64 bp, Homo sapiens
gtgaccatggtttttaccctacaccatacagaactgctgatggggtcaggctgagaacaggcat

SEQ ID NO: 6839977 - DNA, 69 bp, Homo sapiens
ttctacactcacccagctgtaacaaggtgctccaacctccccgcctcccatgctgaggtggtgtcagag

SEQ ID NO: 6839978 - DNA, 86 bp, Homo sapiens
aagtggtacactcaggccccaccctaccacagcacaggcctacctgtgctgaggagagggggtggtctggcggctggtcactattt

SEQ ID NO: 6839979 - DNA, 72 bp, Homo sapiens
ccaggcctgtgcaaggagggagggtgtccgttcacctgccctcccagattgcaagccacaaccagtgcctgg

SEQ ID NO: 6839980 - DNA, 82 bp, Homo sapiens
ctcccaagtggtgagcagggctgaagtcgcaggcctactggaccctgcatttgaagtcagacaggctgctggcggcttggag

SEQ ID NO: 6839981 - DNA, 58 bp, Homo sapiens
cagggaaggctgcaaatgttaaattgattattcctttgacagtaggtggttttcattg

SEQ ID NO: 6839982 - DNA, 57 bp, Homo sapiens
gtgtctgagcccagtgagtctcgcagggcctccctgcctccaccgagggccaggcat

SEQ ID NO: 6839983 - DNA, 56 bp, Homo sapiens
tggctgtctcggctttgctgctgtgtcagtccatcagagcacagtaatgactgcta

SEQ ID NO: 6839984 - DNA, 90 bp, Homo sapiens
cctaggtggatttcataaggacctgtgttcaggtcgtggtggaaagacaggaggggacacgtgagaccttgcagaggtggaatccacagg

SEQ ID NO: 6839985 - DNA, 74 bp, Homo sapiens
gcttcttcccaagactcaatttccttacctgtaaaatagggtaagaggggaaagaagtttatttgtcaagaagc

SEQ ID NO: 6839986 - DNA, 74 bp, Homo sapiens
acaccatctagcagagagatggacagagaagctatgcagggatgctcacccttcatctctcatggtagatgtgt

SEQ ID NO: 6839987 - DNA, 57 bp, Homo sapiens
cagagagataggttggtgtcctaagttctagggcagatgctgagatttatttctgtg

SEQ ID NO: 6839988 - DNA, 124 bp, Homo sapiens
ggaaataataatacatgttgcttctattcacaaagaaaggcatgtggtcaaggctcaaatcaattgggtatggatatatccttatctccccatagggatggaagcaaatatttaaaatatttcc

SEQ ID NO: 6839989 - DNA, 74 bp, Homo sapiens
tgaagagcaatttgggaccaaggccaggactcagattctctttctgtttgctgatgtccctaattagtttttca

SEQ ID NO: 6839990 - DNA, 73 bp, Homo sapiens
gcaagaccagagctgagcaccaagcatggtctggaaaccccggctggcgtagcaagttcagccctggttttgc

SEQ ID NO: 6839991 - DNA, 59 bp, Homo sapiens
gtttacattaagtattagcatccttagagaaaccaggaccagctgacttaattgtaaac

SEQ ID NO: 6839992 - DNA, 65 bp, Homo sapiens
tccatctttaaagaaattcctcatcttttgatatttcgagcaggaaggctttgggggttcctgga

SEQ ID NO: 6839993 - DNA, 123 bp, Homo sapiens
ggaatttcttctcttgctttttacaaagtgagaattctggacctcaccccatagcaatggaagcagaatccatggactgaggtgcagcaatcctcatgtgtaacacataactggaataattcc

SEQ ID NO: 6839994 - DNA, 62 bp, Homo sapiens
gtgtgtaaacctccaatctggggcataatgtagaaattgggtgggcagtggtttgcgcggtc

SEQ ID NO: 6839995 - DNA, 70 bp, Homo sapiens
tggaggatgccatccaggatacgtcataaaaaaattcattcaatttgagtattcttttcagagtccttta

SEQ ID NO: 6839996 - DNA, 108 bp, Homo sapiens
gtgtgaggacccctctgcctcgactacccttctttcatgtcctaaaacaaatagtgctttctaggaaaagatagaaggacgtgtgtgagagccagatcaatcctccac

SEQ ID NO: 6839997 - DNA, 69 bp, Homo sapiens
agtattagggatttttataggtatttataggtattttttataaagtcattatgaagatctaattaagct

SEQ ID NO: 6839998 - DNA, 91 bp, Homo sapiens
cattatcaggcatcttgtgagcagtagatctggaagagaattcaaattatttgactctggttagtgatctttgatcatgatgatgataatg

SEQ ID NO: 6839999 - DNA, 68 bp, Homo sapiens
gatcagcatgacagtgccattgacgctgaccttcatctctaggctgctgttgcatttcatgtttgatt

SEQ ID NO: 6840000 - DNA, 60 bp, Homo sapiens
cctgcctgctcaccagtgtgcctttattagttcggtggagaaacctcggtaagcaggagg

SEQ ID NO: 6840001 - DNA, 129 bp, Homo sapiens
ccctccttcaatacgcccttgaaattcccctgcttcacagccttactgagatccacttctagcacttttctgaaggcctctggaggactcccagtaagatgtccagagggcacatttagggacgtgtgg

SEQ ID NO: 6840002 - DNA, 91 bp, Homo sapiens
ctctcatgacatttgagttacttagtactgaatgcattttgtgatgtattcagaaaatgcatttcactaatgtttccctaattcatggggg

SEQ ID NO: 6840003 - DNA, 73 bp, Homo sapiens
gtatatgcttataatgggagtacagaaaaataggtttggcttcctatttagtgaaacccataaagcattatac

SEQ ID NO: 6840004 - DNA, 76 bp, Homo sapiens
gccaactgcagatcatgggactgtctcagccccatatgtatctgaaggctgagaagtcccatgatccgcacttggc

SEQ ID NO: 6840005 - DNA, 59 bp, Homo sapiens
tgccacactcccctgctgcagtcagtccgtgcctccctgattggttggttggtgtggca

SEQ ID NO: 6840006 - DNA, 73 bp, Homo sapiens
gctagattatgcgtgggccaactgtttcttggtcttttggcgaagatcaagtgtactttatgtatggactggc

SEQ ID NO: 6840007 - DNA, 70 bp, Homo sapiens
atctagctcctatgcaccttcagtctcaaagaaaactgatgagcatcctgcaaggtacaagatgctggat

SEQ ID NO: 6840008 - DNA, 62 bp, Homo sapiens
gttaggctcttctcgcttgcttgtactagtaaagcaaatagcagcagtgagaggtgtcttac

SEQ ID NO: 6840009 - DNA, 63 bp, Homo sapiens
ttctgagatacttttggcaccatcccttatcaagggtgttggttgttgggggctatctcagaa

SEQ ID NO: 6840010 - DNA, 78 bp, Homo sapiens
gcaaaaattttgccaaattgaattacataattcatctagcagatttgatgagttcctggatgcaatttgcaaatttgc

SEQ ID NO: 6840011 - DNA, 55 bp, Homo sapiens
cagacttcctgaaagctggtttttggtccctgggaagccagcccacagtggtttg

SEQ ID NO: 6840012 - DNA, 81 bp, Homo sapiens
tgacattttggctaaaggcatgcctccatttctatgtacataataatatttaaggaatgtgtgtgccaatgcaaagatgca

SEQ ID NO: 6840013 - DNA, 99 bp, Homo sapiens
ctggtggtggaaatctggtggtagatgggaagaagataatgtgctgaagttctcttatcactgcttcagttttcccagtgaaataaaaaaaatcatcag

SEQ ID NO: 6840014 - DNA, 56 bp, Homo sapiens
ccagtgcagtccccctgaactggcacaaattgggccctggcttcagggtgcactgg

SEQ ID NO: 6840015 - DNA, 66 bp, Homo sapiens
cctgtggcccagtggttacaacagaatgattaacagtcaattctttgcatctctgggtggctcagg

SEQ ID NO: 6840016 - DNA, 70 bp, Homo sapiens
attcttaaggctctctgatggcagcagttgaggtctctctgagcctgcagcctcagagaattttgaaagt

SEQ ID NO: 6840017 - DNA, 60 bp, Homo sapiens
ctgccatccacggcccactcatcacatacatccagctgggctgggctttacagagggcgg

SEQ ID NO: 6840018 - DNA, 67 bp, Homo sapiens
gtgcaccaggcacagttccaagcattttatatatattctatagacttacatattgtccctggggcat

SEQ ID NO: 6840019 - DNA, 96 bp, Homo sapiens
acagatttttgtgaccagacttcatagcacaatattacctttatgctagtgttgtactataatggtaacattgtgctacgtggtataatagtctgt

SEQ ID NO: 6840020 - DNA, 70 bp, Homo sapiens
cttagagcctacccagcacctaggctgcctttactatctctgcaggtcagacacagtgctgggtgctgag

SEQ ID NO: 6840021 - DNA, 57 bp, Homo sapiens
tgcattttggtcattctatagcatttagtcttactgtagaatcactaataagatgta

SEQ ID NO: 6840022 - DNA, 71 bp, Homo sapiens
tgcaggcaatttccatcatcctaacgagaaagcagtccaagagtgttttctgccggtggtgggctcctgca

SEQ ID NO: 6840023 - DNA, 61 bp, Homo sapiens
cactgaatgcaggtaagtgactcacatgctttgaaaagttccttgactcaccctgtcagtg

SEQ ID NO: 6840024 - DNA, 61 bp, Homo sapiens
aggctcagcagcttatcttggagaggcaattagattgcccttgagaaagatgcttcagctt

SEQ ID NO: 6840025 - DNA, 57 bp, Homo sapiens
ctgtctggagttatgtaaatagctcatagtgccagctgtcctaccttcctccagcag

SEQ ID NO: 6840026 - DNA, 105 bp, Homo sapiens
atgtcttttagtcctatctgaaaaatgtcattatggaactgaggtcacaccccaccctgcagtttcatcatgcatttccttttatcttagataattctatgacat

SEQ ID NO: 6840027 - DNA, 83 bp, Homo sapiens
agtttgagctaggcagaggctatggaaatggcaggacatccagcagagatgacctgcagccatagtgctgtcagaggcatgct

SEQ ID NO: 6840028 - DNA, 63 bp, Homo sapiens
gggtggatcatgtgatgtcaggagttcaagaccagcctggccaacatggtgaaactcccacct

SEQ ID NO: 6840029 - DNA, 72 bp, Homo sapiens
aaacaatattcagaaatgaatattggtattcataacacaagtgaatgccaatattcatttgtgttagtgttt

SEQ ID NO: 6840030 - DNA, 60 bp, Homo sapiens
tgagtgttcacatgtacatgaatattcattattgagtgttcacatgtacatgaatattca

SEQ ID NO: 6840031 - DNA, 55 bp, Homo sapiens
gctgtccgcacgtctccggtggcattttctgtatcttcgtggggaggtgggcagc

SEQ ID NO: 6840032 - DNA, 71 bp, Homo sapiens
gatgagtatttcccacaaatgacagaatgttggacttaaaaggttctgtggcagtttgggaggtgacagtt

SEQ ID NO: 6840033 - DNA, 70 bp, Homo sapiens
agcaagggtgagagacagaatttgagctcaatttattgaatgccaaagtgctgctctttaccactgtgct

SEQ ID NO: 6840034 - DNA, 59 bp, Homo sapiens
tatttctaagctgtaagtctgaagtcgggaagaatggcgggctaacagttgtggaggta

SEQ ID NO: 6840035 - DNA, 96 bp, Homo sapiens
gggcactaccaaagtgagtctctagtctggtcctggcttctcagggcaagaaatgatttgttagggcacctggaggtgtttggcttaggactgcct

SEQ ID NO: 6840036 - DNA, 58 bp, Homo sapiens
ggatgctcagtcttgtctcctgaagtcaaggtatcttctaggctctgattgggcttcc

SEQ ID NO: 6840037 - DNA, 130 bp, Homo sapiens
gtgctatcagaagaggggtgagggccaggctcccagggcctcgaggtcccgggtggggactccaggtttccttctagaaaggccggcccacccgtccttccccaggacactggcccgctcctccttgtgc

SEQ ID NO: 6840038 - DNA, 110 bp, Homo sapiens
agccccctggggagagaaaaacaactcttctctgcagcctttgaaggaaggagagccttcttttagtagcccttggaggaaggttggcctctttctttgcctgtagggtt

SEQ ID NO: 6840039 - DNA, 85 bp, Homo sapiens
caagctttttgtgattcgtgttgcctttttctctcttaaaaccctctctcctggtttttaaggcaactgggtccaagataaattg

SEQ ID NO: 6840040 - DNA, 56 bp, Homo sapiens
tttgtgggggagaaatgtgacatttagaacaaatgtcatagcatttcttcaataaa

SEQ ID NO: 6840041 - DNA, 81 bp, Homo sapiens
cttctagtcactgtaataatctgcttattttcgtctgctagagcaatgacatcacttagcggaatgtgctgcagacagaag

SEQ ID NO: 6840042 - DNA, 67 bp, Homo sapiens
caggttggttgctgtcacgtgcctctgaggtcaaatactgctatcaggagttgacagttgctatttg

SEQ ID NO: 6840043 - DNA, 61 bp, Homo sapiens
ctgtaaatatattagtttgaacaagtgagacttcactaaatataatgcaatgtatttgcag

SEQ ID NO: 6840044 - DNA, 62 bp, Homo sapiens
ttcagaaatcgagtttcatgtcctcactaataacattttgatgacagaaaagtatttctgaa

SEQ ID NO: 6840045 - DNA, 106 bp, Homo sapiens
aagtttttgcatgccttcatttcccttggttaaatatgtaggagtagaatagctactcttgggtaggtacctagaataggtttatatgaaagagtatgtttgactt

SEQ ID NO: 6840046 - DNA, 66 bp, Homo sapiens
gggcagaggtaccaggaatggggtcaccgtctaacacaggcaaaggtaagctccctggataagtcc

SEQ ID NO: 6840047 - DNA, 66 bp, Homo sapiens
gtgtgtcagaatttttgtggcaattgaaatgtcacaatttttcttggaacaacattctggcatcat

SEQ ID NO: 6840048 - DNA, 65 bp, Homo sapiens
cacagggaaaagagaagttggaaaaagcaacatgatttttaatttttctaactactctccctttg

SEQ ID NO: 6840049 - DNA, 72 bp, Homo sapiens
gggatggaacactcgtcaaatagcgggttttctggaggcaggtcccgtggtggggagtggcttccttgtccc

SEQ ID NO: 6840050 - DNA, 62 bp, Homo sapiens
gagccaagaagggccatgtggattggctgctttgggcaattcactgaacttctctgagactc

SEQ ID NO: 6840051 - DNA, 72 bp, Homo sapiens
cacgatggtaaacaacacaaatcatttgacccgtatgagtttttgcctcaggtgtatgtgtgtgtgcctgtg

SEQ ID NO: 6840052 - DNA, 59 bp, Homo sapiens
ggaggggtggtcacctggcagggcggtggtgaggccggcccgtgcctgcccttccctcc

SEQ ID NO: 6840053 - DNA, 85 bp, Homo sapiens
tcaacttcagcctcatttgttggcctagagtggttgcttgatagcgtttcacatctatacccaataatttgaaggcaggagatga

SEQ ID NO: 6840054 - DNA, 130 bp, Homo sapiens
atacatatatatatatatatatatatatatatatatatatatgtgtgtgtgtgtgagtatatatatatatgcacagacatacacatatatgaatttatgtgtttgtatacatatatatatatatatatat

SEQ ID NO: 6840055 - DNA, 67 bp, Homo sapiens
tagacaatgccatcttgtggttcttgtgaaaatcattccttggaaaattcaagaaggtcattgttta

SEQ ID NO: 6840056 - DNA, 55 bp, Homo sapiens
tctgaaatggcgatggccgttgtgggagcgtggatgggcctttgccttttacaga

SEQ ID NO: 6840057 - DNA, 79 bp, Homo sapiens
tgtgtcacagtgtctgtgctttgcagcaaattgcttgacttgagttttttccttctaagaagcaaagatattggaaaca

SEQ ID NO: 6840058 - DNA, 59 bp, Homo sapiens
gcctctggattcacctttagtacctttattaggtactggatgagctgggtccatcaggc

SEQ ID NO: 6840059 - DNA, 78 bp, Homo sapiens
ctcaggaggagtctttttagggcctgagggaaattattctctgttcaggtttctttgagagacttccttatcctggag

SEQ ID NO: 6840060 - DNA, 65 bp, Homo sapiens
gagagttagtttggctgcagaatcggtaatattagcctcgtgcgttctgggccatgctgcttctc

SEQ ID NO: 6840061 - DNA, 66 bp, Homo sapiens
gctgccacctagtggtctttagtcgcttcgcatgtctatggtgtctaggctacgaagggggcaagt

SEQ ID NO: 6840062 - DNA, 61 bp, Homo sapiens
tgtgatgacagtgccagtctgttctgagcagctctgggctcctggcttcactgacatcata

SEQ ID NO: 6840063 - DNA, 73 bp, Homo sapiens
gatcactacaaaatctgcacatgaagatctttatctatcacagcaaaagtgtgcagagcttgtaacagtggtt

SEQ ID NO: 6840064 - DNA, 70 bp, Homo sapiens
agagggagaagaaagcctcttgtgttgagattaatgtatgctataagagtcttgttttcttatttccttt

SEQ ID NO: 6840065 - DNA, 62 bp, Homo sapiens
tccttgattttgtctctggccctgtaccatttcttctggtttgaggcccagcagagtcggga

SEQ ID NO: 6840066 - DNA, 70 bp, Homo sapiens
ctctggttcaatttagaaagcacagttcgttgcaattatggccaagctgtatgtattctgggagacaggg

SEQ ID NO: 6840067 - DNA, 55 bp, Homo sapiens
gctagtgagctctttgtcatctgactgtaagtttggcaaatatgctttcattagc

SEQ ID NO: 6840068 - DNA, 130 bp, Homo sapiens
taacactgagctaagcctgatgagagatgaataaaattttattttagatagaccaatatagtcattttaaaactaatgacaggttgaagtatcaaaggtggattttatcagatatcttcactacagatta

SEQ ID NO: 6840069 - DNA, 94 bp, Homo sapiens
ccgggcacgcgggggtcggggccgcccctcgtccgccgctgccgctcggtggccgggccgggcgcctccacccccctcgcagtcatgtgcctgg

SEQ ID NO: 6840070 - DNA, 64 bp, Homo sapiens
gctaaggtttctggacagcaagatcagttaataaagtggcagagtgagcttccagaagttttgc

SEQ ID NO: 6840071 - DNA, 91 bp, Homo sapiens
gcattcacctaaggctctgaagcaaccctttgaagatgagagcccatctcaagcagggcaacttagaaaacttccttgggattttgtgtgc

SEQ ID NO: 6840072 - DNA, 84 bp, Homo sapiens
ggtgattaatatatttcaggattagtttaagcagggctctacctcctgcccagtcaagtatgttctggttaatatccaattatc

SEQ ID NO: 6840073 - DNA, 72 bp, Homo sapiens
agttaggagaaggtatctctgatctccgagatacaatgcatggatcgcgatcttgaaatatcttttcctact

SEQ ID NO: 6840074 - DNA, 75 bp, Homo sapiens
ccagaaaggcaatgaatactgtttttgttaataactagctggtgacagaaagctctttcaatcttgccttcctgg

SEQ ID NO: 6840075 - DNA, 61 bp, Homo sapiens
cagggccagcccgacgtggtgcctcgctctgaagtgcacctgttgcctacgctggttgctg

SEQ ID NO: 6840076 - DNA, 64 bp, Homo sapiens
gcagaagaaaaggaaaagagcgacagtttgtaagtctattagctgagattgtttccatttctgc

SEQ ID NO: 6840077 - DNA, 59 bp, Homo sapiens
agctgcccaaggtcacagagctagcaaagtacagagctagattcacacccaggccagct

SEQ ID NO: 6840078 - DNA, 71 bp, Homo sapiens
tgaagtgagtagtgtctaggggccccaaattcaaatgaaataaggattccaacataggcactctcttttca

SEQ ID NO: 6840079 - DNA, 82 bp, Homo sapiens
gatgtctatgcagttttacaatttaaagtagtcatttaatcaaacataactttcatttgtgaagactgtattccagaacatt

SEQ ID NO: 6840080 - DNA, 73 bp, Homo sapiens
ttgaagtgggggaacgagagttctggaaggcttactcaaagttctcatttggacactctttccttcaattcaa

SEQ ID NO: 6840081 - DNA, 80 bp, Homo sapiens
tgggacccctaaaaagtggagggtgattgccggctgtcgtgcacacggcttctcaattctcaccctccaaggaaagcccg

SEQ ID NO: 6840082 - DNA, 65 bp, Homo sapiens
gcctttacagcaaacccagaggccaagtaaaaatgaatggttataatatggttttgtttaaaggc

SEQ ID NO: 6840083 - DNA, 102 bp, Homo sapiens
tcttagctttttatttcctctctaatagggtaaatatctgtgtcttttgcctgtctcatccctttaagactagctgccctaaagtgggaaatgtgagtaaga

SEQ ID NO: 6840084 - DNA, 86 bp, Homo sapiens
gtgaaaaggttagagtagtgggagatgttacatgtctctgagagtcagaggcccagttatcctacttgttccccgatcttttgcac

SEQ ID NO: 6840085 - DNA, 73 bp, Homo sapiens
cagaaatccaggtccatgtggggtattgcacagtgttaatcttgcccctgagatatggattagggagattctg

SEQ ID NO: 6840086 - DNA, 63 bp, Homo sapiens
tttctacagtgatttggacaagttcaatgaggaattgaaaatattccttgtgactgtgtgaaa

SEQ ID NO: 6840087 - DNA, 67 bp, Homo sapiens
ggaactgcagggagaggggacagcctggtttgcaaggccccatttgggctagcctcttccctgctcc

SEQ ID NO: 6840088 - DNA, 57 bp, Homo sapiens
tttagaggaggaagaaattttggcaattctctaagccagctgccttcattttctaga

SEQ ID NO: 6840089 - DNA, 56 bp, Homo sapiens
ctgaggggataaaggtttgggttaaagataaatatgaccttgcctctaccctacag

SEQ ID NO: 6840090 - DNA, 66 bp, Homo sapiens
ggaggaggaagtgagtcagtgggcacagcgattcatgccttagaattctgactttctttttcaacc

SEQ ID NO: 6840091 - DNA, 88 bp, Homo sapiens
gcatggatgagcacatggcaggggcagcaggtaaagaaagaccacctggaaccctgtgcctgctgccactgctgttactgatccaagt

SEQ ID NO: 6840092 - DNA, 64 bp, Homo sapiens
gggtacttctgaaagtgcagctgtgacacagctttcccagctcacattctcatcagatgtgtcc

SEQ ID NO: 6840093 - DNA, 71 bp, Homo sapiens
aacctacattaacaggcaaataatgtggctaacattttaatatcacagagcaaattgactgttaatgggtt

SEQ ID NO: 6840094 - DNA, 60 bp, Homo sapiens
ctcttgacctcgtgatccgcccaccttggcctcccgaagtgctaggattacaggtgtgag

SEQ ID NO: 6840095 - DNA, 130 bp, Homo sapiens
gtgggggctcactgggggcccagcttctccaccctgtcaccatcctggcctcactttcctttctcctgggacttcggttcttggtcaagtgaggctggacaggcccagctgtggcccctggctgagctgc

SEQ ID NO: 6840096 - DNA, 63 bp, Homo sapiens
tgagtggcggggcttgttggagccgatgcatggcctggctcccaaggagctcctgcctgctca

SEQ ID NO: 6840097 - DNA, 116 bp, Homo sapiens
tagtggttaaaagcatggattctaaagttagactgtgttcaaattctccaacctaccatctatgtgactttggacaaatgtctgactttcttttgacctcagttttctcaccacta

SEQ ID NO: 6840098 - DNA, 62 bp, Homo sapiens
ctgccttcatctctgagctgggtgaggcagactggtctgagcccctttgggactgagggcag

SEQ ID NO: 6840099 - DNA, 68 bp, Homo sapiens
tgatcccaggtgcacaagagagatgatgactcagtctgacaacatttccatttccttggtaaggatca

SEQ ID NO: 6840100 - DNA, 73 bp, Homo sapiens
gctttcattaaatgagtaagtgtttcagagctttagcaattattatagtggtgagctgcatttatgtggaagt

SEQ ID NO: 6840101 - DNA, 59 bp, Homo sapiens
ctgattcagtaggtgtgaacttattcaggacacctgagagtttgtttctaatgagtgag

SEQ ID NO: 6840102 - DNA, 69 bp, Homo sapiens
tcaagcagggtagcaagctggtgctggatactgtacacgccctacccaaattcccttctccctgtttga

SEQ ID NO: 6840103 - DNA, 58 bp, Homo sapiens
gagcatggtactcacactgatctctatccactttgacatcctggagtattccatgctt

SEQ ID NO: 6840104 - DNA, 59 bp, Homo sapiens
atcaatatttttgtgtgtactttccaggaaaagaagaaagtatacttaaaagagttgat

SEQ ID NO: 6840105 - DNA, 58 bp, Homo sapiens
tttagttttgttttgacacagatgagtctggagagtcatgagtggctgcggggctgag

SEQ ID NO: 6840106 - DNA, 88 bp, Homo sapiens
cccatccaaacagaaactgctcaaggatctggtagggctcgtaccgatgttctctacttcaacctgtgagcatcaattttgtgatggg

SEQ ID NO: 6840107 - DNA, 105 bp, Homo sapiens
gctttttgatgtgttgctaattcagtttgccagtattttattgatgatttttgcattgatgttcatcagggatattggcctgaaattattttgtcattgttgtgt

SEQ ID NO: 6840108 - DNA, 76 bp, Homo sapiens
gaaggagggccagcggcacagcctggccctggaccgagcacaccggggccgtcaatggactcgctggaggtccttc

SEQ ID NO: 6840109 - DNA, 62 bp, Homo sapiens
gtctttgtttctactctggggctgtggattccaacaaggtccctggaggaagaaacaatggc

SEQ ID NO: 6840110 - DNA, 75 bp, Homo sapiens
gtccgccccgcccgctctagctctgagagccactcgcccagtgcttccagcaccagcagaggggagtggcaggat

SEQ ID NO: 6840111 - DNA, 64 bp, Homo sapiens
tcccatctctggccctgttttctatctgtggaaagcagatgcatgagttgggctaggtcaggga

SEQ ID NO: 6840112 - DNA, 64 bp, Homo sapiens
cagtatctgttaggatcagagctgggtcatgggatgtgcacccactctggtgttgtagatgctg

SEQ ID NO: 6840113 - DNA, 94 bp, Homo sapiens
ggagaagagaaggcagacaggctggagacctcagagaacccaaagaagggcatggcagtgagttccctgggtctcctttcttcttcttttctct

SEQ ID NO: 6840114 - DNA, 63 bp, Homo sapiens
tgtcttcaagccgggtgcctggagtcttaccccttcactctggtaacctggaattgatagaca

SEQ ID NO: 6840115 - DNA, 57 bp, Homo sapiens
ctgaccttgtgatctgcccaccttggcctcccaaagtgctgagattacaagcgtgag

SEQ ID NO: 6840116 - DNA, 63 bp, Homo sapiens
gctacatccttcaaaaggaatagcaggtggtgtcccccagcctggctgacctgaaggtgtagt

SEQ ID NO: 6840117 - DNA, 59 bp, Homo sapiens
ttacaggcatgaatgaaatctgttttattagatgaacaggggattatttatacctgtaa

SEQ ID NO: 6840118 - DNA, 66 bp, Homo sapiens
gatccacgtgtagtgacttggtttgggaaaaaagaatccacagggagaggaacagcgcagagggtt

SEQ ID NO: 6840119 - DNA, 62 bp, Homo sapiens
tagatgtaagaggtttcttacaagagtagaaagaattttgctaaggaaaatgtttgcatttg

SEQ ID NO: 6840120 - DNA, 71 bp, Homo sapiens
tttctttccccatgaacattgcagggatgtgactcggtgtcacttaggtgatgtgcatgacatgagggaaa

SEQ ID NO: 6840121 - DNA, 61 bp, Homo sapiens
ggctgtacctgcctctcctctacactggaggaacccagcacagagaggcctggtgacagcc

SEQ ID NO: 6840122 - DNA, 100 bp, Homo sapiens
ttaaaggaattggcactacctatgatatgtgttagatacattcattcactttcttatacaagaagtgtatactaggagcatatattaccaggcactttgg

SEQ ID NO: 6840123 - DNA, 84 bp, Homo sapiens
aagcatcaaatatgtacagtgctcccatttgcacagcttttatagaaaaatgagtaaatatcagtattgtgcttatttgagttt

SEQ ID NO: 6840124 - DNA, 60 bp, Homo sapiens
ccaatatcaccaagacctgtaattctttatcataggatgttgtaggtctcatggtacagg

SEQ ID NO: 6840125 - DNA, 79 bp, Homo sapiens
tgccttttctacaagcaaatgtgctcataaacaacatttggtattgatttgcacattttcaaagttagtataaatggta

SEQ ID NO: 6840126 - DNA, 69 bp, Homo sapiens
cccgagagagttctgagctttccaaatatggatgctttttgcattcccaaagcatcacgaacatttggg

SEQ ID NO: 6840127 - DNA, 65 bp, Homo sapiens
tcctacagatactaaggagatcttataaatggttgtttgcttggcccttggtttttgttgcagga

SEQ ID NO: 6840128 - DNA, 85 bp, Homo sapiens
taagttaaaacatgtaattctgcttaagatcaggtctcaaatagctaagaccaagttctggagttagttataatggtttatctta

SEQ ID NO: 6840129 - DNA, 61 bp, Homo sapiens
gtacaaggcatttatctgttcaacaaagggttctgattcctcatatagaaagtgttttggc

SEQ ID NO: 6840130 - DNA, 98 bp, Homo sapiens
aaatattatactgcagtcactgcagactctctttgatgtataaataatcaagttaaattatgtgcagcaaggagactagtgctctgccattcttattt

SEQ ID NO: 6840131 - DNA, 61 bp, Homo sapiens
tcttccttttctgaggcactgtagcttttactctatcttgctgagcttattgaaaggaaga

SEQ ID NO: 6840132 - DNA, 99 bp, Homo sapiens
attttcagatatgtttcaatgtctatgtacattttattgtgttgtctctaagaaagttagcagttgaaatgtagattaggcattctcatttctgaagat

SEQ ID NO: 6840133 - DNA, 123 bp, Homo sapiens
ttgaaagaacggttggtgtctgtgtgattttccttgagtctgttcttcagtgtgtcttctgcagcttgccatgactgcctgggaaagagtagggaaatacccagagccaaaacctcctttcag

SEQ ID NO: 6840134 - DNA, 59 bp, Homo sapiens
gctgtttctaagctggttcctaacctcaagactaagggaatgactcagctggaatcagt

SEQ ID NO: 6840135 - DNA, 76 bp, Homo sapiens
ggggcagagcccctgggagtagctgctgcctgggatggaagaaggggagcagtcagggccccgggggccctgtgcc

SEQ ID NO: 6840136 - DNA, 64 bp, Homo sapiens
agatgaaaatacgtgactttaaatgtttgtttataaaaatgtttgaagggattaatttttatct

SEQ ID NO: 6840137 - DNA, 129 bp, Homo sapiens
ctccttcccaagagagagaaagcaacgccatcgcttgctgtcctcaggcctgcaggcttcctggaaaacatccttctaaagtcatgtccctgaagtggtggaagatattgagcctatctctcggggctg

SEQ ID NO: 6840138 - DNA, 77 bp, Homo sapiens
ggaagttttgtctcagaactttatggtaacagaacaactgacaatcataccatgtgtttagatgtggcagaagatcc

SEQ ID NO: 6840139 - DNA, 68 bp, Homo sapiens
ctcgccatcatgccccgctacagtgcaggagcgcagctgctgccaggcttagagcaggggctggtgag

SEQ ID NO: 6840140 - DNA, 89 bp, Homo sapiens
caccaaactcttacttagcattcagcagtcactcaaaaacttcaattccaaattttgcatgtgggcctgttggggttgagttagtggtg

SEQ ID NO: 6840141 - DNA, 98 bp, Homo sapiens
gtccattcacctgttgatggacatttaggtagcttccagtttttggccattagaaataaagctactataagtgttcagatacaaatctttgtatggac

SEQ ID NO: 6840142 - DNA, 59 bp, Homo sapiens
ctgattggcccagtttagtgttggattgagtcttggtccaattcaattgggtcaggaag

SEQ ID NO: 6840143 - DNA, 72 bp, Homo sapiens
gttagcttttcatcctgtctcactttttgcttcttccttgaagtcttggttttgacagggaaagggagcaac

SEQ ID NO: 6840144 - DNA, 55 bp, Homo sapiens
gggagaagggatatgccactctcgggttcccagttggctagcatccccttctttc

SEQ ID NO: 6840145 - DNA, 108 bp, Homo sapiens
cttttaacagcaatgagagattaatgacttatatttaaagcacgatataattttcttgcaatgaatatggtacattaagatgttagcctctcattctgcttgtgaaag

SEQ ID NO: 6840146 - DNA, 63 bp, Homo sapiens
ctgtagctacacatctaaacagcaactcgttagggtttaaggtaacacagatgtgtgcagcag

SEQ ID NO: 6840147 - DNA, 56 bp, Homo sapiens
gctctccctgaatctcgaactagcctgagaccactgcaggcagatatagagagagc

SEQ ID NO: 6840148 - DNA, 85 bp, Homo sapiens
cttctaattggtgctcttagtgatcttgaattacactttctaaacaaaatgaagattatggtgattaaggatattgaaaaagaag

SEQ ID NO: 6840149 - DNA, 81 bp, Homo sapiens
aggaaggaggccaggccctcaagcctgaggttggaaggaaggggcagcgttgagtagggtgagggtctggccttgagttct

SEQ ID NO: 6840150 - DNA, 69 bp, Homo sapiens
ttgagccagattcagtgctgggagtccagtgtgatctgcctggatcttgctgcattgagaacaggccag

SEQ ID NO: 6840151 - DNA, 60 bp, Homo sapiens
gtaattgggagctaataccagatacactttgtgtctactcctgtgctagctcccatttat

SEQ ID NO: 6840152 - DNA, 57 bp, Homo sapiens
aacaagaagagagggacgtaatcccactgcttggaatgcgatcctcaatcctctgtt

SEQ ID NO: 6840153 - DNA, 63 bp, Homo sapiens
tcttaaagttcttggtaactgcaaagccctacattggtacaggtattattaagaggttggaga

SEQ ID NO: 6840154 - DNA, 64 bp, Homo sapiens
ctggtattgaggagtcaggggcacggaatagaagacatttccggtcacatgacatctcggctgg

SEQ ID NO: 6840155 - DNA, 68 bp, Homo sapiens
gtttcacttgacatatagcataaggataagagctccattttgaatttagattgtatgttgagttagat

SEQ ID NO: 6840156 - DNA, 125 bp, Homo sapiens
acccaacaccagggcagctagaagtttataaatgaagactctatggttcctttgtttgaaaatatgtaagttgttgttggaataaagcagctttagttctttattggaaatattctgtgttgggt

SEQ ID NO: 6840157 - DNA, 58 bp, Homo sapiens
cctggattcatgccaggccaccctccacaatttgctgagggaggccccagagtccagg

SEQ ID NO: 6840158 - DNA, 68 bp, Homo sapiens
taaaaacatgcagtcaataaacatgtgtgataaactttaataatacagataatgattgtatgtgagta

SEQ ID NO: 6840159 - DNA, 59 bp, Homo sapiens
tggggcttgaaaattcataggtatttgcatccagatgcctagagaagcttcaactccca

SEQ ID NO: 6840160 - DNA, 77 bp, Homo sapiens
tacctggaaagaggttgtacctaaagtgttctctgtattggcggaaaatgtttcccgggcaacctcttttcattgtg

SEQ ID NO: 6840161 - DNA, 91 bp, Homo sapiens
tgtgtggtcagggtgaggctggctctatctccaaggctgggcacacggtccaggcttggccaattggagttttccatcttcttggctgcca

SEQ ID NO: 6840162 - DNA, 55 bp, Homo sapiens
ggctgattctggggtagagcaggtcttcaaacccttgtacacccacagatcagcc

SEQ ID NO: 6840163 - DNA, 64 bp, Homo sapiens
cgcctacttccctggctcttctacatcgtcatcttccgacaacgacgagggcagcggaggggcg

SEQ ID NO: 6840164 - DNA, 99 bp, Homo sapiens
gcttggttctgtttattgtcgcatcagcccttcagaatgctgtcagcaagactgctcacatttaaaggttgaagctgaagtactcattttacccatagc

SEQ ID NO: 6840165 - DNA, 129 bp, Homo sapiens
cagtggcttctcccaggtctctgagggtgtttggagctcataccctcttctctttaacaagcgtgacagttaaaagagtaagggctggtatggacaaaagcaggaaggtgcctggggtagtagtcattg

SEQ ID NO: 6840166 - DNA, 93 bp, Homo sapiens
gggtgcattcaatatccactctgcacttgacatgctctcagagtctagaccatggctagctttgagaatttcaagttgcattgaaatgtgccc

SEQ ID NO: 6840167 - DNA, 102 bp, Homo sapiens
gcgcacgcgccccggggcccgtcgggccttatttcacggccccgccttcctcctccgcgagcgccaaataagtgtccggccctcccagccccgtgcgtgcgc

SEQ ID NO: 6840168 - DNA, 62 bp, Homo sapiens
tgccacccagccaggagtgggacccgtgctctgaaatggtcatccctgttggctgaggggcg

SEQ ID NO: 6840169 - DNA, 74 bp, Homo sapiens
ggcactgctgtgaggggaactgatgcccattgtctccacctgagggccctgcccatctctcctcacattctgct

SEQ ID NO: 6840170 - DNA, 129 bp, Homo sapiens
acccacaatttatgcataagtgcatgccttcacaaccacatttctgtgagtcaatattgcaggggccttggacagtcttactcaagaaatagttattttgtaaaatgcaaattgtaaaagtctgtgtgt

SEQ ID NO: 6840171 - DNA, 68 bp, Homo sapiens
ccttggcggggctgccacatctccagtccctgcgcggcagggcacagtctgcagccccccagcctagg

SEQ ID NO: 6840172 - DNA, 66 bp, Homo sapiens
ttccgctctgacctgccatgtccagtgcacaccattcctgctacacagccagaagtcagggtggga

SEQ ID NO: 6840173 - DNA, 74 bp, Homo sapiens
tggttgctttaggatttaagtggcaggtgaaaattagtactgctatttgctatgtatatatctttaagcagcta

SEQ ID NO: 6840174 - DNA, 76 bp, Homo sapiens
gctgatgagtggagtgcagagagaaggatgaagtgtttcttgaatactgtacgctcctggcatttcacatagaagt

SEQ ID NO: 6840175 - DNA, 59 bp, Homo sapiens
acatgcagtttctctatgcgtaggttttcaatttttcctagggctagacagacgcatgt

SEQ ID NO: 6840176 - DNA, 98 bp, Homo sapiens
ccagtgagcaagtcagagagacaggtccagaacacaggtgtcctagctaccaggtcagttgcactttctagatactgtgctgtcttccttctttatgg

SEQ ID NO: 6840177 - DNA, 64 bp, Homo sapiens
tgcaagaggattgtatcaataagggacttcagatcttgcccctgagaaatatactctttttgta

SEQ ID NO: 6840178 - DNA, 88 bp, Homo sapiens
gaaacctggagacatggggttggcatcctaacattttccttatcctttgtgtgatgttggaaaaattgcctgatgtcttctcagtttc

SEQ ID NO: 6840179 - DNA, 68 bp, Homo sapiens
caagacgatgataccctattcccaaatggatggttcatactccaatttggcatagagtatcattcttg

SEQ ID NO: 6840180 - DNA, 99 bp, Homo sapiens
agtctctgacatcccctcaccaggtctgtacagcctggctctgagaggctctgtctgggtccgggactgtggatgtgtgtggggagtcaggcccaggct

SEQ ID NO: 6840181 - DNA, 81 bp, Homo sapiens
tatgccccaaccattgggtcatgggatcccagcatccagatcctggatcctagactcctatgccccaaccactgggtcatg

SEQ ID NO: 6840182 - DNA, 83 bp, Homo sapiens
tcaatgcatctgaaatatttgttagtgttttaatgacctcagcagtctttaatcaagataagtatactttagaaatgtgttga

SEQ ID NO: 6840183 - DNA, 60 bp, Homo sapiens
gaatctctttgtccctgagtttcagaagcaaatagtgaagctttgggcagaagaggattc

SEQ ID NO: 6840184 - DNA, 61 bp, Homo sapiens
tacatctgtatgtgcacatgtatcatgtactaatagtgcataataattccactacagagta

SEQ ID NO: 6840185 - DNA, 62 bp, Homo sapiens
ttgcttactgggtactatctatgtggcaggcatgcttcctgacacttgacatccagcagcaa

SEQ ID NO: 6840186 - DNA, 61 bp, Homo sapiens
ggcgagggaggggactatgcggaccaagttgtcttcaaagtgcacctgcttcttcttggcc

SEQ ID NO: 6840187 - DNA, 63 bp, Homo sapiens
ttaccttttaggcaagcatctttcttatttccccacctatgaaaaagtatgcctattaggtga

SEQ ID NO: 6840188 - DNA, 57 bp, Homo sapiens
gggctctgcagagaactggctcgccctccaacctcagtccagtgactcacacagccc

SEQ ID NO: 6840189 - DNA, 83 bp, Homo sapiens
aggctggggacccagggaagagccgatgctgcagctcagcgtctgtctgcaggccgagctccttctcggggagttctcagtct

SEQ ID NO: 6840190 - DNA, 81 bp, Homo sapiens
gcctgcttgactttcaggatgttcagtattaatttgcttttccaggtgatgggagaatgctgagggatgagagaggcaggc

SEQ ID NO: 6840191 - DNA, 59 bp, Homo sapiens
cctcatgtggatttagagaagaaaataaattgaattcatttctgcaatgcacgttgagg

SEQ ID NO: 6840192 - DNA, 96 bp, Homo sapiens
aacctctgggccaagaggtgaagttaaaaaccagtctctggctgtttcagagagttactactccacctgcttgtaaaattctgtctctttgaggtt

SEQ ID NO: 6840193 - DNA, 64 bp, Homo sapiens
ctgctgtcaaaggaaatatttgggtgactcagccaagaaagcagtttattggttttggcagcag

SEQ ID NO: 6840194 - DNA, 64 bp, Homo sapiens
gtttaagagcaacatatggtgacatttcctttaaaaaagtgttatcacaatattgcttttagat

SEQ ID NO: 6840195 - DNA, 81 bp, Homo sapiens
ctagaagggctgttcaagactaggaaattttatattccttgaattttgtggagtttcaaaatgctttgacacttttcttag

SEQ ID NO: 6840196 - DNA, 72 bp, Homo sapiens
ttgttttggagatgagctaaaaggacactttatattttcccctatccaacacaagcgttatcttcagaacaa

SEQ ID NO: 6840197 - DNA, 130 bp, Homo sapiens
ctgcggcgtgctggcggccgccttcctccggggctcgaccgccggggtgcgaggagcgtctttgagtccccaagctcgctgctgcgccccgcctggcgccccctcccagcgggcggcctagcgcacgcgg

SEQ ID NO: 6840198 - DNA, 58 bp, Homo sapiens
tggaacaattcttgaagggaatcatcaaggaactgggttcctttcaatttctattcca

SEQ ID NO: 6840199 - DNA, 67 bp, Homo sapiens
ccagttttctcctttctaggtcacatatcaaactgatatgtggttttaagcaaaagagaaaaaatgg

SEQ ID NO: 6840200 - DNA, 70 bp, Homo sapiens
gtgatagatctgaaatatattttgagtgttatttcctttatggtaatgctcaaaatgtttcatctaccat

SEQ ID NO: 6840201 - DNA, 81 bp, Homo sapiens
tactgttacagggagtgttcaaatttctgaccttgtgtaacattgaaatttgaatatttttgctttgtttagatgacagtg

SEQ ID NO: 6840202 - DNA, 101 bp, Homo sapiens
tagaaaataaagtagagctcttgctaaaccatttctagggatcataaagtagaatcttgctaactattcctaaagatcaagggtttaatttgttccttcta

SEQ ID NO: 6840203 - DNA, 73 bp, Homo sapiens
agaggtgagcctaaataattgtgagccataattgcaggacttggccaagaatgataggctcagttactcctct

SEQ ID NO: 6840204 - DNA, 55 bp, Homo sapiens
gtgggtgtgagtgacggcgtcctggtggccggccggcccgtcaccttctacccgc

SEQ ID NO: 6840205 - DNA, 57 bp, Homo sapiens
ggtacagcagccttcagggccactggttcccactatgccctgtagaggctgctgacc

SEQ ID NO: 6840206 - DNA, 70 bp, Homo sapiens
gagactcttaagccagtggccttcctgtgtttgtcaaactaaactttggattgtgattgtgccgagtttc

SEQ ID NO: 6840207 - DNA, 83 bp, Homo sapiens
ggttccttactgtgctatggagaaatttgttacctaagttttacccaccagtaataagtttctccaaagcacagaaaggaatc

SEQ ID NO: 6840208 - DNA, 57 bp, Homo sapiens
gtttcctatggctgctgcaggaaatgacacaaattatccccttatagtcgtggaagc

SEQ ID NO: 6840209 - DNA, 69 bp, Homo sapiens
ggcagattttgatatgggtattcatgacctgggctccaacagcctagttctctattcaaggatcaagcc

SEQ ID NO: 6840210 - DNA, 64 bp, Homo sapiens
tgtaactggaagccagccacacccgttctgtatgttgtgttgtctgtggctgcttccaggtaca

SEQ ID NO: 6840211 - DNA, 58 bp, Homo sapiens
ttctggccatgcccagagtctctgtggcatcactcatggaggaagtggctggccagaa

SEQ ID NO: 6840212 - DNA, 68 bp, Homo sapiens
aaagcagagaggagcacaaagtgaagttaatttggttggcttgctttatctggtttctcattttcttt

SEQ ID NO: 6840213 - DNA, 56 bp, Homo sapiens
tgtgagcctcagcatttgagtcacatcacacccagaccgacagatgcttgctggca

SEQ ID NO: 6840214 - DNA, 85 bp, Homo sapiens
agcagaatctgagtaaggacatggagaaggatcatctggttagcactgattcattctgcagttctcagctcagacgtcacctgct

SEQ ID NO: 6840215 - DNA, 93 bp, Homo sapiens
agttcaggaagagtttagagatatccttgctgtccccagtctcagactaggttgcactgggctccaggaaggaggctacacatttattgagct

SEQ ID NO: 6840216 - DNA, 84 bp, Homo sapiens
tcatagagttccagtcatatattgatgttagaatctactcctgtacctagggtgaaaatcagatatcatcatgattacctatga

SEQ ID NO: 6840217 - DNA, 77 bp, Homo sapiens
gtttctaaaaatatgcctgctgtcttcaattggctgcaaattaccagcagttgaaggcatcgggggtattttatgac

SEQ ID NO: 6840218 - DNA, 79 bp, Homo sapiens
gggggaagataatggaggtggcaaaaggtctcagcagaaatgaaagatctgatctgcccatctacccatccattctccc

SEQ ID NO: 6840219 - DNA, 60 bp, Homo sapiens
gtggaaaaaactgaggcttcggaatccaaaggtttggattagaactctgggtttaatcac

SEQ ID NO: 6840220 - DNA, 71 bp, Homo sapiens
gcaccccaatgaggagtctttccctaagtccttctcagaagtggccatggaaaaccctagacagggggtgt

SEQ ID NO: 6840221 - DNA, 101 bp, Homo sapiens
gctggagaaactagaaaagattagtatcaggcatgtcttctgcactgtaagaacgcttaggcaatagaatatgcctgagggtctggtttaggaatctaagc

SEQ ID NO: 6840222 - DNA, 84 bp, Homo sapiens
agctggactgttatctggctgaggacagaaaaattcccttacactgagatgggaatctaaagcccagtggggaaatagctagct

SEQ ID NO: 6840223 - DNA, 128 bp, Homo sapiens
gtttaaaaatgtcaagtgataggatgtagctaagacttaggttagacctcgcagatctagagttactattttttctactgtgttgtctcaacctgacctctaccaccaaacacaaagcaaaataaaac

SEQ ID NO: 6840224 - DNA, 64 bp, Homo sapiens
gcagagaagtcaacttgaggagtttaatttatatccctactcaacttccaaggcatttctttgc

SEQ ID NO: 6840225 - DNA, 75 bp, Homo sapiens
ttggttgtgcttgtttttgacccaaatgttcactttagcccatggtctgatcttttcaaagacaagcttactcaa

SEQ ID NO: 6840226 - DNA, 70 bp, Homo sapiens
gttgcagagccttcctagcagactctggtttcacagtcccaaggcagcagctgcagggagggtctgcagc

SEQ ID NO: 6840227 - DNA, 73 bp, Homo sapiens
tttcttgtaaggtagacttccaacaaatgttggatgtctaacaaatgttggatttgtcttccaataaaagaaa

SEQ ID NO: 6840228 - DNA, 88 bp, Homo sapiens
gagaaatagaacccttgcttcctggagctggtcttgctgataccctgtaggcctaggattgtcttcacaggaatgtaggggtcttctc

SEQ ID NO: 6840229 - DNA, 85 bp, Homo sapiens
ggtgcaaagagtccctttctgtgtgagtgagcactgctgtgtcttctccaccagagcttaaaactccatggaaagggacttcatc

SEQ ID NO: 6840230 - DNA, 55 bp, Homo sapiens
gtcctgatagcccaacactgcctaaaaacagcagagagcagtaggcgcgcaggac

SEQ ID NO: 6840231 - DNA, 56 bp, Homo sapiens
tggagcctttggccttggtagggtcccctccatcccactgaggaacatgggctcca

SEQ ID NO: 6840232 - DNA, 72 bp, Homo sapiens
aagtcatttgagctctcactttaacctcctaggctattgggctttggaactgtaaggagatggaaatggctt

SEQ ID NO: 6840233 - DNA, 63 bp, Homo sapiens
gtcctgtctgcaggaaattaccaggagatttgagtattttcctgaatcagcctcagatggtac

SEQ ID NO: 6840234 - DNA, 58 bp, Homo sapiens
tgctgctcatcagattttaaaactaggtagaactaaggataaaacgtgcatggcagca

SEQ ID NO: 6840235 - DNA, 72 bp, Homo sapiens
agaaactgagccctgtacctgatggattagaagatgaggactggtcataaggtcaaaagaggctcaagttct

SEQ ID NO: 6840236 - DNA, 71 bp, Homo sapiens
tccaaaattccaacagacaaagttagacaggttaagaaagtctttatttaagtctgttgtaatgggtagga

SEQ ID NO: 6840237 - DNA, 60 bp, Homo sapiens
gggggctcagttgttgtcttacagaaaaaaaccttgtaaaggcaattcagcaagccaccc

SEQ ID NO: 6840238 - DNA, 77 bp, Homo sapiens
tgggtggggtttgtggtgcaggcagtccaggtgggcatcgtcccagatgctctgctggtaccagtggccgtcaccta

SEQ ID NO: 6840239 - DNA, 87 bp, Homo sapiens
tcgccagccgcagctgggccaaggccgagagcatgcaccaccaggtcgagtatgaggtgctgcaggccttggctgggaaggctgaga

SEQ ID NO: 6840240 - DNA, 71 bp, Homo sapiens
gttttgagtgtgtattatgtatcaggaactagttaacgttttagatacattatcatattttacttcgaaac

SEQ ID NO: 6840241 - DNA, 55 bp, Homo sapiens
gagatttaattcccctgctcaggtcagtgtagggcctcagggaagttcaaagctc

SEQ ID NO: 6840242 - DNA, 63 bp, Homo sapiens
tgctgagcccagaacggcctggctctggcagatttgcccccaggctgcaagtgggcggcagca

SEQ ID NO: 6840243 - DNA, 59 bp, Homo sapiens
tcagagaatgaaaatgaaacttgctcactgtagcttcattgaaccactttattctttga

SEQ ID NO: 6840244 - DNA, 127 bp, Homo sapiens
ttctggcttagagaaatgttccaggcatgaaagcaagaagtgagttgagaacctaccccatcatccccttctcacctctcccatttctctgctctttcacttgctctgcatttcactgtacccagga

SEQ ID NO: 6840245 - DNA, 129 bp, Homo sapiens
aattcacaaacaacagatatattgtactttttttttttttagttatagtgaagaaatacttggtcccatttcttttcgcctgggaggtatctttccactattagcaatgcggtgtgtattctttgaatt

SEQ ID NO: 6840246 - DNA, 59 bp, Homo sapiens
gtggcattgacagcttcagtggagtcaagatggtccacaaaggtacagtcaatggtgac

SEQ ID NO: 6840247 - DNA, 98 bp, Homo sapiens
ggtcctggtggacagcaaacttgagccaagggcttgggacaccctctgaccagaccatgacacccagcaaggccagctcagggctatccagcagggcc

SEQ ID NO: 6840248 - DNA, 63 bp, Homo sapiens
cagaggcacagtgcgggccacttccacggcgcctctgccccaccttgggctgcctggcctctg

SEQ ID NO: 6840249 - DNA, 56 bp, Homo sapiens
gtggttacaggggcaagatggtccaatccttgttttatcagactcctagtaaccac

SEQ ID NO: 6840250 - DNA, 71 bp, Homo sapiens
gtcatagcagctacctggctaagagtctcagttcacttgtgggacatttgtatttggtgagtggtgatgac

SEQ ID NO: 6840251 - DNA, 66 bp, Homo sapiens
gtccagaggcctctggagtgctctgcaggtgggcagcctggggctctccacagtgtctcaagggac

SEQ ID NO: 6840252 - DNA, 56 bp, Homo sapiens
gtggcaagtgttccaagaggcgatttattctttctgctgatggacacacttgccat

SEQ ID NO: 6840253 - DNA, 80 bp, Homo sapiens
ctgttcctacctcattgggctgggcaagaatcaatggagagtcatggaaagcactcagcccagtgccaggcaaggagtgg

SEQ ID NO: 6840254 - DNA, 80 bp, Homo sapiens
tagaaaagaaggccaagaggctccaagatcttaagaacctgtgttttatatcaagaagcgtttttgctttcttcatttta

SEQ ID NO: 6840255 - DNA, 94 bp, Homo sapiens
gggtaagagggggctgaacttactctttcataatggtgctaattccacttgtgaggatggagttctacaggcctaataacctcttaaaactccc

SEQ ID NO: 6840256 - DNA, 81 bp, Homo sapiens
ctcagtaagtaaaaagtccgagtctcctcccagagtggtgcatacacagtcaaagggtatttggattgattacttggggag

SEQ ID NO: 6840257 - DNA, 73 bp, Homo sapiens
cagcatcttcatgtgcatctcccaaaccctccatctcagaaattcagggtgctattggtgtgtgatgatgttg

SEQ ID NO: 6840258 - DNA, 77 bp, Homo sapiens
tccactccagctgccctgcctcagactcctcagtttcgcacgtgaggatcgtcttgcaggcactgactggagatgga

SEQ ID NO: 6840259 - DNA, 103 bp, Homo sapiens
tgctataagattaggtgcattgttcagcatggaatctatgtatgccattttattttaaaaaggttatataattcagtgctttccagagttgaatttaatagta

SEQ ID NO: 6840260 - DNA, 81 bp, Homo sapiens
atggtgagcttatgatgtttacataaaagttctataagctgtgtatacagttttttatgtaaaatattaaaagactatgat

SEQ ID NO: 6840261 - DNA, 126 bp, Homo sapiens
atatttaatttctcaatctgttgttgtcttgtaattacatgagtactgtaagcttagggaagctacacctagttttatggttacatatatttaacattataataaaattcaggaagaattcaatgt

SEQ ID NO: 6840262 - DNA, 111 bp, Homo sapiens
ggcggtcacggcactacgactgctctggctgtcttggaggaaggaggccctgaggtggtcctcctgaataagagcagccccagcgtcgacactggtggtgacgtgggtgcc

SEQ ID NO: 6840263 - DNA, 81 bp, Homo sapiens
tggcatgggaggctggaaagagaacctgggggccctgcgggaggaggctgtgccccagcttgtctgattcagcctgtgcca

SEQ ID NO: 6840264 - DNA, 89 bp, Homo sapiens
aggagtgtcactctgtcaccaggctagagtgcagtggcgcgaccttgtctcactgcaacctctgcctcccaggttcaagtgattctcct

SEQ ID NO: 6840265 - DNA, 80 bp, Homo sapiens
ttcctgaatcaccttcattcttttgtgttcacactggcagaacttgctgtttctaccagaagaatcattttgattgggaa

SEQ ID NO: 6840266 - DNA, 104 bp, Homo sapiens
gcacacggctgggctctctggcaggaaggcttcagggaaggacccatgtgaggctttgtctgcccagttagaatgagagggctttgtacaatcagcacgtatgc

SEQ ID NO: 6840267 - DNA, 55 bp, Homo sapiens
ctttataaggcttggccagagggtggggtgccctttgagagtggccttgttcaag

SEQ ID NO: 6840268 - DNA, 59 bp, Homo sapiens
catatctttgtaagttagaggtagatgatggcttactgaactgtctgtgcagagatgtg

SEQ ID NO: 6840269 - DNA, 107 bp, Homo sapiens
tacattaatttttttgtaaggcaatagctttaggatggttctcttggtgtttctatttatctaagccagtaggtagacctgaggtttttcttcaagaaaattatgta

SEQ ID NO: 6840270 - DNA, 93 bp, Homo sapiens
gtggtagtattaggttggtgcaaaagtaatggcagtttttgcaaataatggcaaaaaccacaattacttttgcaccaacctaatagctgccat

SEQ ID NO: 6840271 - DNA, 56 bp, Homo sapiens
gaccaggcttccccagacctcaggccacactcttctgggttgagtcaagcctggtc

SEQ ID NO: 6840272 - DNA, 77 bp, Homo sapiens
aggttattggaagaaaacttcatggccgaagaatgataaagatcgttttcttcactttgcaagttgctcagaaacct

SEQ ID NO: 6840273 - DNA, 80 bp, Homo sapiens
cggacttgggttttcctggcagtcaggtgctttgcacaatttatatggcacagtgacaacccaggataaatttgtctctg

SEQ ID NO: 6840274 - DNA, 55 bp, Homo sapiens
gccaagcttatatgatgcttgaggtccccttctacggtaagcatggaagctaggc

SEQ ID NO: 6840275 - DNA, 76 bp, Homo sapiens
gggtctcctgggaggtccccagagggtctcctgggaagtcagccaagaggccctgggttagggcccactgagaccc

SEQ ID NO: 6840276 - DNA, 55 bp, Homo sapiens
ccacagtttaggaagtcactctaggttatcactgtgtgggttatctattttgtgg

SEQ ID NO: 6840277 - DNA, 83 bp, Homo sapiens
tcttggagcttcaaagctaggaagatctagattcttgtgatctagtatttgtttattccgtttctttaaagttaatgctaaga

SEQ ID NO: 6840278 - DNA, 57 bp, Homo sapiens
agctctgtgccacatgcagtgttatgttaagcatatagcagccatttcacagagact

SEQ ID NO: 6840279 - DNA, 83 bp, Homo sapiens
tctagattccaagacaatatttctggtgcttctcactcaaggaaagaggaggagaatttaaaaatacaggttgggtttctaga

SEQ ID NO: 6840280 - DNA, 58 bp, Homo sapiens
cctcttcctctttatcattgctcaggtgagtggcctgagcagtgctcctgggatgagg

SEQ ID NO: 6840281 - DNA, 73 bp, Homo sapiens
gctccgccccatcagttcctgcccctgcccctcatgcagactgccctgctggggccgggccggagggtggagc

SEQ ID NO: 6840282 - DNA, 92 bp, Homo sapiens
agcatctgtttcagagaagaacagatccatgcatatggatgtgggattactttctttgcagctggatttatcttttcccagtgataggtgtt

SEQ ID NO: 6840283 - DNA, 79 bp, Homo sapiens
tctgggtcttctggcaaatggaggcttgatttaagctattacaataggaaatcatagcccccatccgattgttcccaga

SEQ ID NO: 6840284 - DNA, 62 bp, Homo sapiens
cttatatgcataggtatctatactcaaagcaaattgcagcatgtgatacactgtgcagggag

SEQ ID NO: 6840285 - DNA, 58 bp, Homo sapiens
tgtgagagagtgtgatggagcacagtcatgtcaggctgagtaacatttcctctccaca

SEQ ID NO: 6840286 - DNA, 73 bp, Homo sapiens
ttccatgactagtagattatcacttttgggtttgctcttggaagtgacaagatgctaggatccctctttggaa

SEQ ID NO: 6840287 - DNA, 73 bp, Homo sapiens
catcacagaagagatattgacagaggtttgtgcattacaagcacatctgattctattgatgtcttctgagatg

SEQ ID NO: 6840288 - DNA, 63 bp, Homo sapiens
tctaggtcatttatctccttcctaatgtgcccacatcttataagcaaggcaggttgaccaaga

SEQ ID NO: 6840289 - DNA, 75 bp, Homo sapiens
gagctccgataagcaattcttgtgctccatatggcgactgttgactgggaccacaggaattgctctgtggtgttc

SEQ ID NO: 6840290 - DNA, 93 bp, Homo sapiens
gcatgacttagtgagtttagggtgcaggtgtatactccactttttatataatctgtttaagttcacacttggctctgagtcactactgtctgt

SEQ ID NO: 6840291 - DNA, 60 bp, Homo sapiens
atcatttagttggcttgctgtagtggactcagacaatatatacaagtaatgctgaatgat

SEQ ID NO: 6840292 - DNA, 73 bp, Homo sapiens
gagctaagatttaaggctgtgctgttacgtatttgaattataggataggttacataggctttaaaagtagctt

SEQ ID NO: 6840293 - DNA, 61 bp, Homo sapiens
agctgtgctgcagcttgctctggcaggtgggaaggatgccaggaatgggtgacagtcagct

SEQ ID NO: 6840294 - DNA, 70 bp, Homo sapiens
cctctgcacccacagtgagtgtcatacttggagcaggacatgccctggactcaggctgtgggcacggagg

SEQ ID NO: 6840295 - DNA, 76 bp, Homo sapiens
gttaccagcagagctgggaataaaattcaagctccttggctcccaattcactgttccttctgctttgctgtgtgat

SEQ ID NO: 6840296 - DNA, 59 bp, Homo sapiens
cagagagcaggaggcagcgggacgtggcagggcctctgtcccctccctcttgcctccag

SEQ ID NO: 6840297 - DNA, 67 bp, Homo sapiens
atccacgctcctaataaatgtggtttagctgctgctcttaaaactacactttgggaccagcatggat

SEQ ID NO: 6840298 - DNA, 82 bp, Homo sapiens
tagatttaacatcatattggtagagatgtgtaacttcttacatggattagacatcaagaagccaatgtgtacatataaacta

SEQ ID NO: 6840299 - DNA, 66 bp, Homo sapiens
ggtcaacttcttatggtagcttttccttaaactttcctggtattcctactgcatgagaaggtgtcc

SEQ ID NO: 6840300 - DNA, 77 bp, Homo sapiens
caggtaagactgagttgggtcctcagcttcagggtcttaaggtgtagactgggctgtggacacccagcgtttgactg

SEQ ID NO: 6840301 - DNA, 73 bp, Homo sapiens
ggggagtgcaactttctccagtgccaactattaccagagctgggtaactgttggaagagaaagggccaccccc

SEQ ID NO: 6840302 - DNA, 103 bp, Homo sapiens
ctgtcaatgacctgggcatctgtgatgagggcctggtggctgtgccggctgctcagcagatacgcagggcatgggccctgtctgcaggtgccattcgtgacag

SEQ ID NO: 6840303 - DNA, 90 bp, Homo sapiens
taaagaatttaactgtataaactctttggtctcaggaaaggtagcacgtgtgacacttttctggtacagggaattacagggaattctttg

SEQ ID NO: 6840304 - DNA, 80 bp, Homo sapiens
aatgttccccaggtgattctcatggcccttgtatattgctgctttccaagccatgggcatcgtcctaggtaatgggcatt

SEQ ID NO: 6840305 - DNA, 62 bp, Homo sapiens
gtgttcttacgggaagagataccatagagctcactcgctctccatctgccatgtgaggacac

SEQ ID NO: 6840306 - DNA, 55 bp, Homo sapiens
ctttccttctcgtggttctcaccaaaaaacaggggagagagcacaggcaggaaag

SEQ ID NO: 6840307 - DNA, 82 bp, Homo sapiens
tctcaagtcttttttgtagatgtagtttttatttagatatgagttgaggcagcaaaatatatcataagagggcatcttgggg

SEQ ID NO: 6840308 - DNA, 60 bp, Homo sapiens
tgggcctgattcagtggaatgactttggatgggaattcaaagtctgagcagaatttctca

SEQ ID NO: 6840309 - DNA, 71 bp, Homo sapiens
cctttgatagatgtttgtgttatctccattttttgaaagatagggaaactgaggcataaagttttcagagg

SEQ ID NO: 6840310 - DNA, 56 bp, Homo sapiens
atatacagaagaactatagccacttttctagtgaagtgtccaagtcttctgtttgt

SEQ ID NO: 6840311 - DNA, 57 bp, Homo sapiens
ttcatgtgataaatgtgtgactagtacttacatttctggtcatttgttttgcatgaa

SEQ ID NO: 6840312 - DNA, 82 bp, Homo sapiens
ggctaggcactacaaggactaggctggccccttctggaattctgtccaaaagtcagtctctcctagctctgtggtatcagcc

SEQ ID NO: 6840313 - DNA, 103 bp, Homo sapiens
ggctgaggtgggaggattgcttgagccaaggaatttgaggctgcagtgagctatgatagtgtcactgcacttcaggctttctcttggggtctctcgcgtggct

SEQ ID NO: 6840314 - DNA, 97 bp, Homo sapiens
agaagtaaaattactagccaaaggatgtgtgtatctttaaggtttttttgtacagactgcatattgtcctttagaatgctgtttcagtttacattct

SEQ ID NO: 6840315 - DNA, 57 bp, Homo sapiens
gcttttctttcatatgtgggctaaaagcccaccctttgtccaatagaaatgaaaagc

SEQ ID NO: 6840316 - DNA, 60 bp, Homo sapiens
ggggggctgttctggacaggaagatgaacaaatgccttcctcttctcttcactgcccccc

SEQ ID NO: 6840317 - DNA, 58 bp, Homo sapiens
aggtcagcctactatatatccatgagagaaaatggatgtgtcctctagggctccacct

SEQ ID NO: 6840318 - DNA, 70 bp, Homo sapiens
cccacacccacgcagctcacctccctggtggcgctcagcctgtcaggcaggttggctgcaggtctctggg

SEQ ID NO: 6840319 - DNA, 61 bp, Homo sapiens
attttggtagtgggaggttgaggattttcatatctgattgcttctattactactttgagat

SEQ ID NO: 6840320 - DNA, 76 bp, Homo sapiens
caggtcttgtatggaaggtgtgtgtttaaacaaatttgaatagtatttaaacactggcaatttcatgcacaatttg

SEQ ID NO: 6840321 - DNA, 59 bp, Homo sapiens
gactgtactgaaaagccacaaggaccaggttggctggtttgtttacttttcagtctgtc

SEQ ID NO: 6840322 - DNA, 77 bp, Homo sapiens
gctggatcaggattctgcgatgaggacgagcttatcccagataaggcaggctgccacgtcgagggtccaaggccagc

SEQ ID NO: 6840323 - DNA, 115 bp, Homo sapiens
cagagtgagagttcagattcattgtcttttctttcatgcactttatctttcagccatgtcaagagctggtttgaaatgcaaggtatggtaggaaaaatctgttcagctatctctg

SEQ ID NO: 6840324 - DNA, 74 bp, Homo sapiens
atgactctgctgaggcacccggaatatggcaccaaactcccttgcttacgtgtgctcttcagttttagggtcat

SEQ ID NO: 6840325 - DNA, 61 bp, Homo sapiens
tattctgcttcccgtggcacaagcaggaggcataaccttcctaaccaagggggatagagtg

SEQ ID NO: 6840326 - DNA, 73 bp, Homo sapiens
atctttatatatctcctctgaaacagaggtgtaaaaagtcactgggaagtcatcaggggatatatagatagat

SEQ ID NO: 6840327 - DNA, 100 bp, Homo sapiens
gggttgggagcctccgcctgagatgctctggggagtggagatgggctgatcagagcagggcccagctcttcctgggagctaagccagcggcctccctccc

SEQ ID NO: 6840328 - DNA, 68 bp, Homo sapiens
ctggctggagtataggagtaggaaggcagttacagctgacattttatgtaatccttactgtcggccag

SEQ ID NO: 6840329 - DNA, 56 bp, Homo sapiens
ggagcctgtgcccaagcccagagtcgtctcaggtttcctgggcttaggtgggcttt

SEQ ID NO: 6840330 - DNA, 60 bp, Homo sapiens
gaggcggctgaagtcggagggagtggagcaaagggactccctggccgcaatggccgcctt

SEQ ID NO: 6840331 - DNA, 86 bp, Homo sapiens
tccagttggagccttttccacccttgatgggctgctcatttcttagtggttgagtgtatatgaaggttgtaattattcccactgga

SEQ ID NO: 6840332 - DNA, 71 bp, Homo sapiens
aaaagcattctggattctgttgtactttttccaagttgaatgaagttctcaaggatcacagaaactctttt

SEQ ID NO: 6840333 - DNA, 87 bp, Homo sapiens
taagacaggaaaacatagtggtcaggctttggactctccactcattcttcccaagttcaaatccctgctccactatttcctatcttg

SEQ ID NO: 6840334 - DNA, 107 bp, Homo sapiens
gactttaaaacttgaggaaaatggacgtgtgttttggagtcaaatggacctgtgctcgtatgccagctttgtgacttcggacaagctatttaccttccctgaatgtc

SEQ ID NO: 6840335 - DNA, 73 bp, Homo sapiens
ggctgggagctgggctggcttcctccctcctcgaccacacgcagcagccaagcctcagcccggctcaccagcc

SEQ ID NO: 6840336 - DNA, 81 bp, Homo sapiens
gaaaggtgaaatccttttctgttcccattaagtgttgttaaggccattagcagaaattggaatagagaaatatgacctttc

SEQ ID NO: 6840337 - DNA, 64 bp, Homo sapiens
ccagagcaggggtttcccaggttcccaccaaatcagggaaacgagccatgaggagactccctgg

SEQ ID NO: 6840338 - DNA, 98 bp, Homo sapiens
cagagcctactccctggggttacttgagggcagagcactggggagcctccccgagtggggcccccactcttccctttgccccggatgagtgttctctg

SEQ ID NO: 6840339 - DNA, 60 bp, Homo sapiens
agagcggggatagttaatattccattttatgctgtgttcttttagactaaccccaactct

SEQ ID NO: 6840340 - DNA, 91 bp, Homo sapiens
gcaatggcctggaaggtcccagagcatcagcctggcaggggctgcagacagaagctccaaggctaggagcatgttccaggcctggccttgc

SEQ ID NO: 6840341 - DNA, 105 bp, Homo sapiens
tcgcagggtgccaccgccgtttccaggcactttttctgctagacgctcaagacaagagaagggcatgtgaagggccaggaagccggggcaggggccgccgtgaga

SEQ ID NO: 6840342 - DNA, 78 bp, Homo sapiens
ccatacctcaagaacttaggagcaagccacaatctcctgaaatgtgttttgtggaggttcctgatttttgagatttgg

SEQ ID NO: 6840343 - DNA, 65 bp, Homo sapiens
agcaccctcccaccctctcagacccagagaaatctgtttctagagttgagggggaggaagatgct

SEQ ID NO: 6840344 - DNA, 63 bp, Homo sapiens
gagcctggctggctgcaaggattggataaataataaataccagccccttctgtctccaggatc

SEQ ID NO: 6840345 - DNA, 101 bp, Homo sapiens
ctttactattctattgactttcagttagtacctagtggcatgtaaaaagaatttttaaaaaatagccactgtaccacactgaggcacgatgtggtgtaaag

SEQ ID NO: 6840346 - DNA, 55 bp, Homo sapiens
gcatctctttagaatcagatggtctccagagatcataatgggttatgagaggtgc

SEQ ID NO: 6840347 - DNA, 58 bp, Homo sapiens
taagcttaaataggctatatatattttgttaggaagagtgtttcctgtttatggcttg

SEQ ID NO: 6840348 - DNA, 100 bp, Homo sapiens
tgagatggagtttcactcattgcctaggctggagtgtagtggcctgaacttggctcaccacaacctccgcctcccgggtttaagcgattctcctgcctca

SEQ ID NO: 6840349 - DNA, 57 bp, Homo sapiens
gagggcctctacctcgagggagtggggtgtagatttttcctggaggtgaaggttctc

SEQ ID NO: 6840350 - DNA, 76 bp, Homo sapiens
ggggcgggttttctgcactgtgtcatttggggaacagctgggcacagctgtgtcctgaagacactgccccagcccc

SEQ ID NO: 6840351 - DNA, 74 bp, Homo sapiens
gctctttggttttcagctgtttgcatccaaatgaagacacatttggcaacattaattgaatccttataaagggc

SEQ ID NO: 6840352 - DNA, 69 bp, Homo sapiens
tggtctaagaagtagatttacagtgaagctaatgaaactttagctttatggtgcctcacttgaaggcca

SEQ ID NO: 6840353 - DNA, 57 bp, Homo sapiens
actggaggtggatcttcatgaccttaacagtaggaggtcatggaatctcactctagt

SEQ ID NO: 6840354 - DNA, 60 bp, Homo sapiens
gacacagtgtaattcatggctgaaaaacagatttgtttttctgttattattacctgtatc

SEQ ID NO: 6840355 - DNA, 57 bp, Homo sapiens
tctgttttgtgctttgttttcttttgcttctttgtgcctgacaaaagtacagacaga

SEQ ID NO: 6840356 - DNA, 70 bp, Homo sapiens
tgttaattaagatctcattgccttggggtgagtacattgctgcaagaataaaattgaggtcttattagca

SEQ ID NO: 6840357 - DNA, 57 bp, Homo sapiens
caagattatagctctgctccagcaaacttctggagttaaaaatgggttgtcattttg

SEQ ID NO: 6840358 - DNA, 57 bp, Homo sapiens
gatgaggtggttcaagagccttgtcataatgaaaggcaattcagggccaccgtcatt

SEQ ID NO: 6840359 - DNA, 72 bp, Homo sapiens
ctctggattttcccatccttgtgctacaacctgaaaactctgtctaggcagtaagatggggtaatcgtaggg

SEQ ID NO: 6840360 - DNA, 113 bp, Homo sapiens
gaatatgtaaggattctggtaaattacctataaatcttagaagaaagacatctgcatctccagggcttcgggaatttgttggtgatttatttcctcattctaaatacatattc

SEQ ID NO: 6840361 - DNA, 88 bp, Homo sapiens
aattaaaagacagctttttaattttaaagacattattagactgtccaaacatgtctgaattcttagaattaaagggaagtttgaaatt

SEQ ID NO: 6840362 - DNA, 59 bp, Homo sapiens
agggccccagtaagattacatgctcaacaaaagcctactgtatttctggctggggcttt

SEQ ID NO: 6840363 - DNA, 111 bp, Homo sapiens
catggctcagagctcaaggggcccagcagtgtcctggggccctaaggccagcagccgggaagttcctgggcagtgggttccccaaggcacggtccccacagctcccacatg

SEQ ID NO: 6840364 - DNA, 65 bp, Homo sapiens
ttcctggtttgcctggaatccaggccttttgatatctgaggcagatgtacccaggcaagcaggaa

SEQ ID NO: 6840365 - DNA, 63 bp, Homo sapiens
gatagaaaactgagttttcagtatctgaagactatagatactgaaaactgagtcttccgtatc

SEQ ID NO: 6840366 - DNA, 87 bp, Homo sapiens
gcggggcagggctggtctgaggggatgtttttgacggagcggagctccagatgctgcacattcctgatcgggtcaggcctgccctgc

SEQ ID NO: 6840367 - DNA, 113 bp, Homo sapiens
tgtcactcgagcattcttgtctcccaaactctgatggtccgcagtgggtactgggctccctgggccctgggaggaagacggaggagtttgggtgaaagatcagacggtgcgca

SEQ ID NO: 6840368 - DNA, 83 bp, Homo sapiens
gggctgcttggcagacctgtcccataagtagtgcaacttgggaagatcctaggcctcttgtgggtagggcagtcatccagtcc

SEQ ID NO: 6840369 - DNA, 59 bp, Homo sapiens
tttcacaaaggaaaagaactgtatggtccataatgacagtctttaatttctttgtggaa

SEQ ID NO: 6840370 - DNA, 66 bp, Homo sapiens
gatattgacaactgaagaaggttgggactgtgagccacagtgagcaagacttcgttgtccaatatc

SEQ ID NO: 6840371 - DNA, 60 bp, Homo sapiens
tggggacaggccatgtgcagcaagctgggaagagataaattgcacacaccctgtcctcca

SEQ ID NO: 6840372 - DNA, 85 bp, Homo sapiens
ttttcttcctgtccacctgaagcagcactaatgggccccagaaaccttctggagtgtattgggtctgctggcgacaggcagagag

SEQ ID NO: 6840373 - DNA, 92 bp, Homo sapiens
ttgcaaggaaaagccacttggggaaagatggaaaaggacaaaaaaattaataaatttccattggccctcgggtgagctgagggtttttgcaa

SEQ ID NO: 6840374 - DNA, 61 bp, Homo sapiens
gtggtgtctttgtaattgtgagccagctattctcctgcctagcaggctttagggacaccac

SEQ ID NO: 6840375 - DNA, 66 bp, Homo sapiens
tctctagtagctgagattacaggcatgtgccaccacgcccggctaattttgtatttttagtagaga

SEQ ID NO: 6840376 - DNA, 98 bp, Homo sapiens
gctctagactcctcaatgctgtttctttttaaagttgtatagagtatttgacaatgagattcaaacactttgagaagttctctagtacttctagaagc

SEQ ID NO: 6840377 - DNA, 55 bp, Homo sapiens
ttgattcctgtactcagaacctgcagaggtttaccactgcttgcaggaagttcaa

SEQ ID NO: 6840378 - DNA, 58 bp, Homo sapiens
gagtaaaagttggattacaaaggcatatgaagtgccttgtggttgcaactatttgctt

SEQ ID NO: 6840379 - DNA, 56 bp, Homo sapiens
attccaggcagaccagagagatgcaattcaaagaatcatactggaatgactggaat

SEQ ID NO: 6840380 - DNA, 60 bp, Homo sapiens
ggaaccgggtttgggcagcccaggctgcctgccagatgagccctccaaacccaggattcc

SEQ ID NO: 6840381 - DNA, 77 bp, Homo sapiens
aatggagttattgagacatagagttatgagtgtgtttaacttcacaagactattcctaaaatgtcctaatttccatt

SEQ ID NO: 6840382 - DNA, 66 bp, Homo sapiens
ccattttgagcttagggaagttacactctgagaagcccagggtaaaactgagaccagctaaagtgg

SEQ ID NO: 6840383 - DNA, 80 bp, Homo sapiens
cccagcagtttattcctaactctgaatcctcacagcagccttggtgggttggagtgacagatgaggaaactgaggctggg

SEQ ID NO: 6840384 - DNA, 57 bp, Homo sapiens
ggtgtacctgatgacctgtggctgaaaagagagactcaggggtgatcgggtgacact

SEQ ID NO: 6840385 - DNA, 62 bp, Homo sapiens
gtgcctgctcagagcccagggtacacccgttcttgggagcgggcagggctgtgggcaggtgc

SEQ ID NO: 6840386 - DNA, 64 bp, Homo sapiens
atttagccaaaaagtagcaattattagaaaaattacttgtaaaattgtacttttgtggctttgt

SEQ ID NO: 6840387 - DNA, 56 bp, Homo sapiens
gtgtcaatgaggtttatttttgtctttcacatcttgagactgaacctcatttgcac

SEQ ID NO: 6840388 - DNA, 68 bp, Homo sapiens
gaagccagagaggccttagaatccatagcccattcccttctggcttctgagtctcctgacattgcttc

SEQ ID NO: 6840389 - DNA, 66 bp, Homo sapiens
gagtggggcaggtggcaaagccagaggggagcagtgatttgtctttgcttggcccctgccaccttc

SEQ ID NO: 6840390 - DNA, 124 bp, Homo sapiens
gtctctaccatgggggaaatagagggacagggtgtgggactgggacagccccaggcaggaaggagcctgcattgtggctcatcttcagctccccccatctgagcagagcccccgtgggtctgac

SEQ ID NO: 6840391 - DNA, 69 bp, Homo sapiens
gaactgggctcaggggacctcctggtgccacctgcatatctgagcccatggagttcctctggtctattc

SEQ ID NO: 6840392 - DNA, 71 bp, Homo sapiens
cctcttggtaattatggatacttaaattgcattatagagagatgtggaattgtgcatgattaactggtagg

SEQ ID NO: 6840393 - DNA, 57 bp, Homo sapiens
agtttccaaagcatgttcacacactatttcctgtgggctccattggcaatggagact

SEQ ID NO: 6840394 - DNA, 70 bp, Homo sapiens
tttagagtctttaggagaaatgagaatgaggaattgaccttttgtaagcttacttctgaggcactctgaa

SEQ ID NO: 6840395 - DNA, 103 bp, Homo sapiens
gcttttcactaacaatttcttctcattccccagagatgccttaatgagcccctcggacatggccaaaggcaatcttgttctctgggccagtgaggtgaaaagc

SEQ ID NO: 6840396 - DNA, 105 bp, Homo sapiens
atagtaaacctggattctgggaaggaggttatcccagtggactccgtaatagatggagaagcattaaagggggtgattatgtccactggaatttcagtatactgt

SEQ ID NO: 6840397 - DNA, 60 bp, Homo sapiens
cagacagctgctttcttgctgtatcctcacatggtagacagagagaaagcaagttctctg

SEQ ID NO: 6840398 - DNA, 61 bp, Homo sapiens
acaagctaggtggaagaccgattcatttattgacttgcagatagtttacctttgagcttgt

SEQ ID NO: 6840399 - DNA, 58 bp, Homo sapiens
gagtatatatagacatgtcacactaatggtggagatgtgtgactatctgcttgtgctt

SEQ ID NO: 6840400 - DNA, 57 bp, Homo sapiens
ggcaggtgttgggggctgactgctgattatttgggtgtcagtgctgaaacaccttcc

SEQ ID NO: 6840401 - DNA, 84 bp, Homo sapiens
tttgcctgtttctatggtttatattactgtcatgcctatattcttgtgggagtttcaaataagaatcaagatataactggcaaa

SEQ ID NO: 6840402 - DNA, 88 bp, Homo sapiens
gaagtcagaaatgagggagtgaaagtgaggggcaaatattctagagccatataagcctctgcatcatcactccagccctctgcatatt

SEQ ID NO: 6840403 - DNA, 58 bp, Homo sapiens
gcaaggctgctgccacccatctgcaactctccaccagagatgggaggctgtgttttgt

SEQ ID NO: 6840404 - DNA, 57 bp, Homo sapiens
tggctggcgccgggctagccacacctgtttgccatcagggctgtctcggcccagcca

SEQ ID NO: 6840405 - DNA, 63 bp, Homo sapiens
cccaaatactaaatatgaagaatacggtgttggtgcatcacttattcataagtttagtgaggg

SEQ ID NO: 6840406 - DNA, 64 bp, Homo sapiens
gtggaggattcagcgaggcagcctggatgatcaagaatgatttcctctccccgctggttcccat

SEQ ID NO: 6840407 - DNA, 70 bp, Homo sapiens
ttaaatacttgtttggagttgttatggttatattagtgaaaaataattatagcgagtctatcgtatatga

SEQ ID NO: 6840408 - DNA, 57 bp, Homo sapiens
actgacaaatatagcttcgtcttaaaagattcttaagagggagctttatttttctgt

SEQ ID NO: 6840409 - DNA, 104 bp, Homo sapiens
cctaccatacaggaacctctttccccagttctgggccagagaatagccttcaaaacctgcctgggggctgccctagagctggcaaggggcctagcatgagtagg

SEQ ID NO: 6840410 - DNA, 84 bp, Homo sapiens
gagtatacgatggccaggcaggaggcatgaagctggcaaagccactttggcaccttctgcctataagacagcctctgtttattt

SEQ ID NO: 6840411 - DNA, 81 bp, Homo sapiens
caggagatcagagttagaattgtactgcaatcaggggaatattttgccttgactacggttcagttaaaagttcatttcctg

SEQ ID NO: 6840412 - DNA, 59 bp, Homo sapiens
gcaatgtctgtgctaaaaactgggaatacagtggtcaaaaatttagacagacatcctgc

SEQ ID NO: 6840413 - DNA, 76 bp, Homo sapiens
acagatggcactttttaggactcaaattggacacaatttcttctagttgtaaaatccttaacaagatggcatttgt

SEQ ID NO: 6840414 - DNA, 95 bp, Homo sapiens
gaaatagcctactggactaacagaattctcagctgaaattcccagccctagagagtcatgctgaggatgctgtgaagccaatctgggctgctttc

SEQ ID NO: 6840415 - DNA, 88 bp, Homo sapiens
gcaggtattcggtgctgcctgtggcttctgggtcagttcatctaattctggtgcagcagcaggaagcccaggctggcactcactctgc

SEQ ID NO: 6840416 - DNA, 82 bp, Homo sapiens
gcagactcaacaaagctagttcactgaagcctatgctattttatggatcataggctcttcagagaactgaatggcagtctgc

SEQ ID NO: 6840417 - DNA, 87 bp, Homo sapiens
gagtaatggagggctaaggggggatacaaaatggagagtgcctttctgggtcattcaaactgtatcacttggtatcttccactgctc

SEQ ID NO: 6840418 - DNA, 121 bp, Homo sapiens
gctcctgggaagacaatgccagctgtgcgctgaaagtctgtgcaagctgctcccgtgaaaaggaggacattggcatggcagggctgtgggcaggtcttagtggctggacattcccaggagt

SEQ ID NO: 6840419 - DNA, 56 bp, Homo sapiens
ccaaatgacagttctctctgagtactgtgctaggtactgaatttctgtcatttagg

SEQ ID NO: 6840420 - DNA, 110 bp, Homo sapiens
ttccctttcctatttgtcttttctttaagactctgctcttggtgctccagcttgtgtcagcaccagacttcccagagttataaacagcagaagaaaaggaaggaacggaa

SEQ ID NO: 6840421 - DNA, 72 bp, Homo sapiens
tgtgaagtcaaagagtgtgtctcattctgaggcaacttggtaatctgggcatgcttccttgcttgctttata

SEQ ID NO: 6840422 - DNA, 110 bp, Homo sapiens
ctgtattctctgtggtctcttgatgtatgtatgtatgtaggtgagtgtgtatacatttgctgatacacatatacatatactcttctttaccactgttaattgatctacag

SEQ ID NO: 6840423 - DNA, 68 bp, Homo sapiens
caattatcacaggagattatgtgtgctagtgtgtttacatggcatgctgtcttctcctggagcatttg

SEQ ID NO: 6840424 - DNA, 108 bp, Homo sapiens
aggcgggcggcgggtgggctgcggccctggggctggggccgggccgcgtgcaccttgctgaggcccaccttggccccggctcccactgcagctcaggccgctcctcct

SEQ ID NO: 6840425 - DNA, 90 bp, Homo sapiens
gggccccttttgcagactcggtgcctggcatgcgccggtgctgcctgctgggtcttggcaccactggcgcagccacggcggcgggggcct

SEQ ID NO: 6840426 - DNA, 75 bp, Homo sapiens
tgtaattatgtagtttcatagaacacagtaatggagctgatttaactgcctactgtgcaaatatgcatgaataca

SEQ ID NO: 6840427 - DNA, 84 bp, Homo sapiens
gcatttgaggataggcacaaaatgaaaatggcagatttcgttcgaattctgttagaagagacgtttttaaagtgcccctagtgc

SEQ ID NO: 6840428 - DNA, 94 bp, Homo sapiens
gagaaatatggaattatggactttgagagctgggaaatgttagcttctctagtcaagagttagctaatagacagcatttggtccattatatctc

SEQ ID NO: 6840429 - DNA, 92 bp, Homo sapiens
ggactgaaattatgaagggaacagtaaatttatgcagcacaaatagcatatccaattgtgttattaaattgctgttcacttccttaaagttt

SEQ ID NO: 6840430 - DNA, 71 bp, Homo sapiens
tactactaaattgaaaatctacagaacaaatcatttatgaaatgtgtgggcatgcttttaatttggtggtg

SEQ ID NO: 6840431 - DNA, 74 bp, Homo sapiens
gtcacatgtgagctttaccttaggttctgttttctagagaaaccaaactaaaataaggcattatactctgtgac

SEQ ID NO: 6840432 - DNA, 55 bp, Homo sapiens
tccctcagcaggaactggcctgacaattttgttcctgctctgtgatgctgagggg

SEQ ID NO: 6840433 - DNA, 70 bp, Homo sapiens
gtcgtctgaaaagtaactgagttgagaagcctgtggaatcttccttggcatctcagatagttcagaccac

SEQ ID NO: 6840434 - DNA, 75 bp, Homo sapiens
ctcctcaggtgccaagatctgaataattaagaggagagaaaacctgtgactcctctcatctgccatttgcaggag

SEQ ID NO: 6840435 - DNA, 67 bp, Homo sapiens
gctcctggtacagacagggctgcctgggttttaagattctggtatttgcccttctgtgaatgggagc

SEQ ID NO: 6840436 - DNA, 66 bp, Homo sapiens
ggtctgcccagaagacatcccctaggtccagtttagaggtcaaggtcagccctctctgggcaggcc

SEQ ID NO: 6840437 - DNA, 62 bp, Homo sapiens
gaaagaggcatctcagcttcctcttgctgtcctgtaccagaggtcagctgcatgccacattc

SEQ ID NO: 6840438 - DNA, 60 bp, Homo sapiens
gctaacttcttggtcctgagctgttatataatgtgtcagctctagctctcagaatgtagt

SEQ ID NO: 6840439 - DNA, 64 bp, Homo sapiens
ggttccaggcatggcaggatgtagaagttaacatttgttggagactgttttgcttcctggaatc

SEQ ID NO: 6840440 - DNA, 84 bp, Homo sapiens
tttaaatctctttctctctctgtatgtgtatatttatatatatatatatatatatatatatatagagagagagagagagagaga

SEQ ID NO: 6840441 - DNA, 76 bp, Homo sapiens
gtctttaatgtgtgaattgagcatcagagtttatttcagattcgtgtatgtgtcctaattcaagcagtttgaagat

SEQ ID NO: 6840442 - DNA, 67 bp, Homo sapiens
attgctagtctttcatttggagcatttttttatcaagaagctctttccttgaaaggcatactgcaat

SEQ ID NO: 6840443 - DNA, 73 bp, Homo sapiens
tatttttggtcatcctggatcttggaaattagaaacaaatcatgagcactgagatccaggatgtcccaaaata

SEQ ID NO: 6840444 - DNA, 113 bp, Homo sapiens
ggagaccaaattacccacttgtgggaaggaaggtgcagcgatcaatcatggggctcattccaggctgctcacaagctgccccccaaccccaacaagggtgggtcttggactcc

SEQ ID NO: 6840445 - DNA, 76 bp, Homo sapiens
tctctagaatcgatcccccagctcaggtcctgaggacatctggcaggatcctgggaatgggagggtcatgaggaga

SEQ ID NO: 6840446 - DNA, 101 bp, Homo sapiens
ggagtctaactccctgcagctaacaacacataaatatgaatgataagagttattagcaatacatcttgtcagattcatgtgttgcagttaggttgggctcc

SEQ ID NO: 6840447 - DNA, 130 bp, Homo sapiens
gctaagtattgctaaattctctttatgtgcagaacagtgtactaggtacatgttcccgggaagccaggtaatttgaggggcactgtacactgtgcatggaattgcaaggccctgaggtttcagcattagc

SEQ ID NO: 6840448 - DNA, 64 bp, Homo sapiens
ctgtaattttccagccaatatgggcaacacaccacattggtaatggaagattcttgtaaagcag

SEQ ID NO: 6840449 - DNA, 103 bp, Homo sapiens
cccacagtgctgggattacaggcatgagccatggcaccttgtctaaaaagaggtatttttggcctggcgcggtggctcacgcctgtaatcccagcactttggg

SEQ ID NO: 6840450 - DNA, 116 bp, Homo sapiens
aacagatagaaaatacattctctagactatgtggcttgtttgggctggccagggtctagcctgaccatccagaccagtccatgggtctgctcagtgggtggagttatctttttgtt

SEQ ID NO: 6840451 - DNA, 80 bp, Homo sapiens
gttctggccccacgcatctgaagtttgtcttaagatataagccgtttcctaaagatgcttccactgcagtggcacaggat

SEQ ID NO: 6840452 - DNA, 101 bp, Homo sapiens
tgctcttactgcacttcatgcaaatttgccagatcaattctgaaatcattttagatcagcagtataaatgagcaagtgcatgaattgtagatctttgagca

SEQ ID NO: 6840453 - DNA, 128 bp, Homo sapiens
ttgctagttactatggcaagttatttaatctctctgaacctcagtttctttatctgtaagattctgacagattgcttagaattgaatggtacagagtatgtaaagtaatacatatagtagacatgcaa

SEQ ID NO: 6840454 - DNA, 58 bp, Homo sapiens
ttgtatttctccactttctgtttaggactactaaatgctgaaatatggacgagtacag

SEQ ID NO: 6840455 - DNA, 83 bp, Homo sapiens
gctgagtggaaggcttctccagggcttacttcagttcttcgtggattttgcccagtcgcccggaggctgcagttccaccaggc

SEQ ID NO: 6840456 - DNA, 58 bp, Homo sapiens
cctactgaaaaatctcctcttgtaacttgttagtaacagctgttgaaatttcagtggg

SEQ ID NO: 6840457 - DNA, 69 bp, Homo sapiens
gtaagaatgttatccccaaaacaaaagcttaaagtcctctaagcttttcagtgggcaatgatgtgatac

SEQ ID NO: 6840458 - DNA, 69 bp, Homo sapiens
tgaagagaggaaggacgtggtcaagctgcacaatagaagtaaaggttggctgctcttttcctaatttca

SEQ ID NO: 6840459 - DNA, 56 bp, Homo sapiens
tcttttcttcttaatggttaattaggtcactaaagaagctcttaagaagaagatga

SEQ ID NO: 6840460 - DNA, 55 bp, Homo sapiens
acagtttggcaaatgtcccacagcccgcttgtcctggggtgtgtgcctgagctgt

SEQ ID NO: 6840461 - DNA, 56 bp, Homo sapiens
taagataaggaacattctgtgatgtgttctatcacaccatgatgatccttaacttg

SEQ ID NO: 6840462 - DNA, 68 bp, Homo sapiens
gttttggctcagtgaagagataacttgatccaagttttgaacaagatggaattatcacgagcaggagc

SEQ ID NO: 6840463 - DNA, 105 bp, Homo sapiens
acctctacccctctctttctctgttacacacacactgttaatgtaggagtatgtgtgcaagcatgtgtatgctcaaaggctatcaatagtgtgaaaatagaaggt

SEQ ID NO: 6840464 - DNA, 100 bp, Homo sapiens
gaggcaggagaatcgcttgaacccaggaggtggaggttgtggtgagccaagatcgtgccattgcactccagcctgggcaacaagagtgaaactctgtctc

SEQ ID NO: 6840465 - DNA, 69 bp, Homo sapiens
tcttagtttccttatttacaaaagggttatattaatgtctaccctttaggttggatgaggattttaaga

SEQ ID NO: 6840466 - DNA, 59 bp, Homo sapiens
atcaccatcgcactgcacactgtcatccttcattaacggctaaagcagatgggggtgat

SEQ ID NO: 6840467 - DNA, 79 bp, Homo sapiens
tatcctttgaggtaggcagaccagtggatgggtctccttggattcatggtgccagtggatttgtctgagacccagggta

SEQ ID NO: 6840468 - DNA, 66 bp, Homo sapiens
agcagccacacgcctccttctccctccctgttaatccccaccgaaagcaggcttggtgtggccgct

SEQ ID NO: 6840469 - DNA, 107 bp, Homo sapiens
atgtcacttgcatttgagcaaagccccctatctcttgtctgttttgcaaagccactgctgtgttctcctacagataaggagggcagcttaagtagtctgtaaaacgt

SEQ ID NO: 6840470 - DNA, 78 bp, Homo sapiens
gaggacagaggcctatccagtgtccatctagtctctcctagacacgacgtatggatgcagggtgcagcctcggtcctc

SEQ ID NO: 6840471 - DNA, 62 bp, Homo sapiens
agcctgacatcaatattctgcagggatacctgatattcctaggaattagggatggaagggct

SEQ ID NO: 6840472 - DNA, 70 bp, Homo sapiens
ctgctactggttctgcttgttctcctgattctccaggcacatctttaggaataggcggctttaggtgcag

SEQ ID NO: 6840473 - DNA, 76 bp, Homo sapiens
ctcaagatgctaagtgaggctgaacaggttctcatgactgcatggtcatgaatagagggcctagcctgtgttagag

SEQ ID NO: 6840474 - DNA, 65 bp, Homo sapiens
ttctcactgcctttggtgggaacactctgtcaacagcagtggctgaagcatcaaaggcaagagga

SEQ ID NO: 6840475 - DNA, 88 bp, Homo sapiens
tccccacacccaccctctcccccacagcagccttctcccccacagaggctgggataggatgaggggggcggagttggggactgaggga

SEQ ID NO: 6840476 - DNA, 75 bp, Homo sapiens
gggggaaacacagtaaagtactaaaaaatatatatatacaaatgatgtgatgcatagtttttattgctttcctct

SEQ ID NO: 6840477 - DNA, 61 bp, Homo sapiens
tgcacagctgcctcctctctgcacggaaacggcagttagaaaaactgaggttgcctgtgca

SEQ ID NO: 6840478 - DNA, 66 bp, Homo sapiens
acccccacatttttgagtcttcatcctttatgttaaacattggggtgaagaataaggagtgggggt

SEQ ID NO: 6840479 - DNA, 130 bp, Homo sapiens
ccttgatgatttgatttttttaaatagttatggttgtgaaaggaaggcatgaaaagtggaagatattttaaaggcagattatggcttatccttaattatagctgcagctgagctgaggagttgggttggg

SEQ ID NO: 6840480 - DNA, 80 bp, Homo sapiens
tcctggggccctctgagagtgcttcatggggccagcaagtggtgcgtggggacccacgtgcagcactcgaggcctcagga

SEQ ID NO: 6840481 - DNA, 92 bp, Homo sapiens
gtttataacgaggatacaatgtcatgattttccattagaaatattttcatgatttagggggataatgactttctgattctatgtccataagc

SEQ ID NO: 6840482 - DNA, 71 bp, Homo sapiens
tcagagttttctatttttattcctgtgtgtaatcaatgggaacacactgtgacggaaataaagaattatga

SEQ ID NO: 6840483 - DNA, 81 bp, Homo sapiens
tcagcaccgagaaatgtcagggttttaagctgccacagagaacatttagcttgaaaataagaaagactttctggatggtga

SEQ ID NO: 6840484 - DNA, 103 bp, Homo sapiens
gtgggagcctggaggcagtgtgtttctgagatatggcctccccataggttatgcccagggatttccattatctttaagcagcacacactccagagcatcttac

SEQ ID NO: 6840485 - DNA, 60 bp, Homo sapiens
tctgtttggaatagcagtaaacattccaggcataggagtgaatttgctcttccaggcaga

SEQ ID NO: 6840486 - DNA, 55 bp, Homo sapiens
cctccacaggggaaacagtgtgagtttttgtaatgttgctactctccctgggagg

SEQ ID NO: 6840487 - DNA, 73 bp, Homo sapiens
gaggaataatatctggcattcaaacatgactggggaaagtttatgttccaattagccagaatggaaaaacctc

SEQ ID NO: 6840488 - DNA, 74 bp, Homo sapiens
ctgctggttccacagatgacagaggggatgggtggagagatatgttatcctagactggtcacttgtgcaagcag

SEQ ID NO: 6840489 - DNA, 64 bp, Homo sapiens
aggtcagtgttcttatttaattaggtattcttgatgcctatttgttggaaaagaacatttgtct

SEQ ID NO: 6840490 - DNA, 99 bp, Homo sapiens
gcaagccccctcgggcctcgggggatggggccggccacacccctgactccgccctggctctgccccatacccctgccgtggggccgacctgggggatgc

SEQ ID NO: 6840491 - DNA, 56 bp, Homo sapiens
aggaggcctttgcacccggattccgtggttggattcagggaggaaaggggcctcct

SEQ ID NO: 6840492 - DNA, 60 bp, Homo sapiens
ttaacacagggggagacaaagttgtagtttttctactcctttgccttcactcctgtttaa

SEQ ID NO: 6840493 - DNA, 72 bp, Homo sapiens
aacaggaagataggggtagaaagtttgccgtcctatatagtagactccttctcactgcctgtacctcctgtt

SEQ ID NO: 6840494 - DNA, 76 bp, Homo sapiens
cttctaccacaatcttgtgtgttttttcattgttaagggaaggaaaacacagtattgatggaatccgctttagaag

SEQ ID NO: 6840495 - DNA, 55 bp, Homo sapiens
ggatgacagctcttccatgtggattatcagcaacataaggccaggggctgtgtct

SEQ ID NO: 6840496 - DNA, 63 bp, Homo sapiens
cccaaagtgctggtattacaggtgtgagccactgtgcccggcctgttttatcagtttttaagg

SEQ ID NO: 6840497 - DNA, 86 bp, Homo sapiens
atgtgagaaagtacatatatttatgattctagagaaggccaaaaatgagtatggtcatgggattatgaatatatgtatgtacacat

SEQ ID NO: 6840498 - DNA, 59 bp, Homo sapiens
tcatctgcatgtgttatatttggttcatcaacagggaaaaaaatagacacatgcattga

SEQ ID NO: 6840499 - DNA, 57 bp, Homo sapiens
tggtgagataactttcggcaagatcatgaaagactgatgcggaaagtatcttcatca

SEQ ID NO: 6840500 - DNA, 88 bp, Homo sapiens
ctttgcccctgagtttccaaaaactaagtattttgaaattaatgttttagcaaaaattatattgaagttgaatgtcagggatgcaaag

SEQ ID NO: 6840501 - DNA, 79 bp, Homo sapiens
gtgtaggtctgtgagccagttcgactgtttctagcacatttatagaagcaaggagagctggcctggtgggacagagcat

SEQ ID NO: 6840502 - DNA, 66 bp, Homo sapiens
gagggagagtgatggaccattgatggaaaatgcttttctgaagcttaatggttttccctttctctc

SEQ ID NO: 6840503 - DNA, 74 bp, Homo sapiens
aatgggcaccttaaaacatgtgtttgaatgagggtctctgaactctgactccttattcattcatgtagcccatt

SEQ ID NO: 6840504 - DNA, 76 bp, Homo sapiens
tttcttagtactttgtactgtgcttttcttattttaggagtttaatgaatatgattaagtatagagtattgaggag

SEQ ID NO: 6840505 - DNA, 72 bp, Homo sapiens
gttatttgtggcatccatgttggtagtaactgattatttggggttttatcacaaggataagccacatataac

SEQ ID NO: 6840506 - DNA, 95 bp, Homo sapiens
tgagttagtttttaaacaatgggttatgtgggggaatgttacgaaaaaaacagaaaggtgtcactgttacatgaactcttactagaaattggcca

SEQ ID NO: 6840507 - DNA, 99 bp, Homo sapiens
ttggggaggtcgaggccaggctcccacttggcttaaagggacattttcagacatttctttctgtcacttggggtgtctatgcctctcaaatttccctaa

SEQ ID NO: 6840508 - DNA, 59 bp, Homo sapiens
gactgggttccatcggaaaggaactgttagatttgtgttcctaactctggcacctagtc

SEQ ID NO: 6840509 - DNA, 57 bp, Homo sapiens
ttctcagccctgatgagtaggcaatacttctaagggtgctgctccaggagctgggga

SEQ ID NO: 6840510 - DNA, 70 bp, Homo sapiens
cctcagtctgtctgatctgccagggagctctggagtataagtcaaacctgagagatggactgacttgggg

SEQ ID NO: 6840511 - DNA, 68 bp, Homo sapiens
aatggtgaatgtggacatctttgccttgtttctgattttagggagaaagcactctgtcttttaccatt

SEQ ID NO: 6840512 - DNA, 58 bp, Homo sapiens
gatacagtgtgttaacgagaaacattgcaaatattttttcctttggacaggctgtatt

SEQ ID NO: 6840513 - DNA, 56 bp, Homo sapiens
gctctcttggatttttgtggttacctcatggcaatctcactaagaagcaggggagc

SEQ ID NO: 6840514 - DNA, 63 bp, Homo sapiens
agtaacactcactctcttgggcttcattctgtccatgtgttcaataagggagttgatgtggct

SEQ ID NO: 6840515 - DNA, 72 bp, Homo sapiens
gagttccagccactttatactgctaaagtctggaaacaggctgaaggtagcagtgtaaagtggctagaactt

SEQ ID NO: 6840516 - DNA, 56 bp, Homo sapiens
ctgttgatgctatgcagaaagcatgcttgaatggcagcaataagtaagtacaacag

SEQ ID NO: 6840517 - DNA, 78 bp, Homo sapiens
tcaacaagccataaggcctcttctctctggagattctcactgtggtttccagactggaaggtctgagtggtctgagga

SEQ ID NO: 6840518 - DNA, 94 bp, Homo sapiens
gtaggagccaacatgattaaaagattttaaagcaatttactcgatagaagggttgggcttaatcaggacttgtgatcatggcaatggttcctgc

SEQ ID NO: 6840519 - DNA, 60 bp, Homo sapiens
gctgaccagaggcaggtctgggcctaaaggaggtcatttctggccttgctctgtggcagc

SEQ ID NO: 6840520 - DNA, 97 bp, Homo sapiens
tccacttattcattcagcaaacagtttctggggatctactacgtgatgtattaaaatgattaggacccaaattgtgttgttgaggaattagtctggg

SEQ ID NO: 6840521 - DNA, 65 bp, Homo sapiens
tttggcacattctgtcacattctacctgaaaagagggttttctgactgatagattgtgaaccaaa

SEQ ID NO: 6840522 - DNA, 55 bp, Homo sapiens
gtgtctgccacccactgacggtcagtattgattttgctgccttggatggctacac

SEQ ID NO: 6840523 - DNA, 87 bp, Homo sapiens
gctggcatctcactccctgcctggacacttgctgaattacagaatcagcagtcttgccacagggtttcaaagggagcagagccaagt

SEQ ID NO: 6840524 - DNA, 61 bp, Homo sapiens
ctactgtagttaaagttttgtagaaacagcacagttttttaagactggctgaacttagtag

SEQ ID NO: 6840525 - DNA, 76 bp, Homo sapiens
tccttccccagcttgctaattttgacttcaggcctgtccgcggttagagtgaagggaaagagtaagggggaaagga

SEQ ID NO: 6840526 - DNA, 55 bp, Homo sapiens
ggtctgcccttcctctccacgatgctaccttgaagcatctgaagtaggtgcagct

SEQ ID NO: 6840527 - DNA, 76 bp, Homo sapiens
cccacttcctggctgggtgacctgggataaattattgaactcctgtgagccccagattccccagctgtgaaatggg

SEQ ID NO: 6840528 - DNA, 83 bp, Homo sapiens
gtgtcctcgcgccctgtgcccccgcagcgggccctcagccggggtggggacccagcttgcgggcggcaggaggctgaggttgc

SEQ ID NO: 6840529 - DNA, 60 bp, Homo sapiens
gtggcccggggggtgcggggcaacctggcaaagttgcccaagtcctccaccgaggtccgc

SEQ ID NO: 6840530 - DNA, 62 bp, Homo sapiens
agggtgatatggttacagtggtatgtaaacaggggttgatatctaccataaccattcgcctt

SEQ ID NO: 6840531 - DNA, 57 bp, Homo sapiens
gcagggcttttctgctttgctcttgctgtaacctcagagcctggcaaaaggtcctgc

SEQ ID NO: 6840532 - DNA, 67 bp, Homo sapiens
atgatgtcatgaatatattagtcttactccccctattcactatggagactgtgtaaacatgattcat

SEQ ID NO: 6840533 - DNA, 82 bp, Homo sapiens
ttcctgacttcctggttttatgttatagatggattgattaattttatctccctctaaactgtaagattcttgaagacaggga

SEQ ID NO: 6840534 - DNA, 77 bp, Homo sapiens
gctggcgatgcatgtgtgtgggtgggagaatttggctgctctctcttggcagcctccatcccatgcacaaagcctgc

SEQ ID NO: 6840535 - DNA, 66 bp, Homo sapiens
ttgtcgacactgcatggatgatggctgtagtcactgcttccttttactgtgcagtgatttggacag

SEQ ID NO: 6840536 - DNA, 63 bp, Homo sapiens
agcagtctagggtgtataaggaagcctcacacttttggggctcttctggcatgctgctctgct

SEQ ID NO: 6840537 - DNA, 82 bp, Homo sapiens
tagcaaagctctcccactgtatgaaggaaagactagcaaagtgaaataagttagccttgtaagcagagggtcagcttttcta

SEQ ID NO: 6840538 - DNA, 130 bp, Homo sapiens
gctcaagattcttgtctaacaggctcccaggtgatgctgatgctgcttttgccctaccacactgttgagtagcagagctaccgccgcatcggcatacctgtgaacctgtgaagaatgcagaaccttggac

SEQ ID NO: 6840539 - DNA, 56 bp, Homo sapiens
ggcagcggcgcctgcttcagtcacttgagtagagttgcttggcaggttttgttgcc

SEQ ID NO: 6840540 - DNA, 75 bp, Homo sapiens
agattcagggcaagtctcagaaggttctggagcactttaaatccataaaatataatgagtgcttactctgtttct

SEQ ID NO: 6840541 - DNA, 57 bp, Homo sapiens
gtctctggaaatttcagttttagagggtgattttcttcttcctggtttttcaagaac

SEQ ID NO: 6840542 - DNA, 94 bp, Homo sapiens
gaggtagtgatttttgtatcaggaagccagtctaatggagatggggctccatggagtagattatcctgaagctggaaggactggagaaaacctt

SEQ ID NO: 6840543 - DNA, 59 bp, Homo sapiens
ccaaagtccatagtttgcattagggctcactcttggccttgtatattctgtgggtttgg

SEQ ID NO: 6840544 - DNA, 66 bp, Homo sapiens
tgcctgtatttgtcctctatttattaaatagattttttggtagaaagaaggaacaaagtagaggta

SEQ ID NO: 6840545 - DNA, 64 bp, Homo sapiens
tcttcctcaatgtaacaacccccatcttccagagtacacagggggcagcgtgtggacaggaagg

SEQ ID NO: 6840546 - DNA, 66 bp, Homo sapiens
tagctgttaatatacaaatggtggaaagtattattgcctatcacagttttgaatataatgcagcta

SEQ ID NO: 6840547 - DNA, 56 bp, Homo sapiens
catctgcagggccccacagccatgggcatcaggaccagggctctgccttgctgatg

SEQ ID NO: 6840548 - DNA, 81 bp, Homo sapiens
gactacccagggagtgctcctgttctcccagcgccaaccaccaacagtgcagtgaccaggagcaggagaccctggggagtc

SEQ ID NO: 6840549 - DNA, 63 bp, Homo sapiens
aggtagtgcctcccctaagtccaggcagcctcacccatggcaggacagaggagaaggcaccct

SEQ ID NO: 6840550 - DNA, 63 bp, Homo sapiens
cccatttggctcttaaactgagcttcttgaacctgctagtgctctgtttctgagccatatggg

SEQ ID NO: 6840551 - DNA, 55 bp, Homo sapiens
cgggctgcttttttcttagcagataaagctgatctgcttatttaacagcagcatg

SEQ ID NO: 6840552 - DNA, 56 bp, Homo sapiens
gttgttttgggagggtgttacaatagatgtagaattgaaacatttgatcaaagcac

SEQ ID NO: 6840553 - DNA, 56 bp, Homo sapiens
aggcggagctcagtgtgtccaataaaactgtcttggtagagcgcctgtatccgctt

SEQ ID NO: 6840554 - DNA, 57 bp, Homo sapiens
tagagtgcttaggatttgagaggcgttgcactacgctttgcataacctaacacttta

SEQ ID NO: 6840555 - DNA, 57 bp, Homo sapiens
gacaaagaaagacaagggggtgttgagagtcacaaacatgccctgtcctcttctgtt

SEQ ID NO: 6840556 - DNA, 62 bp, Homo sapiens
cctgctgaggccagagtttttaattcctatttcattggtgaagaaacttaggttcagagagg

SEQ ID NO: 6840557 - DNA, 67 bp, Homo sapiens
gagacagtggagccacgttgggagcctgtattttttgctgcttccctacttcagtgctccctgcctc

SEQ ID NO: 6840558 - DNA, 55 bp, Homo sapiens
gtggtgagttcaggctggggtgtcatattgtaacccctggttccactgtcaccgc

SEQ ID NO: 6840559 - DNA, 67 bp, Homo sapiens
gaaaacactgcctgcttgactgaggtcacagctgtttactggcctcagttcctaagctgcagttttc

SEQ ID NO: 6840560 - DNA, 80 bp, Homo sapiens
gaagtacatgctatataggaagagcactttgaaattttggggtgttctttttcttatggtgcacttctttcatgtacttc

SEQ ID NO: 6840561 - DNA, 84 bp, Homo sapiens
ctctggatatttttatgaaggtctctaccttgctaagctgttttgttaatgcagatgcagggagggcctttcatgacactagag

SEQ ID NO: 6840562 - DNA, 68 bp, Homo sapiens
tgatttgctcctttctgtgtacccagcactgagagcagtgctatgtccagcacagagtgggtgattca

SEQ ID NO: 6840563 - DNA, 68 bp, Homo sapiens
tgaatgacctgggtgtcatttcatggctgaaatatttaacggccaacagaagaccttctagctcttta

SEQ ID NO: 6840564 - DNA, 91 bp, Homo sapiens
ggaagtggattccacccaggaaggagctgtgtatttcatcaagtgagtaagacgcagtttcctttctgatgtcgctgttggttctactttc

SEQ ID NO: 6840565 - DNA, 62 bp, Homo sapiens
gctggtgatagatgtttgttcatgcttatcttcatatataggaacagacatttgcaattagc

SEQ ID NO: 6840566 - DNA, 86 bp, Homo sapiens
gtattttatattgtattctctcaatatttcataatgttggattggttgaaatattgagtggaaataactacagaggtataaaacac

SEQ ID NO: 6840567 - DNA, 62 bp, Homo sapiens
atgtggcccaggttctgaaaaacagcctcttatttaaaaggcttgtacagcagccttcgcat

SEQ ID NO: 6840568 - DNA, 68 bp, Homo sapiens
ggccttaaaaatgttctttgttttgtgaaacaatgttgataatagcgaacattattttccctaaggcc

SEQ ID NO: 6840569 - DNA, 114 bp, Homo sapiens
actacataaaatttgttgtatgtcaaagtattagggtcctcccaggaattgatgtcacaccaaaggacttagctgaagggcatttaataaatagactgcttcgaaggtgtgagt

SEQ ID NO: 6840570 - DNA, 61 bp, Homo sapiens
ctgattactttttgtctctttgaatgtgcctattctggacatttcatataaaagggatcag

SEQ ID NO: 6840571 - DNA, 86 bp, Homo sapiens
ttagaatatttgaagatgaggtagtactttcctgtatctttacactgtgagtatcaactatctcttttgtctgcagcttagtctga

SEQ ID NO: 6840572 - DNA, 76 bp, Homo sapiens
aatgttttcagtagattggctaatttgatactttgaaaaacaagtatactattattgtcagtttataaatggcatt

SEQ ID NO: 6840573 - DNA, 72 bp, Homo sapiens
cccagctggccagccctcctccctgggttcttccctgggaggcgaaatggagaggggagggctggtcctggg

SEQ ID NO: 6840574 - DNA, 119 bp, Homo sapiens
tggtgttgttatcataagggaataaaaagtatctcttgttttgtctgatttggggcacaatccccttagtgtgtgaagcattaagtgcctctaaaacaagcctcttattgaccacacca

SEQ ID NO: 6840575 - DNA, 129 bp, Homo sapiens
ttgggtgggaagtggcagaatggttatgcacaaggagaaatagatattgacatactgaggaatacttagattcgtcgatttctcagtgtccttcgttcttgttgtttcatttgtcttgattccccaaaa

SEQ ID NO: 6840576 - DNA, 71 bp, Homo sapiens
tgagggaggggcctggactccgggctctgagcctactggggcacaggcctgtgagttgaggccccttctca

SEQ ID NO: 6840577 - DNA, 124 bp, Homo sapiens
tacatttctcacccctttgaagttaggcgaccttatgtcatgttttggctgatgagatgtctctgctaaagatctcatcagcccaaacatgacataaggtcgcccaacttcaaagagaagtgta

SEQ ID NO: 6840578 - DNA, 70 bp, Homo sapiens
tacagaattatatgtagtcagtcagagtaaacattatgtattactttcaaaaactacgtgggcttctgtg

SEQ ID NO: 6840579 - DNA, 80 bp, Homo sapiens
agctgaataagcaggcaggaatggtggaacagattaaacatttaaatgccacctgtttcctgtcgctcccattactagct

SEQ ID NO: 6840580 - DNA, 64 bp, Homo sapiens
atgtgcaggttttacttgcagtcatctcctaatacagagaaaggacacacagagacatgcgcat

SEQ ID NO: 6840581 - DNA, 60 bp, Homo sapiens
ccctttaacacacagaggctgcagtgaagcccccaaaccacaggcttggtgttgaatggg

SEQ ID NO: 6840582 - DNA, 88 bp, Homo sapiens
gggagagagtcacacgtatgaaaaagcataggatttgtagtcggaggaactaagttacctgttttgtcatcatgtgcaatacttaacc

SEQ ID NO: 6840583 - DNA, 58 bp, Homo sapiens
cacagatgagtagatgggtgcagcgttgacaataactgcagtcatattgttcatcttg

SEQ ID NO: 6840584 - DNA, 61 bp, Homo sapiens
aggggagggtccaggacttaactatcaatatttgacagtaattcactgggacccttcatct

SEQ ID NO: 6840585 - DNA, 71 bp, Homo sapiens
ctgtattcctaaatgctattctctaaggctcaggacctagagttgtccttgagaagcattaagaggtaggg

SEQ ID NO: 6840586 - DNA, 57 bp, Homo sapiens
gacagtgagtacctcaaaggccttaaacatgtcgaaggtctcaagtatctcacagtc

SEQ ID NO: 6840587 - DNA, 68 bp, Homo sapiens
tctttttatttcttatgtacttctatcagtttgacttgaaagaaacaggtatattgggaaggggaaga

SEQ ID NO: 6840588 - DNA, 75 bp, Homo sapiens
gcattccctaacctcagctgaattcagggcacatatgggcaagtgtgccttcccaagacgcctgagttagggagc

SEQ ID NO: 6840589 - DNA, 75 bp, Homo sapiens
cacggctctattcatgggtgggccacctggcactgtgcagatgccacttccaggttccacccaagactccctgtg

SEQ ID NO: 6840590 - DNA, 59 bp, Homo sapiens
actgccctcccatctattgcaaattcaaggaggaagatgcaggaactgggagggatagt

SEQ ID NO: 6840591 - DNA, 72 bp, Homo sapiens
ccactgagctgaggctgtgctgatggcaatactcttgctcttccaaggtgcagatcttcttgaagctcaggg

SEQ ID NO: 6840592 - DNA, 88 bp, Homo sapiens
aggctcgagtaggaatgttctgccatcttgggaagaccactggtcccactagtgaagtagatggcagatgcttcctggcttccagtct

SEQ ID NO: 6840593 - DNA, 56 bp, Homo sapiens
gtgaggggctctgacaccctgtgtgggccccgcactgggaagaatgagcctgtcat

SEQ ID NO: 6840594 - DNA, 105 bp, Homo sapiens
gtcgccctctctgtggagtggacgagcgcagggctgggaagcaggcacactgggtccttgtgctgctgtcctatctctttgttcttcacccctgggttgggaagc

SEQ ID NO: 6840595 - DNA, 65 bp, Homo sapiens
ggtgggggcaggtactgggatgcctctgtggctggtccagaggtgacccatagtacctcttcacc

SEQ ID NO: 6840596 - DNA, 66 bp, Homo sapiens
tctgcacctctgaaattggtcagcaccctgaaactgtcctgctggaccaactgcacaggtcacaga

SEQ ID NO: 6840597 - DNA, 63 bp, Homo sapiens
cggggcatggagccaggggtcagctccgaggcaggtatgtgctgtgctccctctggcgccccg

SEQ ID NO: 6840598 - DNA, 102 bp, Homo sapiens
atcatctggggagctttcaaaagtacagatgccagggaaatcaggtaattggtctggagtgggtcctgcacattagtattttttaaaagctcttcagatgat

SEQ ID NO: 6840599 - DNA, 55 bp, Homo sapiens
caggaagctgccggtgagcgaggccactgtgccattgagcacctgcagcttgctg

SEQ ID NO: 6840600 - DNA, 62 bp, Homo sapiens
ccatgcatctaccagccccagaacagcaatgagtgtcatcaggggtctaggaggataggtgg

SEQ ID NO: 6840601 - DNA, 93 bp, Homo sapiens
catggaaacaggtttagctcttagtagtcactgcagggatattcctcaaagaaggacttatttaggtttgacctgttaatattttaatacatg

SEQ ID NO: 6840602 - DNA, 66 bp, Homo sapiens
ttcacatttgaaaggaaagatatgttaagatatacaatgaattgtatctttcctttgaagtgtgaa

SEQ ID NO: 6840603 - DNA, 57 bp, Homo sapiens
ctctgggatagagcctcggtctgagcactctctttatacccagctctgtgccctggg

SEQ ID NO: 6840604 - DNA, 80 bp, Homo sapiens
agagccaagacatctttgcctgggaattctagtgtatccatcataattgggtttattttacccagtaaagagagggcttt

SEQ ID NO: 6840605 - DNA, 101 bp, Homo sapiens
agcggtgactggcgagtcggcagcgcggctgccagggcatcccgggctctgtctggcttccctgagccgcctgccgtgtccctgcttggaaattcactgct

SEQ ID NO: 6840606 - DNA, 90 bp, Homo sapiens
gaactcaggtgtgtggtggaaggcagcacatgtgacctaatctatattttgacaaagaagaaagctccctgccctcccttgcaccagttc

SEQ ID NO: 6840607 - DNA, 73 bp, Homo sapiens
cagcctcctttcttccagctctggcctctcctacacaccccaggtagctctgccaagctggatgaagaggttg

SEQ ID NO: 6840608 - DNA, 80 bp, Homo sapiens
tctgcaagttcccctgcagagcaggagaggcatcgggagctcgtggtccccctccactctcgcaaacctggggaaccaga

SEQ ID NO: 6840609 - DNA, 64 bp, Homo sapiens
ggcatgggtgcttgctgagtgaaggatgaataaatatttcagtgctgagtagcgtgcacccccc

SEQ ID NO: 6840610 - DNA, 78 bp, Homo sapiens
gaactgggcaaaagttgtgaagcagcaattctgttatatggacagtgttctgctttttaatcctatttagctcatttc

SEQ ID NO: 6840611 - DNA, 70 bp, Homo sapiens
aagctttgagaagacctgtttatgctgcattaggggctgagcagacttttataggcttacttaaagactt

SEQ ID NO: 6840612 - DNA, 82 bp, Homo sapiens
tgtcagtgtcatcatctgtcttttaatgttaatgctggtcaattgtgcataaactccaaaaggcaggggttacaataagaca

SEQ ID NO: 6840613 - DNA, 74 bp, Homo sapiens
aggaaattttccgggctggcctcagggtcctcgctgtacagcagctttcaaacactctggccagccgatttctt

SEQ ID NO: 6840614 - DNA, 110 bp, Homo sapiens
atatttttttgtatcaccccttatatatgtatacaaatgcatagatacatattctttgcacgtatgtgtgtgtttatgtgtgtgcatatatatattgattagagaagtgt

SEQ ID NO: 6840615 - DNA, 118 bp, Homo sapiens
tccttatggcccagtctgcttccccttcatagaagggagtttttcctactgctgctaggttatgtcatgaccagggaccacatcccctctgtggagagggtcccaggcccagagagga

SEQ ID NO: 6840616 - DNA, 89 bp, Homo sapiens
ggaaggtactgggtgaggggagagtgaaagaaagaaaaggttagaattttatttgtttatcctttctccatcttacctacttttcttcc

SEQ ID NO: 6840617 - DNA, 57 bp, Homo sapiens
gtgcagatgttatgtttcaaaaaccacattcccacgtgggagctataaaatctgtac

SEQ ID NO: 6840618 - DNA, 73 bp, Homo sapiens
gagaagtgaaactgcaaaagtgtgtctttgggtgttgctaattcagatttgatgctgttgacacttgcctctc

SEQ ID NO: 6840619 - DNA, 90 bp, Homo sapiens
gggcgccagtggaggaaaagtgagtggggcctgcagatggcttccatctcagggaggttccccgttctgctccaatctccacaggctccc

SEQ ID NO: 6840620 - DNA, 80 bp, Homo sapiens
caaaaagatctgaaagacgctattttgaggggtctatttctagaatgggacacctcagatagtgtcttgtgatcattttg

SEQ ID NO: 6840621 - DNA, 115 bp, Homo sapiens
tttttgtttaaaaaaggacaaaattacaaaaaacttgtgtatgtatatgcaatgtgtgtgtatgcgtatgcatgtgtgtaggcatgtgtgtgtgtgtgctagagagaaacagaga

SEQ ID NO: 6840622 - DNA, 87 bp, Homo sapiens
gagtattgcatagaggaaccagactgcctgggttcagatctcagctctgccactattaatagctgtgtgtccttgggcaaattactc

SEQ ID NO: 6840623 - DNA, 74 bp, Homo sapiens
gaaaccaaagtgtagcatttaccagaaacgtacatggtaagttaatgggtgcaaaatgcaggctctttgttttc

SEQ ID NO: 6840624 - DNA, 82 bp, Homo sapiens
ttggttctagcaagtagatactcatttagatgtccttaagaaaaggtgttaattatatgagtatcatatcacttaggattaa

SEQ ID NO: 6840625 - DNA, 74 bp, Homo sapiens
gacacccagagtcagacagccatgggctgaaatcccagttccactcctactggctgagtggctctgagcaagtc

SEQ ID NO: 6840626 - DNA, 57 bp, Homo sapiens
gtggtcaggttatcagatcatatggaaggccctgctggtcttatgaggcctgtccat

SEQ ID NO: 6840627 - DNA, 86 bp, Homo sapiens
tgggctgggaaggaatgagaccaaggattgaatgctggagctgtggcttaccagctctgaaacttggatcaaattctctgagctta

SEQ ID NO: 6840628 - DNA, 64 bp, Homo sapiens
cagcttccaagcctcagtcctcaggctacaatgagtcaaaaataggaagaaaggttggaggttg

SEQ ID NO: 6840629 - DNA, 95 bp, Homo sapiens
ctgagactcaggggccaagggacttgctcaaggtcattgggacgtctgtcatggagcagatttgaaaacctgagcctcccggctccccagtccag

SEQ ID NO: 6840630 - DNA, 70 bp, Homo sapiens
ggtcaacttgagaagctagtacagttctggcaagttaatggtcttgaacaatattgccttcctaatgact

SEQ ID NO: 6840631 - DNA, 62 bp, Homo sapiens
tgagtatccatgggggattggttccagaaccctctgaggataccaaaatccatggatactca

SEQ ID NO: 6840632 - DNA, 62 bp, Homo sapiens
gacagggtccattcccagcggcactagaaggcaggctgctctaggggcagggcccttgggtc

SEQ ID NO: 6840633 - DNA, 99 bp, Homo sapiens
gaggcaggagaatggcgtgaacccgagaggcggagcttgcagtgagccgagatcgcgccactgcactccagcctgggtgacagagcaagactccatctc

SEQ ID NO: 6840634 - DNA, 56 bp, Homo sapiens
gggctcctcacttcacgtctctcgatgtctaaagggtcagctgtgtgtgaggaccc

SEQ ID NO: 6840635 - DNA, 65 bp, Homo sapiens
gtgtagatgcttgtgtacaactatactgggaaatataacaaagtagtcagacttaagctctgcat

SEQ ID NO: 6840636 - DNA, 70 bp, Homo sapiens
gtagaggtttgaatgaggaagagcactggcctgagggaggaagtcctggtcctctcattcattgttctgc

SEQ ID NO: 6840637 - DNA, 55 bp, Homo sapiens
cagctcaccttttataatgggtaccatgatgtggtgccaattgtgtggtgggctg

SEQ ID NO: 6840638 - DNA, 90 bp, Homo sapiens
gatccttgaagtctttcttggtattctgagctaaatattttatagaaattggggtagctaaaaagtatcaggaaaactagcttcaaaatc

SEQ ID NO: 6840639 - DNA, 59 bp, Homo sapiens
cgcagagcggtgatcaggcgcaggcgccggaaggaatcctgctctggggaccggctgtg

SEQ ID NO: 6840640 - DNA, 61 bp, Homo sapiens
tgtgagggcagaggctgtgggtcgctgtggagcaacttcagtgtttactccctgccctcca

SEQ ID NO: 6840641 - DNA, 79 bp, Homo sapiens
gacttgtctgaagctgattaatatcaccaccattggttagtcccaattctgtagagttgattaattcatctggtaagtc

SEQ ID NO: 6840642 - DNA, 58 bp, Homo sapiens
gcctggccaaccctgtctctactaaaaatacaaaaattagctgagcatggtggcgggc

SEQ ID NO: 6840643 - DNA, 85 bp, Homo sapiens
ccagtatctgtgaatgtgaccttatttgggaatagcatctttaacgatatttaaattaagttgaggttataatggattagcatgg

SEQ ID NO: 6840644 - DNA, 55 bp, Homo sapiens
caggagtttggtgatttcttgcctcctactcagccacttcagtcaccaaatcctg

SEQ ID NO: 6840645 - DNA, 61 bp, Homo sapiens
catgcacagatcttctaaagggtagttccaacttgagctctggagttagtgatctgggctg

SEQ ID NO: 6840646 - DNA, 56 bp, Homo sapiens
agcctgtagctagcctctgagggatgtatgggaatccattagctggcactggggtt

SEQ ID NO: 6840647 - DNA, 108 bp, Homo sapiens
tgctagtttgtttgtccattcatctgttggacattcatctgcaggttgttttcaggccttggctattatgaatgctgttatgaacatgaatgtacaaatattctttca

SEQ ID NO: 6840648 - DNA, 62 bp, Homo sapiens
tggcaatgtaggcaagaacattccctcaaggcaatacctgtgggtgtcttggttatattcca

SEQ ID NO: 6840649 - DNA, 60 bp, Homo sapiens
gcccttgctgctgcatctgagcatgtgtgcttgccaaagcttggagaagcagctggtggc

SEQ ID NO: 6840650 - DNA, 59 bp, Homo sapiens
tgggaccttcctgagagcagctctcagtagcagcttctaccatcaggaaattggttcca

SEQ ID NO: 6840651 - DNA, 61 bp, Homo sapiens
agcctttgctggccactgggcaggacctagctgggagcaagtgccagggccagcagaggct

SEQ ID NO: 6840652 - DNA, 78 bp, Homo sapiens
taggttggtgcaaaagtaattgcagtttttgccattgaaaacaatagcaaaaactgcagttacttttgcaccaattta

SEQ ID NO: 6840653 - DNA, 89 bp, Homo sapiens
ggagaatcgcttgaacctgggaggcggaagttgcagtgagccgagattgcgccattgcactccagcctggacaacaagagtgaaactcc

SEQ ID NO: 6840654 - DNA, 64 bp, Homo sapiens
gggttgtgaggaggacccggggaagccccctggactcgggctccctggctctgcctcagagccc

SEQ ID NO: 6840655 - DNA, 106 bp, Homo sapiens
tgtttaatatatgctttacattttggaaaggtgaagtgtacattgatttttctgttgtttttcttgtagtgttacctctttcaaaggtgtaacatgctattaaaca

SEQ ID NO: 6840656 - DNA, 66 bp, Homo sapiens
catacagaagataatgctgccttggctcctggcattgggggttgggctggcccttgtctctggatg

SEQ ID NO: 6840657 - DNA, 59 bp, Homo sapiens
gcagagcttctgtccttcaggagtccatgatgtgggaggaaggagaaagcaagtgctgc

SEQ ID NO: 6840658 - DNA, 69 bp, Homo sapiens
aacctggccctaatcccagtaggatgaggttactctttgcctctgtatttgcttcttagggctatggtt

SEQ ID NO: 6840659 - DNA, 128 bp, Homo sapiens
gtgtgtatgtacatatacacgtgtgtgtatgtacatatacacgtgtgtgtatgtacatatacacgtgtgtgtatgtacatatacacgtgtgtgtgtacatatacacgtgtgtgtgtgtgtgtgtgtat

SEQ ID NO: 6840660 - DNA, 60 bp, Homo sapiens
tggagagcaatgttgctgttgttgtttaatttgttataatacagcaacggaggttttcta

SEQ ID NO: 6840661 - DNA, 71 bp, Homo sapiens
cagagtaggcttgctctaatcaggtgagccccgaaaaagagatactctcctgcaaagaaacaagccacctg

SEQ ID NO: 6840662 - DNA, 60 bp, Homo sapiens
tgttggtcaggctggtctcaaactcctgacatcaggtgatccaccagcctcggcctctca

SEQ ID NO: 6840663 - DNA, 88 bp, Homo sapiens
caggaaggttgggggaggcctgctgcccatgtgccaggcccccaggggctgtttcagggcagagcgtttcctgcccccacccttcctg

SEQ ID NO: 6840664 - DNA, 65 bp, Homo sapiens
gcctgagcagctatacacacaggcaaaaagcaacaaaaataatctgtgttgtagagactcagtgt

SEQ ID NO: 6840665 - DNA, 58 bp, Homo sapiens
gggaggcagtgctggaggctggctcaaccccaagaccagcaggccaagctgccatccc

SEQ ID NO: 6840666 - DNA, 112 bp, Homo sapiens
ggcccggcggcccgggcccagcgaccccggcgaggccccgaagctctctgaaagctggacagccagtcggggccatgctgggcctgccctcgccctgcccggacgccgcgcc

SEQ ID NO: 6840667 - DNA, 87 bp, Homo sapiens
tatgtgtcaacttgactggctcatgggatgcccagataactggttaaatactgtttctgggtgtgtctcaccttcagtgtgagcgtg

SEQ ID NO: 6840668 - DNA, 71 bp, Homo sapiens
ccttccagcttctagggaaggcagtcacacatgtgactcttgggaagtgtgactgtgctgtggagggaggg

SEQ ID NO: 6840669 - DNA, 82 bp, Homo sapiens
ggttccaagtctttgctattgtgagtagtgccacaataaacatatgtgtgcatgtgtctttatagcagcatgatttagaatc

SEQ ID NO: 6840670 - DNA, 75 bp, Homo sapiens
ggggccgagtctatgtctccaccttcgcagagttcagggaactctgttttgtatttggagggatagaaaggcccc

SEQ ID NO: 6840671 - DNA, 78 bp, Homo sapiens
tggaaggggctggaaggaagctgtctggatgtgtgcccttacacatacatcttaacgcgctcttgggtttttcttcca

SEQ ID NO: 6840672 - DNA, 82 bp, Homo sapiens
gaatatgattgaccaggatactgcagggatggaacatttgataaactgtctcctgtagcttcttggaaggcagagcatgttc

SEQ ID NO: 6840673 - DNA, 69 bp, Homo sapiens
gatgtgtctccgtttcaaggcaatggtagaattagttgatctccttggttttgctgaatggacacgtgc

SEQ ID NO: 6840674 - DNA, 68 bp, Homo sapiens
gttatgagatggcaatatgtgaggttcatgatggcatatattaagaactggttatgttatcttgcaac

SEQ ID NO: 6840675 - DNA, 69 bp, Homo sapiens
cctcagattgctggagtagaaaacttaactttccaaaacactgagttgttttcagcccagcattagagg

SEQ ID NO: 6840676 - DNA, 80 bp, Homo sapiens
ctcccaagttctgattcccagcccagcctgctgcaggattttgcagcacatgtctggggctgggagcaccagggtgggag

SEQ ID NO: 6840677 - DNA, 56 bp, Homo sapiens
ctgaggctgggcatggggtccacatctggtagaaaggtcccagtgctcagtcacag

SEQ ID NO: 6840678 - DNA, 75 bp, Homo sapiens
tcctggaggcagagcgcatgcgtcgcagaaccgaaacgtttccgtgaacaagttgcttgctttctgtttcccgga

SEQ ID NO: 6840679 - DNA, 99 bp, Homo sapiens
gttgtatttacttgctagtcacagcttccattagaatgagatagacagtgttatcacacaaagctgatggaagttcagtgcaaagcatacagatgtgac

SEQ ID NO: 6840680 - DNA, 101 bp, Homo sapiens
gaaagttttttgtgggggtgcttctgggagagcttttgcttcttaacaaaagggaagggtgtgaaaggagagttctcttaggtccaccctcactttctttc

SEQ ID NO: 6840681 - DNA, 129 bp, Homo sapiens
tgaagattaatgttccttacatgttaagtttaggaaggatggctttttcctgctgactacttttatgagatggcatgaatttagctttccattttgaacttactgtttatgtacagtgcattttgttca

SEQ ID NO: 6840682 - DNA, 57 bp, Homo sapiens
ttcagagtggtatgaagtgatgatgtagatatttgtcattccatttccagctctgaa

SEQ ID NO: 6840683 - DNA, 98 bp, Homo sapiens
ggtcacacggtcacacagagcagaggtcgggcatatgggctcctggttggattcccgggatgccagtcctggccctgcctgccttgtgctgtgtggcc

SEQ ID NO: 6840684 - DNA, 82 bp, Homo sapiens
gggaggtcctgtccttggtctctgataggtgcaatccatataccagtctcagtgaaggccatgtgatataggaaggacaccc

SEQ ID NO: 6840685 - DNA, 55 bp, Homo sapiens
cataatccattaattaatgaccatgatttaattacatgtcatgctatgggttatg

SEQ ID NO: 6840686 - DNA, 59 bp, Homo sapiens
gaggcggccccaccgtggagcttcccccgtgcaaggacgaggtccactgaggctgcctc

SEQ ID NO: 6840687 - DNA, 110 bp, Homo sapiens
tttctggctatttttgcaagttaggcttcttcaagtctggtccagctttgcagatctgcataggtaatggactattggggtggggtggcatggaggagtggaaacagaga

SEQ ID NO: 6840688 - DNA, 85 bp, Homo sapiens
tcactgttgagctccattcctgtcccttcattgttgagctgcgttccagccatgactcggacagtgagctatggacccccagtga

SEQ ID NO: 6840689 - DNA, 67 bp, Homo sapiens
tgttgcccaggcttcagtgcagttgcaggatcatagctcactgtagctttgaacttctgggctcaca

SEQ ID NO: 6840690 - DNA, 68 bp, Homo sapiens
gagtccagtgatgttcctggtctctccccagaagtacagacaggttgggccacgttaacactggactt

SEQ ID NO: 6840691 - DNA, 73 bp, Homo sapiens
ggggcagttatagcttctccctttcctattggttagcaactctgaccagggcccgggagagctctccagtcct

SEQ ID NO: 6840692 - DNA, 79 bp, Homo sapiens
gcgggagcccagagaggctggcagtgccaggttcaaacttagagccatgggctcccagtcctttcaactgggttctttc

SEQ ID NO: 6840693 - DNA, 66 bp, Homo sapiens
gattaggctaaaggaactgctgctatggaaccagcatggtgctaaggatgaggattctgcctgatc

SEQ ID NO: 6840694 - DNA, 87 bp, Homo sapiens
ttggatagaggggtgcaggtggggaacaggggtaccaagggagatcatggaatgtttccccagcctgcaatctcccctcctaaccaa

SEQ ID NO: 6840695 - DNA, 93 bp, Homo sapiens
cagaagtacagacttgctgagctgagccaaatctgtctatccaattactgggtaagagagctgactgtagctttaggcaaaacctgtaatctg

SEQ ID NO: 6840696 - DNA, 73 bp, Homo sapiens
ctctagccttgggatttgagatctggatatgtagagaatatatttccttttgctctccaatctcacagcagag

SEQ ID NO: 6840697 - DNA, 58 bp, Homo sapiens
ggagagaagggtgtagcctgggcccttgtgaaggaggctcaggccctgcctttgctcc

SEQ ID NO: 6840698 - DNA, 75 bp, Homo sapiens
gctgttaaatcagtggttcccagcccaggatgtgcactgataccctgatgcctagagcccctgatgaatgacagc

SEQ ID NO: 6840699 - DNA, 93 bp, Homo sapiens
ctgctgctgaaaaggctgtgaccaagaaggaacttcagggcgaatggactgctccagctcctgagttcactgctactcagcctgaggttgcag

SEQ ID NO: 6840700 - DNA, 60 bp, Homo sapiens
tattattgttttgttatcatcagcatcaattgttttgcttatggaaatggagcagttctg

SEQ ID NO: 6840701 - DNA, 59 bp, Homo sapiens
tagacagtggcagtcgtgttctctagaagagcctggagatcaggaagactgaactgctg

SEQ ID NO: 6840702 - DNA, 78 bp, Homo sapiens
tgccttgagctgccaattacctatttctgagaatttggtgactcttattggtaatgatggcatttacaacatttggca

SEQ ID NO: 6840703 - DNA, 83 bp, Homo sapiens
cattccctgcagcctttggaggaagtgtggccctgtatatacctttatttcagacttgtagcctccagaactgtgagagaatg

SEQ ID NO: 6840704 - DNA, 63 bp, Homo sapiens
tgcactgatgttttgccaaggaagcatgactctggtttcatctggctaatggctttgcgtgca

SEQ ID NO: 6840705 - DNA, 69 bp, Homo sapiens
atcttcccacaacagcatccagagaaagagaaacaggcactcttcctctcagtgtggttgtgggaagat

SEQ ID NO: 6840706 - DNA, 56 bp, Homo sapiens
gtcagcagtgtcagctctgggggttctgcacaaacactgctagggttgctgctgat

SEQ ID NO: 6840707 - DNA, 84 bp, Homo sapiens
gcacccctgtctgtgcagtccagccctggacaccacgtggtggtgccagggtcctgagggccttgcgcataggtcacggggtgc

SEQ ID NO: 6840708 - DNA, 72 bp, Homo sapiens
tcagtaatattttactctaggccagaggttggcaaacttcttggtaaagggctagagggcaaatgttgctga

SEQ ID NO: 6840709 - DNA, 126 bp, Homo sapiens
gggagcagaaggttgcagatggggagagacaggtggcttctctgcagcctttgttcctcatgtgggagagggtagcaggtggcttccagattttctgcctacaaatgtctgtaacaaacaagtcct

SEQ ID NO: 6840710 - DNA, 86 bp, Homo sapiens
gccaggggcgtgcgtggctcagtggcagccgcagctaggaaggactagaaagtggctagaccgcggagccaagatgctggcctggc

SEQ ID NO: 6840711 - DNA, 63 bp, Homo sapiens
tcctatgctgtctggctctctctttccttctcaaggccagcctgagagctaacagaatcagga

SEQ ID NO: 6840712 - DNA, 130 bp, Homo sapiens
ctgccacccaccacttcacccaagggcttccaagaacacatgttcttaacttctgtttcctctgaggccttcgagcagtgggaaggaacagggtgtcacttggagcccaagtgtctcccaaggggttttg

SEQ ID NO: 6840713 - DNA, 61 bp, Homo sapiens
cgctggcagggctgatctgaagactggcagcaactcctttttatactccactctgcaagcg

SEQ ID NO: 6840714 - DNA, 77 bp, Homo sapiens
aatgtcataggtgccactgaattgtgaacacctacaattaaataagtaggtatttcccaaagtggcatggtggtgtt

SEQ ID NO: 6840715 - DNA, 72 bp, Homo sapiens
atgttcactgatttagtcatttatatctgactgtgcaatgcagtggcatggttgactgcagtaaaagaacat

SEQ ID NO: 6840716 - DNA, 78 bp, Homo sapiens
tcagtttcccagataaagaaaagtagctgtgagtgtgcgtgcgtgcatgtatgtggctacttttcttgctatcactga

SEQ ID NO: 6840717 - DNA, 63 bp, Homo sapiens
tcacacatatggcttgtggagagttgtagtaagtcctgctatgatttccaaagtcatttctga

SEQ ID NO: 6840718 - DNA, 92 bp, Homo sapiens
tcatttataatttttttaaaagcagctgatagtctcatctcataaaaatctgagggtgagataatttagttcctggaaagaaattagaatga

SEQ ID NO: 6840719 - DNA, 61 bp, Homo sapiens
tagccaggcgaggtcagtgtcggcaggctacctggtcattattgctgcctcgtccaggctg

SEQ ID NO: 6840720 - DNA, 61 bp, Homo sapiens
gctcaccaccgaacaacaagggcaagaagaaccagccttctgctctgaagttcggctgagc

SEQ ID NO: 6840721 - DNA, 68 bp, Homo sapiens
caccaggctggatggagagggccctgtagctgggtcttcccagtgtggactctctcctttggcttgtg

SEQ ID NO: 6840722 - DNA, 55 bp, Homo sapiens
gcatgttatgtgtgtatggtgtttacagtgtgtgtagtatgtatatgtaacgtgt

SEQ ID NO: 6840723 - DNA, 56 bp, Homo sapiens
acagctgctgtttttgaaggacgccagtctcttatgcttcattggcagcagactgt

SEQ ID NO: 6840724 - DNA, 92 bp, Homo sapiens
aggaaaagtgatggcatctatatcataaatctgaagaggacctgggagaagcttctctggcagcttgtgctgttgttgccattgaaaaccct

SEQ ID NO: 6840725 - DNA, 85 bp, Homo sapiens
ccaacactatagggttgtttttatggattgtatgagataacatacttaaaatactctgcacacagtggacaagtcttggagttgg

SEQ ID NO: 6840726 - DNA, 74 bp, Homo sapiens
ttggggatgaggccactgtccctgccttcctgggagccaggatgttgattgaatggccatttcactctctccaa

SEQ ID NO: 6840727 - DNA, 66 bp, Homo sapiens
tgctctcagagtcaggaggtaagtaaaggccacttagccatgggcaggccttctgtctccagagca

SEQ ID NO: 6840728 - DNA, 61 bp, Homo sapiens
acctaggacggttagtgatgtgggaaatgataaatctgacacatttttcccgttctgaggt

SEQ ID NO: 6840729 - DNA, 67 bp, Homo sapiens
gtcccggaggccgggggagctctttccacctgtgtggtttcaggaaggacttcggtaatgctggggc

SEQ ID NO: 6840730 - DNA, 62 bp, Homo sapiens
cccacagctcaagtgtctacaccgcactgccatccaggctgtgagccgctgctgagcatggg

SEQ ID NO: 6840731 - DNA, 57 bp, Homo sapiens
tggtactgtcatccattttaaagcaagaaaatcttcaggcaaataaatgacagacca

SEQ ID NO: 6840732 - DNA, 76 bp, Homo sapiens
cattcccacggccactgcagcaccccagtagctccaacagaaggacccctggagtctgtgtgtgtctgtaggaatg

SEQ ID NO: 6840733 - DNA, 55 bp, Homo sapiens
ttctgctgacagccctgcttcaggttggcaaagcctctatgtggctgtcagagaa

SEQ ID NO: 6840734 - DNA, 79 bp, Homo sapiens
tatgattctttttgtcccttcacatttcaataattcacatttgttaaaactagtggttgggactaaagaaaaggtcata

SEQ ID NO: 6840735 - DNA, 109 bp, Homo sapiens
gggtgaaggcagtgggggcctgcacaatgggatcttgccctgagggctcaggcacgggccggcccttgtccggggtccctccagtgtcccagccccaagctgcacaccc

SEQ ID NO: 6840736 - DNA, 60 bp, Homo sapiens
ggcaaggagagaggatgagactggaagtctggagttctgtgttcattctttctacttacc

SEQ ID NO: 6840737 - DNA, 63 bp, Homo sapiens
tgcagagatagaactactttctgatgacttttttctgttctcttaaggtggtttgtctctgta

SEQ ID NO: 6840738 - DNA, 76 bp, Homo sapiens
ctgcagtgctcagccactgaactcctggctatgtagtcagaaagacatcatgtccagggctttagcggggctgcag

SEQ ID NO: 6840739 - DNA, 61 bp, Homo sapiens
tcctgcagttacatcccagccagggcccgtggaggaggggctgggatggagactgcagtga

SEQ ID NO: 6840740 - DNA, 73 bp, Homo sapiens
ggaatgactggctctgaaactcctgcaccttcttcagcttgatgcacagaggcaagttcagagctaggaagcc

SEQ ID NO: 6840741 - DNA, 82 bp, Homo sapiens
accctgcaccctgatcctgcccctggagtgttccaagtggatggaacagctttatctcagggatcagcatggttggaagggt

SEQ ID NO: 6840742 - DNA, 59 bp, Homo sapiens
gaggtgggagggcagtccctaacagccacggatgcctggcggggcgctcactccacctc

SEQ ID NO: 6840743 - DNA, 60 bp, Homo sapiens
tgttttattaaaggtgtttttctaggaggaaaatctgtagaaaagcaagggagtagaaca

SEQ ID NO: 6840744 - DNA, 77 bp, Homo sapiens
gtgacaataagacagcaatatgggagacggagggctttgtcccctgcccttcctattcctgtgtgttgttgtttcac

SEQ ID NO: 6840745 - DNA, 62 bp, Homo sapiens
taacaagtcattttatcagcaggcctgagcttcagccagctgtcattaagagtgtcttgtta

SEQ ID NO: 6840746 - DNA, 64 bp, Homo sapiens
gaagaaagattggcatgcttcacaagactttgacctttaaacaaagcatggtcagtctgttttc

SEQ ID NO: 6840747 - DNA, 65 bp, Homo sapiens
caggatgacacagttagaaagagatctatgaagaacattatctgtttctctctctgtccctcttg

SEQ ID NO: 6840748 - DNA, 64 bp, Homo sapiens
ccaggctttgttctgcacacacagacaggtgcaagtaggcatgtcatgtatagacggggcctgg

SEQ ID NO: 6840749 - DNA, 70 bp, Homo sapiens
gtctttggcaacacatgtgggacagagctatagactaaagagtgttctgtcccattctcttgtggaggac

SEQ ID NO: 6840750 - DNA, 55 bp, Homo sapiens
aggaggagcagctttttgtctccatagaggatggaataaaaagtatcttattcct

SEQ ID NO: 6840751 - DNA, 56 bp, Homo sapiens
cgtttttctaataaagcggtgctctgtgttgcgccaaagctggaggtggaggtgcg

SEQ ID NO: 6840752 - DNA, 75 bp, Homo sapiens
attcatttaaaaatatttactggatatctactaaaaggcctcttagaaggtgcttggtaaatattttaggggaat

SEQ ID NO: 6840753 - DNA, 67 bp, Homo sapiens
ggaaggaaagaggcttcagatccttcagatgcatacaatttgacatgggctgtaggtctccacttcc

SEQ ID NO: 6840754 - DNA, 70 bp, Homo sapiens
tgaacaccatggatgtgagcattatgataaaataacaaggtgctttcacatgtatgcacaaagatgttca

SEQ ID NO: 6840755 - DNA, 86 bp, Homo sapiens
cggtggatggggttgagatagaaaaatgtagatggccctcataaactagtggtgctcttaacatattattttagcacaggccattg

SEQ ID NO: 6840756 - DNA, 57 bp, Homo sapiens
ggagtggcctctcctgtgcagggtaagaaaggcattcatggaagggagtggtcctcc

SEQ ID NO: 6840757 - DNA, 59 bp, Homo sapiens
ccagaggggaatttgtctttgaataccattgcctgtgttcttggcattttcccatttgg

SEQ ID NO: 6840758 - DNA, 122 bp, Homo sapiens
gtgtgtgtctcgtgttaggagaaaggtccgtggttgccgtctcagctggtttgcttactctctgcccccaggagaagtttgctcacttgggacaccagcgaccctcctcacctccacctcac

SEQ ID NO: 6840759 - DNA, 62 bp, Homo sapiens
aactgcctgtattgtctgcttgggctgccataacagtgaagttaacagagtacagagttgtt

SEQ ID NO: 6840760 - DNA, 85 bp, Homo sapiens
cccgcttcttccagaccaaggaaggctgggctgtgggagcttggtgttcctgtccagtgtcctcgtttgtaaaatgagaggtggg

SEQ ID NO: 6840761 - DNA, 73 bp, Homo sapiens
gcagcctcctagttctctgccagtcgctgaaggacacccaggacagttattgagtgcagagcagggctgctgc

SEQ ID NO: 6840762 - DNA, 61 bp, Homo sapiens
tgtgtctgtacaggtgcatgttctttttatttcttaaggccaacatttgtagtcaggcaca

SEQ ID NO: 6840763 - DNA, 58 bp, Homo sapiens
tgtaaagtatacgtttcccagcacctgccaccagcaggtaaggaacaaatactatgca

SEQ ID NO: 6840764 - DNA, 55 bp, Homo sapiens
tggtcatctacatttacatgaagaattctgtacatgttaaaagtgaggatggcca

SEQ ID NO: 6840765 - DNA, 58 bp, Homo sapiens
ctgtgcaggagcttctggcctgaccaggccgcgcaggtggtcaggtcgttcctgccgg

SEQ ID NO: 6840766 - DNA, 88 bp, Homo sapiens
gcctgctacatcatgaagcattacaggatgacagcagccgagaccattgcgtgggtaaggatctgcagacctggcttggtgatcgggc

SEQ ID NO: 6840767 - DNA, 95 bp, Homo sapiens
tttatcttgtttgagctacactgattcatttgttcattttctgtctcttattttcagttgaactttatcggaacaggtactcataacaagatgag

SEQ ID NO: 6840768 - DNA, 100 bp, Homo sapiens
ggtggggtggccgatgcccagggcctctgcctccccgttgttctccgcagaggaggaggaggacagaaaagacagaggctccaggcctcagcccctcact

SEQ ID NO: 6840769 - DNA, 56 bp, Homo sapiens
ggcggagttagggaattgcattctggtgccaggctccagaacccatatcctttgcc

SEQ ID NO: 6840770 - DNA, 66 bp, Homo sapiens
caggccagaggagttgaggctttgggtagcaccccgcaggcccagcagtagagctcatatggcctg

SEQ ID NO: 6840771 - DNA, 57 bp, Homo sapiens
cacattcaggattttccatgtcttagtgatggcatttctggaatattcctggatctg

SEQ ID NO: 6840772 - DNA, 55 bp, Homo sapiens
gtccctgggtctaaggcagtaattctcaactggagcaattttgtcctcaggggac

SEQ ID NO: 6840773 - DNA, 63 bp, Homo sapiens
ggcctttccttcatcaagacttgtccaggaacatcttcaaagatggagggatagattaaggcc

SEQ ID NO: 6840774 - DNA, 79 bp, Homo sapiens
gggtcaattacagcacagtactccatttctctagcttcagtgattggtacaagttctggcatgtgattctaaccgaccc

SEQ ID NO: 6840775 - DNA, 57 bp, Homo sapiens
gcatggtaaaagatatactgtgcatttccctgtgccagaacttgtctctttgcctgt

SEQ ID NO: 6840776 - DNA, 67 bp, Homo sapiens
gggaggcatcccaagtagcaatcctggtagccttcaaggaaatgccaagtgcttacttggccctccc

SEQ ID NO: 6840777 - DNA, 70 bp, Homo sapiens
tcagctaccacaggacacaactgctgacctcccgccaaagggaggctggaacatttttgtccttgtctga

SEQ ID NO: 6840778 - DNA, 85 bp, Homo sapiens
aatagtgcctacctagtggcattgttgtgaggattaagctaattaatataggaaagttcttacagtagtgcctggatgtactatt

SEQ ID NO: 6840779 - DNA, 105 bp, Homo sapiens
gcgagtgcttaccttgattaccttgttgaatcctcagtaactctacgaggtaggtgccattttacccaggaggaaactgaggctcagagaggctaagtaacttgc

SEQ ID NO: 6840780 - DNA, 84 bp, Homo sapiens
caaggctatagagtggttgagagcaggctctcgggggccaggccgcctgggttccaaatgccagctctgccacttcctgctgtg

SEQ ID NO: 6840781 - DNA, 65 bp, Homo sapiens
gagtgagagctgggggtgaggggacagctgggaattccccctgcactgcctgctggctgtcactt

SEQ ID NO: 6840782 - DNA, 57 bp, Homo sapiens
caggagcccagggacagggcggatgtcgatgctttgacaagccctgctctggtcgtg

SEQ ID NO: 6840783 - DNA, 83 bp, Homo sapiens
agcatatttttcaagtcttttgctaagagtaatgccatggagcagcctcccatcattcttgttaataggactgtctgtgtgtt

SEQ ID NO: 6840784 - DNA, 71 bp, Homo sapiens
agggagattctggttaaactgacctaaaaggattcttgctgaaggtaggccaagttgatcagacatcctct

SEQ ID NO: 6840785 - DNA, 61 bp, Homo sapiens
gctgatagaccctctttgggttattaaccagttagtttcttccagaaaagaggtcattagc

SEQ ID NO: 6840786 - DNA, 57 bp, Homo sapiens
tttcacttgaagatgctgatgatagtattccacagtctttagccatccacagtgaaa

SEQ ID NO: 6840787 - DNA, 63 bp, Homo sapiens
acatgtcagctctgttccatcattacatgccatcatgcagtgcaacagaagcaggctggctgt

SEQ ID NO: 6840788 - DNA, 59 bp, Homo sapiens
agcagggctcactacaaccctgggactcctcagggactcctgggtctgtgagccatact

SEQ ID NO: 6840789 - DNA, 75 bp, Homo sapiens
ctagaaaatgctttatacaaaacacttaataggttcctatagtgtgaaagttgtaaagtaagatgacttttctag

SEQ ID NO: 6840790 - DNA, 74 bp, Homo sapiens
gtgtcacatagcacacgcattagcaaatcattgatttattcactgtctatggagtgcttgtgtgttctagacac

SEQ ID NO: 6840791 - DNA, 57 bp, Homo sapiens
ggatcttgatttcaacccagaggatcttaaatgttctctggaactgaaacaagatct

SEQ ID NO: 6840792 - DNA, 127 bp, Homo sapiens
cagaaatcactaacatcttatggaaaagctttgaaagccatggctgcatcagcctgcctctcccacttagagacgggaaagtttatgtgagccagggtcgaggctgtttgggactgtgtgatctctg

SEQ ID NO: 6840793 - DNA, 57 bp, Homo sapiens
gtgcattggtgcgccacttcaccctgtgctccctaacagccctgtgcatcagtgcat

SEQ ID NO: 6840794 - DNA, 59 bp, Homo sapiens
agggccacatgactaggttctagctaagacaatgtaagcagaactgttgtttgggtcct

SEQ ID NO: 6840795 - DNA, 81 bp, Homo sapiens
ttcctcaaaacttgaaaggtactgttggtttcattttatttaccctgaatgggattaactgtactttctaattttggagaa

SEQ ID NO: 6840796 - DNA, 63 bp, Homo sapiens
tctcattaaatgtcacttctcagttgggctattactggtagtatgacaggtgatatcttgaga

SEQ ID NO: 6840797 - DNA, 58 bp, Homo sapiens
cagagtaaggagctgtcaaacgggaataaattctgccttctaacagccttcttctttg

SEQ ID NO: 6840798 - DNA, 127 bp, Homo sapiens
aattctgcaagtcttgatactaactctgaggaactgcatgaaggtggtgcttctgctcctctgctcatacagagcaagcagaacaagccactgtttctgtggtgtgatttcaggagaatgctctgtt

SEQ ID NO: 6840799 - DNA, 88 bp, Homo sapiens
tttgagggttaattgtcatgtctattgtaccccaggcaagcaccatcctgctgagtacaaagtggacctgatagtaaagcccctcaga

SEQ ID NO: 6840800 - DNA, 55 bp, Homo sapiens
tgggggagagtttagatgattttggccacttggtttcccttgattttttccccca

SEQ ID NO: 6840801 - DNA, 103 bp, Homo sapiens
ggcctagtaaagtttggggactttgatcttaccattattaggtggacttgagatcttttcttgtaccaggtgatggagtcatatcttcactgttgccagggct

SEQ ID NO: 6840802 - DNA, 75 bp, Homo sapiens
tttgacacaaaaaaatagggaatttgtatagagaagtttccctcttataaaaggactcccatttgattgttcgaa

SEQ ID NO: 6840803 - DNA, 79 bp, Homo sapiens
catgagtaggtgtcaactttgaaccaaatgctactacctagctaaaggctctgaaattgatttaacaacctatatcatg

SEQ ID NO: 6840804 - DNA, 60 bp, Homo sapiens
gtcagaggggcagctgccaggctcacaccccaccccgtcacccctcagctgcccctggac

SEQ ID NO: 6840805 - DNA, 89 bp, Homo sapiens
tgggaaactcaaaccttctgcttcacagccaaggcctggcagtccattctgccagcagcagtgacagccgaaagcccttgaccatccca

SEQ ID NO: 6840806 - DNA, 73 bp, Homo sapiens
ttccgtgccaagccaagagttaactatttgtgagaagaaaaacagaaatacattctctggtgtgtgtttggaa

SEQ ID NO: 6840807 - DNA, 76 bp, Homo sapiens
gggcacttgtgttcttcactttgctgggcctctccacacccatcgtcccattttacagatgaggagctcaaggctc

SEQ ID NO: 6840808 - DNA, 67 bp, Homo sapiens
tagaaggcaggtggttggagttctgttgaaggtcccatctatgaattccaggctcctgcagtttcta

SEQ ID NO: 6840809 - DNA, 107 bp, Homo sapiens
gcataccttgtccctacaaaagtatgcagcacacaataggtacccagcaaatatttgctgaacttattgagtgcttgctaagtgactgaaagggagagagtgtgtgc

SEQ ID NO: 6840810 - DNA, 58 bp, Homo sapiens
ctgtagcaccaagcctagagtgatgtttgcttctgactcctgctggtttggtagccag

SEQ ID NO: 6840811 - DNA, 127 bp, Homo sapiens
ctagctagctagatacctagctgtcaggttggagcaaaagtaattgcggtttttgctgcaattaaaggttatggcaaaaaccacaattacttttgcaccaacctaatagctatctatctagggctag

SEQ ID NO: 6840812 - DNA, 62 bp, Homo sapiens
tgagttgttaaagacatttctggtagaaagtaatactgggttgaaatttctttgacaactta

SEQ ID NO: 6840813 - DNA, 57 bp, Homo sapiens
ggggagtgtggaaggcaaattatggagaaaaaggctaggcagccagtcatgctccct

SEQ ID NO: 6840814 - DNA, 75 bp, Homo sapiens
ttgcttgagcccaggaattaagctcgcagtgagctacgatcatatcactgcactccatcctgggcaacagagcaa

SEQ ID NO: 6840815 - DNA, 60 bp, Homo sapiens
ggaccatgaggagatgggcctcagaagataaattattctcctttcatccttcagtggtct

SEQ ID NO: 6840816 - DNA, 101 bp, Homo sapiens
ctttgcagtgtcactgagagaggcgtgtcttgcccctggctctaatttgggagctcctggcaaggtcatggtggcccctcttgtttgtgattctgtttaag

SEQ ID NO: 6840817 - DNA, 66 bp, Homo sapiens
gtttgggctgggtctggaggaagggagatacttaactgtgtcccagggaaggcccagcactcaaat

SEQ ID NO: 6840818 - DNA, 81 bp, Homo sapiens
gcaaggttttctgttaaagtgcaggctactcagaagttattttcagagtcagctctgccttaatatttcaaacagtcttgt

SEQ ID NO: 6840819 - DNA, 74 bp, Homo sapiens
gaagaaacaggtgttctttttgtactccagagaaacttctcctgagcccagataaagtacaaccatgttttttt

SEQ ID NO: 6840820 - DNA, 57 bp, Homo sapiens
ttgacctgggcacagtgagcatgagatacattttgttgtaatcgctgtttaggtcaa

SEQ ID NO: 6840821 - DNA, 66 bp, Homo sapiens
acctgtaggaacgccttcatttgctttatttctgacattaaatttgcaaaaaggcactttccaggt

SEQ ID NO: 6840822 - DNA, 85 bp, Homo sapiens
gtgaggatgtagaccagggcagcaatgcagctgctgctgatgaaggccaggagcatgtcattgttgaacgtcctgcgcacttcat

SEQ ID NO: 6840823 - DNA, 117 bp, Homo sapiens
cagcgagaaaataaaataaatggaaaagtggattatgatcgtgaaagattggcttatacagcatttgataggaacagtttcaggatgttttccccccttcaatttgtatttttcctg

SEQ ID NO: 6840824 - DNA, 68 bp, Homo sapiens
ggatttggcaggtggagacagcagagcaggttatgacaccagctttgtcttcccacgtgtggatcacc

SEQ ID NO: 6840825 - DNA, 61 bp, Homo sapiens
agtccactgcttatagtagcctaggcttttgataagctatagttgcttcaggctgtgtgct

SEQ ID NO: 6840826 - DNA, 62 bp, Homo sapiens
tcttcagtcaatccagatgtttggcatcttgtagacaaaacatccagatgattaactgaaga

SEQ ID NO: 6840827 - DNA, 61 bp, Homo sapiens
aggaggctgtgggcatcgggatcctgtttgttcttgctggcactgcctggcccggcttcct

SEQ ID NO: 6840828 - DNA, 77 bp, Homo sapiens
tctagacaaagcgctctgagctgaaacatgagcatgcacacatatgcatctctctcggtctcatgagataatctgga

SEQ ID NO: 6840829 - DNA, 66 bp, Homo sapiens
gccccttccctggtagaagttttggatgagttgagggagagactgtccagctccagggaggcaggc

SEQ ID NO: 6840830 - DNA, 88 bp, Homo sapiens
cccatccctgggccagccagcatttgccataccgctggagagacatctgacccagcacagtgcagatgctgactggctctgtggtggg

SEQ ID NO: 6840831 - DNA, 78 bp, Homo sapiens
tgcacagatgacaggaataactatgatggtcttaggcacaacaggatgtatggttccccttgtcagataccctgagca

SEQ ID NO: 6840832 - DNA, 78 bp, Homo sapiens
cagtgtgtccctgatggtggggctctggggtgtttccttagcagcagcctagagtctctctgcaggagtttcactctg

SEQ ID NO: 6840833 - DNA, 71 bp, Homo sapiens
ctgatgggtcatgtactcagcttttagacaggcataactttatgtccttttaaaatgtgagaacctaccag

SEQ ID NO: 6840834 - DNA, 79 bp, Homo sapiens
gcttggctgaagaggttggtgagtggtagagctgggtcactgtggctcttccgccaccagccacaccttccatggaggc

SEQ ID NO: 6840835 - DNA, 80 bp, Homo sapiens
cttttaatgtttataactcaacttggagggttcttttccaatggattcaggagccacttaggtgagataaacaaggagag

SEQ ID NO: 6840836 - DNA, 92 bp, Homo sapiens
gtgaatgtctttgagaaggcatcttcaaaattgccaaatcgtccccttaggataaatttctagcagtgaacttgcttgctcaaagattacac

SEQ ID NO: 6840837 - DNA, 89 bp, Homo sapiens
ggagcatggagggcagccaggagcctctgcaactatctccatctcatggtaaaaatctctagtcagagtcttctctgttgtccagcttc

SEQ ID NO: 6840838 - DNA, 81 bp, Homo sapiens
gcccagggaaggtgcggaacagtggtgtcctgggctgcccccttgccctttcactttaatctgacaccttagctcctgggt

SEQ ID NO: 6840839 - DNA, 86 bp, Homo sapiens
agcatggggcattattagaggtgttgacgccaaggtagacacatccatgtatatctttgcaaatatctctaagtgtttcttgtgct

SEQ ID NO: 6840840 - DNA, 62 bp, Homo sapiens
cctcacaagctggaggttggagctactatcaatatagtggagagaccaattagctgaggagg

SEQ ID NO: 6840841 - DNA, 69 bp, Homo sapiens
gggtggtgctcagcacgccaaaatcttagcccagagcttgggtgcaagggttgagttgagtgtagaccc

SEQ ID NO: 6840842 - DNA, 58 bp, Homo sapiens
tttagttctgagacagtgggaaggtattttcttctacttctaactgtccaagattgaa

SEQ ID NO: 6840843 - DNA, 82 bp, Homo sapiens
ttttcttaggctcatccccacaaagcaaagcctactagatttaactgctagtagatttttgggaaggtgatcttaatgagaa

SEQ ID NO: 6840844 - DNA, 69 bp, Homo sapiens
gccaaaaaccagaggcgctgctgagtgttggcgtgggaatgctagtttagtcagagccttgctctgggc

SEQ ID NO: 6840845 - DNA, 79 bp, Homo sapiens
atttcttctgacaggaaacatgcagtgattaataaaagcgcctccttgagcactgatttatttttgtctctgaaggaat

SEQ ID NO: 6840846 - DNA, 65 bp, Homo sapiens
catttatgagaaactgctttgtgatatgtatattcatctcacagagttaaaagtttcttttaatg

SEQ ID NO: 6840847 - DNA, 97 bp, Homo sapiens
gggagctgttgcatatgtaagcaggtggttcacctaaaagttggatgtaacgtagttaacgccagctcttggtgcacttacatattgcattgcttcc

SEQ ID NO: 6840848 - DNA, 91 bp, Homo sapiens
ctaagagagtctagttctcttctttggggtgggctcacgttaaagttagaagtcagaaggaagagaggaaagattagaaaacctctcagag

SEQ ID NO: 6840849 - DNA, 60 bp, Homo sapiens
aggacagtggcaaggcaggacactagtgaagagtgccaggaaagagccttaccctgtcct

SEQ ID NO: 6840850 - DNA, 81 bp, Homo sapiens
gcttcacagacatctcggggaagagagttcctggcagagggagctgctagtgcaaaggccctgagatggaactgtgctggc

SEQ ID NO: 6840851 - DNA, 85 bp, Homo sapiens
tttgagccaggtcagcccttgatgtttgggggtgcagagcacagatggacccccattccatagggctgaatccttaaggcttaga

SEQ ID NO: 6840852 - DNA, 61 bp, Homo sapiens
gcgcgcaccctctgagctccgctccgtgcgaagcggcggggctgagggctcagggtgcggc

SEQ ID NO: 6840853 - DNA, 82 bp, Homo sapiens
gtccttgctattgtgaatggtgccgcaataaacatacgagtgcatgtgtctttatagcagcatgatttataatcgtttgggc

SEQ ID NO: 6840854 - DNA, 55 bp, Homo sapiens
gtggcttacttgtcatttctttaggtcttgccttcccaagtagatcatgagccac

SEQ ID NO: 6840855 - DNA, 89 bp, Homo sapiens
gatttagataacacgtttgaagtacttcctttggctgcacctgaagtgtggattcctgattagggggctttaagtgtggcctaattttc

SEQ ID NO: 6840856 - DNA, 74 bp, Homo sapiens
gatgctggctcagagaacctgggtaacggaaaggagaggcagcttttcccactcactgtctctgacacaagctc

SEQ ID NO: 6840857 - DNA, 63 bp, Homo sapiens
gcctccctggcccacagcagcggctgaggagagcgcaggggctgctgctctggccagggaggc

SEQ ID NO: 6840858 - DNA, 103 bp, Homo sapiens
tctctctcttacccaccttcactttggagtccatgctgtcctgtggatgggtgtgtgggtcttccaaagaagggcttcgagggtaacatctacagcagggaga

SEQ ID NO: 6840859 - DNA, 85 bp, Homo sapiens
tagctccaggtgagtttgtctcttagctccttaagagaggcttagatctctttagggaagcatggaggagatggtatttgagctg

SEQ ID NO: 6840860 - DNA, 59 bp, Homo sapiens
caggacagttggcatctgctgcttcatgaattgtttgtagcagagtggcagctcttttg

SEQ ID NO: 6840861 - DNA, 69 bp, Homo sapiens
ggagatgagggatgccccagctgacagaggcccagctgggctactgactcactgtggctcttaatctcc

SEQ ID NO: 6840862 - DNA, 56 bp, Homo sapiens
tgtgggctccccctcactctgttctggggatccttgcagactaggaagagctcaca

SEQ ID NO: 6840863 - DNA, 75 bp, Homo sapiens
ggagaaggccagtggggagtttccagatgtgtcactcaaaagacaaaaagctccattactgtcctcactttcttc

SEQ ID NO: 6840864 - DNA, 72 bp, Homo sapiens
gtgtgtgtggctaggcctcaggcctgcctggctggcctccagctgcaggagagctggtctggccccagccac

SEQ ID NO: 6840865 - DNA, 70 bp, Homo sapiens
gcagaggtgctagggcaggaggtgaggaggatgggaaaatccccagcctttgcttcctggttccctctgc

SEQ ID NO: 6840866 - DNA, 71 bp, Homo sapiens
gtggcccagggtctctgctgcctgagacttggccattgaggacttgcatctggggtgtagacttgggccat

SEQ ID NO: 6840867 - DNA, 75 bp, Homo sapiens
tagaattttctcctttgaaaagtgagatatttgagctacatgttttggtatgtcctgttcagatcagagatgcta

SEQ ID NO: 6840868 - DNA, 101 bp, Homo sapiens
tgttcagtgacttgcacaccagttttgatgtggacatcaaacacaactacttaatgagatgccacaaaactgtgtgtcaaagaacatgtcaggactgaaca

SEQ ID NO: 6840869 - DNA, 67 bp, Homo sapiens
ctccacatgacctagattaacattctgtgaaatgcaaattttataaaatgtgttttaggaaacgggg

SEQ ID NO: 6840870 - DNA, 82 bp, Homo sapiens
tgatgtattaataactgaattttgcagaactgataggtttcttggatattttgtctgctaatgtggttatttctagacatca

SEQ ID NO: 6840871 - DNA, 110 bp, Homo sapiens
tcttgaattcttaaaatatccttccagctggctttgaaggtctttcctataagaaagccttttagaaaacgccttcaaaattacacagaaggagattttattattctaga

SEQ ID NO: 6840872 - DNA, 69 bp, Homo sapiens
catctgaaattcttcctccagctgtctcgatagcgatgcttgacagactggaggagaatagtttgaatg

SEQ ID NO: 6840873 - DNA, 82 bp, Homo sapiens
ggctgtcggggttatgaggggagtggggctgtggccaggacagggcggccccgtgcctggctctctgcagatcctggcagcc

SEQ ID NO: 6840874 - DNA, 130 bp, Homo sapiens
gactattctgcttggatggttatgtgagattttttgggtcttgttgaagtggccaaactgcaccttagtgagtacagtttctacgacttaagcacagaatccagatacatcacagccaagcagaacaatc

SEQ ID NO: 6840875 - DNA, 79 bp, Homo sapiens
tcccagccactgcttggatccttacagttagacgttgggttcctcctggagctggacctgggggcaggcagggttgggg

SEQ ID NO: 6840876 - DNA, 109 bp, Homo sapiens
atgctgagtggtgtttactgctcattagctcagatacctctgagagattctgcctaaactactataaatctcttatttgagcagcaagtagatagccatgaatatgcat

SEQ ID NO: 6840877 - DNA, 69 bp, Homo sapiens
gggagtcaggcccatctcattctccaggcaggactgaaactgggcaggcaagaatttgggtctgacccc

SEQ ID NO: 6840878 - DNA, 59 bp, Homo sapiens
gttagcaattgcttaagactaggctaagaaattacttcctcttgagaacaatttctggc

SEQ ID NO: 6840879 - DNA, 66 bp, Homo sapiens
gccctggtgtgcccagcatgggctcctgggtgcaacactgggagattgcttagggcacaaggaggc

SEQ ID NO: 6840880 - DNA, 77 bp, Homo sapiens
ctgcctagcattcagaactgagagcaacacatttctgttgtttacaagttactcagtctgaggcattgttacagcag

SEQ ID NO: 6840881 - DNA, 76 bp, Homo sapiens
ggtgctcataaatgctccgcttggtccttcacatttgtgttccacacaggagaagccaagttgtgagcagtgcacc

SEQ ID NO: 6840882 - DNA, 64 bp, Homo sapiens
gtgggccagttcctcacaggtataggattttttaatttcctctcttggagactcttggccacat

SEQ ID NO: 6840883 - DNA, 82 bp, Homo sapiens
gtgtttaattctgtatggaaacatcctccagcagctcatttgcttctgatattctctgaggatttccatagattctgatcac

SEQ ID NO: 6840884 - DNA, 60 bp, Homo sapiens
ttcagctctgggtactgccgcagcaggtgagcttgtgtttggtccctttcagagtctgga

SEQ ID NO: 6840885 - DNA, 74 bp, Homo sapiens
ctagatctttttctgccatgtgagaatacaacaagaagttagcattctgcatcccagaagaggacactcactag

SEQ ID NO: 6840886 - DNA, 65 bp, Homo sapiens
agagtggcagcaagtcaggtagactaaggattctacaggattctgactcctggctctgtcatttt

SEQ ID NO: 6840887 - DNA, 63 bp, Homo sapiens
gagggaaaggttaatacatgatgttaccttgtatgagcaacagaatattttgcctttctcatc

SEQ ID NO: 6840888 - DNA, 70 bp, Homo sapiens
atcacccaagctggagtgcagtggtgcaatctcagctaactgcaacctctgcctcctgggttgaagtgat

SEQ ID NO: 6840889 - DNA, 70 bp, Homo sapiens
ctctacaagatctatgaggacaaagacctcatttaaatttttctttgtatttaatagctgtcttggggag

SEQ ID NO: 6840890 - DNA, 56 bp, Homo sapiens
cctgcttcttggctgcccctgccggaaacacgcagggcccaagcctggacagcagg

SEQ ID NO: 6840891 - DNA, 56 bp, Homo sapiens
cctcccggatcatgtcccgcacaaacctggtgtgtttggtcagacgtccggggcgg

SEQ ID NO: 6840892 - DNA, 78 bp, Homo sapiens
ggttacccggaaagctctgcttcagcctgcagctcagccttgcttggctccaggctgtgcatgagtttaggtctgacc

SEQ ID NO: 6840893 - DNA, 103 bp, Homo sapiens
gagttggtatgaatgcgcgtttgggtagaaacaaggctggactgggtaagaaccttcacaggcagttctcattttacccagaggctgtttttttcctttgctc

SEQ ID NO: 6840894 - DNA, 70 bp, Homo sapiens
tggtggacacgttcccaggccctcgcggggatctgttgaacccagggagcttggagaacgggcagcatca

SEQ ID NO: 6840895 - DNA, 65 bp, Homo sapiens
tttgggagaggaatagctcaaattagttccataagcaaattgggaaatttctctagctctccaaa

SEQ ID NO: 6840896 - DNA, 59 bp, Homo sapiens
gggatcaggtgaagtcactgagtgggtctttacctgaggtcacaacttcgcttgattcc

SEQ ID NO: 6840897 - DNA, 71 bp, Homo sapiens
tagaagaaagtagaataactacaactaagttttcaataaattggtttgagttgtctctataatcttttctg

SEQ ID NO: 6840898 - DNA, 115 bp, Homo sapiens
gatgtacaggaaatggatatagtgctgtggatactgagagatcctccagcctggaagttggctgccctcaaaatgcatctcgttaccatagccttgtccctttgttcttgtcatc

SEQ ID NO: 6840899 - DNA, 65 bp, Homo sapiens
tcagagtggtgcaagggcagtgttgagatgctttaagcagcagcctgagctttagcactatttga

SEQ ID NO: 6840900 - DNA, 88 bp, Homo sapiens
taagggaaaggagccaactttgtgtctgttaataattattcccactgaatgatgcaagtcagatataatagactactcttatttttta

SEQ ID NO: 6840901 - DNA, 56 bp, Homo sapiens
tgcatacagtgtatgttgtgtctatttgtgtaaccatgacatacattctgtctgca

SEQ ID NO: 6840902 - DNA, 81 bp, Homo sapiens
tccttgttcaggcagcagggcactgtgagatgtggctccttggccctttccagccaccaccttgattgcctgctacaagga

SEQ ID NO: 6840903 - DNA, 57 bp, Homo sapiens
tacattttatgatctgaacaatacactttgcaagaggtgtcagatacataggaagta

SEQ ID NO: 6840904 - DNA, 83 bp, Homo sapiens
gcacaaattcattaataagtctaactctccttcagccataaggtatttggagtgagagacatgttaacacatgagttatgtgt

SEQ ID NO: 6840905 - DNA, 65 bp, Homo sapiens
acttgctcaaggtcacacaggggtgattgatggggtcacccagactgtctgactcttgtgtgggt

SEQ ID NO: 6840906 - DNA, 82 bp, Homo sapiens
tgcactggctttcccttaaatagttctccagtgattctttccagctggagccactttttatcctttggtgggaagtcttgca

SEQ ID NO: 6840907 - DNA, 107 bp, Homo sapiens
gttgtctgggagggtgcaaggtgtgtgaacaatgttctatattttgatcagggtgctggttatacgggtgtagacacatgttcatctaactgcacccttaggattac

SEQ ID NO: 6840908 - DNA, 76 bp, Homo sapiens
ccatgtgacagttcggtttcctgttcaaactattgaggcagctccagcccagaccagaaggaagccgacaacatgg

SEQ ID NO: 6840909 - DNA, 62 bp, Homo sapiens
ggtggaggagccgggggctgaggaagggatgaagccatcccctagtcttccgcgtccccacc

SEQ ID NO: 6840910 - DNA, 64 bp, Homo sapiens
agaggaagcagtggaaaaagccctgtggactctctgggtccccagggaagccatttctgacttt

SEQ ID NO: 6840911 - DNA, 55 bp, Homo sapiens
gggggtaggcagacaaggacatgattaaaatagtgtcacgtcttcacatactccc

SEQ ID NO: 6840912 - DNA, 57 bp, Homo sapiens
tgacatctgtttggtgaagtcttctctgactccccagagaatccccagacagagtta

SEQ ID NO: 6840913 - DNA, 69 bp, Homo sapiens
agggaagattgcttaactaattaattatagatttgttaattgcagttaaagagtttggctttcttccct

SEQ ID NO: 6840914 - DNA, 87 bp, Homo sapiens
cccagaagactcttgagatgcaactggggcttgcccctgaaaggaggggaagcaaaatcatcagtcattttccatttgtgttctggg

SEQ ID NO: 6840915 - DNA, 77 bp, Homo sapiens
gaggtaagtcatggcatggtggcactcaataaatgtgtcaactacatttattggagtctgctgtccttttctacttc

SEQ ID NO: 6840916 - DNA, 69 bp, Homo sapiens
aggaaggctaagggatgactggagtggcagtttcaggccctaccaaagtctccattagccaactttcct

SEQ ID NO: 6840917 - DNA, 69 bp, Homo sapiens
tccttccaagtgctgctttttccttgactgttgtaattatatctatgaggagagggaggattgtgagga

SEQ ID NO: 6840918 - DNA, 83 bp, Homo sapiens
ggtaggactatggtgtggggatcttctgtatgccaggtacacatgcataatgcatgcacagatcctggcacttagtcaatgcc

SEQ ID NO: 6840919 - DNA, 75 bp, Homo sapiens
gtgtgtgtgtcctgtgcccagaccctctgtgtgtcttctccatctcacacagacagtcccataggactcacgtgt

SEQ ID NO: 6840920 - DNA, 75 bp, Homo sapiens
cagacttatgaagtcagacataattctaacattgttatataatcagatttatctgtctggcagtggcagagtttg

SEQ ID NO: 6840921 - DNA, 65 bp, Homo sapiens
gtgatagtggctgccaagatataattcctagtctgacagggcttgagatatggcagtcaaattac

SEQ ID NO: 6840922 - DNA, 106 bp, Homo sapiens
gtgtgtgtgtgtgtgtgtgtgtgtgtgtgtaatgcttattgtgcttattgtgtgtcaggcactatgttagtcattacacttacatacgatgcatatatatatgtat

SEQ ID NO: 6840923 - DNA, 74 bp, Homo sapiens
gacccatcgatggctctagaactgttcagaaaactctgtatgggttggctggaatatgtggagaccattgggtt

SEQ ID NO: 6840924 - DNA, 59 bp, Homo sapiens
gaagcaatagaatttaaatgcagtggctttgtaaattgccactacagttctataacttt

SEQ ID NO: 6840925 - DNA, 58 bp, Homo sapiens
gaggaggtcgctgctgagcccctacctcactcagtgaggtcagctggcaggcctcctc

SEQ ID NO: 6840926 - DNA, 81 bp, Homo sapiens
ccctgagaggccagctccagcccatctgctcgtgtgcagcacatacagcgtatagactgggctcagaagagcagtctaggg

SEQ ID NO: 6840927 - DNA, 59 bp, Homo sapiens
atgggcagcagctgtcattttctctggctatggctgaggaagagccagctgctgtgtgt

SEQ ID NO: 6840928 - DNA, 62 bp, Homo sapiens
actgcttcaactgagctctatctggcctgcaatcgctagatatgatgagtcacttgagtggt

SEQ ID NO: 6840929 - DNA, 57 bp, Homo sapiens
ggaagggtgtcagggcgtcatgagtgttgcagctatctgatccctggcggcctttcc

SEQ ID NO: 6840930 - DNA, 64 bp, Homo sapiens
tgacaacacaggtctaactctcctcagataccctgattgatggaatgtttacctgtgaatgtca

SEQ ID NO: 6840931 - DNA, 83 bp, Homo sapiens
ctaagaggtcaacacagcagcatcctatttcactcctacagcagccccaagggggaagtggtgacctgctcaagatgtcatag

SEQ ID NO: 6840932 - DNA, 99 bp, Homo sapiens
ctgtttccttaataggccacttccctccaaggattcagggaccattcatcaccgtggtgcctagtccccaggaggtcagtggcctgctgcggtgctcag

SEQ ID NO: 6840933 - DNA, 88 bp, Homo sapiens
tagctacagccttagctgatttgtcaaaatgtattatagcaactctgttttaatatctcaccatgacaaagcagtaaagctctggtta

SEQ ID NO: 6840934 - DNA, 63 bp, Homo sapiens
tgcagtcatcagtcctttaattagtctcaaataacaggttaaatagtggatttggtgattaca

SEQ ID NO: 6840935 - DNA, 59 bp, Homo sapiens
ttttgtatgctctgaattttcaagtttaaatttgagaaagtgaatacagagatacagaa

SEQ ID NO: 6840936 - DNA, 73 bp, Homo sapiens
cttggtcacatggtgaaaagcagggctttggtaaaattccatctaaactgtgcttgccaaaccattgagtagg

SEQ ID NO: 6840937 - DNA, 58 bp, Homo sapiens
acccaggctggagtgcagtggtgcaatctgggctcactgcaacctccacctcccaggt

SEQ ID NO: 6840938 - DNA, 55 bp, Homo sapiens
tctggcccagcccctgaggtcaggtggatgatctatgctggttggttggactagg

SEQ ID NO: 6840939 - DNA, 74 bp, Homo sapiens
ataatgtatattagatgtaactttggatgagtgtgagtaccctccacttaagcagttaatttatcttacattat

SEQ ID NO: 6840940 - DNA, 87 bp, Homo sapiens
ggctgagcagagcaggcattctagtggctgaaggagatttctctttctgtttccctttctactctctatgcctgcctctgcctagcc

SEQ ID NO: 6840941 - DNA, 57 bp, Homo sapiens
agtagtttgggcagtgacagatggaagcccagatgatccctgattgccttgactcct

SEQ ID NO: 6840942 - DNA, 60 bp, Homo sapiens
aggtgtggcttgaagtctctatggggacagcccctataaatggagactcagcccatgcct

SEQ ID NO: 6840943 - DNA, 69 bp, Homo sapiens
cacttgtggctggggagtcttgtgtctgccctattgcatatgtcgaggctcccctagttattgttggtg

SEQ ID NO: 6840944 - DNA, 97 bp, Homo sapiens
gtgtattttttcatgatcttagggctaagataaggagagtgctagtaaaatttactgatgcaaatttatttcagtaataaagattatggaggaacac

SEQ ID NO: 6840945 - DNA, 59 bp, Homo sapiens
agtgtcctggcaagggtttcagggtttcaaaaacagattccactaacccctaggacatt

SEQ ID NO: 6840946 - DNA, 84 bp, Homo sapiens
tgcctatacttatgggactctggtgacttgacctgtatttgtgatgctggggtgaaaaactagagtaataggagtgtgagagta

SEQ ID NO: 6840947 - DNA, 84 bp, Homo sapiens
agcttggtcaagattacacactggtgttttgtcagtacaattcagaaaataaaatccagcaaataatgtgctcttcacaaagct

SEQ ID NO: 6840948 - DNA, 77 bp, Homo sapiens
cctgtctggctgtgtccacagagtaagctgggaccatggcgattatccagcttatttgaatcttacaggcagccagg

SEQ ID NO: 6840949 - DNA, 72 bp, Homo sapiens
aaccctgacagaactttttcacatctcctggatttcaaccaggtaatttctgagatgttctgctccttagtt

SEQ ID NO: 6840950 - DNA, 104 bp, Homo sapiens
agtttgggttctcattatctagcatattccttggcaaaaaatatatgtctatcacatgtttctttgatgagtaaggggatgagaaggtaataggattataggct

SEQ ID NO: 6840951 - DNA, 67 bp, Homo sapiens
tagaagtttttggcctggattttaatcaacacaaccattgttttcaagtcaaggccaaattcttgtg

SEQ ID NO: 6840952 - DNA, 85 bp, Homo sapiens
agtaggagaatattgcaaatgaccattgccacatctgaccctatttgtgtctatgtggcattcttggtcatttctgtctcttatt

SEQ ID NO: 6840953 - DNA, 78 bp, Homo sapiens
ttaaataaattaatacacatcatacactgggattagtgtctggcccacaggagtgtgtgagtgttaactaatatttga

SEQ ID NO: 6840954 - DNA, 105 bp, Homo sapiens
gtgtcatcatggtcctccttctgcccccgtgagattggagtttgatgaggccaggtaacaaataaatgcctgtgtaaattctagctacggtgggtccatagacac

SEQ ID NO: 6840955 - DNA, 64 bp, Homo sapiens
ggacactgtgctagctgggcttatccttcttactgggatggcagaagcacaacacggcaagtcc

SEQ ID NO: 6840956 - DNA, 65 bp, Homo sapiens
gtcctcaccttttctctgattgctagccaaaggcccaagggagcagagggaggagaggtgagggc

SEQ ID NO: 6840957 - DNA, 79 bp, Homo sapiens
tcttagagtggctctgctgggcacagaaggagggctctgaaactctcccgaattgtgctcccagctgggctctcctgga

SEQ ID NO: 6840958 - DNA, 59 bp, Homo sapiens
gagctgccctgagctttgcatgttcccttgagtgtcttacacaaagctgtgagcagctt

SEQ ID NO: 6840959 - DNA, 81 bp, Homo sapiens
agggccagacttgaatatctgttgtccatgcagaaagtgacccaagtcatttcctcaacactcagaaacatttaaagctct

SEQ ID NO: 6840960 - DNA, 56 bp, Homo sapiens
tgactctggagatccgaaataaagaccctagaggggtttcgtcctccctgaagtca

SEQ ID NO: 6840961 - DNA, 63 bp, Homo sapiens
tcgcattgaccaaaattgaagggatgggggaacagttcacctttggataatttgagtttgcgg

SEQ ID NO: 6840962 - DNA, 56 bp, Homo sapiens
ttaatctttattctttcttagatatgctgtagtatattatgtagagtaagggttaa

SEQ ID NO: 6840963 - DNA, 129 bp, Homo sapiens
gcccctctgcagcaacttctaaaattccttctttaactctttagtttgaaatccacatatgatagggtttaatgcaggaggactaaagggatgaaggacattaaacaggatcaggatgtccatggggac

SEQ ID NO: 6840964 - DNA, 57 bp, Homo sapiens
agggcatgctggaggagagacagggcactagccctgcctctattcctgcctgctcct

SEQ ID NO: 6840965 - DNA, 73 bp, Homo sapiens
cctcatcgtgtccgccatcttggggcgacggccagaagtccagggctaggagcctcagccggcggacgccagg

SEQ ID NO: 6840966 - DNA, 70 bp, Homo sapiens
tcctgtttgccactggcctagtccagggaagagaagctgatggcctggactgggctaatggcagacagga

SEQ ID NO: 6840967 - DNA, 65 bp, Homo sapiens
gttgtagaaatacttgtaattagctaaataaatctcaaatgttttctacaggcagtttctacaat

SEQ ID NO: 6840968 - DNA, 103 bp, Homo sapiens
gggagcccaacatagtaagttcctggggcccaaggcctccagcccagcatgccagtttcatcctgggttgccctgggcctgtgaggtagctgagaggactccc

SEQ ID NO: 6840969 - DNA, 56 bp, Homo sapiens
ctgaagggcaaggaaaggacaataaagtctgtctttctacatcatttgcttctcag

SEQ ID NO: 6840970 - DNA, 89 bp, Homo sapiens
ctacccagtctcagttattcttttatagcaatacaaaacagactaagacagctgggtttctatagaagtagtcaactgtagatttgtag

SEQ ID NO: 6840971 - DNA, 62 bp, Homo sapiens
gcaagtggtgtattgtgagtcttcaagaaacagcaggagggaggtttcacatacttccttgc

SEQ ID NO: 6840972 - DNA, 83 bp, Homo sapiens
acagggacacacttgcatttgagaaagttctcctggcagcagggtgcacagcagaggaagcagattcggggaggtgcccctgt

SEQ ID NO: 6840973 - DNA, 72 bp, Homo sapiens
tcaggctgtgggaatctgtaaacatccagcatgtttacttctctgaatgttttaccctttgcacaaacctgg

SEQ ID NO: 6840974 - DNA, 61 bp, Homo sapiens
acttccagctgattggcatccaggatgggcacctatcactgctccaggacagcatggaggt

SEQ ID NO: 6840975 - DNA, 66 bp, Homo sapiens
gcctgcaacaaagcttagacctaagagatgcatttaacgtagaatttcaatctctctaaggcaggc

SEQ ID NO: 6840976 - DNA, 82 bp, Homo sapiens
ccctgatcagtttgtatatgaaacactttttttcctgccttaaggttggaatctggtaagtttcagacaagtggttgcaggg

SEQ ID NO: 6840977 - DNA, 73 bp, Homo sapiens
caccctgagaatgccttggagagcctagaggccctgagccttgggcctgggaatcggtgcgttgagggaggtg

SEQ ID NO: 6840978 - DNA, 63 bp, Homo sapiens
catttctgtacatgttttggtgagttcaaaatttaaaccacaaacttaaatgtgcaagaaatg

SEQ ID NO: 6840979 - DNA, 61 bp, Homo sapiens
agggccagaggcaccttgcagcaggcgaaacttgtcagcccagcagggtccttctggtcct

SEQ ID NO: 6840980 - DNA, 107 bp, Homo sapiens
gtatatatggtataaagggtgattagacagtgtgtgtatatatggtataaagggtgattagactgtgtgtgtatatatggtataaagagtgattagactgtgtgtat

SEQ ID NO: 6840981 - DNA, 84 bp, Homo sapiens
cttgctgagccttcggggcagcattctgtgggcaggtactattttgtacccattgtacaagctaggaagctgaggcacagcaag

SEQ ID NO: 6840982 - DNA, 70 bp, Homo sapiens
gtttatttctactattttgcctgatttttttctaatcagaaataaggcaagtttttagtggacatggtac

SEQ ID NO: 6840983 - DNA, 65 bp, Homo sapiens
taggtgagaggaaccatgtttagacgagcaacccaagtttcctaacaatggactcctcttagcta

SEQ ID NO: 6840984 - DNA, 81 bp, Homo sapiens
cctgtcccctggggtgggcttcggcccataggccccaatggtggagcagaagggggccctggccgaatccctctggacggg

SEQ ID NO: 6840985 - DNA, 79 bp, Homo sapiens
gctgagtggcatagaagcatatagacttaatgttatctaaagtttataaactgcttatatgcttgaatgtatattcagt

SEQ ID NO: 6840986 - DNA, 76 bp, Homo sapiens
tcaactgttttgttttatctccatggtgctagtacagtgctgagtacacagtatatggtgagataatccatgttga

SEQ ID NO: 6840987 - DNA, 75 bp, Homo sapiens
aggaagtaaggatttaacattcagttgctaacatgtttagatgatggcagcagacccctaagtctaccgcctcct

SEQ ID NO: 6840988 - DNA, 74 bp, Homo sapiens
gggagtcaggagagacctgttctcctgggcccactgattccttcccagggaaacaggaagtttttctcgttccc

SEQ ID NO: 6840989 - DNA, 70 bp, Homo sapiens
tgcaagagggtgttcagtttgtgcaaatcaaccaagctgtatatttataattgggcactttcttcttgca

SEQ ID NO: 6840990 - DNA, 114 bp, Homo sapiens
gctcgaacagattgacagggattttttgttaaagtgcagattgtgattcaggaggtctgggccagggcttgaagttctgcatttctaataaactgagactccctatccatgagc

SEQ ID NO: 6840991 - DNA, 93 bp, Homo sapiens
tggggcatggtctgcctgggaaggggaaggtcctctccagcccccaggcctcagtggagtagtcggctccctcctttctgcagccatgcctca

SEQ ID NO: 6840992 - DNA, 62 bp, Homo sapiens
gtgtgtgtgtgtgtgtgtatgtgtgtgtgtgtgtgtgtgtgtgtatacacacatatatgtac

SEQ ID NO: 6840993 - DNA, 110 bp, Homo sapiens
gtaaggcatagattaattcaccccactattaatgtgtagccaacttaatcccaggctctggattaagtggtccatatgtaacagtattggtgacatctagaagaccttgc

SEQ ID NO: 6840994 - DNA, 84 bp, Homo sapiens
ccctatgatgaagaaatactaggaatattcataatggaaagcctttttgtgtatgtctgtgaatgtcctgtattatcaataggg

SEQ ID NO: 6840995 - DNA, 93 bp, Homo sapiens
cagttatagcaaaactgtacttagcccctccttagttctaggaactaagttctaggaagtaaggagggactaagtacagctttggcataattg

SEQ ID NO: 6840996 - DNA, 55 bp, Homo sapiens
cagctccagccctttgtggttcactgaaaggtcagtgtatggagtgctggatttg

SEQ ID NO: 6840997 - DNA, 104 bp, Homo sapiens
gacaagcaattagcactctctaaggctaagaaattgtgtgttttaaaaaagtaaataaatattgatttccttttagcttgaagagttttgaaactccacttgtc

SEQ ID NO: 6840998 - DNA, 113 bp, Homo sapiens
gccgggtggacatggccgcaggggttgagcgacttgcctttttccgcccagcaggggctgctctaggagaggggcagtccaaggttctgcaggctaagctccacatccccggt

SEQ ID NO: 6840999 - DNA, 89 bp, Homo sapiens
tcctatcacctccccaccacctcaatcattgacatatctggtgctgacagaccacaggaaaggtgtgtcatgatgggaggcatgtagga

SEQ ID NO: 6841000 - DNA, 60 bp, Homo sapiens
ttaaggcattgatatggtgctaagggaaaaatgtattagcacacttgtacaatgccctag

SEQ ID NO: 6841001 - DNA, 60 bp, Homo sapiens
gatgaggcataaacacagtcacaggcctcagcctccacctgggactgtcccatcctcatc

SEQ ID NO: 6841002 - DNA, 103 bp, Homo sapiens
ggcccagggttctaggggaggccatgggcagaatctttgaataagtttcgtggagctccttgtaaagctgctgtcaatgccctgtccttagaccctctgggcc

SEQ ID NO: 6841003 - DNA, 67 bp, Homo sapiens
aaagttcattcagagtcttggcaataggttactctcccttgtcacttaatgccagctcttgtccttt

SEQ ID NO: 6841004 - DNA, 88 bp, Homo sapiens
tcaaggtacacaatgtgatgatttgataaacgtattgggaaatgattaccacaatgaaattaatcaacacatacatcagtacacttgg

SEQ ID NO: 6841005 - DNA, 56 bp, Homo sapiens
ccctgtttatttttggagagaacacatttttgctgcttttcaggagctatgcaggg

SEQ ID NO: 6841006 - DNA, 58 bp, Homo sapiens
cttgccttgggtccgcagtgagctatgtacatctgcgtctgtgtagtgctcaggtaag

SEQ ID NO: 6841007 - DNA, 55 bp, Homo sapiens
ttcagtcccttgcttaaatttacatggctggtaattgacagagcagggacttgaa

SEQ ID NO: 6841008 - DNA, 71 bp, Homo sapiens
gcaactctggatggatatggacagtaagcccacaactacttggcctagagcattctatctccaacaggtgc

SEQ ID NO: 6841009 - DNA, 56 bp, Homo sapiens
atcttaccttctacaggcactgaacatagtgagtccatgcttttagctggtcggat

SEQ ID NO: 6841010 - DNA, 64 bp, Homo sapiens
ctctttccattgcccagcagtaacctctgttaaagtttattgggtgctctggaaatggtctgag

SEQ ID NO: 6841011 - DNA, 115 bp, Homo sapiens
ggaagtaggggcgctggggcaagcatgttgagaaacagattggcaccgtagtccaccaaatgtttgctgcccccttgtggtctcagggagtgctctggctccagaccctttttcc

SEQ ID NO: 6841012 - DNA, 88 bp, Homo sapiens
gagcattttcttggtattttgtttgatggtgttttggagtttttagttcactgagatatttaaatcagacaaagaatggagaatgtcc

SEQ ID NO: 6841013 - DNA, 77 bp, Homo sapiens
atgtaaagggagttacaatgttcttcagttctgtgtaggtatagaaggaccctcgacttgtgctgaaccctttatat

SEQ ID NO: 6841014 - DNA, 56 bp, Homo sapiens
gcctgtaattccctcttgattaagatggtgatattgatttagctgggattgcatgc

SEQ ID NO: 6841015 - DNA, 73 bp, Homo sapiens
ctgagcaagtactgaggagtaagccaagattttccctaaaaataattttaagtttattccagtacatgaacag

SEQ ID NO: 6841016 - DNA, 117 bp, Homo sapiens
tccaccccggactcttggtcactgttggctgacagatctggatctgaacttttcagattgtcttgggttagaatcagagcagaatcttcatcgccttgtgaagggctccgggatgga

SEQ ID NO: 6841017 - DNA, 64 bp, Homo sapiens
ggatgaaaagcccatgtggaagtacaggcctccctggttactgcctttcccaggtttcccttcc

SEQ ID NO: 6841018 - DNA, 67 bp, Homo sapiens
tcctgtcccctggtgtttgttgtatgtgtctgtggtatggctcagcagatggtgtcatgggatggga

SEQ ID NO: 6841019 - DNA, 85 bp, Homo sapiens
aacttacatcagtatctcaaagtggtttatggccctaaaacttggagttataagaaatacctggggttactcctgatgtgttgtt

SEQ ID NO: 6841020 - DNA, 57 bp, Homo sapiens
gtttggacaaggtcctctgaaatgcattaaaatgctaatcacagcatctgtctgaac

SEQ ID NO: 6841021 - DNA, 79 bp, Homo sapiens
ggaatgtttcagaatatcgattcagtgaacttctgttgtacaaagctttatctcattgttgatatgctgtctgcattcc

SEQ ID NO: 6841022 - DNA, 118 bp, Homo sapiens
ccaccgctacacccaaacccgtgggactggttatccccagcacacacagctctctgttgctgcttgtgtttgttagttggcatttgaacagttctctgtggttcaagtgtgagggtgg

SEQ ID NO: 6841023 - DNA, 64 bp, Homo sapiens
ggtcttcaggaggggagggcatgggcaaaggaaaaggctgtaccatgtcctgcttctcctcacc

SEQ ID NO: 6841024 - DNA, 90 bp, Homo sapiens
tctggaagcaggctggtcccagagcattgcctagtacgcccatcctggaaaagcacttgagccttgggccgacctggaggttcttccaga

SEQ ID NO: 6841025 - DNA, 69 bp, Homo sapiens
ccttcacatctaacattgaatggctgattagtgtaaatttatattagtgaccaagcaatttggagaagg

SEQ ID NO: 6841026 - DNA, 57 bp, Homo sapiens
tagtggaggtggtctgtgaactacgttttgaaaaacactaatagccccacctcactg

SEQ ID NO: 6841027 - DNA, 59 bp, Homo sapiens
cttcatcttctctgcatttgagaaggctctccattctgccatgtaggggagttgtgaag

SEQ ID NO: 6841028 - DNA, 129 bp, Homo sapiens
gggggactgctggtgggggatgactggcagaggatgtgcaggtgcagctggatggaagcccttggcattggggctcctgtcatgcatccaaatccccagtgcccctattcctccacccaggtcattcct

SEQ ID NO: 6841029 - DNA, 57 bp, Homo sapiens
tgtcagttctggttggctcccacttgaacctaggtctcaacgacacagagcctgaca

SEQ ID NO: 6841030 - DNA, 63 bp, Homo sapiens
ggacagccgagtggccttctcccccccaacaccggtccaggccattgagactcggtcttgtcc

SEQ ID NO: 6841031 - DNA, 109 bp, Homo sapiens
cctggtgaacttcgattctcatgttctcagaggactgttggtcttagaaagtgggtcgctggctgaatatggggcagtcatttgcaggaatgagtgaattacacccagg

SEQ ID NO: 6841032 - DNA, 62 bp, Homo sapiens
ggccaagaaactatttattgtgggtatccaggctgtgtctgtatgcacaaaatatcctggcc

SEQ ID NO: 6841033 - DNA, 100 bp, Homo sapiens
gctcatacgctgggactttggtgatacagatacggccgagataattattcagctctcgttattgctgtagctctgcacctgatccccgagccattagagc

SEQ ID NO: 6841034 - DNA, 64 bp, Homo sapiens
cagaagtcattttgtggaaattgctttttagtactttaagagcatctgcttaatggcttaactg

SEQ ID NO: 6841035 - DNA, 95 bp, Homo sapiens
gccaatggccacaagttagcaggtggcagaggtgggatctggtaccagccagtctgactccactgccacgctcttaaactccatgccagagaggc

SEQ ID NO: 6841036 - DNA, 84 bp, Homo sapiens
cattaaatgaagcccccagtagtatatcagtggtttccatggcatagctatgattcactttgatgacatacagcttccatagtg

SEQ ID NO: 6841037 - DNA, 84 bp, Homo sapiens
ggaacatatggaactgagcttgccaaactgggcttatcatcaagattactatctcagtttgggaacacttcagctagcatgacc

SEQ ID NO: 6841038 - DNA, 71 bp, Homo sapiens
cacagtaacacagacagccactagtaattgttccctaaaaattctgtgtgggaatgtctgagatgtttgtg

SEQ ID NO: 6841039 - DNA, 59 bp, Homo sapiens
gggaaattgtgtgagatctttgtaatctccaattcagattctctcttaacacagttccc

SEQ ID NO: 6841040 - DNA, 62 bp, Homo sapiens
attttttacctgtggctccccagacaagcatctgatttaagggacttacataggtaaggggt

SEQ ID NO: 6841041 - DNA, 60 bp, Homo sapiens
tccatcatctgggttctcagatggatatggttcccatgtccattgccaatcagaagtgga

SEQ ID NO: 6841042 - DNA, 88 bp, Homo sapiens
atgtgcaaggtcattcttgggtataagcaaggtttgtaatgaggtatctcacatcagattatgctttgcttatgaccgtaagccacat

SEQ ID NO: 6841043 - DNA, 86 bp, Homo sapiens
agaggcatcatccactctgggtcaagtggtactggcagtctcagttttggtatttgcatccagcagtggctacagtgatggcttct

SEQ ID NO: 6841044 - DNA, 121 bp, Homo sapiens
ggatgaatcagctctgaaagaaagaagctcagttcagtcactatcagtgagcctcaagctttggcttatgtaaaaagctcctggagagattgagaaagcttcagattcccaggcctcatcc

SEQ ID NO: 6841045 - DNA, 69 bp, Homo sapiens
ggatagtgggtaggagtgaagacttaagattgtgctaagacattatcagcccgtttctgccttctattc

SEQ ID NO: 6841046 - DNA, 67 bp, Homo sapiens
tggtgcagcggtaaggagagcctgaagggggcagtgtcaccccctggctctggcttcctgttgtcca

SEQ ID NO: 6841047 - DNA, 55 bp, Homo sapiens
tctgagggtgggagaaggagctgagaaccagctaccaggcccagagaccctcgga

SEQ ID NO: 6841048 - DNA, 55 bp, Homo sapiens
gtttgtagttttgtgtagtttggtacaattaaactttgcataactaactacaggc

SEQ ID NO: 6841049 - DNA, 60 bp, Homo sapiens
tgcttttggaaatcctggaattggtctgagcctagagctggcactagcgtttccaaggca

SEQ ID NO: 6841050 - DNA, 72 bp, Homo sapiens
tctgagggatttctgaatccacagctggctagatttagacaaagaaactgtggaatcatcaggtcttacaga

SEQ ID NO: 6841051 - DNA, 74 bp, Homo sapiens
tcttgctccacatgctgagatgatcttgctttttccctgaacagtggtaaatccagtatgtgtagagtctagga

SEQ ID NO: 6841052 - DNA, 68 bp, Homo sapiens
gggtatatgtgcacatcgtgcaggtttgttacatatgtatacatgtgccatgttggtgtgctgcaccc

SEQ ID NO: 6841053 - DNA, 58 bp, Homo sapiens
gtgaattaggctatggcagaggtaggtggataatgtgtctgtgaagtagcctgatcac

SEQ ID NO: 6841054 - DNA, 78 bp, Homo sapiens
gaagctgaagagcattgagctatgacacatttttatggcactccactaattactctctagttcaagttctttcagttc

SEQ ID NO: 6841055 - DNA, 68 bp, Homo sapiens
tggagcttgcagggctaagtcagagcctggcgggagtggcaggttacttcctacttagcccctctcta

SEQ ID NO: 6841056 - DNA, 103 bp, Homo sapiens
tggactctgatctcatactcttgccttatagtgctctgcattggcagaactcagctgaaatgcagaaagcaggtgagcccaatgatgcagaggtcagagttca

SEQ ID NO: 6841057 - DNA, 89 bp, Homo sapiens
gccagtgccaaggaactggaatatttgtaggatgaaaccatatcctgacgggttagtcttcatgtatatccaactgttccttgtttggc

SEQ ID NO: 6841058 - DNA, 59 bp, Homo sapiens
atcatcttgctttctgtttacttctagtaaatttctagagtggacattaacaggatgat

SEQ ID NO: 6841059 - DNA, 108 bp, Homo sapiens
gataaaggattggagacctgagtttaccaaatgtaatcattctaatcgtttgtaaggattagagaatgaatttatgtttgtctgtgaccaacatttccaccttttgtc

SEQ ID NO: 6841060 - DNA, 80 bp, Homo sapiens
agctacagaactatgagaaaataaatatctgttgttttagccacagcatctgtgatattttgttatggcaacctgtagct

SEQ ID NO: 6841061 - DNA, 70 bp, Homo sapiens
tcagttcctggtggtcatggcagctcaaaacaaatgtagggcagtgcaaaatgaacactatggaagatga

SEQ ID NO: 6841062 - DNA, 84 bp, Homo sapiens
gacacgccgcgcgagcaggagctcggataggtcgctttggccggcctggccgctccgagctccgcccctcttcggtggcgcgtc

SEQ ID NO: 6841063 - DNA, 66 bp, Homo sapiens
gtagggccttgttatggtagaaggtagggttgtgcagtctggcagcaagataacaatgggccctac

SEQ ID NO: 6841064 - DNA, 81 bp, Homo sapiens
cctcaaacattatgagcccactggtgaatccccagctccacctctgtacccccattcaccagtgggctgatagtccccagg

SEQ ID NO: 6841065 - DNA, 73 bp, Homo sapiens
ctgccagccgccatgttatctcccagcctggctagggtgcctgctagcctgcagtggctatggtggtgtgcag

SEQ ID NO: 6841066 - DNA, 90 bp, Homo sapiens
aaattttattccatgtcaatttggcctttgtatgcagtatcctagatggattctttcatataaaggctcagtactgaacagaaaaaattt

SEQ ID NO: 6841067 - DNA, 67 bp, Homo sapiens
actgtttaactttcatgcaaaaacttcccagtgtttgggaaatctgtctttgtttgaatagtttagt

SEQ ID NO: 6841068 - DNA, 104 bp, Homo sapiens
ctgcttggactgaaacatccaacatagctttactcaaatgacctggaccttttctagggtagcgggaatggttgtggttggttgtgcctttctgtaccaagtag

SEQ ID NO: 6841069 - DNA, 66 bp, Homo sapiens
ctggtgcacattcgctctcatacacatctaaactgatgctaatagagagtaaagtgatgctatcag

SEQ ID NO: 6841070 - DNA, 81 bp, Homo sapiens
ctcatccttggcgggcaggtatcccagggcagaggtgagaattcagaaagcacttcggagtgcctgtcatgcaggtttggg

SEQ ID NO: 6841071 - DNA, 59 bp, Homo sapiens
tctgagtggcaggttccgtagacagcattttcatggaatattgtcaatctgctttcaga

SEQ ID NO: 6841072 - DNA, 87 bp, Homo sapiens
gctttcactcttctgctttcgagccagcactttttctctgggcacagcactgctgggaggttgtcctggcagcagtcttgagtaagc

SEQ ID NO: 6841073 - DNA, 86 bp, Homo sapiens
atcttctaatctcagttgtttctgtcaaatgccagtagagaacaatcacatctgttttgactgacagcatagctgacaaggaagat

SEQ ID NO: 6841074 - DNA, 56 bp, Homo sapiens
aggctgggctccgcccaactccactcactggagcttgtccttggagcccagagcct

SEQ ID NO: 6841075 - DNA, 55 bp, Homo sapiens
gtgtgtgttggggtgtcagtattcaagcacatgtgctggatgctaaaacacacac

SEQ ID NO: 6841076 - DNA, 76 bp, Homo sapiens
tttatttgcttactgtccattggtatattagggttctccagagaaacccaaccaactggatagatagatagataga

SEQ ID NO: 6841077 - DNA, 67 bp, Homo sapiens
attgttactaattgatttttgaatagggagcacattcccatggttcaaaattcaaatggtatacgat

SEQ ID NO: 6841078 - DNA, 92 bp, Homo sapiens
ggtgagtttcctgggccttgttttggaccagcagccccagtgcctcctttcagagcctagaaggctgggtctgcagagcctgggaaagtacc

SEQ ID NO: 6841079 - DNA, 73 bp, Homo sapiens
tttttcaggatacaaaacgtcttgcagaacttcagaaacaagaggttccaggattcattttgctcctgagaga

SEQ ID NO: 6841080 - DNA, 72 bp, Homo sapiens
gtctgccagtggtttggccctgaacacctgttattcaggtcacacttgtcaggagctagtctagctggagac

SEQ ID NO: 6841081 - DNA, 58 bp, Homo sapiens
gctgggctcaccaggccactagacccccaaatgtgtatttgccttctggtggcccagc

SEQ ID NO: 6841082 - DNA, 102 bp, Homo sapiens
acttcatttataaacagcacagtaggcactggtctaccccttagttatacccagtgacaagcatcagtatccactgcctaggctgtgagtaattactgaagt

SEQ ID NO: 6841083 - DNA, 62 bp, Homo sapiens
aggaatagaccacttcactgagaggcagaacttgagttctatccttgtaaagggctgtttct

SEQ ID NO: 6841084 - DNA, 55 bp, Homo sapiens
gctggccccgagtgctacgctctgaaacccgccattgccttagcacaaggccagc

SEQ ID NO: 6841085 - DNA, 66 bp, Homo sapiens
cttgaatagcttctgcccctgtagcctgagtcttagaataaactcatgtggagcagagctgccaag

SEQ ID NO: 6841086 - DNA, 58 bp, Homo sapiens
tcatgcagataagaataagtaaggagataactaaatgatttggtcaatgtctgcgtga

SEQ ID NO: 6841087 - DNA, 81 bp, Homo sapiens
gaatatgtttgtcttggactgcatcaacacagttggttttctccgagattgagttcatatagttcaagatacaccttgttc

SEQ ID NO: 6841088 - DNA, 68 bp, Homo sapiens
ctgcgaggtgtcccggcctgcggggctcgggcacccggtgcgtcctgggggctgggtcgtgtgcgcgg

SEQ ID NO: 6841089 - DNA, 62 bp, Homo sapiens
ccagaggtggtcatagaaagcaagcccttagtatgagagtctgaaatctgatcattctctgg

SEQ ID NO: 6841090 - DNA, 61 bp, Homo sapiens
gcttcatgcttgctccaaagctgagctctgatttcacaaccagcttggagaagcaggaggc

SEQ ID NO: 6841091 - DNA, 63 bp, Homo sapiens
ccattgaagcttgagtgtcagttcctcttggaagaggatcttgaaccctacaggcttagttgg

SEQ ID NO: 6841092 - DNA, 58 bp, Homo sapiens
agggagaggtctgccacctctaagcctaggagagaggcctggcacagatttcctccct

SEQ ID NO: 6841093 - DNA, 92 bp, Homo sapiens
cagagtcagttcatggtcagctagtggttgcatctgagtattaagagaatgaatgtccagccaaccactggattgagaaagaggagaagttg

SEQ ID NO: 6841094 - DNA, 62 bp, Homo sapiens
gtaatgtgccagagacatgactagctgcctctttggccctggggaagtgtgtctggccctgc

SEQ ID NO: 6841095 - DNA, 68 bp, Homo sapiens
tagagctgctggactgtaacagatatgtattaattggaagtagatgtgacagcttacagcagttacta

SEQ ID NO: 6841096 - DNA, 57 bp, Homo sapiens
ggtgatgctatatttatacgaaagatggtgtgtggttctatatttatgggcatcacc

SEQ ID NO: 6841097 - DNA, 61 bp, Homo sapiens
caaaaagtattggccatggttgaagaccttcattacatttcaggagtgccagtaccttttg

SEQ ID NO: 6841098 - DNA, 86 bp, Homo sapiens
ccaagagactctcgaagattctttttgttagtagggaaaacattttccatttttctgccaactttagggttttcagagaagtttgg

SEQ ID NO: 6841099 - DNA, 63 bp, Homo sapiens
cctattccagttcatgggtgatatcttaatgaggattctttacatcatgtaactggatatagg

SEQ ID NO: 6841100 - DNA, 71 bp, Homo sapiens
aggtctgctatgtgagcaatacatatgaatgtttcaactactattattatttttgttgttgcatgcagcct

SEQ ID NO: 6841101 - DNA, 86 bp, Homo sapiens
ggcaatagggaatgtgtgtgagtttctgagcatgggccttaagaaaccttgcagcttccacatccacactccctcagaatcttgcc

SEQ ID NO: 6841102 - DNA, 59 bp, Homo sapiens
agctggtagatgaacagtagccatccccacttattgagcactatttatatatgccagct

SEQ ID NO: 6841103 - DNA, 117 bp, Homo sapiens
catggggaaactgaggctgagagcagtgctgcagtcacacggctatctcagagcagatgcagaggtgggcccagtgggctccagtgccgctcactccttcagtctgagggcttcatg

SEQ ID NO: 6841104 - DNA, 112 bp, Homo sapiens
atgctcattcccaaaagcaagcatctttctgatgggatatttgagatgcagatgtgaactttgatttttatctcaaaaatgacctagagaaatatatgatgcttatgagcat

SEQ ID NO: 6841105 - DNA, 84 bp, Homo sapiens
ggagatgttacaagttgggtaggaacctggctgatgttgaaaggactcacatttacattttctctggccttctgtaacattttc

SEQ ID NO: 6841106 - DNA, 72 bp, Homo sapiens
atacaacttcctgcagcagtactcagcagccaggcttctgggctgcccgctactgttgcaacttgtctgtgt

SEQ ID NO: 6841107 - DNA, 79 bp, Homo sapiens
attcactgaacattgcattctctatgagatggcatttgcaaatctcataaattcagagaacacaattatgtcagtgaat

SEQ ID NO: 6841108 - DNA, 71 bp, Homo sapiens
ttctgtatgctctgggtccagaaaagcttgtcctcttcagagcagtcactgtgtctcagagcaggacagaa

SEQ ID NO: 6841109 - DNA, 55 bp, Homo sapiens
gccagtgttattcctggggctgaattaatccacagacttcagaattttacctggc

SEQ ID NO: 6841110 - DNA, 61 bp, Homo sapiens
gtcaaaatactgggagcttcaaaaaagttgtttagtggctcttttggagtccaggtatgac

SEQ ID NO: 6841111 - DNA, 82 bp, Homo sapiens
atagcccaacaacctcaggtacactcccttgtgctgatcaatgatcagccattgtcagtgacactggccattgttaacctgt

SEQ ID NO: 6841112 - DNA, 57 bp, Homo sapiens
catttcctctgagtgagctgggagccaacagacggttttgagcaaaggagggacatg

SEQ ID NO: 6841113 - DNA, 130 bp, Homo sapiens
ggcttttgtgattggtcctccttgtcgccttggcccctctggtcctcagtggcagttctttctctcttgctgcctccttcaggagggcccggctcagggtctgggtgttcagggagaagacctcaggctc

SEQ ID NO: 6841114 - DNA, 93 bp, Homo sapiens
gtctccttgtctcctgttacttcttaggcattagtaccttgaaagtttgccataaaatctcagttagggcctcagaagacagacacatgagat

SEQ ID NO: 6841115 - DNA, 69 bp, Homo sapiens
tcaccatgtcatgtgtctttaggtcacagcttcttccccttgatgttgtactatcaccatgtcatgtga

SEQ ID NO: 6841116 - DNA, 69 bp, Homo sapiens
tgcatgtattcttagttttaatcagagctactgactgtggggctcttatgtaaacaaagaataaataca

SEQ ID NO: 6841117 - DNA, 82 bp, Homo sapiens
gctccgggacggctgttccctgcgtgcggccgcgggactgcggacaaagctgcagtgtggtcgggagcgcggggccgggagc

SEQ ID NO: 6841118 - DNA, 55 bp, Homo sapiens
tgcctttactgattagctgtgtctgccatgggctcagaaagagaaagcagaggca

SEQ ID NO: 6841119 - DNA, 83 bp, Homo sapiens
agagtctcttgtcacccaggctggattgcagtggtacaatcttggctcactgcaacctccgccttttaggttcaattgactct

SEQ ID NO: 6841120 - DNA, 67 bp, Homo sapiens
ggaataagtagagttctggattatagtgtggtgaacatatagcaaggtctggatttctgcttctttc

SEQ ID NO: 6841121 - DNA, 57 bp, Homo sapiens
gggagaggctagccatccttcctggccacacagctggatggctccacagtttctccc

SEQ ID NO: 6841122 - DNA, 93 bp, Homo sapiens
cagcttaattggtctaacctttcctgttggtttctgtgagaaagacacatttaaacgtaaagcaggaaggtctgttagtccattcctcagctg

SEQ ID NO: 6841123 - DNA, 72 bp, Homo sapiens
ccgtttgggatctgagagagtcggccatgcagcagccatttgtgcatgcttcccttctcccagccccacagg

SEQ ID NO: 6841124 - DNA, 68 bp, Homo sapiens
gcggagaggcagagactccgcgcgtcgccatttctggactaggctgctgctttctgtgctttttctgc

SEQ ID NO: 6841125 - DNA, 61 bp, Homo sapiens
atcttttcatgccagcccatcacagaggttgcacctatggattggctgcgcttgggttggt

SEQ ID NO: 6841126 - DNA, 92 bp, Homo sapiens
gagtagggaattactgacagtctttcagtaataatactgtctggtacagtgtaggttatctgaaaggctacggatcttcagggtctcttctc

SEQ ID NO: 6841127 - DNA, 81 bp, Homo sapiens
taagggcgttcctgttgttcgcctgcgatggatggcatcttgagctcacatctagcgttaggccgagaaatggggccctta

SEQ ID NO: 6841128 - DNA, 71 bp, Homo sapiens
gtaggagaaagtaaatgtgatttactgatgaagatgccacccccaagtgacccattaaccactttccctgc

SEQ ID NO: 6841129 - DNA, 77 bp, Homo sapiens
gagagcagacacggagcttggctggacctcacggatcactagtccatgtcactgcacaatgttcttcctctgttctt

SEQ ID NO: 6841130 - DNA, 73 bp, Homo sapiens
ggagtcacctggcaggaaggtgggtgatgagacaaaccattttcatccttgctcccctgactagctgagttcc

SEQ ID NO: 6841131 - DNA, 73 bp, Homo sapiens
cttctgtgtgctagttttgtcagtattggtgtcatgaaataattataaggacttgaattagacatttaagaag

SEQ ID NO: 6841132 - DNA, 85 bp, Homo sapiens
cacgctgacctctgtccgcgtgggaggggccggtgtgaggcaagggctcacactgacctctctcagcgtgggaggggccggtgtg

SEQ ID NO: 6841133 - DNA, 73 bp, Homo sapiens
cagttcacatccttgtgaggattttcatttctgttttgctgatgaagaacccaaggcccagggatgtgaagtg

SEQ ID NO: 6841134 - DNA, 72 bp, Homo sapiens
tgactacaatattgtacccagaagtttttggaaacagtttatgtaaattatgggtaagatatgataaagtca

SEQ ID NO: 6841135 - DNA, 61 bp, Homo sapiens
tctctgggacttgatgaaatgactgtcagatcttttgttagtattctacaggtccctgagg

SEQ ID NO: 6841136 - DNA, 61 bp, Homo sapiens
gtttagggtgatgtatgtgcagcaatcattattgacagctggagaagtgcatcacttaaat

SEQ ID NO: 6841137 - DNA, 93 bp, Homo sapiens
tgactctgtctgagggctttatcaggccttgggagcctgcctgacccatgtagggtaggccagaagggcctggaagtaaacacccctggagca

SEQ ID NO: 6841138 - DNA, 57 bp, Homo sapiens
taaaggttagaaagaaattggagttgtaattacttctccagggaatttcaactttta

SEQ ID NO: 6841139 - DNA, 65 bp, Homo sapiens
gaggagagaggggaggcgaaccagagtcttgtatgggtctctggaggatcctcctcgcttgcctc

SEQ ID NO: 6841140 - DNA, 69 bp, Homo sapiens
tcggttgcatttctcagtggaataaaatgcaataaattgggcttgttttgctgagactgatgtgaggga

SEQ ID NO: 6841141 - DNA, 95 bp, Homo sapiens
tgcagtcttaatatccgtgatgtttataaaccactgcttgctggcacgaataaccacaggtttcttggtcctccagtcatacggatagctatgca

SEQ ID NO: 6841142 - DNA, 65 bp, Homo sapiens
gggatcagctgctgatgagctcaagacactgagcatgtgacttagcttctctgcatctgtgtctt

SEQ ID NO: 6841143 - DNA, 92 bp, Homo sapiens
gtgactggctgtattccatactggagtccacagttcactgtctggtgctcagctgggatgagtggacccagttggaatgtaggaagactcac

SEQ ID NO: 6841144 - DNA, 78 bp, Homo sapiens
attaagaatttctagcctaaaacgtttaagtttgaacgactcaacggggagtccttgaatgttttgaaatcatataat

SEQ ID NO: 6841145 - DNA, 75 bp, Homo sapiens
agatcttttcctggatatttgcttaaggttgcagttattaccggtaataaaaccttaacaagatctcaggtttct

SEQ ID NO: 6841146 - DNA, 75 bp, Homo sapiens
tgcgctttaaaagctgccctgtgttagagttcattttacagatgtactcctggcaggcagcctgtttcggtgaca

SEQ ID NO: 6841147 - DNA, 57 bp, Homo sapiens
actcagggcagaaagtttctggagacttccctcccttcagcagcatctgcctagagt

SEQ ID NO: 6841148 - DNA, 63 bp, Homo sapiens
gaatgtgtcagctgtgtacaaagaacaattcctccttgtttagtcagcacagtgatattattt

SEQ ID NO: 6841149 - DNA, 62 bp, Homo sapiens
atagtaggttggagagtccagaggtgaaagtgctggttctcactgtgctcctaactagctgt

SEQ ID NO: 6841150 - DNA, 106 bp, Homo sapiens
ttgcttctgttcacttctctcctcccttcccatccctcttctaaactttgtggtggcagattagttggggtggagaaggatatgggagcatgtagggagaaagcaa

SEQ ID NO: 6841151 - DNA, 63 bp, Homo sapiens
tgagggttcaagactcttgagtatctcaacccacatgtccccattctgagtcttggggtctca

SEQ ID NO: 6841152 - DNA, 59 bp, Homo sapiens
ggccagggggcttcagactccactgtactctgcattccaggattctctgttctctggct

SEQ ID NO: 6841153 - DNA, 56 bp, Homo sapiens
cagtctcatagttgtttcttatgtgaaaataattccagaaggaactatgagaactg

SEQ ID NO: 6841154 - DNA, 57 bp, Homo sapiens
ggacagactaaatggctgtaggatgactccaattattctacccctggtggtctgccc

SEQ ID NO: 6841155 - DNA, 62 bp, Homo sapiens
tctggagaagcagtgagagtcaggttacaaatcacaaagcatttggtaactgcatctccaga

SEQ ID NO: 6841156 - DNA, 76 bp, Homo sapiens
tttggtaccttgctccagcttccctcagctgtggaaaggattcatttggctgtatggctggtctcatggtatcaaa

SEQ ID NO: 6841157 - DNA, 64 bp, Homo sapiens
gctccaggtggcttatttgtatcttatctggtgggtgcctgtgacccctccatctgctttgagt

SEQ ID NO: 6841158 - DNA, 77 bp, Homo sapiens
agacctgaaaagcaaggccaggacaccaggggacttcaggcttcagccttggcccattcctgtcttttcaaggtgct

SEQ ID NO: 6841159 - DNA, 85 bp, Homo sapiens
gggtggctctcggggttctggaacccggttttatggtggcacaccatgaggaagggcacacggaccctgcttagtaagcacgccc

SEQ ID NO: 6841160 - DNA, 56 bp, Homo sapiens
ttgttgcgttgcttgcccatttgttggaccctagcagggcaaagtcaggctaacaa

SEQ ID NO: 6841161 - DNA, 60 bp, Homo sapiens
gaggaaaatgcaacaggaatgcacagaggaatgatgcaaacacttgtggtgttcttcctc

SEQ ID NO: 6841162 - DNA, 61 bp, Homo sapiens
tgctttgctttatggtcgcttcctggattacaaaatcagatagcgtttgagagcataagta

SEQ ID NO: 6841163 - DNA, 69 bp, Homo sapiens
atattgtctctcttctatatggtactttcagtctctcttgtatcatgtccctaaagagaggaacagtat

SEQ ID NO: 6841164 - DNA, 58 bp, Homo sapiens
tgtgcctgttcccactttgccttctaccacgattgtaaagcttcctgggccaggcgca

SEQ ID NO: 6841165 - DNA, 67 bp, Homo sapiens
gtacttcagctctgaggaacactcctttactttcttaaacttttggtcctcatgggttgctctgtac

SEQ ID NO: 6841166 - DNA, 55 bp, Homo sapiens
gtggtagcatgtctggctttttggaggaatcgcaaggaggccagtactgctgaac

SEQ ID NO: 6841167 - DNA, 63 bp, Homo sapiens
gcctgagaaggacacagcaggtcagaggcaggccctcacccttcctgccctgcctcctcaggt

SEQ ID NO: 6841168 - DNA, 78 bp, Homo sapiens
gggtaggcaaatttttattctgcatttgaaaaagattgataatttaataatcattgcagaaataaaggtgaactactt

SEQ ID NO: 6841169 - DNA, 60 bp, Homo sapiens
gttgtagcatgtaatttcatttacttttcatcaaggtaaatgtaaatggcgtcttgcggc

SEQ ID NO: 6841170 - DNA, 84 bp, Homo sapiens
ctctggtactttatgtatgcatttatttgaattgatctatttaaacattagataggtacttaatttaaatgcaagcctccagag

SEQ ID NO: 6841171 - DNA, 61 bp, Homo sapiens
atagtgctgaatttgagaaactctgctagacagcagtgggttctcaaatgttagcatctgt

SEQ ID NO: 6841172 - DNA, 66 bp, Homo sapiens
ctgtcagcatgcctgggctgcctgcctgattagcagagcaaaggcaggaacccaggggtgtttcag

SEQ ID NO: 6841173 - DNA, 60 bp, Homo sapiens
aagagaggatgagcttcagttgggtgacctgtcacacccagctcatccattacctctctt

SEQ ID NO: 6841174 - DNA, 66 bp, Homo sapiens
actagcacagacagaatgagataacccagattgattgatttagctggggctttcattcttgctggt

SEQ ID NO: 6841175 - DNA, 64 bp, Homo sapiens
gctaatagctaccatgttggacagtacagctctgtgctttacttccaagaaagtggtttagagc

SEQ ID NO: 6841176 - DNA, 57 bp, Homo sapiens
agctgggagctgcagtgccgtgagggttatggagccttcagcaccatagctccttct

SEQ ID NO: 6841177 - DNA, 55 bp, Homo sapiens
tgtagtggcagtggtagtgtctgctccataaaggtaaacacagcctctctttaca

SEQ ID NO: 6841178 - DNA, 55 bp, Homo sapiens
ttggaatgcataaacttaaggttttgtcaatgtaaaacctgaggcagtgttccag

SEQ ID NO: 6841179 - DNA, 75 bp, Homo sapiens
gctactgggggctcttccagggaagacgctggcgggaataggatggggctggcagctggggagcctcgcggtggc

SEQ ID NO: 6841180 - DNA, 74 bp, Homo sapiens
atgcaaatttccagaccccatccacagagattttgattttgagagggtctgaggtgtggtctgggagtatgtat

SEQ ID NO: 6841181 - DNA, 62 bp, Homo sapiens
gtaaggaggtggcggtaatggcttcgatttaaatcgactaagaatattgccaccgcatttat

SEQ ID NO: 6841182 - DNA, 57 bp, Homo sapiens
gcaaggcctgaggtgggtgctcatttggtgtgtgtggcaccaaaagaaggccattgt

SEQ ID NO: 6841183 - DNA, 71 bp, Homo sapiens
cttttagctcaggatgacttcaaggaggaagtaaaatttgattaactcatgtcaatttgagcacatgaaag

SEQ ID NO: 6841184 - DNA, 57 bp, Homo sapiens
gaggtaggtgtaggaggcctgcaggtacaaattgaccaggctgttgacggctgcctc

SEQ ID NO: 6841185 - DNA, 85 bp, Homo sapiens
acctgggcatcagttaaaatgcagattcttattctgtaggtctgagtggggcctcagagtctgcatttctgtcagcctcccaggt

SEQ ID NO: 6841186 - DNA, 55 bp, Homo sapiens
cagtagaccgtcccggcagccctgcagtcctccacagctgccaggacagttactg

SEQ ID NO: 6841187 - DNA, 77 bp, Homo sapiens
tgttgcttgcttgactcacattctatttggtcactcagcagatatttactgaggacctgctaatgtgccaagtaaca

SEQ ID NO: 6841188 - DNA, 62 bp, Homo sapiens
gaaataagagtccatgccaggttccctatcaacatgcctgactgtggcatggactctatttc

SEQ ID NO: 6841189 - DNA, 83 bp, Homo sapiens
ggtgttagcatttgctctgcctcacattggctgtgtgaccctgagtacggtgcatggcctctctgggctgtaatgataatacc

SEQ ID NO: 6841190 - DNA, 104 bp, Homo sapiens
ttgtcacttcactttgacctcctggttatcctgcctattttgtaggaaaggaaactgaggcctacaaaggttgggtcaattgtcctaggtcatgtggagggcaa

SEQ ID NO: 6841191 - DNA, 86 bp, Homo sapiens
ctctgtggttggagacagtttaacctctgtagtaggttctgtagttatggtaagctccaggtccagaggttcaactgtgacttgag

SEQ ID NO: 6841192 - DNA, 61 bp, Homo sapiens
cagaattggagagcaacagaatttgagtggccccttcagagaatgtccttcttcatttttg

SEQ ID NO: 6841193 - DNA, 67 bp, Homo sapiens
cccagctgtgcttagccatcacattcaacctgactggtagttgaatcttctagcagagcatgctggg

SEQ ID NO: 6841194 - DNA, 114 bp, Homo sapiens
gcagtctttacgatgactttcttgtagtgtctgatgaggtctgtgtgaaaatttacagttaaacacatacacacacagagagattattcattgtcccaatctcagaaggactgt

SEQ ID NO: 6841195 - DNA, 67 bp, Homo sapiens
atatagttccaggtaattgtgattgttaataaaccttgggtacatttgtgattatctagggctgtgt

SEQ ID NO: 6841196 - DNA, 68 bp, Homo sapiens
gtgtttagcttgatggcccggaatacaaatccagtaaaattggcatgttccagctgtcatttacacac

SEQ ID NO: 6841197 - DNA, 126 bp, Homo sapiens
agggtgtctccttttgttcttgcagtgtcagttggcagtcatcccacttggaaccggcaatgatctggctcgtgttctgggctggggtgcattctggaacaaaagcaagtcacctctggacatcct

SEQ ID NO: 6841198 - DNA, 56 bp, Homo sapiens
tgtactgtattcatctttaactgccctgaggaatgctattaaaggaatacagtaca

SEQ ID NO: 6841199 - DNA, 85 bp, Homo sapiens
ggtttcttactacagatgccttgggatatatggacactggcattacctgctgcaacaggtcctctcccagggtactgctgagacc

SEQ ID NO: 6841200 - DNA, 75 bp, Homo sapiens
ggcggggttgctgagaggatgctgcagtggaggccggggatatctcagcagcctcctggagggtccggccctgcc

SEQ ID NO: 6841201 - DNA, 81 bp, Homo sapiens
aagtggatgactgagccctaagggtcaagcaggcccttgtctatatgcaacaaatgtctcttgtccttgggttttttgctt

SEQ ID NO: 6841202 - DNA, 68 bp, Homo sapiens
gtaatgtataaaccttcatgatggtcattattatttatttgttttggtgaaccttggagggacattat

SEQ ID NO: 6841203 - DNA, 74 bp, Homo sapiens
caaagtcttcagttgattctgatatatccagtttttggacttactgtttgccttgagagtcaataggggctttg

SEQ ID NO: 6841204 - DNA, 57 bp, Homo sapiens
gttcagggcggggtgttcggtgcatcatagaatgcttccagcatccctggcctgtac

SEQ ID NO: 6841205 - DNA, 64 bp, Homo sapiens
gcccttgattatttctcctcccctgttagcaaaaaattaaagggacaggaaagacgaagagggc

SEQ ID NO: 6841206 - DNA, 102 bp, Homo sapiens
ccacacagcccctctcctccaggaactcacagtacagctgagaaattacctggaaaaggctggaaattgtataagtacctggaaaagactaaggtgtgctgg

SEQ ID NO: 6841207 - DNA, 81 bp, Homo sapiens
gcaatcgatttaggctggtattcacaatatttaaagagtcaccttctgacttttaacaatgtgtgatgctcagaggattgc

SEQ ID NO: 6841208 - DNA, 64 bp, Homo sapiens
gtaccttgatttcctggggataacacttacgtgttcttcattacaagggaaccaaggaaattac

SEQ ID NO: 6841209 - DNA, 86 bp, Homo sapiens
atggttgcacctgtggtcccagctactcaggaggctgaggtgggaggattgcttgagcccaggagttggagaccgcagtgagctat

SEQ ID NO: 6841210 - DNA, 66 bp, Homo sapiens
gccagattctgggagtggggtgattagagggcctggaagccacttagcctggcacccggggctggc

SEQ ID NO: 6841211 - DNA, 57 bp, Homo sapiens
aggtcataaaattaagataatggcagaaatgaaaggagtctttatgttttatgacct

SEQ ID NO: 6841212 - DNA, 68 bp, Homo sapiens
ccagtgttctggtgttcatttcaccaaggaaacccttattttaaaaaatgaatattaacagcttctgg

SEQ ID NO: 6841213 - DNA, 63 bp, Homo sapiens
agccctgcacagttcgggaggagcgtggcctcaggggaacgcaggcccagggctgccagggct

SEQ ID NO: 6841214 - DNA, 69 bp, Homo sapiens
agggccccactgagagtcagcttctcctccttcatctgtgtgggcaggaacaagcaggctctgggccct

SEQ ID NO: 6841215 - DNA, 74 bp, Homo sapiens
tggttaaatgagggctgacatgattgggagagttgcctgcagtgtgtcttgttctgttcagttcttatttatca

SEQ ID NO: 6841216 - DNA, 64 bp, Homo sapiens
agtctctttctaaataaggtcatattttaaagttccaagtgacataaattttgggaagggcact

SEQ ID NO: 6841217 - DNA, 84 bp, Homo sapiens
atgttgaatgtataatatttaatgcttttggcatccctgaaaattgagagcaaaagagtattggaatatattactgtttaatat

SEQ ID NO: 6841218 - DNA, 76 bp, Homo sapiens
gattttgaaggcaacggaatgatttgcagttagggataggacagacctcttaactgtatcatactgtttcaatatc

SEQ ID NO: 6841219 - DNA, 60 bp, Homo sapiens
ccaggcttggtccattctggaagaagggcatggccctgacttctcaggggcctggactgg

SEQ ID NO: 6841220 - DNA, 65 bp, Homo sapiens
ccatgatggaagggacagaagggcaagagaactctctctcttcaaccttgagcccttttataagg

SEQ ID NO: 6841221 - DNA, 58 bp, Homo sapiens
ttttcagtagagacggggtttcactttaaggagtgtggagtgagctgctctgtgaaga

SEQ ID NO: 6841222 - DNA, 88 bp, Homo sapiens
tagtcctttatggtgtgattgcccagcaccattgttcgttcaaaagatctgagagcaagggtcttgggcttacgttattaaggcgctg

SEQ ID NO: 6841223 - DNA, 72 bp, Homo sapiens
gcccttaacacccactcacatcacagagcccccatgaggtcttcctgtgaagatctgggtgctgaaattggc

SEQ ID NO: 6841224 - DNA, 55 bp, Homo sapiens
agccatcctactacctcagcatgaaacatgttgtgagagggtaaagtagtatgct

SEQ ID NO: 6841225 - DNA, 55 bp, Homo sapiens
acttcagaatgcggagcaggctttccaacagtctgccttccccataatctgatgt

SEQ ID NO: 6841226 - DNA, 72 bp, Homo sapiens
cctttggggtccacaacagccggctgtccccagacttgtgtccagggaagatagtgttgagggccctcaagg

SEQ ID NO: 6841227 - DNA, 83 bp, Homo sapiens
ggaggatgtggtctcataggcagaattgttgaatgaagtgctaaggtttttctgacttctgtttcgggtttccatattgctcc

SEQ ID NO: 6841228 - DNA, 61 bp, Homo sapiens
gttttaggagtcatggttatttaatatgcttatattaggcattcatgcagctcctgtgtgc

SEQ ID NO: 6841229 - DNA, 90 bp, Homo sapiens
cattctaatatctatctcataactcatttgaagacaccaaagagctacaggccctaagtcttcagtttgagagtggaatacattagagtg

SEQ ID NO: 6841230 - DNA, 55 bp, Homo sapiens
ttttagggtagcatgttcttaactccacggtgccctgggcatgctggctctagag

SEQ ID NO: 6841231 - DNA, 57 bp, Homo sapiens
gttcttcatcttaaccatctgttgcaggctgacagatgggttgatatatgacagaat

SEQ ID NO: 6841232 - DNA, 130 bp, Homo sapiens
cacgttgatagagctaatgaaagctgtcaagtttgaaatgtctctggatttgcttttggcttttgcctgaaagtacatgagattcaaggggaatatttcacctgcgactttgatttggaaaattgaaaag

SEQ ID NO: 6841233 - DNA, 80 bp, Homo sapiens
gtgggcatgctgctggcatctagggggtggaggccagggatgctgccaactatcctaaaatgcacaggacagccgtccac

SEQ ID NO: 6841234 - DNA, 70 bp, Homo sapiens
gggtgtcttccgagggctcggcggccgccgcaggtgcaggcgcctccccaccgccctcggggagcagccc

SEQ ID NO: 6841235 - DNA, 56 bp, Homo sapiens
ggtgttgcagttgaagactggtaagtttgccaatcagatcttccaacactgacacc

SEQ ID NO: 6841236 - DNA, 67 bp, Homo sapiens
ccctgaataactattctgtggactcttatagtcagtgtggtttagtgtagagaacgcaggataaggg

SEQ ID NO: 6841237 - DNA, 74 bp, Homo sapiens
tcccagtgagatgaaacaggtaactcagttggaaatgcagaaatcacccgctttctgtgtcaatctcactggga

SEQ ID NO: 6841238 - DNA, 62 bp, Homo sapiens
ccatagcccagcagggggcagcgcagatcagcacctgctgagggctccccgctgctgtgtgg

SEQ ID NO: 6841239 - DNA, 79 bp, Homo sapiens
tggaagggcacgtcttggctaatttctcctgccttccttaaggctctctagggaacaggaacatattggctctcttcca

SEQ ID NO: 6841240 - DNA, 96 bp, Homo sapiens
gcaaactctgtccttcacgaggaaagccagggtccaggcctgccttctagaggcaggtctgtaagttggcctctctctgtgaagtcatgattctgc

SEQ ID NO: 6841241 - DNA, 79 bp, Homo sapiens
actcttgaggaactgagtaccatgattcgtagaagcagggcattggccgcgagtaaatattgtgctttttctctagggt

SEQ ID NO: 6841242 - DNA, 60 bp, Homo sapiens
gggctagcagattctacctaattgctctccccacatccagaagtaggtggttgctggtct

SEQ ID NO: 6841243 - DNA, 55 bp, Homo sapiens
tcctctgaaatgtgtgttcggctttactaaatctgaacacattttcttcagtaga

SEQ ID NO: 6841244 - DNA, 56 bp, Homo sapiens
tgggcagaggctctgaagtccaccgccttatttggtatggaaatctgtttctctca

SEQ ID NO: 6841245 - DNA, 72 bp, Homo sapiens
aatctgcagtgtaacaggctctacgtctccattaaagagaagtcagtttaattctgtgctacactccagatt

SEQ ID NO: 6841246 - DNA, 68 bp, Homo sapiens
tgctttgtgaagttgattgttatcgtcatgtccaagaggaggtctgacattttatcaatatcacagca

SEQ ID NO: 6841247 - DNA, 90 bp, Homo sapiens
cctcccaccttgaaatggtccttcgtggtgcagttctgcttacggggtagactttgttgccttccacagaggacagttagggtgggcagg

SEQ ID NO: 6841248 - DNA, 68 bp, Homo sapiens
cattggtgatacctgagatggactttaaggatgtgcatgccaccagagggtcaacaggagtcaagatg

SEQ ID NO: 6841249 - DNA, 56 bp, Homo sapiens
gttcttcaggctgagcagagaggctcctgtaccctctctctcggaatctgaagagc

SEQ ID NO: 6841250 - DNA, 78 bp, Homo sapiens
ctacagggtccacttggacattgatcttggaagtttctctgtgtcctgaatggtaataatgcaagtggcccctgatag

SEQ ID NO: 6841251 - DNA, 93 bp, Homo sapiens
agtgagtaggtgagagggtgggttttactggcgaagggtccccagagaagaggactcttccagcaatgtgaaatcaccctgcttccgtgcact

SEQ ID NO: 6841252 - DNA, 62 bp, Homo sapiens
cagggacagcactaaactcttgttgtgatataggtgttagatgataagggaggccgtctctg

SEQ ID NO: 6841253 - DNA, 73 bp, Homo sapiens
tttgtcacttaagcagtctttgagtatcttcaaatgcaaatttgatatgcagagggactgaataagtagcaaa

SEQ ID NO: 6841254 - DNA, 122 bp, Homo sapiens
tggttagtatctattccctatatagtaaacaaaataataatttaattttcacagtggtcagaggccatcttaggaactatatgtgaaggtagaatttgtgaacagggaaggagtagtagcta

SEQ ID NO: 6841255 - DNA, 58 bp, Homo sapiens
tgtcaatgtacgtttatcagttgtcacaaatttgatactctggtgagggttattgata

SEQ ID NO: 6841256 - DNA, 63 bp, Homo sapiens
attcactcagcattcactgggcctgccaagctctgtgctgggcccagaggacgctgagaggat

SEQ ID NO: 6841257 - DNA, 105 bp, Homo sapiens
gcaccaacatcacttggaagtttgttagaaatgcagaatttcagactccaccttactgaactagaacctgcattttaacaagatgcccaggtgatttttgtgtgc

SEQ ID NO: 6841258 - DNA, 71 bp, Homo sapiens
cccgcggcctctgcgcctcagccgacctccaccgcgggtgcgtgcgggggtgcgggggtgaggggtgcggg

SEQ ID NO: 6841259 - DNA, 80 bp, Homo sapiens
cctgaggtcatggtccagtgttactgaagactgtggttaatgtggagggagaggcagtcacactggtgcctgatgtcagg

SEQ ID NO: 6841260 - DNA, 101 bp, Homo sapiens
tgttggctgggatggtctcgaactcctgaccttgtgatccacccgccttggcctcccaaagtgctgggattacaggtgtgagccaccgtgcccggcctaca

SEQ ID NO: 6841261 - DNA, 57 bp, Homo sapiens
aagtcaagataaaggtgctggcagattcagttgctatgaggacccttatcctggctt

SEQ ID NO: 6841262 - DNA, 73 bp, Homo sapiens
ccttgttttcagtggtagttgctaatctaatgtgttcattactgagcttgtagctgcatcactccaaattcgg

SEQ ID NO: 6841263 - DNA, 116 bp, Homo sapiens
agaatgtttggtaaatgtttggaaaatgcagacttccaaagaagtgattacagagccttatgcttggatggtgtcttttttctgggagcgtcttcaagcattttacaaacttatct

SEQ ID NO: 6841264 - DNA, 71 bp, Homo sapiens
caggagagaggggctgaggtcccgaggctggaacccacacttctgcctggaccggcagccctcctttcttg

SEQ ID NO: 6841265 - DNA, 90 bp, Homo sapiens
ctgtgggtagatacccagtggtgagattgctggatcaaatggtagttctacttttagttcattaaggaatctccccacttttttccatag

SEQ ID NO: 6841266 - DNA, 81 bp, Homo sapiens
gagccttgcagattacatgataattatacttaagggctgccaaggaacttcaggaataattatcatatgatttgcaggttt

SEQ ID NO: 6841267 - DNA, 72 bp, Homo sapiens
ggcaggtcgcatctttatttatatagacaggggccagttctctttgctaaaagtgatgaagacacatctgcc

SEQ ID NO: 6841268 - DNA, 78 bp, Homo sapiens
gtgcaaaggcacacagttagatagagcatcctgttggttatgtgtctctcctcaaactcatatcagtgtgccttgcac

SEQ ID NO: 6841269 - DNA, 61 bp, Homo sapiens
gtgaacattgaggcagaaaggaaactggcctcaccagactctttttcatcctcaattctac

SEQ ID NO: 6841270 - DNA, 65 bp, Homo sapiens
tcaggctttgaagtctagctgggaaggcacagtgcatgacccagggaaggggctctcaaacttga

SEQ ID NO: 6841271 - DNA, 82 bp, Homo sapiens
agaccatctgatagtgtaaattccaggcaggttctaaatctgtttcccaaggagctttctggatataacattcagtccttct

SEQ ID NO: 6841272 - DNA, 64 bp, Homo sapiens
ggagggacagtggcttcttcctagagccactttgcagtgttcccttgaggccagctgtccatcc

SEQ ID NO: 6841273 - DNA, 59 bp, Homo sapiens
gggcccagggctgtctgactccagggcctatgccttaaccatcaggctgccctgtgtct

SEQ ID NO: 6841274 - DNA, 63 bp, Homo sapiens
ttaaatcatttccctttagatcacaaaggtacctttggggcttattgggacaatgcaatttaa

SEQ ID NO: 6841275 - DNA, 57 bp, Homo sapiens
ggtactacatggttggctggggcatttaatcctgccaaggagacacggtgttgtatt

SEQ ID NO: 6841276 - DNA, 82 bp, Homo sapiens
aagctgaagaaatactgggttagctttctatacatacagtgacaaagtatgtatagaaagttaacccagtatttcttttctt

SEQ ID NO: 6841277 - DNA, 62 bp, Homo sapiens
cagccctggaacagctgactcagccttcccctaccactggcagagagtcacttctaggcctg

SEQ ID NO: 6841278 - DNA, 78 bp, Homo sapiens
tgtggacatttcccagggagctttgtcttctcattccattgagtgataaggtgaaaggttcctagaataggtcagaca

SEQ ID NO: 6841279 - DNA, 82 bp, Homo sapiens
aaaacattagggcctcatgctcccaagacacttggccgggtagaccatggcttctggggtggcctgcatggccctatgtttt

SEQ ID NO: 6841280 - DNA, 55 bp, Homo sapiens
tttgatgttacaaggtgcctaaactgttatcagtgctgggaaagtaacatacaaa

SEQ ID NO: 6841281 - DNA, 127 bp, Homo sapiens
caggaaaccacgagcttaactgctgtgttattcactactaatgcttagctgaaacttccatatggggaacgctaggtcagctgaatcagtgagtggaaatacaaaagattgaagttatgatttcctg

SEQ ID NO: 6841282 - DNA, 77 bp, Homo sapiens
ttgtctgtcctcttgcttggcctcttctcagggtgggctctgctctccctccccagggccaaaggattcagaggcaa

SEQ ID NO: 6841283 - DNA, 73 bp, Homo sapiens
gccacattcacagagggggaagcatcactcctgcaggaaggaaaggaagtgagtcccctgcttgggaaatggt

SEQ ID NO: 6841284 - DNA, 91 bp, Homo sapiens
gagaaaggaaccttctgccttttaaagccagtgttattttggtctctgttaaagtagctaaaccagtatgtgaaggcaggggttctgactc

SEQ ID NO: 6841285 - DNA, 64 bp, Homo sapiens
ttcatggtattggagtatgagggtgtttaatcacttatttcttcttctacttcaaccaattgaa

SEQ ID NO: 6841286 - DNA, 58 bp, Homo sapiens
ggatagctggaaagccctaccttggaaattagtcctggggttgaattgtagctgtgcc

SEQ ID NO: 6841287 - DNA, 94 bp, Homo sapiens
gagcgatcccattttgaaagccagcttttcttatcattataaggcaactgtgtttataagaataagacaaggcttcctgctgagaaacatgctc

SEQ ID NO: 6841288 - DNA, 101 bp, Homo sapiens
tgagacagagtcttgctctatcacccaggctggagtgcagtggcgcaaccttggctcactgcaacctctgcctcccgggttcaagcgattctcctgcctca

SEQ ID NO: 6841289 - DNA, 126 bp, Homo sapiens
tggttctgccactactccctgtgcagcctggggcaagcctacagctctttctagtcctccatgtcttcactggcacagcaagagtttgggaagatctccaggttcatcgggggtttggtgagtcca

SEQ ID NO: 6841290 - DNA, 56 bp, Homo sapiens
catgaagcatgttttgtcatgaggcaactcagttgacaacctcatgctttgtcatg

SEQ ID NO: 6841291 - DNA, 70 bp, Homo sapiens
attcagtactctccttttcctaattcatctcattcattcaaggtgaattaggaaatgagagtatttgaat

SEQ ID NO: 6841292 - DNA, 59 bp, Homo sapiens
gccccctccattgggcctgcttcccggagctggagccgagcaggccagtgtcagggggc

SEQ ID NO: 6841293 - DNA, 75 bp, Homo sapiens
tagttacagtcacaatttgtacctttttctccactccaaactgagactaagagggaaattgttggctgctaactg

SEQ ID NO: 6841294 - DNA, 65 bp, Homo sapiens
gtgcgaaagtgtctagagcattattatgtatctgttatggtaacactagctctgtcactttcaac

SEQ ID NO: 6841295 - DNA, 81 bp, Homo sapiens
gggggtcaagacccaggagtgcagagagtgggagagaggatctcctccgcccatcctgggctcctgtcgggcctaacctcc

SEQ ID NO: 6841296 - DNA, 90 bp, Homo sapiens
ggaataattattttctgttttctctaggattgggttcaaggataggatgggaaagaacccagaactgggcaacagaaagtaaaagcttcc

SEQ ID NO: 6841297 - DNA, 81 bp, Homo sapiens
gttagcttgaaccacatgaaattgccattttgtaggtcataaatagttaagtatcagtaattgcatgtgtttcaacctaac

SEQ ID NO: 6841298 - DNA, 93 bp, Homo sapiens
tcctagatcagcagattccagtcccacccccttgtcccagatggagaaactgaggcccatttgcagaagggagggggacctgttgattaggga

SEQ ID NO: 6841299 - DNA, 93 bp, Homo sapiens
ccctcagaaaccaactttgacctctctgtgcccctcctggcacacagtaagtccttgagggagcaaagaaagggaaagaatgcattttgaggg

SEQ ID NO: 6841300 - DNA, 85 bp, Homo sapiens
ggctgtgggctcaggggtctcatggagggggtccagtgtcccctgggagggaggatatctgccccatgagtcacctcccacctcc

SEQ ID NO: 6841301 - DNA, 75 bp, Homo sapiens
ggcagcaatctgtttccatgttttattgtgagatacagaaatctttgcagaggatggaagcaccagttggatgcc

SEQ ID NO: 6841302 - DNA, 123 bp, Homo sapiens
tccccagtgccttcgtccaactccaggcactgacccctccagggcccctctcactggagcagggcagctcccctagagcaaaggggcctcttggccagtcaggccctcgttacccactgggga

SEQ ID NO: 6841303 - DNA, 99 bp, Homo sapiens
gggctggagccaggcaaaactgtgaggttagctgggatttcatgagtcacccttttagacctcccagcaatctcatgccatgaatttgcatctgagccc

SEQ ID NO: 6841304 - DNA, 57 bp, Homo sapiens
ctgcagctgtctctactgggcaaggataggaggcccaggagggggaaatggctgcag

SEQ ID NO: 6841305 - DNA, 57 bp, Homo sapiens
tgttacaggaaatagaattaccttaactaatgttaaggtagcttcccttctggaata

SEQ ID NO: 6841306 - DNA, 72 bp, Homo sapiens
ttctttgagctaaaaggagcactagagattatctattgaggtagtttccaaatattgttttagcacagtgga

SEQ ID NO: 6841307 - DNA, 69 bp, Homo sapiens
ctctattcttttaatttctgtctgcagaagggctaatattcaggacagaaataaggaatataataagag

SEQ ID NO: 6841308 - DNA, 60 bp, Homo sapiens
tcagtgttcagcggtgtgtgcagagaaaagtcgtctggtacatgcggtgtgatgctctgg

SEQ ID NO: 6841309 - DNA, 60 bp, Homo sapiens
gactcagagagttaagtgaattacccaaggtcacataccttgtggcacaactgcctgatc

SEQ ID NO: 6841310 - DNA, 75 bp, Homo sapiens
aggacatgagatttgggaggggccatgtgtggaatgatatggttaggccttgtgtccccacccaaatctcatcct

SEQ ID NO: 6841311 - DNA, 91 bp, Homo sapiens
gagttgtcagccctgagtactagaggtgagatggaatcactggcaatgccactgaagtctgtgtcgcttctctcaggggatttgagagctt

SEQ ID NO: 6841312 - DNA, 74 bp, Homo sapiens
gtttaacaatgtaatctactctgctcaagttgattgtcttcattttgcatggaggagtagagattgcatgtagc

SEQ ID NO: 6841313 - DNA, 97 bp, Homo sapiens
ccattatgtcttggtggaaatatagcaattatgcctactagcctctcgaacaatgctaatgggcataattgttcatatttccaccaagacatgatgg

SEQ ID NO: 6841314 - DNA, 75 bp, Homo sapiens
tgtgacactaaatgagtctacagtactgttgaacaacctatcagtagagtagatgatttggtgaagaaaatcaca

SEQ ID NO: 6841315 - DNA, 56 bp, Homo sapiens
tgtagaacacttgtgacaccttgaggtcttcagggacacactccagtgttattaca

SEQ ID NO: 6841316 - DNA, 71 bp, Homo sapiens
ccatgatctatcacctttaggtttgttgttttttgccatgacaactgcttatctttggtagatgtttttgg

SEQ ID NO: 6841317 - DNA, 66 bp, Homo sapiens
cctccttcattataaagtctgggccaggcatggtggctcacacctgtaatcccagactttgggagg

SEQ ID NO: 6841318 - DNA, 65 bp, Homo sapiens
gctgggatgcaggacggcatggatgtacagccatcctgtacatggatggggcctgcatcctaagc

SEQ ID NO: 6841319 - DNA, 76 bp, Homo sapiens
ggcaagaaaagttcaactttcctatcaacaatatcaagtgttggtaagatcatgggaaatggacatttcctaggct

SEQ ID NO: 6841320 - DNA, 62 bp, Homo sapiens
cgtatttgcctcgtatgttagctgtcatcaaatgaaggcagtatctgtagagtgcttatatg

SEQ ID NO: 6841321 - DNA, 94 bp, Homo sapiens
ggaacaatgtccccagaattcttttctttctgaaagtcgcttctcttagatgccattttaaaggagtttatggggagtaaaattgtaattatcc

SEQ ID NO: 6841322 - DNA, 67 bp, Homo sapiens
actccatacagagtcattcattgtccagtacgttagtggatgatgtatattttgcagttaatggagt

SEQ ID NO: 6841323 - DNA, 67 bp, Homo sapiens
tgctcactagaagattcagcagtagggtgggatgctcttcttctcctgcccttggacttccagagca

SEQ ID NO: 6841324 - DNA, 70 bp, Homo sapiens
ccagtcagagaaaatgtccactccatcaggatgtcaattccacaaaagggatattgtctttggattttgg

SEQ ID NO: 6841325 - DNA, 76 bp, Homo sapiens
ggggaaaattgagcgagggctggaggggagacagagggaagcggctctgggtctatcccatgcctttgcagtcccc

SEQ ID NO: 6841326 - DNA, 85 bp, Homo sapiens
ggtgcagcaattttaacccagtgcttttaaaacaacatcagtaactgattatgcatgagacagtactagggttacagtctgctcc

SEQ ID NO: 6841327 - DNA, 68 bp, Homo sapiens
aggctggaaagggaccagagtgcgttgtgaataagcgtatcttttgtattctgttccttctactgcct

SEQ ID NO: 6841328 - DNA, 86 bp, Homo sapiens
ggagaatcacttgaacccaagaggcggaggttgtagtgagctgagatcatgccactgcactccagcctaggcaagagtgagactcc

SEQ ID NO: 6841329 - DNA, 75 bp, Homo sapiens
ctaaatttgacctctatctcgcacatcttgatccatcaaaattatcaatactgtgagtaggggtagaaagtttag

SEQ ID NO: 6841330 - DNA, 58 bp, Homo sapiens
cagccttcagccttagagaatgtggctgagaggctatggaagataaggctgaaagttg

SEQ ID NO: 6841331 - DNA, 81 bp, Homo sapiens
ttgaataactttgcataaaggagcatttctccatgattgttttagagaaaactttggcttctttagtgctaggctatttga

SEQ ID NO: 6841332 - DNA, 88 bp, Homo sapiens
ggtttttactccaagttattttcacagcagtgtgctgcttttgttgttgacaaaagtagttgctgctctgaaagaggcatgaaagacc

SEQ ID NO: 6841333 - DNA, 60 bp, Homo sapiens
tccatccattttccttggcagcaggacatgccgatgcctatgaacaggaaatggaacgga

SEQ ID NO: 6841334 - DNA, 84 bp, Homo sapiens
ggaattactgttttagactcatgcttcttttaacaagaaaacactccatcaagaaggagctgagtcagcccgacagctgaatcc

SEQ ID NO: 6841335 - DNA, 62 bp, Homo sapiens
ccggctattggcttctcccatcccctaccagagggtgacgagacgggaagccgggaagccgg

SEQ ID NO: 6841336 - DNA, 60 bp, Homo sapiens
cagcacatggtaggattgcacttttcagtccccttgaagttaagcatggccatgtgactg

SEQ ID NO: 6841337 - DNA, 72 bp, Homo sapiens
agaactgttcctttgaatgttgttcatatggaatgcatttgaatgaaattgacatttgggggaaaagattct

SEQ ID NO: 6841338 - DNA, 80 bp, Homo sapiens
gtagagggtgctggagagacattgcagaaggaaagagttttgccttctcattccagtgtcctctcctagcagcctcctac

SEQ ID NO: 6841339 - DNA, 59 bp, Homo sapiens
ggttcttgggccgtctgctacatttccgtgatggaggtggcagagctggcccagcgacc

SEQ ID NO: 6841340 - DNA, 75 bp, Homo sapiens
agtacatcatgcagggacttgtgctccattttcgtggattatgggctccgccagtccctgggaaatgaagttact

SEQ ID NO: 6841341 - DNA, 93 bp, Homo sapiens
gcctttcttaaatttctttcctgtacagcccactccactgggcagataatcaggcagagggcttccctaggagtgagagcataagagaatggc

SEQ ID NO: 6841342 - DNA, 57 bp, Homo sapiens
gtttcactgaattaatttccttcttaagttctatctcaagaaggattcaagtggaat

SEQ ID NO: 6841343 - DNA, 56 bp, Homo sapiens
ccatttgtgatgtggcagcatctttcatgaaaatgacaagctccagatcaaggtgg

SEQ ID NO: 6841344 - DNA, 75 bp, Homo sapiens
ttagataaggaagtgaattggaatgaagtaacagttctatattaggtagttacactaagctacttctatatttaa

SEQ ID NO: 6841345 - DNA, 64 bp, Homo sapiens
gggcctccatttgtattactgccccagggctgtaaatgttaggggtaggcccgaatgggagtcc

SEQ ID NO: 6841346 - DNA, 65 bp, Homo sapiens
ctgttgcctctgggagactgctactgagctctaaaaatagcatcttgcaggttctcagaggacag

SEQ ID NO: 6841347 - DNA, 72 bp, Homo sapiens
ggttattcattgtgctaaagtaataagtcagctcatcctttgattttatctgttgttttagtacaattgacc

SEQ ID NO: 6841348 - DNA, 89 bp, Homo sapiens
gggaagggagtagcagggaaggtgtgctgagccatcagggtaccagctcagctcagggaccgtcacacttttcctggtttcccattccc

SEQ ID NO: 6841349 - DNA, 69 bp, Homo sapiens
gagtgggaggatcgcttgagcccaggagttcaagaccaacctgggcaacataggaagattctgtctctt

SEQ ID NO: 6841350 - DNA, 64 bp, Homo sapiens
gtcttctgcctccattagagttgcttctggagatgtcaaaatatttctaatgttggcagcaggc

SEQ ID NO: 6841351 - DNA, 84 bp, Homo sapiens
ctgtcatgactatatatctcagagaaatttgaatgcaattaccagagtgaatgtaaaaagtttctgtgatatatacatgggcag

SEQ ID NO: 6841352 - DNA, 73 bp, Homo sapiens
tagaagacgaatggctacatttgtgctggtttgcttatttctgggctctcaatgtagtgccctttgtcatcta

SEQ ID NO: 6841353 - DNA, 60 bp, Homo sapiens
agatgtccctggtggaggctggcagcctcatcctgcagccagtgtcttccaggggaggct

SEQ ID NO: 6841354 - DNA, 65 bp, Homo sapiens
ccactgatctgttttcagattctgtgctttgcttgtacagaacatgatataaacagaagcactgg

SEQ ID NO: 6841355 - DNA, 58 bp, Homo sapiens
agtttatgttgtttataagccatccagtttacagtgtttggttatagcagcctgaact

SEQ ID NO: 6841356 - DNA, 74 bp, Homo sapiens
ggtttgcattaactcaacattctcctagtttcaccatttcaagaactgaagaactgaaagttgatgcacagtcc

SEQ ID NO: 6841357 - DNA, 78 bp, Homo sapiens
tgtaatgcactgtgtttttctgagttggtccatttgagattgaagagtggatatttacattaagcacattgcattcca

SEQ ID NO: 6841358 - DNA, 83 bp, Homo sapiens
ctgaccctcacaatcaaagccaggtttgaaatatcccatcaaataggtggcctgtgtttaggagcctggagtgagaagggcag

SEQ ID NO: 6841359 - DNA, 62 bp, Homo sapiens
tatagcatagaggttaagaactcagtttctttatcaagattttctctacctctagtgctgta

SEQ ID NO: 6841360 - DNA, 74 bp, Homo sapiens
ggggattccattgtgtgtttatgcccagatatctttatgcgtctagaagacatttggaagatacacataaaccc

SEQ ID NO: 6841361 - DNA, 62 bp, Homo sapiens
tctgtttatcatgtacatttccacacttaaatttgactctggaagggctatgaataaacaga

SEQ ID NO: 6841362 - DNA, 72 bp, Homo sapiens
gactctgcctttatctgtcgcatacatacttggcttcctcgtgagccagggatggaagataggtgttaagtc

SEQ ID NO: 6841363 - DNA, 68 bp, Homo sapiens
gctaagtcctgctttaagtattcaacaaagtggctcatgtgaagaatattgaagcagttggaagtagc

SEQ ID NO: 6841364 - DNA, 69 bp, Homo sapiens
gtttctcagcatgtcagtacaaccataagttccttgaagatagggaatgtattccaaaatgctgaggat

SEQ ID NO: 6841365 - DNA, 71 bp, Homo sapiens
accagacagaagtgacacctcttccctttccagtccctgtgggcttggtggtgtcatttggcatgtctggt

SEQ ID NO: 6841366 - DNA, 59 bp, Homo sapiens
tttggtcttgagtggcttgttaagtggtagtgacatttcatgagttggacaagactggg

SEQ ID NO: 6841367 - DNA, 61 bp, Homo sapiens
agcctctgctggccctggcacttgctcccagctaggtcctgcccagtggccagcaaaggct

SEQ ID NO: 6841368 - DNA, 86 bp, Homo sapiens
gggagacgtaggcctctgctgtacttaggaagaggaaccaggaagctgttctcttctcttgaggcagcaaggcaaggatgtttgct

SEQ ID NO: 6841369 - DNA, 58 bp, Homo sapiens
atgataagaacacagtatggggagcaaggcaatctgtttcctttcctgctcttattat

SEQ ID NO: 6841370 - DNA, 63 bp, Homo sapiens
atactgctgctgctgaaatcactgttgttgctccttccagaactgtcggcaccgcagcattat

SEQ ID NO: 6841371 - DNA, 71 bp, Homo sapiens
agatcacttgacctgtaatatgtcatgcctgtggtggaatataaggctctgtgaccttaggcaagttgttt

SEQ ID NO: 6841372 - DNA, 68 bp, Homo sapiens
gagtaaggtctgactctttgccacatagacattaacctctgtgaccttgggcaagtcagtcctaactt

SEQ ID NO: 6841373 - DNA, 71 bp, Homo sapiens
tctgacatcaaagtggttttctgtgctttaaatgagtcagtgtggagataggattattattttgtgttgga

SEQ ID NO: 6841374 - DNA, 64 bp, Homo sapiens
gagaccaagctgtatattattggttacagttttcagtaacttgataatttaagtttgggtcctc

SEQ ID NO: 6841375 - DNA, 99 bp, Homo sapiens
tgaggagctggaatagctactaaaagtaaaactcacaaaaggatggggcctcccatgaccctgtcctgtgctttttactgtcagacttttccaacctta

SEQ ID NO: 6841376 - DNA, 56 bp, Homo sapiens
ttaggcttcatgtgcagaggatacagtccacttctgccctctcacatggagtctga

SEQ ID NO: 6841377 - DNA, 67 bp, Homo sapiens
aatttgtacacaggtcattcagggatgattcaaagaacaaagtaagcccttgactgtgtgacaaatt

SEQ ID NO: 6841378 - DNA, 58 bp, Homo sapiens
ggaggcggggaaggcatcccatcaccctaagacctgtgggtgcaagttctctgtcttt

SEQ ID NO: 6841379 - DNA, 66 bp, Homo sapiens
gctggagagctgcaaggtagggcgggagggagactttccccgtggacccctttgtacctcttgagt

SEQ ID NO: 6841380 - DNA, 75 bp, Homo sapiens
ttatggttgggcttgacagctgtccttgtgttgacagctcttctgattatagcagttgtcaaactccatccttaa

SEQ ID NO: 6841381 - DNA, 76 bp, Homo sapiens
ctcagagtttagcttctgacaaagcgggaggtacaataaatctaagttccagcctgggtgttagaagacatctgag

SEQ ID NO: 6841382 - DNA, 58 bp, Homo sapiens
tctaagctagtggctcatgtgagaagaagtctcagcacacaagggccctcagcacagg

SEQ ID NO: 6841383 - DNA, 72 bp, Homo sapiens
gaggggctagaaattctgtcctgaatgccattgcttaagtattgtggtttcttgatggagaacctccccctc

SEQ ID NO: 6841384 - DNA, 71 bp, Homo sapiens
cttttccaccatctaagagaaaggaagttcagagccttagcttcaacaccacaatttcttaactggaaaag

SEQ ID NO: 6841385 - DNA, 57 bp, Homo sapiens
ctgcagctcccctgagatcaagtaacatcgctggttggaggtctatggtgctgacag

SEQ ID NO: 6841386 - DNA, 75 bp, Homo sapiens
cagttttcttgccatatttcagcccttattccttctgtgaataagcttttgacttggtagggaagataactactg

SEQ ID NO: 6841387 - DNA, 72 bp, Homo sapiens
gaaaaattgaggtttgaactgttgaaaagccaacctatgaggcttaggatttaatttcagactcagcttttc

SEQ ID NO: 6841388 - DNA, 57 bp, Homo sapiens
aaaatagctgtatttaccctgtagtcaagtcactatgaaagtaagtgcagctgtttt

SEQ ID NO: 6841389 - DNA, 71 bp, Homo sapiens
ggttagctagggggctttggttgtctcaaagctcattatgagtcattgaacgaagagctccattcctcacc

SEQ ID NO: 6841390 - DNA, 60 bp, Homo sapiens
ctgcaggttggccttctcctggtttagctgcaactgaagcttctggttcaggtcaagcag

SEQ ID NO: 6841391 - DNA, 103 bp, Homo sapiens
ccaccacaagggaaattctgtaagcatttcaatataatattcacccttgtaaccaaagtgaattatatggaggagcttaataaggatttgttgatttaattgg

SEQ ID NO: 6841392 - DNA, 86 bp, Homo sapiens
ttctttgttcatggttagaaatatttgcttttaaagtatttctggtgctaaaggactagtctttctaccatgaagcatataaaggg

SEQ ID NO: 6841393 - DNA, 69 bp, Homo sapiens
gataacttgctgtttgatttcatgtttgtacataaatgcatggggtattactgaacagctgagactatc

SEQ ID NO: 6841394 - DNA, 56 bp, Homo sapiens
accagtctggctaattttttgtagagatgggatctcactttgttgcccagacttgt

SEQ ID NO: 6841395 - DNA, 64 bp, Homo sapiens
ccagggggggaccacacctcagggggtggcctcccccacactcctgagggtttcccagccttgg

SEQ ID NO: 6841396 - DNA, 71 bp, Homo sapiens
agatgcgctccttggggtaaattgatgtgatgaaaatttattgtcatgtggcacttcagggagcagcatct

SEQ ID NO: 6841397 - DNA, 69 bp, Homo sapiens
agagcttacatgtgagtaaatttaatgtttaaagtgtaaatatatagatagggctcacaaagtagtttt

SEQ ID NO: 6841398 - DNA, 61 bp, Homo sapiens
gggtctcatgctctttaaagtatgtgttttgcagaaaagaacacattatgagcatagactc

SEQ ID NO: 6841399 - DNA, 77 bp, Homo sapiens
tgtctcttaagactctatctggctttatagtgacaacatcaaaggatatttgtattagttagggttctgcagagaca

SEQ ID NO: 6841400 - DNA, 60 bp, Homo sapiens
atcatgtcataaatatactgttccttgaggattcaaggtcaggaagagtttatcacagat

SEQ ID NO: 6841401 - DNA, 104 bp, Homo sapiens
ggagtgtttgtgagagcactgtgtgttgctgtgcgcgtgcagcggagtgtttgtgagtgcagcctgtgttgctgtgcgcatgttgtggttgttttcttcattcc

SEQ ID NO: 6841402 - DNA, 127 bp, Homo sapiens
gttgtgtgacataagaagatcttggattaattagcactatttttcactatccttctattagtattccactgaggaaatgaagaaaagtgttgtattaaattgtaaggatttaggaacattaggcaac

SEQ ID NO: 6841403 - DNA, 79 bp, Homo sapiens
agctgctggcagccaggaagcagttagatgggttttctcagaaagaactaagacagcattcctggtgatgattgtagct

SEQ ID NO: 6841404 - DNA, 67 bp, Homo sapiens
gagacatggcaaaagcactggtcttacattgccagaagaaatataaagactaatgcttgaatgtctt

SEQ ID NO: 6841405 - DNA, 130 bp, Homo sapiens
ccctctgctgattccttgaaaagcaacaggaaagagcaggctgctgtggagtagacagacttgagactctctgcaccgtcttgttttgtaaacccttttgctccctttccaaggatttcagttcaggagg

SEQ ID NO: 6841406 - DNA, 100 bp, Homo sapiens
cggggggcagatgggtgcggcagcagggcccccgggtgcgccggggcatatctcgactctggttgcgggttctgctgcgcctgtcacccatggccttccg

SEQ ID NO: 6841407 - DNA, 60 bp, Homo sapiens
ggcactggcagatttgggatctggtgagggccctcttccaggttcacagactgcggtgtt

SEQ ID NO: 6841408 - DNA, 65 bp, Homo sapiens
tttagaggctgcctatcacaactattgagaatttcccttcttttcaggtgacggtaacctttgaa

SEQ ID NO: 6841409 - DNA, 89 bp, Homo sapiens
ttcttgctttgttacttgtctgtcaggtctaaaatgggtctctggtagtcacccagggacctagactgatggagaaccacattcctgaa

SEQ ID NO: 6841410 - DNA, 75 bp, Homo sapiens
gcctatgtttctgtgttgataattttggagatgatatttacttcatggctaagaatgttatgcagcaatgttggt

SEQ ID NO: 6841411 - DNA, 66 bp, Homo sapiens
ctgaccctgcctgtcctggtcccgtttagcaaatgctctaatcctcttaggccaggccagcctcag

SEQ ID NO: 6841412 - DNA, 62 bp, Homo sapiens
aatatgtgaaccctcctcctaagggtttttataatcctttctatcttgggtatctacgtgtt

SEQ ID NO: 6841413 - DNA, 57 bp, Homo sapiens
gccgaagctgccgtctggtcctgtaacttgatgcccgtgacagttggcagctgcggc

SEQ ID NO: 6841414 - DNA, 61 bp, Homo sapiens
gaggtgtctgctgtgttcaaaggacagtggcactgaaaactcaggactcagagacactctc

SEQ ID NO: 6841415 - DNA, 65 bp, Homo sapiens
ctgatccctacagttcacagtatcataaattcactgttgtcgatttatagtttgaaggggattag

SEQ ID NO: 6841416 - DNA, 68 bp, Homo sapiens
tccggggtcctcttgtagcggccacgttgatctgcgatacgcgtgtttgcccagtgagtggccccgga

SEQ ID NO: 6841417 - DNA, 67 bp, Homo sapiens
agggcagttgctacaatatggctgatctagtgctaaggatgaggaccaacaggaagtaacatgcttt

SEQ ID NO: 6841418 - DNA, 56 bp, Homo sapiens
ctgagatctttatacgaggcactgagaacagtgccttgtccttcgtcagggctcag

SEQ ID NO: 6841419 - DNA, 65 bp, Homo sapiens
aggcattgcccttggctgaaggcactgccacacccaaggttatgtcctttccccaggggtagctt

SEQ ID NO: 6841420 - DNA, 64 bp, Homo sapiens
tggaagttccaccagagccctctttgcgggttcttcaagagggactttctctggggttcctcca

SEQ ID NO: 6841421 - DNA, 73 bp, Homo sapiens
tagggaagggaagtagcatctgagcttcaatctgtacatgcactatgacctttgacgctatttaatttgccta

SEQ ID NO: 6841422 - DNA, 58 bp, Homo sapiens
attgttggaagggtccttggaagatgaaaatgttcttcgtaaggttgtttacaacaat

SEQ ID NO: 6841423 - DNA, 101 bp, Homo sapiens
tccattcctttcagccttctaagaattgatgtgaattgcagccagatcaatttggctgtggcgattggtatcgattgtgtagatgggcaaaaaagaatgga

SEQ ID NO: 6841424 - DNA, 116 bp, Homo sapiens
cattatctactgattagcaggatatctttagggctcagaaagcaggttttctgtctctaccgatggcttgttttctggctgaagaatgaaggtgttttgatacaaagttattattg

SEQ ID NO: 6841425 - DNA, 73 bp, Homo sapiens
ctgcaggatgagtgagtacatttatgaatgaatcttccatttaaatattgagttccttatctcatacctgcag

SEQ ID NO: 6841426 - DNA, 64 bp, Homo sapiens
agtggtgccattaaaatcattgatttttagaacacataaatgaatggatagtttgtggcccatt

SEQ ID NO: 6841427 - DNA, 60 bp, Homo sapiens
ctctgacttcatgagtgttcatgaagctcttattttagagctatattcaagaagacagag

SEQ ID NO: 6841428 - DNA, 68 bp, Homo sapiens
tcagaggatctttgtgaatctcaacttggacatggtgtctagtttgccctgttatagggtacctctgg

SEQ ID NO: 6841429 - DNA, 62 bp, Homo sapiens
aaaactgacttcttgaaatggaaggccgatgtgtgttcccatgttaccaaggagtcactttt

SEQ ID NO: 6841430 - DNA, 79 bp, Homo sapiens
gaatgggcatgcttctagttgaaaggttatttgactcttgaagttattttctcttttcactgggccatgcaactatctc

SEQ ID NO: 6841431 - DNA, 106 bp, Homo sapiens
gaatcttcttaggaatatggcttatattgaggatctcctgctaattgtttgtcctggtctaattggtatgttttctcaattaacgttatttttaagatacaagttc

SEQ ID NO: 6841432 - DNA, 80 bp, Homo sapiens
gctcatgtgaagtgcagagacctggtcaggcatgaagaatacagcttttcctactgcctttccaggctctggccatgggc

SEQ ID NO: 6841433 - DNA, 60 bp, Homo sapiens
ccctgagctctgactgctgggtgacacagacgtgtgtttacagctgatcaggcatcaggg

SEQ ID NO: 6841434 - DNA, 64 bp, Homo sapiens
gcacctggctgtgaagcctgggtttcttcctcctgggatgtgcactgggctctcagcaaggtgt

SEQ ID NO: 6841435 - DNA, 57 bp, Homo sapiens
gggggtttttgtttggggtggcattcctcctgaccacacccatcactaagagctcct

SEQ ID NO: 6841436 - DNA, 79 bp, Homo sapiens
ataacttaacttctctgagcctcattcctgtgtaaaatgggtgtaggaagtgaggaattaggtttataagaagggttgt

SEQ ID NO: 6841437 - DNA, 86 bp, Homo sapiens
tgactgtttttgcatttttagtggctcactcatgctattgtacagaaactagagtggagccagggtagaagcagaggagacagtca

SEQ ID NO: 6841438 - DNA, 69 bp, Homo sapiens
agctgagggggtgtcattaattgtgatgaaataatttaaaccatcaggaataaatgaggctgttaagct

SEQ ID NO: 6841439 - DNA, 77 bp, Homo sapiens
gtgcatttgccctggagtcaggatacatggattcttgtcttctttttgccccatctgtgtgatttcagggaagtcac

SEQ ID NO: 6841440 - DNA, 67 bp, Homo sapiens
tccagtccctcagtagtgcacagtggcacttgacacagccagacctgcaaggctgagagggcacaga

SEQ ID NO: 6841441 - DNA, 88 bp, Homo sapiens
ttttccctggtcctgtctgccattagcccagtccaggccatcagcttctcttccctggactaggccagtggcaaacaggactggaaga

SEQ ID NO: 6841442 - DNA, 130 bp, Homo sapiens
agggcctccatctgtctgcctggaacatgtggtctcatcagtgtggcagttcactgtggctagagctcattagagaatgtgctgacattgactaccggcccctacgttcaattcttttcttgaggctcct

SEQ ID NO: 6841443 - DNA, 67 bp, Homo sapiens
ttaattaaagggacttttgctggctctttgcagattgctgctggcgccccatatagttcttaattaa

SEQ ID NO: 6841444 - DNA, 62 bp, Homo sapiens
gggcaaacacctgtcagctgatggctatgtatggctatgcaggtcctcagtgacaggggccc

SEQ ID NO: 6841445 - DNA, 90 bp, Homo sapiens
gtggtgccaggattcaagttggggcagaatgaccctggagtttttggcctcaagtcaattctgtctcgcaaattggatttcttgaattat

SEQ ID NO: 6841446 - DNA, 78 bp, Homo sapiens
atacagctagtcaccagctacaggacagctggagccagggggctattgctggtcacagtcgctggtgtgtgtgtgtgt

SEQ ID NO: 6841447 - DNA, 130 bp, Homo sapiens
gccagagtggttgaaaataaacattcagaagtaatcacagcataacggacttgcgttcattaggaaaatgatgacaacttgtttctgttatatgtggttatactcctaccatatttgcattaacctctgc

SEQ ID NO: 6841448 - DNA, 56 bp, Homo sapiens
tctagcagagtagccaatgtgggaattgttcagtgcctgcttgggacactgccaga

SEQ ID NO: 6841449 - DNA, 59 bp, Homo sapiens
agacaaataagtgctgggatttctgagtctcaattccaaatcttagggcttattagtct

SEQ ID NO: 6841450 - DNA, 60 bp, Homo sapiens
gagggttgggacacagatcagcatggccaaaggggaggccagtcctgatcccacatcctt

SEQ ID NO: 6841451 - DNA, 62 bp, Homo sapiens
agggctagttggaaggcaaaaatacagttggaatttgtaaccaactgctttcttcctgccct

SEQ ID NO: 6841452 - DNA, 129 bp, Homo sapiens
ggcagctattcttcactcagttatttagggatctaggctgaagacagcactggcattttcaagatatggcttctaagatggcttagtgcgtccccagtctataggtagaaaagaaaagaacagatagcc

SEQ ID NO: 6841453 - DNA, 72 bp, Homo sapiens
aggaatacttatacactgttgttgggagtctgaattagttcaactattatgaaagacagtgtgacaatttct

SEQ ID NO: 6841454 - DNA, 109 bp, Homo sapiens
gaatctttttagtctttgccagtctgataggggagaagtagcagctcattgttgtttaatttgcatttctctcattgttagctaggttgagcattttaaaaatatattc

SEQ ID NO: 6841455 - DNA, 63 bp, Homo sapiens
gctcctgcccagcagcctccggggcagtgtgggccaattgtcctgtcaggctgggggctgagc

SEQ ID NO: 6841456 - DNA, 57 bp, Homo sapiens
ggtggaggtgtccaactcgtgggtgtgcctgggcgtcacctacccccgcagctcccc

SEQ ID NO: 6841457 - DNA, 57 bp, Homo sapiens
catactcactgttgtatcttcggtgtcaaacatagcacctggtacacagtaagtatg

SEQ ID NO: 6841458 - DNA, 84 bp, Homo sapiens
tggatttaatactgaaagttggataaaatttgatcttgttaagaagacaaggaagatatatcaagcttaatgtaatggagttta

SEQ ID NO: 6841459 - DNA, 67 bp, Homo sapiens
tccgagtggcaagtggcaccggctgtggcatgtattcatgccgcttcctatggcatttctcttccga

SEQ ID NO: 6841460 - DNA, 107 bp, Homo sapiens
gtctgtgagctctgggtgttccatcctgacttgatacccctcccaaaggaccctaaaaagcagggaggtgtgcaggatgaacccctcagccccctcactgtagagac

SEQ ID NO: 6841461 - DNA, 78 bp, Homo sapiens
ggggagagggataggtaataccccagggtcctcccagcccaagggccaggaactggggctattcaccctccaattccc

SEQ ID NO: 6841462 - DNA, 129 bp, Homo sapiens
ggagtttcagtgttattgtaattaaggtgcaagtgtaaatgtgaccttcattttatagtcccgggcttgtgaatgcaggcatattaatcaaacattgatcttaaattagctttaagcatgtagactaac

SEQ ID NO: 6841463 - DNA, 90 bp, Homo sapiens
tccaacagatcttgacctatggtatgtgtgactgaacagtcccttttgcttcttatttgtacattctatatctgttacatctgttttgga

SEQ ID NO: 6841464 - DNA, 82 bp, Homo sapiens
gcattcagacatttcagtgagaaagcaatcaaataaattcacatattcagtgcttttgtcacatggtcaaagttagaaatgc

SEQ ID NO: 6841465 - DNA, 74 bp, Homo sapiens
ggatgacttgtaagctctgtatttgagttgtgtagactctgcagcatcacatatatgggagcttgcatttatcc

SEQ ID NO: 6841466 - DNA, 72 bp, Homo sapiens
aagaagtcaacactgtgtgtcaggctgccttttgaagcatggttcctgaccctttccagtgttggcagtctt

SEQ ID NO: 6841467 - DNA, 65 bp, Homo sapiens
ggccttattgactgtcattctccatgcttgagtaagcattagctcatgcctttgatagtcaggct

SEQ ID NO: 6841468 - DNA, 57 bp, Homo sapiens
tttttggtacatgcaatagcaattattatttgtgtaatgcttgtcttgtgccaagaa

SEQ ID NO: 6841469 - DNA, 81 bp, Homo sapiens
agtttctagtgctgaggccaatgtcagggtgtctcatcttcatatctctcaggcactgatccttcctcaccatcagacact

SEQ ID NO: 6841470 - DNA, 78 bp, Homo sapiens
ttttgtgttctggtcagtagctttaccctctacacctgacaaagtgtatggaagtataagttttgaaggaagatgaag

SEQ ID NO: 6841471 - DNA, 75 bp, Homo sapiens
ttcaccagagttggaataattttgaccaaagcatttttacttataaacatagggtcaaagtgttcttttgttgaa

SEQ ID NO: 6841472 - DNA, 72 bp, Homo sapiens
gtgggtgaactctcagaacttttggtgggtggatattcatctgaccagtgagctctgaaatggtttccctac

SEQ ID NO: 6841473 - DNA, 59 bp, Homo sapiens
gtggcaaaaccccatctcttctaaaaatacaaaaattagctgagtgcggtggtgcacac

SEQ ID NO: 6841474 - DNA, 59 bp, Homo sapiens
ctgtatataatgtatgcatgggtacacatatatgcacatgcattctatttgtcatgcag

SEQ ID NO: 6841475 - DNA, 89 bp, Homo sapiens
catcgaaattgcagtatcatagaaacagatgcacttctctaattatagagatggtgactttgtttataggcaaatgcagttttcaaatg

SEQ ID NO: 6841476 - DNA, 76 bp, Homo sapiens
agtctctgggaacactttgtgagctccttagccctggaactgttctaagggggtctataatgttctcagcaggatt

SEQ ID NO: 6841477 - DNA, 69 bp, Homo sapiens
cttgtataaacatgctctggattgctgtgaaggcaatattctttcatgcagtttaaagcagtttttaag

SEQ ID NO: 6841478 - DNA, 63 bp, Homo sapiens
gaactcgtcttttgcatccttgtaatagtattccccttttatttgaggagtgagagtgggttt

SEQ ID NO: 6841479 - DNA, 85 bp, Homo sapiens
cagataaggaaactgaggttacgggacttaaccatgtgactttgggcaagttgctgaacagttctgtgctccgtttcctcatctg

SEQ ID NO: 6841480 - DNA, 130 bp, Homo sapiens
gcatgtatccaggagacagaagcactcagcatcccagtccctccttccactcctgctctgaggttgcagtgaagcagggtttggggattggcacccagcatgatgactgtgtgtctctggatgtacatgt

SEQ ID NO: 6841481 - DNA, 61 bp, Homo sapiens
cagcagcctgtctaaagtatgtttggtaatttccgccaagacctgcatctgataggccctg

SEQ ID NO: 6841482 - DNA, 83 bp, Homo sapiens
aaagacaaacaacttgcttaaaatgaaatggaaagtaagagattttagtgccattcaagttttaagggaataagtttgtcttt

SEQ ID NO: 6841483 - DNA, 74 bp, Homo sapiens
gggggccaagagtacttgcagccagggccccactgattccttgtggggcctctgaggtgcttttgtgtgctcct

SEQ ID NO: 6841484 - DNA, 56 bp, Homo sapiens
atagctgtagctgcaaaaattctgttttctggaattacatgagcaaatatagctat

SEQ ID NO: 6841485 - DNA, 61 bp, Homo sapiens
ctctgtgccttctacttcactctaggaaattcctgagaggaatgagaggaaggcatcggag

SEQ ID NO: 6841486 - DNA, 64 bp, Homo sapiens
ggacctgctttccctggccttcttctccctacttgtcagagaatcctggccaggtcagagctcc

SEQ ID NO: 6841487 - DNA, 85 bp, Homo sapiens
tgtattttccaagctctgatagtattggtgatttatagcatttttgcttcagatcctaatttgtctttgttttgaattttttaca

SEQ ID NO: 6841488 - DNA, 70 bp, Homo sapiens
ggcagcttacgttttgctagtgacagtctcctgtaaaaataactctcttattagcgatgacataagagcc

SEQ ID NO: 6841489 - DNA, 76 bp, Homo sapiens
gccaaatatagtcccattttgaggtatttggaggttcaatgtcaacaaataaattttggaagggacacaatttggc

SEQ ID NO: 6841490 - DNA, 130 bp, Homo sapiens
agctgtctatctagagtcatatgtaatctagcagacatttctaggcattgcgacagacccactagggattgtagcacatgcattagagtgtggccaagccaggtaaggtgtgactcaaagagcctgcact

SEQ ID NO: 6841491 - DNA, 58 bp, Homo sapiens
gagctggactttcagatacatctgtctaagtggctgatgtgtagggaaagtcagactc

SEQ ID NO: 6841492 - DNA, 72 bp, Homo sapiens
ttttaaagttgtagagggtgatgctgctggcggctccctcccaatcagcaccatttgcagcctcttttgaag

SEQ ID NO: 6841493 - DNA, 121 bp, Homo sapiens
taatttatctccatggctttctgttcttctagggtgacagtttgtcagtttgacttcccatttaaaggtcaaagcagtgcaccttaattgatggtgggtggaaaatgtcttgagaagatta

SEQ ID NO: 6841494 - DNA, 73 bp, Homo sapiens
cgctttggctccagagtccatgccgttaaccacttctgtgcatttattgagcaactctggggctctcagagtg

SEQ ID NO: 6841495 - DNA, 111 bp, Homo sapiens
ttgtttcagtgtgggagtagtggtggctggaagtcagaaatgggaaagaggtttcttctcccttctttgccttctgaattttagttttctggggctcccatttctctgcaa

SEQ ID NO: 6841496 - DNA, 59 bp, Homo sapiens
ctgccacttactaggcatggtgcattaggaatgtcagatggtatgtagggaggtggcgg

SEQ ID NO: 6841497 - DNA, 88 bp, Homo sapiens
tggtgtggttatatagaagaatattcttgatcttagatgacaggatacatttaggagtcaaatgttttaggatctgtaagctatttta

SEQ ID NO: 6841498 - DNA, 92 bp, Homo sapiens
atcacttagcttattaaagcacacatctctggctgggtttcttcaccagagattttgctagaatttgtgtttctaaaaagctcaaaggtgat

SEQ ID NO: 6841499 - DNA, 86 bp, Homo sapiens
ttccctttgtgaatggggctctaagacttagaaaggggaggtgaattccctgagacagtgcagagtacatttgtggcaaagcggaa

SEQ ID NO: 6841500 - DNA, 84 bp, Homo sapiens
gttttacctgggggtggctgagctagctatctcagtctgtgatcacctatcataaactctagggcgcccactcctgggtgaggc

SEQ ID NO: 6841501 - DNA, 57 bp, Homo sapiens
tgcccaggcttcaccctcagagaatcaggcgcaattggtctggggtgtggcctggca

SEQ ID NO: 6841502 - DNA, 72 bp, Homo sapiens
ctcttagaatgtcaactgatgtttattcagcagttctgtgtgctcagaacaatattagatgccatttgagag

SEQ ID NO: 6841503 - DNA, 57 bp, Homo sapiens
aagatagtagatctgaacaggtttaagcgggggtatgatgtgtcagatttgctcctt

SEQ ID NO: 6841504 - DNA, 81 bp, Homo sapiens
cctgccttattccactcccacccagttttaaacctgggggaccattatctggtttctctgggtgtgggtgctaaagtcggg

SEQ ID NO: 6841505 - DNA, 76 bp, Homo sapiens
caatgcacgctcagatttgacctaagaaacaccttaaaacattaaaaattcatcagtcagagctggtgttgtattg

SEQ ID NO: 6841506 - DNA, 59 bp, Homo sapiens
ccctcgccgcagctgcttcccggactcgggaggggacggaagcggccctgagcgcaggg

SEQ ID NO: 6841507 - DNA, 97 bp, Homo sapiens
tgctatgatggtggtggcgggggccggggaggctgtcctgggcactgtacactgttgagcagcatccccggcctccacccactggatgattgtagca

SEQ ID NO: 6841508 - DNA, 65 bp, Homo sapiens
cccaattgtgaatttcagttagagccacaaaagtctgtgcctttgtgccatgatttattataggg

SEQ ID NO: 6841509 - DNA, 60 bp, Homo sapiens
gtggtcctcttcttctgtttggtcactcctaggtcaccgcatcggaaacaggaggatcac

SEQ ID NO: 6841510 - DNA, 118 bp, Homo sapiens
cagtaaatcatgtgttcaaagttgtggttccatatagtgatgggtttatgtggaaacagacatcctcatcttgcttcatctgctgtgtaatcattaactcatgaagataacaggactg

SEQ ID NO: 6841511 - DNA, 78 bp, Homo sapiens
ctttgaatcacctcatgttaagtgtttgataaccagggtcttcctttgttaagatcagcctttagcatttattcagag

SEQ ID NO: 6841512 - DNA, 58 bp, Homo sapiens
agtgatttctagtcttggctccgcagatgtgacctgtggtactcagatcaagtcagct

SEQ ID NO: 6841513 - DNA, 61 bp, Homo sapiens
gaggtacagagtgttccaatgtctgctaccaggatggcactgaaattggcatgctgacctc

SEQ ID NO: 6841514 - DNA, 66 bp, Homo sapiens
gtttgttttaaggagatggggtctcccatgttacccaggccgaactccaactcctgggctcaagtc

SEQ ID NO: 6841515 - DNA, 129 bp, Homo sapiens
gttaacttttctgagctttcatttcctcacttgtatgaagacttcttctgtgttcaattttatgttgataccaggagagattttattgagaagggcgtcctggaagagaattttgaagttgaatcactc

SEQ ID NO: 6841516 - DNA, 55 bp, Homo sapiens
agttatggagcagagtttgtgtttcataagaaaacataggcagagctttaaagct

SEQ ID NO: 6841517 - DNA, 61 bp, Homo sapiens
tctgtggcaaatgatacctcccagagtggtcattctacaatgggacctagctttgcacagg

SEQ ID NO: 6841518 - DNA, 99 bp, Homo sapiens
ccatttaaaaagacaaaatctgctatgctattcttcagagtgttctttgggtacaatatgaatgctttgggaattcagaatagtaagtttctttcatgg

SEQ ID NO: 6841519 - DNA, 72 bp, Homo sapiens
gggctgctgggcagttcgctttcgttttcacgtttttgtgggggtagggcgattgctgcttttttctcaccc

SEQ ID NO: 6841520 - DNA, 87 bp, Homo sapiens
gaaccctggagctggcaggggtgatgtgtgctggtggcagggcgtgaagcaccaggcacactgccctgcccttcagctttagttttc

SEQ ID NO: 6841521 - DNA, 56 bp, Homo sapiens
tacggataatgctcttagcacgtatgacctttacgatatgtggaacactgtccgtg

SEQ ID NO: 6841522 - DNA, 67 bp, Homo sapiens
gggagccagaggagagtgagtattagtgcaggtcggcctagttaaaatcacaactccatcatttccc

SEQ ID NO: 6841523 - DNA, 129 bp, Homo sapiens
ccagctcctggggtctccagatagcacaggctgggccatcaggagactccatccccttgaccacagtgattggctcagggaaagagctcctgtctgtctagcgagtcctaatccctagactttttctgg

SEQ ID NO: 6841524 - DNA, 125 bp, Homo sapiens
gccaggggggtgaaacgcagtaggcagtgaaagggaagatggggggagagtctgcaagccaatgggcagaatttttgattatctactcgtttagatcatctgtctcactgcttccctccattggt

SEQ ID NO: 6841525 - DNA, 70 bp, Homo sapiens
ctttagatttctatgtatcacttgctttttcaagttcatatgaaaagaatagtggagcaagagtctggag

SEQ ID NO: 6841526 - DNA, 72 bp, Homo sapiens
ccacatcctattagaagtgggtcactcaagtcaacttaagagatgaggtgatacagaccctactttttgtgg

SEQ ID NO: 6841527 - DNA, 73 bp, Homo sapiens
acctaaagcaacaggcagtttgctcatgtgcgccagaagaagcgcacaagtggctgtgtgtgtgtgtgtgtgt

SEQ ID NO: 6841528 - DNA, 64 bp, Homo sapiens
tccagcttgcctggtcttttgggactcctgaaggaagggagcaccaaaactataggtgttagga

SEQ ID NO: 6841529 - DNA, 63 bp, Homo sapiens
ggctccactgctgaccactccattcagtgtgctctgggaagagaggctcctgcagttggggct

SEQ ID NO: 6841530 - DNA, 99 bp, Homo sapiens
gtgtgcgggctgccagtccatatttatactgccgggacatggctctccctgtctggagggcactatggagtgtggatatgggggtggctctctgcagac

SEQ ID NO: 6841531 - DNA, 60 bp, Homo sapiens
gctcactgccaacctgggactggatcacaggactctttccgacccatgttgccagtcagc

SEQ ID NO: 6841532 - DNA, 61 bp, Homo sapiens
catccaatagtgtctccaagtggaacagatatttagagaccatttggcaggagataggatg

SEQ ID NO: 6841533 - DNA, 101 bp, Homo sapiens
tgcatgtttttaagtaagttggatgtcagaggtaacaatttggattggttaatttcttcaacagtgatggcctttgtatttaatagctatgacaatatgca

SEQ ID NO: 6841534 - DNA, 80 bp, Homo sapiens
tggccaggcacatctgggtggacagaggggttccagccactcacagagccctctcagtcagagccagataagcctgggca

SEQ ID NO: 6841535 - DNA, 80 bp, Homo sapiens
tgattcaatggggtcaagatgaaccaggacattcatgttctaagctgcatgggatgtcctgtacctactttattgaaaca

SEQ ID NO: 6841536 - DNA, 58 bp, Homo sapiens
ccatctgactgccacccaggccaaggaccatccttgtaaactgggggggcatcagtgg

SEQ ID NO: 6841537 - DNA, 100 bp, Homo sapiens
gagatagcgaccaggggcaagctagacacaggggtttgccaacttgaaatatgggttctctcaaactttgtgtttgccttatggcctggggcttttattc

SEQ ID NO: 6841538 - DNA, 81 bp, Homo sapiens
gagtggagctcttcctcccagatgcaggacccttgtgatcagaaataatgtaggctcctgggagaaagtccactttcactc

SEQ ID NO: 6841539 - DNA, 101 bp, Homo sapiens
gcccgcgctcgggccgccctccctggcagccgcactcctggtggcagcggtctctgaggtaggtggtggcagccatggcagtggggccccggccgcagggc

SEQ ID NO: 6841540 - DNA, 56 bp, Homo sapiens
gagttaagggaaagttgtggtattagatgctggatcctacttctttgacttaactt

SEQ ID NO: 6841541 - DNA, 125 bp, Homo sapiens
gtgtgtagggaaaaacattctgacatttgatagtattcttgccagcatttatagggatttttaaaaattcctgtggtttgctgtgtgtgagtcttgtctacctggatagacctttccctccagac

SEQ ID NO: 6841542 - DNA, 73 bp, Homo sapiens
aggtacttagtgaatgttggctattaatactattactatatatgcagtgttactaataattcattcagtactt

SEQ ID NO: 6841543 - DNA, 127 bp, Homo sapiens
ggcaaagactcaaatctaatatcactgaggcttctgccaggcagagagcagtggccgtctgctcaccgcagtggccagtgtgtctttgtgaagagcaatggaggccaggattgaggtgagtattgtc

SEQ ID NO: 6841544 - DNA, 74 bp, Homo sapiens
taccatccatctgcatctgaatatcccaggcatatctatagcagattgtaacatgttcagatcactgggaggta

SEQ ID NO: 6841545 - DNA, 84 bp, Homo sapiens
aactcacttgcagtttgttcccagatttgctggcaagaccactcttcatgtggtcctgtttctggaacagactccaactcagtt

SEQ ID NO: 6841546 - DNA, 78 bp, Homo sapiens
ataatgacaagacatagtctctgagtgtctcctttccttccactagacttgaatcaatactatgattttgtacattgt

SEQ ID NO: 6841547 - DNA, 61 bp, Homo sapiens
agattcaagtctagggctctacacaatgtgacaaggcctgctggagccagggacctgttct

SEQ ID NO: 6841548 - DNA, 74 bp, Homo sapiens
gcttggcaggtatgagtgagaaatgaaattggcttaagccactgatatcatttgttacagccacatacctgagc

SEQ ID NO: 6841549 - DNA, 86 bp, Homo sapiens
aggtgtgagaacatttgcagggagagtagtgctggataaaggtcattgcaccatgaaagccttcctttatatgtctccagctacct

SEQ ID NO: 6841550 - DNA, 72 bp, Homo sapiens
actgccccttgaaggcagggagtcctgaggctgtttctagcatgacccaggccaggccttccagggggaagt

SEQ ID NO: 6841551 - DNA, 76 bp, Homo sapiens
aattaattcaatgtttcttatcaagttgaaatcaggagggttttcaggtcagctggatgggagaccatgtttggtt

SEQ ID NO: 6841552 - DNA, 63 bp, Homo sapiens
cactagagcttatttagcaatgcttggaagaagtagttcagcatgaaaagaataggcctactg

SEQ ID NO: 6841553 - DNA, 56 bp, Homo sapiens
cacaaggttggctctttctttgtgcctgaagagcacacatgagttctcatcttgtg

SEQ ID NO: 6841554 - DNA, 120 bp, Homo sapiens
gtctgttctaacttgtgcagagaaaatgagtttttaattacttctgccaacctcggaactgccggtcttggaggcatttgtgtggcggaaggattccacctgtaggagtgggtgataggc

SEQ ID NO: 6841555 - DNA, 74 bp, Homo sapiens
ttgaggtgaaaatggaaaatcaactgcagaatatatggtattcagagggttgaatttttagggctttgccttaa

SEQ ID NO: 6841556 - DNA, 59 bp, Homo sapiens
ggaaatcagagttgtgtttatattaaggagcagggcatgcaaatacagcagctgtttcc

SEQ ID NO: 6841557 - DNA, 90 bp, Homo sapiens
tcatgctaccagctaggtaatagacttgcagcccatgggaacaaagaggacttacatgcagctgctctgtttcttagctgggtaaaatga

SEQ ID NO: 6841558 - DNA, 61 bp, Homo sapiens
cttaaagggagaagagtgacctccacccctcctgcactggagtatatttctctctcttaag

SEQ ID NO: 6841559 - DNA, 83 bp, Homo sapiens
gatcgtgatgtatttcttaggctattgttggcctccacacaaattcatggagttgctggatgtggtttaaagggtacaagatc

SEQ ID NO: 6841560 - DNA, 72 bp, Homo sapiens
cctggtttagtgtgagtaattgagtctgtcttcattcctgatgactatcctttgttcattccaatagccagg

SEQ ID NO: 6841561 - DNA, 107 bp, Homo sapiens
ctgtttgctggctgtatcttggaagctggaacagaagcactggagagatagtaaaccaacattctccatctgtccatttaggaaatgccacctgagccagcagccag

SEQ ID NO: 6841562 - DNA, 78 bp, Homo sapiens
gatggccattgctggtgtaagcccctgttttggagccatttgctcctcagcagtaaacgtccggaacatgggtccatc

SEQ ID NO: 6841563 - DNA, 59 bp, Homo sapiens
gcactggttaccctgagtggctgcaggcagagctgatggtcagcaggtccagccagtgc

SEQ ID NO: 6841564 - DNA, 79 bp, Homo sapiens
acaaagttggttagtggaattcttctgcctatataataacatcacagtatttcagagttgttttctgtcctctctttgt

SEQ ID NO: 6841565 - DNA, 63 bp, Homo sapiens
gctctatgggcacagccagtgtgtccctacctcatgattggagccatggctgccccatatagc

SEQ ID NO: 6841566 - DNA, 65 bp, Homo sapiens
ggcatctttctggtgcccatgcaatttatatcagtgagcactgattgggcaccagatgggatgcc

SEQ ID NO: 6841567 - DNA, 100 bp, Homo sapiens
cagaggatcacatggaaggggccttgcagtcgttaagctcaatccttcttttcacaatagcatggactgcagggcatcctggccaagtgacatcctactg

SEQ ID NO: 6841568 - DNA, 60 bp, Homo sapiens
gggtagagtacagaaaaaggagtacgcaaccgcaatctcactttctcatgaatttggccc

SEQ ID NO: 6841569 - DNA, 97 bp, Homo sapiens
ccatgtcccctgcaccttcttggagtattgggcctcaggaagcagcctctgttctgaatcccaaactctgaaagcaggagtgtccttggggacctgg

SEQ ID NO: 6841570 - DNA, 73 bp, Homo sapiens
tgtatgatgattgatgtgttcattgattgtggtaatcttcacaatgtatgtgtatatcaaatcaagttataca

SEQ ID NO: 6841571 - DNA, 60 bp, Homo sapiens
ggaaaggagatgaataggattaagctataaatacagcctggagattgtcatctcttttcc

SEQ ID NO: 6841572 - DNA, 77 bp, Homo sapiens
cagaagatctgagattttcagcatcacttcagcaaaaattgttatggtaataatatgaaggtctttaaatcttgctg

SEQ ID NO: 6841573 - DNA, 61 bp, Homo sapiens
ttggctcatgctgttttgtgcagtgcacaaattgcacaactgtatacagcaactgagccag

SEQ ID NO: 6841574 - DNA, 88 bp, Homo sapiens
ccaggaagaaacggatcgcatggctcatttatcttgcagccattaattaatggtggttaattgtagttatgagctgttgaattccagg

SEQ ID NO: 6841575 - DNA, 101 bp, Homo sapiens
ttgagacggagtcttgccctgtcgcaggctggagtacagtggcacgatctcggctcactgcaacttccgcctcccaggatcaagcgattctcctgcctcag

SEQ ID NO: 6841576 - DNA, 102 bp, Homo sapiens
tcgcagttctccatgaaagagtaggatctcaccatggccatactctgatatctgactcatctgaattgcttgctgagattaaagcttgaaatggagagtcga

SEQ ID NO: 6841577 - DNA, 64 bp, Homo sapiens
agagacagggtctcaaatataggcatgactggtggaggtcatctctgtgaatgaggcagtttct

SEQ ID NO: 6841578 - DNA, 74 bp, Homo sapiens
tcagtgttgaaaccctgctgtgtgaagacatttaagaagggagaagagttatcaccagaaggggtcaataaaga

SEQ ID NO: 6841579 - DNA, 71 bp, Homo sapiens
tgggtttagcccaccaccctgctccccatcaggaaatccatgggcagcaaagactgtgtgctctaaatcca

SEQ ID NO: 6841580 - DNA, 69 bp, Homo sapiens
ctatgggttgctaagggacgtgccactctgaagcgctgcatgcacgtggcaactccttagcacctgtgg

SEQ ID NO: 6841581 - DNA, 77 bp, Homo sapiens
ttcatattcccaatgtctagctgacacggtacttggtatatacaggacactcagtaaacgacaatgggattaatgaa

SEQ ID NO: 6841582 - DNA, 64 bp, Homo sapiens
cttcataggcttacttgagaaatgttgtatagttttgtcatttctatgcaaataagccatgaag

SEQ ID NO: 6841583 - DNA, 79 bp, Homo sapiens
gcttacctcaaagctttgcatattcggcccgggcaactgaatgccgcgttgggaccagatgcaaatgctgcaggaaagc

SEQ ID NO: 6841584 - DNA, 77 bp, Homo sapiens
gctatatctacatttgctgtttggctcctcttataaatatcactcagactaacagattgtagtgtagatataattgc

SEQ ID NO: 6841585 - DNA, 70 bp, Homo sapiens
tggaacaaattacaattaactttgtagttataagttaatatgaagtggttaatatgtaaatttgtgacca

SEQ ID NO: 6841586 - DNA, 86 bp, Homo sapiens
ggagaaggaacaaggtgctgtggacttgggagccagaaaaggacctggcttggtgccagctatgcatctttctacccattgcctcc

SEQ ID NO: 6841587 - DNA, 66 bp, Homo sapiens
ttatatttgggttgtttgtagtttttggccattatgactgaagctgctatgaacattcacatataa

SEQ ID NO: 6841588 - DNA, 57 bp, Homo sapiens
gcttcaagaatctgagtaattagttgaactgtcttgtttaactaaagatctttaagc

SEQ ID NO: 6841589 - DNA, 116 bp, Homo sapiens
catgccacatttcttttgatgatgtcatatttttgcagggttggatttttactagttgtgatacagatcaagcactgtgcaaaaatcagtgtggaacaggaaaggagggtggcatg

SEQ ID NO: 6841590 - DNA, 60 bp, Homo sapiens
ggcagtgcaaggcagcctggatttgggtgcaaagccagggccaggcccacgatgcacgcc

SEQ ID NO: 6841591 - DNA, 59 bp, Homo sapiens
ggttctgtggcttttctctttgggttccttcctagagatgcggttccatggttatgacc

SEQ ID NO: 6841592 - DNA, 63 bp, Homo sapiens
tgctgggcaaattgtgccagctatgggtatcaattttatagcttatcccacagtgcccagaca

SEQ ID NO: 6841593 - DNA, 68 bp, Homo sapiens
ggcctgagaaccatggggccaatgggataagtctcagtccaagtcccaaggcccaagtactgagtgcc

SEQ ID NO: 6841594 - DNA, 57 bp, Homo sapiens
ctgtgtgtttatatcatttcctcaactcagatactgaggcaggattcaaacacagag

SEQ ID NO: 6841595 - DNA, 74 bp, Homo sapiens
gcctgcctctgtgtgaatctattgaatatatgtgcatgcatgtaacggcaggatttttatggtggtaatatggc

SEQ ID NO: 6841596 - DNA, 122 bp, Homo sapiens
ccctcacaccctcccctttttttttccacccaccaggtggggttcagtctcagccgggttcggtctggcagagttcgctcctattcagtgagtggagggcatggggaagacgggagaagggg

SEQ ID NO: 6841597 - DNA, 77 bp, Homo sapiens
cctactacccctgaaccccattccatcctagagtctatggtaggaagcactggaaggggttggggggggaaacgagg

SEQ ID NO: 6841598 - DNA, 62 bp, Homo sapiens
tgaaagccaggctgaagttctcctcctctaccacactgagaagaaaaaccagcatgttttca

SEQ ID NO: 6841599 - DNA, 62 bp, Homo sapiens
agccagataatttactgacctgcttccctcctgtgaggtggctcccagtgttgttgtgtgct

SEQ ID NO: 6841600 - DNA, 62 bp, Homo sapiens
tgggtgcaagaaggggagactgggtacaaaagcttgagctcatttctgtttcttgcaactta

SEQ ID NO: 6841601 - DNA, 62 bp, Homo sapiens
ggggtgggctggggctgagacccatggcatgaccccaattctctctcctcaagctcgacccc

SEQ ID NO: 6841602 - DNA, 66 bp, Homo sapiens
aggccatagaagtctgtttttctgggtcagttttttttgcctgagaataacaaattgctgctgtct

SEQ ID NO: 6841603 - DNA, 82 bp, Homo sapiens
gatagggaaaaaagcttgatgcagagtcagggagagcagctcccttgttccttcactctgcacttaagtaatcaaccttatc

SEQ ID NO: 6841604 - DNA, 99 bp, Homo sapiens
aatgaaataatgcaatatgtacacttacaggtatatcttcttagtaaaatgtatttaagcttcatatatgtgtgagtcaatagtttgtgtctcttcatt

SEQ ID NO: 6841605 - DNA, 105 bp, Homo sapiens
ctgattttcttgttgcattttattttacttatgagtataagttgcattttattttacttatgagtgtcagctaattattcatgaattaaactgaaggatgatcag

SEQ ID NO: 6841606 - DNA, 56 bp, Homo sapiens
tggggaattgcaataattagggtaatgtgtccacccaaaattattccaactctcca

SEQ ID NO: 6841607 - DNA, 61 bp, Homo sapiens
aggtgccagcagaatgtgtgtgacaagtagcctccctaagtgacactgcatctgttgtcct

SEQ ID NO: 6841608 - DNA, 80 bp, Homo sapiens
gacagccccttgtcttggtttccacttgctgaagaaaggagtcctgttgtccttgtgagagtggagagagcacggttgtc

SEQ ID NO: 6841609 - DNA, 75 bp, Homo sapiens
gatgcccacagtcagggcccagatgttcacatgcttggcggtggaggcataggcctgggccctgttcaggtcgtc

SEQ ID NO: 6841610 - DNA, 88 bp, Homo sapiens
caggcgcacgctcaccctggggatcagccccgcctcctgcttcagcagctggctcagccgggtggtcttcttggagagggtgtgtgtg

SEQ ID NO: 6841611 - DNA, 84 bp, Homo sapiens
tgtctgctagtgtattgagcatccactgtatgcagttccctgcgctttgagtactttggatccttacaatagcacttttagata

SEQ ID NO: 6841612 - DNA, 59 bp, Homo sapiens
ccttataggggtgctgtggggactgatgtgagaatatgttatacacattcctggtgagg

SEQ ID NO: 6841613 - DNA, 71 bp, Homo sapiens
cctggtctgcggggtggagggttctgtccaaggcttcccgagggcccggaccttcctctctgagttccagg

SEQ ID NO: 6841614 - DNA, 75 bp, Homo sapiens
ggatagagacattcattaagcctttctgtaacttgaatgaaatatcacacagagagatataatttgttttgatct

SEQ ID NO: 6841615 - DNA, 58 bp, Homo sapiens
tctaactctgccaggacacagatccacagggtcagccctgcatcctgagcagcttaga

SEQ ID NO: 6841616 - DNA, 80 bp, Homo sapiens
ggccagggcatctggagtcgggcgggcagtgttcatgccaaacctcacaccctcgtctcctacttgggatcctcagagcc

SEQ ID NO: 6841617 - DNA, 89 bp, Homo sapiens
cctcatgtcagcatgtgcagtgccacagaggtgaagcccactgcccttttgtagtcagctctctctgtggccatgcgcactcattcagg

SEQ ID NO: 6841618 - DNA, 64 bp, Homo sapiens
ctaagggatagggtcagaaatggggagtggactcacttttcattgaatgtgcttttctacttag

SEQ ID NO: 6841619 - DNA, 70 bp, Homo sapiens
tcaatattatatttaagatggagatttcaaatataagtttgaaggaggctcctttttaaaatagtactga

SEQ ID NO: 6841620 - DNA, 64 bp, Homo sapiens
gtccccagtcccccagggccgcctgtgtgcagttcccgccagcatccctcaggggcctctggac

SEQ ID NO: 6841621 - DNA, 72 bp, Homo sapiens
atccaatggatattttatgtgagaaaactgttagtatacagcattcctttccagtaaattattgagttgggt

SEQ ID NO: 6841622 - DNA, 69 bp, Homo sapiens
cttcatattgtaagtagaaatgttatggtctcaaccttcagcccatgatttgagctacttactgtggag

SEQ ID NO: 6841623 - DNA, 67 bp, Homo sapiens
tggtgcaggtgatgtgatgtgagcatctttcattgctaaggactcacttccacttttatctccacca

SEQ ID NO: 6841624 - DNA, 56 bp, Homo sapiens
gggtgttcccattttacagatgaggactctgagtcatgtgagagggtggcttgccc

SEQ ID NO: 6841625 - DNA, 55 bp, Homo sapiens
gtgtgttccacatgtgtttggccattatcttattgtcacacataagtgaacgcac

SEQ ID NO: 6841626 - DNA, 56 bp, Homo sapiens
gagttggtcgagccacttcggggacaggggcaggcctctgtctgcttctccaactc

SEQ ID NO: 6841627 - DNA, 81 bp, Homo sapiens
taggtatatttctgtttgtagtagagaggggtggctttcaaactgagccatgataacatttcaacaggcagagaagactta

SEQ ID NO: 6841628 - DNA, 100 bp, Homo sapiens
tctcctgagacaatacccatctcagaggctctggtctggaccccctagcccaggaatgcacactctgagaatttcttctgggtgtcccctcctcaggaga

SEQ ID NO: 6841629 - DNA, 56 bp, Homo sapiens
tctaggtttcttttgctcctggaccttcatactagttccagtggcctgaatctgga

SEQ ID NO: 6841630 - DNA, 57 bp, Homo sapiens
ggggcgaggaagcaattgagttatatgccccttaaaattcacaggtatcctctccct

SEQ ID NO: 6841631 - DNA, 78 bp, Homo sapiens
ttaatgggcttgcatcacagtatctctgtaatgctcaatcctggtattgtgcagaactgctggtgtgagccgcattga

SEQ ID NO: 6841632 - DNA, 68 bp, Homo sapiens
gctctgttaagtctggaatgaaagttatctttaacagccagactttcagactcagaacttagcaaagc

SEQ ID NO: 6841633 - DNA, 57 bp, Homo sapiens
agacagccagggacatacaatggtacccaatcctgtaccattaacacccaggtttct

SEQ ID NO: 6841634 - DNA, 66 bp, Homo sapiens
tgtatttttctatttgtatgctgctcctaaaaggatctaagacagctaacagatcgacaaagtata

SEQ ID NO: 6841635 - DNA, 62 bp, Homo sapiens
gggtgacatagtgatggggcataaagcacttcccaccaagctagcaaatcactgtttcagtc

SEQ ID NO: 6841636 - DNA, 62 bp, Homo sapiens
gaagtgcattctcctattacattaataataattttacagtatggtggcaggaaatgcacttt

SEQ ID NO: 6841637 - DNA, 66 bp, Homo sapiens
tccaagctatcttcctgcagccttcatcagtgataccacatctgggtgaaggaggaagctgatgga

SEQ ID NO: 6841638 - DNA, 78 bp, Homo sapiens
gcgtggcgggagggtcttcctaatttgctattaggatgaattcctagcaagatattatggaatgacaattccacatgc

SEQ ID NO: 6841639 - DNA, 111 bp, Homo sapiens
gctctccatggaccattttactcagcctgccaagctgtgttctacacctttgtttttagacacaagcagcttttgagcggaaacctgaaagaaggtcagtgttgtgggagt

SEQ ID NO: 6841640 - DNA, 83 bp, Homo sapiens
tgggtttggtggaatctggggactcctcagagcaaagcaggggcctttgctctgtcagggcctcagtctcctccccatcccca

SEQ ID NO: 6841641 - DNA, 69 bp, Homo sapiens
ttgggtacaaaaaggaagccaggatcctcctgtcaacaagttgattcgggagataaggcttctgcccaa

SEQ ID NO: 6841642 - DNA, 69 bp, Homo sapiens
gggtggtattttaaaactagcagctaagacataattttttaaagaattcttgttgttagtatatttccc

SEQ ID NO: 6841643 - DNA, 62 bp, Homo sapiens
gctagttttaagcctagaactcaagatgcctaggctcttgagttctaggcttaaaactaagc

SEQ ID NO: 6841644 - DNA, 62 bp, Homo sapiens
ctagatgccaatttttatggatgtcagcccaacgatattccataaagtatttggcaatctgg

SEQ ID NO: 6841645 - DNA, 67 bp, Homo sapiens
gctctgaaatcatccaagcagaaaagtgagaaagcacgttttatggtttgctgaatgattccagggc

SEQ ID NO: 6841646 - DNA, 66 bp, Homo sapiens
atccattgaacctagagatgcttatgaacaccactgtgtgccaggcactgtactaggtacagggat

SEQ ID NO: 6841647 - DNA, 71 bp, Homo sapiens
ctcaggctgctggccagcaggctgtagccccattgcattggcttctaagcctcatggctcatgtccctgag

SEQ ID NO: 6841648 - DNA, 56 bp, Homo sapiens
tgtccagccggcccacgcccatcttctcgaagagcacggtgggtttggctggcacg

SEQ ID NO: 6841649 - DNA, 68 bp, Homo sapiens
gtcttctcttcagctctgcttctcccattcatttaggtaattactggagggagccagctgtggaaggc

SEQ ID NO: 6841650 - DNA, 58 bp, Homo sapiens
ggaggctccactgctcttcctgggatcaactgttcctagaagagaagcaggaccctct

SEQ ID NO: 6841651 - DNA, 115 bp, Homo sapiens
gaggttaaaatactgcttaaaaagggaaacactcaatttagtaattcggttgcctagatgaaatcgagtggctattgatccgtgatgtttctagatttttaagactatgtacttc

SEQ ID NO: 6841652 - DNA, 69 bp, Homo sapiens
ggtggaggatgtgccaccagctttgcaactcccaaggggccttagcagtctggtgggcagattcctacc

SEQ ID NO: 6841653 - DNA, 61 bp, Homo sapiens
gaagcacagggctcgatctcagcaggaaaacatccctggcatggggacagcccgtgcgttc

SEQ ID NO: 6841654 - DNA, 58 bp, Homo sapiens
tcttgcagactcacaaggtacttgcgcatatcaaaggccttgagaagtcctgcagtga

SEQ ID NO: 6841655 - DNA, 65 bp, Homo sapiens
aagcaatcaaatatgtgatagaagctaatttgaaacaatattagctttatatatttggatcgctt

SEQ ID NO: 6841656 - DNA, 63 bp, Homo sapiens
ttctgcttagagggcatttgcaattagaaataaacatttctgtgtgagtccatctgagcagaa

SEQ ID NO: 6841657 - DNA, 59 bp, Homo sapiens
ggcagcttcggacggcttataattggttccagttaatctctgccgccctgagaactgcc

SEQ ID NO: 6841658 - DNA, 56 bp, Homo sapiens
cttattttgatccttgcttcttgtgatcaatggcacttaagccaggtcaagataag

SEQ ID NO: 6841659 - DNA, 62 bp, Homo sapiens
cactgaagcctctgttcaatttgcctaggggccagctaagtattgcacagaggtttcaagtg

SEQ ID NO: 6841660 - DNA, 74 bp, Homo sapiens
gctgtgtttgacaacaggctcacagaattcctgaacccttgacaatggattctcacaagcccttgcgagccagc

SEQ ID NO: 6841661 - DNA, 73 bp, Homo sapiens
gtcaatgtaaatattttctaatcaacaattatgtcctgcatcccgaatgattacggaagatattcccgtggat

SEQ ID NO: 6841662 - DNA, 79 bp, Homo sapiens
ctgtcttctgtattaaaggagtgtataattgtagtagtttactgaaatggggacagtccttagtggttgtttggagcag

SEQ ID NO: 6841663 - DNA, 64 bp, Homo sapiens
cgcaggcttctcaataggtttgaagtggacaagatctatgaaagccaagtggagaagactggtg

SEQ ID NO: 6841664 - DNA, 58 bp, Homo sapiens
catttttcgtcattggattttagcctgggaggaggctaggtctggcagaagaaaaatg

SEQ ID NO: 6841665 - DNA, 56 bp, Homo sapiens
ttggcccacagtaccatgctgtcaactgcatatgacatgggttattgtgaggttaa

SEQ ID NO: 6841666 - DNA, 105 bp, Homo sapiens
tagctggctgtggtggtgtgcacctgtagtcttagctacccaggaggctgatgtgggcttgagcctgggaggctgaggctgcagtgagccatgatcatgccactg

SEQ ID NO: 6841667 - DNA, 74 bp, Homo sapiens
tatgtgacaaaagtaaactgcatgacttctgatgctatgtcataagaaccccgtagttctacttcagtctcatg

SEQ ID NO: 6841668 - DNA, 83 bp, Homo sapiens
agccaagttttaaacttagaaggaacagtttagtgcagtagtcttgtattgaaaaactttctgagaaattaaaaaattaggct

SEQ ID NO: 6841669 - DNA, 62 bp, Homo sapiens
ccttcatgtccttgtcctctaacgtcagcatcacctgtgtaagagaaaagtgatcgtggagg

SEQ ID NO: 6841670 - DNA, 55 bp, Homo sapiens
ggtggctcatgcctgtaatcccagcagtttgggaggccaaggcaggcagatcacc

SEQ ID NO: 6841671 - DNA, 58 bp, Homo sapiens
gaaagagccttaggagtgagccacatggctttgtcaaacactctgagcttgctctatc

SEQ ID NO: 6841672 - DNA, 60 bp, Homo sapiens
gggctggagatgcttatggagagttccagggaatgtttcttctcagtaggcttccagctt

SEQ ID NO: 6841673 - DNA, 111 bp, Homo sapiens
actagacattcaaaaacactccctggcagatttaacattggaactcgttttgaaagaacaatgtggaatctccttcactgggagtttttgaataagtatgaaatttctagt

SEQ ID NO: 6841674 - DNA, 55 bp, Homo sapiens
gccagagcagaatagagtggcctaagacatctgggatctctggaatgactctggc

SEQ ID NO: 6841675 - DNA, 76 bp, Homo sapiens
ctaagccctgatggctggtgatactggagtgaggagaatgtcctgatacccagagatactagtttctagggaagag

SEQ ID NO: 6841676 - DNA, 55 bp, Homo sapiens
agggctggatgctctggtcttctaaaagaaagctgggcagggcatcaacagctct

SEQ ID NO: 6841677 - DNA, 87 bp, Homo sapiens
gagaccacctctttcttccctctgctccccagcaaactcctcatccttccatggggcagaagaccatggtggaaagagtgtgtgctc

SEQ ID NO: 6841678 - DNA, 58 bp, Homo sapiens
cttcttccccctgcctcctccctggtggaggagcactaattcctgcagagggagggag

SEQ ID NO: 6841679 - DNA, 72 bp, Homo sapiens
gtctgcatttcggcccctgcgggacaatagaggcctctctccctttgtgcccgggcccgggcctctgcagac

SEQ ID NO: 6841680 - DNA, 64 bp, Homo sapiens
ttggaaacaagatttctacttaaagcctccactttctaaagctttcagagcagcttgttttcaa

SEQ ID NO: 6841681 - DNA, 58 bp, Homo sapiens
caaagtccatagtttacaatagagctcactcttgttgttatacattctatggattttg

SEQ ID NO: 6841682 - DNA, 62 bp, Homo sapiens
gagtatacctgtctgtatcggttcagagttcatggcgaacctgtcaagtgaagacactactc

SEQ ID NO: 6841683 - DNA, 64 bp, Homo sapiens
ggaagtctcagcaacagagttaaagattctattctattgactatttgcagttgttgggactttc

SEQ ID NO: 6841684 - DNA, 77 bp, Homo sapiens
tcatgtctgggagtcctatattcttttaaaatttgcattagattaattgtggaacctgtatggtctctcttgcatga

SEQ ID NO: 6841685 - DNA, 66 bp, Homo sapiens
gaagcctggtccagagctcccatcaagcctcccatggggatgtcactggggttcagggaaagcttc

SEQ ID NO: 6841686 - DNA, 71 bp, Homo sapiens
agttacctgttttaaagctaaaaggggtcatgactatctataattatctattttatctaagataggtgact

SEQ ID NO: 6841687 - DNA, 73 bp, Homo sapiens
ctatcttttcctcagcagcagtcacggccgccgctgcctcggcaggatgccatctgctgctgctgctggatag

SEQ ID NO: 6841688 - DNA, 111 bp, Homo sapiens
agaggtggtgtcacccaggccttgctggggaacatggagcttggggtccctgggacaccgcggagggtccacgtttccccgagtccatcggcaggtgtggacaccgccttt

SEQ ID NO: 6841689 - DNA, 74 bp, Homo sapiens
ggagggggctggtcagagagaaaggaggccctgctaggcagagtccccagctaatctctttgcccacaccctcc

SEQ ID NO: 6841690 - DNA, 75 bp, Homo sapiens
acatttggagatgggcactcaggctgaggccgtgaaagacttaaggcctttctagctttgtgctcctccatttgt

SEQ ID NO: 6841691 - DNA, 59 bp, Homo sapiens
agtaagtccaaggctgggtgcagtggctcatgcctgtaatcccaatgctttggaaggct

SEQ ID NO: 6841692 - DNA, 130 bp, Homo sapiens
ctctgggtgcaggtcagaggcctccctgtctgtgctggggtccagctgagccagggccactgagcccttgagggctctgcaggcctcgggatgggaagggaaggtgtgggagatgaccctgagcccgggg

SEQ ID NO: 6841693 - DNA, 58 bp, Homo sapiens
aatgctggatctcctccttggcatgcttattatctccctcgggagcagatccaccatt

SEQ ID NO: 6841694 - DNA, 72 bp, Homo sapiens
gtgtgacccttgtcctcaaggtcaggatagagttccagctgtcatatcccattggccaggacatagttgcat

SEQ ID NO: 6841695 - DNA, 71 bp, Homo sapiens
cacagacaggctctgaggcagattttcgttttagctttaggatgatcactctggctcaagggatgtgtgtg

SEQ ID NO: 6841696 - DNA, 60 bp, Homo sapiens
ccatgaagttaggaactgagcctggctcttcactacaaggatcaaattcctaagttctgg

SEQ ID NO: 6841697 - DNA, 70 bp, Homo sapiens
tggaataaatccagtgttcaaagtttgaagaaatccggtcggcttcaagcaagcgtctagatttatccca

SEQ ID NO: 6841698 - DNA, 56 bp, Homo sapiens
ctggacctggttgttttgagtcagttcagtggcttggccctgccgcctgggtccag

SEQ ID NO: 6841699 - DNA, 67 bp, Homo sapiens
ggaatgcctagtatctaagcagacctgcttagctggtctaacaagcattaggaacccaaggtatccc

SEQ ID NO: 6841700 - DNA, 62 bp, Homo sapiens
cagttcattgcctctgtggatatacttgctttcacaggtaaggaaattgaggcaattaactg

SEQ ID NO: 6841701 - DNA, 61 bp, Homo sapiens
tgtgtgggtaacaatccacatcaaaagtgagctttacattgacttggattgttagacatca

SEQ ID NO: 6841702 - DNA, 60 bp, Homo sapiens
catgggccagttggaatggatactcaggtctccctgcagttaggccccctggtcaccatg

SEQ ID NO: 6841703 - DNA, 99 bp, Homo sapiens
aggaaggattgggtcattagcttggcctttcacactcccaaattgttgggttaggcaaggactggcagtgtgaggggtcagaccacagcaatttctcct

SEQ ID NO: 6841704 - DNA, 66 bp, Homo sapiens
accttggggatacactggccaagtggaggagctgatggcagactcctcccagtgtgtccctgttgt

SEQ ID NO: 6841705 - DNA, 56 bp, Homo sapiens
gtttccctttgattttcacagtaggctgttctgtgtgggaatgttggagaggaaac

SEQ ID NO: 6841706 - DNA, 59 bp, Homo sapiens
atatctgtggagggcttacaaatgagtacctggcacaggaataagcccttcacaagtgt

SEQ ID NO: 6841707 - DNA, 65 bp, Homo sapiens
tcctcttctctagagccggaatcccctaggagcatttccttgttttcctcctctggagaagaaga

SEQ ID NO: 6841708 - DNA, 68 bp, Homo sapiens
cttattgtgggcattgaaaactgatgcatgttattatcatgaaatcaattgcaatgtttattcttaag

SEQ ID NO: 6841709 - DNA, 58 bp, Homo sapiens
tcttctgtggcttgtaaagtggctctgaaggaaagtcatgtcttaggaaagcagagga

SEQ ID NO: 6841710 - DNA, 69 bp, Homo sapiens
ggggaggagaggtgggacctgccctaggccctggcacctttgggccctcaccaggaacctctccttttt

SEQ ID NO: 6841711 - DNA, 79 bp, Homo sapiens
cttaatcactcaggagggatcagctatcactgccattaaaagacaaatgctttgatggttctttacctggaagaataag

SEQ ID NO: 6841712 - DNA, 130 bp, Homo sapiens
ttgggaatgagggcctattcccaggccacacacagaaccgctcgccacttgaaccctaacttctaatcttccagtggctcaagtggtgggcagttctgtgtgtggcctgggaataggccctcatccccaa

SEQ ID NO: 6841713 - DNA, 55 bp, Homo sapiens
ctatgcagtggggcaggtgaggcttggcctgcccagcctgtcctgagtgtcatgg

SEQ ID NO: 6841714 - DNA, 63 bp, Homo sapiens
gactcaacacagccattcccctagaagttacagcacttctagggtcacctgtgttcagagatc

SEQ ID NO: 6841715 - DNA, 76 bp, Homo sapiens
ggagtgcagtggcaggatctcggttcactgcaacctccgcctcctgggttcaagtgattctcctgcctcagcctcc

SEQ ID NO: 6841716 - DNA, 75 bp, Homo sapiens
gtccacctgtggttgtaaacatcgaaagagtgactgcttctctttacatttttttgtagcaagcgcagataggac

SEQ ID NO: 6841717 - DNA, 60 bp, Homo sapiens
cctgagttctttgatagctgagatgtctttaaatattggtgcaatagtcaggagctcagg

SEQ ID NO: 6841718 - DNA, 79 bp, Homo sapiens
ctggctcttggctagggagagtcacaagtgggtagaacatgttttccaattctggagcagtctttggcccagagctcag

SEQ ID NO: 6841719 - DNA, 92 bp, Homo sapiens
actaaactggtgggttattcagtagagtagcaggatataagccacttatctatattgttaaactgtattgcataagggcccaccaaaatggt

SEQ ID NO: 6841720 - DNA, 77 bp, Homo sapiens
ttgcatagcaatgctgacagatgcttttagaacacatgttttttaaaatgttcaaaaggcacagcattgtctagcag

SEQ ID NO: 6841721 - DNA, 58 bp, Homo sapiens
ttggtcatattaattcaatcggtgaataaccacaaattgagctagtaatatagaccag

SEQ ID NO: 6841722 - DNA, 88 bp, Homo sapiens
tctgtggcttgtgaccacggcagacgcgcggcaccgcctcctccgtccttggcccacgcttcgctttgcccgttgtcatttgccagga

SEQ ID NO: 6841723 - DNA, 62 bp, Homo sapiens
ggtgagcctttagtaaggccttgacagaaatagcttatttccaaaaaggccatattctcatc

SEQ ID NO: 6841724 - DNA, 121 bp, Homo sapiens
actaaaaggtctattctcccatcaatgcataagggatttacaagtttaactctcattgctgttaataggaattctatgtgtgatccaagggtgtattcatggagaaaatgcatctattagt

SEQ ID NO: 6841725 - DNA, 55 bp, Homo sapiens
tattaacacgtataaagtgtttagcagagtgcttgacacatgtgcgtgttcagta

SEQ ID NO: 6841726 - DNA, 61 bp, Homo sapiens
tccatcctttacatccttctgtctgttcaagaaccagtctgggatcttgtactggcgtgga

SEQ ID NO: 6841727 - DNA, 82 bp, Homo sapiens
gtgttatttcacaaaacggactgaagatcttgaatttactgacatcataaatacaatttcaggctgtaattttgaatggcat

SEQ ID NO: 6841728 - DNA, 70 bp, Homo sapiens
tggggaagatttactatctaccacatatgcttcatctttattgtgtatttggctattgaattattcctca

SEQ ID NO: 6841729 - DNA, 55 bp, Homo sapiens
ggtggttcacgcctataatcccagcactttgggaggctgaggtaggtggatcact

SEQ ID NO: 6841730 - DNA, 63 bp, Homo sapiens
aaacagctccttagtttccatctgtgccgtcagctctcatcagaggaagcacaggagcagttt

SEQ ID NO: 6841731 - DNA, 57 bp, Homo sapiens
ggcttcctggagaaggtctgagttttattaaaggatgagacagtcaccaggcaggcc

SEQ ID NO: 6841732 - DNA, 76 bp, Homo sapiens
ggcttattcgttttctaggaccaacagagacgggggacattaggtttgtttgtggcgtagttcctaggaagaagcc

SEQ ID NO: 6841733 - DNA, 78 bp, Homo sapiens
tgccagctctttccctagtgatcttattagttgtctgctacatgtctaaataataagatactaagggagttgtaggta

SEQ ID NO: 6841734 - DNA, 67 bp, Homo sapiens
gtgctcaccatgggaacttgggcaagccaagggacttttctgggcctcagttgatctgtgtgagcac

SEQ ID NO: 6841735 - DNA, 66 bp, Homo sapiens
gcccggggaggctcttgagaggggagtaggctactccaggctgcattccagggagcctcctagggc

SEQ ID NO: 6841736 - DNA, 85 bp, Homo sapiens
tgttttctcttgtatgtgtattttgctgttttttactttgtacattctataatggacacaaatctatatgatgcaagaaaaggca

SEQ ID NO: 6841737 - DNA, 59 bp, Homo sapiens
ctctgggtcattcatcaatgaatgtattaagcatttattgaacacttgcactggcagag

SEQ ID NO: 6841738 - DNA, 56 bp, Homo sapiens
atgaggctgactcccatgtactgtgagtcagacttccaggcttggaacagccttat

SEQ ID NO: 6841739 - DNA, 76 bp, Homo sapiens
cagatgcactgagttattattgatgacagtaaaatgaacacatttaaattgttcaatgtaataattttgatatctg

SEQ ID NO: 6841740 - DNA, 86 bp, Homo sapiens
ggctgtctgctgcctggccaggcctcttggtgcccactgtgctcctgattagttggcgccggcaatggcaggagcagcagacggcc

SEQ ID NO: 6841741 - DNA, 101 bp, Homo sapiens
gatcattttcttgccatcatggtacaaatgagagttctgttttatggtaactaaaaaaagttctttacttatttgttatgatatggggtattttgatgatt

SEQ ID NO: 6841742 - DNA, 81 bp, Homo sapiens
taaaggtaacatgatgctatattcaaaacttttgttttacccagagtaaagcaagtgtaagaatgcagaatcatgtcttta

SEQ ID NO: 6841743 - DNA, 79 bp, Homo sapiens
tgtctgattttctcatagcttctgtctggatggtttcaaaaaactaatcattccacagctacgttttgagcatcactca

SEQ ID NO: 6841744 - DNA, 61 bp, Homo sapiens
agtctcttggcattctgaaacagacaaaatcactgatttgtaccaggagtttcagcagact

SEQ ID NO: 6841745 - DNA, 55 bp, Homo sapiens
tagtgtgggaggccttagcctgttcttagatcaaactctgaggccaactacactg

SEQ ID NO: 6841746 - DNA, 55 bp, Homo sapiens
tccctccccacttctgagctttgcagcaatatcaaaggctgaaggaggggaggga

SEQ ID NO: 6841747 - DNA, 59 bp, Homo sapiens
acagcattcaataaataataactactttcactatgactgttattatgtgtggttgctgt

SEQ ID NO: 6841748 - DNA, 89 bp, Homo sapiens
gttcgtggtcctagctctgttctcctctaccttcagatcatattcatattatgattttgtcagtgagaacagagttgcgatccatgggt

SEQ ID NO: 6841749 - DNA, 85 bp, Homo sapiens
acatggatatggcatccttcttaaattggctgcacagatacaatggtattctctgtgcagatttaagacagccaaaaatttaggt

SEQ ID NO: 6841750 - DNA, 93 bp, Homo sapiens
tttctctctctgtcacataatttatctgtaggaacatctgttgtgtgtgtgtataatgtctatggaaagattaatgtgacaaagatttggaaa

SEQ ID NO: 6841751 - DNA, 86 bp, Homo sapiens
agagttgaattcaagtccatgattcctctaagacctctgttgacctcattaaccagagtcagagagagtcatggaaaattaacact

SEQ ID NO: 6841752 - DNA, 72 bp, Homo sapiens
cagccaggggcacggggctgagccacgacaactccagggcttcccagtccctgctctcaagttcactggttg

SEQ ID NO: 6841753 - DNA, 60 bp, Homo sapiens
tgggactggatggaggcttagaaggagaaccccctccctccctccctcctcacagcccca

SEQ ID NO: 6841754 - DNA, 55 bp, Homo sapiens
gtcacatgttgcattagtgtggcatgtttgtcacaattaatgaatacattttgat

SEQ ID NO: 6841755 - DNA, 63 bp, Homo sapiens
agcctcctgggcaagaaacaggttgtatacattaagcaatagaagctgaggcttagagaggtt

SEQ ID NO: 6841756 - DNA, 63 bp, Homo sapiens
aaatacttctagaaatactatgcaaagatattcctgtctgtgtaagtacttatggaagtattt

SEQ ID NO: 6841757 - DNA, 78 bp, Homo sapiens
gctttgcctgttttattctgttgtatcttgtgcctagaagagcaccttaaatagtctcaatgaataaacgggagaagt

SEQ ID NO: 6841758 - DNA, 97 bp, Homo sapiens
ccaatattaatgagaaatgagtcacttattattggggtgcaaatagagagataaatgacatcagtaattaagtctcaagccctctttggtataatgg

SEQ ID NO: 6841759 - DNA, 83 bp, Homo sapiens
gccttctggtatcctgcagttgagtgcatctttaggatggtgataaacatcaataagtaggatatcaagataactagaagggc

SEQ ID NO: 6841760 - DNA, 61 bp, Homo sapiens
atgctcaggttttgcccaagaccacttacatgagaatcttctgggagttgaaaccgggcat

SEQ ID NO: 6841761 - DNA, 79 bp, Homo sapiens
catatctgtagatttattggtctttcattggtaagcattggcaatgaaagttccaataagaactggatttgggggtatg

SEQ ID NO: 6841762 - DNA, 68 bp, Homo sapiens
ttttctaactgttcctatggggaggcgaatctgtaacaagctcctctgcctttagtgaaagttgaaaa

SEQ ID NO: 6841763 - DNA, 65 bp, Homo sapiens
ttgtgctgcgtaggacgtggacaaggatgtcacgtgatctccaatatcaagtcctaggcccacaa

SEQ ID NO: 6841764 - DNA, 59 bp, Homo sapiens
atagttcctatcctagagccatttgaggatctgacatcggttataggagagggaattat

SEQ ID NO: 6841765 - DNA, 59 bp, Homo sapiens
ccactgagggcggagcccagggaggacatctctcccttccactatccccctactggtgg

SEQ ID NO: 6841766 - DNA, 93 bp, Homo sapiens
ggccaggatggtctcgatcccccgaccttgtgatccacccaccttggcctcccaaagtgttgggattacaggtgtgagccaccgtgcctggcc

SEQ ID NO: 6841767 - DNA, 77 bp, Homo sapiens
tgtatgtattgagtagctgttatgtgccaagatctgttctcagtgcttttcatacattacctaacttaatgctcaca

SEQ ID NO: 6841768 - DNA, 76 bp, Homo sapiens
acatgtttactctgatctagaatttctgcacaaatcaattgagtgtgagcatgaggtctggcaatcagaaacctgt

SEQ ID NO: 6841769 - DNA, 60 bp, Homo sapiens
ccaggagagcagaagcccaggcctgtcctcaatgaagcagcctgggatagtggcctccgg

SEQ ID NO: 6841770 - DNA, 89 bp, Homo sapiens
ctgaaatctgtgtaggcttttggaaaagtgaaactagatgcaaagcacaatgatgtaattctggcaatttccactgacacagaactcag

SEQ ID NO: 6841771 - DNA, 80 bp, Homo sapiens
accagaaccagcccagcactaagtagatttgtgttggataaatgaaaatgaccattccgctttttgctgggctgtttggt

SEQ ID NO: 6841772 - DNA, 59 bp, Homo sapiens
caggtgctgcagggctggcgtcagcctccccaacagccgctccagctgtgcagcatctg

SEQ ID NO: 6841773 - DNA, 58 bp, Homo sapiens
tcaattcttattggtgttctgctatatatgagctttgtgaacatgaatgggttattga

SEQ ID NO: 6841774 - DNA, 72 bp, Homo sapiens
gggtaaagctggtgcctgtgggcatggtgcatgctgggtaaagccagtgcctgtgggcatggtgcagtgcct

SEQ ID NO: 6841775 - DNA, 68 bp, Homo sapiens
gcatcaatcttatatctgcatatctgaacctaccctatcagaaaatttgtcttcatatgagatggtgt

SEQ ID NO: 6841776 - DNA, 92 bp, Homo sapiens
ttttaattgaatttgttgatttcttccttgtcattagaatgcttatggttctagcagaaaagttgggaagaaaaatgcctattcaggtgaag

SEQ ID NO: 6841777 - DNA, 57 bp, Homo sapiens
gcctgtggacccctcacccgagcggactgccatcccctctggtcctgtctggcaggc

SEQ ID NO: 6841778 - DNA, 64 bp, Homo sapiens
accatgcaagcttgacctgtgcgctgctcatatctagagctcagcttcagcaaggcttgctggt

SEQ ID NO: 6841779 - DNA, 96 bp, Homo sapiens
gggatttatgtgactgttaaaattaggtgactactgggcacttgagataaatgtctttcaggatattacctaatatttgacttagcaataaattct

SEQ ID NO: 6841780 - DNA, 71 bp, Homo sapiens
catgaggtgcagcatgagtccaacggagagttaagggagatttgccttggaaatcaatgctgtttcttatg

SEQ ID NO: 6841781 - DNA, 68 bp, Homo sapiens
caggaagaggacaggcttcccctgcaagtgcaacttgtgttccctggagtggcctgtctcatttcctg

SEQ ID NO: 6841782 - DNA, 89 bp, Homo sapiens
ggctcttcttagatccaggaaattcccagaaggactgtcagctgtcagcagcaagcagctggggagttctttagtccttaaggaggatc

SEQ ID NO: 6841783 - DNA, 57 bp, Homo sapiens
ggatggagcaggggccagctcccttgagggccaggccttttgtgtccttgcccgtcc

SEQ ID NO: 6841784 - DNA, 115 bp, Homo sapiens
ctgcaagtacagaaaggaggtcaacttgactgtggcttagggattaggctaaagagagagagagtcagagccctgtgtgccatgtgaaagaatctggtttccattctgcaggcag

SEQ ID NO: 6841785 - DNA, 72 bp, Homo sapiens
tccaataactattggctgattgatttcctatgtatctgaagatgcattttaaagggtcagctgagttatgga

SEQ ID NO: 6841786 - DNA, 84 bp, Homo sapiens
tatgtaaagtagaaatgtaagaaggattatggaagtaattgaatttctcttttttagttttttttgacatatctgtattatatg

SEQ ID NO: 6841787 - DNA, 67 bp, Homo sapiens
tcttgcattcattacattcaaaaggcatttctgcagtgggaagtctcctgtgtgttatgaagctaga

SEQ ID NO: 6841788 - DNA, 78 bp, Homo sapiens
tgcagaaagcattgactcttcccccaaggccattcttctgtatctatttggctggcggtcaaggtcaggctttcttca

SEQ ID NO: 6841789 - DNA, 76 bp, Homo sapiens
gggcggcagccctgagccgctggcgtgcagagcgggtgcaagtcctgtccagcacagccaggcttacctgccgcct

SEQ ID NO: 6841790 - DNA, 56 bp, Homo sapiens
gagcagtgctaggagtgttgagcctttaaagttcattgaaatgtttctagctgctt

SEQ ID NO: 6841791 - DNA, 66 bp, Homo sapiens
tttatgggatatagtaaaacatgaattgggtctctgaaaaccaatttagatttatgttaccataaa

SEQ ID NO: 6841792 - DNA, 64 bp, Homo sapiens
gtatcatctcctagcgtgcatcccagcctggagctgggtccacggaagacttagggggctttac

SEQ ID NO: 6841793 - DNA, 58 bp, Homo sapiens
ctttagtttgctgtcccctggggtagaccgcaggaaggactttcggacagtgctgaag

SEQ ID NO: 6841794 - DNA, 79 bp, Homo sapiens
gccacgcgcattcctgagcagggctctgcagggcgcggcgtgcacggctctggaacctgccaggatgcgctgatgtggc

SEQ ID NO: 6841795 - DNA, 79 bp, Homo sapiens
agaactgcaaagcccccacgcaggctcccgctgcttctaggagcctggagcccagtgtggggctctgcaaatgtgttct

SEQ ID NO: 6841796 - DNA, 67 bp, Homo sapiens
gactgagacagctccgctgcccgctgaactccatcctcccggcggtcgggcggcggcggctgcggtc

SEQ ID NO: 6841797 - DNA, 57 bp, Homo sapiens
tatattctctctatataagaatgtggcatatcctcatatgacatgtagagagatatg

SEQ ID NO: 6841798 - DNA, 64 bp, Homo sapiens
gatcaattcaaactattttcctagatcctaattctttggaggtaggaggaaagggtgagtggtc

SEQ ID NO: 6841799 - DNA, 73 bp, Homo sapiens
taacacagtggttgtcagcaacaatatgagctagcgcttatatcatgttctctgtgtgtcaggcattgtttta

SEQ ID NO: 6841800 - DNA, 63 bp, Homo sapiens
catttgtcctgtgatttcagggcctgctccctcagcctcaggctctgcagtccgggatagctg

SEQ ID NO: 6841801 - DNA, 63 bp, Homo sapiens
ccttttagtttagtatgccattctacctcaattacagagaagtagatgggttaaagctatggg

SEQ ID NO: 6841802 - DNA, 68 bp, Homo sapiens
tctgactgggagggttcagctgggttgcatctgttctgtgtacctcttttccccctcctagcatcaga

SEQ ID NO: 6841803 - DNA, 62 bp, Homo sapiens
aatgtcatgagcctgctcttgtttctctccactgggaacagaggaatgggctacaaggcatt

SEQ ID NO: 6841804 - DNA, 62 bp, Homo sapiens
gaggagggatgggtctaacccagaaccacagatggctctgagccgggggcctgtccaccctc

SEQ ID NO: 6841805 - DNA, 72 bp, Homo sapiens
gaagccactgtgagtggttccaaagcttgcttaattgcaagccacaagagggcagccatgtcccagggcttc

SEQ ID NO: 6841806 - DNA, 59 bp, Homo sapiens
gagtcagctcctaggaagtgccagcgcccacgcacctgtgagctcctggagtctgactc

SEQ ID NO: 6841807 - DNA, 84 bp, Homo sapiens
ttcctgaggccttgatgttcttgggagattcatgcatatctgaattctatattattctgccaaaaatcttaaggttttgtggaa

SEQ ID NO: 6841808 - DNA, 60 bp, Homo sapiens
gcaaagtctgcatctggatcaggatgttaattctctagactactgtccagtagactctgc

SEQ ID NO: 6841809 - DNA, 99 bp, Homo sapiens
aaagaaatgaaggaaatgaagtctattaactgatttcttaacccaaaaaagagagaagagttagaaatggtttatagtttaatatcctacagtctcttt

SEQ ID NO: 6841810 - DNA, 61 bp, Homo sapiens
aacaatgtctcatcctatgtggtttttacctggttggagcttactgggatgatgctgtgtt

SEQ ID NO: 6841811 - DNA, 59 bp, Homo sapiens
ccagtttaagacttatctcaatctctaaatttagagattgaggataggatttaagcagg

SEQ ID NO: 6841812 - DNA, 81 bp, Homo sapiens
acataagtagagtcttagaggatatgtcctttgtgaatggcttatttcatgtagtgtaatgtcttcaagattcattcatgt

SEQ ID NO: 6841813 - DNA, 67 bp, Homo sapiens
ctgctgtcttatgtagatactgagaatattaaacctgtactcttctcatttgctacataagcaccgg

SEQ ID NO: 6841814 - DNA, 62 bp, Homo sapiens
gcaaggcagggaaagtggattaggcttggtcgtttattctcgttctttccttcttcctttgc

SEQ ID NO: 6841815 - DNA, 60 bp, Homo sapiens
ccagctcagggtcacatggcacatggctcatttgaggcagagcctgtggcttgatgttgg

SEQ ID NO: 6841816 - DNA, 84 bp, Homo sapiens
tcatttcataaatcacattcgtctgctccttccagcaatttcccttttccctggaagggggatgttattgtgttttatctgtgg

SEQ ID NO: 6841817 - DNA, 78 bp, Homo sapiens
ctcttttccaatgtgagtgccaggtgaagtatgtagtctaggcctacaaatcataagaattcacaaagaggaggagag

SEQ ID NO: 6841818 - DNA, 93 bp, Homo sapiens
ccctactggctgtgttacatcatatggaatttaaagtcactggaattgaggtagcagtgagaagcatcatatgatttaaaataaagctttggg

SEQ ID NO: 6841819 - DNA, 58 bp, Homo sapiens
gagggtaggtacattattagatgcatgttgaattcaactgaattatgtgcttaccttt

SEQ ID NO: 6841820 - DNA, 59 bp, Homo sapiens
ggccatggtggtttgagcacctccagcaccaggggagatgctgtcctagaaccagggcc

SEQ ID NO: 6841821 - DNA, 72 bp, Homo sapiens
gggtgcttcctgggcttcacagactctgtcctgaggagagaggtgcagtttgagaaggccagagtggggccc

SEQ ID NO: 6841822 - DNA, 84 bp, Homo sapiens
ggagtggctaaagtatgtcatggcctagtaagtctttcacattttcccctttctgccttaatccatggcataattttcctctcc

SEQ ID NO: 6841823 - DNA, 72 bp, Homo sapiens
gaggcctgtttccttgggttgcttatgaaggaagcagagcaacaaaccctttcagggaaacaatatgcactc

SEQ ID NO: 6841824 - DNA, 70 bp, Homo sapiens
atttgtaagatagttttattttatttacattcttatgagaactaattgaaatgagactggtgatacaagt

SEQ ID NO: 6841825 - DNA, 67 bp, Homo sapiens
aatgcagcctcggtaactcaaatgtaatagattcacttcttgtcttttaagttactgatcggccatt

SEQ ID NO: 6841826 - DNA, 115 bp, Homo sapiens
cctcttctggagcaactcatttgtctctaggttttaagcacttacaggttttccctaattaagatttttgtaatgagtggatcttagggagaaaaaataattgtttcaaaagtgg

SEQ ID NO: 6841827 - DNA, 92 bp, Homo sapiens
aaccagtagcatctgagaagattttggcataaacatgtgaattatttacaaagataataattatgctcaattcctccagatctaaaagggtt

SEQ ID NO: 6841828 - DNA, 84 bp, Homo sapiens
tcctcactcatttttaggaagctttggaggccaggcacagtgcctcatgcctgtaatcccagcactttgtgaggtcgaggaggg

SEQ ID NO: 6841829 - DNA, 78 bp, Homo sapiens
ataactagaagaggagaatttgcgtagtatagtgatatggtttggctgtgtccccacccaaatctcatcttgagttat

SEQ ID NO: 6841830 - DNA, 56 bp, Homo sapiens
tgatcaaagccaaagttgagatctcagcagtatgaacatcggctctggctttggca

SEQ ID NO: 6841831 - DNA, 75 bp, Homo sapiens
gatacagaaggacagtaccactcatgagctcacatttgggctggctcaatgaatgcagcactgtttttctgcatc

SEQ ID NO: 6841832 - DNA, 93 bp, Homo sapiens
gaggcttgtactacatggcttctatcatcgagagtttgatgtgatcctcattagcaactttgagatagacttagagtataaattattagtctc

SEQ ID NO: 6841833 - DNA, 76 bp, Homo sapiens
gcctgtcattttctggttagttaatcataaatagttagtgatggcttgttgattaattaacaggaaaaatgaaagc

SEQ ID NO: 6841834 - DNA, 58 bp, Homo sapiens
gcctggaaggcggaggttgcggtgagctgagatcatgccactgcactccagcctaggc

SEQ ID NO: 6841835 - DNA, 60 bp, Homo sapiens
tcaggagggctaagactgtagcttgttatcaggcatttcttactcttagtccaaacttga

SEQ ID NO: 6841836 - DNA, 72 bp, Homo sapiens
agggttgtggaaagaggtgaaagttattcatttatgcttttatatttgaaaccttgtaccctcccacactct

SEQ ID NO: 6841837 - DNA, 80 bp, Homo sapiens
tcctgtccaagacctgagtatagatccctgcagcacttcactttggctgtagatgaactgcctctcagcaagggcatggg

SEQ ID NO: 6841838 - DNA, 92 bp, Homo sapiens
ggtaaaaaataattagatgcaaaagtatcattttaatgctatctttaaatttggacataaattgtgcttttgacatctcaggagtttatacc

SEQ ID NO: 6841839 - DNA, 64 bp, Homo sapiens
ttctagtttccattttaagacagctgtgaagctacagtcaatgtgtagaatgtggtacgtagaa

SEQ ID NO: 6841840 - DNA, 63 bp, Homo sapiens
atgttgccgaagctgttgaacatttagtaaaaatgcaaaatgttctggcacctttaaaaacat

SEQ ID NO: 6841841 - DNA, 120 bp, Homo sapiens
aatagagaattgaaagtgaaaatgtagcactgaatgcttttactgtaatgcctagtgttgtcagtgtcagtagtatcacagtgtcatattatcaatgtgatatttgttcgttcatctatt

SEQ ID NO: 6841842 - DNA, 107 bp, Homo sapiens
ctcttccaattacattctcattgtcctttctcttggataccgattgctaagataaacagacactgattaagtggtagaaagagaaaggtaaaatgcaactggaaggg

SEQ ID NO: 6841843 - DNA, 107 bp, Homo sapiens
caataaacaaaaaatatggatcatatcacagctctttcattgctttcatttcttgagatatatgaatgtatgtgatatatttgatgtcctgtattttatctttattg

SEQ ID NO: 6841844 - DNA, 93 bp, Homo sapiens
aggagtagaaacaccgcctaactctgaaagagagtacatacagtttagaaagcaagattgactaaatgtgcttatttttaaaaggtcactcct

SEQ ID NO: 6841845 - DNA, 77 bp, Homo sapiens
gctccttttaagggataataagatgtttgtaatgtttatgtcttccaaatgaattgtaaattccttgaaaactgagc

SEQ ID NO: 6841846 - DNA, 82 bp, Homo sapiens
ctccacttccctgtccttgccccacagccaacttcaccctcagcaagggccttggcatgggccagggagagctgaggtcaag

SEQ ID NO: 6841847 - DNA, 68 bp, Homo sapiens
gaacactcagggccttatcctgccattgagcctctcaatgatatcagcaggatgtggcccgaaggttt

SEQ ID NO: 6841848 - DNA, 98 bp, Homo sapiens
tgctattttgtttagtcttgtggccatacatgtccatattatacacagttcttcaattataaggtagggctggctattgatcataagcagtaatagta

SEQ ID NO: 6841849 - DNA, 79 bp, Homo sapiens
aatttatatgttgaaatcctaaccccctagtacctcaaaatgtgatgtatttggaggtaggactttaaagaattaagtt

SEQ ID NO: 6841850 - DNA, 59 bp, Homo sapiens
tttctaggatgtgatgacctgcttaataaaatagcaagaatgtttacacattctagaaa

SEQ ID NO: 6841851 - DNA, 66 bp, Homo sapiens
gagccagggctgtgagctgagcgccactagatcaagaaatgtcagcttttctctcagcttttcctc

SEQ ID NO: 6841852 - DNA, 69 bp, Homo sapiens
ccagaatgcagtgagaagcagttatgatttgcagttgtcaaatcatatagttgtcactgctaatcatgg

SEQ ID NO: 6841853 - DNA, 81 bp, Homo sapiens
ccaggaaaatgagatgttcaggagtctgagtgtatgtgttcacatgtgtgtgtgctcaggccttgaagtcttttcttttgg

SEQ ID NO: 6841854 - DNA, 102 bp, Homo sapiens
caccgcagccctccctggaccacaaggagccaagggcaggcaagaaagcttcaggctccctctggctgttgttaggttcctgggtcaaaggctgagtttgtg

SEQ ID NO: 6841855 - DNA, 119 bp, Homo sapiens
ggaactcctctctagaaaaatatccaattaaaattcacagtggcaggtgtgggttgtggacctggtcaaaaggcataaaccaccaacccaccctgtgattgttttagcagaggatttcc

SEQ ID NO: 6841856 - DNA, 60 bp, Homo sapiens
ttggccatctaagcccagccacccactaaacatggcaggaattctggggttagaggccaa

SEQ ID NO: 6841857 - DNA, 62 bp, Homo sapiens
cattgagcaggatggctatgcacagaccttgagggatgtgggtggcatcgtcctggccaatg

SEQ ID NO: 6841858 - DNA, 61 bp, Homo sapiens
gatttctgggcccaaccctagagtgtgtgactcagtagttctgggatggagcccaagaatt

SEQ ID NO: 6841859 - DNA, 72 bp, Homo sapiens
gtagcaactgtagcccaaattctattctgggtgaaaattataaagtccattttgaattggctatggttttgc

SEQ ID NO: 6841860 - DNA, 106 bp, Homo sapiens
cctcttcctgttgggaaccctgaggttccaagctccaagctccaagctccatggctgctggaggcctggactttaagggatgtactcccaacagctcaggaagagg

SEQ ID NO: 6841861 - DNA, 63 bp, Homo sapiens
atcgagctactcgctaggaggagcagactgtgaagttgcagccctgcagggtgagtgggcgat

SEQ ID NO: 6841862 - DNA, 85 bp, Homo sapiens
cagggtgctgtctccctctcctgagtactgtgtgaatcagtcctcatgtcccactcacacactctcagagggtggcagcaatttg

SEQ ID NO: 6841863 - DNA, 56 bp, Homo sapiens
gcagataacttgtccaacaccatcattttatggtgtgcttggcattttgtttaagc

SEQ ID NO: 6841864 - DNA, 87 bp, Homo sapiens
gaatttcacattaataaaggccagtatcagatatacttttaatgcctttagaaaatgtctgctgttggtttattatgacagagattc

SEQ ID NO: 6841865 - DNA, 68 bp, Homo sapiens
ggtaccttattgtacatttttcggtttctaccagcttctggtgacagcatggaagaagtgattggact

SEQ ID NO: 6841866 - DNA, 63 bp, Homo sapiens
ggctggctttgcactgggtgcatggtcacagggaattgacacagtctagtggggtagccagcc

SEQ ID NO: 6841867 - DNA, 82 bp, Homo sapiens
ggagtgaggggcagcagggggtcattcacgctggctctgctctgttagctgaatgacagcctctctctctgagtctcactct

SEQ ID NO: 6841868 - DNA, 69 bp, Homo sapiens
tcggggatctctgtattctgatattcacttttgcacaaggagtgtgttcagcttgcagaaagtgcctgg

SEQ ID NO: 6841869 - DNA, 93 bp, Homo sapiens
gcattcattttcagttttggaagaggacacagagacattcattgttcaaaacaggcataattcagtgttcttttctgttagcgaagcgaatgc

SEQ ID NO: 6841870 - DNA, 115 bp, Homo sapiens
gtataaatctctctctgcttttctttcaatatctctaagaatgaggcttccccaaggccctcagaagcttggagatgtgttgaatttgtgtaaagcagtagggtagcactggtac

SEQ ID NO: 6841871 - DNA, 97 bp, Homo sapiens
tttgctggaattttctactcagcccatagaagtgaaagaatacaaaaagccagttttctctttggaggggctgaatggagagaagagtttcagcaaa

SEQ ID NO: 6841872 - DNA, 58 bp, Homo sapiens
tggggagagttacaaggaatcttcttaaggatgggggagattataaagaaccttctta

SEQ ID NO: 6841873 - DNA, 65 bp, Homo sapiens
cagtgtgtgactctgggggtacagcaaaacagcatgctctttactctcttggagttcacattctg

SEQ ID NO: 6841874 - DNA, 75 bp, Homo sapiens
ctaaaacttcactaatcactgaactccaaaagcccctagtctcactggtggaccacagtgacagtgatattttgg

SEQ ID NO: 6841875 - DNA, 55 bp, Homo sapiens
agtgacaaagattctccttgttgcatgatggacacaaggatgaatctttgttact

SEQ ID NO: 6841876 - DNA, 82 bp, Homo sapiens
gacttgagcagaaatgtgttgcagaagattaagctcactctagtgagtgtctcttctctgtaggatattagccactcaagtc

SEQ ID NO: 6841877 - DNA, 67 bp, Homo sapiens
gatacacagggctaagatggattttaaatcattttaattttctattattttggccactgtagtcatc

SEQ ID NO: 6841878 - DNA, 66 bp, Homo sapiens
tctggagttgctgttaggtctgattgaatgattgacacaccacaagcagaaatctagaactccaga

SEQ ID NO: 6841879 - DNA, 67 bp, Homo sapiens
atccttatcttcccattgtgtgcagccccagaatgggtcctgggactcccaagcttggaggaaggat

SEQ ID NO: 6841880 - DNA, 76 bp, Homo sapiens
ggataaacttgctgatgctgtagatcttagcctctacatgagatcatgtggaaaatctgaaagcattttaggttcc

SEQ ID NO: 6841881 - DNA, 62 bp, Homo sapiens
atatctctctgtcttcctgagagttttattaaatgttaaagttttctgtgatagagaggtgt

SEQ ID NO: 6841882 - DNA, 60 bp, Homo sapiens
agatttactgtaggagctgtggtggaagaaaattcctgcaggtggttcgaacagaagttt

SEQ ID NO: 6841883 - DNA, 77 bp, Homo sapiens
aggctagagtagtggcgtgatctcggctcactgcaagctccgcctcctgagctcacgccattctccttcctcagcct

SEQ ID NO: 6841884 - DNA, 73 bp, Homo sapiens
ctagcacttcattctttaccaagttgtcactctatcactgcaagcgtgaggattggtgaaaagtattaagcag

SEQ ID NO: 6841885 - DNA, 58 bp, Homo sapiens
gcctccaggtcggtctttctctttccggtttgctgatgaggaaacttatacttggagc

SEQ ID NO: 6841886 - DNA, 75 bp, Homo sapiens
aaagcaaaagctagtccagatttaagtcacagagtatagccactgaaaacaggaatttgactaggtaagtgcttt

SEQ ID NO: 6841887 - DNA, 63 bp, Homo sapiens
gatgaatatccttttatcctgtaatgagttcccaggtgggagcagttagggatacaagttatc

SEQ ID NO: 6841888 - DNA, 66 bp, Homo sapiens
ctgggggcttcgcgggcagcccacccccttctacaagtggcctccagctgctcagagcagctccag

SEQ ID NO: 6841889 - DNA, 72 bp, Homo sapiens
gcttgagaccagcaggttgagggtgcagtgagtcgtgactgggtcactgcactccagcctgggcaacagagc

SEQ ID NO: 6841890 - DNA, 56 bp, Homo sapiens
ggtcatagagaattcaccaggatctaaatcttgaatgctggtgagctcatgtggct

SEQ ID NO: 6841891 - DNA, 109 bp, Homo sapiens
ttgtccttgaaacttccactgaaagggaagaggctgaacccagtgaaacttattcagcagggtacagagttttctaaacttttgtgtgagaagaagccctagtggacag

SEQ ID NO: 6841892 - DNA, 93 bp, Homo sapiens
gcagttagggttggctgtctgccaaaaggtgcacctgctggcagcagagccggaagcagcagttcttttgagaagcagacatttattaagtgc

SEQ ID NO: 6841893 - DNA, 62 bp, Homo sapiens
tgctggcaggcacctcctggggaaaatggcttttggcttttaggaggttgtctaagccagta

SEQ ID NO: 6841894 - DNA, 62 bp, Homo sapiens
gatgttaggcaaataactgtggagcatctatgtgaactgcccgctgttccttgcttgagctc

SEQ ID NO: 6841895 - DNA, 64 bp, Homo sapiens
caccctttcctggccaagcagagtggaaagcccaagctttccaggatgccgtggcacagaggtg

SEQ ID NO: 6841896 - DNA, 68 bp, Homo sapiens
agcaaggggtctggctttctgaacatcagtgaatggaagtgtttactttagtaaatccagcccttgct

SEQ ID NO: 6841897 - DNA, 76 bp, Homo sapiens
gattccaagtcctgccagctgcttccctctgagctcactcatggcagcaaatgtctggctggggctgagtggactc

SEQ ID NO: 6841898 - DNA, 77 bp, Homo sapiens
gcactaagtgtatgacgaaggtagtatatgattcacagtagctatattgaatattgctttctcagacgtttagtagt

SEQ ID NO: 6841899 - DNA, 90 bp, Homo sapiens
accccaccagccagcttccctgaccagagtgagggcttagttccagggccgccctcctacctgggcagaaggaaggcccatggcaggggt

SEQ ID NO: 6841900 - DNA, 58 bp, Homo sapiens
tctcaggtaagcttctttgatgtagagacaataatatttcacaactgcttatttgaga

SEQ ID NO: 6841901 - DNA, 82 bp, Homo sapiens
ggatgctgcagattcgggctcaagctggaggaggggcccaggtggtatcgaccagcccctctccgccctgagtcgtggcgcc

SEQ ID NO: 6841902 - DNA, 56 bp, Homo sapiens
tttagtctttgggttgtgggtgggctgcaagccctgctggcttcctgagggctgag

SEQ ID NO: 6841903 - DNA, 57 bp, Homo sapiens
tgttggtaggatttgcttcagcttctagttgctggcttgctttctctctgctcaata

SEQ ID NO: 6841904 - DNA, 80 bp, Homo sapiens
agtatttactggatatggcagacaaaatattgtatgttcataaaatgtttccaggttcttcctatgtccataggaatact

SEQ ID NO: 6841905 - DNA, 90 bp, Homo sapiens
tagatagaatgtgacatttttggtcaactccaaagaagtggcaggattttctttggaatttgctggaaatattgtggttgttttctactg

SEQ ID NO: 6841906 - DNA, 70 bp, Homo sapiens
gcagcatccttgggcccagctcctgctgcaggctctggagggatgcaggagactatggcccaaggcctgc

SEQ ID NO: 6841907 - DNA, 62 bp, Homo sapiens
atacataggagaataacttcagagatatggaagatatccactgggttgagtttctgatgtat

SEQ ID NO: 6841908 - DNA, 88 bp, Homo sapiens
gcacgtattcgatatctaacctggttaatggttacatggttttatacatatgtaaaaattcatcaggctgagcatttaagatctgtgc

SEQ ID NO: 6841909 - DNA, 60 bp, Homo sapiens
tgaattattggagttggtaagaagtcatatcattgtttcttaaaagctctcaatattgca

SEQ ID NO: 6841910 - DNA, 77 bp, Homo sapiens
gtcaaacgtgaggattttagataagacagcaagggtttttttcccctagtttgtagaaatctagaaatttaagtgat

SEQ ID NO: 6841911 - DNA, 92 bp, Homo sapiens
gcgcaggctgggctcagaggagtggcctgggagatgttttctgagtgaaagaaagaatgagcctaggcatttgtttagcttcagctctgcgc

SEQ ID NO: 6841912 - DNA, 65 bp, Homo sapiens
gatatcatctcggtgaaacatttggtgctccaggtaacagtgtgccagggccacggggaggtatt

SEQ ID NO: 6841913 - DNA, 67 bp, Homo sapiens
gaaaactaacggaaaagttaggaaaattctccatttttcactcctaactcatctgggtgagtttgtc

SEQ ID NO: 6841914 - DNA, 55 bp, Homo sapiens
ctccagtatctgtaggaaaaggaaacttttcttttaaaagagagcagaaatggag

SEQ ID NO: 6841915 - DNA, 58 bp, Homo sapiens
cattccaggcagagcacaagactctccatcagaagggagattagcatgcttgaggatg

SEQ ID NO: 6841916 - DNA, 66 bp, Homo sapiens
tctgcgagtccagggttaggagtccgagcacagctcacttggtcctctactcaggggctcaccaga

SEQ ID NO: 6841917 - DNA, 74 bp, Homo sapiens
gggtgtgtacttctttattatccattataagtcagacaatgattttcagatgcattgtaacgatgtgcacattt

SEQ ID NO: 6841918 - DNA, 58 bp, Homo sapiens
gcccaggaggtggaggttgcagtgagccgtgatcacaccactgcactccagcctgggc

SEQ ID NO: 6841919 - DNA, 81 bp, Homo sapiens
ccaggtgcctcgcctcctggatcagctgtattacaaatggtcttcttcacagtcccagagaggtcggggccatattcttgg

SEQ ID NO: 6841920 - DNA, 83 bp, Homo sapiens
cgtctctcctcccttagctcacaagctaaagcaaagagaaagcagactgttgctcttggtgaaggggctgggggtcagagacg

SEQ ID NO: 6841921 - DNA, 60 bp, Homo sapiens
catctctccctacatccttgcctagctcacctgcccagggaggtagcaggagaaaagatg

SEQ ID NO: 6841922 - DNA, 76 bp, Homo sapiens
tcatacccagttagttgtaagtattctagagtgaaattttaaaaaacattttaagaaatgtatgactgtctggtga

SEQ ID NO: 6841923 - DNA, 70 bp, Homo sapiens
gcttctttttgtttagtgttcttcttggaccaatcttgtctttatgtggaaatactaaacacaaagcagt

SEQ ID NO: 6841924 - DNA, 75 bp, Homo sapiens
gtatgggtgttaattattggtgaatagaattcaaagtcagaatcttttctgttaaatattgatagatattcatac

SEQ ID NO: 6841925 - DNA, 122 bp, Homo sapiens
gtctcaatatactgctttcaagggttgttgaaaactgtatgcaaatttattagcacagtgtctggcccttgctataaatggtttcatattatcacatttctatgagagcagtgatcaagtac

SEQ ID NO: 6841926 - DNA, 68 bp, Homo sapiens
cttggcccagagatgctctggaatatgacatggtgtggcattagacggggacatctgctaggggcaag

SEQ ID NO: 6841927 - DNA, 76 bp, Homo sapiens
agcccaaagcaaatatctaaatggaatattccagagcattgctctggtggtatacatctaggagtttgaatgggtt

SEQ ID NO: 6841928 - DNA, 57 bp, Homo sapiens
tgctagggcactaggactcatgtgctttctactccacaggtttcagatgccactgca

SEQ ID NO: 6841929 - DNA, 71 bp, Homo sapiens
ggattaccagatgcaaagcgattgtgttgataacttcagaccacattttgtaattgcacctgtattcatcc

SEQ ID NO: 6841930 - DNA, 83 bp, Homo sapiens
cctgctggaggcggagccgtctggctgaccccagtgcctgggctcagccatgacctccacctgcctctccttgtaatgctcgg

SEQ ID NO: 6841931 - DNA, 59 bp, Homo sapiens
gtttttagtgaagctttgcatttcacataaggtatgtgaagtgaaatttcacaagggac

SEQ ID NO: 6841932 - DNA, 68 bp, Homo sapiens
taagtaagtgttgaattagtgctcccaatgtctggtaatggggctttctacatcaaccacttttcttg

SEQ ID NO: 6841933 - DNA, 82 bp, Homo sapiens
caggtctcactgctgttggacactcccttttcgaagctgccactgctctgagtctgggcatgttcactttgcctgggacctg

SEQ ID NO: 6841934 - DNA, 81 bp, Homo sapiens
tgggggagccagactgtctgggttcaaaacctggctctacaacttgaccagctgtgtgacctgaggcagttactctcgcca

SEQ ID NO: 6841935 - DNA, 59 bp, Homo sapiens
gagcccagcccagagccatatgtggcctccccaagagggctcactggtgggctgggctc

SEQ ID NO: 6841936 - DNA, 70 bp, Homo sapiens
cactggcagattttctctggaggagttgatttcacgctccaaaatacagaaggatctgactcttccagtg

SEQ ID NO: 6841937 - DNA, 69 bp, Homo sapiens
gagatttttaggaaatgacttggtgcttcgtttctttgggggaagtgagtgattaggtttttccttctt

SEQ ID NO: 6841938 - DNA, 59 bp, Homo sapiens
gaactgtgctggtccagggagctggttttgagaagcctgggcttccacgagcagaggtc

SEQ ID NO: 6841939 - DNA, 78 bp, Homo sapiens
atgcccccagaacacaggctaaactgagatagttaatcaaagacaactgtaaatctcagactgtgtttttcacagcat

SEQ ID NO: 6841940 - DNA, 63 bp, Homo sapiens
agctgcaagtgttgcctcctacatgttgttaatttagaggtaatcaggtttgcatttgcagct

SEQ ID NO: 6841941 - DNA, 72 bp, Homo sapiens
agaaagaggcactgggttttcttcatcattcaatcaatctctagaggcagctttcagtgtctctcaaattct

SEQ ID NO: 6841942 - DNA, 59 bp, Homo sapiens
gaggctcacctcaatgtttctgagtccacttcagaaattccaaacactgggtgagcctc

SEQ ID NO: 6841943 - DNA, 70 bp, Homo sapiens
cttggctgctcttccttgccttgcttcatcatacaaacaataataaggtcgaggcaggaattctgcgaag

SEQ ID NO: 6841944 - DNA, 57 bp, Homo sapiens
gacatttttgttcatttctcttcagagtgaattgaagtgaatatgcagcaagaagtt

SEQ ID NO: 6841945 - DNA, 96 bp, Homo sapiens
tctcagtacttcttatacgtgcatgatatatgagttgtttaatacctgaattaaaatcagatgatgactatatacatgcagtaagagatgcagagg

SEQ ID NO: 6841946 - DNA, 75 bp, Homo sapiens
tgacaagggccccactgtggaacctaagtctgggagccccctgacttctggctggccagaggctgcggtccgtca

SEQ ID NO: 6841947 - DNA, 93 bp, Homo sapiens
cacaatttatttaagcagtcgcctattgatcaacatttgggttgtttctaatcctgtgctgttaatagtgatactgcaatgaataaccttgtg

SEQ ID NO: 6841948 - DNA, 65 bp, Homo sapiens
gctattattgcctgataaaggctcggagcctgaggctggccttttctttcacaggcaagattagc

SEQ ID NO: 6841949 - DNA, 89 bp, Homo sapiens
cctgctcggcggccgagccgctgttccgcagcacccgtaactccaccgggtccagcgacagcaggctcaggcgcaggccgctgaacagg

SEQ ID NO: 6841950 - DNA, 58 bp, Homo sapiens
ttcatgtttccatattaatgagaagaagcagctgaacattaacaaatggaagcatgaa

SEQ ID NO: 6841951 - DNA, 76 bp, Homo sapiens
cctcagagtttgggtggaaggagggtaaggaggcaagattcctatgcccattcgctccaccacccacccctctagg

SEQ ID NO: 6841952 - DNA, 112 bp, Homo sapiens
cgcagactgcatagttcttactcattcgtggaagcccagtgtcttcttttctaatcttagaaaattattggcatttccttcagaatgggaatgagttgatgttgagtctgtg

SEQ ID NO: 6841953 - DNA, 82 bp, Homo sapiens
gaatgctgctaactgaattacaaagtctggggcctaatgattaccagtgccagagctccagggttttgtagtgtcagcattt

SEQ ID NO: 6841954 - DNA, 100 bp, Homo sapiens
gtcagcatgctggtttggcagaatgtgtggctgattgccagagtatttttgagcaaagcagccattcatttcacctgcaaaatcgaaagttcactttgac

SEQ ID NO: 6841955 - DNA, 87 bp, Homo sapiens
aatgtcccagccttctcttgccagagatgagactctggggaaggtaacgagagagtccatatgtgggaggagtggcttaaaaacgtt

SEQ ID NO: 6841956 - DNA, 77 bp, Homo sapiens
ctccatctgtcaaatatcatgctctttggtttggaacatattccttggtttggagcattatgtttgaacagatggag

SEQ ID NO: 6841957 - DNA, 76 bp, Homo sapiens
gggggaggaggaacagcagggaatatgggaattgggagaacctttagcagttcacactgtgctatctgccttcctc

SEQ ID NO: 6841958 - DNA, 62 bp, Homo sapiens
catttctacagcttcttcagaagaatgctaacaacaacttcttagggaggtctctggaaatg

SEQ ID NO: 6841959 - DNA, 56 bp, Homo sapiens
aaagcgcagacacagagagtggagagtatacgattctctttcctcttttgtgtttt

SEQ ID NO: 6841960 - DNA, 74 bp, Homo sapiens
cctctctgtctcagttcttctcattccagaggtccctgtggactgtgacaaggatttttcagaattcagagagg

SEQ ID NO: 6841961 - DNA, 67 bp, Homo sapiens
gggaatgtggccctggggctcccacttgatgggtgtggagaaccctggggggccacgatacataccc

SEQ ID NO: 6841962 - DNA, 68 bp, Homo sapiens
ctggcggcagggcccgggcatggcggctccatgcaggacaggccatgtcctgggcatctgccacccag

SEQ ID NO: 6841963 - DNA, 83 bp, Homo sapiens
tgttaggctggtgcaaaagtaattgctgttttgcctgtacttttaatggcaaaaaatccaactgcttttgcaccaacctaata

SEQ ID NO: 6841964 - DNA, 95 bp, Homo sapiens
aggcagagacagcaggctccctctgcttttatgtgccggcgctgccagaggcagaaggctggctttctgagagcaggggcccgcacgctctgtct

SEQ ID NO: 6841965 - DNA, 61 bp, Homo sapiens
tccatcagtaaatattcattgtgcacatactatgtccacacctcatgtattgtgctgggga

SEQ ID NO: 6841966 - DNA, 63 bp, Homo sapiens
tgcccaaggtcaagctgtaatttttgaggtcaggatttggactccaacagtttgattttagca

SEQ ID NO: 6841967 - DNA, 74 bp, Homo sapiens
ctctcccacttttttggtagtgccttctgccattctttgtaaccgagaaggtcaaggccaaaagagtggtggag

SEQ ID NO: 6841968 - DNA, 130 bp, Homo sapiens
tttttttttttttgctatctggatagttgacattggacttcatgtttctattagctcacggaaggaggcctgtgggatcagtctggaatattgattcctgtgggggtgtatgggtgcaagaaaaggagag

SEQ ID NO: 6841969 - DNA, 70 bp, Homo sapiens
ttttatggaaaggtacagaataaaaagtggcagatgttcccctgtgtactttcttgttcctttcataaaa

SEQ ID NO: 6841970 - DNA, 60 bp, Homo sapiens
gtcttcatctgcgcacttggggaaatacaggcatctatccctgagggtggttgtgaagat

SEQ ID NO: 6841971 - DNA, 67 bp, Homo sapiens
ctgtgtattgaaaaagggttaagattgcaaaaatcaatcttaggcaatttgatttttcaagacacag

SEQ ID NO: 6841972 - DNA, 80 bp, Homo sapiens
gctttccctgcagctacgcatgactgagttctagccaaagagagtaaggagggtacaatgggtggaaatcatgggaaagt

SEQ ID NO: 6841973 - DNA, 67 bp, Homo sapiens
ctgcaagccaatgagagtgatctgggaggaaactaacactgccagcaccttgatcttggacttccag

SEQ ID NO: 6841974 - DNA, 124 bp, Homo sapiens
gaggctggatcacaggcagatgcatctgagaggccagatcaggcacgcggcagacccaaggagcttctcggcccagctctgcctgctgcctgggggctccagctgctgaatgccttgaagcctc

SEQ ID NO: 6841975 - DNA, 75 bp, Homo sapiens
gccagcctgggtagtggcctccccagcaagttgcatgtcactagcttcctgtggctgtcactcctgggcccaggc

SEQ ID NO: 6841976 - DNA, 71 bp, Homo sapiens
cttggcacacaggaggtactcgatgcatatttagtgaataaatgaacatcaaatgcctaccatgtgctagg

SEQ ID NO: 6841977 - DNA, 69 bp, Homo sapiens
gcctgctgtcttccctgcatgtttatgaataagtagatacaagttcaaggaagggaggaaagccaaggc

SEQ ID NO: 6841978 - DNA, 62 bp, Homo sapiens
aagagtttgtcagatctgcacgattctgcattcttgtgctttcagcagtctaacacactttt

SEQ ID NO: 6841979 - DNA, 89 bp, Homo sapiens
ggagattcacttgaacctgggatggggaggttgcagtgagccgagatcatgccactgcactccagcccgggcaacaaaagtgaaactcc

SEQ ID NO: 6841980 - DNA, 65 bp, Homo sapiens
gcttatatatagtatatgactttgctaaaagtcaccttaatgtaaagtcacatattagagtgagc

SEQ ID NO: 6841981 - DNA, 62 bp, Homo sapiens
tgcaaaagtaattgtggtttttgccattactgtcaatggtaaaaactgcaattacttttgca

SEQ ID NO: 6841982 - DNA, 61 bp, Homo sapiens
gggcagggcttatctttttttgccaccatattatgaggtaaggaacttggtgcccgtgccc

SEQ ID NO: 6841983 - DNA, 83 bp, Homo sapiens
ggaaagttttaacaactgaggtatctgctgtgtttagtaaatcataaaagtaagcacaatgaacatcttagatgaaaagctcc

SEQ ID NO: 6841984 - DNA, 57 bp, Homo sapiens
ggcacacagcttggcaggagatgctttcattcaagtgttgatcacctactgtgtgcc

SEQ ID NO: 6841985 - DNA, 101 bp, Homo sapiens
ctgccaagctggtcaatcaaggtcatgcagggattgttggcatccatggtagagagccatgaatttctaatctctgtcaagatcaggatgccaactggcag

SEQ ID NO: 6841986 - DNA, 60 bp, Homo sapiens
gagtaagtctctgtgtaagctaattatatgtgataattttgcctgaaaggagactggctt

SEQ ID NO: 6841987 - DNA, 71 bp, Homo sapiens
cctcgctctccattcggccctcggggttagacagcaagagtcgcagccggatggtcatgaaggggcgcagg

SEQ ID NO: 6841988 - DNA, 81 bp, Homo sapiens
aggccagattttcagaagggaccttgcttttggaatttgcagtcccagagcctgtacttttctgtgaatctaatactgcct

SEQ ID NO: 6841989 - DNA, 80 bp, Homo sapiens
ttattgatctgctactgtgtcccagccgccgtggagccctcggtctagtggggaaggaggacaagaagcaagattaataa

SEQ ID NO: 6841990 - DNA, 57 bp, Homo sapiens
atcttgggcccctgtaagatggatacaagaatgtgcatttccaagggtacctaagat

SEQ ID NO: 6841991 - DNA, 64 bp, Homo sapiens
gcctggggaacttgatcctgtccgtcaagtgcgaggaagcagaggggatcgagtacctccgggt

SEQ ID NO: 6841992 - DNA, 60 bp, Homo sapiens
catggctgcgagaagagtgggttgacagaaaagaaagattttagttgactcgaggctgtg

SEQ ID NO: 6841993 - DNA, 72 bp, Homo sapiens
agagggggaccgagggctgtggcatcacagtcgtgggcatctactggctggccacaccctggtacaccctct

SEQ ID NO: 6841994 - DNA, 63 bp, Homo sapiens
cacatgatggtggaagccatagaaatgcaagatgatctgtgttgctggcaaagccaatgtgtg

SEQ ID NO: 6841995 - DNA, 72 bp, Homo sapiens
gacatggaaaactaactgcttttttaaaggatgttttcacagatacctgttgaaatcagatagattcatgtc

SEQ ID NO: 6841996 - DNA, 58 bp, Homo sapiens
tggaagctgaacttagcaaggaagcttagtagttatccctccggatgttcagcttgca

SEQ ID NO: 6841997 - DNA, 61 bp, Homo sapiens
tgttactggcttgtgagacaatgcctgatgagaagtcaggtacattcgtgtgccactgata

SEQ ID NO: 6841998 - DNA, 64 bp, Homo sapiens
taccatgctggctcataatcagaactaaatacttggcagttttgcattatcatatcagttggtg

SEQ ID NO: 6841999 - DNA, 74 bp, Homo sapiens
tcggctctatcctgagaaggcacagcttgcacgtgacctcctgggcccggcggctgtgtcttcacaggagccga

SEQ ID NO: 6842000 - DNA, 74 bp, Homo sapiens
tggcatcagtttctagcctcactgtttagaatgttgcagttctgaatcagtgtctgggctggagaaagaatcca

SEQ ID NO: 6842001 - DNA, 56 bp, Homo sapiens
agtggcttctgcggtgtgcgcagggggcctgcccccatgaagccccatgaagctct

SEQ ID NO: 6842002 - DNA, 60 bp, Homo sapiens
aaaagggcttgatcatgttgaagagctgtgactcgtgtggctttcatgataagtcctttt

SEQ ID NO: 6842003 - DNA, 60 bp, Homo sapiens
tctatgtttctctgcagtgcctctcactatggaagttaggcactcgacagaaatattgga

SEQ ID NO: 6842004 - DNA, 67 bp, Homo sapiens
gtggttaaacaataactggcacacagaaagcactcagtgttagctgttcctgtttgttgctaaccac

SEQ ID NO: 6842005 - DNA, 71 bp, Homo sapiens
gtgcacctctgagtctcactgtaaccttttttgtcattgaaaggtgctaattgatcttagggtactgacac

SEQ ID NO: 6842006 - DNA, 77 bp, Homo sapiens
ttcatttatttatccagcagctattcaaaaggtacccaccaggggccagattttggatactgtggataaaataggaa

SEQ ID NO: 6842007 - DNA, 58 bp, Homo sapiens
aggctccctgaatcgcccgttcccagagctaccaggcagacacggcattcaagggcct

SEQ ID NO: 6842008 - DNA, 69 bp, Homo sapiens
gtagagggagaggtctgggtttccatccaggttccatgcctcttagatctaatttctccaaatctctac

SEQ ID NO: 6842009 - DNA, 78 bp, Homo sapiens
gttgcgaattttgtctgcatattagatttgtttttgaaaccaaatgaacaggtgaatgtcagatttccaagttccaac

SEQ ID NO: 6842010 - DNA, 81 bp, Homo sapiens
tgttctaacttactcagtttgagtcatttccaaccaaaaggttaatgcagaaatcaaactgacaataagaagcctggaaca

SEQ ID NO: 6842011 - DNA, 72 bp, Homo sapiens
tgtcagaataagccatttggacttctggtaggctgtggggagtcactgaagtcttcaagtaggagaatgaca

SEQ ID NO: 6842012 - DNA, 59 bp, Homo sapiens
gtgtctttcacagctactcacctctgctgttgtagctagagagccgctgtggaaaatat

SEQ ID NO: 6842013 - DNA, 67 bp, Homo sapiens
tcagtggattttcctttccaagtagaaatgcagtgcaattctaaatggaaagaaaatacctaaatga

SEQ ID NO: 6842014 - DNA, 69 bp, Homo sapiens
gcatgctaaaatgaatgactgaggtttcattaataagattagtgtctttagcaagtttagtcagcatgt

SEQ ID NO: 6842015 - DNA, 72 bp, Homo sapiens
cattattctcctgtggtgcgtacccctccatataaacaagatggggattcgttgccatggtaacagagtgtg

SEQ ID NO: 6842016 - DNA, 104 bp, Homo sapiens
gtgttgtgctttattctctgaactctaattcacagaaccatggtgctctcctgtccaggctgaacactaatgctcttgagagtcacattgaagaaagccaacat

SEQ ID NO: 6842017 - DNA, 69 bp, Homo sapiens
gaatcagactacaaatgacccctggtccatgcccggcctgtaacggggccatttgtagtttctgccgtc

SEQ ID NO: 6842018 - DNA, 57 bp, Homo sapiens
gagctgggcctgcgagtgctgcgccgacggggcctgctccacatcgaggctcagctt

SEQ ID NO: 6842019 - DNA, 74 bp, Homo sapiens
gaggaatatgtacgggatttgactcctggatccaccatcttcctgtgatgatcttgagcaagttgtgtaacctc

SEQ ID NO: 6842020 - DNA, 61 bp, Homo sapiens
agcagctgagaatcttccccagtgttgtgtagcacttggtaggacttcagtgaaatgtgct

SEQ ID NO: 6842021 - DNA, 58 bp, Homo sapiens
atgttacaaccctgaggagccggtttctgagtcatatttgctctgccagtggtaacat

SEQ ID NO: 6842022 - DNA, 80 bp, Homo sapiens
cctttgtaggtttcatagtttatagtgatactgctgatgttgtctcagagaattagtcacaattataggaactcagaagg

SEQ ID NO: 6842023 - DNA, 63 bp, Homo sapiens
tgtcttttaagaagggttactgcctcactgaaattagcaggcagtcatctttcatatttgata

SEQ ID NO: 6842024 - DNA, 55 bp, Homo sapiens
ttcctggggcgactgtatctgactaaaattggtcattttgtagatcctttagggg

SEQ ID NO: 6842025 - DNA, 56 bp, Homo sapiens
ctccagatagagtcctgttagtattgtgatttttgctctcaaaactttcactggag

SEQ ID NO: 6842026 - DNA, 73 bp, Homo sapiens
cagtgtgattttggaaagcaaagtatccatgaatcctttgtctgctgatgtatgctttctaaaaatactattg

SEQ ID NO: 6842027 - DNA, 67 bp, Homo sapiens
tcctgattcaagaagaagttgttatcagcccatatgaaactggttttgactttatattgtgtcagga

SEQ ID NO: 6842028 - DNA, 70 bp, Homo sapiens
gatgcagtggaaagaaccctggactcagaattaaaaaacctgggtgtgagtcctgtctttgtcacttatc

SEQ ID NO: 6842029 - DNA, 79 bp, Homo sapiens
cccaaagtaaacagggctgggataaccgaggctgacagcagagagttttccttggctgtgctgccctttgccctttggg

SEQ ID NO: 6842030 - DNA, 86 bp, Homo sapiens
ttaaaatgaattcagagaagttgttcaaggtggtgagtgccatgtcacatatcataggtcttggataatttagggtgattttttaa

SEQ ID NO: 6842031 - DNA, 69 bp, Homo sapiens
gctcagtgatagcaaataaaatgtaaccatttccctatggttttgctgttatatgctattatagacagc

SEQ ID NO: 6842032 - DNA, 78 bp, Homo sapiens
ggctgctactagtcctgtgtgtggcctttcccagcgtgttcttacctgtgggccatgatcatagtgctgggccgagcc

SEQ ID NO: 6842033 - DNA, 56 bp, Homo sapiens
aggtctttagtggcagagtctaggtcttttccttactctgtaattctgaagcacct

SEQ ID NO: 6842034 - DNA, 113 bp, Homo sapiens
tttgataaacactattcagcacctataattcattcattctgtaagtaactattgagcacatacaatatgccaagcaagtgaaagtagtgggactatgatggtgacacgtcaga

SEQ ID NO: 6842035 - DNA, 71 bp, Homo sapiens
tgtgttttgttcattgctgtatttgtagcacccagcatgctgactaataccttttcagtgcacaaaaaata

SEQ ID NO: 6842036 - DNA, 63 bp, Homo sapiens
tgtgtggttcgggttaatgagggtctgagtcatcaagttagaaactcacctttccagccatca

SEQ ID NO: 6842037 - DNA, 58 bp, Homo sapiens
tccttttgctgggatcatcagggaaagtccttctcatggtgatagcacagttaaggga

SEQ ID NO: 6842038 - DNA, 74 bp, Homo sapiens
gcttagcttctctgcctggaaggagcaaggggaactctggttcctctcccacctccctccaggttggctgttgc

SEQ ID NO: 6842039 - DNA, 77 bp, Homo sapiens
attgcctatcacagcctatcacagcactcaactctcatagtctgatacatgattggtatggcgagtattagagcaat

SEQ ID NO: 6842040 - DNA, 66 bp, Homo sapiens
agttctatgcctggcaaccttcagcaacctcggcctccctggactgcttgctatgcatcctgaact

SEQ ID NO: 6842041 - DNA, 87 bp, Homo sapiens
tagttatcacataaataaacaagcaatttgctcagaaataaatgtgtcattgtaaacaaattgcttgtctgtagtggactttggctg

SEQ ID NO: 6842042 - DNA, 65 bp, Homo sapiens
ggcctgagtgtgctaggtgtctcggtaggattgtcagtgccaggcagttcaagtacaccagcgtc

SEQ ID NO: 6842043 - DNA, 84 bp, Homo sapiens
tcccaccgggcagacgttatgtgagcagcctcacctgagggtagagaatattctttaatggggcccttattctgctctctggga

SEQ ID NO: 6842044 - DNA, 61 bp, Homo sapiens
tccaattcacttccaaccccttcattcaatgcatcttatgaagaattgggagagaatttga

SEQ ID NO: 6842045 - DNA, 79 bp, Homo sapiens
catcatagtgtgacccatggcaagggcagtaataaccaccaaaatctcctgcatttgcaatgggtacacaaccaagatg

SEQ ID NO: 6842046 - DNA, 57 bp, Homo sapiens
gctgtgcactacctatacatccaggtgaggtcgtggtgtgtagttaggtgacacagc

SEQ ID NO: 6842047 - DNA, 64 bp, Homo sapiens
tctgtgtgtgtgtgtgtgtgtgtgtgtgtgtgtgtgtgtgatcactcaagtgggcatgcgcaga

SEQ ID NO: 6842048 - DNA, 128 bp, Homo sapiens
aacctgaaacctcttcctttatgctcgcgattttctatgacttgcttagaaccaggctggcttggctggacttagaggtggaaaagagagtgagcatctgtctctccttggaggatgagctttgggtt

SEQ ID NO: 6842049 - DNA, 70 bp, Homo sapiens
agtcatcccgcactgctcagctctctgtgagaataattatcgtcaccttgaatgcagcagcgtggagact

SEQ ID NO: 6842050 - DNA, 77 bp, Homo sapiens
ctgcaccatccgattcagtgtttgtgttgaaagccatctgttcctgtggcttgtgcataagaagacctgaggtgtag

SEQ ID NO: 6842051 - DNA, 93 bp, Homo sapiens
ggagagtgagctgttactgaaagtggtcaacagtggagggagcgtgcacatgtgcagtcacttttgatccctatgcagtcgcagtcagtctct

SEQ ID NO: 6842052 - DNA, 87 bp, Homo sapiens
gaggttcacactgcaaatatttttccttttggaaaatagcacttttactattcccagcagtcagagctatgtgtctttgtgaatctc

SEQ ID NO: 6842053 - DNA, 82 bp, Homo sapiens
gaacatgcttgatttttactgtggcaaaagaacattggagggaaaaccctcatgatttttctttacagttgatcattatgtc

SEQ ID NO: 6842054 - DNA, 80 bp, Homo sapiens
caaagaagagtgggaatgttctaagaattctttttggcttaatctttgttgaattgaaaatatgtataactcttctgctg

SEQ ID NO: 6842055 - DNA, 128 bp, Homo sapiens
atcagagaccataagccttccaagacagtctttgcaggagaaaggacgtttctctaaatagcagagcctgttctccttctgtctttttttcctgtgcagagctggctccaaacaggctctcctctggt

SEQ ID NO: 6842056 - DNA, 100 bp, Homo sapiens
ccatgttttctttgaaactctgtagcttttggtatggaatccttgctccatagattcactctgagcagaatttaatatgaaaagtctaccttgaacatgg

SEQ ID NO: 6842057 - DNA, 98 bp, Homo sapiens
cagtcatgctataggggatcagtgatggtgatggggcatggcattttcacagccactatttatacttcctgatccctctagctaaaaaatggtggctg

SEQ ID NO: 6842058 - DNA, 66 bp, Homo sapiens
cctcagtttcttcatcagaaaatgaagctaatagtaagctttacatgagatgaggacaactagagg

SEQ ID NO: 6842059 - DNA, 71 bp, Homo sapiens
gcaagctcagaggtaaggagtgacgcccgccaggactagctgatggagccatgcctggcctttccccttgc

SEQ ID NO: 6842060 - DNA, 66 bp, Homo sapiens
acacatgtatgttttgtatttgctatgctgtggaggctaaaaccaaaatcaaaacattagatgtgt

SEQ ID NO: 6842061 - DNA, 70 bp, Homo sapiens
gtgtgcccaaggacaaggtcattaagttctctattcaaggcatagtagaggccaccactgtcagggacat

SEQ ID NO: 6842062 - DNA, 64 bp, Homo sapiens
cctggctgagggggctctgctcaggaccacccatttccatggcaaccagagccctctggctggg

SEQ ID NO: 6842063 - DNA, 77 bp, Homo sapiens
gaggaaagattcttaattcttttgatgtgccacgtacaaatgtgtattcacatgagacaattaaagacttttttttc

SEQ ID NO: 6842064 - DNA, 78 bp, Homo sapiens
gccttaaatagacattttctcaacatctctagaataaatgcattatttctaaggatagtaaaatgtctgatggaaggc

SEQ ID NO: 6842065 - DNA, 66 bp, Homo sapiens
gttttatcagaatgcagccatgtgcatctgtttaagtgttgtctatggctgccttctgagtacaac

SEQ ID NO: 6842066 - DNA, 56 bp, Homo sapiens
cagtgggctgtgatggattcaccttgttgtgtctgtctccaaggcatggcccagtg

SEQ ID NO: 6842067 - DNA, 56 bp, Homo sapiens
ctggaggcttttctggtaggcggccttggggctgtccacctccagagccttaacag

SEQ ID NO: 6842068 - DNA, 78 bp, Homo sapiens
cctgtaagattgagctgcagacatagataagcgagctggaagcttgcatgaataaatgcctgcagctctgctaatagg

SEQ ID NO: 6842069 - DNA, 70 bp, Homo sapiens
gggtacagtgagactggctcagggactgccaaaaaaagggactagattctggggccaattgccactgcct

SEQ ID NO: 6842070 - DNA, 65 bp, Homo sapiens
gtagacaagcacaggactcagatcactcttgttttaccaaccaactgaattctgggtttatctgc

SEQ ID NO: 6842071 - DNA, 55 bp, Homo sapiens
gaagctgtgtgaagctctgaagttgtccttagtctcacgtggtcacatgagcttt

SEQ ID NO: 6842072 - DNA, 73 bp, Homo sapiens
ttggtctagtaaatgtttgctgatgattctgatatttaattctttcagaatttattttgtttcctatgaccaa

SEQ ID NO: 6842073 - DNA, 70 bp, Homo sapiens
ggagctgaataggggtacctagagtggataatatgtcttttgtctatttaggagaccctggttctgtgcc

SEQ ID NO: 6842074 - DNA, 58 bp, Homo sapiens
ggaggccacggtttagcaccgatgtctgcggaggaggtgggtgctcgccctggtcttt

SEQ ID NO: 6842075 - DNA, 55 bp, Homo sapiens
tctgcacacttttattgacctctgccagaccctggggtcatagaagtgaatcaga

SEQ ID NO: 6842076 - DNA, 72 bp, Homo sapiens
gaagtttgcaaaatgctgttccccagtgctacgctgaaactagcggggccaagggaatgtattgtggacctc

SEQ ID NO: 6842077 - DNA, 118 bp, Homo sapiens
gggaatattgggaaggttagatattagtggtcacctctagcattcctgtcactaagatgttgactactcatattgtacagagggatcaccctgtttctggatctaaccatttatcacc

SEQ ID NO: 6842078 - DNA, 129 bp, Homo sapiens
taccatgatgaagggaggagcttgcaccagcaggtgtaaggagtgtgagtttgagttctgctcatcagacagcctaagcagtcacatccttgaatcctggtcttttgcaggccagtccttggtcaggtg

SEQ ID NO: 6842079 - DNA, 125 bp, Homo sapiens
ggcctggagtggagccctcgcaggctcttggtaccctggctgtcaagctgtgtgtttggctgccctgtttagccagggtttcaggaggtttctgtgcctgtggggtgcaggtcagactccaggtc

SEQ ID NO: 6842080 - DNA, 80 bp, Homo sapiens
tctactggctgggttccttcgccatgagcatcctggtgttccttacaggaaacattcttggtaaggacaaggctttggga

SEQ ID NO: 6842081 - DNA, 107 bp, Homo sapiens
gttctgcccaggcttaacttcctgtaaatggaactatgtagtatataggcacaaaagggtaaatactgccaaattccatttataggaagttcgaacactggcagaac

SEQ ID NO: 6842082 - DNA, 67 bp, Homo sapiens
attcagtcaagttgcagatcagacagtaacctcccactgattgtcttggcacttgaaggtcctgaat

SEQ ID NO: 6842083 - DNA, 64 bp, Homo sapiens
ttgggactgatcatttttgaaccctatttgatatgttctatatctcaaagaagattcagctcaa

SEQ ID NO: 6842084 - DNA, 68 bp, Homo sapiens
cctgtaatgactttcttctgtgctgtgcactagtgtagtgtaagacatagccaagagcatcccatagg

SEQ ID NO: 6842085 - DNA, 57 bp, Homo sapiens
tttgttctttttcccagaatgtttggaaaaagacatttggcaagaaagagaaacaaa

SEQ ID NO: 6842086 - DNA, 61 bp, Homo sapiens
tcattatttggaaatacgcgcttttggaatttccttcattttcgctatttccaggttcaga

SEQ ID NO: 6842087 - DNA, 86 bp, Homo sapiens
gctggttatgaatgaggatccttgaccttatcacaggcctactaatcacaatctctagggtaaggctcaggaatctccttttcagc

SEQ ID NO: 6842088 - DNA, 60 bp, Homo sapiens
agcagagcagcaaatggaaaggaaggaaaattactatcctcctccttctgttgcttttct

SEQ ID NO: 6842089 - DNA, 72 bp, Homo sapiens
ttaacaattgaattgtacgctttacataggtgaattttatgatatgtgaattatacttagtaaagctgttaa

SEQ ID NO: 6842090 - DNA, 55 bp, Homo sapiens
taaggacatttgtcattggatttaggacctacctgggtaatgcagaatgttctta

SEQ ID NO: 6842091 - DNA, 63 bp, Homo sapiens
aaccaggctctgcaaaatcaggctccaagactgtcacaaggagcctccttcagagtctaggtt

SEQ ID NO: 6842092 - DNA, 71 bp, Homo sapiens
gtattgctgtagggggaaaatacttattagatttattcataaaattaagtacatttttaacttacagctgc

SEQ ID NO: 6842093 - DNA, 60 bp, Homo sapiens
caggtgcctgtttcttttgaattcagtcttatctaaatttacccaaggaacatgtatttg

SEQ ID NO: 6842094 - DNA, 60 bp, Homo sapiens
gatgtttgttaggctctgaatagatatttatttcctcttctcatgaagcctacaaacatc

SEQ ID NO: 6842095 - DNA, 67 bp, Homo sapiens
aaggttagtcaagggagacttggggtaagtgcctgttcaaggccctccacctggtctctctggcctt

SEQ ID NO: 6842096 - DNA, 83 bp, Homo sapiens
tggttctttaatctgtatgactaagagtgtggattggctgacattatgagatgcaattaatttacatgcttaagttaggacta

SEQ ID NO: 6842097 - DNA, 65 bp, Homo sapiens
attgagctaaatagatcaagggactctaatactacttagagtaatgggttgaaatttagttcaat

SEQ ID NO: 6842098 - DNA, 80 bp, Homo sapiens
gcgcaagcccatcttctgttgtcgtaatgatggtgcctttgaatatttatctgccagatgacaaacaggacatcttgtgc

SEQ ID NO: 6842099 - DNA, 83 bp, Homo sapiens
gatatatttttggaagggaaccaaaacatgggaatcctagagcattttgggtggatatttggttcttcttctgtgtatatgtc

SEQ ID NO: 6842100 - DNA, 102 bp, Homo sapiens
ggtgtggtggcacacgcctgtaatcccagctactcgggaggctgagacatgagaactgcttgaacctgggaggtggaggttgcagtgagtcaagaccacgcc

SEQ ID NO: 6842101 - DNA, 129 bp, Homo sapiens
ttttaaacactgactctcaaatctctgcatttctgtgactgtggagttgttccagtgtgtgaattgacactggtttgtggaacacacttcaaggagaaagagtgtagactcaaagaattaggttgctag

SEQ ID NO: 6842102 - DNA, 56 bp, Homo sapiens
ttcacagctcatactgttctcacctgggaaacttgggaagggctgatgagtttggg

SEQ ID NO: 6842103 - DNA, 87 bp, Homo sapiens
ggagaacttggtcagcccacggtccttaaactgggagacaccagtttagtgtgcccattccacttgagtaccgagggcaccatttcc

SEQ ID NO: 6842104 - DNA, 81 bp, Homo sapiens
gattgcaataatactagtgaatagcaggatcttttttattcaagggagaaaaatttggctgactcactaattgtttcagtt

SEQ ID NO: 6842105 - DNA, 103 bp, Homo sapiens
ctcaaggacttgaaggtggttctgcttagcaatgaggttgggaaatagagcagctactctcttgcaggcaaactacctctactactacatctaggtctttagg

SEQ ID NO: 6842106 - DNA, 130 bp, Homo sapiens
aaaatgaacaggcaaactataggaacttcaggcaaagaggctttcagtgaacttgtgggtagtaactattgccttcttttgctagttttttgaaaagccactttaaaggaagtgctgtgcctggcttttt

SEQ ID NO: 6842107 - DNA, 56 bp, Homo sapiens
tgggtaccttgtgagggaggagatgaaattctaagtccagctctcatagtgttcca

SEQ ID NO: 6842108 - DNA, 60 bp, Homo sapiens
ctgactgctctttgctctacattatctttttcagggtgtttatacagcaaagagcattag

SEQ ID NO: 6842109 - DNA, 73 bp, Homo sapiens
ataccaaagcaaagagctaacattgccgagatactatgtacttgattttgtgctagctctttgcattcagtat

SEQ ID NO: 6842110 - DNA, 60 bp, Homo sapiens
tctggatgctctgagcccaaggaataagtaactcatttcctgggctcatggtgttacaga

SEQ ID NO: 6842111 - DNA, 58 bp, Homo sapiens
tggagatccttcattttggtgttataatgaaactgattctagaatgacatgatttcta

SEQ ID NO: 6842112 - DNA, 76 bp, Homo sapiens
tcccagccttagccctccctacagcctatttctgtccacacataggaaggcaggaggcaggcctgaaatcctgggg

SEQ ID NO: 6842113 - DNA, 90 bp, Homo sapiens
ggggactgggtaggtggaaacagctgggaggtagaggcggggccctgaggcctgtcctgtccatatcccactgtgtagccccagtccacc

SEQ ID NO: 6842114 - DNA, 89 bp, Homo sapiens
gagagtggaggcgtgcggacatgggttgctcacctggcactgttgcagccacattgccgccacccttatcccatgcttctcaaaccctc

SEQ ID NO: 6842115 - DNA, 59 bp, Homo sapiens
tcatgtgtgtgtgtttgtgtgtgtaaactccttcaatgtgtaatgcacttaacacatgg

SEQ ID NO: 6842116 - DNA, 57 bp, Homo sapiens
gttctctgccacttaccagctacagagccctgactgcctgcggagtgtgcagagtac

SEQ ID NO: 6842117 - DNA, 60 bp, Homo sapiens
tggcctgagttgtctgcaggcctcatctctgtctgagctcgtccccaaccaaccaggcca

SEQ ID NO: 6842118 - DNA, 68 bp, Homo sapiens
cacagaggcggaaaattctgaaggaaacatgactatttgtagctcagagctattcctgcttccctgtg

SEQ ID NO: 6842119 - DNA, 66 bp, Homo sapiens
gtgacgaccgtctccggtcctgtccttcatcccaagatgagcagactccattgagtgagtcgtggc

SEQ ID NO: 6842120 - DNA, 58 bp, Homo sapiens
gctcccgtgaaggctgtagaagatgatctgtgtcttgtctcttccagcatctgggggc

SEQ ID NO: 6842121 - DNA, 92 bp, Homo sapiens
ttctatttttggaagttatcaagtatttgtttgaggcattgcaaaggtttctcaagttcagatatttgaaagagccaccagacttcatagaa

SEQ ID NO: 6842122 - DNA, 58 bp, Homo sapiens
ggtcagctttgttggatactgctgaaaggtcaagtaacatgaacacacagagctgacc

SEQ ID NO: 6842123 - DNA, 58 bp, Homo sapiens
acagtgttttatgagaattgttggtcatgcccagctacacaatcctcatgcatattgt

SEQ ID NO: 6842124 - DNA, 55 bp, Homo sapiens
ggtggaggtgggatttgaaccaaggtcagcctgactccaaagctcacgttccatc

SEQ ID NO: 6842125 - DNA, 81 bp, Homo sapiens
agtacttctattttgatttgcaggattcattggccatgtaaaacagcaattctataaatcctcagaagaaatagcagaact

SEQ ID NO: 6842126 - DNA, 56 bp, Homo sapiens
ctgttcttcacatttcattgaggagcacggggaagctttggggtgggaagaagcag

SEQ ID NO: 6842127 - DNA, 63 bp, Homo sapiens
aagggggagcttttatttcttggtctcttcctccttagacaaagtcttgatgatctcctcctt

SEQ ID NO: 6842128 - DNA, 57 bp, Homo sapiens
atgcactttctagagattctgattcagcctagagtctatattttctgaaagatgcat

SEQ ID NO: 6842129 - DNA, 113 bp, Homo sapiens
tgccaggacttcattggggctttcctgcaatgcacttcaagcatctctctgttggaggaattttgatagcaggtacttggggttatggatgggggaggtatctgagcctggca

SEQ ID NO: 6842130 - DNA, 70 bp, Homo sapiens
ctgtcagaggctgcacttgctcatgatgtttatttttataccagcacagagcaatgcgtgttctctatgg

SEQ ID NO: 6842131 - DNA, 85 bp, Homo sapiens
ttcttagccatgtcaatcaatgtcatgacaatagtatatcaaagcagtgtacttccgtggactaattgttctgcatggttatgaa

SEQ ID NO: 6842132 - DNA, 64 bp, Homo sapiens
gccggtggcagagttggaggtggaagacagcatgtctgtctcccactgccaccttgtctcctgt

SEQ ID NO: 6842133 - DNA, 68 bp, Homo sapiens
ttgctctgactggagtgcagtggtgtggtcatagcttactgcaacctttaactcctaggctcaagcaa

SEQ ID NO: 6842134 - DNA, 69 bp, Homo sapiens
tgctgttcggcagcacctggagctagaccagctttgatgaatgggagcccatgctgttgggcccgagca

SEQ ID NO: 6842135 - DNA, 58 bp, Homo sapiens
gctctctgccatatgaggatacaaggagaagtcaatagtattcaacttggcagagggc

SEQ ID NO: 6842136 - DNA, 72 bp, Homo sapiens
aatagctgatgggaaagaagccactgcccaatgctctctgaaagtgactccctttcaccagttagggctgtt

SEQ ID NO: 6842137 - DNA, 77 bp, Homo sapiens
ggctatttagctcatctgttgccacctttaattgttggcattgacactaaaggtcatcagattagcgggaaccagct

SEQ ID NO: 6842138 - DNA, 99 bp, Homo sapiens
cacttagttttctagacatttctatgtacatgatcttattagaccctcttaatgactgaggtaggactgtatcagatgtgatctagagtatgttaagtg

SEQ ID NO: 6842139 - DNA, 79 bp, Homo sapiens
ctgagcatatgggattagcagcatgtaagtgagtagaagtagttcttatgttctcttgcagttgtcctatttttttcag

SEQ ID NO: 6842140 - DNA, 59 bp, Homo sapiens
tgtgtgtcagtcttgtttagggccacattcttagtccctagcacagtacctgacacaca

SEQ ID NO: 6842141 - DNA, 95 bp, Homo sapiens
ggtcttgttttattttgctttgctatgttttgcttgatttttattgccaatgatgtttcaggcgaactaacatgcttttaagatacagacatact

SEQ ID NO: 6842142 - DNA, 76 bp, Homo sapiens
aggttggccatgaactcgggcatggagacggtgtccatcagcacgaagtctgccttgccgaattccaggctctcct

SEQ ID NO: 6842143 - DNA, 60 bp, Homo sapiens
aagtcaggacagattttctgggggtatcctctggttgctcttccagatacttcctgactt

SEQ ID NO: 6842144 - DNA, 56 bp, Homo sapiens
ggggagtgcctgagccagtcacctcgctgtggttggtcactggccagagtagccct

SEQ ID NO: 6842145 - DNA, 78 bp, Homo sapiens
gagtagaagattgccagataggcatgaaaagtaggagaataataaagtactaagcacgtgtatttggcagaactactt

SEQ ID NO: 6842146 - DNA, 127 bp, Homo sapiens
ttgagctatccatgtgtactttctgttccttttgtgagtactgctatttatatattccggtaatgttaactggcaatggttatgtgtatagtctgtaggacagaaggaatcaaagtgatctgttcaa

SEQ ID NO: 6842147 - DNA, 74 bp, Homo sapiens
gggtgttaaatactgagttggagttggcattggaactctatgaatgttagctgttagtcagtattgatacactt

SEQ ID NO: 6842148 - DNA, 58 bp, Homo sapiens
gccggggaaactcaggcatttccactttgtttagaatgggccatcactttccccaggc

SEQ ID NO: 6842149 - DNA, 87 bp, Homo sapiens
gagaaaactgttttatactgttcaagcaaatgacattggtctgagacagaaaggccatgtaatttttttgaacaggaactgtgtctt

SEQ ID NO: 6842150 - DNA, 60 bp, Homo sapiens
gccggagccgcgcgcgatgattcattgccccaattaggggctctctgcagcgcgcccggc

SEQ ID NO: 6842151 - DNA, 64 bp, Homo sapiens
ggcagctgggtgcctaataatgataaaaaccataatacttcataattacgcactgccctttgcc

SEQ ID NO: 6842152 - DNA, 79 bp, Homo sapiens
ggggtactgataaatttctggaagtgtcagagtatgcccagcaacactgaatgctgtttagaaattattttagtatttt

SEQ ID NO: 6842153 - DNA, 67 bp, Homo sapiens
gggagcataaaataaatagtttgcatgacgtttcatttttcatgtattatgattattttcatgcccc

SEQ ID NO: 6842154 - DNA, 72 bp, Homo sapiens
gcgaggaaggttgcccatctcagtgcctcgctgtcccagctgggccctgtgatggcagctctgtgttcctgc

SEQ ID NO: 6842155 - DNA, 62 bp, Homo sapiens
gcgctatggggagtctttacccagaaaagatgcaaaatatcttcacagggcttcccatgtgc

SEQ ID NO: 6842156 - DNA, 77 bp, Homo sapiens
gcatcctgaccctgagcaaaagcagttctctccctaagaaacaccggtgacttttgttcatggcactccatggatgc

SEQ ID NO: 6842157 - DNA, 88 bp, Homo sapiens
ggctgtgccaggttttcagatgcaattaattttcaagataagctctaaacttctgaaatgtctttgcaattgaaatgctgatacagtc

SEQ ID NO: 6842158 - DNA, 61 bp, Homo sapiens
ggttttcattattagtgctttgttttagaaaaagtccaaaacaagccctaatgaagagtcc

SEQ ID NO: 6842159 - DNA, 60 bp, Homo sapiens
gagaggaggtggctatgacagctaaatgtcatcttttactatcatggccatcctcttctc

SEQ ID NO: 6842160 - DNA, 90 bp, Homo sapiens
gcagaacatgtcatgaatgttgtttcggcctttcttcatccatctcctcctttcaaatggggaaactgaaacatcatcatgttgtttggc

SEQ ID NO: 6842161 - DNA, 129 bp, Homo sapiens
ggggttgctgaatatcttttgaaattttgttttgagaacttttggagacttttagtacatccttcagggaaattagaaaaactcaagggctctataaaactaaggttcaatgtcactatattagaccat

SEQ ID NO: 6842162 - DNA, 98 bp, Homo sapiens
atgaaaggatttatattcagtatggtctagatttctgttatagggccctcaacagaaccttagaatgaaatctaaatagactgaatcatccattttgt

SEQ ID NO: 6842163 - DNA, 78 bp, Homo sapiens
atgccaaactgcattagctaacgtgagttgtcccccgttttcgtaggagggtcgtgttgctagtttagtttccggcat

SEQ ID NO: 6842164 - DNA, 56 bp, Homo sapiens
tgaggcctgacagaccaagcctgtggtggtttagacaaaggttcttggaggtctca

SEQ ID NO: 6842165 - DNA, 60 bp, Homo sapiens
cccgtagctgcctttgggctcctgctggggtctctcccacagcggcgcggtagcggcggg

SEQ ID NO: 6842166 - DNA, 55 bp, Homo sapiens
cctttggggctttactgtggaagcataacttagtcacagtataacctcatatagg

SEQ ID NO: 6842167 - DNA, 60 bp, Homo sapiens
ttacacaattttattgacctaaactcaggaaatccctcactggtcatggaggttgtgtga

SEQ ID NO: 6842168 - DNA, 59 bp, Homo sapiens
cagcggtggcaaggtgactgtgctgacccactgtaacactggtgctctggccaccgctg

SEQ ID NO: 6842169 - DNA, 60 bp, Homo sapiens
gtcccctgcagccccttggagtcccatgagtgggctcctgaaggctctgcagggtctggc

SEQ ID NO: 6842170 - DNA, 56 bp, Homo sapiens
cactggactccccaagggccaggtgtgcagttcgttcacctcagggagatccagtg

SEQ ID NO: 6842171 - DNA, 89 bp, Homo sapiens
tagcttggttttatgacctggctggttgtgattcccatatattaataagtgggttcatggtcaggacttacagggccagggccagggtg

SEQ ID NO: 6842172 - DNA, 57 bp, Homo sapiens
aaacatagcacacacagctcttgtccacttgggagatttctgtgtgtgcatgtgttt

SEQ ID NO: 6842173 - DNA, 66 bp, Homo sapiens
gttgcctcagcagtagaaaatggcttagcaggctacatacttgcagattcaacatgctgaggcagc

SEQ ID NO: 6842174 - DNA, 100 bp, Homo sapiens
agaactttgagcagaaacttggtgtattagctctcactgccctaccaaaataccacagcatgggtggcttaaacaacagaattttttttctcacagttct

SEQ ID NO: 6842175 - DNA, 60 bp, Homo sapiens
gccaggtgattctgatatagctaaagtttgaaaactagtgcagtcgggtaatcgccaggc

SEQ ID NO: 6842176 - DNA, 127 bp, Homo sapiens
tgcagccacttaaagttttcaaagattacataacatgaaaaatgcttctggtataagaaaaatgaggacttctctttattgtataccaggatgctttagaatgtttgtttttataaatagtgttgca

SEQ ID NO: 6842177 - DNA, 94 bp, Homo sapiens
aagacagtcatgttctaatccctgctatgtatgaatgttaccttatggtatatggtaaaagggacttggcagatggaattaagttaaaggtctt

SEQ ID NO: 6842178 - DNA, 80 bp, Homo sapiens
agtatgtgaggtgatggatatgttaaatagcttgactgaaccatttcacaatgcgtacatatatcaaaacgtcatgtatt

SEQ ID NO: 6842179 - DNA, 130 bp, Homo sapiens
aaaatgatgtaattagtgcaacggtgatgctgtgactcagagggaggactgggctggtgatgagtgaggtgatgtgtgtgacgttgccagccaagcttctcctggtatctgtctgccactaactctcctt

SEQ ID NO: 6842180 - DNA, 55 bp, Homo sapiens
tgagtttctgctctaggtctggtggcagatccactgatcctaggcagaggctaca

SEQ ID NO: 6842181 - DNA, 59 bp, Homo sapiens
cacgtgcatctgatcttttctgagaagcagattttcacagaaaagtggagagcctagtg

SEQ ID NO: 6842182 - DNA, 73 bp, Homo sapiens
gcttatctttggaaagtggttcaggtgacaagatgcccacatttcttacctttcttaacttattaaggagagc

SEQ ID NO: 6842183 - DNA, 58 bp, Homo sapiens
tccagagataactatttaggaggttgttgttttcttcctgattttggtcttttttgga

SEQ ID NO: 6842184 - DNA, 92 bp, Homo sapiens
cactttgggcattctcagatgctttgtatgtggtgggactctagatgctgagctatgtttctcttaacacataaagtaggaagcttaatttg

SEQ ID NO: 6842185 - DNA, 67 bp, Homo sapiens
attgagtacttagtgtcatatactaggaatttcctttggtattttcatgtgcactatgtcatttaat

SEQ ID NO: 6842186 - DNA, 95 bp, Homo sapiens
atacagagagactgaaagttatgtgccactttttgaagatgactactccaaattggttaaattttcaaaattggtatgttaaaaagagttggtat

SEQ ID NO: 6842187 - DNA, 129 bp, Homo sapiens
tgccgttctttcaaaatcatcttcaatgaggttgccttcttggcctgtgcttccctttattcatctgggggcactggaggccaaggagctgcgtggagtcttcacctgatggaactgatggaagtggca

SEQ ID NO: 6842188 - DNA, 87 bp, Homo sapiens
atgtgcattgattagtattgcattttaatatgtgcattgattttagtgcctattcaatatatgcatttactatatatcgatgagcat

SEQ ID NO: 6842189 - DNA, 66 bp, Homo sapiens
ctgttgtcttggtacctctttgaagtgcaaaaacattacaacttcaaaagcggtccaggaagatgg

SEQ ID NO: 6842190 - DNA, 56 bp, Homo sapiens
ctgcttccatggtctggagactggaatatgtgggttctgcagacacctgggggggg

SEQ ID NO: 6842191 - DNA, 58 bp, Homo sapiens
gtcagctggtgaactagtttttcatgctccatgagatttctgcaattaccaagcttac

SEQ ID NO: 6842192 - DNA, 75 bp, Homo sapiens
gagcacagatcctggagccacacttcctggatttgaatcccaaatctgatacttgctggttatatgatcttgctc

SEQ ID NO: 6842193 - DNA, 95 bp, Homo sapiens
tctggctgcactggggtagagggtgtttggcagagcatggggatgacattgtcatcagagctcccccaaacgtcactccctgcctcccagctagg

SEQ ID NO: 6842194 - DNA, 55 bp, Homo sapiens
tggtgacaccccatctctaaagatacaaaaattagcgggcgtggtggtgatccca

SEQ ID NO: 6842195 - DNA, 71 bp, Homo sapiens
ctgcaatcttacctcttcctctgcattttttggggggagtgacattttaatgggaggcaggaggtttgtgg

SEQ ID NO: 6842196 - DNA, 94 bp, Homo sapiens
gttgctagttttataattgcagtctctagtttctgaatgaaaaaggatgccccacattatacagaacattaagaactgtttttaaagctgaaac

SEQ ID NO: 6842197 - DNA, 76 bp, Homo sapiens
gcatcccactgggtctctttagggtgccgtatgtagctcatgttagaatttgagtatggtaccttagaagacatgc

SEQ ID NO: 6842198 - DNA, 77 bp, Homo sapiens
aatctctgagtcacaaggcagacagacacacaggagagatcagggtaaatgtatttctctttaaagactcagagatt

SEQ ID NO: 6842199 - DNA, 83 bp, Homo sapiens
tgtacaaaattaggatttcagagacccagatcttttggcagatagctaggtcctgacgccctttgaaatcggaatatagtaca

SEQ ID NO: 6842200 - DNA, 57 bp, Homo sapiens
acttcctgacttctgggttggaagttattctgccaactttctccaagtacaagaagt

SEQ ID NO: 6842201 - DNA, 70 bp, Homo sapiens
ctacttattcagcagggacttcctttcagccgagactcgctgaagagtccacttaattgagttttagtag

SEQ ID NO: 6842202 - DNA, 99 bp, Homo sapiens
gcccggctgccgcccagcgccagccagagcccaccccgcctccctgcaggaagccggctggcggcgcctgctgcgtgaccttgggctgcaaagtcgggc

SEQ ID NO: 6842203 - DNA, 57 bp, Homo sapiens
caggtgctctgatatggggctggccagcagactggcttctgtggcaggtggcgcttg

SEQ ID NO: 6842204 - DNA, 120 bp, Homo sapiens
gggtgactctgtcttgctatttattcacttctgcattcgacaagtactgtggacacctgctgtgtgccaggcactgctcgaggtgctagggggagatcaggaagcaagaaaaagtttccc

SEQ ID NO: 6842205 - DNA, 58 bp, Homo sapiens
gaaggggtcctgtcaacaaacaatgggaagcttcagtctcaacaggatcctccacttc

SEQ ID NO: 6842206 - DNA, 69 bp, Homo sapiens
cttcagtgtctgagactgggcacatacctacaaatctcattaggatgttaaattctcagagctctcaag

SEQ ID NO: 6842207 - DNA, 62 bp, Homo sapiens
taggccagattgttatccatggttgagcatgactctgcaatagaaactaacaatttggctta

SEQ ID NO: 6842208 - DNA, 106 bp, Homo sapiens
attatatttttagggagattttagttgttcatttttgtttccatatcttattcagatttgtcaataagatgaacatatatttgctgctaaatcaataaaaagtaat

SEQ ID NO: 6842209 - DNA, 67 bp, Homo sapiens
gaccatggcttaccccaggagcagcacttccagagcagttgccgttcccatctgtgagccaacagtc

SEQ ID NO: 6842210 - DNA, 120 bp, Homo sapiens
gaatggtcgataaaaatttgtggcttttattgatgaaaaattttccttcagtttcataacttgttattggaaatgtcatgcaaatttttagaactgctatcaaatttgagaaaacctttc

SEQ ID NO: 6842211 - DNA, 59 bp, Homo sapiens
gccactgggtgaatcatgcacctcaacctctgctgagagagcctgaatctcttactggc

SEQ ID NO: 6842212 - DNA, 77 bp, Homo sapiens
tagctgcagctgctcttcatttccccccagcaaaacaagaggaaatggatggtggagatggtggagacagcttcctg

SEQ ID NO: 6842213 - DNA, 58 bp, Homo sapiens
tctgtattccatccctacagactctgtctcaggcctgggtagggaaggaatctgcagg

SEQ ID NO: 6842214 - DNA, 76 bp, Homo sapiens
agatgaaaattcctgggactctttatcagagattatggtatagcatttctttgttggagtccaaggatatttattt

SEQ ID NO: 6842215 - DNA, 55 bp, Homo sapiens
agtttcttgcatggggcaatgtgattcctgccacagggcctttgcacaagcagct

SEQ ID NO: 6842216 - DNA, 92 bp, Homo sapiens
tgggcatgtttcgatattcaatacaaatgtactgtagaatagcaaatgccatctgcgtgaatttgcattgtgggatggaggaacgtgaccta

SEQ ID NO: 6842217 - DNA, 57 bp, Homo sapiens
caggaaccttgtctgtgttgttcatggctatatccccagcactcagaacagggcctg

SEQ ID NO: 6842218 - DNA, 65 bp, Homo sapiens
gttcccttctcatggggtccagcatgtcctatcattgtggagctgggctctgagtggaagggggc

SEQ ID NO: 6842219 - DNA, 56 bp, Homo sapiens
gaagcagttcgaaagcagttggggatttccccaaaggcttgtttgaggactggttc

SEQ ID NO: 6842220 - DNA, 84 bp, Homo sapiens
tttgttattctcccagtctctgatggagtgagtcattggtttactacttaagaaaatcaactgtttccacagggagaaaacaaa

SEQ ID NO: 6842221 - DNA, 62 bp, Homo sapiens
gtcacctaaccttactgtgtcttagtgtccttttcataagaggagaagtaaggctagatgat

SEQ ID NO: 6842222 - DNA, 63 bp, Homo sapiens
gcaggcgctctgcctttgtcttacacggctgaaacatctgttgcagaggggcggagaggccgc

SEQ ID NO: 6842223 - DNA, 56 bp, Homo sapiens
ggagaggacatggctcccacagaaaggctggatatttaaggagcctgttcctcccc

SEQ ID NO: 6842224 - DNA, 64 bp, Homo sapiens
gataggaaataaagggatagtgaaacttaaatctctatgttttacaagttctgaaatttccttc

SEQ ID NO: 6842225 - DNA, 65 bp, Homo sapiens
tgtgtaactgtatattaaggtggcccctgatattccagggtcgcttaatatatgtttaaaacaca

SEQ ID NO: 6842226 - DNA, 87 bp, Homo sapiens
atctgattccttttcaaatcttcactcattcagagttgtttgatgaataactctgtgcaagggcgaggaatgcaaaatgaaaaagat

SEQ ID NO: 6842227 - DNA, 80 bp, Homo sapiens
tctgcaaaccagctgccatgctcaagaagtctttcctggaaaggcttcagtgagtgggtattaagattgccatttgcgga

SEQ ID NO: 6842228 - DNA, 89 bp, Homo sapiens
ctcagggttcactgatgttgtagtatgagtcaaaatttccttccttggctgggcatggtggctcatgcatgcaatcccagcactttgag

SEQ ID NO: 6842229 - DNA, 68 bp, Homo sapiens
gagctgggcttttggctactctttttgcaataattatgtaaagagctggtcacaggtccattttcctc

SEQ ID NO: 6842230 - DNA, 80 bp, Homo sapiens
ggtaaatgatccaaagccacaggggcagatctgccatctatctctcaagatgtggctcctgtctttgggtcccaggtgcc

SEQ ID NO: 6842231 - DNA, 80 bp, Homo sapiens
gggatctggaactatggaagggatgcaaagaaaggaagtggcctctctctgtcttaccaccctccatcattccttgtctt

SEQ ID NO: 6842232 - DNA, 58 bp, Homo sapiens
accttgtctgttttccagtatgtaggatcccctagcacagagatggcacagagaaggt

SEQ ID NO: 6842233 - DNA, 60 bp, Homo sapiens
ctgctctcctggctgtgcatgcaaggcttctctgttagggcagtgcagcttggagggtag

SEQ ID NO: 6842234 - DNA, 67 bp, Homo sapiens
ctctcttgaaggggggcagtgttgatctgaatctttttgtctaatgctttttcttcctctgggaggg

SEQ ID NO: 6842235 - DNA, 74 bp, Homo sapiens
tggctgaagctctgtagctcatgtgatattacaagtatttaaaacagtgttattcagtcacagagtttaagcca

SEQ ID NO: 6842236 - DNA, 66 bp, Homo sapiens
gctgctgctggcatcattctgaagggtagaagcaggggacctatatcagagtgtgttacagcaagc

SEQ ID NO: 6842237 - DNA, 70 bp, Homo sapiens
atggaagcagctcagattgactgaattgactctgcaaacccttcaggaacattaatggagttgctactat

SEQ ID NO: 6842238 - DNA, 59 bp, Homo sapiens
agcagcacctggctatctgatcccatcttatggggtcaagtaacaaatcaggagctgtt

SEQ ID NO: 6842239 - DNA, 55 bp, Homo sapiens
gagttccgggttccacagctgggacagtgttgcccagagctgattcctgggactt

SEQ ID NO: 6842240 - DNA, 92 bp, Homo sapiens
catctcttccccagcgcccaggggcagggctctctggcctggcttgtgctggttcccagagtccctgctgtcaggtgctgggagtggaggtg

SEQ ID NO: 6842241 - DNA, 58 bp, Homo sapiens
gttacaaaggactgggggccacaggtctgagtgtgagcccagtagcatcctttgtagc

SEQ ID NO: 6842242 - DNA, 62 bp, Homo sapiens
ggagatgtctgtcagggcaaggccaggccactgaccggtctggcagtcttgtaggcatctcc

SEQ ID NO: 6842243 - DNA, 55 bp, Homo sapiens
tgtgtatatgtaaatatagttgtgttcataatagcacttcgtttgcatagacaca

SEQ ID NO: 6842244 - DNA, 75 bp, Homo sapiens
ctaggatgtgagaaaaattcctaagggtttgagttcagagatcctggagaccagaaggaagcttcgaacagctgg

SEQ ID NO: 6842245 - DNA, 86 bp, Homo sapiens
ttttcagaaagattttaagaaagacttaaattgcagttacctctgtgtatctggtaaagctggagaggtcttttatctttggaaaa

SEQ ID NO: 6842246 - DNA, 78 bp, Homo sapiens
aagcaagactgtctttaccatcaaataaatgaaatctggggctatgtgtagttccgcttcatatttggagtcttgctt

SEQ ID NO: 6842247 - DNA, 85 bp, Homo sapiens
tgacttctttgcagcttagtgatgttatctgaattatttttattgtatgcagcattaagcaatttgctcctaagaaaacgagtca

SEQ ID NO: 6842248 - DNA, 59 bp, Homo sapiens
gccccaggagttggagcctgcagtgagtcatgatcgtaccactgcactccagtctgggc

SEQ ID NO: 6842249 - DNA, 86 bp, Homo sapiens
gtgagatcaagtgaggtatcttagagagtgtagagactagagaaaagcaggcttagtgcaaacctcagagacacactagaacttac

SEQ ID NO: 6842250 - DNA, 68 bp, Homo sapiens
agtaccattaaaatggaatgtagtgatcattcagattcaactaatgtttattttatgaagtggctact

SEQ ID NO: 6842251 - DNA, 64 bp, Homo sapiens
ggtggagagatgctgcccgcagacgtgacccccggttggtttgctccgggcaatattttgcacc

SEQ ID NO: 6842252 - DNA, 59 bp, Homo sapiens
gtaatgtgattatttaaatcaataaaaattatgtggttggtataagtaatcataattgc

SEQ ID NO: 6842253 - DNA, 115 bp, Homo sapiens
gagttttattttctctctctgtgtgtttgactttttaaaacattttctaaattcactaaacactttagtgaatttcatgtaagtgtgtgagttttatatgagtgaggataaactt

SEQ ID NO: 6842254 - DNA, 79 bp, Homo sapiens
gttgataaacacaatgtttctttgttctttgttttctttgtgtatgtaaagaattagaagccatttgtgtcaaggtaac

SEQ ID NO: 6842255 - DNA, 55 bp, Homo sapiens
gcactgcaggtgggtggagaggagattcatctctctggtcccactccctgtgtgc

SEQ ID NO: 6842256 - DNA, 93 bp, Homo sapiens
aaaagatggggtaaatacacgagtaacacattaacatggattatgtaagttcagtctaatgaaaatgttaatcttataaaccttttatctttt

SEQ ID NO: 6842257 - DNA, 58 bp, Homo sapiens
gcatgggaggacagtctgggctgttgaagtcggtgtggattgatagctcttccggtgc

SEQ ID NO: 6842258 - DNA, 92 bp, Homo sapiens
gggacagcttagcgctggctgcaaaggattgtggctcagggttggaagatgcacggacttggttacatatcctttggagcctcagttttctc

SEQ ID NO: 6842259 - DNA, 57 bp, Homo sapiens
tccgctggcctgtgtcccaggctgtaaagccatcagccttgctacagtgttagtgga

SEQ ID NO: 6842260 - DNA, 55 bp, Homo sapiens
atggctttcagatggtgaaagaccagctgtgtgtctgaaaatggatgagagccat

SEQ ID NO: 6842261 - DNA, 83 bp, Homo sapiens
ggcggtgacaagagctcactgtgacctcagcagacaattagcaaggcggtgtcgagttactgagctccagcaggtcacctgct

SEQ ID NO: 6842262 - DNA, 72 bp, Homo sapiens
gaacccaaacctggacctccctctgggtgatcttctcttctacagccctgtctaggtgcagctttgggtctc

SEQ ID NO: 6842263 - DNA, 76 bp, Homo sapiens
tagcctcagctcccgagcgcgaagcccagctgctgccggggcactctcgacttgctctcggggaggctgcaggctg

SEQ ID NO: 6842264 - DNA, 59 bp, Homo sapiens
ggagtcatgttctgaatcttttgtcataacaggagaattatctggaacaaacagattcc

SEQ ID NO: 6842265 - DNA, 63 bp, Homo sapiens
ttttgcccactggataatgcaaactggataattccaagttgttcaagttccacgtggctagaa

SEQ ID NO: 6842266 - DNA, 67 bp, Homo sapiens
tccagtgtttcaggtagataaattttcattaagaaataagggaagaatcaacattgaaagagctgga

SEQ ID NO: 6842267 - DNA, 78 bp, Homo sapiens
tgacctgaagtgccaaatcataatcagaaggttattgaaaaatattgaataaaatgaatgtatgatggcatcggttca

SEQ ID NO: 6842268 - DNA, 79 bp, Homo sapiens
cagaaaaatgttcattttttacatgtttaattgcttaagggtagtccatggttgtagaagtttatgaacacattttctg

SEQ ID NO: 6842269 - DNA, 58 bp, Homo sapiens
gccagatctgacatagtggaagcaaccctagcactttcatcctctgtcctggtgtggc

SEQ ID NO: 6842270 - DNA, 66 bp, Homo sapiens
cgtattgtagctacaatagacgtattgtagctagacgtattctagacgtattgtagctacaatacg

SEQ ID NO: 6842271 - DNA, 76 bp, Homo sapiens
tccacaaagccccccagagttctcaggtcagctgagtctccaaaagcctggagaccagcagagaagggggccagga

SEQ ID NO: 6842272 - DNA, 83 bp, Homo sapiens
tttccagatcctcttattgcatattgtacttgaatggactctcattgccaaagttttgattaagtaaatgtcgtaactggaaa

SEQ ID NO: 6842273 - DNA, 95 bp, Homo sapiens
ctgcagctactcaacacctctcaggaggaggcccagcccagggagcagctccctgctgtgtcccacctggaaaggcattgagtctgctggtgcag

SEQ ID NO: 6842274 - DNA, 114 bp, Homo sapiens
cttgtctgttttgcatgacctccactacagcctcaatatcatgttgaatttctgagaagctttccaatgttagctaagatatgatcgttggggcacctagggagcatagataag

SEQ ID NO: 6842275 - DNA, 56 bp, Homo sapiens
gcatatgaaatttctagttctgcttttgcatgtacaggagcggtttttcatgttgc

SEQ ID NO: 6842276 - DNA, 115 bp, Homo sapiens
tttaagattgtaaaattggttgcatatgttgttttagtctgcttgggctgccataacaaaataccacagactaggttcctaaaacaacataaatttattttctcacagttctgaa

SEQ ID NO: 6842277 - DNA, 59 bp, Homo sapiens
tagtgcttgcaaatttctgtggtaaacatactcctaccatggccaatgtcaagctacta

SEQ ID NO: 6842278 - DNA, 82 bp, Homo sapiens
tggggttttgtttgttttggggttacggcaaactgaagaggtgccagtttgtaaaatgtggcctggaaattaacttgcctca

SEQ ID NO: 6842279 - DNA, 79 bp, Homo sapiens
ggcgctttgcagaagccagtggcgtgggccccggggacagttccttggaggagaactccctggctacaggtcaggcgcc

SEQ ID NO: 6842280 - DNA, 68 bp, Homo sapiens
ttctcaacaacagtgagatatttcagtcaatgtgctgactgaatagaaatgctcataggttgtaagaa

SEQ ID NO: 6842281 - DNA, 71 bp, Homo sapiens
gatgctgtctgtcaggagcaggcaacagacggtcctggggtccatctgtgctaatgcttcacaatagagtc

SEQ ID NO: 6842282 - DNA, 96 bp, Homo sapiens
ctcagaaagaacaccttggaagtattgtaaacttcctaaggagttgttaggaagctttttagaattttttggagttttccaaggtgacttttggag

SEQ ID NO: 6842283 - DNA, 74 bp, Homo sapiens
gtgcagccacttgttcatataccctctggatcaggtcccctggacatgggatgagatgaagcatatggtagcac

SEQ ID NO: 6842284 - DNA, 64 bp, Homo sapiens
cagcatggacccatcgctgagtcggcacaaagtgccctgccgagccatgcctctatccatgttg

SEQ ID NO: 6842285 - DNA, 77 bp, Homo sapiens
ctccagtgcgtggcaggggtattccagctgagcttaactagctctcaggggccaggagacccctgctgccattggag

SEQ ID NO: 6842286 - DNA, 62 bp, Homo sapiens
tccctctatgggggctcaaatggcaaaaaccatatgccagccttctgggccagtagaaggga

SEQ ID NO: 6842287 - DNA, 74 bp, Homo sapiens
catgatattattgagatgtcttttggcattatctcatatctacttgataatggaaaagatcatttcctattttg

SEQ ID NO: 6842288 - DNA, 87 bp, Homo sapiens
ggtttgccttgtgtattagtaagaattatgtaagatgatatttacaagtgctctgtatgtagttcttgctttgtgagtgttcaaacc

SEQ ID NO: 6842289 - DNA, 62 bp, Homo sapiens
gtaagaaaaagcaagtgcatgtttgggaaactgtctaggaaatgtcaaatgctttattttat

SEQ ID NO: 6842290 - DNA, 81 bp, Homo sapiens
tgttctctgctatgtttctaatcagtacagtgaccatatattgttaagtaaacattgagagacaagatctggcagaggaca

SEQ ID NO: 6842291 - DNA, 67 bp, Homo sapiens
ttcatttgcccctggtcagaggaggctgggaggaccccaatccctgatcagaggagcctacaatgaa

SEQ ID NO: 6842292 - DNA, 76 bp, Homo sapiens
agctcagcctccagctgctccaacccagcgggcttcagtcagagaagccagctgttctggggcagcaacttgagct

SEQ ID NO: 6842293 - DNA, 90 bp, Homo sapiens
ggctggcccagatgtgtattcgctaaaggatgctgtgcgcgggctgctgcgggtcaccggcgcagactccttggtaaacatctagcagcc

SEQ ID NO: 6842294 - DNA, 79 bp, Homo sapiens
gagtagaccaagttcacatcccagaaagagcattcctgtgatggaggggcaactgcattgtgaattatgatcagtattc

SEQ ID NO: 6842295 - DNA, 62 bp, Homo sapiens
ttgtgaccaggggcacacatggggcgttaagattttccaagtgttacagtaccttgtcacaa

SEQ ID NO: 6842296 - DNA, 80 bp, Homo sapiens
ggcctgccttcccacaatttgtcccttcagtaagagtggacatacaggagtccatagtgaaggagataggggtggttgcc

SEQ ID NO: 6842297 - DNA, 86 bp, Homo sapiens
tcactggaaattttatgaggtatgctgaactctgtttctgaaaagtacaaacattagacaccatatgctcctgaaatgctccagga

SEQ ID NO: 6842298 - DNA, 85 bp, Homo sapiens
aggtaggaggaaaatggcagacctgggctggagaagaaccttctccgtatcccaggtgtgcctggcagtatggtttcctcttcct

SEQ ID NO: 6842299 - DNA, 74 bp, Homo sapiens
tttagcaagtatggatccaagggaaattatttttaaatttttgtaaaactgaaccttgagatctttgtgttaga

SEQ ID NO: 6842300 - DNA, 75 bp, Homo sapiens
agaattcaaaagggctttgaatttccaccctggaaataataaggaaaaggaattaagaagtcattctgaaattct

SEQ ID NO: 6842301 - DNA, 130 bp, Homo sapiens
acttccctggtcactccagcctctaggggcttaagggccagagtggcaaaagcctgaacagtcattaaataactgaccattaactggtgtcactctgaggccctcagcccaacagtgaccatctaacagt

SEQ ID NO: 6842302 - DNA, 64 bp, Homo sapiens
ggactgctgtttacctggctttgtaacccctccccactacagggctctagtgggtacacagtcc

SEQ ID NO: 6842303 - DNA, 96 bp, Homo sapiens
ctggcgcacagtcagggcaggataggcatgaggcatcttctatcatttatatgttgtggttgttttgctgtctgtcttagacctgctcttagccag

SEQ ID NO: 6842304 - DNA, 58 bp, Homo sapiens
tggcatccaggtcctcacatgggactaggatccccacatgagtctttaaggaatgtca

SEQ ID NO: 6842305 - DNA, 130 bp, Homo sapiens
aaacaaaggaaatattaataataggaagagaattctcacagcagaaatatgaaggcagaggagagatttcacttatgttacactgttttgctgtgttttttaaatcattttaatcccttttccttccaat

SEQ ID NO: 6842306 - DNA, 64 bp, Homo sapiens
tagtaccctggtgttatcataggtcatgccatccctttggcatcactttatatattaggtacta

SEQ ID NO: 6842307 - DNA, 68 bp, Homo sapiens
cagggccaggggccgtcactcagtccatggggcagacccattggcaaggctgcggtgtctgtcccctg

SEQ ID NO: 6842308 - DNA, 68 bp, Homo sapiens
gttttctcatggcgccaagcccatagctccaactcgagtgacccctgagctggtgctcttgtcaagac

SEQ ID NO: 6842309 - DNA, 66 bp, Homo sapiens
gatgctgctgccttaacttcttcgctgtcctctgaggtacgctgccgaaaagtgaggccagagctc

SEQ ID NO: 6842310 - DNA, 63 bp, Homo sapiens
ttagggcatggggttaacctgggaggctgttttggacacatcttcttagacacccatttctaa

SEQ ID NO: 6842311 - DNA, 59 bp, Homo sapiens
agggtcaacaagatttctgtattctgattggtcagaactcccagccctttgttggctct

SEQ ID NO: 6842312 - DNA, 106 bp, Homo sapiens
catgatagttaattaattgtgggtacatttatgtgcctgaaccaagtacagctgttccaaataagttcacattgaaatgacccaataataactgtttgctatcatg

SEQ ID NO: 6842313 - DNA, 80 bp, Homo sapiens
gctcattgttccatacgactgaggtctcggtgtcactcacatagccatcgtctcctgtgtagtgtgtggggtagatgagc

SEQ ID NO: 6842314 - DNA, 64 bp, Homo sapiens
cttggggacacagagcccagggcctgggacctcctgccatgtgaggaagctgtgggtccccagg

SEQ ID NO: 6842315 - DNA, 85 bp, Homo sapiens
ctcaggctgtgaccctctagagggaagcactttctgttgcttgaaagaagagaaagcgcttccttttagaggattactctttgag

SEQ ID NO: 6842316 - DNA, 61 bp, Homo sapiens
ggactttggtgcgaagtcactttagaaaactgggatctggaaggggccaggcgcggagtcc

SEQ ID NO: 6842317 - DNA, 75 bp, Homo sapiens
cccagggccggcctttgcgagcattctgagcagcgagcagagaatgctcgctggggcacaggtagaggctctggg

SEQ ID NO: 6842318 - DNA, 67 bp, Homo sapiens
ggtaatccagcacttgttcatgtgaactgaactctgattggaccttcacggatggagtgcaggtgct

SEQ ID NO: 6842319 - DNA, 73 bp, Homo sapiens
ttgtcattctccgatatgatctcagggtataccatacatgagtgaatattctgatttcaagtgagagtggtaa

SEQ ID NO: 6842320 - DNA, 57 bp, Homo sapiens
tctgccagataatcattttctccattttatagaggaggacactgaagttcaggcaga

SEQ ID NO: 6842321 - DNA, 101 bp, Homo sapiens
tgaggcaggagaatggcatgaacccatgaggtggaggttgcagtgagccgagatcgtgccactgcactccagcctgggtgacagagcgagactccatctca

SEQ ID NO: 6842322 - DNA, 88 bp, Homo sapiens
ggggtgcaggagcactgtgggggaggctgagacatggtcgccctgacacaggtgggcacattcagtctctgtcacacctagctacctc

SEQ ID NO: 6842323 - DNA, 65 bp, Homo sapiens
tactgcgaaatgcataatcttagtagatttctttcctgagatgttactgtctgtggtttccagta

SEQ ID NO: 6842324 - DNA, 67 bp, Homo sapiens
gtggggtaaggagcaaatatctttttagctcctagggaaggagctgaagtttccatttgtacctcac

SEQ ID NO: 6842325 - DNA, 60 bp, Homo sapiens
cagtcatgctacttcatcttctgtcggtagacagaaaggaagaaaaggtagcagagagtg

SEQ ID NO: 6842326 - DNA, 82 bp, Homo sapiens
ccatgcctgctctgctccgctgtggctgcctggggatacggacgtctctgcaccaagcccagctggagaaggaaggccatgg

SEQ ID NO: 6842327 - DNA, 80 bp, Homo sapiens
gtttttgtaatttctaattcattttcagtgaagaaaccatgagagtagatgaactgaaaatgaattagaaacagcaatgc

SEQ ID NO: 6842328 - DNA, 80 bp, Homo sapiens
gttgtgtgtggacaagatgccaattgatctgactcaaaagccattgaagttccatcagtgcatcctgccacaaagaaaac

SEQ ID NO: 6842329 - DNA, 61 bp, Homo sapiens
gcaatgaggagtggtagggataagcgggcacttttctgccctcctgccacacctcagttgc

SEQ ID NO: 6842330 - DNA, 66 bp, Homo sapiens
tacatcacagagacagatctattttgcctgcagcaaaatgctaggcacatgctcaatgtgtatgta

SEQ ID NO: 6842331 - DNA, 70 bp, Homo sapiens
ggttttcacagctgggtggcagagtctcacttccttttcaaggtggattactccagcagctgtgaagatt

SEQ ID NO: 6842332 - DNA, 59 bp, Homo sapiens
caggcaggagccagggattccaggaatttgtaaccttctgtgtgtcctggcctgctctg

SEQ ID NO: 6842333 - DNA, 55 bp, Homo sapiens
cccactccctacgacacgctcccagttaaccaagaccaggcttcagggagctggg

SEQ ID NO: 6842334 - DNA, 64 bp, Homo sapiens
gtctgggctgtgccaaagctcttccttgtgcatcagagcaggagctcacacccacagccagggc

SEQ ID NO: 6842335 - DNA, 61 bp, Homo sapiens
ctccttagcatccaagctggtgttccaaacagaaagatccaaggcttggctgcagagagag

SEQ ID NO: 6842336 - DNA, 100 bp, Homo sapiens
gtgggtaccatccttttttcaaaacttatgtcctttaaatgacttaatacagcttgctcagtgttatgttatagagtgacaggattgaggtagtgcccac

SEQ ID NO: 6842337 - DNA, 77 bp, Homo sapiens
ggttctgatcagatgactatgaccaacactttgttacaagacagaaatgatggaaatatgtaatctggttactgacc

SEQ ID NO: 6842338 - DNA, 67 bp, Homo sapiens
tgcttctagacactgcaattgacagtccaggtaaacatgattgtaaaagtgtagatgtttagaagta

SEQ ID NO: 6842339 - DNA, 60 bp, Homo sapiens
ctctttgtgttcaggagccacgtacctgggaacaaagggatgggccagggatacagagag

SEQ ID NO: 6842340 - DNA, 68 bp, Homo sapiens
agtatccacccatctcgcccaacgtttccaccactgggtgttcaaattttctaggtgggtggtttgct

SEQ ID NO: 6842341 - DNA, 79 bp, Homo sapiens
ctggagttgtctatccagagggcattccaagcagaactagtaatggcactgaagctggaaagcctgaggcaaagaccag

SEQ ID NO: 6842342 - DNA, 78 bp, Homo sapiens
gggtctccagctgggtcatgggacagatgctcatttatgatgctctgggcttgttgacctgcacttagtggagttccc

SEQ ID NO: 6842343 - DNA, 62 bp, Homo sapiens
ccaaaaagctgtttttaggtggaggtagtgggtgttactatttgagcgaagcagtgttttgg

SEQ ID NO: 6842344 - DNA, 88 bp, Homo sapiens
ggagaatcacttgaacctgggaggcagaggttgcagtgagccgagatcgcaccattgcactctagcctgggtgacagagtgagactcc

SEQ ID NO: 6842345 - DNA, 77 bp, Homo sapiens
ctaccatggccagcacagctccacacagaacacgagctgccttgtgtacctaccgtttgtgtgcgtctggcctgggg

SEQ ID NO: 6842346 - DNA, 60 bp, Homo sapiens
ctgactgtgtcaaggagggtgtggcccccacgtctgggcctcccctctcctgctagtggg

SEQ ID NO: 6842347 - DNA, 66 bp, Homo sapiens
catctctgctgcagatcattttacacctgcttttcctcactttgtttttggctctgcagccagatg

SEQ ID NO: 6842348 - DNA, 61 bp, Homo sapiens
acagtacttcacatttgcaagtcttggggaatcttttgaagacttggagttgaagggttgt

SEQ ID NO: 6842349 - DNA, 62 bp, Homo sapiens
tatgggtaggcctgccgcctgtctcgctctatctgctacctgggagtggcttcctgctcata

SEQ ID NO: 6842350 - DNA, 109 bp, Homo sapiens
ggtgcgctacgttagggttctctggtggttagttcctttggatatcttgtgttgaaatgagggattaatcaggtgttttgtctatgagtgccataagacttggtgcatt

SEQ ID NO: 6842351 - DNA, 97 bp, Homo sapiens
ctttcacaggatcttgctgtcagacagcagtggtaaatccgttggaaattcagcactctctgttgccgactgtctgggggccaaacttttgtgagag

SEQ ID NO: 6842352 - DNA, 69 bp, Homo sapiens
cagcagtggggaagctacagggtttcttgttctctagctggccagagcccctgagcttccctgtggctg

SEQ ID NO: 6842353 - DNA, 77 bp, Homo sapiens
ggagccttacaaaataacaagaaatacattggttcttacattaggtgatggacttatagtattctcttggttgctct

SEQ ID NO: 6842354 - DNA, 71 bp, Homo sapiens
ttcttgaggaaccaaatcagcttgcacatagttcaaaatcagaaatggttgctgatatgagttcttttgaa

SEQ ID NO: 6842355 - DNA, 71 bp, Homo sapiens
gtggtctacacaacatgggttgaaatcaacactcctcatatacctggtgtttcagccctgtttgaggctac

SEQ ID NO: 6842356 - DNA, 77 bp, Homo sapiens
acggttgcaaacttgaccctatccaattacttttctgcattggaagtgattgcaattctgggtcatgtctaggctgt

SEQ ID NO: 6842357 - DNA, 76 bp, Homo sapiens
cacctaatccaccctgtggtggctttctggagagggaggcatctaagctgagctgtggctgggtggagtgtgggtg

SEQ ID NO: 6842358 - DNA, 65 bp, Homo sapiens
gagtataagtaatttcaagcaagatccctgattatttcaaggcaaaattgaagttatttacattc

SEQ ID NO: 6842359 - DNA, 63 bp, Homo sapiens
tggtcctgcccagccccatgcccatgctcatatgagcacagttcctgtgggttgggcagacca

SEQ ID NO: 6842360 - DNA, 130 bp, Homo sapiens
ctgaaatgctattttgtgaaagttgggaatttatataaaatcagttagtggtaggattgatgagatgtttaccaggcctggtaggtagctgatttcttgtttgacttctcaactgaggcaggaaagtagg

SEQ ID NO: 6842361 - DNA, 60 bp, Homo sapiens
gtttccatttctgtaaatagggaaaggtctatgtgaacccgcctatggcaggatggaggc

SEQ ID NO: 6842362 - DNA, 71 bp, Homo sapiens
ctttctgagattataagatagagtcattcacgtcagtgctctggagattctatgttgttgattatagaaag

SEQ ID NO: 6842363 - DNA, 114 bp, Homo sapiens
aaaagcaggctactgagaggctttaacagatagtttcttctgtattccagaacattccccaatatccaggagaaacatgtaactgtgtctgttaagtgtcagtagctttttttt

SEQ ID NO: 6842364 - DNA, 65 bp, Homo sapiens
gtgttgtctccacaattcatgtgttggaaacttaatcccaatgcaacagggttgggaggcggagc

SEQ ID NO: 6842365 - DNA, 75 bp, Homo sapiens
tttgtctcatagtccttgctgggcacagagtagacccaccatgtcaactttgttggcataggaactggagatgaa

SEQ ID NO: 6842366 - DNA, 129 bp, Homo sapiens
caggatttcctaccatttttctctttctgatgaaattaacttcccatagttggtcagcaggataatctaattttagccaatcagcttgggagctgctgttgacctcacaaagggagagaaaggtatctg

SEQ ID NO: 6842367 - DNA, 56 bp, Homo sapiens
gcagagtcagcctccgagacagttcttttgtgtctgtctcgaaggctccactctgt

SEQ ID NO: 6842368 - DNA, 81 bp, Homo sapiens
tagtagttctctggatgtttctcagtcactctgattggcctagtcctatttatctgacttctaaacattagagttgctcta

SEQ ID NO: 6842369 - DNA, 77 bp, Homo sapiens
ggtattaacagtcaacagtttttgatgtaaaggtcctgactttgccactaactagctgtgagacattagttaacccc

SEQ ID NO: 6842370 - DNA, 99 bp, Homo sapiens
catggatgttgccttctcttttactgtatctccttcccttctttggcaagttgtcaaagcatggtggatgatacagtggataaaagaggctgcagtatg

SEQ ID NO: 6842371 - DNA, 61 bp, Homo sapiens
tagcataaggcttaaagaatatatattttcacatggaaaaaaatgtgcttgggccatgcta

SEQ ID NO: 6842372 - DNA, 68 bp, Homo sapiens
ccaatacttagattaaaatagtttgaccaattgaaattaaaattgtttttaaggtagtctagtattgg

SEQ ID NO: 6842373 - DNA, 64 bp, Homo sapiens
taagggagcatttacatcgacggagagaaggcataattcgtcagtggagactcatgcttcctta

SEQ ID NO: 6842374 - DNA, 70 bp, Homo sapiens
ggtccgtgaacagccaggagagtcagcagtatttctgctttgccggctctgaggctatgctttacagacc

SEQ ID NO: 6842375 - DNA, 85 bp, Homo sapiens
tgaaatgtggacttgaaatatcattttcatctccctctatatatagagggcagatgtcatgattgtttctgaatccattccctca

SEQ ID NO: 6842376 - DNA, 80 bp, Homo sapiens
tatctccatggaatgtaccacctattgttaggaatgaaaatttccatcatcctaatatgtttaggtatcatttccagatg

SEQ ID NO: 6842377 - DNA, 72 bp, Homo sapiens
cctacttagcagagtgagttgactaagtgactgaacctatctaacccttagtttcttcacctgtaaaatggg

SEQ ID NO: 6842378 - DNA, 69 bp, Homo sapiens
ggcgattagggtttcctgtactgcagtcccatcagttgaccatagcaaaatggaaaccttggactcgcc

SEQ ID NO: 6842379 - DNA, 95 bp, Homo sapiens
ccttgactccaggcttggtcttgcagctcgctttgactaactgacagaagtggcagggtgccagttgcgagtctaggctttaaaaggtttcaagg

SEQ ID NO: 6842380 - DNA, 97 bp, Homo sapiens
gagatggagactcgctctgtgcccaggctggagtgcagtggcataatctcgcctcactgcaacctccacctcagggttcaagtgattctcctgcctc

SEQ ID NO: 6842381 - DNA, 69 bp, Homo sapiens
gtccccaaaggccaagctcaggtaaaaggcagacccggcttttctccaaagtggctaggtctatgtgac

SEQ ID NO: 6842382 - DNA, 82 bp, Homo sapiens
ggctacacatatgagaatgtatcattgcactggagggttatgtactctcagagcttcacctgttacattcgcatggacagcc

SEQ ID NO: 6842383 - DNA, 68 bp, Homo sapiens
ggtgggctggacttcatgcattcctgtcattactgtaggatggaaatgctccaggagtccaacccatc

SEQ ID NO: 6842384 - DNA, 61 bp, Homo sapiens
ttgttagctgaagtgtgatgtttgcagaaacttctgtcagacctgtgatttcagcaagcaa

SEQ ID NO: 6842385 - DNA, 84 bp, Homo sapiens
ggagtaaatggtgtttatcgttctggattgtctgacagtttgtcacacaggagtctccaggtatgacaggccactcctgacttc

SEQ ID NO: 6842386 - DNA, 59 bp, Homo sapiens
tttctgtagaggaacaagagctcttcccggttcaaaggggaagtcttctgtcacagaaa

SEQ ID NO: 6842387 - DNA, 73 bp, Homo sapiens
ttattttcatagtcatttttggctggtgaaaattttatttcactcatttgcatgatgtgctatgttaaaataa

SEQ ID NO: 6842388 - DNA, 78 bp, Homo sapiens
tgagctcccatatcttaccctcaacacatccagccaaggtgaaactggctggaacttaagggagatgtggtgatttca

SEQ ID NO: 6842389 - DNA, 62 bp, Homo sapiens
tcatttcagaatgtcctaatttagcctgatgtaaacgtcctgaggtaaaatattctgaagga

SEQ ID NO: 6842390 - DNA, 72 bp, Homo sapiens
aaaggaaatggtctttgttaattccagtcagataatggcattgtacagacatgggaaacaaccaattttttt

SEQ ID NO: 6842391 - DNA, 57 bp, Homo sapiens
gaggaagagcatggccagtttctacaaaggggcctttggccagctgctcgtctcctc

SEQ ID NO: 6842392 - DNA, 78 bp, Homo sapiens
agcaaggttaacatggttgtttacgaaataaatacaaacttcagttagtatttcatcttgaaaaccagtttaagtgct

SEQ ID NO: 6842393 - DNA, 91 bp, Homo sapiens
ggaaatttggttgtggccatgttgtggaagtgggaagggcagctgaagcagtctacactgaatttccacagagagtgaatagcaagtttcc

SEQ ID NO: 6842394 - DNA, 62 bp, Homo sapiens
aggcttaacttaactttagagctcttcaaagaaaatctaagctactcatgttaagcaagcct

SEQ ID NO: 6842395 - DNA, 84 bp, Homo sapiens
ctcagagagatgaatgtggtggaatctgagtggtgtcaccagccatgacttacacagaaacactgttcagaagccttctctgag

SEQ ID NO: 6842396 - DNA, 57 bp, Homo sapiens
gttatggttttagttgaatgataagtgtcataatcttgtctaaactagtcccataac

SEQ ID NO: 6842397 - DNA, 95 bp, Homo sapiens
acctcccaaaaggcaagaggtggccatgggcgctggaactgggacacagcccccgcctccgccctgccctggctacactcacctgccaaggaggt

SEQ ID NO: 6842398 - DNA, 85 bp, Homo sapiens
ttatttttgatagggctagaattttctaagataccatttgacattttatttcagtaccacacaggattctgcttttcagaaataa

SEQ ID NO: 6842399 - DNA, 94 bp, Homo sapiens
ggacttgcattagagacagaatagcatggctggttagagccactctctaaagtgggctggctgcctggttatgcctttaagtgtctgtgcctcc

SEQ ID NO: 6842400 - DNA, 55 bp, Homo sapiens
cacaaaccttctgcagcctgtactgctacagcacgaggctgcagaatcagttgtg

SEQ ID NO: 6842401 - DNA, 70 bp, Homo sapiens
attcttgaagtctgtcatttaaattccgcagaatcctctgtttattcaaatcagcagatgttcattgagt

SEQ ID NO: 6842402 - DNA, 128 bp, Homo sapiens
ggattcgcgggagggcagggagagcagacagacagacagacagccgtggccaccctagagacacactgcagccgtggtggcccacaggactctttagtctctgtgctctaaggccccctgcagagtcc

SEQ ID NO: 6842403 - DNA, 89 bp, Homo sapiens
ctgctggtgagcctgtcaatgccacctgtctgatgccatactgatgacacctgtgtgccctcagcaggtggtgggcaggtgagtggcag

SEQ ID NO: 6842404 - DNA, 77 bp, Homo sapiens
ttagaggcacagtctatgtagaggagaaaacagaatgagtaccctttcccctgcttctatatagctgctgcttttaa

SEQ ID NO: 6842405 - DNA, 102 bp, Homo sapiens
atgtgggtagatatttctaagcctcaatattctgtaaaatgggaaaaacaagagcatttaccttacagcattgttcagaggcttaacggaaataatccacgt

SEQ ID NO: 6842406 - DNA, 66 bp, Homo sapiens
tagatgagtgtaatctgaaaacttgaacattgcatgtgttcagcctcttcctaattgcctgatcta

SEQ ID NO: 6842407 - DNA, 97 bp, Homo sapiens
tgggggggggctttccaagtaatgtctcttgagaggcgaaacagcttggtagttgaaagcacaggctcaggaacagacttgctgggctcaaatccca

SEQ ID NO: 6842408 - DNA, 66 bp, Homo sapiens
tgtggtgataagggtagctctcttcatcctggttcaggagagggaaaaactcatgtcattttcaca

SEQ ID NO: 6842409 - DNA, 72 bp, Homo sapiens
gtgtgcctctatagatgtgtgcatctatttttctgtgcatctatagatgtgtacatctgtgagcttgcatgt

SEQ ID NO: 6842410 - DNA, 80 bp, Homo sapiens
tgagtgtactggagctggtgtgtgcccaagcacagactaattaatgtctgtgtgctgcccaactcgcagattcacactca

SEQ ID NO: 6842411 - DNA, 106 bp, Homo sapiens
ctagagaaatgattcagtattcactaattcagtgtttgcggcaactttataaaacataactactgtaaataatgacagttgactgtactttgagattgtttcctag

SEQ ID NO: 6842412 - DNA, 63 bp, Homo sapiens
gacacagtgtgctgcagagaacatttccagacaacaagagaaatagctccgtggcacactctc

SEQ ID NO: 6842413 - DNA, 69 bp, Homo sapiens
cctgcaggctgcaggccagttccagttaaagccctttactaggtagtggcctggtctgctgcttccagg

SEQ ID NO: 6842414 - DNA, 96 bp, Homo sapiens
gaagagaatcataatgctttgattcaaaaaccactccacgacttttagaaaaaccacacctagtctgtgggcatgggaatctcaatgaggcttttc

SEQ ID NO: 6842415 - DNA, 80 bp, Homo sapiens
agttctattcagtttcttcatccaaaaaatggagctaattatacctccttcataatcttttggggaggaattatagaact

SEQ ID NO: 6842416 - DNA, 59 bp, Homo sapiens
gtgccgtgtgattggctgaggctgtctgtgccataggaaagcagaaatcacaccagcac

SEQ ID NO: 6842417 - DNA, 61 bp, Homo sapiens
tgagcgcaggaaaggccttttgaagtggggacagttttaagaggcagcattcctcgcctca

SEQ ID NO: 6842418 - DNA, 84 bp, Homo sapiens
ggaaggagggccctttccctcagagcttgaaggcttctctgtatcctatgccaacaagtctggggagaaaaggctaacactttc

SEQ ID NO: 6842419 - DNA, 72 bp, Homo sapiens
tgtccagatactgttaatgttaaattcagggagaagctccctaaagtcatgtaacagtttaatcattggaca

SEQ ID NO: 6842420 - DNA, 75 bp, Homo sapiens
ctgggtgaggtgggctggccagagacaacactgggagcctgcagtggtggtctagccatagcccccctcagccag

SEQ ID NO: 6842421 - DNA, 57 bp, Homo sapiens
gccaggctgccttatctctagcaccctctcgggcttcctgcagacaaacagtgtggc

SEQ ID NO: 6842422 - DNA, 71 bp, Homo sapiens
tgagagagaaacttggagttattctggattcctttccttatcacatccaaatgattactaatttctgtcca

SEQ ID NO: 6842423 - DNA, 75 bp, Homo sapiens
ctgtccttcagaaaagtgtcagttgcttagaatacagaatgacctctgataagacagctgatttgaagtcttcag

SEQ ID NO: 6842424 - DNA, 73 bp, Homo sapiens
ttccacttgtgcagctactgaataaatagcaaagtaattaacagtgtgctatggctagatgtatcaggtggaa

SEQ ID NO: 6842425 - DNA, 57 bp, Homo sapiens
cagcctgaatcacttctgagccctttggggatggggatcagccctgagtccaggctg

SEQ ID NO: 6842426 - DNA, 129 bp, Homo sapiens
aatactttaccatcttaatgagaaagtaaggaatgaggagattgttttctaaagctttacttagatcattttatgaagataattttctgatatttttctcttcctcttatatttaaatattagggtatt

SEQ ID NO: 6842427 - DNA, 84 bp, Homo sapiens
tacatttgaattgaagggctaaagtgcagaagctcatcatgtatttttaggcaatactgcatctttgccctttcccaagttgta

SEQ ID NO: 6842428 - DNA, 75 bp, Homo sapiens
cctcctccttttccacagccactcactggggccaccaaaacccagagatggcaggtgtgtgggacagactggagg

SEQ ID NO: 6842429 - DNA, 63 bp, Homo sapiens
agcaggtttgggagtagaaatcagaagtttatttttgaacacataagacttccaatgcctgtt

SEQ ID NO: 6842430 - DNA, 60 bp, Homo sapiens
atgcaactacccccaggattttaagattcaaagaagtggaaatccttgggagtggtgcat

SEQ ID NO: 6842431 - DNA, 67 bp, Homo sapiens
gtggcagggtgagcgtcagccttaagagggatgatgacctctggcaggacatgctgaccatgcagac

SEQ ID NO: 6842432 - DNA, 92 bp, Homo sapiens
ggaatgcatgcttttctcaagttaagacacataaaagagttgtcctggcccaggtgagactcgcctttgtgtagcagctggagcttcattcc

SEQ ID NO: 6842433 - DNA, 67 bp, Homo sapiens
ggctgcctgtttggcatcattggttgttgcctgtttggcatcggccttgacaagcttagcagcagtc

SEQ ID NO: 6842434 - DNA, 61 bp, Homo sapiens
ccaggctcaggtgcgagagacacatgtaacccagtgcctgaccttatgcagctgagcttgg

SEQ ID NO: 6842435 - DNA, 61 bp, Homo sapiens
atctaggagcatgaagggaaggcatgaaaacccaaagcttttcctgtgatgcttcctgggt

SEQ ID NO: 6842436 - DNA, 92 bp, Homo sapiens
attttagctttaaagcactgtaaagaagtaagtatgggtgtgggggatgggctgtatatttttattcttataattgttgagggagttgagat

SEQ ID NO: 6842437 - DNA, 118 bp, Homo sapiens
tgagcagctgttacattccaagtacactgtgctagtccattttacatgtgttctctaacaaaaacctaacagtagattttagattacatagttggagaggtatattagtccatgctca

SEQ ID NO: 6842438 - DNA, 76 bp, Homo sapiens
ctgacagcctctgtgacccttagtgaacattagaaggacacatctgggccttttatgatttatcaagcggtgtcag

SEQ ID NO: 6842439 - DNA, 62 bp, Homo sapiens
gatttggtaaaagaatcagggagccttagaataaaggtttctgattctcactttggcatctc

SEQ ID NO: 6842440 - DNA, 78 bp, Homo sapiens
gcagcagacctggggctgtggggaattggctgttgctaccacctgcagattcttcattgccccattcactattgctgc

SEQ ID NO: 6842441 - DNA, 104 bp, Homo sapiens
ctgcagctgggctcacctgcggctgggctcacctgtggctggcattactcctgttgctgacctcccctgcagctgggctcacctgcggctgggctcacctgcgg

SEQ ID NO: 6842442 - DNA, 116 bp, Homo sapiens
aagatgtatttactttgaggaagacctaatgagatcttggtaaatccccttacacaaagagatgcttttttgtgtaaatttaaaggatgacactccctctaagtgttctacatttt

SEQ ID NO: 6842443 - DNA, 75 bp, Homo sapiens
agcagaggtatgaggtatggccaagagttgagttttttaagccagccttgaatcagttgctgcctaaattctgtt

SEQ ID NO: 6842444 - DNA, 98 bp, Homo sapiens
tgttatgtattagattgctacaaaagtaattgtggtttttgccattgaaaataacggtcaaaaccgcaattacttttgcaccaacctaagtataagca

SEQ ID NO: 6842445 - DNA, 82 bp, Homo sapiens
agtaaagtaaattcaaggatctgttaaatctggtaaaagtagatcaaatcagagatcgacagcctgtggagagtgctgaact

SEQ ID NO: 6842446 - DNA, 97 bp, Homo sapiens
tgcacgacacaacgcccaccactgcttcctgccatctgtcccgagtgatggaaatagagccagtgacagcaagcagtgctgggtgggccagtctgca

SEQ ID NO: 6842447 - DNA, 63 bp, Homo sapiens
ggacaaaggggtacgatctagctggcatgaaactggagggaagttggcaaggcctgtttgttc

SEQ ID NO: 6842448 - DNA, 76 bp, Homo sapiens
cagcctgccaaagtgctaggattacaggcatgggccaccaaacccggccaggtctgtcttcttagctcacaggttg

SEQ ID NO: 6842449 - DNA, 58 bp, Homo sapiens
aggcagcagtcatgaggaaagaagggcttttgaccttcttgcacagtgtctgctgtct

SEQ ID NO: 6842450 - DNA, 63 bp, Homo sapiens
cagcagagcatttggtaggaggtcaggagctcataggagatgggattctgccgatgcctgctg

SEQ ID NO: 6842451 - DNA, 82 bp, Homo sapiens
tccccaaggcctaggctgggcctgccttccagggggctgaaatatggacaccctttgggaaaggcacagccaggacaaggga

SEQ ID NO: 6842452 - DNA, 67 bp, Homo sapiens
gaggatcttgctgtagaggatagaggatgaagtcaaggacagctctatcctttcatcagtgatcttt

SEQ ID NO: 6842453 - DNA, 69 bp, Homo sapiens
tgatgaggcatatgctacacatttgtgggaagaatgccacaaggtagtgtgtcacattgcatctcatta

SEQ ID NO: 6842454 - DNA, 55 bp, Homo sapiens
ggtctctgaagcttttagtcccttggattctttaggcctgagggcaacagaggct

SEQ ID NO: 6842455 - DNA, 66 bp, Homo sapiens
atcatgtcacccagctcccaactttgttgagccaaaagacatggtaggggaaatgagtgaatggat

SEQ ID NO: 6842456 - DNA, 83 bp, Homo sapiens
ctatccttttacgagctgccaaggagtctctccagcagcctgaaccagtctggacagatcccttgtagcttgtgaaagtgtag

SEQ ID NO: 6842457 - DNA, 55 bp, Homo sapiens
ccttttggaaagttgtcactttagatgatctctaatttaggtattttccagaagg

SEQ ID NO: 6842458 - DNA, 77 bp, Homo sapiens
tgccacactaggagaggagtgtctgtgttcccaagcttaccaattcccatatgcctccctgtctacctgttgtggca

SEQ ID NO: 6842459 - DNA, 128 bp, Homo sapiens
agaacctcagggagttgatagttggagccaggttattttatctctgagaggttgtcaaattggaacattatttaatatatcagagatagaggtaaagagaacctccataaacgttttcattgtggtct

SEQ ID NO: 6842460 - DNA, 68 bp, Homo sapiens
gtccctggatctgggacagctgcatgcagtagcggttctctgtctccgccaggttgccctccagggat

SEQ ID NO: 6842461 - DNA, 76 bp, Homo sapiens
gttatcccagttgctcagtcagtttttgtgagagattcagggatcttaataaaactgtgctgctactgctactaac

SEQ ID NO: 6842462 - DNA, 78 bp, Homo sapiens
aggttgagtcgaggagaagaaagaagtggaaaggttgccccagccttattccaatttctcctacaaaaactcgcacct

SEQ ID NO: 6842463 - DNA, 75 bp, Homo sapiens
ttctggctgcaatagtaaattacggaggagagtaaatccctactggttcgtctcttttacagttcacacccagaa

SEQ ID NO: 6842464 - DNA, 73 bp, Homo sapiens
gctaatgaaaactgatagcttgagtggcttctgcttgacaaggagattgtcactgttgacagggttgactggc

SEQ ID NO: 6842465 - DNA, 57 bp, Homo sapiens
gtctggaagggagtgcattttcacataatgatgttggttgatgtaatgtttctaggc

SEQ ID NO: 6842466 - DNA, 61 bp, Homo sapiens
tccaaaggcctgagaactgaggggattgttggtataaatccctgagtacaaaggcctgaga

SEQ ID NO: 6842467 - DNA, 121 bp, Homo sapiens
tggtatatgtctccgtgatttgagtttcagttatggcttaactaaagaggttttgtgaaactgttttcaatttcattctattagttaagtagctaagttaattttctaagatataaaatca

SEQ ID NO: 6842468 - DNA, 62 bp, Homo sapiens
agagccaaccccgtgaagatctgaaagaacttcctatcagaggacgcactagggttgtctct

SEQ ID NO: 6842469 - DNA, 69 bp, Homo sapiens
tggatagctcttaccaagaaagggctcaccaaaatcacttctgtatttgaggagtgctttttctatcca

SEQ ID NO: 6842470 - DNA, 55 bp, Homo sapiens
tgacgtcaactgcaaaggccttgttctccaagaggacttgtgcagttcacgctca

SEQ ID NO: 6842471 - DNA, 61 bp, Homo sapiens
cagctcctatgagtatgattccctcccttctccaggaactgtcctcagctgatgggagctg

SEQ ID NO: 6842472 - DNA, 73 bp, Homo sapiens
gggcttagctgccctcagatccaagtgtgatattaggagaacagactttgaatttttgtgggtagctacactt

SEQ ID NO: 6842473 - DNA, 61 bp, Homo sapiens
ccttgttctgtgtggggagggaggcagcgcggtggttatcaacctcaccctgcagaggagg

SEQ ID NO: 6842474 - DNA, 55 bp, Homo sapiens
tggcagaaggtacctgaccccaagtgtttttgccaccaggaaacacctactgcta

SEQ ID NO: 6842475 - DNA, 110 bp, Homo sapiens
gaaggactgtccaggctgggaatgaggttagggtatcagaagcacagccccctgagggctgagtcatctggggcctcctggatctgttctgcagtttgaatgcagccttc

SEQ ID NO: 6842476 - DNA, 109 bp, Homo sapiens
ggcaacacagatttggcctggcttttgcttttttgggatgcctgccttgggatcccagaggcattctataagaagtctggtgctcagaggccatcatgttagaaaagcc

SEQ ID NO: 6842477 - DNA, 70 bp, Homo sapiens
tgagaattctggagttgggaggaaaatagaaaccataatatattaattcctaccaaactttgagttctca

SEQ ID NO: 6842478 - DNA, 67 bp, Homo sapiens
ctggaacgcatttctaccaccggggcctcccagcttctgctcagctcctggcaggcagtgtgtgtgg

SEQ ID NO: 6842479 - DNA, 74 bp, Homo sapiens
gactgatatagtttgtgaaacacagcagttgttttttcaaccctgcaaggctccaaattaccaagctctcagtc

SEQ ID NO: 6842480 - DNA, 113 bp, Homo sapiens
ccctaaatgtacttgttgaagccctaactcaaatacctctccatgtgactttatttggaaacaggttgttacagaggtaattagttaagatgaggtcataacggagtagaggg

SEQ ID NO: 6842481 - DNA, 82 bp, Homo sapiens
gcctccgcctagaagtgactcacattgctcatatttctgtatcccagactagtaacatgagtttttctaatggcaaggaggc

SEQ ID NO: 6842482 - DNA, 59 bp, Homo sapiens
gctggcccagagctctggcctttagccctgggatcagagcagaggtggctctgatcagc

SEQ ID NO: 6842483 - DNA, 56 bp, Homo sapiens
gcctgcaggctaccttgaggccttaactgtcaactgaggcagctggccaggcaggt

SEQ ID NO: 6842484 - DNA, 70 bp, Homo sapiens
tgtcatgtttttctcttagcctgtatgagaacaaaaagttttcagagtctaaatagaagaataccagaca

SEQ ID NO: 6842485 - DNA, 113 bp, Homo sapiens
agctagcccactttgccctgggaatccttgcgccataaatactgccttcctcctgtctctggagcagtccccgtcgtggcagggaggcccagagccatcagtgtggtagagct

SEQ ID NO: 6842486 - DNA, 78 bp, Homo sapiens
gcgtccctgcctttcttcgtttgcaccttatctcctctcttctctcaaggctggtgtccttgcagaaggcggcgacgc

SEQ ID NO: 6842487 - DNA, 73 bp, Homo sapiens
accttctaattgtgtttgcatatcttaaaaaacatatttgattaagtaagaatgtaagtacaacttgggatgt

SEQ ID NO: 6842488 - DNA, 79 bp, Homo sapiens
tgtgcaaagtacagaactgaagtagtgaaaaatatcattttccatcatatttctgttcagatttgcctgtcttttcaca

SEQ ID NO: 6842489 - DNA, 64 bp, Homo sapiens
aaaatttgtagagcttaggcataggccagagcaacggctatgcaagcaacattttgcacatttt

SEQ ID NO: 6842490 - DNA, 90 bp, Homo sapiens
cgtacattatatttctataggaggacagtattggtctttacacagattttaaggttctgtcctgctatgaggttccatgattcaaatacg

SEQ ID NO: 6842491 - DNA, 115 bp, Homo sapiens
gtgcatgtgtgtgtgtgtatcttcatttataggtataggtgtatatatatctatatgtctgtagatatgtttgtatatatttgtatatgtgtagtacacacacccataagggcac

SEQ ID NO: 6842492 - DNA, 59 bp, Homo sapiens
ccttcgaagaaaacccaggaagacccatgcaatagattcctgggactcaacttagaagg

SEQ ID NO: 6842493 - DNA, 69 bp, Homo sapiens
cttgatgaaatgtcaaagacaccatctattctggaaagaaagtagatttctcatggcgaaaatatcaag

SEQ ID NO: 6842494 - DNA, 58 bp, Homo sapiens
gggacctggcgagggtcacacagcctttctgtgatagggcgttgatctcccagcttcc

SEQ ID NO: 6842495 - DNA, 60 bp, Homo sapiens
agcttgtctaaggacacagcttataggtgacagagttggggctggccctaagacagtgct

SEQ ID NO: 6842496 - DNA, 79 bp, Homo sapiens
agggagtcaggggcagtgggccagatgctaggtcttcctgtacccagcctggcttctttccactgtcctgtggctttct

SEQ ID NO: 6842497 - DNA, 64 bp, Homo sapiens
ctcatccagtcaagcttttagatgactgcaagccacaaccagcatctgattgcaactgcatgag

SEQ ID NO: 6842498 - DNA, 59 bp, Homo sapiens
agtcttactttgggttgtctactctgagatcgatggagtacatttgacccaaataagct

SEQ ID NO: 6842499 - DNA, 96 bp, Homo sapiens
gaggagtagggaggatcagactcagaaatgacgtgggataggaaaagcaaaactttctgacgcacattttctgtgtacctgctccctccacacctt

SEQ ID NO: 6842500 - DNA, 65 bp, Homo sapiens
agcaatagacacaagatggataatatataaacttcattcgtgtcctacttttgtgatctattgtt

SEQ ID NO: 6842501 - DNA, 102 bp, Homo sapiens
ggacatgggacataagtgacctgtgtttgctgttgctcccccatccccatctcacaacactggactgtgagctctggcagggcaggtctgctgtctcattcc

SEQ ID NO: 6842502 - DNA, 129 bp, Homo sapiens
gacttcttttggaaaacatttatcttggacattagtctacagtggttcttatcaactactgttttcattattgtggaaattagtcggtttaggaatttgggccaatgtcatgaataatgaaaggagttc

SEQ ID NO: 6842503 - DNA, 70 bp, Homo sapiens
gttggaagggctgtggaggtcttctctgccaaactcccaccacaggcaagacgctgcgaagcctttcagc

SEQ ID NO: 6842504 - DNA, 71 bp, Homo sapiens
gctctgctctctttaccctctgagacaagaaaccccacatagacttctcagaggtggtaaaggacagcagc

SEQ ID NO: 6842505 - DNA, 70 bp, Homo sapiens
ttaaggaaatagaagggtaatcccaatttgctctagagtatgattggcctagtccctattatatccctag

SEQ ID NO: 6842506 - DNA, 69 bp, Homo sapiens
ggtggtgatcaggtctgaacagggaggtccatgcacatatgaaatttcttcctctcaggctttcccact

SEQ ID NO: 6842507 - DNA, 89 bp, Homo sapiens
tctccattggtgaatgttgtagcagggctgaccagaaggttacctatatctcatttgtctgccttgctggactgtaaactcggtggaga

SEQ ID NO: 6842508 - DNA, 58 bp, Homo sapiens
ggggctggagagaccctgggcggggtggtgggaatggcccaggaggagctccggctcc

SEQ ID NO: 6842509 - DNA, 124 bp, Homo sapiens
tgtttgcattacctgttaagaaagccagagtgaagttctaggaaattaggagacatgcaaaacacagcactcttcttaaaccacacatgtgctctcttaacattattggaataatgtattaaca

SEQ ID NO: 6842510 - DNA, 98 bp, Homo sapiens
cagtgtgttgtcattgattaatttatttaagaatctccatctgattcactctcagaggagcaccatggagaattcattatttgatgatgaacgtgttg

SEQ ID NO: 6842511 - DNA, 78 bp, Homo sapiens
gcagcttcttgagggaatcctcacatcaatctttaaaataaatagtgatgatgccccgattttccatctggaaactgc

SEQ ID NO: 6842512 - DNA, 122 bp, Homo sapiens
cctgcattgccacaactctctcctagaactgtccccgccctgccacacccaccccaggtctctctccaggctcccatggtgtggcaggacggcccagcctctatgagctgtcacaggccagg

SEQ ID NO: 6842513 - DNA, 81 bp, Homo sapiens
ttcaattttttgtgacagaaagattaagtcccacgttgggtacaacttaaaaagaatcttttcacggtacagaaagatgaa

SEQ ID NO: 6842514 - DNA, 56 bp, Homo sapiens
gggcactggtgctgccatcttgtgagcgcctggtgagactggtgctgccggtggcc

SEQ ID NO: 6842515 - DNA, 56 bp, Homo sapiens
ggacagttgttttccagatatgtttaaaatgtaggcattctaatcaaggactgtct

SEQ ID NO: 6842516 - DNA, 69 bp, Homo sapiens
ttggaggacagtgtgagatgattgaggagcaaatgcctttgccctgaattttttacctagtctttccag

SEQ ID NO: 6842517 - DNA, 64 bp, Homo sapiens
atgtttgttgaacatctactgcaatgggccaagccctgggcttgaaaggtgcttttgcaggcat

SEQ ID NO: 6842518 - DNA, 62 bp, Homo sapiens
caaggacaggtggagtggttagcaggccattgcgtggttgccgtttgttctaccagaccttg

SEQ ID NO: 6842519 - DNA, 74 bp, Homo sapiens
aagcctgacagctgaagggtcccagagcagcaaatatcaccttgtttctatgggaccattccagctgtctgctt

SEQ ID NO: 6842520 - DNA, 64 bp, Homo sapiens
gcccgctcacccgcccgcctgttgttttccacagagaggacgccgtggcgcccgggtgcaaggc

SEQ ID NO: 6842521 - DNA, 67 bp, Homo sapiens
tgggattgtaactgtgggttgattagatcatttaatcttgctctcatttctctacattattttctca

SEQ ID NO: 6842522 - DNA, 64 bp, Homo sapiens
tcacatactgaaagtccagtgatccatcaaacacactcaggacaagactttttattgtatgtga

SEQ ID NO: 6842523 - DNA, 58 bp, Homo sapiens
gacttcagctgttcttagaaagcattctgcatagttatccagagcagccactgaagtt

SEQ ID NO: 6842524 - DNA, 72 bp, Homo sapiens
aggcagtgcatatatgtgcagcatcaaataggctgggcctccgcagagattgagctgactgtggcactgtct

SEQ ID NO: 6842525 - DNA, 87 bp, Homo sapiens
gtgttgacaggaaaaagtttaggatgaaacactgtgttcagtacataacactacagttgcagtcttgtcactaattcttgtaaatac

SEQ ID NO: 6842526 - DNA, 95 bp, Homo sapiens
gattgttcattctattgacagacttgaaagtgttgttttaaatttattaactaacatggcaggtttttaatgagagattcagtgtgtgaacaatt

SEQ ID NO: 6842527 - DNA, 76 bp, Homo sapiens
tgattcattttatttctgacaaaaaaagacatgagtataatttcatggttttagaatcaggaaaaaaagtgactca

SEQ ID NO: 6842528 - DNA, 67 bp, Homo sapiens
gcaagcaagacagaagttactgcctctttgttaaccaatcttggaagtaacattctgtctttcctgc

SEQ ID NO: 6842529 - DNA, 55 bp, Homo sapiens
tgaggcaggactgagcgggatgaaggtgtaatttcattcctcagccccagcctca

SEQ ID NO: 6842530 - DNA, 80 bp, Homo sapiens
gagccaggaacccaacaacatagggctagttggaggtggttattcatgccagcagctgctatgtggtttttctatggttc

SEQ ID NO: 6842531 - DNA, 61 bp, Homo sapiens
aggcatatttctaaaatgcctgtctcctatcattatgagtcaggcatgaaggtaattacct

SEQ ID NO: 6842532 - DNA, 59 bp, Homo sapiens
gccccagcagcaatgcggttgagaaggggaccctcaaacgtcactttcctgctgggtgc

SEQ ID NO: 6842533 - DNA, 70 bp, Homo sapiens
ccagtaatggaaatagcagttcagctaaaatatatattgacaaagctaggtcatgctatggtgttactgg

SEQ ID NO: 6842534 - DNA, 70 bp, Homo sapiens
catggggcccaccctcaccctctccctgtcatctaatagtcccagggggagctgggaggtgagttacctg

SEQ ID NO: 6842535 - DNA, 59 bp, Homo sapiens
tcagtggaagctgcatataattgtcttcagaagcaggatttagcagacacttctattga

SEQ ID NO: 6842536 - DNA, 100 bp, Homo sapiens
ggctgttctgatctttaaaagattttggtttttaatacaaagtacatgatgatttgcatgtactgaataagattgtgatccaatgtctttgatggtggcc

SEQ ID NO: 6842537 - DNA, 73 bp, Homo sapiens
gcagaccactaatttctgaaggagattttgtactcaaagagtttaaactctactgaggaaataagatatctgt

SEQ ID NO: 6842538 - DNA, 56 bp, Homo sapiens
ggggctcttagagagcctagtgtgagtgattcccaaactgtgctccttagaacccc

SEQ ID NO: 6842539 - DNA, 80 bp, Homo sapiens
ttggggtaagaggacaaggccttgcaattctgagtaggatttttattaagaatatctccaagccttctcctcttctttaa

SEQ ID NO: 6842540 - DNA, 86 bp, Homo sapiens
caggcaaaggagaagtaggccgggccactgtgggtctccctctgggccatgcctgactctggccaggccagctctgacttagcctg

SEQ ID NO: 6842541 - DNA, 63 bp, Homo sapiens
aaagtttgagcctcccaacacacatgttcccaactgaggtggaacaaagggatgctcatcttt

SEQ ID NO: 6842542 - DNA, 68 bp, Homo sapiens
aggaatagcaaacagacatgcacaagtgcttttcaagcctctgcatgcatgatgtttggtagcatcct

SEQ ID NO: 6842543 - DNA, 79 bp, Homo sapiens
agtttatcagatatcttgtatatgtagggatgaggcagctgtataacaagttgtagagtatagaaggatctggtgaatt

SEQ ID NO: 6842544 - DNA, 97 bp, Homo sapiens
ggccacagtttactggtgtatgaagctatattgttggctgtattgttactctggcagagctgtagacttccctatcccagtggtattagacttggcc

SEQ ID NO: 6842545 - DNA, 88 bp, Homo sapiens
tgtgtgtgatgagctggcagtgtattgttagctggttgaatatgtgaatggcatcggctaacatgcaactgctgtcttattgcatata

SEQ ID NO: 6842546 - DNA, 57 bp, Homo sapiens
ctgttgtatcatttgttcacatttcctttagtggttgtggaatagaaattataatag

SEQ ID NO: 6842547 - DNA, 65 bp, Homo sapiens
gcactcagagagctgggctggagctccaagcggaaaccgcgggagccgagcccagctaggaatgc

SEQ ID NO: 6842548 - DNA, 70 bp, Homo sapiens
cagtctaaattctttttggtaaagtaactctgaatcatcagggtgacttgaagcaaaatagaatttcctg

SEQ ID NO: 6842549 - DNA, 57 bp, Homo sapiens
tcttgtgcaaacacaggcagtgggccagtttggcctgcaggctgtagtttgataaga

SEQ ID NO: 6842550 - DNA, 67 bp, Homo sapiens
ctcctctgacagtgtgaatattgacttgcacttataaaggtcagacagttccactagttaataggag

SEQ ID NO: 6842551 - DNA, 74 bp, Homo sapiens
gaaggctgcagggaggggagagaacaggaggatcccgggccagggtgacttcagtgacattccttccctccttc

SEQ ID NO: 6842552 - DNA, 63 bp, Homo sapiens
gctttctgaagcagtgtttctcaaagggtggtccagcatcacctgggaacttgttagagatgc

SEQ ID NO: 6842553 - DNA, 122 bp, Homo sapiens
ttctagagggctgggcctatgggtcttggcttcaatctcaggcctgcgggaagtcgtggggagctggatgattgaggcaatagtactgatggtctctgccaaagccacagccaattctagaa

SEQ ID NO: 6842554 - DNA, 129 bp, Homo sapiens
ttgataattttatatttctttactcaaacacgaatcatgttcagttttggggctgttacacaaaagagtcttgtgtcaccctaagcatctgaaccggcctttgggaaagtcagtacctttttctaaaaa

SEQ ID NO: 6842555 - DNA, 55 bp, Homo sapiens
tcaggtccttttggtgtatatttcataagggtgtaggtgcatggaggggtcctga

SEQ ID NO: 6842556 - DNA, 76 bp, Homo sapiens
atctctcctccactaggcaaaatgtggtaagatcattaattaagaaaccatgtgagccatgaggtggagggaaggt

SEQ ID NO: 6842557 - DNA, 62 bp, Homo sapiens
gggaatgggaaagaggcagcctttatttcctgaggttcagcaggctgcctccttcctttcct

SEQ ID NO: 6842558 - DNA, 85 bp, Homo sapiens
gcaaagggttttcagtggatggtttgtcttgccttttttcccgctgggatcttcaggcattcagtaccctcatgctgccctctgc

SEQ ID NO: 6842559 - DNA, 57 bp, Homo sapiens
ggtttttcatcagagtggccacggatgccttgaactgtgagcctgctgtaggaggcc

SEQ ID NO: 6842560 - DNA, 67 bp, Homo sapiens
ttttcaaataagctataatacacttgtttatataatctgtagaagtggattgaagtttggatgaaaa

SEQ ID NO: 6842561 - DNA, 73 bp, Homo sapiens
actcaacaaataagtggcacttaaagtcttagcttacagctaaggtccagtgaaactttatttggtttggagt

SEQ ID NO: 6842562 - DNA, 63 bp, Homo sapiens
tggcaatacataatcttaatggcaagatctatcataaccctttgctatgaggttatgatttca

SEQ ID NO: 6842563 - DNA, 98 bp, Homo sapiens
gctgaaggagtggactggggcacttaatgggcacagagattgattaattcattcaatacctttgtgccatttagtgttgtgccaggcactttctaggc

SEQ ID NO: 6842564 - DNA, 81 bp, Homo sapiens
cagaagtgagaactcttcttcctttaaaatgattaacagaggataatatcatttacaaggatcaagggatctctacctttg

SEQ ID NO: 6842565 - DNA, 64 bp, Homo sapiens
cacacacagttttgtattctgttggtttaacctctcatacccatgggaatatttccctgtggtg

SEQ ID NO: 6842566 - DNA, 106 bp, Homo sapiens
gtgtttttgtttgtttgtttcaatttttttgatatcaatgaagtgccttccaaaggcacttcagtttccctcaacaagattgcatttgacaggttgacactgatat

SEQ ID NO: 6842567 - DNA, 69 bp, Homo sapiens
cttggttgaacagataatttctaagttacttttccacttaaggtaatatgattttatttggataccagg

SEQ ID NO: 6842568 - DNA, 82 bp, Homo sapiens
tcttagcttcatgttctgcctgtggaagaagggaatgctgagctgcttcactgaaacttccggggctgacaatggggcagga

SEQ ID NO: 6842569 - DNA, 60 bp, Homo sapiens
tctaagcccccgcaccgcaggaacaacacagatacggttcctgcccacagggggcttaga

SEQ ID NO: 6842570 - DNA, 60 bp, Homo sapiens
ctagtagacagaaatgtccagtgtattcattttgcccactggatttagctatttcactgg

SEQ ID NO: 6842571 - DNA, 69 bp, Homo sapiens
gatgcagcagtccctgcagtggggaaaactcagtccatgaacattcacaccagcagggggtgctgtctc

SEQ ID NO: 6842572 - DNA, 91 bp, Homo sapiens
taaattctcatcagcaacaaggaaagctgtggttctgagaagaatcactgtctccgatcacaggttttcaatcaagcttctgagtgattta

SEQ ID NO: 6842573 - DNA, 84 bp, Homo sapiens
tgtatttagtgattttttagccctgtactgtgatactaagaagtagggcttaaatagggcctaaaaagtattgctaaaattaca

SEQ ID NO: 6842574 - DNA, 129 bp, Homo sapiens
cactaatgaaatttctctaaaaactataaatatagggaatatctttgttcaaagacatgctgaggatcaacagcatgttgggatgagaaggaatagttctctttagtttctcagagaagttccttaaag

SEQ ID NO: 6842575 - DNA, 72 bp, Homo sapiens
gttctttggtcagcagttggtggcgtgggcacaggtctggagacctgccagcctccaggcaggctagagggc

SEQ ID NO: 6842576 - DNA, 89 bp, Homo sapiens
gccccgacccgcgccgggttcacagcatgcggaggggccgaggccgggctgctcctctgctccaggctggacttccgcgtgggtggggc

SEQ ID NO: 6842577 - DNA, 63 bp, Homo sapiens
tcccaagccctggatgcctcagcaaggattgtcagaaatgtctgagatgatcagagctaggga

SEQ ID NO: 6842578 - DNA, 74 bp, Homo sapiens
acagatagggctacgtgcaattctagctttggatgtcttttagaaatgcagtcattgtatagtagaactaatgt

SEQ ID NO: 6842579 - DNA, 129 bp, Homo sapiens
gaaatggctgggctacatatgataccctgtaagcgttatcaaactggcttatggaactggaatggcaagaagttataagcctcgatggtaagcctgagttatggggaggacatatctgccaccccaagc

SEQ ID NO: 6842580 - DNA, 60 bp, Homo sapiens
gcatttttctgattttccctacacttgagagttgtgtaggaaacaaagtggatgaaatgt

SEQ ID NO: 6842581 - DNA, 81 bp, Homo sapiens
ctggtttctcatgaggtattcttgtgctgttaatggtacacattagatatattatggcttaagaatgcttttgtggactag

SEQ ID NO: 6842582 - DNA, 64 bp, Homo sapiens
agaaagaacagacttttaggtttttaactcccaatcgtagaatctgaaagtggctgtgagttct

SEQ ID NO: 6842583 - DNA, 78 bp, Homo sapiens
cctttcataaaggaaatgatgagacttggaataattcctgaaatggaaaaacctagacttaacattttaaatgaaagg

SEQ ID NO: 6842584 - DNA, 87 bp, Homo sapiens
gcttacagaggaagccctgtcattctgctgcctgatgacctcacggtctcctgtcctgcaggatggagcctcagctcctttgtgggc

SEQ ID NO: 6842585 - DNA, 67 bp, Homo sapiens
gagttaaatgacttggttaaggtcaccaagtggtaacactaggatttgaaccacagttatccaattt

SEQ ID NO: 6842586 - DNA, 70 bp, Homo sapiens
atcagctcacagtcaagagcaagattgggccaggccaggcttgccacagcagtgctttgacagtggggat

SEQ ID NO: 6842587 - DNA, 83 bp, Homo sapiens
agtctgtaggtagttaatcctgtcttgccatccaataatataaaattgtaggaatgtgtaatatgggaactcctaccaagact

SEQ ID NO: 6842588 - DNA, 87 bp, Homo sapiens
gctgttgcttcaagacactaagctttcaggatactttatgtgcgcatagatatctgtgacaaattttggtatctagaagtaggatgc

SEQ ID NO: 6842589 - DNA, 76 bp, Homo sapiens
actctaatatgactctttttctggtgaactcttcagtccaatagaactatcagatttagaggagtcataaaagagt

SEQ ID NO: 6842590 - DNA, 69 bp, Homo sapiens
ggcatcccgccaccctgccctccactcccaggactcggccccgttctggtgggaggcaaggtggaagct

SEQ ID NO: 6842591 - DNA, 99 bp, Homo sapiens
ccactgaggtcatggacgcacactgagctgctctaatctcgccttttaggctcatctacagggccagctagagccctcgccgccatgtcatctccttgg

SEQ ID NO: 6842592 - DNA, 68 bp, Homo sapiens
tgaaggctgtcattttctagagattaagcagaaaatgctgctctgtctgagggagtgacatttgagca

SEQ ID NO: 6842593 - DNA, 62 bp, Homo sapiens
aagctctgctcagcagactaggcagcaggaaagagtcaagcatctgtctctgagctagactt

SEQ ID NO: 6842594 - DNA, 57 bp, Homo sapiens
tccatggtctcttccagataaccgagacataaacaaggggctggagaagcctgtgga

SEQ ID NO: 6842595 - DNA, 79 bp, Homo sapiens
ccatattcttcctcatcaatctgtaggtaattgctgaagtagaggtacaggactcctgcattgatcaggcagaatctgg

SEQ ID NO: 6842596 - DNA, 76 bp, Homo sapiens
acagtgaagtgactgaggggttaccttggagttgatgccttggctcagatccagctcccctgttttcttcctctgt

SEQ ID NO: 6842597 - DNA, 107 bp, Homo sapiens
ctgctgtgatcaaggaattagataatctggcttgtttgcttaaggggtctgtatcttgagacttttatagggcagtattaaagctctgagcctccttattatgccag

SEQ ID NO: 6842598 - DNA, 56 bp, Homo sapiens
ggactgggaatcagggagatgcattttgtccactagctttgaccatgaaccagtcc

SEQ ID NO: 6842599 - DNA, 56 bp, Homo sapiens
ggttacagtgagaagatagcctacgaggaagtgggccctcatcagacactgaaact

SEQ ID NO: 6842600 - DNA, 79 bp, Homo sapiens
ttgctgtaggttcagtgacatcatactggtatcttgaaactggccatgatggcagtatttgtatcacagaaatcagcaa

SEQ ID NO: 6842601 - DNA, 63 bp, Homo sapiens
ggtggactttgggggataatgaggtgtcagtgttgcttcatcaactctaacaaatgtaccacc

SEQ ID NO: 6842602 - DNA, 63 bp, Homo sapiens
ggtgatgtacattttcctaatgttttgggactcttgaaaaccagtggaaagtttacaaacatc

SEQ ID NO: 6842603 - DNA, 81 bp, Homo sapiens
atagctgtaattaatgtatagagtgcctatgacaaacactttacaaatatcttcatggaaactctgaaaattaatagttat

SEQ ID NO: 6842604 - DNA, 81 bp, Homo sapiens
aactcccattccacatctgcccaaatccttcttcctctgggcaaccaccccgggggtgggaggttgggtgggacggaggtt

SEQ ID NO: 6842605 - DNA, 60 bp, Homo sapiens
tgcggccaggaagtccttgatgtgcgatgtgcagtagctaacaagggcccccctgccgcg

SEQ ID NO: 6842606 - DNA, 82 bp, Homo sapiens
ttatgtacaggcaaagttttagtaaacatatatgaagtaagtgatattaaatgtgtatttatttggggcttaacgtacataa

SEQ ID NO: 6842607 - DNA, 66 bp, Homo sapiens
gctgtttctcccagtctcctgagacagactgaagaggccctttctctctgactgggagctgacagt

SEQ ID NO: 6842608 - DNA, 59 bp, Homo sapiens
gtgggctctcctgcttataacacagaacaatgaacttgggagtgagcagagagcatcac

SEQ ID NO: 6842609 - DNA, 85 bp, Homo sapiens
caaggctgtggtcctggggttttatattttggatcagattgtctgtgagcctggattagaatggatagatccccagagctctttg

SEQ ID NO: 6842610 - DNA, 55 bp, Homo sapiens
ggcagccatgcacgctgcctgggagaagacaactccaggcagtgcatcttctgtc

SEQ ID NO: 6842611 - DNA, 95 bp, Homo sapiens
tgctgggttctcagggttaggtagggactctgccatttcttactgtcaaaatctctcctgtggagatggtgttccactgccagtctagctcagca

SEQ ID NO: 6842612 - DNA, 95 bp, Homo sapiens
ggcacctgggatgccatttgtctaaggagctctgacaaggattttctgcaaaccattgtagtatcatctgcagaccttggacaactctcagtgcc

SEQ ID NO: 6842613 - DNA, 72 bp, Homo sapiens
tttgggcaaagctagaaggaaattttatgttcttgttgcaacctcattgaatccttccttcagaagtccaag

SEQ ID NO: 6842614 - DNA, 129 bp, Homo sapiens
catgatgagaggaaatgagactttaggggaaaggatttttaggcattgggtgctcaagtgcttatttgtttcaacttgactagtcagtgtgtggactcatccaataaccatttatttcttttatcaatg

SEQ ID NO: 6842615 - DNA, 56 bp, Homo sapiens
tctggtcagtctccattctaccgggccccggaggtaggggagagaattcacacaga

SEQ ID NO: 6842616 - DNA, 98 bp, Homo sapiens
gaggtgggagaatcacttgaacccaggagttggaggctgtggtgagcagagatcgcaccattgcactccagcctgggccacaagggtgaaactgtctc

SEQ ID NO: 6842617 - DNA, 110 bp, Homo sapiens
cagatcaataggtattagactctcattaaggacagcgcaacctagatccctcacatgcacggttcacaacagggtgcgttctatgagaatctaatgctgctgctgatctg

SEQ ID NO: 6842618 - DNA, 76 bp, Homo sapiens
gtggtttgaattagtgagaaagaagatgcaatactgatctttcatgctatttctatctcatttaaattttaattat

SEQ ID NO: 6842619 - DNA, 74 bp, Homo sapiens
tctttcccttttttctgtgccctgctagctggaaatcttccatttggttatgtatcgaaactaccagcggaaga

SEQ ID NO: 6842620 - DNA, 77 bp, Homo sapiens
agccagtgagagcttataagcatcaggaccaagtatacctgtatttgtctctctgggtttacttaactccaaaggct

SEQ ID NO: 6842621 - DNA, 63 bp, Homo sapiens
ggccgggagcaggcgccaccgccagcgaccatggggaacatgttggccgccagctcgccgccc

SEQ ID NO: 6842622 - DNA, 89 bp, Homo sapiens
catttagcttcaggttgtcttgtttctgtatataatgacagcattctgctgccatcttagccgtggacaatgggggatcagctggcatg

SEQ ID NO: 6842623 - DNA, 61 bp, Homo sapiens
ccacctcttaggggaacttgctgagaatgaaaccagctcagaggtaagggctgagaggagg

SEQ ID NO: 6842624 - DNA, 110 bp, Homo sapiens
acctggaaacttgttagaaacacaatttcctgggtctcactccagagctcctgatttaaaaattctgcaggtagagctcaggaatctatgttttcacaagtcctctaggt

SEQ ID NO: 6842625 - DNA, 130 bp, Homo sapiens
tgactggaggctagattcaccagctgggagagcccatggttacttttctggctttgtcctcacccagcatgacaaagcaccagcaactatgggctgccccagagggcactggaggcatctgaccttttca

SEQ ID NO: 6842626 - DNA, 85 bp, Homo sapiens
tgtgagggcatgagatgtgggaggggccaggggcagaatgatatggtttggctctgtccccacccaaatctcatcttgaattgta

SEQ ID NO: 6842627 - DNA, 130 bp, Homo sapiens
tggctaggcaagccaggctctgcccatgtgttgagtgatcattcagaattggtattataatttggcaaacaaaaatgctttgattgattaaaacaatggatcccatttagagttttttgggtgtctggaa

SEQ ID NO: 6842628 - DNA, 101 bp, Homo sapiens
tgaccaggtatcctggtgtgcctggaactgtcctgatttcaataccgagtcccatgtcttgagaaagcctttagtcccaggcaaaccaggatggttggtca

SEQ ID NO: 6842629 - DNA, 59 bp, Homo sapiens
gactatagtgcattatttacagtaagtcatttttatttggtaagatgatgcgctgtgtt

SEQ ID NO: 6842630 - DNA, 70 bp, Homo sapiens
gctgaagatgcatcccttctcttcttttcccctaaataagtaaagctggaaaagtaatgcattctacagt

SEQ ID NO: 6842631 - DNA, 64 bp, Homo sapiens
ggccacggtgtgtgttttctcactctcgaatgcaagtgggagagagaaaatgactccggacgcc

SEQ ID NO: 6842632 - DNA, 63 bp, Homo sapiens
gaggacttggtcagcttcttccctcaaggcaatgggtgctcagtgaagaagttggaggatctc

SEQ ID NO: 6842633 - DNA, 74 bp, Homo sapiens
tatttgttatagaagcccaagctgactaaggcaagaaattggtgctaagaagtgagatgctgctgtaacaaata

SEQ ID NO: 6842634 - DNA, 60 bp, Homo sapiens
gcttctgcaggagtcaactctgggcgaactacatgccagggagtattgcctgcagagagc

SEQ ID NO: 6842635 - DNA, 72 bp, Homo sapiens
gggaggtggccatctttggccctgactcagccctgcagggagaagaggggctggaggtgcaggtggcctgcc

SEQ ID NO: 6842636 - DNA, 55 bp, Homo sapiens
gagacggaggatggcatcatctgtgaataacacagatgatgccatcctccatctc

SEQ ID NO: 6842637 - DNA, 63 bp, Homo sapiens
acttgtctttaatccgaatgtaacagaaatgtacacgacgttatattaggattagagaggagt

SEQ ID NO: 6842638 - DNA, 100 bp, Homo sapiens
ttttcccttctagaccttacatgcttttttcctcaggcagttggagaaagatacataccaaaaatgagagggaaacatgatgaggggtaagtggggagga

SEQ ID NO: 6842639 - DNA, 58 bp, Homo sapiens
gctttgtgtgaagtccatggcgtagagttcagaactaggctagtggtctgggcaaggc

SEQ ID NO: 6842640 - DNA, 59 bp, Homo sapiens
agagcctgagcctgaaagccctcagacctcctgacactgaagcacagagcccaggctct

SEQ ID NO: 6842641 - DNA, 60 bp, Homo sapiens
gcgcctgggcacacagtgactctgcactttctggtccagtttcctgtggctgcctagggc

SEQ ID NO: 6842642 - DNA, 56 bp, Homo sapiens
gaggccataagaagttcttgggttctgttttccataattaactaattatgtgcctc

SEQ ID NO: 6842643 - DNA, 94 bp, Homo sapiens
tatctatggaaatagagttaatggctgggataaaggaatgataccatttactgtgtacctattctgttctagtcattgtgctatgtacattata

SEQ ID NO: 6842644 - DNA, 61 bp, Homo sapiens
aagggtagatggggtaaaataattaagattaagattcttgtatttccaaccctttatcctt

SEQ ID NO: 6842645 - DNA, 109 bp, Homo sapiens
ggtgaggtgcctgggtcagtgctgatagggcagtcaggccgccactgacctgagcatcctgcagggggaggaggcggccaggcgctctacatcgatggggacctgaacc

SEQ ID NO: 6842646 - DNA, 60 bp, Homo sapiens
tctgatggggttcacctgacagagaagttactcctaatcttttcatcaaagcccctcaga

SEQ ID NO: 6842647 - DNA, 69 bp, Homo sapiens
tgcagttttaagggctggccacattctgggtagtttctggtcagaatatacagagctcaggaaactgca

SEQ ID NO: 6842648 - DNA, 101 bp, Homo sapiens
ggccaggacatgcaagctgattttccagaaagagtagccctgggcgggaaggaccccaggtggtgctgaattctggaggaggctggtctgtcttggacacc

SEQ ID NO: 6842649 - DNA, 76 bp, Homo sapiens
ctccagcatctagcaattgtcctcttccctcactgtgttaggtctcggggaggtcattgttcaatgctgttccgag

SEQ ID NO: 6842650 - DNA, 84 bp, Homo sapiens
gtagcttatgattgtgctctaataaagcctgacattaattatgacatgggaaatggaaggtctattagttataattataattac

SEQ ID NO: 6842651 - DNA, 79 bp, Homo sapiens
tgtgtgcaagcctgaacattactagttgtgtaatcttgtgcctatcacatataattagttgcatgttcattgttacata

SEQ ID NO: 6842652 - DNA, 59 bp, Homo sapiens
ggagaaagaggcatgttttatgcctgctgaatttcaaggtggcctttgcctctttctct

SEQ ID NO: 6842653 - DNA, 91 bp, Homo sapiens
tcttgtctgatttttttctcttggttattctttgtatggtttggctaatatttttgattgctgtacactaagaacaaagatctgtatagga

SEQ ID NO: 6842654 - DNA, 84 bp, Homo sapiens
ctatacacatcactgtatctttcagtgactcagtggcaagaaccttgctgggatggttggatggatacataggtggatgaatgg

SEQ ID NO: 6842655 - DNA, 74 bp, Homo sapiens
gaagaagcatggctgctccctggctgcacctgctgagttgacaggtagtcccagagagctggtcgtgggtcttc

SEQ ID NO: 6842656 - DNA, 62 bp, Homo sapiens
cctcctttctttactggagacagaagggagatatattcttccactccaagttaagagggagg

SEQ ID NO: 6842657 - DNA, 66 bp, Homo sapiens
gataaatgtttgcttaattggagaaattctaaaatatctagaattgacttcaaggtagactttgtt

SEQ ID NO: 6842658 - DNA, 61 bp, Homo sapiens
ctaatatctctgtgggccactattccgctcaggtcaggagacagtggccgagaggtactag

SEQ ID NO: 6842659 - DNA, 61 bp, Homo sapiens
gcatacgtgcatgctgccgccctcgactgttggagaccccgggccagctgatgcacgatgc

SEQ ID NO: 6842660 - DNA, 68 bp, Homo sapiens
gtcccatgagcaaacactcagcatcctctgcaccatagaacacatgcttctgtgtatgtttcaggtac

SEQ ID NO: 6842661 - DNA, 89 bp, Homo sapiens
tcagcatcagtccagatttacctaactccaagttctaggctatcgatcttacatcttaaagctcaggagtgagggagtttctgatgtga

SEQ ID NO: 6842662 - DNA, 85 bp, Homo sapiens
catccctgggccctgcctgtcatcgcctgcgcccgcctcttcccttgaagtcggtgtccagatacggagcggtggcttggtgatg

SEQ ID NO: 6842663 - DNA, 69 bp, Homo sapiens
cagtcacttcatggtttcttggacaggcagatcctggccatgttcatgtaattccataaggtaaggctg

SEQ ID NO: 6842664 - DNA, 58 bp, Homo sapiens
cagtattctgagtacttgttctttttgttagagagatgaacattagtttcagatattg

SEQ ID NO: 6842665 - DNA, 56 bp, Homo sapiens
tcactgtaccttccatttcatttgcaaacccaaatgttggctggggaaggcagtga

SEQ ID NO: 6842666 - DNA, 78 bp, Homo sapiens
cctgccttataagaccccagggacctggcacctgcaaccatagcaggaggcaggagccagcgttcctcaggattcagg

SEQ ID NO: 6842667 - DNA, 70 bp, Homo sapiens
tttctcagaggagccagacggtccacatacatcatcaactgcctctgagctttctggctgctctgtgaga

SEQ ID NO: 6842668 - DNA, 60 bp, Homo sapiens
gctggctttgtggtctctcctccctgtgcaggtagggtgtggagggtaatcagagtcagt

SEQ ID NO: 6842669 - DNA, 68 bp, Homo sapiens
cttgtgggtggggctcccccttctgagtcatagcaaatgccggctggggctgtccccatgactatagg

SEQ ID NO: 6842670 - DNA, 78 bp, Homo sapiens
ggtacctggccgccatggcccactctggtcccggcacccccgcggggctgctgagcagggagggccgtgtgaggtgcc

SEQ ID NO: 6842671 - DNA, 77 bp, Homo sapiens
ggcaattttgccacccaggggacatttagcaatgactagagatgtttctggttgtcacaactgggtgggagggtgct

SEQ ID NO: 6842672 - DNA, 57 bp, Homo sapiens
ccgcagggcaaacccaggtgttcagggcaaggcctggacactgtctgtgacctgtgg

SEQ ID NO: 6842673 - DNA, 70 bp, Homo sapiens
gcatctgagctggcctgtgactgcactgacaaatagaatacatcagaaatgttttatgccagttctgtgt

SEQ ID NO: 6842674 - DNA, 60 bp, Homo sapiens
gtgagctttaggagaaggaggtcaaacagcatattagtttgcctattattttaagcttac

SEQ ID NO: 6842675 - DNA, 56 bp, Homo sapiens
ctgctgcctcactccagcccaatacacaggcttgtgtggtatgctgcaggcagcag

SEQ ID NO: 6842676 - DNA, 69 bp, Homo sapiens
gcagagagaatggtaatgaggacttgaaggggtcttcaccaagtccatatgcatcatgggatgctctgt

SEQ ID NO: 6842677 - DNA, 130 bp, Homo sapiens
gctatacaagtgagttgtaggagtgtagtatggtgttgagagagtcaaggaactgcaaagccaaggtgtcattgcttccttgagctctccaatcccagcctaggtcagccctacttactccagctgtagc

SEQ ID NO: 6842678 - DNA, 91 bp, Homo sapiens
tggactcatgtatgtggttatagtcatgggacagcattgcttcttcctaagtacctgttaggactgtgacctatagacaatgctttttcca

SEQ ID NO: 6842679 - DNA, 62 bp, Homo sapiens
gggaatgtttttataagtgttacattgtcatacaggctgtatcttagtgtgaaaatatttct

SEQ ID NO: 6842680 - DNA, 58 bp, Homo sapiens
tctccaaggtggttatttgagatagaaagatttaatcaggaatgaatacttttggaga

SEQ ID NO: 6842681 - DNA, 56 bp, Homo sapiens
ctgaggaccggggtctctggggtgttccccggaaactacgtgacacccgtttccag

SEQ ID NO: 6842682 - DNA, 65 bp, Homo sapiens
cccaaattgtcttggctattgtgagtctgtggcggtaatctatggatagtgtctggatatttggg

SEQ ID NO: 6842683 - DNA, 90 bp, Homo sapiens
gcgctttgtcggtgtggcagctcggacccgcggggactgcaaggaatgtccttgaggcccggcaggccgagcggcggccggcatcagtgc

SEQ ID NO: 6842684 - DNA, 92 bp, Homo sapiens
ggtagttgctccaggtgtctgcccttccatcgccgtggggtcctcgggtcaccctgagggtttccgggcagtggactcaggcatccgacccc

SEQ ID NO: 6842685 - DNA, 68 bp, Homo sapiens
gtgcagagctcaggcagaatccagttgcccaaaacagtcaggcactttctgttcctctagctttgcat

SEQ ID NO: 6842686 - DNA, 61 bp, Homo sapiens
gtttctctcgtggctccaagtacatgaaaattttttcatgttatcttggctctgggaaaac

SEQ ID NO: 6842687 - DNA, 120 bp, Homo sapiens
attgttttgtttgattaaatgtgggagcattagttcttgtattttaatgtgtttagcttttaaacatgttttctgaatatttttagtagctgatgcctggtctcccaaccacaaaataat

SEQ ID NO: 6842688 - DNA, 97 bp, Homo sapiens
cacaggtgctaacctttcactgtttggatgccatggtcaaggaggcaatcaattctttgaatatacttcaaacaaagaaataaggtttaattctgtg

SEQ ID NO: 6842689 - DNA, 75 bp, Homo sapiens
ggtctctaagggcgcatggactggtgtttcccagactgtggtctccagggacacactagccggctagtgcctgcc

SEQ ID NO: 6842690 - DNA, 78 bp, Homo sapiens
gctcttcatgcaatatataggaacaacttagggttgtaatgcagtgcctgggagttcctttatatcacatttagttgc

SEQ ID NO: 6842691 - DNA, 75 bp, Homo sapiens
tgttccaatagatacctttgtcccaatatctttcttgggattaaccagtgttgggcaaggttatcagtttaaaca

SEQ ID NO: 6842692 - DNA, 96 bp, Homo sapiens
gtaggagaataagcacttcctggggccagcactgtgcctttgtgggcatcctaaacctgggagggctgccgtggccttgggagctgatactcttgc

SEQ ID NO: 6842693 - DNA, 67 bp, Homo sapiens
ctgcaagtccaagatcaagaagccagaagggttggtgtcctctgtggcctccctccttggtttgcag

SEQ ID NO: 6842694 - DNA, 64 bp, Homo sapiens
gagcacaggaagtctttgcccaggccagagatctctgtgcctgggatcagaattccctcagctc

SEQ ID NO: 6842695 - DNA, 58 bp, Homo sapiens
tctgaatttagtgattagctttgactttttctccaactaaggctatcacttggttaga

SEQ ID NO: 6842696 - DNA, 69 bp, Homo sapiens
attccccaaggtttactttatgatccaggccaagttaggtcaggatcatgctgaatctggcacaggaat

SEQ ID NO: 6842697 - DNA, 66 bp, Homo sapiens
tagcttgttgacctactgtaacatgtgaaatataccgtgtttcacatcagaggtagattagtgctg

SEQ ID NO: 6842698 - DNA, 59 bp, Homo sapiens
cctgtggcctgaatttggtaaaatagtccactcatttgtttacttcacagagccacagg

SEQ ID NO: 6842699 - DNA, 64 bp, Homo sapiens
cgaggctagaagtctgagatcaaggtgtcagtaaggctgtttttttctgaggcttctccccttg

SEQ ID NO: 6842700 - DNA, 66 bp, Homo sapiens
ttccacaggtgttcttgcagtgaaaatgaaaattttaacctgtcaatttgcatgctttttgtgggg

SEQ ID NO: 6842701 - DNA, 83 bp, Homo sapiens
ggtgggctggatgctttctcctttctccaccaacccaagggcatctggagggtggaccagggcagaaaggcgattagctctcc

SEQ ID NO: 6842702 - DNA, 64 bp, Homo sapiens
ggaaaaagtggcaagtcaatgatagtgacccagcatggttacatttggctatgtcctctattcc

SEQ ID NO: 6842703 - DNA, 62 bp, Homo sapiens
ggtggatatttatgtgtgatacaaagatcttcatactttgtacccactcccatatgtccatc

SEQ ID NO: 6842704 - DNA, 55 bp, Homo sapiens
gcagctgctgtggcatcaagctctgcgtgggcaccatctgacttcacacagctgc

SEQ ID NO: 6842705 - DNA, 69 bp, Homo sapiens
ttcatgtcttatatcctgtcttcatgtcttgcttgtaccttagttttgaacagtatgtgggacattgag

SEQ ID NO: 6842706 - DNA, 70 bp, Homo sapiens
tttttgaaagcaggttgcaattacagtgcttcattttgtggaagtactgccattatcctgctgaaagaaa

SEQ ID NO: 6842707 - DNA, 110 bp, Homo sapiens
atgaacttcaaataaataaaaactatggtatgtactcttttatgtctggcttaatttgtccagtatgtttgggagacatgacccttgtgttgtgtgtgtcagtagttcat

SEQ ID NO: 6842708 - DNA, 58 bp, Homo sapiens
gtcctctgcccaggtcaaggttggaagaagaaaaccccagaatctgacccagagagac

SEQ ID NO: 6842709 - DNA, 73 bp, Homo sapiens
ttcctgccctcgaggagctcacagtctagtatgtctcatcccctactagactgaagctccttgaggacaggga

SEQ ID NO: 6842710 - DNA, 55 bp, Homo sapiens
agggcctgggaagaggaaccctgactgagcaacaggaatccattcctaaggccct

SEQ ID NO: 6842711 - DNA, 71 bp, Homo sapiens
gaggctaccacagtctgccattagatggttttttatccctccatctaagtctttggagtgtggaaagcctt

SEQ ID NO: 6842712 - DNA, 67 bp, Homo sapiens
gcagagcttcagggaataagaatgtgcttttctgcaagacccatttccacccctgaatgctccatgc

SEQ ID NO: 6842713 - DNA, 72 bp, Homo sapiens
tgagggcctggggtagcttactgcgaagcagcctcagggaatagaggcttcagcagggcatcttggccccca

SEQ ID NO: 6842714 - DNA, 66 bp, Homo sapiens
tctgatttcccacaattaggtgcatgtattttgtgtgcatgtatattttatgtggagagaagcaga

SEQ ID NO: 6842715 - DNA, 87 bp, Homo sapiens
ggaacttgttgggaactggagcaaaagtgactcctcttatggtttaacaaacagactggaggcattttgctcctgccctagagatct

SEQ ID NO: 6842716 - DNA, 74 bp, Homo sapiens
cacgcctggcagcaggtgggcccgtgtcagcaacagaaatgaggtcacttactaccctgcctgccacccgcgtg

SEQ ID NO: 6842717 - DNA, 63 bp, Homo sapiens
ttgtcaagcaccatgataagtggtggaaaataatgattctgacacttgaatggtgttttacaa

SEQ ID NO: 6842718 - DNA, 58 bp, Homo sapiens
atttgagttgtttttagttttgttaatttatgaacagagttgctaaaaacactcagat

SEQ ID NO: 6842719 - DNA, 130 bp, Homo sapiens
ctcagcctcacaaagtgctgtgattacaggtatgagcctctgcacccagctctttcctccttttaaaaacaagaaacctggccaggcacggtggctcatgcctataatctcaataccttgggaagctgag

SEQ ID NO: 6842720 - DNA, 65 bp, Homo sapiens
attggtggttgcctagggccagggagagtgtagggattggcaagaaatgggatttgactgccaat

SEQ ID NO: 6842721 - DNA, 65 bp, Homo sapiens
ccggaagagctggcccaatctgagcatccccaagaaggtgctgggagtagccaggttcatgttgg

SEQ ID NO: 6842722 - DNA, 56 bp, Homo sapiens
tctctttcatgtatatgcaacctaaatttacaattagtgcttaaaagtggaagaga

SEQ ID NO: 6842723 - DNA, 74 bp, Homo sapiens
tggctcaaggaaacagattttagactcttggcctccagaattttgagagaataaatttctgttgttttgagcca

SEQ ID NO: 6842724 - DNA, 70 bp, Homo sapiens
agtccttggcttccactgtgtgccccctggatggtgagggctagaagggggtagcatgaggagtgggact

SEQ ID NO: 6842725 - DNA, 59 bp, Homo sapiens
gatctggtctttgattagacaccctgaccttttacgagtgttgatcattgatcatgatc

SEQ ID NO: 6842726 - DNA, 77 bp, Homo sapiens
cttagtaggtgaggccagagagtttgcatttctaacaagttccagatgatgcgaatgctgttggaccacactttaag

SEQ ID NO: 6842727 - DNA, 59 bp, Homo sapiens
gctagttttagctctttgggggatacttgccaaactcttcatcaaaagttaacactagt

SEQ ID NO: 6842728 - DNA, 66 bp, Homo sapiens
tgaggctctgtgcaagtatttgacattttctgaagaaaatttagaattgcatgcatccactcctca

SEQ ID NO: 6842729 - DNA, 60 bp, Homo sapiens
gcccttaggcaagcagaagcccaatcacatgaacctgggctgccctcgcttggttaaggc

SEQ ID NO: 6842730 - DNA, 79 bp, Homo sapiens
atttgtgtggcatgggagggactgcattcgatttggaattgatctctgtgttgaactctcctacatttcattcacaaat

SEQ ID NO: 6842731 - DNA, 74 bp, Homo sapiens
gcagccaggtgggctgcctctccagctccttctggctttcgcccttcggctgggacaggagcaccctaggctgt

SEQ ID NO: 6842732 - DNA, 58 bp, Homo sapiens
aggactgaggctcccctaggctcagttgtagattttgaggctcttgagtttcagttct

SEQ ID NO: 6842733 - DNA, 82 bp, Homo sapiens
gtgaacgtcgcaggtgctcttcactgaagttctgcgtcgtccccaccagggacgagagagacatggtgacctgcatcttcac

SEQ ID NO: 6842734 - DNA, 79 bp, Homo sapiens
tccattggttcatttttccacctcctaggaagttaatgagtttcacacagggtcggaaagagtgataaaacacagagga

SEQ ID NO: 6842735 - DNA, 94 bp, Homo sapiens
gctcctgtccttatctcccttgtcttggtgaccaggggaaatgccaaacatcctctggtcctgacaaagacagagtgggagaaaggtgatgagc

SEQ ID NO: 6842736 - DNA, 71 bp, Homo sapiens
attgcatcaatttcatgtgcactgatttaggcgaagatgcgtaggaaaagagcaaggaaatgaggtgtgat

SEQ ID NO: 6842737 - DNA, 86 bp, Homo sapiens
ctagcctgatctttacaccttctgaggggaaactggcagtgattcctcactgcaggtggatatctcatcagataaagcagggttag

SEQ ID NO: 6842738 - DNA, 75 bp, Homo sapiens
acttatatttgtgtggaaaatgcttcttaattgaacaaagattaattaccaggatttttcagtatgaagataggt

SEQ ID NO: 6842739 - DNA, 96 bp, Homo sapiens
tctgcaggtccgcttcaaagccctggtctgccacccacacccctccaaatgtggagaatgggggctacaggccacatgcagttgtggacctgcgga

SEQ ID NO: 6842740 - DNA, 88 bp, Homo sapiens
tttgaagcaatgcattcatgaagattgcacattctggcatacttagtaatttcacagtaataatgagtcattcctgaatgctttcaaa

SEQ ID NO: 6842741 - DNA, 58 bp, Homo sapiens
agggaggtagcaagcctgcagctcagttcaactatggagtatagcctgtggcctctct

SEQ ID NO: 6842742 - DNA, 64 bp, Homo sapiens
ccatttcctctcccccaaggacttgcagccaatctccgatagccctgtccaggagaggcaatgg

SEQ ID NO: 6842743 - DNA, 88 bp, Homo sapiens
cctacattttttccagtgattgctgctctcatctttttgccaaattgatcagagttggcagtaaaacacaggcagttgaaaatgtggg

SEQ ID NO: 6842744 - DNA, 67 bp, Homo sapiens
tctgccatgtgaggatataggattcatcttcttttttgtccttccatctttcctaacatgttgcaga

SEQ ID NO: 6842745 - DNA, 78 bp, Homo sapiens
tcacatgactttatcttgtccttcctgctcccaagagccagagcaagggaagcaggattgggcagagggtgaaggtga

SEQ ID NO: 6842746 - DNA, 82 bp, Homo sapiens
cactgtttatgcaataattaagttgtgaatctggatttatttgccatccacagtcttgattattttaaaagccagacagctg

SEQ ID NO: 6842747 - DNA, 65 bp, Homo sapiens
ggaggaaaggatggcggtcgtcgacggtcctggctgcagggacacggggactgccaatccacccc

SEQ ID NO: 6842748 - DNA, 60 bp, Homo sapiens
gcagacagatatatgaacacatccaccatatcttgtgggtcattggtaagttttgtttgc

SEQ ID NO: 6842749 - DNA, 93 bp, Homo sapiens
atcagcagttggactttgccacttgctccagcttgtccttcttcttgatggcatagaagttggagaagcccttggcaaagatattgagctgat

SEQ ID NO: 6842750 - DNA, 55 bp, Homo sapiens
ggcacctgtctgctcacagtgaaggcaatcatgcaatcatgacaaaacaggcgct

SEQ ID NO: 6842751 - DNA, 77 bp, Homo sapiens
ttcattgctgtcttcacttcctggtttctcaaagtatagataagtggattcagaaagggagtgaagatggtatagaa

SEQ ID NO: 6842752 - DNA, 89 bp, Homo sapiens
atggtggctcattgactagaaccagtccacagaatttgggatgttttattttgggcttgtgttcctcagtttgtcaaagactccaccat

SEQ ID NO: 6842753 - DNA, 80 bp, Homo sapiens
gaagctcaactcagacttctactttgcagagcgagaatcccaggacacgttctatagtggagtctaccctgtttagcttc

SEQ ID NO: 6842754 - DNA, 66 bp, Homo sapiens
ctggcatgcacagccctgttcgggagcagtgtctgttttcttgtctgagcagtgctttgcagtggg

SEQ ID NO: 6842755 - DNA, 116 bp, Homo sapiens
ctatggactttagcagaggaatgcagccaccagcagaaaaggggccagagggataaatacctggacctcactgtctgctggtacaatctgttgcatggcattttggtgaactgtag

SEQ ID NO: 6842756 - DNA, 61 bp, Homo sapiens
gcggcttaggggcagaagcggcggtccagggccgcctggcgcagcagcctgtcccagccgc

SEQ ID NO: 6842757 - DNA, 67 bp, Homo sapiens
ggaaagtagtgtattctgcatgggagacttactgtttaaaagtaaatttcttttggatatattttcc

SEQ ID NO: 6842758 - DNA, 63 bp, Homo sapiens
catcttgaaggtttctttagcttttcacaaagtcttagaaaactgagagactaaatcaggatg

SEQ ID NO: 6842759 - DNA, 61 bp, Homo sapiens
ggagcacagccttactcactggtggggacatccttcccagtggccttccaggttgtgtttc

SEQ ID NO: 6842760 - DNA, 80 bp, Homo sapiens
gccaaagcgtgactcttacccggcaacgtgtgtcgccgcttgatcgcagcggtgcggtgattgggtaggtcagttctggc

SEQ ID NO: 6842761 - DNA, 130 bp, Homo sapiens
gaaggggagtaaacacaacctgaggtttattgtgatctgatgttgtcagagcctgggctgaagctaagggctgggcttatgtttgtcaagcaatcaggaaaacctctgtcttcttctttcactacacatc

SEQ ID NO: 6842762 - DNA, 78 bp, Homo sapiens
aaaagtcataaattgtacccattccaacacaaatccctgattgtggtgtcagtgaaggtagagttttctttgtctttt

SEQ ID NO: 6842763 - DNA, 83 bp, Homo sapiens
gagttcccatatatgcaaaaatgtaaccgtcagaaatgggtgttaacagagtgagaattatatttttttatacttgagaattt

SEQ ID NO: 6842764 - DNA, 58 bp, Homo sapiens
cctttctaacagattgtggatcgctttgaagagcagcgtcctacattcataggaaagg

SEQ ID NO: 6842765 - DNA, 78 bp, Homo sapiens
attgttagaaagatccttctggctgcctccttgtggagagtggcttggagggggccagatggggactgatcagacagt

SEQ ID NO: 6842766 - DNA, 90 bp, Homo sapiens
tttacaaacagttactttgatgtacacacacatctttgcgtacttgtcctgttgtatgctgagatagtttacaagaagtagaattgtagg

SEQ ID NO: 6842767 - DNA, 80 bp, Homo sapiens
ctatttgtaaagtaagaggcttgtattcattgattcctgtggttctttggaatgctagcattctattaatttataactag

SEQ ID NO: 6842768 - DNA, 60 bp, Homo sapiens
gcagaagcccggtcagcgcacgtgcccgcgagacctgcaaacttgtgccaccggctctgc

SEQ ID NO: 6842769 - DNA, 59 bp, Homo sapiens
gttgttctgtaggcacacagtttcaagcctgggatggcttggagtgttacagatgcatc

SEQ ID NO: 6842770 - DNA, 55 bp, Homo sapiens
ggatggatggatggatggatggacggactgccagttccaagccctccttccattc

SEQ ID NO: 6842771 - DNA, 61 bp, Homo sapiens
acttgtgtcatttttttgcattccagattggcgagattgtaatgatgaaagatgacagagt

SEQ ID NO: 6842772 - DNA, 62 bp, Homo sapiens
cctgacctccttcagaagattctgtaggggtttttatgttttctaaggctgaaggaggaggg

SEQ ID NO: 6842773 - DNA, 62 bp, Homo sapiens
ggaattcttgaatgctatggttctgattctagaattctcaggttctacagttttagaattcc

SEQ ID NO: 6842774 - DNA, 63 bp, Homo sapiens
ttaattgtaaagtttgcctgtttaatgctcagggcagtgaccagagtatccctttagaattaa

SEQ ID NO: 6842775 - DNA, 64 bp, Homo sapiens
ctatagtcttaactattcaggaggctgaggtggatcacttgagccttggaggttgaggctgcag

SEQ ID NO: 6842776 - DNA, 61 bp, Homo sapiens
atagcagggagacagtgcagcattaaactggtggcataatgttgtaaatattctttgagat

SEQ ID NO: 6842777 - DNA, 84 bp, Homo sapiens
gaggtgttgtactgtggttaagagcaaggatttggtgtcgagctgcttgggctggagcttgttgcttccccactgcttgacctt

SEQ ID NO: 6842778 - DNA, 62 bp, Homo sapiens
gcctcatgattccagatgaattgcatagttaaatttaaacttgcaactttaaatggaaaggc

SEQ ID NO: 6842779 - DNA, 60 bp, Homo sapiens
cagacatgagatacagctgctacaaaacaacaccgattaatagttgtattttatgtgctg

SEQ ID NO: 6842780 - DNA, 66 bp, Homo sapiens
atggggatgttaggctctaagcatggtagggaatcatcgtggctgtcagtaccttgacatctttat

SEQ ID NO: 6842781 - DNA, 88 bp, Homo sapiens
gaagctcaggctagaagtggtaatggagtaaggacctgaagaattagatgacaaatttttcatattcccctctctggaccagggcttt

SEQ ID NO: 6842782 - DNA, 71 bp, Homo sapiens
gaagcctaagtataatcagataacctcaacatcagtaggacaactgatgctgaaccttaacttggagcttt

SEQ ID NO: 6842783 - DNA, 75 bp, Homo sapiens
actgccttgattcatgctgatgtgatcggtttcaccccattgcctctgcaccatcagtttgaatgttagcacagt

SEQ ID NO: 6842784 - DNA, 96 bp, Homo sapiens
ctcgactgggggcgtctcaccgtcggactcggcaaggctatgcagcgccagctcgccatggaagtccttgcggaaatccgggtggcccacctcgag

SEQ ID NO: 6842785 - DNA, 76 bp, Homo sapiens
agggccaggtgaccacaggtatgggcttggcagggagaaccagcctgctaggcagagggctgtggagctgagccct

SEQ ID NO: 6842786 - DNA, 82 bp, Homo sapiens
tttctgtggcatagtgatgtttggcttctggttcttattgagaggtgcagtatatggattttaaacattgcagctatagaaa

SEQ ID NO: 6842787 - DNA, 68 bp, Homo sapiens
actgttggttgctagtatgtatgaaaccataaactagaatgcatacatacaatagctgccacaaaagt

SEQ ID NO: 6842788 - DNA, 57 bp, Homo sapiens
aaggacagagagccattccagactcacccagtattgaaacagggctctctgctcctt

SEQ ID NO: 6842789 - DNA, 73 bp, Homo sapiens
ttgtttagctaatatgtggcatggagtaaggatatcattgtcacattcaagttttatatccatggcttgataa

SEQ ID NO: 6842790 - DNA, 76 bp, Homo sapiens
acatggttccagacccatgcccatagaataagagttaagaagtttctgatatgtgcactttgggtctgggaattgt

SEQ ID NO: 6842791 - DNA, 115 bp, Homo sapiens
tttttagtgaatacagaagggtggagacaatttgaggcacttcagaataaatgcaaaaatagagagattctgttgtctatataagtttttccaaatttggtattattcctagaaa

SEQ ID NO: 6842792 - DNA, 64 bp, Homo sapiens
agatgctgaggcaggaatggggaaaagtggaggagacactgaactcactttgctttagaaatct

SEQ ID NO: 6842793 - DNA, 77 bp, Homo sapiens
aacaaaaactcccttgactcctcagatggcctatgtagacccatgatgtccttgagtaagtcatggtggttcctgtt

SEQ ID NO: 6842794 - DNA, 59 bp, Homo sapiens
ctggggcatcatccattctttcgtatattcacagatatgtatggtatgtcctgccccag

SEQ ID NO: 6842795 - DNA, 80 bp, Homo sapiens
gaatatcatgttacagtggctttttaaacacttaagaacgtttctcttatttgtaagcatcactgtgatgtggttttgtc

SEQ ID NO: 6842796 - DNA, 80 bp, Homo sapiens
tctatggatgagttgagtggttctgccaatttgggccatgtgtggctgatcctggcagggcctgctcatcatccagcagg

SEQ ID NO: 6842797 - DNA, 62 bp, Homo sapiens
ggaatcctgtgagggctgagagttggagctctgcctctgaagtggcctttaaatagtattcc

SEQ ID NO: 6842798 - DNA, 118 bp, Homo sapiens
gtgcatgatcatggatagatcaaagtgtggttgcaagtgaaatgggataaatgacaaaatgacagttttataaagttaagcctgaatcacattaattctgtatcttctagacatgcac

SEQ ID NO: 6842799 - DNA, 79 bp, Homo sapiens
ggctcattttaacatgcaaatggtggctaaatggattgctaaattgtgagtcactttagtttgtaacctagtttgagcc

SEQ ID NO: 6842800 - DNA, 68 bp, Homo sapiens
agtcattattatttgtcaaaggggtctttaaaatacgcaaatatcctctctacaaatggtcagtggct

SEQ ID NO: 6842801 - DNA, 89 bp, Homo sapiens
aatggctaacaatcaccttccccatgctgccttctcagtgcttcttataaccaggaggcctcaggcgtgggaagggtgtgggggctatt

SEQ ID NO: 6842802 - DNA, 65 bp, Homo sapiens
taagaatagtagttgaagcaggtgaatatggaggaataactcttcccttctccagcttgttcttg

SEQ ID NO: 6842803 - DNA, 103 bp, Homo sapiens
acttggctacatcctcccaatactattcggaccatctctgggtacggatacagagaagtctcaagaatatattactaagggcaaaaatcagggtgtggaaggt

SEQ ID NO: 6842804 - DNA, 87 bp, Homo sapiens
gctccttagaactcctgctctttattttctggtatcccaattgaacagactggtgggagctggagagtacagagtttattaagctgc

SEQ ID NO: 6842805 - DNA, 82 bp, Homo sapiens
gtaacagggactactcagttatcacattcagagccctgctccttaagaactctgagaactccgggttagatccttaagttac

SEQ ID NO: 6842806 - DNA, 60 bp, Homo sapiens
ctgagtcttctcttcttctagaggcctaggctgctggtccagtaagggtggagagaccag

SEQ ID NO: 6842807 - DNA, 68 bp, Homo sapiens
atctaggttatttccagtttgtccttctggtgtcagctcacatgtacactactggtgaaagcctagat

SEQ ID NO: 6842808 - DNA, 91 bp, Homo sapiens
gcatttttacacattgtgggcattactgtatgaattatgttatttagagctctgcaacatagttacttcatatagctttgtgtagaaaagc

SEQ ID NO: 6842809 - DNA, 66 bp, Homo sapiens
gaatgcaggaatgcacatgccttcgatacacaaaccaaaaatgatacaatgtgcaattttgtattt

SEQ ID NO: 6842810 - DNA, 59 bp, Homo sapiens
gaataaacaagtagtagagctggtgtttgaatccaggtttagttctaccacttgcattc

SEQ ID NO: 6842811 - DNA, 66 bp, Homo sapiens
tgtagagtaattcatggcatttaaatgttgacatcaatacttactgagtgctaagaataatctgca

SEQ ID NO: 6842812 - DNA, 87 bp, Homo sapiens
aggagaatttgtgtttttataaccaagttctgcttgttacattttaagagtgacaagcaggttttgttgtggattagcaggactcct

SEQ ID NO: 6842813 - DNA, 58 bp, Homo sapiens
gctctcaccatggctggcagtgtgcggggacttcgcagccacctcccatggcgggggc

SEQ ID NO: 6842814 - DNA, 57 bp, Homo sapiens
tgagcggagccgcggccgtcctggcattttaaaggcgaggcagctggacgctgttca

SEQ ID NO: 6842815 - DNA, 71 bp, Homo sapiens
ttccagtgcttgcctttcccatgtctaggagtttgcctaaatcttcaaagatatgtgaggcttgcctagaa

SEQ ID NO: 6842816 - DNA, 95 bp, Homo sapiens
gtaaggcactgagctagccaatgagggaaaaagacatgtgatagacatcggtttgcactttatttcctctcacacgtctgtcgtcagtgccttat

SEQ ID NO: 6842817 - DNA, 73 bp, Homo sapiens
gtggagaaacagacttggtagccttggagtcaggactgaggactgactctgccatcccaggtgctgtggctac

SEQ ID NO: 6842818 - DNA, 82 bp, Homo sapiens
ggctccacacaagacttgttttggctagtatgatgtcttcagacacaatacagggctcaaaatatgcttgtatggtggagct

SEQ ID NO: 6842819 - DNA, 125 bp, Homo sapiens
gagagaattttaagaaataaccagagaatgtaaatttgcttaaactttgaccttagaaaaaattactttttggttagagagctgagaaagtttacagtcactaaaataattttagactcttcctc

SEQ ID NO: 6842820 - DNA, 92 bp, Homo sapiens
tccacctgggtagcagcactggcctggcagggagggcatggccagtctcactcctttagaccctgccaggcctctgggcagaactcagtgga

SEQ ID NO: 6842821 - DNA, 65 bp, Homo sapiens
aacataaacaatgtcgtaacttagttttccctcagtgaagatataggaccgacttgtttatagtt

SEQ ID NO: 6842822 - DNA, 101 bp, Homo sapiens
gtgtactctgttctctgagtgtattggagctgttggctgtaaagcctgagtttgcattctttacaccaagcagatctttcactggagacaaaagaagacac

SEQ ID NO: 6842823 - DNA, 82 bp, Homo sapiens
atgaatggtgctgtctggaatgcagtacatagtctgcatgcaaccctgtgtgctaaacatattagatttgtaaagtgttcat

SEQ ID NO: 6842824 - DNA, 68 bp, Homo sapiens
tatcaaagtgatttgtaaacagggaaatgcaaatattatacagaagagccctgtgaattggtttgata

SEQ ID NO: 6842825 - DNA, 64 bp, Homo sapiens
tagaggctgacattgaaaaagttgaggccttttaaacaaaggagtatctcagtgtcagctcctg

SEQ ID NO: 6842826 - DNA, 74 bp, Homo sapiens
gatatggaaagataagcaggctatgggcatgaggattatgaggagctctgtctaaacttgttttatctcatatt

SEQ ID NO: 6842827 - DNA, 79 bp, Homo sapiens
gcccattgtgatgctctctggctagtccatcggggtctacatgaaagaacccgagtatctccagggagtttctgtgggc

SEQ ID NO: 6842828 - DNA, 82 bp, Homo sapiens
gtttgcatgggaggtgagaaggcaacctgtgtgtttttatcattacactgtcccctgtgctttcacttgcttccatgcaaac

SEQ ID NO: 6842829 - DNA, 128 bp, Homo sapiens
cattagtaaggagcaatcagaaatcagatccaagaaagactgtatctctattcagttctaagtcagagagctagcaggaagcagtttagttttgctttgtttggtttgttttaatgtggtttctagtg

SEQ ID NO: 6842830 - DNA, 129 bp, Homo sapiens
agctgctataaacatttgtgtttaggtttttgtgtggatatagtttcaactcaattgggtaaatacttaggagtgcataaaactatatttggcttgtaaaaaactgtcaaattctcttttattgtggct

SEQ ID NO: 6842831 - DNA, 68 bp, Homo sapiens
gctcaacagagttatctgagttcactcagctagaagtggctgagctgggagtagagactctggagagt

SEQ ID NO: 6842832 - DNA, 108 bp, Homo sapiens
cttgtaaaaattattcaacatatacagaaatttaaaaagcagcattgcaggttatgtgagattatgtatgtctgctctttggaactaggttgaaatgatagctacaag

SEQ ID NO: 6842833 - DNA, 61 bp, Homo sapiens
tgttcccctcaaatatttgttggagattattctgctagggaagaacgagggaattagaaca

SEQ ID NO: 6842834 - DNA, 76 bp, Homo sapiens
attgcgtggctggtccctgtgaccctgttaagccttatgttttacttaactcggaagcacgaaccaaccacccagt

SEQ ID NO: 6842835 - DNA, 72 bp, Homo sapiens
gggaaaattacccagggattaccatgtgaaaattacatcacagaaaatagttaactcttggtaataggtccc

SEQ ID NO: 6842836 - DNA, 57 bp, Homo sapiens
tgtattagattgtacagacatctttcaagagggaagcatttctgtttatctatcgca

SEQ ID NO: 6842837 - DNA, 84 bp, Homo sapiens
gctgcaagatgaagtttcagcctttattacatgatttgatttcattgagatccatggagataaactgaaatatttagtgacagt

SEQ ID NO: 6842838 - DNA, 78 bp, Homo sapiens
ctggctgacttgatggtttttaaaattccactgacatctcagtgatggggaatttcaaaagccagaacggggtgtcag

SEQ ID NO: 6842839 - DNA, 63 bp, Homo sapiens
gcttttcttactcccgcaaggcaaggtttggcagagctctgtaaagtcgggagtcaggaatgt

SEQ ID NO: 6842840 - DNA, 59 bp, Homo sapiens
ggtggggtattgggtacttgtactgtgaaggtacagaagagtacctttagtatgttacc

SEQ ID NO: 6842841 - DNA, 79 bp, Homo sapiens
ggaaacgggagctgttgcgcatgcgctcggacgctggcccgttccggggcacgggcgcacgcgcgctcctggagtttcc

SEQ ID NO: 6842842 - DNA, 81 bp, Homo sapiens
tccctccctactcatttttcttaagctgtaaagcagaatagcttgttctgtatttagtttgaggacaatttgggcatggga

SEQ ID NO: 6842843 - DNA, 56 bp, Homo sapiens
taaaagagaatggataacagagtaactttctgactgtgttattcagtctcatttta

SEQ ID NO: 6842844 - DNA, 59 bp, Homo sapiens
ttcattcaacaagtagtacacacagtatctactgtgtgtcaggcacagttgctgatggg

SEQ ID NO: 6842845 - DNA, 77 bp, Homo sapiens
tccaaagaagaatagtctctgatgtcaaggagtttccatctagctgggaattctcagggagtattttctatccagga

SEQ ID NO: 6842846 - DNA, 55 bp, Homo sapiens
tactgagtaccaagcattgtgttgaaactggaaacataaatacgggttttcagta

SEQ ID NO: 6842847 - DNA, 60 bp, Homo sapiens
ccaggggaacagattagcagagacatctcataggactgggaggtgcttctgtattgctgg

SEQ ID NO: 6842848 - DNA, 89 bp, Homo sapiens
tgagatttttatgcatctctgaaatgcagttatcttttcttacaacaaatgaaagctgaagataggcatttcagcatgccaagacctca

SEQ ID NO: 6842849 - DNA, 85 bp, Homo sapiens
tcctgggctttacagcacatgggatctgtttacatgtggtctccgcagactcgtgtcaagatcctaagtcagtgaatcccgaggg

SEQ ID NO: 6842850 - DNA, 60 bp, Homo sapiens
aaagggtctgtggcttgaacatgttggaaagtcttgctttaaagctccagcagatccttt

SEQ ID NO: 6842851 - DNA, 67 bp, Homo sapiens
atggctctctagggcccaggttttctgtcaagcattcactagctagcttgggggcctggggaatcat

SEQ ID NO: 6842852 - DNA, 61 bp, Homo sapiens
gggctgggcctctccctcagctgtgtgggccaaggcctcggcccagggggaggctgagccc

SEQ ID NO: 6842853 - DNA, 78 bp, Homo sapiens
tgaatacagatgaaatactaagctagccgatgaatcttttagaaaatggaattagcaacggtatgcaatctgtcttta

SEQ ID NO: 6842854 - DNA, 71 bp, Homo sapiens
aaagtattgggacttagtgaagacttactccctacttccctagtgaaatcttcactaagtctcttcgcttt

SEQ ID NO: 6842855 - DNA, 69 bp, Homo sapiens
gcaggaaaggacatggaaggaggagatagccaaaccaatcaagtttctcccctctgagagtcccattgc

SEQ ID NO: 6842856 - DNA, 88 bp, Homo sapiens
gcctctgatcttggtaatgtgtttgtcctgcagaaataggagctctatcctgcactaaacacacacttggtccaggagtcagggaagc

SEQ ID NO: 6842857 - DNA, 61 bp, Homo sapiens
tgtaaataagtgtgggaatgtatatgaatttatatagatcttttcactacatatgtttgca

SEQ ID NO: 6842858 - DNA, 58 bp, Homo sapiens
gccagcttctccttatgtcctcatactgtctttccttggtccatataggggagcaggc

SEQ ID NO: 6842859 - DNA, 74 bp, Homo sapiens
gagggacgggcacctttttcttaatattcatcataatcacttggtacttattatgagccaggtgctgtctactt

SEQ ID NO: 6842860 - DNA, 105 bp, Homo sapiens
gaaggattctgttaaatcagtctagatctgtttgtaacaatgccagtgacctgttctgtagatgtcttcaaactgatttctgaatgatttattacagtgtctttt

SEQ ID NO: 6842861 - DNA, 61 bp, Homo sapiens
ctatgttctgctgagttggaatgtcagttttcctggagtttatgcagcatgtagaacatgg

SEQ ID NO: 6842862 - DNA, 89 bp, Homo sapiens
ggagtttcactcttgttgctcaggctggcgtgcaatggcatgatctcggctcactgcaacctccgcctcctgggttcaagcagttctcc

SEQ ID NO: 6842863 - DNA, 65 bp, Homo sapiens
agcaagaaaatagctatggaatgtcacttctcttgtggaagttacaagctattttacttaatgct

SEQ ID NO: 6842864 - DNA, 74 bp, Homo sapiens
ttcaagtcaactcaaattgttatcctcatgtttatagttgaagaaacaggctagatgaagttgagtgatttgag

SEQ ID NO: 6842865 - DNA, 101 bp, Homo sapiens
tgaggcaggagaatcatttgaacccaggaggtagaggttgcagtgagctgagattgcatcgctgcaccccagcctgggtaacaaaatgagactctgtctca

SEQ ID NO: 6842866 - DNA, 81 bp, Homo sapiens
gttggtgaacttggtgtcatgccaggagtgaggactccagcccagctcactcctggaaaagaacgcagggggctcaaagac

SEQ ID NO: 6842867 - DNA, 102 bp, Homo sapiens
gattgtgatgatggtttcacaggtgtacatagatgtacatacatatgtaaaaacttaaatatgtacaatttgttgtatgtctataaagccgtaaaaatgatc

SEQ ID NO: 6842868 - DNA, 88 bp, Homo sapiens
cttctcaagctcagaatcagcccttgctattaacatctccttcaaggatcattagaggctcccaagggccaatgggactgggtggaag

SEQ ID NO: 6842869 - DNA, 66 bp, Homo sapiens
tgatcttaattacccaatgtggtaggcatggtcttgttgtgattaagattgtggtgattacagtca

SEQ ID NO: 6842870 - DNA, 70 bp, Homo sapiens
gttccctgggtctccggcagcctcgggcctctcggaagccgcttgccagaagaccggggagtcagggagc

SEQ ID NO: 6842871 - DNA, 86 bp, Homo sapiens
ttcctacttaaatcagggcaggttaacttgggtgacatatgcaaggacatgtaaccagtaccctgaccttccttcttaaggaggaa

SEQ ID NO: 6842872 - DNA, 63 bp, Homo sapiens
tggtcatattaccccacttctcgcaatctgttcttgcatctgtaaaatggggtagtgttacca

SEQ ID NO: 6842873 - DNA, 69 bp, Homo sapiens
gaacctaggtttagggtacatgtttttctctgtttcatgaacttacagtgtggtttgagcactgggttc

SEQ ID NO: 6842874 - DNA, 66 bp, Homo sapiens
gaatgggcaatagttgctaacttccattttggtaactctaagttatggaagtgcaacttgctcatc

SEQ ID NO: 6842875 - DNA, 79 bp, Homo sapiens
gagccaccagccactcctcccaggcttcccttcctcccagtgcgggaggatgacagcaagggggtgaaggcaggggctc

SEQ ID NO: 6842876 - DNA, 58 bp, Homo sapiens
tatgtaacctgaggttcaaaaggttaagttgctttgtcaagctctgtcaggctacata

SEQ ID NO: 6842877 - DNA, 81 bp, Homo sapiens
ggagagcaagggtgggggacgcaggggcgagggggatccccactcccacgcaccccactgtccctcaaccaaaacgctccc

SEQ ID NO: 6842878 - DNA, 75 bp, Homo sapiens
agggcctggaatgcctccctgtcagagaccatgagtaccctggctccctgcccatttggggcatcccagtgctct

SEQ ID NO: 6842879 - DNA, 60 bp, Homo sapiens
gccaccaggagcccagtccaaatgtcacctgcccaccacacacagcgggcttcctgtggt

SEQ ID NO: 6842880 - DNA, 65 bp, Homo sapiens
taggtttcttctcaaagtctttaaatagaactccagctaagtagttcctaagggctttgaactta

SEQ ID NO: 6842881 - DNA, 58 bp, Homo sapiens
tgcacttcaaaaatgtcactgagaattctcaaataagaaatgacatttccagagtgta

SEQ ID NO: 6842882 - DNA, 57 bp, Homo sapiens
agttcagcaaataaaacatagttcagagtcgagttatgtggtaaaaatgcatgaact

SEQ ID NO: 6842883 - DNA, 59 bp, Homo sapiens
gggaacagccagggcattgtcgccgagccgggaggctctgtgtgttccgtggctttccc

SEQ ID NO: 6842884 - DNA, 114 bp, Homo sapiens
gcaggatttctatgaatattcattactgcacgtgggacatatatattttatcagatctgggcttaaacatagaggtacctttgtgcagaaagaataattcaacatggactctgc

SEQ ID NO: 6842885 - DNA, 111 bp, Homo sapiens
ttaaaaatagtctgatttgagggcacagatttcaggtaggaatgattattctcaagtagtagagagttaatgaacatcttaatctgaaaagcagtgtcagaaaatttttaa

SEQ ID NO: 6842886 - DNA, 56 bp, Homo sapiens
atgaggtcatcctggagtaaggtgggctcttattccagtatgtctggtgtccttat

SEQ ID NO: 6842887 - DNA, 100 bp, Homo sapiens
tctggtattacttaactgagttagtatgttctgtaagtataacttgggtcaacactgtacctacagagacatcactgaagtgggaaagttgaagcacaga

SEQ ID NO: 6842888 - DNA, 63 bp, Homo sapiens
ccaggttttttgaatcttcctatagggatggagattttctttggggactgttagagaaaatgg

SEQ ID NO: 6842889 - DNA, 80 bp, Homo sapiens
taggatgccatttatcactgttcagactaaaaaaaatctagaggcaagttagtctgtggcatgaggaaataggcactcta

SEQ ID NO: 6842890 - DNA, 79 bp, Homo sapiens
tgattctgtcgtcagattttgacatctgttaactggttttatagaacagaacagtttttaaagctggcttcagagatca

SEQ ID NO: 6842891 - DNA, 65 bp, Homo sapiens
cagaactctgccctgcatttctgtttcttgcttctgaatgcagttatgtgagggcatgatttctg

SEQ ID NO: 6842892 - DNA, 99 bp, Homo sapiens
ctcgcggccgcagaccccctctccactgcagccccgcaggcagcctctccggcgtgggcttcaccgcggggttgcaggggggccaagatgaggcgcggg

SEQ ID NO: 6842893 - DNA, 102 bp, Homo sapiens
gcaggagacagcaacgccaggggccgggacctctgtcccagagaccctccgcgcccagtctgtggtgggacagtgtgccttgctcctgtgtgttctccctgc

SEQ ID NO: 6842894 - DNA, 56 bp, Homo sapiens
agggcaggaggtccgtcccttcagaatctccctgtcaggacacggctttctgccct

SEQ ID NO: 6842895 - DNA, 59 bp, Homo sapiens
gagagggtgggatgaggaggaagagaaaggtcttgaacgtttattcagcctaccctctt

SEQ ID NO: 6842896 - DNA, 79 bp, Homo sapiens
atgtttgttatattagttagacttgctgtgcagcagtaaaccaaattgccacatttctaatttaatgtaacaaagacat

SEQ ID NO: 6842897 - DNA, 55 bp, Homo sapiens
tcttctggatcgatcacattgttctaaatgaatgatgctgtcagagtcctgaaga

SEQ ID NO: 6842898 - DNA, 83 bp, Homo sapiens
gcgggaggctccgcggctgcgcgggcgcgtgctggtggcctcggcggaggctcagtcccggcccgcgcccgcggcgcccccgc

SEQ ID NO: 6842899 - DNA, 60 bp, Homo sapiens
ttgatgctgactgaccaaaaggatagattctgctggctatttactgtctctcagcttcaa

SEQ ID NO: 6842900 - DNA, 129 bp, Homo sapiens
ctaaaactctgatagaaatcacaaaacattcaagcaaaagggcaaggtcttccaggagcctaggagcagacttttggctacaaagagcctagtccaggctgaatgccttatggagtatgtcagtcttgg

SEQ ID NO: 6842901 - DNA, 60 bp, Homo sapiens
ccaggttcaaaagtggcctgtaaaatcttgtttacaagagattctatgttttgagcttgg

SEQ ID NO: 6842902 - DNA, 92 bp, Homo sapiens
atgtcttgttctggcattatactttttcaaaatgtattcactgacttaatctcattggaaggtgtatactgagaaatgtcagcccgttatat

SEQ ID NO: 6842903 - DNA, 66 bp, Homo sapiens
cttgaacccgggaggtggaggttatggtgaactgagattgcgccattacactccagccagggcaag

SEQ ID NO: 6842904 - DNA, 110 bp, Homo sapiens
agggtttgggcctggaggatgctgtcctgatgtccccttagctgagccttaaatctcccacaacggtccagaatgaggcacatccaggccagctcctgtggccaaaccct

SEQ ID NO: 6842905 - DNA, 83 bp, Homo sapiens
gtgactctgtcctggataagtctgcacaactgcaaataaatgtgttggaaaagaattaactagggcgtgatacccagagtcat

SEQ ID NO: 6842906 - DNA, 85 bp, Homo sapiens
caggtaactaaagcattactagactggattttggagtttgagtagaaagataacagaatttagcttgtatgaatgcttttatgtg

SEQ ID NO: 6842907 - DNA, 74 bp, Homo sapiens
cttcccatccttggaaatttgaagacttttctgctggctggtagagaatcctctacatgtttttttgggggaag

SEQ ID NO: 6842908 - DNA, 95 bp, Homo sapiens
gattaaagcagtaattccaatgcgggtgggggttcagattcagaaatactggaaagctttgttttcctcaccctgtgtcttggaaccgccggatc

SEQ ID NO: 6842909 - DNA, 84 bp, Homo sapiens
atcaattacatttccacaaataccagtttcctaacaaaaccaaaggtatgttaaatgagattggaatttggctaatgcattggt

SEQ ID NO: 6842910 - DNA, 84 bp, Homo sapiens
agctcagaactgcagggtggagcggaagcggagacaatgctgactgttctctgtcatctcacctccaatccctgcccctgtgct

SEQ ID NO: 6842911 - DNA, 61 bp, Homo sapiens
gacagctggcagtggaaaggtggccaggaggtttatatgttcctttcctgcaggtactgtc

SEQ ID NO: 6842912 - DNA, 55 bp, Homo sapiens
tgctatcaccaactctgctaagtgatcaagtttcatggcacatgtaatgatagca

SEQ ID NO: 6842913 - DNA, 72 bp, Homo sapiens
gctggcctgaactctggacccacatcacacttccaagaaggaagctagagtggcccctagggaacagcctgt

SEQ ID NO: 6842914 - DNA, 65 bp, Homo sapiens
gaggcatcccttgatgtcctgctctagggaggagaagggtgaggagtggctgtcaagggggcctt

SEQ ID NO: 6842915 - DNA, 69 bp, Homo sapiens
ctctaagtgtcagttaggcatttgccttaattttgaataaaatgaaaaatgtctaatttattttgggag

SEQ ID NO: 6842916 - DNA, 71 bp, Homo sapiens
attataatccacagaaggaacttgaaaggacgcccaagtgtctttaatgtattctttggaaccattatagt

SEQ ID NO: 6842917 - DNA, 75 bp, Homo sapiens
ttccaggaaacagcatctcagcatctccaggctgagacgggccccaggtcgtgactgagagctgaattcctggaa

SEQ ID NO: 6842918 - DNA, 118 bp, Homo sapiens
ggaatgttgtaatagcacttggatcggcttcagtaattccatgtccagaaatttctgatgcatctggtgtcaaattattgagtttcatctccaagaagtcgtgctattaaaaatctcc

SEQ ID NO: 6842919 - DNA, 57 bp, Homo sapiens
gcttctgtctgtaaacttctcaattgtttgatacgatttaagtactgtagacagagc

SEQ ID NO: 6842920 - DNA, 125 bp, Homo sapiens
ataggaaaactgtggttagaaaaataggaggaaagggaggaaatattgtgttgagcatcatctctccatgcttatacaccctcttcccaggcctcttgtgtatttcttttaatggttttcactat

SEQ ID NO: 6842921 - DNA, 89 bp, Homo sapiens
cagataatttttcttcatattccttgcacatcagatagttgctgaattggcgaaactagtaaagaatatcctaattagagaagtgtctg

SEQ ID NO: 6842922 - DNA, 74 bp, Homo sapiens
actggcccagctcactgcagccttggacacatatattggcaatggctgtttataatatgcagtgagcagccggt

SEQ ID NO: 6842923 - DNA, 106 bp, Homo sapiens
aaggtggctaccttggattcccagtctcattggtggttttcaaggtctctgatgaagatcttggaagcctcaagatactctttggaagggaatctctcaacacctt

SEQ ID NO: 6842924 - DNA, 55 bp, Homo sapiens
atgagttgaagctacaagaggcacaagacagaaagtgcctatgtcttcaaatcat

SEQ ID NO: 6842925 - DNA, 77 bp, Homo sapiens
ccagctggcacacctgcccccagagaaagactgatcctactgtgccgtcaagctctcaggcactgggtgccaactgg

SEQ ID NO: 6842926 - DNA, 80 bp, Homo sapiens
gaggagagccaaaaggactgatgctgagtaccttccttattctgatatgaagtatttatgcacttaattttttaatcctc

SEQ ID NO: 6842927 - DNA, 78 bp, Homo sapiens
ctgcatccttttctgtgcagtgagcagctgacgtggtgtgccagctctcattgtataggcttttatcacaggaagtag

SEQ ID NO: 6842928 - DNA, 67 bp, Homo sapiens
tgcctttggtattttacaatgtcagtgagctttaaagagcttttaaacaaataggattgcctaggca

SEQ ID NO: 6842929 - DNA, 72 bp, Homo sapiens
ggacttcttatggctgtagtctggaagtgatgcatataattgccattcacagttcattagctgtaagtagcc

SEQ ID NO: 6842930 - DNA, 82 bp, Homo sapiens
gatgacattatgtgtgtttcagaagccaggtgtaaagagcacttttccatacattttatatctgagttaccaatgcctcatc

SEQ ID NO: 6842931 - DNA, 60 bp, Homo sapiens
gtggcgcagagggtggcagagaggtccccggtgccatcactgttatctcactctggctgc

SEQ ID NO: 6842932 - DNA, 65 bp, Homo sapiens
tgtgcagcactagtgcagggcctgcagcactgtgtccttgctggcccagtactaatgtctgcata

SEQ ID NO: 6842933 - DNA, 71 bp, Homo sapiens
gatttatcatctgttatttatgcctgagtctgaataaaagatttgagagcagattttgatagaagaaaatc

SEQ ID NO: 6842934 - DNA, 88 bp, Homo sapiens
ttatggtaagcagcagctcactgaataatgacttccattgagtaaacatttggctctggttatcttcagggatgctgttggctcatga

SEQ ID NO: 6842935 - DNA, 62 bp, Homo sapiens
catatgcatgtatattcacatgtgtatgtatgtatgtatgtgtatacctatacatgtgtgtg

SEQ ID NO: 6842936 - DNA, 55 bp, Homo sapiens
ttggtagatctcagctcaggattcacgcataccatgtagtcctggagatcaccaa

SEQ ID NO: 6842937 - DNA, 80 bp, Homo sapiens
aggcaatggggagaggttgtaaatattaaactgtaatacccttgtccctgttatgcttccaatattctccctttttgcct

SEQ ID NO: 6842938 - DNA, 82 bp, Homo sapiens
ttgaagtaaggacaatgaagacagccacaaaagctttctggaattaccaaatgcatgtccctttctgtattgtctttgtcag

SEQ ID NO: 6842939 - DNA, 113 bp, Homo sapiens
tagcatgaacttaataataggtaacagaagatactgttagtaaaaggtacttaatagtaaagggtacctcatagtaaaaggtactgttgcttaacagtaagttggtctagctg

SEQ ID NO: 6842940 - DNA, 92 bp, Homo sapiens
tttcaaaaaatgtctttttcagaattagcataccattgggtcgtgacttcaaatgccagtgtgttgattccaggtggtgatatttcaggaga

SEQ ID NO: 6842941 - DNA, 71 bp, Homo sapiens
cactgacatcaacatgattatgaagcttccaatatggcacatggttcattgtggatgcttaaatatcggtg

SEQ ID NO: 6842942 - DNA, 60 bp, Homo sapiens
aggtacgcatgcccgcctgcactaacccccagaggtctgtgtatagggttgtgcgctcct

SEQ ID NO: 6842943 - DNA, 56 bp, Homo sapiens
gagaggccggcgtcgctgcggcgttcccagccagccctcggcggcgcccgcctttc

SEQ ID NO: 6842944 - DNA, 58 bp, Homo sapiens
agtaacatatagcacttttggaacaatgtatggaatacagtcggtgttgtgtgttact

SEQ ID NO: 6842945 - DNA, 55 bp, Homo sapiens
gaatatttcttctcaacagggtgacagccactgttactaagagaagtaaatattt

SEQ ID NO: 6842946 - DNA, 129 bp, Homo sapiens
ggtcctgaactctcacttgtgttctattgatctcattatccatcactgcactgagatgaactcagtgcagtgatgaataatggtttagaaattgtcatctagcttacttttgaggagttcaaaatgatc

SEQ ID NO: 6842947 - DNA, 65 bp, Homo sapiens
gggcagccaacccacaggttgcccaatgatgtatgtgtggctagacctgaaatgggggcctgtcc

SEQ ID NO: 6842948 - DNA, 86 bp, Homo sapiens
gctgactaggccaaggttagaaaaggtactttccagaagttcaccatcccaggcagactcaaggtgcctggctttgccttctcagc

SEQ ID NO: 6842949 - DNA, 64 bp, Homo sapiens
gctggagagtcagacatgggtttcaggcctggccctgacacttattagctgtgtgaccttgggc

SEQ ID NO: 6842950 - DNA, 77 bp, Homo sapiens
ggttcttggccaaattcagttccatgccatccttgtgttgaagtctccatttccttactggctggtggctaagaatc

SEQ ID NO: 6842951 - DNA, 58 bp, Homo sapiens
cttggctaggaaagagccactgtttttaaatgagaaagcagggagattcttagctgag

SEQ ID NO: 6842952 - DNA, 57 bp, Homo sapiens
agcagctattgccaggcatgagcaaaacacagactcatgtgcagcaagcagcatgct

SEQ ID NO: 6842953 - DNA, 69 bp, Homo sapiens
tgcctgaggatggtgaaagtaatttgtatgtgtgtatacataatcctgctttttcactatttccagtca

SEQ ID NO: 6842954 - DNA, 85 bp, Homo sapiens
tggcgttataatctgtcgtagtaaaaagcagagaagtaaatacaatcctgctctccaaatatgacaagctgattataacaagcca

SEQ ID NO: 6842955 - DNA, 73 bp, Homo sapiens
tcacaggccagtaagactgtgttcatgccaaacacaacagtggaataggcgaaacctggtttcctgcccttga

SEQ ID NO: 6842956 - DNA, 60 bp, Homo sapiens
ttggcttctcttaaccctaaagtctacagtacttagattggggattaaattggaagtgaa

SEQ ID NO: 6842957 - DNA, 66 bp, Homo sapiens
tctctcttcatgcttttagaatagcctaagattgacctaggggatgaaagaccacatggagagaga

SEQ ID NO: 6842958 - DNA, 65 bp, Homo sapiens
cagggggattttatgggctcacatttggaaggcattttgaaggtcatccaggccatgaacctctg

SEQ ID NO: 6842959 - DNA, 65 bp, Homo sapiens
ccccacagtccgtgaggagccatgagatcttgcttggagggcctcttacatggactgctctgggg

SEQ ID NO: 6842960 - DNA, 129 bp, Homo sapiens
aagcccagacctgcaggccctgaggagacaagggagctatagattattttgtgagacctgcatttcaataggcagcatttcacaggccttttgtagccctgcttatcttagaaactttgtgtgcggctt

SEQ ID NO: 6842961 - DNA, 59 bp, Homo sapiens
gcctgtggccgactgagagcctttatgggagagttcgtgggcagtctggtggctatggc

SEQ ID NO: 6842962 - DNA, 86 bp, Homo sapiens
gtctattaggtagcttggcagccctttcactgggacaactgctcactgaagactgggctctaaaaattacattgctgctttgagac

SEQ ID NO: 6842963 - DNA, 73 bp, Homo sapiens
catactgtttggtcctaatgaagtgtattaaatcatttacgatgtgtcaggttgggtaggattcagcagtgtg

SEQ ID NO: 6842964 - DNA, 60 bp, Homo sapiens
gtcatattgtgtgatgagtataataccactgaggcatagactggaaacacacagtgtgat

SEQ ID NO: 6842965 - DNA, 66 bp, Homo sapiens
tctaaggatgttatctgtgcaggtgggactgaattggtttcttgccactaataaatattcttaaga

SEQ ID NO: 6842966 - DNA, 58 bp, Homo sapiens
agtgctaggtgtgaactgtgtgaatgcttttgaatatcactaagttacatttagtatt

SEQ ID NO: 6842967 - DNA, 77 bp, Homo sapiens
ggaaatgggaattattagatctgttagggatcctgtaagaaaaggcacaggacttggagttctaatattctgttttc

SEQ ID NO: 6842968 - DNA, 94 bp, Homo sapiens
catttgggtctggataaaatacaatagggcttttgtttatgtttgttttcaatccataaacaatagtctattaagttttaatgtatcccacatg

SEQ ID NO: 6842969 - DNA, 65 bp, Homo sapiens
gtttgataaattggttggactagagatgttctgaacatcatcatgaacaactaatcctatcaaac

SEQ ID NO: 6842970 - DNA, 94 bp, Homo sapiens
gtggaagctcattaccagtaacgttttcgaggactttaaaaccaacttttctgtgctgagctgtctggaagttcctcatgataccggtgaccac

SEQ ID NO: 6842971 - DNA, 93 bp, Homo sapiens
agtgatatgaactggtctgccacaagatttttgagatactggaaataaggtttttgaaaacatttatggcaattagagtaagtttatgttgct

SEQ ID NO: 6842972 - DNA, 64 bp, Homo sapiens
aaatgatggaaatgaggctgaatctgtggaaaatcaggttttagctaatcagtttcagccattt

SEQ ID NO: 6842973 - DNA, 72 bp, Homo sapiens
ctgtttttgtgagaatcaatgaaatattatgcttgatgttactgtgatcatgatactatctgacaagggcag

SEQ ID NO: 6842974 - DNA, 60 bp, Homo sapiens
gggaaagaagatctagatactgttttgttgttttaatgatgatctagaaacttctctcct

SEQ ID NO: 6842975 - DNA, 65 bp, Homo sapiens
gttcctagtggtctctgagcctggagcaggacccctgacgctgcccaggccaggcctacggggat

SEQ ID NO: 6842976 - DNA, 70 bp, Homo sapiens
gtgaatagagcagccaagataggtatacaggaaatgcaaatgtaatacacaagggccagctcttgttcac

SEQ ID NO: 6842977 - DNA, 57 bp, Homo sapiens
ttagagtggtccttggagcccttttatacaagtatgggcttctcagggcttctctga

SEQ ID NO: 6842978 - DNA, 67 bp, Homo sapiens
aaaacatcttctcttgattctttcttagcataactgagataggctggagagttcaaggaagtgtttt

SEQ ID NO: 6842979 - DNA, 55 bp, Homo sapiens
gctgctccagtgttctgtctagaaagcaacttctggacaggatagtgcagtacgc

SEQ ID NO: 6842980 - DNA, 92 bp, Homo sapiens
taagaaagaaaaattcaccagtcttctgggtgtttccagaggaatatttgatgtcctctggacacccagaggtctaggattttgcattttta

SEQ ID NO: 6842981 - DNA, 58 bp, Homo sapiens
agcagaaattaagtaagtaaggggtaaatttttcctaaattatatacttggtttctct

SEQ ID NO: 6842982 - DNA, 78 bp, Homo sapiens
gtgcaatgtctgggtcacagccagagaaagggcactgccagaggcatgtttattgctcttgctggccaaacattccat

SEQ ID NO: 6842983 - DNA, 55 bp, Homo sapiens
tccaggacagagtagaagcagctaggcacttggtgactctctcagatgttctgga

SEQ ID NO: 6842984 - DNA, 56 bp, Homo sapiens
ggctgacatcagctttgggccagctgtgggctggctcatctagaatggtttcagct

SEQ ID NO: 6842985 - DNA, 77 bp, Homo sapiens
gcatggagaatagtatgttgtggtaaataattagaaagtgataagttttgagtatttatgacatttgtttttaatgc

SEQ ID NO: 6842986 - DNA, 95 bp, Homo sapiens
gcttttgctgcttaacaaaccattgccaacagccatttgttgagcatgtgattccactggtcagcaatttggactgggctcaggtgggcgcctgc

SEQ ID NO: 6842987 - DNA, 57 bp, Homo sapiens
ttagatgtgcaggaataggcattctgcctgcttttaaatgtctagctgcacagctga

SEQ ID NO: 6842988 - DNA, 99 bp, Homo sapiens
tctttatagcagtgccccactcctcagtatcaacttcctgtattagttcattctcacgctgctatacagagacacttgagactgggtaatttataaaga

SEQ ID NO: 6842989 - DNA, 61 bp, Homo sapiens
gggcttcaggagggtcagcccaggccaagctactgtatttgggttgttcccatccaggccc

SEQ ID NO: 6842990 - DNA, 102 bp, Homo sapiens
ctctggggtgagctgagtcagggagatagaggccatgagatttggggatacagcactcctccacccatcccgaacctctacttctttcagaacccccaagag

SEQ ID NO: 6842991 - DNA, 70 bp, Homo sapiens
tacggcaaatactgttcttgacttttactgtatcgagtgagaactgtaaggcttagaacagcatgtggtg

SEQ ID NO: 6842992 - DNA, 56 bp, Homo sapiens
agcatgtaaagctcttagcaccaagcttggtgtatggtgtgtgctccatgcatgct

SEQ ID NO: 6842993 - DNA, 103 bp, Homo sapiens
ggaacagcagcctaatatttcatactttcttatgtctctttcttttagccaaatgcagaggaaccactctgagaagccaccggatgttaggagcctgtgttcc

SEQ ID NO: 6842994 - DNA, 103 bp, Homo sapiens
catatgcttaattcttattgttgatgttattgcttttttacaaatcaaggacactcatgagaaagtaataaagtaatgaatagcaacagaaaagttagtcttg

SEQ ID NO: 6842995 - DNA, 55 bp, Homo sapiens
gggcactctcacctgaccacatgcccttgggggctggtctcagtgctgggttccc

SEQ ID NO: 6842996 - DNA, 67 bp, Homo sapiens
tctgttcccaggagcatattacatgggctcagggcttagggcattagaatttctcctgggtaacaga

SEQ ID NO: 6842997 - DNA, 77 bp, Homo sapiens
tagaaggcagggtgccgacttcagggatgaggccaaggtgacatcctagctggggagttggcgctacctgctggtta

SEQ ID NO: 6842998 - DNA, 83 bp, Homo sapiens
atcactggggaagcaggacttacagtatcccagattgttttccctagtacattatgatacactgagtccttttctcatttgat

SEQ ID NO: 6842999 - DNA, 63 bp, Homo sapiens
taggaaggcctgtcactacttgatgtttgaatttagcctacgatgtagtcacaggcatttcta

SEQ ID NO: 6843000 - DNA, 70 bp, Homo sapiens
tcatgagagaagttcaggtcaggtccacaaatgtctgatatgtgcctttgaaagcctggcttttctctga

SEQ ID NO: 6843001 - DNA, 62 bp, Homo sapiens
tgtttgttaaaatattggagaaaggatatagaattccgtcctctctccctgtttggcaaata

SEQ ID NO: 6843002 - DNA, 84 bp, Homo sapiens
aataagatcattgaaatatattcagagatttagcctgaaaataactgagtcttgaggtcatcatctgaaacaatgtgccttatt

SEQ ID NO: 6843003 - DNA, 60 bp, Homo sapiens
gctgtcccatggttgcaagatgactgcagttctaggaattacatctgtaatccgggcagc

SEQ ID NO: 6843004 - DNA, 62 bp, Homo sapiens
cttgtatatgtatatgtgtacatatgtagatatttacatgcatggacatgtatatatgtggg

SEQ ID NO: 6843005 - DNA, 57 bp, Homo sapiens
tcattgaaagtgcctcctcggactggccaaaagcagttaggtaatgctcttcggtga

SEQ ID NO: 6843006 - DNA, 129 bp, Homo sapiens
agctgtgtccctttagcctcttacatcatcaccagcaataaagattttactgtcaggacttggctgacaaatttgcaggctctttattactggtgatgatggactataagaagcagaaaaaacacagct

SEQ ID NO: 6843007 - DNA, 99 bp, Homo sapiens
gaactttaaaaaatacagtgcctgggtcccagtccctagcttttgatctaattcatgtaggggtgggatccaggaattaccatgtattttaaaagcttc

SEQ ID NO: 6843008 - DNA, 129 bp, Homo sapiens
ggtgaagagaaggggtagggaaccacctgagggacttggagtgttaatgacaagtggcatagaatgtctacaacttagttgtctgggtcacatgtcacaaaacactgccatcaggacactctgcctgcc

SEQ ID NO: 6843009 - DNA, 59 bp, Homo sapiens
ccttgccttggtccttcgcaggaatgagccaccaggctgtggaggagaaggggtcaagg

SEQ ID NO: 6843010 - DNA, 64 bp, Homo sapiens
atgcctgctcttgaagcagaggaccacattcttcttctggatttgtcatctttagggcgagtat

SEQ ID NO: 6843011 - DNA, 70 bp, Homo sapiens
gctgggaaattgtatttctatttcaaagatgggacaccaaggctcagaaaaatgaagacaaagtcccagc

SEQ ID NO: 6843012 - DNA, 65 bp, Homo sapiens
ctacaacgtccaggagaaggccatccagcgctttttcagtggctatggccgcctcctcgaagtag

SEQ ID NO: 6843013 - DNA, 69 bp, Homo sapiens
tgactattgggtgatttgttatacagcagtagacaactgaaacagtagatataaatctctctttagtca

SEQ ID NO: 6843014 - DNA, 72 bp, Homo sapiens
gcttccttggtcctggtctaaggcctctcccacctcaccatactgagagaactaagaacaagactaggaagc

SEQ ID NO: 6843015 - DNA, 66 bp, Homo sapiens
tgcctaatatacacatatgcatatatgtgcatatatttatcaggtatgtatgtgtgtatatttaca

SEQ ID NO: 6843016 - DNA, 88 bp, Homo sapiens
gctcaaaataatccttatccaaagtggcatattatagggtagcatattctgatcttctataacagtgtggtttggagattgattgagt

SEQ ID NO: 6843017 - DNA, 73 bp, Homo sapiens
tcagaggtggccagagtcaagagccaggtttcattataattctcgagtggtcatggatagctggagcctttga

SEQ ID NO: 6843018 - DNA, 79 bp, Homo sapiens
gtagatcatgtattctgtctccaggaatgtgtcagtactgaacttatgaccctgtctggacatcctggagaatgactgc

SEQ ID NO: 6843019 - DNA, 90 bp, Homo sapiens
ctgacacataagtgctcaataaatgtttatagataacaaaattaaattatatttattgttattattgagcattgagattatgtgttccag

SEQ ID NO: 6843020 - DNA, 74 bp, Homo sapiens
gacacgaatgtggcatttgctgaatcttggagcagtagaatagttcttcatgtcagaaagctatatggtgtgtc

SEQ ID NO: 6843021 - DNA, 75 bp, Homo sapiens
ttgccaacttccttttaaaagttcatgtgggaattttgatttggaaattgctgaacttataaatgaatttggcaa

SEQ ID NO: 6843022 - DNA, 82 bp, Homo sapiens
ggcacatacctgtaatcccagctacttgtgaggctgaggcaggaggattgcttgagctaggaaggctgaggctgcagtggcc

SEQ ID NO: 6843023 - DNA, 86 bp, Homo sapiens
ttcagttccccattagagattatgaattcctaggtctgtatctctggactccactggctgggtcattttctttcataggtgctgag

SEQ ID NO: 6843024 - DNA, 66 bp, Homo sapiens
tgctggatggagtaaaactggagggcaaaacgagcaagagagcccttctccttcttgatccaagca

SEQ ID NO: 6843025 - DNA, 93 bp, Homo sapiens
tgccacttcttcccaaactactaggttttcctaaaattctggtttgtcatgggccagggtcctgaagaccaagttttgggcagaatgtgagca

SEQ ID NO: 6843026 - DNA, 81 bp, Homo sapiens
gaagtatcacttattttctatgagtctgctgaaattaagcttagcatccatccaggaaaattgagttattttaggtacttt

SEQ ID NO: 6843027 - DNA, 73 bp, Homo sapiens
ggggcagggatgctatctctctgggccctgacctggggcctcccaccatttagagagagcagctccccacccc

SEQ ID NO: 6843028 - DNA, 74 bp, Homo sapiens
ccttttccaacccaaaagcgtttccatttttttaatgctggaagtgtcttaactccttttggggtcttagaagg

SEQ ID NO: 6843029 - DNA, 71 bp, Homo sapiens
ggggccgctcaggaggtgctaggattggccggtgcagacgtggagctgcagtgttggacctcaggggtccc

SEQ ID NO: 6843030 - DNA, 84 bp, Homo sapiens
gcccagaaggcagcatggccatttctcgctgcttttttgtatggttgttagaggcagcgtggggctgagtcagctgctgtgggt

SEQ ID NO: 6843031 - DNA, 70 bp, Homo sapiens
gatcataaatgatatggtcacccttatgaatgactggtgatctttcataagggtggccatataaaagatc

SEQ ID NO: 6843032 - DNA, 83 bp, Homo sapiens
tccctagtaggggctgaggtcaggagctgtggggtcagtcaaggctcctccgactttctgacttcaccactttggctcaggga

SEQ ID NO: 6843033 - DNA, 91 bp, Homo sapiens
tgctgatctccttctcagaattgtgaacgcacctggaccacagccgtcagcaatgaccaaggccaggccagggcgtgcactgaaggcagca

SEQ ID NO: 6843034 - DNA, 66 bp, Homo sapiens
agttaccctttctggttcatatgatagtcttctatatcaagcttggagcctgaaagagaagtaact

SEQ ID NO: 6843035 - DNA, 95 bp, Homo sapiens
ggcaggaagcagaggagaggtcttttcctgggtttcaaaggttataccctgaggcaacagaaagggccaatgtcccctactcagcttctcctgcc

SEQ ID NO: 6843036 - DNA, 79 bp, Homo sapiens
atggtttatacatgcaaatgtggcctagtatagaaatgaatggaaattcgtggtttgcagcaaggccacattctaccat

SEQ ID NO: 6843037 - DNA, 129 bp, Homo sapiens
ataagaccaatataaacagaaatataaaactgcactaatgagcagaatttctgtatgaatagagaaacataccatgtttccgtgtagaaattcctgatattgtattttgtcatttcttccttaatttat

SEQ ID NO: 6843038 - DNA, 62 bp, Homo sapiens
acagaaacctgggggttgtacataacgcaggccccagctatgttttaccccagggtttgtgt

SEQ ID NO: 6843039 - DNA, 129 bp, Homo sapiens
tttatggaaaggagctagaaacagtgctgggcacaaaggagggctgacaaatggcagtgaccgctaattaatcccggccagtgttcttcaccccctctgccttgcctgttgtctttcctcttccaagag

SEQ ID NO: 6843040 - DNA, 63 bp, Homo sapiens
cgctgtgcccatcccagtgggtgctgaggaagctgaacggcagtgctgactctgggcacagtg

SEQ ID NO: 6843041 - DNA, 73 bp, Homo sapiens
ttacaggaccccctgccttgggcaatatgaagttttataaagttatacacaattccagaggcagcttctgtaa

SEQ ID NO: 6843042 - DNA, 69 bp, Homo sapiens
gggacacgggctgagcagagcccagggtgccccagccccttcccgagtccctgctgggcccgtgtcgcc

SEQ ID NO: 6843043 - DNA, 89 bp, Homo sapiens
cagccctacgtttctgtcccaggcaaaggcagctcattggaattgtcccagcaggcttgttatgtctgagagtgaggaggaagatgctg

SEQ ID NO: 6843044 - DNA, 58 bp, Homo sapiens
gtttattatcagatattaaatagcaagttcaacttgctatttgtgtaatggtaaatac

SEQ ID NO: 6843045 - DNA, 123 bp, Homo sapiens
aagtgagctgggtcaaccatcagtttggctttctctctatcctgtggtttttttccccatctcagcaggaagtagagttggccagccatgatgataaacaaagaaggattcagcattttactt

SEQ ID NO: 6843046 - DNA, 60 bp, Homo sapiens
gttagggaaggctgctgtcagctttgtggtttagagtagacaggaatctcctttctgaac

SEQ ID NO: 6843047 - DNA, 59 bp, Homo sapiens
atcactctgagaggtcactggaaaagaacgagaacagctttccccatttcttaggtgat

SEQ ID NO: 6843048 - DNA, 56 bp, Homo sapiens
gtatcttcttgcacaggagtttcatccgcaggtgagacatgctgtccaagaagtgc

SEQ ID NO: 6843049 - DNA, 56 bp, Homo sapiens
gacctgcctgagctgcctctgctctcctgacagagcaggccgtgggagtgtaggtc

SEQ ID NO: 6843050 - DNA, 85 bp, Homo sapiens
gtctttatcttctgttagctaaaatgcaatgtagtgtgctgtgtacaaggacatgcaatttggatttctaaaagagtatttggat

SEQ ID NO: 6843051 - DNA, 59 bp, Homo sapiens
catgctggaattgacctagaaggaactggagacattttgaaagtcaaccttccagtttg

SEQ ID NO: 6843052 - DNA, 77 bp, Homo sapiens
cacagaccaacgaaaggacaaggatgagatctcttggatcctgtgttcttatctttgtgtcccttttgatggctgtg

SEQ ID NO: 6843053 - DNA, 99 bp, Homo sapiens
gggtagagtggtggaatggggcgaggaagaaacctactagagtttcttgtgtaaggaagtattaataactggttccttcctcctccttctcccctcccc

SEQ ID NO: 6843054 - DNA, 122 bp, Homo sapiens
tggcctctgatgacaggaggggagccatcctttaggagtgaggaccgagcagatttagaaaaaccttcaattcctgcttggctttactagggggacatcctctctctagcagctggaggtca

SEQ ID NO: 6843055 - DNA, 78 bp, Homo sapiens
gtccctccctcaagggctccctgcctgaggtggcagaaaggccattcccacccagccagatgcaggaagcccaggggc

SEQ ID NO: 6843056 - DNA, 95 bp, Homo sapiens
ggactaattattgtgagtttgttattttgagttatatggctctgaggctaggtgtcagtcagagtttcaggatacaaataacataatccctagcc

SEQ ID NO: 6843057 - DNA, 56 bp, Homo sapiens
agactgctgtgaaaatgttgacccatctctggccttaacattaaaagcagcatttt

SEQ ID NO: 6843058 - DNA, 63 bp, Homo sapiens
tctgcaccctggcccttaggaaaacaaagttgaagaaaattcgttttcctaagggccaccaga

SEQ ID NO: 6843059 - DNA, 80 bp, Homo sapiens
gaagtagggtactagtcacacaattgtgtacatttgtcaaaatttataaaattgtgtacttcaaaagggtaaattatttc

SEQ ID NO: 6843060 - DNA, 82 bp, Homo sapiens
ctctaggctggctggtttgcattctgaaaggctcactcacaggtgagccattaccacctgcaggaatcagctagcctgggag

SEQ ID NO: 6843061 - DNA, 57 bp, Homo sapiens
actgagcttggatagggcaaagccatcatctttgatgagctgcctgtcttagccagt

SEQ ID NO: 6843062 - DNA, 63 bp, Homo sapiens
aatatcgggcactctgctcagtgcaaggttttattaatgatgtgctgtcaggggctggatgtt

SEQ ID NO: 6843063 - DNA, 85 bp, Homo sapiens
ctgcttagtaatgaggttatatttaattcacttctcactttgaaaatagttgattggtgggtaaaaatagagttgacacaagcag

SEQ ID NO: 6843064 - DNA, 84 bp, Homo sapiens
aaatgaatgatggccccttctaaacgtaaacggagctgctcatccttcagggctgtttataaatagaggggagtccatttgttt

SEQ ID NO: 6843065 - DNA, 76 bp, Homo sapiens
agtttacctacatagttaagtaacaaactcaagaaatgaatttggcaatttgactgtataggccattgaatgaact

SEQ ID NO: 6843066 - DNA, 116 bp, Homo sapiens
acatgttagagggctgggaaacaggagacctgaattcttatctgggctgtgccactaacttgcatagtgaccttgggcaattcccctctcctctgtgttccactttctccacatgt

SEQ ID NO: 6843067 - DNA, 60 bp, Homo sapiens
aggatggaattaggtagcaagttgaaggcataaaacccagtttcctcctatttccaccct

SEQ ID NO: 6843068 - DNA, 78 bp, Homo sapiens
gggaataatggccagcacttagcccttaccaagtagaggcactgttccacaggtttggggtatgtgttggttgttccc

SEQ ID NO: 6843069 - DNA, 66 bp, Homo sapiens
tggccgcccgggacgagctcggcctcggcggggattctcttgaggccatgcccgtgccggccgcca

SEQ ID NO: 6843070 - DNA, 71 bp, Homo sapiens
ggcttctttcactaagtagagacgggctcaaatgctgcctttccttctctatctctatactgacagaggtc

SEQ ID NO: 6843071 - DNA, 74 bp, Homo sapiens
ggcccactgtgtggcaagggagccaagaaagcagggcccagtggctctgctgaagccccttgcatgtggaggcc

SEQ ID NO: 6843072 - DNA, 58 bp, Homo sapiens
cgcaggccgctgctacggaggcgcccgctcgctgtctcgctctctggcggtgtctgcg

SEQ ID NO: 6843073 - DNA, 91 bp, Homo sapiens
ttgtggatattgaagtttgaagcctgttgttcatctatagatgcactggatgggattggaagtcttcagatttcagtagggttttccacaa

SEQ ID NO: 6843074 - DNA, 59 bp, Homo sapiens
ctgggaagaagggacaacagcggactgtctaaaggatgcctggattccttgtttctcag

SEQ ID NO: 6843075 - DNA, 60 bp, Homo sapiens
ctaggaagagaaggaattccccttcaaaagtgactgaaatggaatccttcttgtttgtag

SEQ ID NO: 6843076 - DNA, 56 bp, Homo sapiens
tggtgttaatggtgtgaaagccggtaccaaggctgctcaatagaccataatatcca

SEQ ID NO: 6843077 - DNA, 95 bp, Homo sapiens
gggtgagaatctcaagtgggaggtgaaaactcaggagaatggtttctaaaaattcttgttcagttgcctctcctgcttgggtggattcttcttcc

SEQ ID NO: 6843078 - DNA, 94 bp, Homo sapiens
tgggagggtcttgctctttcacccaggctggagtgcagtggcacaatctcagctaactgcaacctccatcttgtgggctcaagtgatcctccca

SEQ ID NO: 6843079 - DNA, 58 bp, Homo sapiens
tgccagggcagtctcccccagacctggggctccccagggacagagactgcaccttgca

SEQ ID NO: 6843080 - DNA, 56 bp, Homo sapiens
gtctatcctttagtcctacaactcgatcttctcggttcacttgggctaggatatgc

SEQ ID NO: 6843081 - DNA, 102 bp, Homo sapiens
ttttgggtataagtgaataagtgcctttttctagtaccatgagatgtagaattttatggaatttgcaaaaggttacttgacttccctcttgtccccccaaaa

SEQ ID NO: 6843082 - DNA, 56 bp, Homo sapiens
ggatgtgtctccatacaccaccctgcattacaagggctgtgccagagacagcatcc

SEQ ID NO: 6843083 - DNA, 69 bp, Homo sapiens
tgagagaaacgttccttacatcctcctcctccacagcaaaatggtttcagggtgtggggacatctgtta

SEQ ID NO: 6843084 - DNA, 55 bp, Homo sapiens
agaggccagccctgggctgagagaggaagccaccatctctcacgggttggtttct

SEQ ID NO: 6843085 - DNA, 59 bp, Homo sapiens
gaactctgggcaagccaagggcagaagatgttagcctagtggctccaattgtccagttc

SEQ ID NO: 6843086 - DNA, 73 bp, Homo sapiens
catttgtttactcaatgcatatgctgcagacccatcccaggcctgctgcccagtgtgcattggggtaaaaatg

SEQ ID NO: 6843087 - DNA, 58 bp, Homo sapiens
agtttccttcccttttagctgagttgtatgtaggtacaagtgctgtgagggaaaagct

SEQ ID NO: 6843088 - DNA, 61 bp, Homo sapiens
gcataatccttgcttagtgtggggcctcttagaagctgaccctgagacaaggattgaatgc

SEQ ID NO: 6843089 - DNA, 77 bp, Homo sapiens
agttgcctgggtagatagcagcagcagctcaccagccccacgctgccaggctgctggctgctgtccaccaggcagct

SEQ ID NO: 6843090 - DNA, 116 bp, Homo sapiens
tctcagtccatttgggctgatgttacaaaattctatgaacaaagtggtttataaacaacgtaggtttatttctcacagttctggagcgtgaaaagcctaaaatcaaaatgctggga

SEQ ID NO: 6843091 - DNA, 69 bp, Homo sapiens
cgtgacttccagagctaggtcggagaggcattgcggcttcttccttggtttcctggataggtagttgcg

SEQ ID NO: 6843092 - DNA, 80 bp, Homo sapiens
tacaggctcactttctcagtcacacaaaatatatttcaagtgctcaatatccacatgtggctagagagtagagtattgta

SEQ ID NO: 6843093 - DNA, 66 bp, Homo sapiens
cctatggaatcttcataaaaatctagtagaattagatttctactagaatttagcgagatcacaagg

SEQ ID NO: 6843094 - DNA, 60 bp, Homo sapiens
tgggagctccttcaagaccccaacaggcaggccttgcctgtggatctagagggggcccta

SEQ ID NO: 6843095 - DNA, 63 bp, Homo sapiens
ttgcttccttgagctggtctgaggattattgcctataaggttctcagcttagtaagtaggtaa

SEQ ID NO: 6843096 - DNA, 62 bp, Homo sapiens
gatggatgggcacaggggtaggaatgagattttccattccaaaactcttgtgttcttttttc

SEQ ID NO: 6843097 - DNA, 55 bp, Homo sapiens
tcagttattgttattcttatggaaacaacccatgggaaatgtagccttggcatga

SEQ ID NO: 6843098 - DNA, 71 bp, Homo sapiens
gccatctataactgataatgctggaaatacttctcatctttcttggcatcctttgtgtcagtttagaaagc

SEQ ID NO: 6843099 - DNA, 78 bp, Homo sapiens
gccttggtaccccagccctcagcaaagacatctatgcgtacgggcagtgtctgaactgggtgctgacggtggcaaggt

SEQ ID NO: 6843100 - DNA, 70 bp, Homo sapiens
acagttatctttgaaatagagaaagtaagagctgcagtgtagattctcaaattattttaaggacaactgt

SEQ ID NO: 6843101 - DNA, 80 bp, Homo sapiens
gtaagtgaaatcagaagtgcaatttaaattagggtggtcaagtcaggactccctacgaagttgacttttgagcagagtgc

SEQ ID NO: 6843102 - DNA, 55 bp, Homo sapiens
gtttggtacaggttcgaatatcatggagatgagtgtggaagaacactggccaggc

SEQ ID NO: 6843103 - DNA, 87 bp, Homo sapiens
gcaaccatttctattgcatcaagaagtctaagtttgcaaaggcaagcttaaactttgcaaactgattttgatagcattaagaattgc

SEQ ID NO: 6843104 - DNA, 78 bp, Homo sapiens
tgctcgctgccaggcttcagggaacgcagtctgtagacatctccaactgtcacctttctgtggtttgtctcagcggca

SEQ ID NO: 6843105 - DNA, 91 bp, Homo sapiens
acttaacatttcaaggtacttactgggcattgtgtattatctaagttaaaaatttacaaagcctggtagatatctgggagttatgttgagt

SEQ ID NO: 6843106 - DNA, 58 bp, Homo sapiens
ccaggtgtttcaatcccaagtcattaaaatgcacatgatgggctgggactgaccctgg

SEQ ID NO: 6843107 - DNA, 78 bp, Homo sapiens
gagggaatgagctgcaggattatggaatggagtcacaggtggttccagctcttcagttctgcaaattctcactctgtc

SEQ ID NO: 6843108 - DNA, 83 bp, Homo sapiens
tgcctcattcaaaagttctcacccagacatgtatccctgtgaggtgttgtctgcatgtgtgtggctgacaattttttgagtca

SEQ ID NO: 6843109 - DNA, 78 bp, Homo sapiens
tttatccacagaaaaaggcttgaaaatcccccagagacactagctgggctgattggcaaaggtctttcactgtatgaa

SEQ ID NO: 6843110 - DNA, 72 bp, Homo sapiens
ggggccagagaggacccaggtggccctccttagttgactctggtgttgcttgtcggttccactcacggcccc

SEQ ID NO: 6843111 - DNA, 71 bp, Homo sapiens
aggttcctcttcctctggcctgatgccacctcaccccaatttccaaggcacaggctctgctagaggagcct

SEQ ID NO: 6843112 - DNA, 78 bp, Homo sapiens
agaagataattaaattatgtccaaagaattaatattgcttactttagagatataagttagtggtcatgtttatctttt

SEQ ID NO: 6843113 - DNA, 74 bp, Homo sapiens
tggctgccacagtgaacattctgtcaggggtgttgtgctccaaatattgtccctggcagaatgtctctgggcca

SEQ ID NO: 6843114 - DNA, 67 bp, Homo sapiens
atgaagtattctagaaaagtatgcagaaagataaagaaaatgcatccatctctagaagtgcttacat

SEQ ID NO: 6843115 - DNA, 67 bp, Homo sapiens
gcaacagggacttatctactctgattcaagagttcttgaaatcacttgtgccatgggtacctgaagc

SEQ ID NO: 6843116 - DNA, 57 bp, Homo sapiens
gcagtggtagcctgggccctgtcctctgaagggctgggggcgtggcctgccagttgc

SEQ ID NO: 6843117 - DNA, 74 bp, Homo sapiens
tctacctctttgcatgtgccagtggcatgtcagaaacaatttttctgtgcatttcaaggcacagctaagtatga

SEQ ID NO: 6843118 - DNA, 59 bp, Homo sapiens
tgtgactgcatttggagctggggtctttacagaggtacttaggttaaaatgaggtcata

SEQ ID NO: 6843119 - DNA, 58 bp, Homo sapiens
gcccaggctggagtgcagtggtgcgatcttggctcactgcaagctcagcctcccgggt

SEQ ID NO: 6843120 - DNA, 85 bp, Homo sapiens
gggtacatttttgcccagccctgtgataaggtttgttgtttattaggcagaaaggcaagcatttatataggacaggaatgtgcct

SEQ ID NO: 6843121 - DNA, 61 bp, Homo sapiens
cgccttcttgtcaatttgccattgtcaccaagtccaggacacagcatcagagaagaaggtg

SEQ ID NO: 6843122 - DNA, 57 bp, Homo sapiens
atctggaatcagtggcttaccctccttgagcaggagtagctatacaggatttcggat

SEQ ID NO: 6843123 - DNA, 57 bp, Homo sapiens
agcatattttgtctcaacttcttggaggtgctcctcctttgacaagagacagatgtt

SEQ ID NO: 6843124 - DNA, 59 bp, Homo sapiens
ttgaagtcctaactcccagtacctcagaatatgactgaatctggagatagggcctttaa

SEQ ID NO: 6843125 - DNA, 59 bp, Homo sapiens
agcatgcaattatggtattagataaagcatacagtttggtctaaaaccaagatgcagct

SEQ ID NO: 6843126 - DNA, 99 bp, Homo sapiens
ttgaaatttaagctatgaaatcattgaagagatttaattggattaacttaatttggattagatttgatgcaattggattgaagtgaattagaattttaa

SEQ ID NO: 6843127 - DNA, 102 bp, Homo sapiens
agggcacaaaagatttgaataagcagacatcccatacttttgggtgggaacatctaatagtataaggatgttgatgctcccccaaataacctaaaacaccct

SEQ ID NO: 6843128 - DNA, 70 bp, Homo sapiens
gctctggccctggcaaactgggattcgagcccaggcatgaggcccagtcctctgccgtctgggccacagc

SEQ ID NO: 6843129 - DNA, 63 bp, Homo sapiens
ggcctgctgacccaagtcctgtgaccgtggcccagaaggaagggacaggcatgggcacaggct

SEQ ID NO: 6843130 - DNA, 92 bp, Homo sapiens
aaatggaagtttctctgtcctatgcttgatagaaccatgtcggttgagacacgtttctatcatgcatagggcagggtataagaaatctgttt

SEQ ID NO: 6843131 - DNA, 55 bp, Homo sapiens
gcagggcacaaggacgcacaggccctcctgcaccgtcaccgacttctgcacttgc

SEQ ID NO: 6843132 - DNA, 87 bp, Homo sapiens
ttgactaaatctatgttgaaattttttagaaaatctggaagctcaataggcttcctcagctgagagatgatatagcttaatggttaa

SEQ ID NO: 6843133 - DNA, 79 bp, Homo sapiens
ggtccttaccagaggtgccacagaaagagcctggtgggcagggcatgggctctgggctgccctctggacagtaggagcc

SEQ ID NO: 6843134 - DNA, 108 bp, Homo sapiens
tctattataggaggatcaggaattgtttcttcagggaagcttgttaattctgtaatcgctcaatttcatatgtatcacctagcccagtgcctgatttgatgagatggg

SEQ ID NO: 6843135 - DNA, 59 bp, Homo sapiens
cacatggggagcaaggaaggcagaatgaacatttttcttcctccaggcacacccatgtg

SEQ ID NO: 6843136 - DNA, 68 bp, Homo sapiens
gagcatggttccataggttggtcttgtttcaatcaagaaaatcctcatagcagcctggaatccatttc

SEQ ID NO: 6843137 - DNA, 115 bp, Homo sapiens
atatttttggggttaactgcttacagagatctttaaaagttattattatccagagaagagatagcaataatagttagggaccattttgtagcagttaccactgtcctagaaatat

SEQ ID NO: 6843138 - DNA, 85 bp, Homo sapiens
ccaaccagttcttttgagattaagaaaatatcctggaattcatagacattttcaggactggaagtctcaagagaactatatttgg

SEQ ID NO: 6843139 - DNA, 88 bp, Homo sapiens
gaggcctcactgcctggctgcagatcattcagaataatgatctaccacacatttatctgggattttgcagtctgcaatgcaatgtctc

SEQ ID NO: 6843140 - DNA, 63 bp, Homo sapiens
atgtacccagtgattccttcttcaccactgattggtgagaaacacaggcatgaataggtgcat

SEQ ID NO: 6843141 - DNA, 79 bp, Homo sapiens
cttagaaatctttgattgaagggaccctgggaagcacagaattgaagcttctaggggactgacaagcggggactctgag

SEQ ID NO: 6843142 - DNA, 63 bp, Homo sapiens
cctcagtgcaggaatttccttagaaacattacaaatggctctaaattctttcctgggttgagg

SEQ ID NO: 6843143 - DNA, 63 bp, Homo sapiens
ggtctaaggaacaccaggagatggtcttggcaaacccaggaatcccactgagttccttaaacc

SEQ ID NO: 6843144 - DNA, 64 bp, Homo sapiens
ggtatcagcagtgtagtttatcattccctaccagagaatggtataaattagactgcagaatgct

SEQ ID NO: 6843145 - DNA, 69 bp, Homo sapiens
gggacaaggcagtgtgcaaaggattttaaatggattctttcatttaatcctcacaagcctataaagccc

SEQ ID NO: 6843146 - DNA, 118 bp, Homo sapiens
tttatgcagtagaaacctgaatgcctttcaactacatacaggcgatggataaaatcagtgatgtacaaatacatcccctgtatgtagttgaaaggcattcagatttctactgtgtaaa

SEQ ID NO: 6843147 - DNA, 61 bp, Homo sapiens
tggtctctctcctgcaacaactcactttcaatctattaccagtctgttgccagagcgatca

SEQ ID NO: 6843148 - DNA, 70 bp, Homo sapiens
aatgtatcagttgcctactacatggcaggcagagggctgtgtgtgtgtgtgtgtgtgcaaatattatatt

SEQ ID NO: 6843149 - DNA, 99 bp, Homo sapiens
gcccatggctgttcacattgaggcttaacttggaaagggaggcccattttaactctgcaattcgaccttccctggtgttagcccaatgacagtgatggc

SEQ ID NO: 6843150 - DNA, 62 bp, Homo sapiens
ttcctcagaaatcttgtcaaggcatcttggctacacctggattgcctgtgaattttgatgaa

SEQ ID NO: 6843151 - DNA, 59 bp, Homo sapiens
tctggtcaacagaaactctttgtgatttcaaaagtcagaaagtgaactgttgacatgga

SEQ ID NO: 6843152 - DNA, 56 bp, Homo sapiens
gtcagtaatgaattataaagcactaaaaaaataggcatttgtaagtccttactgat

SEQ ID NO: 6843153 - DNA, 58 bp, Homo sapiens
actggctggttatgaggagtggcagcgcttgctggcagccctttctggccagctcagt

SEQ ID NO: 6843154 - DNA, 121 bp, Homo sapiens
ggttcagtccttaacttgccattctcttgttttaaagattctcctttagataactcacttgcttatgaattattagcaattctctgtgggggtgtcttaacctagagctctaggctgggcc

SEQ ID NO: 6843155 - DNA, 71 bp, Homo sapiens
tgtattaagtgcccatacagctcaatgggtattcattgtgctcattgagctgtatggacacaatgagtaca

SEQ ID NO: 6843156 - DNA, 64 bp, Homo sapiens
gatactttaggaagatgctttttctgggtaaactaaaagcctgacgtggctcttcctgatgttc

SEQ ID NO: 6843157 - DNA, 61 bp, Homo sapiens
gaaatcatgagatctcttggacacctttaattttagtgtctaagggcttgttcttgatttc

SEQ ID NO: 6843158 - DNA, 85 bp, Homo sapiens
caggcatggatccttcattggttgagggctactctctggagcatatatggtgcttccagccttcccaatgcttggtttgagcctg

SEQ ID NO: 6843159 - DNA, 76 bp, Homo sapiens
ctcagaggcccagcagcgcaggtcttggagaatgaatgtgggtcactgggccgcgctgcagagggccggtcctgag

SEQ ID NO: 6843160 - DNA, 128 bp, Homo sapiens
agcatcaagaatcacattatttcacagctggtttgctgaatagattgtaaacttagttaatgatattgctccattatggtgccaatttatttagccaagaaagcaaaaataccagtgatttttcagct

SEQ ID NO: 6843161 - DNA, 61 bp, Homo sapiens
agtagggaacttatgatatgactttagacttttgtcttcataggaaatagtgttctttatt

SEQ ID NO: 6843162 - DNA, 57 bp, Homo sapiens
gattatgattgaagccaggtgtccaaaagaagacactggtttttttaaattatattc

SEQ ID NO: 6843163 - DNA, 64 bp, Homo sapiens
gaatgtctccgaagctggattgatgtggggaaagcacctttcccttctagttttgagagacttc

SEQ ID NO: 6843164 - DNA, 121 bp, Homo sapiens
atttctgtctcaccttatataaaacttcaaacatggagtgtccagcttgaagcagtgtctgaggggagtactgcttttagctggatacaccccgacggaggttttatgcaaggacagagat

SEQ ID NO: 6843165 - DNA, 66 bp, Homo sapiens
gcctgtgctgtgggatctgctccagagggaaaagagtgtttgggccctgcagattctagtgcaggt

SEQ ID NO: 6843166 - DNA, 66 bp, Homo sapiens
gtccagagccagctgtccttggcatccgtcaggcagaggggtgaggtgattgctggtgtttgtgac

SEQ ID NO: 6843167 - DNA, 61 bp, Homo sapiens
tttggatcacacatgcactgtttgagacaaatttcaagctgcatcagtgcagtgagacaga

SEQ ID NO: 6843168 - DNA, 88 bp, Homo sapiens
catgaggcatttttggaaagtgtacaaatttgaataaggactggatattacgtattataaaattgttcattttcctaaggtgacaatg

SEQ ID NO: 6843169 - DNA, 79 bp, Homo sapiens
gctcccctttttctcttaagtcctggatattaaattgattaaactgattattttatcccaggatgagaagcagtggagt

SEQ ID NO: 6843170 - DNA, 57 bp, Homo sapiens
ggtgctcaggaaatgacaggtgtctccttcctgagagctgacagctgtcctgagccc

SEQ ID NO: 6843171 - DNA, 128 bp, Homo sapiens
gaggtatgcaccccggatgcctgaaggtgggcatgagagtggtgggtgggggcgggtgcccttctgaaactgcattctctacactcctgccctgcctcctcattcccttttggggaaaaaaatatctc

SEQ ID NO: 6843172 - DNA, 111 bp, Homo sapiens
ggcgttgacagagggggaaaggggaatagagtgggttgtggaaaatgtcaattatcaaacatatgcaaggctttttctctgtttctgtgttttctcctttctcacccagcc

SEQ ID NO: 6843173 - DNA, 60 bp, Homo sapiens
ggagaactgcaaccgtatcaggaaccctgctggcacaggagtctgaacaatgcagttccc

SEQ ID NO: 6843174 - DNA, 77 bp, Homo sapiens
aatctgttaggatgaggatacggaatgactattaaactttcctgtctctatctggcatccttatctaaatcaagatt

SEQ ID NO: 6843175 - DNA, 62 bp, Homo sapiens
tctctctgccctgggttccaggctcctggtcccaaaggctggtgcttcctagggcaggaaga

SEQ ID NO: 6843176 - DNA, 68 bp, Homo sapiens
agtcataattccataacagatatcaggacgtgcctgaatgagatctaagtatgggattacccaagact

SEQ ID NO: 6843177 - DNA, 64 bp, Homo sapiens
gtgactaccccaaggagtgaactgcaggtcaagcatttctcttcctcctagggttgcaagtgac

SEQ ID NO: 6843178 - DNA, 60 bp, Homo sapiens
gctacagagagaggggttaccaggtctatcagaggcagctgccacacctctttctcttgc

SEQ ID NO: 6843179 - DNA, 59 bp, Homo sapiens
gtttccaggctgggcagcgagcagcccctttagaaaggacctcttgttcttagtgaaac

SEQ ID NO: 6843180 - DNA, 59 bp, Homo sapiens
ggtcaggagtgataccatttgtcatgtgtccaacttcatgactaaatggttgctctacc

SEQ ID NO: 6843181 - DNA, 77 bp, Homo sapiens
gcatcaagatgtcactgagttgggttttattttagttccaagtattgtatctgtttagcacccagccagcttggtgc

SEQ ID NO: 6843182 - DNA, 66 bp, Homo sapiens
ttcattcagtgcatttgggagagtcctgagcatccaggcaggacatgatgagtgcaattgaatgag

SEQ ID NO: 6843183 - DNA, 83 bp, Homo sapiens
caggacagacctgcagctgaggggagcccgccctggacgcggcagggatgaccggcgtccgccccctcctgcaggatgacctg

SEQ ID NO: 6843184 - DNA, 86 bp, Homo sapiens
tacccaaacacaatttacgtcttggcctgtggctcaagaattttgtccagaaatctcttaggccctcaggcccttgcgaaatggta

SEQ ID NO: 6843185 - DNA, 82 bp, Homo sapiens
tgagaatgagctgcagactgggaggcaggtgtcccagcatgggctcaccaagctcctaccctctcccggtccagctttctca

SEQ ID NO: 6843186 - DNA, 78 bp, Homo sapiens
ccttcctcttgggccctggaaatgaggcatgtgcgcgcctcctccgtgcacccagggccaggcgttgaagacggaagg

SEQ ID NO: 6843187 - DNA, 93 bp, Homo sapiens
ttccctaggactcatctttgttatctcagatcttgttggtttaagaaaaatggtacaactagagcagattgcagagtaggtgcttctggggga

SEQ ID NO: 6843188 - DNA, 65 bp, Homo sapiens
tttttgtctgggaaaaatatatcaccaagtaaataggcttgagtatattaatttgccagcagaaa

SEQ ID NO: 6843189 - DNA, 89 bp, Homo sapiens
ccagactccatactatcagccacttgtgatgctggggaagttcctctacacaagttcccctggtgccacgatctgcttcacgagtctgg

SEQ ID NO: 6843190 - DNA, 55 bp, Homo sapiens
ctgcaaggctggggtgagctggcacccaaatttagctcatactccagtctagcag

SEQ ID NO: 6843191 - DNA, 56 bp, Homo sapiens
catttaataagctttatggactcaggatataaaatcagagtaaagcttattacatg

SEQ ID NO: 6843192 - DNA, 62 bp, Homo sapiens
ccatcaagtaatttcagatcaggtcttgctgttattgaagctttctagatttggaattgtgg

SEQ ID NO: 6843193 - DNA, 86 bp, Homo sapiens
ggtttggagggctgcgttcattttgagtgctgttgtaatcaattttagatacagcattccacaatggatcagtttgcatccaaacc

SEQ ID NO: 6843194 - DNA, 79 bp, Homo sapiens
acttggtttttcatctgtacaacaaagggatgagacacatatctgtctcatttttcaggtacagttttaaaaatcaagt

SEQ ID NO: 6843195 - DNA, 58 bp, Homo sapiens
gtgtctgcttgctgagcatttaattgggtgcaaatgttaagtgcaaagagacagatac

SEQ ID NO: 6843196 - DNA, 94 bp, Homo sapiens
gagactggtcttgaagagctgctgaatgacactgcaagtcctattatgggattttcattgtaaatcaggaaacctagtctagaagacctctctc

SEQ ID NO: 6843197 - DNA, 78 bp, Homo sapiens
atttactatttgtaggttttctgggtttgtagtacaatcctcatgtttggattatacaaggaaaattttatagtaagt

SEQ ID NO: 6843198 - DNA, 121 bp, Homo sapiens
ctccgactgtgatgaaggttgagcaatgctgagtacactaaagaacatggaattgtatgttgttaaatgggtgtattttatggtatatgaattatttctcaattaagacattaaaatgggg

SEQ ID NO: 6843199 - DNA, 74 bp, Homo sapiens
tttttgtagtgttgatagatgttgcttgtgtttatctatttgaaatgccactaaatctgtgaatacaatggaaa

SEQ ID NO: 6843200 - DNA, 55 bp, Homo sapiens
gggtgggtgggcacctgcccagagccaagcagcctgggagagggctcagctaccc

SEQ ID NO: 6843201 - DNA, 59 bp, Homo sapiens
aaaagcagatctccaaagtctaaaagccttaatgtttgctaggtggagggtttgttttt

SEQ ID NO: 6843202 - DNA, 71 bp, Homo sapiens
ggctggagttaggcacagatgctgggtgctggagagacagcacctattcttctgtgctctgaatccagacc

SEQ ID NO: 6843203 - DNA, 55 bp, Homo sapiens
aagtccctatctacaaatacactcccattctgaggtatgctgggggttagggctt

SEQ ID NO: 6843204 - DNA, 78 bp, Homo sapiens
gaggtttagagtaggaaatgcagtttcctaaatttgaaatataccaggcctaattagcattgctactctcaagacctt

SEQ ID NO: 6843205 - DNA, 71 bp, Homo sapiens
tggcctttgaaagatttactttctttgtaatacctgtttggtgtaaagagaagaaacgtgagcctctgcca

SEQ ID NO: 6843206 - DNA, 55 bp, Homo sapiens
gaggagcttgtgagaagatgtcattaactcaaatactttttatcagaagctcttt

SEQ ID NO: 6843207 - DNA, 81 bp, Homo sapiens
tatcccgcatctcaggctgaggctggcagctccaggaagtcctctgggagctctttccggcttgagtcaggtgtagtgatg

SEQ ID NO: 6843208 - DNA, 58 bp, Homo sapiens
cagccaattaattagggtaggaggtggaagccccccatttctttggctaaattgggtg

SEQ ID NO: 6843209 - DNA, 93 bp, Homo sapiens
ttgagagacatgaagccagacagttaagggaatctgacgatacatctgggcctatccaatcattgtaaatggttttgtttggcttccttttaa

SEQ ID NO: 6843210 - DNA, 87 bp, Homo sapiens
tgagggcaggctgcttgatggaaggggacgctccacaataagaaagaacaaaggctttggtttgtcctcatcctccagtctgtccca

SEQ ID NO: 6843211 - DNA, 57 bp, Homo sapiens
cctatgtttaactttttgaggaatgggccacagtttctctatgaagttcaaacgagg

SEQ ID NO: 6843212 - DNA, 117 bp, Homo sapiens
gactaggagttaaagccttgtcctgtgaaatcaaccttgagcccagcctcgagaaatgagagaagagtttgtccaggggccaaggggacttcacgcttggctgatgaactcctggtc

SEQ ID NO: 6843213 - DNA, 62 bp, Homo sapiens
gcaaagacagaggggtcacagcctgaaggagcagcatccttgccaacgccctctgtctcagc

SEQ ID NO: 6843214 - DNA, 87 bp, Homo sapiens
tagtgtcttattcacctttgttgtgataatggtctgcactgaatagatgatcagtagatgcttgcagacagaatgaataaaccacta

SEQ ID NO: 6843215 - DNA, 55 bp, Homo sapiens
agcaagattttccttgaatgttattaatggtgttcttatttaggaaaatgttgct

SEQ ID NO: 6843216 - DNA, 62 bp, Homo sapiens
tgcatataagggaaactcagtaaataattatgttgaattgattagagttgccattatatgta

SEQ ID NO: 6843217 - DNA, 75 bp, Homo sapiens
ccctctggctttctgaagggcagcagactcttgagtatactgcagaggacatgctttatcagtaggtcctgaggg

SEQ ID NO: 6843218 - DNA, 61 bp, Homo sapiens
ctgtggtctgtaggagtgatgggtcactttgcccaaagacttgtacttttaaagatcagag

SEQ ID NO: 6843219 - DNA, 85 bp, Homo sapiens
gtgtgtttatgtgtcagcctcctctcttagaacacagccagctagttatcaactgtcgttccggagcctggcatatgagacgcat

SEQ ID NO: 6843220 - DNA, 95 bp, Homo sapiens
gcaatcctgggatggcacaagtttcccacagtgttgaatcctctcttttgacagtagagacaagcagtgtggagtcttcctcctcagtgatttgc

SEQ ID NO: 6843221 - DNA, 64 bp, Homo sapiens
acattcttcatttactgttacttgtcattttgcaaactgattagttaacttgaatgaggagtgt

SEQ ID NO: 6843222 - DNA, 91 bp, Homo sapiens
cttggcctgggctcatcccacccatcctgcatctcttgccctgcaatccacaggcccaggatggccatggcccctgtgagcccgcaccggg

SEQ ID NO: 6843223 - DNA, 130 bp, Homo sapiens
cttttatactgtatgagtatcatagtctgtcttctgtagccagtaacatatagaagttagtttttgtgttgtctatgtttttgaggttaaagaaaacagaatactaaattgctatatactaatctataag

SEQ ID NO: 6843224 - DNA, 92 bp, Homo sapiens
atcacctggggatctcattaaaaatgtagactctgattcagtagggctgggctgaggtcaagattctacatttgtaacaggctccaggtgat

SEQ ID NO: 6843225 - DNA, 83 bp, Homo sapiens
cttcaacttcatgattgattctttgtatcttaattttgtaaatttaaaatttcagatattaaagaatgaggtagtggagggag

SEQ ID NO: 6843226 - DNA, 71 bp, Homo sapiens
tcaggtggtagagtgtcataacagtgcccatcacgcaagtgagactgtggctctcatgcactcccagttga

SEQ ID NO: 6843227 - DNA, 66 bp, Homo sapiens
tgtgatcagtgtgggtaagcatgctgtcaaagatgatatcgtcacgtttactcatgagactgtaca

SEQ ID NO: 6843228 - DNA, 64 bp, Homo sapiens
gcctgtgtccagctgggtgtcatctggggtccatgtcctcatggggtttggctggatgtcaggc

SEQ ID NO: 6843229 - DNA, 62 bp, Homo sapiens
gaaacgaagctctagattagaatactctacattttgtcattttgagaagggagcttcctttc

SEQ ID NO: 6843230 - DNA, 104 bp, Homo sapiens
aggtttgggtggtgcctttcttttgtaaagtggagtaagcatggctttggacccagagactttcttgacctagttaatattaggaaagtgtaccactggaagtt

SEQ ID NO: 6843231 - DNA, 64 bp, Homo sapiens
ttataaagaaatgatttccagaagcccaagaagcctggtattctgaggtatcatttctttgtga

SEQ ID NO: 6843232 - DNA, 60 bp, Homo sapiens
agatggttcgagtgtttttgttcccctctagatgttgaactcctgaatcgtgagccatct

SEQ ID NO: 6843233 - DNA, 87 bp, Homo sapiens
atatagtacactatggggattcaaagttatcatttgagtttttgactacttatgaacaacttgaagctccatgacttgtgtgtgtat

SEQ ID NO: 6843234 - DNA, 58 bp, Homo sapiens
ctttgacctcatatgacacatttctagattcttgtctgtgcagttttggggtccaaag

SEQ ID NO: 6843235 - DNA, 81 bp, Homo sapiens
ggcccaagaatgtcaattaccagaacagaataacaaaatacaccgaattcttacctttgtaatgtaatggacaactgggtc

SEQ ID NO: 6843236 - DNA, 56 bp, Homo sapiens
gtggggctgtggccactgcagagcagcccaggggaccttgctgtgcacagccctat

SEQ ID NO: 6843237 - DNA, 78 bp, Homo sapiens
agaaggattccagaggatgagtggagagtaccgtgtttctaagacacctgtttcttctcatccctgaaatcagtgtct

SEQ ID NO: 6843238 - DNA, 58 bp, Homo sapiens
agtgacggttgggacttctgagcccgagtttaagtggacttgcagtttcaccttcact

SEQ ID NO: 6843239 - DNA, 62 bp, Homo sapiens
tgagtgtttctggggaaagagctgccggaggagtggagctacttccctgtaggaaacacgca

SEQ ID NO: 6843240 - DNA, 70 bp, Homo sapiens
ttctgagagggtggcatttgagcagatgtctagaagacatgctaaagcaaactgtgctactatttgagaa

SEQ ID NO: 6843241 - DNA, 99 bp, Homo sapiens
cccggggccggggcccggctgcaggcgccgtgcccgctccgcgccgctgccgcccggccgcggagctccgcccggtgcccaggcctgtcccggcccggg

SEQ ID NO: 6843242 - DNA, 80 bp, Homo sapiens
cctacttagccacagtttccattatcttcatgagcagtagctggaatgaaggagaaatggaaagtgggaatgaagacagg

SEQ ID NO: 6843243 - DNA, 55 bp, Homo sapiens
gaaagctggttattctgaggcagctggagaggctgctgaagggatttcagcattc

SEQ ID NO: 6843244 - DNA, 56 bp, Homo sapiens
tagcaaggcttccaatgaacagcagatgcaggagctggagtaggaagtgattgttg

SEQ ID NO: 6843245 - DNA, 115 bp, Homo sapiens
ggaggcaacatgatatagtgaaaagagtgccagaataggagtaataaaaccggggtttttgcccaaggtctgctattgccttgctttgtgacctttggcaaatatctgagcctct

SEQ ID NO: 6843246 - DNA, 99 bp, Homo sapiens
tgtaagcattctccttgcttggcaggttaacttacaactgtcataactggctgcaacagtggtatagcctctaaacaagagaaatttgctttgtttaca

SEQ ID NO: 6843247 - DNA, 90 bp, Homo sapiens
taagtttgaccctcttaactgtatagcttggactaaaattcaaaatgtaagctgttttattcaaatgcagtggggtcactaattgattta

SEQ ID NO: 6843248 - DNA, 55 bp, Homo sapiens
acagctggccgaggctcagggatagagacggctgctccagctaaaggtcagttgt

SEQ ID NO: 6843249 - DNA, 82 bp, Homo sapiens
gggtttccactgcttattcacatgtgatctcatgacattgtgttgtctgataccctcactgtaaactaggtcagtcctaccc

SEQ ID NO: 6843250 - DNA, 90 bp, Homo sapiens
atttgaccccaatatttcttaccctttggctggccttgttctgtgtggtatcagagaaccagctgcaggggagcagtggaggaggcagat

SEQ ID NO: 6843251 - DNA, 62 bp, Homo sapiens
gccacctccacctattgccagcccagtttcacgaaaggaaggctgaaaggtgggaggatggc

SEQ ID NO: 6843252 - DNA, 85 bp, Homo sapiens
accactgaaatgagcaatgtggaccagctcagggtgggcactgcagtacttttcatgggctgagtccttttgaggtttccttggt

SEQ ID NO: 6843253 - DNA, 65 bp, Homo sapiens
ggagctgagggaggttaaggagaccctggggactcacttgttctgtctgggcttcccccagctcc

SEQ ID NO: 6843254 - DNA, 92 bp, Homo sapiens
tttttagcaagaaatgtggttactgttggccaccacagtcagaaccagaggacaccatgctggctaatggaaaccagatgctctggtaaaga

SEQ ID NO: 6843255 - DNA, 99 bp, Homo sapiens
cagggacctgagcttggggctggatgtgagatgagtgctgcgtatcttggatataatccataacctggtgtcattttagcctcaggcaagtgctccctg

SEQ ID NO: 6843256 - DNA, 60 bp, Homo sapiens
gttgaatacatgtatgatgtgactctcccatttggagctcttatatcataatgtgccaat

SEQ ID NO: 6843257 - DNA, 56 bp, Homo sapiens
gtggattagcttttgttcttgacttggagccagtcctgtatctgagctgagtccac

SEQ ID NO: 6843258 - DNA, 70 bp, Homo sapiens
cttttctggctactctccctgcttcagggaagacgtggtctcccaggactcagaggagaagccagagaag

SEQ ID NO: 6843259 - DNA, 113 bp, Homo sapiens
taagttgctctcatgaaaggtaaacagatcctttcccaaggagctcttggtagtctgcctcctggagaaactcagagatctgtttatctatgtgctttttagagagcaagtta

SEQ ID NO: 6843260 - DNA, 57 bp, Homo sapiens
ctcttccaggaggatatggtcccttttaccatttagggacagtagtagtcaggagag

SEQ ID NO: 6843261 - DNA, 113 bp, Homo sapiens
gtgatttatcttcgttctgcatttctttccgtagctcctgtagacattgaaggtagggtgaacctgttactaaggggagatacaaaagtagtgcagggggtaagattaatcgc

SEQ ID NO: 6843262 - DNA, 60 bp, Homo sapiens
tcaggctgggagacaatcactgtgactgttgacatctgtggcttcagtttcccagtctgg

SEQ ID NO: 6843263 - DNA, 79 bp, Homo sapiens
agataagaggatctcagctgtgtttccctgaatgagcttatttctctagatttcagggttacagttggctctgcaatct

SEQ ID NO: 6843264 - DNA, 99 bp, Homo sapiens
gggtcctcctgcgtcctctagtccagtctggagtctgatgctctgtggcaggagcagcttgggacaggcttaggtgacactgtttgaggaacatctccc

SEQ ID NO: 6843265 - DNA, 114 bp, Homo sapiens
agaatctttatgtattaggtgtgtctcctgaagaaggcagatatttgttttgtaatatattttattctacctgtctgtattttttaagtagagcacttagaccatttacattct

SEQ ID NO: 6843266 - DNA, 58 bp, Homo sapiens
ctgccctcccagttggtccgtgtccccttccaggcttgagaccagatcctgggggcag

SEQ ID NO: 6843267 - DNA, 98 bp, Homo sapiens
cttcttatgtgtgccatgcattggaatgcatttgaagagacactcttaaaacaaagcacttctctttaaagtgttgcatatgcattcatttaaagtag

SEQ ID NO: 6843268 - DNA, 76 bp, Homo sapiens
taagacagccagagtggcccgttggcctgaacccttgcatagggttctgattggcaggcggcatctggcattcttg

SEQ ID NO: 6843269 - DNA, 74 bp, Homo sapiens
cctgggagattgggcgaggagaatgctgtgaatgagaaagacccattctttgcttccttgctttctaagacagg

SEQ ID NO: 6843270 - DNA, 61 bp, Homo sapiens
acgtcttgacgtggagagagctgggtttgcaagtgtccagtccttctccattaaggctcgt

SEQ ID NO: 6843271 - DNA, 104 bp, Homo sapiens
tcaaggaagagaatgagcacccttttctgaaccacttaaataaatctgaatgcagactgtgtttgaaaagagctgcttcaaggggctcatctgtgattccttga

SEQ ID NO: 6843272 - DNA, 60 bp, Homo sapiens
tattttagagaacctcttgaaagtggccacctcggccttttgcaataagtcactggaata

SEQ ID NO: 6843273 - DNA, 57 bp, Homo sapiens
ggtcccaggggagctctctgattggctgtgcttgggccagtcattatctcctggacc

SEQ ID NO: 6843274 - DNA, 64 bp, Homo sapiens
caaggctgtgtccaccttctgtgagctacttaaggtatataggaaaggagtggtcacaaacttg

SEQ ID NO: 6843275 - DNA, 70 bp, Homo sapiens
gggagtttttccaaggtcacatgactgcttagtggggatggcagaattcaaactcaactttggaaagccc

SEQ ID NO: 6843276 - DNA, 60 bp, Homo sapiens
tgggccggactggggtaacagcatgagtctcctgatgcccatccatggggtcatggcctg

SEQ ID NO: 6843277 - DNA, 55 bp, Homo sapiens
gcctactttttcatgaaagcagctaactagatcggctcttaaatgtaaagtaggc

SEQ ID NO: 6843278 - DNA, 78 bp, Homo sapiens
gtggaaccagctcgttcgttcctgacagtgataaaggcggcagttggatttcatctgtgaataatgaactggtttcac

SEQ ID NO: 6843279 - DNA, 93 bp, Homo sapiens
gggtacaatatatttctagcaacctatggatagagaagagaacatatattcatttattttctcatcattgggttgcaagtatgtgctaggccc

SEQ ID NO: 6843280 - DNA, 60 bp, Homo sapiens
tgatgtgtggtatcagtattggggagaaacttgtaataacttcaaaattgccacatgtta

SEQ ID NO: 6843281 - DNA, 65 bp, Homo sapiens
gcggttgccggggcaactgtgggcggggcgagcgaccccgagcccgtggttgcccaggcgactgt

SEQ ID NO: 6843282 - DNA, 72 bp, Homo sapiens
aggccacaccattagtgattaaaggcagaatgttcatccccagagcccctttcttttgatcattgtgtgcct

SEQ ID NO: 6843283 - DNA, 68 bp, Homo sapiens
agatataaatgtgcttggtaaacgtattctttcaggttgaaactagatgattatgaagcatagtatct

SEQ ID NO: 6843284 - DNA, 91 bp, Homo sapiens
gacacagtgacagatataaagtcaaggtttagactagagaaactcaagattccttctagttagaaactatgatagtctgtgatgatttgtc

SEQ ID NO: 6843285 - DNA, 129 bp, Homo sapiens
agtgaggcaagttatttatatttattatttataccctgcccacttccagaaatgatttaatttggcctaggcaagtgtcttctgatggggtgtgtgtgtgtgtgtgtgtgtgtgtgtgatgataattct

SEQ ID NO: 6843286 - DNA, 59 bp, Homo sapiens
ggggctgtggagcttgtggcagtgggtaaggaggtgcccaggtcaaaattcacaggcct

SEQ ID NO: 6843287 - DNA, 56 bp, Homo sapiens
caggtgctgacttcccactaacttcaaagggaattgaggaggaagaaagcacactg

SEQ ID NO: 6843288 - DNA, 123 bp, Homo sapiens
tggattgcttgaaggttggtgttctgtcttcatcatttgcactctaagagccaacagagttaatgtctgctgaatcagatgatgaaagatgaagcatggaacacgatgcccacaaacagtcca

SEQ ID NO: 6843289 - DNA, 119 bp, Homo sapiens
aggcaatgggcgcgggggtggcgcgggggcggcgcagacctcagtgtgagccaggaggcagtagctgtggagtttgtggcgctgactgggcgccgggtgccctgttgcgtcctctgcct

SEQ ID NO: 6843290 - DNA, 101 bp, Homo sapiens
ggaaaacttgatagagagatgaaaatatcaaagtaggcatatgtttttatgaaagtttcagaaaagtatgtttattttgacttatgtctaaattagattcc

SEQ ID NO: 6843291 - DNA, 129 bp, Homo sapiens
gtgtatgtgtgtgtgtgtgtgtgtgtgtttggtggggagggcaggggtcttgcacggtggctgcccttgtacaccggccctggctgcacctttccccaccctctgcttcccaccagcctcctcatgcat

SEQ ID NO: 6843292 - DNA, 64 bp, Homo sapiens
ggaggcccttaggacccctgcgtggtcgcccttcaggtagcgcccgtccatcttgatggcctcc

SEQ ID NO: 6843293 - DNA, 79 bp, Homo sapiens
agaaagccttccagcttgggagtttggttttatccaacaaagatacaatcaaccacttgcgagctcccgaaatatttct

SEQ ID NO: 6843294 - DNA, 75 bp, Homo sapiens
gcagctcacagtctccgccatcccagcctccaaaagggaagagacccagatgtggggactctgagagaattctgc

SEQ ID NO: 6843295 - DNA, 62 bp, Homo sapiens
aggtaactgtggctaggtaactgtgcgtgccccttgcactttgctatactcattagttattt

SEQ ID NO: 6843296 - DNA, 62 bp, Homo sapiens
gctgggtggtgactgtcctagggatggtgggatccagtagaccagaattgtcagcaccttgc

SEQ ID NO: 6843297 - DNA, 71 bp, Homo sapiens
gggagatatgtctatagagcctgtgggacgaattgctgtcttaaaggtcattctgttgatatctaattctc

SEQ ID NO: 6843298 - DNA, 75 bp, Homo sapiens
gggcaggaagttaagaaggtcaacgagggaaaaggccagaggcctgagaatgtccctgtccttcaacttctgtcc

SEQ ID NO: 6843299 - DNA, 93 bp, Homo sapiens
agaccaaatgctttagcccttgttttttactttattgtggtcagattatattaattgcataatcaggccaagtgaagtgggagctcttggtct

SEQ ID NO: 6843300 - DNA, 60 bp, Homo sapiens
ggtggcttagtgacctcatttacagtgtttcatacactctgaaactacctacaagctacc

SEQ ID NO: 6843301 - DNA, 61 bp, Homo sapiens
caactctcagtaaatttctgccccaggctccttgagaatgggttggatattgaggatgttg

SEQ ID NO: 6843302 - DNA, 83 bp, Homo sapiens
ccagggattttgtgttctattaaagtcagtcattaaatacttctttatatggatcagattggcatagtaggacagatcagtgg

SEQ ID NO: 6843303 - DNA, 80 bp, Homo sapiens
tatccaaagatttctgcttttggaggcagatagcctactttcgtgtcctccaaacaaagccagtataagaacttaggata

SEQ ID NO: 6843304 - DNA, 55 bp, Homo sapiens
ttgagacacagtttcactctgttgcccaggatagagtgtaatggcatgatctcag

SEQ ID NO: 6843305 - DNA, 67 bp, Homo sapiens
ctagaggagatggtgcagcagagaatactgttataaagcattattcttatgtcatcatggcttccag

SEQ ID NO: 6843306 - DNA, 65 bp, Homo sapiens
cgtggtttgttttcctgctttgaaaatgaaaccgttcatagctcagagatggaaagcagaccacg

SEQ ID NO: 6843307 - DNA, 67 bp, Homo sapiens
gccacagtcactgctgcaggggctggagagtcatgaaaaccgggtcctgcatcccatgagtgaaggc

SEQ ID NO: 6843308 - DNA, 70 bp, Homo sapiens
ttctcttcaggacatcccctctttaggaggacaaattttttctccagggaaaggggcgtccgcctcagaa

SEQ ID NO: 6843309 - DNA, 73 bp, Homo sapiens
ttcctgttaatggttagtaatggttattattgtttgttttaagtagtgatcttatagtgattattagtcggaa

SEQ ID NO: 6843310 - DNA, 65 bp, Homo sapiens
gtgaaaaggagtccttgttttcatttgatcttattaaatatgaatgaaattggatatcttttcac

SEQ ID NO: 6843311 - DNA, 71 bp, Homo sapiens
gaggaaaagccaggaggggagagtgtgtcagtatcactgtagtgctgatcttctcatctatcctgcccctt

SEQ ID NO: 6843312 - DNA, 59 bp, Homo sapiens
gtgattcctgggatatgagtctgggggtgtcctctgtaccctcagacatattccatcat

SEQ ID NO: 6843313 - DNA, 89 bp, Homo sapiens
ccttacagtggccgtggtcgctgactctcgtgtctcccctgttcacatgccagccatcgagggtgagtacagcggacccaagcttgagg

SEQ ID NO: 6843314 - DNA, 101 bp, Homo sapiens
tgaggcaggagaattgcttgaacccgggaggcggaggttgcagtgagccgagatcgtgccattgcactccagcctaggcgacagagcgagactctgtctca

SEQ ID NO: 6843315 - DNA, 100 bp, Homo sapiens
aagaagaatttagctttgtaatgacaagaactttccatagtaattcctctaaatgtttaggaccttattagggtggtttatgttctgtgatattcttttt

SEQ ID NO: 6843316 - DNA, 59 bp, Homo sapiens
gagatactgaaatatccttgggcaaatggaccttgctgaaggtggttttcaagtatctc

SEQ ID NO: 6843317 - DNA, 129 bp, Homo sapiens
tgctcattaagggatgccagggccagctctggtggttcctggggaggctgcgtccttccctgcttctgcatgtcatgaggcagcaggaaggtttcccctgcacctgtctgtcctggctccctctgggta

SEQ ID NO: 6843318 - DNA, 112 bp, Homo sapiens
ggagcaaaagttaacctaagcctaggtagaaccttctttactagagtattaggcatgggttgtggcaactattctaaccaaagaggctccactgagggcgggttggcaatcc

SEQ ID NO: 6843319 - DNA, 55 bp, Homo sapiens
atttttgtaatactgctgtgtgaagtatagttctacaaagcagtaggataaaaat

SEQ ID NO: 6843320 - DNA, 69 bp, Homo sapiens
tttgtttcttacaggcaagggcgctagctggtgggagccaccccgccatgctgatgtcagagaagcaag

SEQ ID NO: 6843321 - DNA, 63 bp, Homo sapiens
ggagacaaaagagagctgaggagctccagtgcttctggagggacttctgtctttttagtctct

SEQ ID NO: 6843322 - DNA, 60 bp, Homo sapiens
accatggtattgcaacaactgtcattcaatatgaagatatctctgtcctggtactgtggt

SEQ ID NO: 6843323 - DNA, 62 bp, Homo sapiens
ggataagccaacttcaaacatctgtcacccggagacagagcagttctggagctggctaattc

SEQ ID NO: 6843324 - DNA, 107 bp, Homo sapiens
cagagcggcattcctggcatcctcattcagcccgaaggtgcgccgttcaccttcggcgttatttccctgagggttgcaggtggttggtgagcgaggaggcgtctctg

SEQ ID NO: 6843325 - DNA, 70 bp, Homo sapiens
ctgttgaatagtataccatggtgtgaatatcctttatcaattttcacacacatggatagtattttttcag

SEQ ID NO: 6843326 - DNA, 86 bp, Homo sapiens
gaggttataagtggatagcaagccttcggagttacatcctgccccacagatctctgagatagtttctatcaattgttgtagtcctt

SEQ ID NO: 6843327 - DNA, 75 bp, Homo sapiens
ctggctggcatagctgcaaggccgctcctgaagctaattgagcttcctgagaacatggcagcttagtgcagtcag

SEQ ID NO: 6843328 - DNA, 60 bp, Homo sapiens
actacactgccctggggatcaaggtagaggaactaagggagtgccttagggcagtgtggt

SEQ ID NO: 6843329 - DNA, 62 bp, Homo sapiens
gaaagcatgttctgggaatagtaagggggttgtgctgcctactttgcctagaatgttctttc

SEQ ID NO: 6843330 - DNA, 64 bp, Homo sapiens
ggcgcatgtggccggcggccgcgggccgtgtcagttgcggcagccaccgcgtggcccgcgcgcc

SEQ ID NO: 6843331 - DNA, 82 bp, Homo sapiens
gtctgttgatttctgtacacccactattcattgtgttcaagctttgatgaaaatactgtggttgataggaagaaattatggc

SEQ ID NO: 6843332 - DNA, 57 bp, Homo sapiens
agccaggattggctgagccttagccaggataccacctggcattcagccacatcggct

SEQ ID NO: 6843333 - DNA, 101 bp, Homo sapiens
cagtcacctctttctggtccctgtctgaagcagccagtgctgttcctttggcctagtggggcagtggctgactttagagactaggggagagtgggtgactg

SEQ ID NO: 6843334 - DNA, 62 bp, Homo sapiens
gaaaatatgaacctgaaataaaagcactcaaattcaattgctttggcctaggtcatgttttt

SEQ ID NO: 6843335 - DNA, 67 bp, Homo sapiens
gaaggtctggctgcctggagtgagggagagagcggggtgagactccccccagggggccaggaacttc

SEQ ID NO: 6843336 - DNA, 61 bp, Homo sapiens
aggacagcccccaacagcaacatttatctaaccaaaatgtaagtagtgccaaggttgtctt

SEQ ID NO: 6843337 - DNA, 56 bp, Homo sapiens
ctggcagtgagctggccactcagtaaatgctccgatttgcagggtcctcgagccag

SEQ ID NO: 6843338 - DNA, 55 bp, Homo sapiens
gtattcttggttatcaaaatactcgtatagctttgggattttgaactgggaatat

SEQ ID NO: 6843339 - DNA, 68 bp, Homo sapiens
ttttgtctcccactttctggcctcttccaggcattgcagctggatggggccaggagtgggggacagag

SEQ ID NO: 6843340 - DNA, 63 bp, Homo sapiens
tgggagaggcttggaagtggcagaactgggatttgaatccagggctgtctccaaaggccccca

SEQ ID NO: 6843341 - DNA, 61 bp, Homo sapiens
gttagatcacatgtagagtagggggctcatttctaaccactactttacagagaagactgac

SEQ ID NO: 6843342 - DNA, 67 bp, Homo sapiens
cagtaacctaaatttcctgttattaggatatcagttgactgttatgactaaataggaaggggaactg

SEQ ID NO: 6843343 - DNA, 79 bp, Homo sapiens
ggtgatctgcgttcagctgtggggcagccggccatggctcatggaggtggcatctgacagctgactgagccagggagcc

SEQ ID NO: 6843344 - DNA, 61 bp, Homo sapiens
cagctttatcacaatattggctactggcttagtggttggaaaaattgttttgttaaagttg

SEQ ID NO: 6843345 - DNA, 81 bp, Homo sapiens
tggtcatatatctgttccctggtacaatggttcattttatgtgtcaacttggctgcgtcattgtgcccaggtatttggtca

SEQ ID NO: 6843346 - DNA, 91 bp, Homo sapiens
cttgatctgataggagaaaatggtaatatttcatagttgttttccaaagacaaatttaaatgttgtctgttatctccttacttagtttaag

SEQ ID NO: 6843347 - DNA, 68 bp, Homo sapiens
attggcatcttgggcttagggcacttaccactttttgacagtaggataagagcctgtccaatgtgaat

SEQ ID NO: 6843348 - DNA, 75 bp, Homo sapiens
gtttcattattttcaagaacagcagcattccatattttaatgtggcatctcttgatttttgaaaatgatggctac

SEQ ID NO: 6843349 - DNA, 72 bp, Homo sapiens
agttagggaaaattagcatcaaataaagctcattaataaactttgatatttggtggctgattatctttgatt

SEQ ID NO: 6843350 - DNA, 63 bp, Homo sapiens
gggtgaggctggctggaggcaggtgaggcagcccagcctcaggagccaggaaccagcttcccc

SEQ ID NO: 6843351 - DNA, 59 bp, Homo sapiens
actaggcctctgaatagaccccaaagaagcctgatttgggagataagcagaagcctggt

SEQ ID NO: 6843352 - DNA, 108 bp, Homo sapiens
agatgtttaaagcacttataataatgtctaggtaatagtatagcttaataaatgttagatatttttatttattgatatattatttctaactggtaggttgcaacattt

SEQ ID NO: 6843353 - DNA, 61 bp, Homo sapiens
atgagatgtgtctaatggaaccttggaacatgctgtccccatctcacagacatcgtctcat

SEQ ID NO: 6843354 - DNA, 101 bp, Homo sapiens
atcagtacttcattcctttttatggctgaataatgttctcttgtatgggatactttatactatttatcaagggagggttttcaacagaggagtggcctgat

SEQ ID NO: 6843355 - DNA, 83 bp, Homo sapiens
gctgcgcacagtgttggctcggctggctgccctctccaaccggtggtctggggcgggtgagcccggctgacctgagtgcctgc

SEQ ID NO: 6843356 - DNA, 87 bp, Homo sapiens
atttcatgaaacattccccttgagaaatacctgagtaaaattaattcacaatcagtagaaacccagtgggaatgtgttcatcgaaat

SEQ ID NO: 6843357 - DNA, 55 bp, Homo sapiens
ttggttttcaggggcaggataaatgctacaacagccttcagcttttgaaaaccaa

SEQ ID NO: 6843358 - DNA, 90 bp, Homo sapiens
ttctaagcctcagtttcctcacctgtaagatggaagagatagtactcatacgcttctgttcatctcatgggagaatggggagggttagaa

SEQ ID NO: 6843359 - DNA, 65 bp, Homo sapiens
tatgtctaggaaagacacagagagtttctgtgacaaagagagtttctgtgtctttcctagatatg

SEQ ID NO: 6843360 - DNA, 115 bp, Homo sapiens
gtgggaaggagaaagtataccgtaagtttatagattctttttgcttttactgtattttattgtacatgacaaaatgcacaggattaaaatggttttgcttcagactcctttcctc

SEQ ID NO: 6843361 - DNA, 83 bp, Homo sapiens
aagttattcaaactctctgagtcttgtgatcctcatctataaaataggcatggaccacaatatttgtgaggtttaaataagtt

SEQ ID NO: 6843362 - DNA, 72 bp, Homo sapiens
gtgagcagacatcaaaggctgctcagtggacagggcctggatgacaacagctttgattctttctgccatcac

SEQ ID NO: 6843363 - DNA, 61 bp, Homo sapiens
tggagctggcagcggaaaagggcacgttccactccttcctatttccgtcatcttagctcta

SEQ ID NO: 6843364 - DNA, 58 bp, Homo sapiens
ggcctccctgctcacacacccaggtcactctctgggaaccagtgcggctggggtggcc

SEQ ID NO: 6843365 - DNA, 62 bp, Homo sapiens
catggggttgaataggggattgaggttaatttgagggcctgaatcaattatgggattcaatg

SEQ ID NO: 6843366 - DNA, 60 bp, Homo sapiens
gctccctgtgctctgagtgataatctctagagatgtttataagaagttgcatagggtagc

SEQ ID NO: 6843367 - DNA, 92 bp, Homo sapiens
gaggccacacattgcagagaggagagcccagggcaggggagatagagatctgagtcctagttctggttctgtcactcttactgtgtgacctt

SEQ ID NO: 6843368 - DNA, 92 bp, Homo sapiens
ttcttgcccccatggttatcatagactaaatagttacaggtaggcccattcattgcttccatttggatacttttggttactataagcaagaa

SEQ ID NO: 6843369 - DNA, 60 bp, Homo sapiens
tccaccctcctcccagctcttggacaggggcattcctggcacccttgggttggaggtgga

SEQ ID NO: 6843370 - DNA, 57 bp, Homo sapiens
aaagaggtggtattttctgacacattcgttgtgaatccagagtaattattacccttt

SEQ ID NO: 6843371 - DNA, 70 bp, Homo sapiens
aagaagcataatgttgtaacacatagaggactggggtagtttgcatccaggttttggcaatattcttctt

SEQ ID NO: 6843372 - DNA, 70 bp, Homo sapiens
gggcaagagaccttgaccttgagcacctgttagtgacagtggctgctaggagtggtgggtcaaggagccc

SEQ ID NO: 6843373 - DNA, 126 bp, Homo sapiens
aatttagctactactgatttaacttggagctgattcagatgcctttctctgtctttcaagagtgtaaaaggtaaaattttagaaactttggaggatagattgattttgttccatttagctcaaatt

SEQ ID NO: 6843374 - DNA, 66 bp, Homo sapiens
cactggctggcagatgctcttgcttaagtcacatgactatgtagaacaggaagtactgcagcagtg

SEQ ID NO: 6843375 - DNA, 69 bp, Homo sapiens
tttggcttttcaggaaatcagaactcaagtggggaggcttgcttcctactcactggttttctggctggg

SEQ ID NO: 6843376 - DNA, 57 bp, Homo sapiens
accttggctggggcctgaatcctgcagaaacttggtcaggtagggcatcagcctggt

SEQ ID NO: 6843377 - DNA, 65 bp, Homo sapiens
ccaatttgctatgtatgtctcatctacaaattgtccgtggagtgaggcatttgtagctgagatgg

SEQ ID NO: 6843378 - DNA, 77 bp, Homo sapiens
taggcatgtgatttcaggtttttcatactgagaacattgagatttcagttggaagacaccctgaaatcttatgagta

SEQ ID NO: 6843379 - DNA, 55 bp, Homo sapiens
gagggagtgctttctgatagttgtttactggcctcttaccagaaactgctccctc

SEQ ID NO: 6843380 - DNA, 73 bp, Homo sapiens
ggtatatatgtgttttggccatggaagaacccaactgatacctctcaggctcctgacatatatgttcaaggcc

SEQ ID NO: 6843381 - DNA, 83 bp, Homo sapiens
tgcttgatttctgttgtctcctctcagattattctaggcatccaggagataaaacaggcaggaaagcagcagacatcacagca

SEQ ID NO: 6843382 - DNA, 111 bp, Homo sapiens
ggttcaaaagaaggcagaagtgtttgaaataaaataattaatggtggattttatggttgtctcattaaaacattttaattactacaaacaaaatgcatttgtatttgaacc

SEQ ID NO: 6843383 - DNA, 89 bp, Homo sapiens
atgactgtgaatctgcttgcaggctggcccttcctagattctgaaccgtttgtagagagtccttagtttgcaggtagccccaaagttat

SEQ ID NO: 6843384 - DNA, 55 bp, Homo sapiens
tttaactctgagagtaactgagaagcctccttcacagaactctaaggagcttaga

SEQ ID NO: 6843385 - DNA, 66 bp, Homo sapiens
cttggatgatacatgtgcatatatgtgtacttattcacacatgaattcacatgtattttacctaag

SEQ ID NO: 6843386 - DNA, 72 bp, Homo sapiens
ccagtgtattttcatccactcacggagaggttaattattaacacactgaaggtgagatggggtacatgatgg

SEQ ID NO: 6843387 - DNA, 63 bp, Homo sapiens
atagagtgatgtaaggtatgtgaagtgcctggccacagtttaccctcaacaaattcactctat

SEQ ID NO: 6843388 - DNA, 69 bp, Homo sapiens
tggttacacatcttgggctatcagctaagtagtctccactgcaatagctcccctgaaggtgcaagacca

SEQ ID NO: 6843389 - DNA, 80 bp, Homo sapiens
gctgaatgacctaggttctaaaagaagcaagttcataggcaaacttgcttgtgagttgctcttttgctactgtggtcagc

SEQ ID NO: 6843390 - DNA, 89 bp, Homo sapiens
taaagaaggttatgatggccctttcctggtgagatgccaactggggagaaatggggggcaaaatcagaaagttcatcatgtttgtttta

SEQ ID NO: 6843391 - DNA, 68 bp, Homo sapiens
tcgcttgaacctgggaggcggaagttgcagtgagccgagatcgtgctactgcactcctgcctgggcga

SEQ ID NO: 6843392 - DNA, 129 bp, Homo sapiens
gtgatgcaggtgtgtccttctcctattggctctcgggatgctgcttaagtatctcaggtgagtttctgaggaggtagaagccagtgtttttgagagttgtctaagaggaaggttgttaaagttttccat

SEQ ID NO: 6843393 - DNA, 88 bp, Homo sapiens
cctggttggttatctcatacactcagatattccataagtcagcctgtggcttctgaaactgtattgagaaaaagctgtataaactagg

SEQ ID NO: 6843394 - DNA, 128 bp, Homo sapiens
gctgcgaggtggccgtccactggagggcgctggtcgggggcctgacggccggcgccgcgctgctggtgctgctgctgctggcgctgggcgtccgggcggtgcgctccggatggtggggcggccagcgc

SEQ ID NO: 6843395 - DNA, 64 bp, Homo sapiens
ggaagccatgagggacagttctagttacactgagtacaggaactctaatgaccctgatggttcc

SEQ ID NO: 6843396 - DNA, 88 bp, Homo sapiens
ttattggctaactgtgtatttctagtaattcaaagtctagtgtttaatttacataatgaaatgcagaaatcaattacttggtcagtag

SEQ ID NO: 6843397 - DNA, 122 bp, Homo sapiens
gcctagcctgggagtgctgtatccctctttctccctctgaggctccatgcaggctttgttgggcaacaatgaagcctgctgcctgtggcgggggaagcagggagggtgagtctaggcaaggc

SEQ ID NO: 6843398 - DNA, 63 bp, Homo sapiens
gagttaatgagctgagtttgtaagtctttttgacaagagatcaactgctatgctcgcggactc

SEQ ID NO: 6843399 - DNA, 58 bp, Homo sapiens
tgagcccttttccttctgttttgtgtctgtaaactgaacaagatcctggaaggggcca

SEQ ID NO: 6843400 - DNA, 74 bp, Homo sapiens
tttacagctatgtcttggtgttctctggttaaacaacttcacagaacagcaacatcagacaaagttactgtgaa

SEQ ID NO: 6843401 - DNA, 65 bp, Homo sapiens
gactcagagttggtacttagcctgaggtcagagtttagtctggagttggtgccaagtctgggatc

SEQ ID NO: 6843402 - DNA, 93 bp, Homo sapiens
ataggcaaattaattcaagtgtccaaattatacagtatttttcatgggtattatataaaattctggaagcttttagtgttcagttctgcttgt

SEQ ID NO: 6843403 - DNA, 73 bp, Homo sapiens
ttctctattgaccaaaaaattccctgtgagacacagatctaatgtgtttatataatttcttggtggtagagga

SEQ ID NO: 6843404 - DNA, 74 bp, Homo sapiens
catggcagaagacagagtctacattctagacccgttgactgagggcttggttgtgtgacttggtttgagccatg

SEQ ID NO: 6843405 - DNA, 63 bp, Homo sapiens
tcagtgatacatgattagtggaataaggctttgccaaccatttcaaggtgtctgtaccactga

SEQ ID NO: 6843406 - DNA, 79 bp, Homo sapiens
agctacgcatttctcttccagtaagagtctttaaatcatcaatatttggaattctttctcgaagttggtgtgggtggct

SEQ ID NO: 6843407 - DNA, 77 bp, Homo sapiens
aatatttatcgaatgcctactatgttccaggcaccatcctgggccctgagcacacagtagcaaagaaaacaaatatt

SEQ ID NO: 6843408 - DNA, 89 bp, Homo sapiens
cccattttcagaattgctctatttcaggatgaatttctggccacaagaagacaaagtgaggtctcctgggttgaccagctgaaagtggg

SEQ ID NO: 6843409 - DNA, 59 bp, Homo sapiens
ctcccacgttcatctgccttaatagtgactagctctaagtccagaaggagaactgggag

SEQ ID NO: 6843410 - DNA, 69 bp, Homo sapiens
aaaccaattccatccatttgtttcaacagtacctaatgtttaattaaatggtgtggagaagaggggttt

SEQ ID NO: 6843411 - DNA, 78 bp, Homo sapiens
tgctattgtgaatagtgctgcaataaacatacgtgtgcatgtgtctttgtagcagcatgatttataatcctttcggca

SEQ ID NO: 6843412 - DNA, 79 bp, Homo sapiens
ggtcagcttggtgaaggtgggctgagcaagcctcagtgcctgcacctgaggtagccatggcccaagtaccatacctacc

SEQ ID NO: 6843413 - DNA, 127 bp, Homo sapiens
cagaccccaagagactggcagtaccaacccaagcgtgccctggcatgtcctcctggcatgcccgctgtgtcccttccaggatggccggggtgtgggctggtctgcagaggctctgcagctggggctg

SEQ ID NO: 6843414 - DNA, 94 bp, Homo sapiens
atgtagcatttttagatgaggtatgaagtgtgggatataaatgtaaactgaatgttcttaggccccttcgacttgtaggtataaaggtgaccat

SEQ ID NO: 6843415 - DNA, 56 bp, Homo sapiens
agccttggtcccgcgtcagccacggctgcctgctgtctccgcgggactacgaggct

SEQ ID NO: 6843416 - DNA, 110 bp, Homo sapiens
cccacatcagcccagggacagcctttgaaggggcctgaggcactaacaaggacaaggactgtgtcctgtgacctgctgtgtttgtccccaaagtgtccgtgaggagtggg

SEQ ID NO: 6843417 - DNA, 59 bp, Homo sapiens
tgttattgaggttacttataaggtgtgatagaaacaccaaggaagaacactcaatagca

SEQ ID NO: 6843418 - DNA, 62 bp, Homo sapiens
gtttgtggccttcagattgactcctgggggtttctccctcctttactcataggaccacaagc

SEQ ID NO: 6843419 - DNA, 79 bp, Homo sapiens
aagctgaagttctatgacatctgaccacacgtattcagcaggcagttgaatacttgggtctggagtcaagaataagctt

SEQ ID NO: 6843420 - DNA, 66 bp, Homo sapiens
gacctgtttctcccaacgccctagttttaaccttgatagagcatggatgggagtggacagatagtc

SEQ ID NO: 6843421 - DNA, 58 bp, Homo sapiens
aaaggcagaggatttattttaaaggactcctttgaaagggatatatctttctgctttt

SEQ ID NO: 6843422 - DNA, 82 bp, Homo sapiens
tgatgctggcttttcttatttcccccttcatcatggtaagcctactatggtgaaggggggagctaagaaaagcagggtatta

SEQ ID NO: 6843423 - DNA, 83 bp, Homo sapiens
cctcaacaaagttttcttgacgtctctaatgtgaccaaagagctgttcagtgtcgctgaggagatgtgcaaggtggacagagg

SEQ ID NO: 6843424 - DNA, 55 bp, Homo sapiens
tggctgatcaggaagttgctgactgactagagaagtcagcaggttctcacagcca

SEQ ID NO: 6843425 - DNA, 112 bp, Homo sapiens
gctctccttgggccttagtgtcagctctaaagatttataaaggttgcactggaacctctttccagttgttatttttataaaggatcagtgacattttgaggcagataagagc

SEQ ID NO: 6843426 - DNA, 68 bp, Homo sapiens
ctgcttaaaatgtgcatgaatcaatgattccgcaggtgcgtgctgcctgctgattcacccacgagcag

SEQ ID NO: 6843427 - DNA, 58 bp, Homo sapiens
acccaggctggagtgcagtgatgcaatcttggatcactgcacactccacctcccgggt

SEQ ID NO: 6843428 - DNA, 56 bp, Homo sapiens
ggcacaggagctagtcaaagcccctaaagcatcaggttggtgaccttctccttgtc

SEQ ID NO: 6843429 - DNA, 70 bp, Homo sapiens
ggctctatcctgagaaggcacagcttgcacgtgacctcctgggcctggcggctgtgtcttcacaggagcc

SEQ ID NO: 6843430 - DNA, 85 bp, Homo sapiens
ctaaaatacccaattctgcccaattttgtcaaatggtttaattctgtccaaccccatcagatgaaattcagaatggttgtactag

SEQ ID NO: 6843431 - DNA, 110 bp, Homo sapiens
gtttctttacagtgactggtggtagttccaagttctcttctttgtctcagaatatactggttggttccattcacaaagaagggaagtacatctgctgaagttaaaggaac

SEQ ID NO: 6843432 - DNA, 95 bp, Homo sapiens
cttttggctatcatgaataatgctgctgtgaacaatgatatgcaagtttctgtgtgcatgtatgttttcagttgtattaggtatatacataggag

SEQ ID NO: 6843433 - DNA, 57 bp, Homo sapiens
catcaggctgtgttcctggaaccccaataaccctgggcccccagggccagcctgttg

SEQ ID NO: 6843434 - DNA, 57 bp, Homo sapiens
tggtggaggcgctgctggccaggctcaggctgctgcgaggtcggctctcctccatca

SEQ ID NO: 6843435 - DNA, 75 bp, Homo sapiens
cccccatggtaatatagtgtgtgagagagtgaaacacctgtttagcttttttgtgtattaagaagctacaggggg

SEQ ID NO: 6843436 - DNA, 56 bp, Homo sapiens
cccaagcgggaatgcaatggcgtgatctcagctcactgcaacctctgcttcctggg

SEQ ID NO: 6843437 - DNA, 61 bp, Homo sapiens
gggaactgaagagagaagccagagtatattctaattgtagtaaatggttcttttcattccc

SEQ ID NO: 6843438 - DNA, 57 bp, Homo sapiens
ggactcaggctggtgttcggaccccttctcccttatccagacgcaggcctttggtcc

SEQ ID NO: 6843439 - DNA, 57 bp, Homo sapiens
acagaagagtaaaggatttttgctctgacagttggaagaaagtgttttcttttctgt

SEQ ID NO: 6843440 - DNA, 109 bp, Homo sapiens
ccccgtgccctcctctgcagacgtgacacccgcatgccactgtgccaggcagggcttctggaggacgcaggtgtggggttgtttgtgttgcatgtggcccggctcgggg

SEQ ID NO: 6843441 - DNA, 62 bp, Homo sapiens
ctgagcgaggagttggagctttgccataaaccaagtaaagtgaaaacactagttcttgccag

SEQ ID NO: 6843442 - DNA, 65 bp, Homo sapiens
gggcatgagatttcacccctcttaaccttccgatcctcgtgaaggaggagtgggtaagactgccc

SEQ ID NO: 6843443 - DNA, 97 bp, Homo sapiens
gcctgtgggagcctgggggaagaggcatgaagtcctgtagatttgttacatcaagatgttaatgtttttaatcaaggttcctaggtgaccctcaggc

SEQ ID NO: 6843444 - DNA, 81 bp, Homo sapiens
caagcaattttggttgatgtgagggtgataggccacattggcttcagtgacctgacatgaattaaaaacttatttgtcttg

SEQ ID NO: 6843445 - DNA, 86 bp, Homo sapiens
atgaagggagacgcccaccccctgcagcatgacactgccatcctgctcatcaggtactgcagctgcaggagggtgggagcctgcat

SEQ ID NO: 6843446 - DNA, 57 bp, Homo sapiens
cacccccttcgcacactctttcaccttgggaagggtatgggaatgaagaaaggagtg

SEQ ID NO: 6843447 - DNA, 127 bp, Homo sapiens
aatgtcctcactttcattttctgagcttagttatttgtgtcttctctttttttggtcagtgtagctaaatgttggtccgtttttgaagacagtggctgagcatggagataccaagtggcagggcatt

SEQ ID NO: 6843448 - DNA, 90 bp, Homo sapiens
gggctggatctggtgatacctcagcccaacccagcactgtggtctccatggctgcctgtcctgaggagtccgggccggagctccatgccc

SEQ ID NO: 6843449 - DNA, 65 bp, Homo sapiens
tataggaacagctagcacagaactgctcaggaaggatgcaatgtcttcagtgcatgttacctata

SEQ ID NO: 6843450 - DNA, 78 bp, Homo sapiens
gagttggaaaccctgtaggtttgctctgacctggctttgcaagaacagtttaacagacctcgcagcctgtttctactc

SEQ ID NO: 6843451 - DNA, 85 bp, Homo sapiens
gagaaaggagtttgaattttattccatacttggaaattatttgagacgttaagcatggaagtgaaataatctgacttacattttc

SEQ ID NO: 6843452 - DNA, 92 bp, Homo sapiens
ggtcatgcagctggtgggctacatgggtcatttttgtggaaaatattattattattgcacaatgagctgtgtatctcatttaatgcatcacc

SEQ ID NO: 6843453 - DNA, 70 bp, Homo sapiens
aattgcaagaattgtataccctcattgagctcatttggtttaagtgcagagtgctacgattcttgtcgtt

SEQ ID NO: 6843454 - DNA, 64 bp, Homo sapiens
ggctttacttcagcaagctttcctgggagactctaatggcagagactgttgaaatagaaatgcc

SEQ ID NO: 6843455 - DNA, 61 bp, Homo sapiens
tgaggaatgttattaaaggagctgtacaaaacttacccttggaattagctgacattcctca

SEQ ID NO: 6843456 - DNA, 80 bp, Homo sapiens
gttctgccactggacatctcttcccaactccacattctgtgacatcaagttgtgtagcctgaagttggccatggtaggac

SEQ ID NO: 6843457 - DNA, 129 bp, Homo sapiens
atgtttattaattcactcatggactccatcattcagctagcatttgccaatgcttacgggtggccagatgctgtggtaggcactggggaggcagcatggaacaggacaaatggagtttacagtagattt

SEQ ID NO: 6843458 - DNA, 76 bp, Homo sapiens
ggtgagaagtgttttttgtatatttttttgggaaaaagccaattaagatatagatatacagagaattattcacacc

SEQ ID NO: 6843459 - DNA, 61 bp, Homo sapiens
acactgtagactgttgaagtacagctgtgtatccagcattacttttcagtgtgtatagtgt

SEQ ID NO: 6843460 - DNA, 99 bp, Homo sapiens
aggatgacaacaccattctccaactagagctccccagttctcactcggcagtgggagcaccctgaggagcttcctagtggaaagaggaaaaatcatttt

SEQ ID NO: 6843461 - DNA, 67 bp, Homo sapiens
gttttgtttgtgtgtgtgtgtgtgtgtgtgtgtatgagcagctgtttacattgactacaaataaagc

SEQ ID NO: 6843462 - DNA, 96 bp, Homo sapiens
atgaagttgcgtgtgtgcatgttaatgagaaaaagagagcagacctaaacctctcccctgtgtgattttctcatgaacatgccatgtacctttcat

SEQ ID NO: 6843463 - DNA, 67 bp, Homo sapiens
tatactcacaaacattgccatgtagtcagaagttggagaacagctgttgttacaatgcaagagtatg

SEQ ID NO: 6843464 - DNA, 60 bp, Homo sapiens
agatccactcgaatccaggaatgtgtattttattattaatctttggtcttgagtgcatct

SEQ ID NO: 6843465 - DNA, 76 bp, Homo sapiens
tgcacagtatgtggtcctttgtgtcttgctcctttcatgtaagcatattttttgaggtccatctatttattgtgta

SEQ ID NO: 6843466 - DNA, 63 bp, Homo sapiens
ggaagaggtcacttctagccaagggaatttggagaagctatctggctgcagtgcacctcatct

SEQ ID NO: 6843467 - DNA, 115 bp, Homo sapiens
tgagtctctaatttggagtttgtttgtggttttgaggactgagaaggctgccatgttactaagttgcctccacttctttagtatgacaggaaacaaactctaccaaagagactca

SEQ ID NO: 6843468 - DNA, 59 bp, Homo sapiens
tgagcacctactaagtgccaggttgccatgctggtgaggctgctgagatgggtgtgtca

SEQ ID NO: 6843469 - DNA, 68 bp, Homo sapiens
gagaatttgtcttgaattttaaacaacatttgattccaaaatggggagatttagcagacaaagctctt

SEQ ID NO: 6843470 - DNA, 56 bp, Homo sapiens
ctctttcccctacagagcacattagacagatatgtgagtctctgtacaggaaagag

SEQ ID NO: 6843471 - DNA, 75 bp, Homo sapiens
gaggctagaatgatttggaatgttaggtgtctcatataatgagccaaatgcatttccatattgttctgtgtcctc

SEQ ID NO: 6843472 - DNA, 59 bp, Homo sapiens
gtcattccttgagccgtggccagggccagcatgtggcactggcctggggccaagaggac

SEQ ID NO: 6843473 - DNA, 71 bp, Homo sapiens
tggaggagcagggcgctgtctggccagcggtgccatagcaaccactggctccgatgctgccaccacctcca

SEQ ID NO: 6843474 - DNA, 55 bp, Homo sapiens
ctctgcattttaacagatgattagttatacatgtttgtttgcttgaagagcagag

SEQ ID NO: 6843475 - DNA, 129 bp, Homo sapiens
cactgtccttccattgatctttttgctttgggtagtcttccaattatcctaagaatagtagactttgggaaggaagtgggaagggtctgccaggtagagcagaatcaacgatcttcaatccagacagtg

SEQ ID NO: 6843476 - DNA, 68 bp, Homo sapiens
ctgtaatcccagctacctgggaggctagggcagcaaaatagcttgaacccaggaggctgaggttgcag

SEQ ID NO: 6843477 - DNA, 73 bp, Homo sapiens
gtgtataatgtctcatgcaaaatttagttatttgtttctcagcttaaactggattttgatgagcagttttcac

SEQ ID NO: 6843478 - DNA, 64 bp, Homo sapiens
ggcatctgagacagaagttggaattagatactgaaccagactgtctgtcaactcctgggatgtc

SEQ ID NO: 6843479 - DNA, 84 bp, Homo sapiens
gaggatcaatgggaatagaaaatgtattctatattttccttgttacatagagttagagcgcatattttattaatgttcatcctt

SEQ ID NO: 6843480 - DNA, 82 bp, Homo sapiens
agtgctcattatattgtagagagggcctttggagctctcattagatttgacaggaattctctctagggggaaactgggcatt

SEQ ID NO: 6843481 - DNA, 63 bp, Homo sapiens
gctgttgctgggagcagggatcctgtttggaattacaggattcgttctactctaagcataggc

SEQ ID NO: 6843482 - DNA, 79 bp, Homo sapiens
ctggtggctctgaaaaatggaggttggctgcagatactccaaacctgcttcgctgtgtcaccctcttcagggccagtgg

SEQ ID NO: 6843483 - DNA, 55 bp, Homo sapiens
ttgcaaagttttaaatgtttatagcacatcatttgcttttgacattgctttgcag

SEQ ID NO: 6843484 - DNA, 61 bp, Homo sapiens
ttaacaaggtgactgcattaaaacatttattagtctgtttatgctttggcactcttgttag

SEQ ID NO: 6843485 - DNA, 58 bp, Homo sapiens
gccgaagctccaaggttcctccgcttcctgcccgcaggcggaaccttagagcttcagc

SEQ ID NO: 6843486 - DNA, 84 bp, Homo sapiens
agtcagtataagtggtcacttatgtgtaggcagcttataaataagcctgtaacacatgagtggtgattattgtgccatttgact

SEQ ID NO: 6843487 - DNA, 78 bp, Homo sapiens
ggagagggcagtggggaagagcatgggccctggaccttagatggctcagggttcgaatctcctcttcaccccttctct

SEQ ID NO: 6843488 - DNA, 56 bp, Homo sapiens
acttctggaggcctagggaagatgctgttttcttgcctttttaagctaccagaagt

SEQ ID NO: 6843489 - DNA, 80 bp, Homo sapiens
caggatggaagatgtaccaggtattacaggagcaggtaagagggctatgtaaccatatactgggtgcaatgtctaaactg

SEQ ID NO: 6843490 - DNA, 72 bp, Homo sapiens
ggagtttcagagactgagtgacctttctgatattgcacagcacatcagagacaaaaccagcacttgaactcc

SEQ ID NO: 6843491 - DNA, 76 bp, Homo sapiens
tattttcagatactcctggtctcaggaggaggagtgtttctggtctttctctctgaggaaggagcatctgtgaatg

SEQ ID NO: 6843492 - DNA, 104 bp, Homo sapiens
ataagtataataccatctctatcatgcagggatgttgcaaagaatatgcaattccacatattctttgcaacatccctgcatgatagagatggtattaggcttat

SEQ ID NO: 6843493 - DNA, 110 bp, Homo sapiens
gggtattggaatagccttttctctcagttaaactttgtgaatgttatctgtgtttaactccaagtttgagactgagagtggggcaaatgaagcctttttccactaattcc

SEQ ID NO: 6843494 - DNA, 123 bp, Homo sapiens
cagccttttcccctcccctctgaaatctgcctgcccacagagagggtgcattctgagtttctctctctctcagctatgctctaagcttagtgaggcagagtctacccttgtaggaatgagctg

SEQ ID NO: 6843495 - DNA, 62 bp, Homo sapiens
taagagctaggattttaaatcagccaatgttgataaagttgattgtaaaatgttggtactta

SEQ ID NO: 6843496 - DNA, 84 bp, Homo sapiens
gggcacagcgcagccatccaggggtaccctggagcccgacagaagcagggccgggctccagatgtctcctggcaaatgcgcccc

SEQ ID NO: 6843497 - DNA, 58 bp, Homo sapiens
ggtagcaatcagaaagaaccttgggatttgggggtccagagagatcttctgatagacc

SEQ ID NO: 6843498 - DNA, 120 bp, Homo sapiens
ctgtgtcttctctctactcttcatttcctgcctttaaggggacctggaaacaaacatgaatggcacagaaccttggtggtagggacacagtggagagtgagtgttggggataagacagag

SEQ ID NO: 6843499 - DNA, 65 bp, Homo sapiens
tttcgattcctatttggctcctgttccttccaatgggaactttgtggggctgagaggaagggaga

SEQ ID NO: 6843500 - DNA, 79 bp, Homo sapiens
tagtgtacagtctctgagttgtaaaaaatagtcattcctttctgcttgaaagactgtattagctactcagggaatacta

SEQ ID NO: 6843501 - DNA, 66 bp, Homo sapiens
ggcactgtgaaagtaagtcagactttacttaattattgtgaaagtaagtcttacattcacattgcc

SEQ ID NO: 6843502 - DNA, 86 bp, Homo sapiens
ccagatccattttcttctctaatctcaatgatctcatctataaagacaagttggtctaagggttaggaacgacagtgcaggtcagg

SEQ ID NO: 6843503 - DNA, 62 bp, Homo sapiens
ggcagtggctggacagcagggcacctgggggcttagggtaccccttctgctccagctttgcc

SEQ ID NO: 6843504 - DNA, 68 bp, Homo sapiens
tcattcttgtcttgctggacagcttcacggagattaatctccctaaagctgtccggcaccctgagtga

SEQ ID NO: 6843505 - DNA, 69 bp, Homo sapiens
tacagacacagattttggaaaagatccatatatggaaaatctttatggccaaaaattttctttgctgta

SEQ ID NO: 6843506 - DNA, 58 bp, Homo sapiens
catgcctttattgttagtcttcttccccagaggagtcctgatctaattgaagagcgtg

SEQ ID NO: 6843507 - DNA, 56 bp, Homo sapiens
ggcatggttgagttggtgtttatcagtcacaatcaagcagcattgtaaccaatgcc

SEQ ID NO: 6843508 - DNA, 129 bp, Homo sapiens
tgacttttggtcatgttttagttggtatttgcttctgtgggtgcctatggctgaaggtaaatgtttgttttcttaacctgggcatcaacaagcagagatgacataaaaatgagtttagattgaaagtta

SEQ ID NO: 6843509 - DNA, 56 bp, Homo sapiens
cccaggagcaggcccaaggacacatgggccctatgagctgaggaacctgccctggg

SEQ ID NO: 6843510 - DNA, 76 bp, Homo sapiens
gatgatgctaggtgttagggctgcaataccaaatactagattattcacaggttcatgaggctcatctagcatcatt

SEQ ID NO: 6843511 - DNA, 82 bp, Homo sapiens
agtccagacttttctcttgagctcctgtattctgtttcttacttgacagctctacctggacatcagagagacacattgtact

SEQ ID NO: 6843512 - DNA, 100 bp, Homo sapiens
agctaatggctgatggctacagtttccaagggcttgaagtttagttctcagtgttttgaaggtgtttctttatgccctccgagattgcatcaccctagtt

SEQ ID NO: 6843513 - DNA, 82 bp, Homo sapiens
tttcttgctatgtgtagatagtgatttatgaccattggctaataaaatctaatgagtatgatgcacatttataagcaggaaa

SEQ ID NO: 6843514 - DNA, 85 bp, Homo sapiens
gatatagacagtgggaaaagggcacacaaaggcagcatttgagcatagctaacatttgcttcttgtgcctggtctcctaaatatc

SEQ ID NO: 6843515 - DNA, 76 bp, Homo sapiens
tttgtgtgatctggctatggggcacttttgtagaaaccaaaatttatgtctgttttcatatcagatattcagcaga

SEQ ID NO: 6843516 - DNA, 80 bp, Homo sapiens
cttttattttcaatgccgtagagcagaggtggggagtatttcaagaagttcttgtcatccttcccccttttggcataaag

SEQ ID NO: 6843517 - DNA, 71 bp, Homo sapiens
caggggcactaatgacattgtatccacagagcaaaatttgaatgttctgtaatgatgtcattaaactcctg

SEQ ID NO: 6843518 - DNA, 69 bp, Homo sapiens
gccccttgaactacatcaccctatttctgtccatggtgggcagtactttaagggatgaagctctggggc

SEQ ID NO: 6843519 - DNA, 97 bp, Homo sapiens
gtgggctccatgactttatgaatattcttcattcaggttctaaactgctagtgcactttctaggaccctgcgtgagaacgtagagctcagtgctcac

SEQ ID NO: 6843520 - DNA, 67 bp, Homo sapiens
ggtccaagggtcaccgacacctgcccctcccctcctcatgtctgctggtgcaggttccccttgcact

SEQ ID NO: 6843521 - DNA, 58 bp, Homo sapiens
atgatggtgaggttgagcacagagctggtgagaagttcacagtcacttcgcctgtcgt

SEQ ID NO: 6843522 - DNA, 79 bp, Homo sapiens
cagtccaaaatgtcagtgttactgctattgaaaagccttgatctataccagttagcacatgacatccttctggcaactg

SEQ ID NO: 6843523 - DNA, 57 bp, Homo sapiens
ggcaattcatgttaaacagaagcagtccagtactgccatgtttaaagttgaagggct

SEQ ID NO: 6843524 - DNA, 94 bp, Homo sapiens
gatgagattatgcacagtgtgagagataattcattaagttattcagtatataatattgagtatttctaatattccagtgcatagtttaggcatc

SEQ ID NO: 6843525 - DNA, 65 bp, Homo sapiens
ggccctggggaccaggagcaagcaggggggtgaaaaagagctgcctgttccaggaggccagggct

SEQ ID NO: 6843526 - DNA, 61 bp, Homo sapiens
tgagggactggtccaggatctcacagctagcagagctgggactcagaccagttctgtctca

SEQ ID NO: 6843527 - DNA, 58 bp, Homo sapiens
gcggggccgctgcgcctccaaccgagcgccgacagagggcgcccgcggcgagcctcgc

SEQ ID NO: 6843528 - DNA, 81 bp, Homo sapiens
tgatgctttattcattcgatttaacctagttccagtcttccagattctttctagtgagtctgaatgagttgcccagggtca

SEQ ID NO: 6843529 - DNA, 57 bp, Homo sapiens
agccgagagtatttgccagagcggccatgtggaggtcatggccaggtactgtctgct

SEQ ID NO: 6843530 - DNA, 73 bp, Homo sapiens
gcctctgtttcttcaggaatgaaatgggataatgagccttatctcacactgtgaagagacaagcagataaggc

SEQ ID NO: 6843531 - DNA, 60 bp, Homo sapiens
ctaggcagtggcccttcatcatgacagccacgcaagctgaaggagaaggccactgttcag

SEQ ID NO: 6843532 - DNA, 78 bp, Homo sapiens
ctttttacaagttattgggagagggaatgggagggacttaattcttcccagattcctgctcttatataatgtaaaggg

SEQ ID NO: 6843533 - DNA, 59 bp, Homo sapiens
agggcgttagtatacactgcaggcaaataatttgccaaaagctaatgtattagggcctt

SEQ ID NO: 6843534 - DNA, 65 bp, Homo sapiens
cttcttaatgacagattaaaatagttgtcaaggctctgatggggtgaaactctgtcattaagaag

SEQ ID NO: 6843535 - DNA, 62 bp, Homo sapiens
cccaggactaatgagctctacgctgagggcatctctgaaggaactggaactcgatggctggg

SEQ ID NO: 6843536 - DNA, 66 bp, Homo sapiens
gtacctgcaccaggcccagcatggtgcccccagcatttagcacacggcctggtacatagtagttac

SEQ ID NO: 6843537 - DNA, 58 bp, Homo sapiens
cctggcctttgaacgctagactgcagaaagcggcaggacagcggttctcaaagtcagg

SEQ ID NO: 6843538 - DNA, 58 bp, Homo sapiens
agggatcatcctgcaagtgcctctgcagcttctccaggggctttgaaagatggttcct

SEQ ID NO: 6843539 - DNA, 129 bp, Homo sapiens
tacattttccttcataacttatctgtgtatttgtttatttatattctgccttctgctgaggatgactttgagcagcctgcaaaggcacatatatttgagattacaatgtgtttaaaataagaaaaatga

SEQ ID NO: 6843540 - DNA, 68 bp, Homo sapiens
gtgttctgtctgagcaccacaggatatcatatgtgagtggcttccagtgggttgctgagggaggggac

SEQ ID NO: 6843541 - DNA, 97 bp, Homo sapiens
tgcaaatcaagctcccctagtagctaatctaattcatcacctgccatggttatgatttaggaaacagctacaggtggctaaagagcattgacttgca

SEQ ID NO: 6843542 - DNA, 58 bp, Homo sapiens
acttgcttgggccatctcgcttggcagcgtcaaggctgatatctgggcccaggcaggt

SEQ ID NO: 6843543 - DNA, 60 bp, Homo sapiens
gttgctgcccgtacctgtgcacttggccacagtccaaagtgactccattgcgggcacagc

SEQ ID NO: 6843544 - DNA, 62 bp, Homo sapiens
gcatgctccacgcttgtgagcgatgtctgtctgcctgccaaaagaagctgctggatgcatgc

SEQ ID NO: 6843545 - DNA, 60 bp, Homo sapiens
tttttcatgtgctgtattctgtttggctccaactagcagaaatacccagcatttggagag

SEQ ID NO: 6843546 - DNA, 123 bp, Homo sapiens
ttgcaaatctttcttatgttaaatgtgactctaaaatgctatgagatctgaaaaataaatgcaaaatcagaaagatttcttcttaagccttttgggcaattgactttagcatcaaagaggcag

SEQ ID NO: 6843547 - DNA, 58 bp, Homo sapiens
tgggctgcagagcccggccttccactgggctaatggagggaggggtgaccgcagccca

SEQ ID NO: 6843548 - DNA, 110 bp, Homo sapiens
ctgggaagacctttccgtcggtctgtcagtctgtccctgcctggcgggctttctctgggaaccgctgcagacgcgctggcgaaagcaccaccgccaagagtcatgctcag

SEQ ID NO: 6843549 - DNA, 58 bp, Homo sapiens
aggcagaaaacaataaccatttcaaggatcacttaaggaatcctggtgttttctgcct

SEQ ID NO: 6843550 - DNA, 107 bp, Homo sapiens
aaagcatgaatagcaataggaaaaggtcattggggactatctccgagtctgacagttacaatcttgagatgagcttcctaatgaaagattaatgctcaacatacttt

SEQ ID NO: 6843551 - DNA, 72 bp, Homo sapiens
attcgtttacttatctgttctgccattggaccctaagctttataatggcagaatccatagtaggtgccgaat

SEQ ID NO: 6843552 - DNA, 78 bp, Homo sapiens
ttcccttggccattaccatttgccttttctgaagcctgtgttaaagtgatccagcaaatgaactgatgccaatgggaa

SEQ ID NO: 6843553 - DNA, 60 bp, Homo sapiens
tctggcagttgccgcttcagtcttggccttagcctcatcttgaagtgggtagctggcggg

SEQ ID NO: 6843554 - DNA, 129 bp, Homo sapiens
catacatggctttgattctctgctacacatttctcagatggttttatgagacctcaggaataatacctatttcttggctttgtgtgaggactcagtgaaacatgttaggaatgctgtgaagtctggttg

SEQ ID NO: 6843555 - DNA, 58 bp, Homo sapiens
tatgtatacatttaactagatagaaatggaaccatcgtctataagtgatgtaggcata

SEQ ID NO: 6843556 - DNA, 66 bp, Homo sapiens
ccgtagttatttatttaccactccctttaggctgtggctggaatatgggaatgtaaataatgatgg

SEQ ID NO: 6843557 - DNA, 57 bp, Homo sapiens
gcacatgtctgttcacatgttacaatgacagaattgaggagttgtgacagatactgc

SEQ ID NO: 6843558 - DNA, 68 bp, Homo sapiens
ggtgatgtttatgacctccataaggatttccattaatccctaatttctgtcggtcatgacactctacc

SEQ ID NO: 6843559 - DNA, 64 bp, Homo sapiens
cttcatgagcacagctgagcaggtgcggctgccggatgactgcacagttggctacatcgtggag

SEQ ID NO: 6843560 - DNA, 70 bp, Homo sapiens
atcttgagagttaatgtatcttctacataataggcattcagcttacatgtgataaattgattaaaaggat

SEQ ID NO: 6843561 - DNA, 58 bp, Homo sapiens
agcttggcttgtgaccagggagtgacgtctaggaagagaggtcagcaggggccaagct

SEQ ID NO: 6843562 - DNA, 63 bp, Homo sapiens
atccctgtgtgtgtgtgtgtgtgtgtgtgtgtgtgtacttgcataaaaaccacatacaaggat

SEQ ID NO: 6843563 - DNA, 58 bp, Homo sapiens
ctgattgtgcagaggtgtaattgaaatgttttgttcaatgttacacaggtataatcag

SEQ ID NO: 6843564 - DNA, 67 bp, Homo sapiens
ctgcttagcatgattacatgaagccaggtagaaatccacttacctatttatgcaattatgaaaacgg

SEQ ID NO: 6843565 - DNA, 126 bp, Homo sapiens
ggcagaccttgggtctttcttattcatagattaattcctagcactgagaatagtgcatagctctcattagctattcagtaaatatgtgctgatttgatgaatgagtgaatgtgggcttgccctgct

SEQ ID NO: 6843566 - DNA, 128 bp, Homo sapiens
agtggggatgttaatatcttattaggttgcctggatgattgaattagatcctgcataggttgtgctttgctcagagcctgacttataggatgtgcttcatcaaggcaaacctgctgttcattcttgct

SEQ ID NO: 6843567 - DNA, 78 bp, Homo sapiens
tgtttcttgttacaacagtaccgtgctgtgcttcagccatccataacacgcccactgtatgtagtctcataggaggca

SEQ ID NO: 6843568 - DNA, 67 bp, Homo sapiens
tcattagaaatgcagattctcatgccccaccccagacctgcttcatcagaatctgcattttcagagg

SEQ ID NO: 6843569 - DNA, 57 bp, Homo sapiens
tttacagatgaggaaactgagatgcaaacaagtcaagtaacctgccacatctgtaaa

SEQ ID NO: 6843570 - DNA, 70 bp, Homo sapiens
taagaattgcctttcaattgtttgatgtcaaataacgatggcgcccgaaaataaatgtaagggcttctta

SEQ ID NO: 6843571 - DNA, 101 bp, Homo sapiens
atagccacacatatatacttttgttactttttattccttttgattttaactagcctggctgaatatgaatgatgggaaggagaaaagcaaaagggggttat

SEQ ID NO: 6843572 - DNA, 55 bp, Homo sapiens
ctacctcactttttccatcccattctctgggaatcagaagaagcttgagaagtag

SEQ ID NO: 6843573 - DNA, 61 bp, Homo sapiens
atgggtccacttctgcactgtggcttagcctctcttcctagtcacaccaggagtggcccat

SEQ ID NO: 6843574 - DNA, 61 bp, Homo sapiens
ccatgaccttgtagaacctgctagaatattcattaccaagtatgttctgtggctgtcatgg

SEQ ID NO: 6843575 - DNA, 76 bp, Homo sapiens
gaatacgggattttgagattaagcaaaattttcaagatcagaaagtttgtaagtggtagatctaagattctgattc

SEQ ID NO: 6843576 - DNA, 59 bp, Homo sapiens
ggagcaggcaaagatgaaaggagaaatttatttcctcataacaactctttgccttttcc

SEQ ID NO: 6843577 - DNA, 84 bp, Homo sapiens
gtctccagccttctcagctcagccccttatcgaaatgcactaagcaccatcttcaaaggcgctgggctaaggcaccagggagac

SEQ ID NO: 6843578 - DNA, 67 bp, Homo sapiens
cagccaagccctggggttgcacaaggccactttgtggcataatgccctggctctaagagtaaggttg

SEQ ID NO: 6843579 - DNA, 96 bp, Homo sapiens
tctaaaatgttctataaaaggtcagacagggtgtctttctctgattccatcaggcctctgggaagaacctctgctaccaattatgtgctacttgga

SEQ ID NO: 6843580 - DNA, 75 bp, Homo sapiens
ctctgtccctagctgagtcatgggactggggaagctaccactcagattcctcctgtgagcagcacagagacagag

SEQ ID NO: 6843581 - DNA, 61 bp, Homo sapiens
ccttctagagatgttcttcttcaggtggagcctcacctttggaaataaacactctgcctgg

SEQ ID NO: 6843582 - DNA, 85 bp, Homo sapiens
ctctactgaatacctaagagaatcagtgagcagttgtgatatgatggtatctaccactgattcctgatgtgaaattgttcaaggg

SEQ ID NO: 6843583 - DNA, 59 bp, Homo sapiens
tcagctgctcaaatttatgtcaaggaaagccaaattctattaatattttgtgtagctga

SEQ ID NO: 6843584 - DNA, 57 bp, Homo sapiens
aacagcacataagccgaagactgtgtgtgtgtgttgcacaggtacattatggctgtt

SEQ ID NO: 6843585 - DNA, 77 bp, Homo sapiens
atagggctggaatgaatttggcttcctcctggagcaccacttttggggagaataaatcagattttaactggccctgt

SEQ ID NO: 6843586 - DNA, 64 bp, Homo sapiens
attactaaggcagttttgcctgagatatttggtaatcatcttaatttcaaggctgtctggtgat

SEQ ID NO: 6843587 - DNA, 78 bp, Homo sapiens
gcagatagcacagtggtaagggcataggcactgagatcatgccccatggtccaaatgctggccctgctacttatcagc

SEQ ID NO: 6843588 - DNA, 70 bp, Homo sapiens
agtgaatggcagatggcctggaaccaaagcctcctggctcccaatccattgcttctgccatgaaatcatt

SEQ ID NO: 6843589 - DNA, 58 bp, Homo sapiens
gtggctctgtgctttgccaaggatgcagtctggcgccccagcagggacacagggtcac

SEQ ID NO: 6843590 - DNA, 75 bp, Homo sapiens
gaggctaagaatcttttaggggatcctgagggttggtgctttctgcaaaatacctctaaaaggccttgtggcttc

SEQ ID NO: 6843591 - DNA, 77 bp, Homo sapiens
gtggctggaactgcaggtgtgggtggctgccaggcccagctctgtgcctgcacttctcacagctgctgtgtgtccac

SEQ ID NO: 6843592 - DNA, 76 bp, Homo sapiens
gtgagggtggtgtgagcttgaggcccatgaggggatggccaaggtgggcgtgggccccagccactccctccctcac

SEQ ID NO: 6843593 - DNA, 63 bp, Homo sapiens
tattaggttggtgcaaaattaattgtggcttttaatggcaattacttttgcaccaacatagta

SEQ ID NO: 6843594 - DNA, 72 bp, Homo sapiens
ccagaatgttcttaggtctgatcctcagtgaagctcatgggctctttttggtctgacttgcgggcactctgg

SEQ ID NO: 6843595 - DNA, 72 bp, Homo sapiens
tcctcttgaatagcaagtagtgcagatgtacatagaacctgttgcctgccacgcttgctaccacaaaaagga

SEQ ID NO: 6843596 - DNA, 69 bp, Homo sapiens
ctgtttttaaggtttctagtttctaaactccatgccctgtgctgagtttagaagaggaacttgttacag

SEQ ID NO: 6843597 - DNA, 57 bp, Homo sapiens
agagtttgtgtcctttatcaggaagcattggcatcaaatggggagggcataaattct

SEQ ID NO: 6843598 - DNA, 79 bp, Homo sapiens
ccacatggctagtaagtagcattgtgaggattcaaacccatatttgactccaaagccccatgcactttctactatatgg

SEQ ID NO: 6843599 - DNA, 86 bp, Homo sapiens
aggtgctgaggaccccaaacacagagggccccctggccacagtctgtgtgagctggctgggtccatggtcctcgggtccctctcct

SEQ ID NO: 6843600 - DNA, 59 bp, Homo sapiens
gcttgaagccagttgcctggtggacaactattgctatccatgagatgtgggcttctagt

SEQ ID NO: 6843601 - DNA, 66 bp, Homo sapiens
ggataacttgatgttatttgtccacctgaccactaggtggcaataaagaccaacaggttacaatcc

SEQ ID NO: 6843602 - DNA, 59 bp, Homo sapiens
ctttcactttcagatgctccctccggccattccatcatagggctctgtaaggttgaaag

SEQ ID NO: 6843603 - DNA, 55 bp, Homo sapiens
gactgaaattataccaagtggttaacgttgggcaaattacttggcaaagtcagtc

SEQ ID NO: 6843604 - DNA, 74 bp, Homo sapiens
cccacaggcaggctcactgtaaggtcagctccatcacagtggcagctaggagattttgtgaggcttcctgtggg

SEQ ID NO: 6843605 - DNA, 93 bp, Homo sapiens
tcctgatcccaagtcagtagcgggcaccctttgagggtttgagttactctaaataggaaccacgggctggccttactgcccttgagatcaaga

SEQ ID NO: 6843606 - DNA, 66 bp, Homo sapiens
tgtgtcctggtgccactagagaatgtctgcttcaagcaggcaggactcttctgtgggccgaacaca

SEQ ID NO: 6843607 - DNA, 84 bp, Homo sapiens
cccctgcagtgacaggtggctctgacagctctggtttgtcagcaggcagacacatgaggatgaggggatcatgaggatgagggg

SEQ ID NO: 6843608 - DNA, 57 bp, Homo sapiens
ggaggagggcaggggttgaccagagaaggcctcctctgcacctgtgccccatccttc

SEQ ID NO: 6843609 - DNA, 64 bp, Homo sapiens
gctaagttctttaacgagtaagatttgcattacaaagtttttccattgttggagaaggcctagc

SEQ ID NO: 6843610 - DNA, 93 bp, Homo sapiens
agggagtagcggggcagaagccgcaggaagtcagtgcaggacgccggaggccactcctaattgcttcatgtgttgttgccgtgctgatgacct

SEQ ID NO: 6843611 - DNA, 65 bp, Homo sapiens
caggtgtcagcagcactgtactccctcaaaaacctatgggggtccggggcagtggctcatgcctg

SEQ ID NO: 6843612 - DNA, 88 bp, Homo sapiens
ctgtcaggtttgggctccctgtccttggctgtgaggctgctgctgcaggccaggatagcatggatcagaagaggtgtaaatctgacag

SEQ ID NO: 6843613 - DNA, 55 bp, Homo sapiens
gggtttggtggaggggaagggcagtggttcttgcccttgggcttccacccagccc

SEQ ID NO: 6843614 - DNA, 57 bp, Homo sapiens
cagctaatcctctctatccaagttgagtacatttctaaaatagaggagggtagcgtg

SEQ ID NO: 6843615 - DNA, 63 bp, Homo sapiens
cactttcactgtacgccaggctctccttggagcacccgctggtccctgcagttctagaaggtg

SEQ ID NO: 6843616 - DNA, 108 bp, Homo sapiens
tccttcccatgaagcctattcagtcatgctctgaaggaagagccccatttgactcaggttggccttcttccttaagggccaggcagaaggatggctgagtacagagga

SEQ ID NO: 6843617 - DNA, 65 bp, Homo sapiens
tgtggctgggctaataggcaaagccagggactatttcaaactggagtttctgcagcccagcagca

SEQ ID NO: 6843618 - DNA, 64 bp, Homo sapiens
ggcaggcatcctggtggttgatgaccaggaactgcatggccagttggccccgggcatgcaggct

SEQ ID NO: 6843619 - DNA, 63 bp, Homo sapiens
gtgggcaggatgcgttgattcttccccaggtctatgagggagagcctgctccatgctgcttgc

SEQ ID NO: 6843620 - DNA, 64 bp, Homo sapiens
ccagtgtgaagttctttagtgaggaaaggagatagctttttctctcttaaggagtttaaaatgg

SEQ ID NO: 6843621 - DNA, 83 bp, Homo sapiens
gctggcttcatgagctttcagaagaggacctttccagaatgagaaacttggaatctttaggaagcacatagacatcagttagc

SEQ ID NO: 6843622 - DNA, 56 bp, Homo sapiens
acagccaacgtctttcttacttcctgatcggacaggaagtaggtttcagttgctgt

SEQ ID NO: 6843623 - DNA, 57 bp, Homo sapiens
ttaagggaatgattagagatttgtttgaccctgaaattgtctgtaatttttccttga

SEQ ID NO: 6843624 - DNA, 71 bp, Homo sapiens
tggagtggctgctgactttaatacatgaaaaaaagtgttgccatctgtacttgaaatcagctgtcacccca

SEQ ID NO: 6843625 - DNA, 57 bp, Homo sapiens
caaggaaaagaagtatttcagaagcatcctgctttttaaatgctagaattttctttg

SEQ ID NO: 6843626 - DNA, 94 bp, Homo sapiens
ggttttcaagaaggatgttctatactagattatttgcatagccagcagggcagtgtgattatctggagtagaaaaatcgcttcctgaagtggcc

SEQ ID NO: 6843627 - DNA, 72 bp, Homo sapiens
aagagattaccttggactccagatgctgactaaagatcagatagatctggaaaatcacaggtgcaagctctt

SEQ ID NO: 6843628 - DNA, 57 bp, Homo sapiens
tttgtaacactcccactcttcttccaaagaggcaagaagaggtgacagggttatggg

SEQ ID NO: 6843629 - DNA, 73 bp, Homo sapiens
ttagagctttctgggaagtgttaatcttgaactgaaccttaaggttaaataggtattttccagacagtgctaa

SEQ ID NO: 6843630 - DNA, 64 bp, Homo sapiens
attgatgccactggagttgtttactaacctgaagatcacaataaataaaacagttggtgtcaat

SEQ ID NO: 6843631 - DNA, 57 bp, Homo sapiens
tggtctgtgcagggaccccaagagtttaaaaaggtgaatccttccttgcagggtcca

SEQ ID NO: 6843632 - DNA, 60 bp, Homo sapiens
ggctgagcttttcatgatggttcctgctgacctggaaacatcttaaatggaaggttagct

SEQ ID NO: 6843633 - DNA, 87 bp, Homo sapiens
ggaaagaagaaaggaaaggaagaagggaggggagttagttgagtctaactatgtcccagacactttatcttatttcattttcattct

SEQ ID NO: 6843634 - DNA, 82 bp, Homo sapiens
caggtttgtcaaagatcagatggttgtaggtgtgcagtcttaattctgggttcttactctgttccattgatctacatgtctg

SEQ ID NO: 6843635 - DNA, 87 bp, Homo sapiens
tgtagaaacagttgggttgtaaaatatcacatctctttggtgacagtgctgtgatgtggcttttctaacccttccaactattctata

SEQ ID NO: 6843636 - DNA, 65 bp, Homo sapiens
gcatctttgtctgaacagggacattctagacatagcctctcaagaggtccctgaagataaattgc

SEQ ID NO: 6843637 - DNA, 57 bp, Homo sapiens
gagttaccatgaattgttagccggttgaatcctaaattgacaacaaaatggtaattt

SEQ ID NO: 6843638 - DNA, 82 bp, Homo sapiens
ttaagccagactattaatatcagtcagaggatattcagattaatcagttttagttctgctgtaatatctctgctgggcttga

SEQ ID NO: 6843639 - DNA, 60 bp, Homo sapiens
gtctcaaatttgttagataaaattcctgacccttaagaattttgtctttaaaatagaggc

SEQ ID NO: 6843640 - DNA, 79 bp, Homo sapiens
taaaggcaatgggaagagtggatgttggtgctgggtacatacactctggaagcacaatttgactctattcatactttta

SEQ ID NO: 6843641 - DNA, 63 bp, Homo sapiens
ggagaggcctgctttggcactctgggcaaaaagagttgctaagatcccagagcaggcctgtcc

SEQ ID NO: 6843642 - DNA, 60 bp, Homo sapiens
tttgtgctggaatctggctgccaccgcaatatcctgcaggaagcaaccaggtccaacaaa

SEQ ID NO: 6843643 - DNA, 79 bp, Homo sapiens
gcctgctccggaatgttctgggggcatgggtgcatgggcttgtgcactgacatttcaagaacagctcttgatggtaggc

SEQ ID NO: 6843644 - DNA, 94 bp, Homo sapiens
taccattatgaatacattttaccttaaagtctatattgcctgttattaccatagatacactagggttttggggtggggtgacttttgcatggta

SEQ ID NO: 6843645 - DNA, 70 bp, Homo sapiens
gtgttagagcatgcccttgctactatgttgattcagatttaccatagggcagtggcatctcttaaaacat

SEQ ID NO: 6843646 - DNA, 55 bp, Homo sapiens
ttcacagtataggtttccagcgcagaccctgccttacgtgcctcctacttgtgaa

SEQ ID NO: 6843647 - DNA, 60 bp, Homo sapiens
gcatatacgtgtgtgtgtatgtgtgtgtgtgtgtgtgtgtgtacacatatatgtatgtgt

SEQ ID NO: 6843648 - DNA, 56 bp, Homo sapiens
gcattggcagaaacagcagggccagccggctttgcctggccctgttttctccaggc

SEQ ID NO: 6843649 - DNA, 86 bp, Homo sapiens
ctggcactcaggcagtaagacttcaaacgacatttattttaaactttatttgtgactgtctttagttttactgtctggagaatcag

SEQ ID NO: 6843650 - DNA, 60 bp, Homo sapiens
gtgagccaagttcacaccattgcactccagtctggatgacagagtgagaccttgtcttac

SEQ ID NO: 6843651 - DNA, 76 bp, Homo sapiens
gagacaaagctgagtgtcctacagaatgtggcagccccgctctgccagtctctgttccagggcttcaggcggtctc

SEQ ID NO: 6843652 - DNA, 58 bp, Homo sapiens
ctccctgtggcatgcgctctgatgggtcagcacaaaggaggcacctgtcacaggtgag

SEQ ID NO: 6843653 - DNA, 80 bp, Homo sapiens
agtgtgagtagataaagcaatgagatggggtgaggttacaggcatcagcccattctaggctttgctcttcaacacatact

SEQ ID NO: 6843654 - DNA, 73 bp, Homo sapiens
gcaagagacgctgaccgtttgtttgggagatgaaaactcaccgtcctggaacaatcccggtttagctcacggc

SEQ ID NO: 6843655 - DNA, 62 bp, Homo sapiens
ttatggcaaatgaaagaaagccagtctcagaaggcgatgggctgggtgattcatttccataa

SEQ ID NO: 6843656 - DNA, 69 bp, Homo sapiens
cccaagaggaccttgccagggcagtgctaggcagagtctctctgcctgcctaggtctggcctccttggg

SEQ ID NO: 6843657 - DNA, 58 bp, Homo sapiens
cagtttctgagccctgtcatttggtaggttctttggatccttgggtctctggaaattg

SEQ ID NO: 6843658 - DNA, 57 bp, Homo sapiens
ggggtggatgggtggaggcagtgccatctcccccagtgccagctgcccttccaccct

SEQ ID NO: 6843659 - DNA, 107 bp, Homo sapiens
gcagaaacaatgggatgatggtgtttcaggtctgctttccttgccactgttagatttcaacgtgtcagcaaaggcaggccgggagctgctagagctcagatttcagc

SEQ ID NO: 6843660 - DNA, 62 bp, Homo sapiens
atgagcagtttttaagtagcaagctctatttctcggcaaggctaacgaaaaagcgtgctgat

SEQ ID NO: 6843661 - DNA, 92 bp, Homo sapiens
ccaaaatgtaaagtagtggggcagggaggttatcgccgaggggcaggatttcggtgattctcattccttttcttcttttccttttcttttgg

SEQ ID NO: 6843662 - DNA, 76 bp, Homo sapiens
tctgccgcaatactgctcatggtacatgtgggtctcttttattggagcagatgtttcagagcaggcttgtatcaga

SEQ ID NO: 6843663 - DNA, 114 bp, Homo sapiens
tcaatcctactaaacattttatttcagttcacattcttctctttctaccagaaatgttcttctctatgtggggagaagcaatagactctagcaatggattggctgtagggttga

SEQ ID NO: 6843664 - DNA, 63 bp, Homo sapiens
ctccctggaggtgagctggcacctggagagcaaggtcagagccagcctccctccagatgggag

SEQ ID NO: 6843665 - DNA, 66 bp, Homo sapiens
ggagaaattatattcacttgtgtccaaccactgttaaagaaatggttgcacatggatgggttttct

SEQ ID NO: 6843666 - DNA, 92 bp, Homo sapiens
tgcaagtactttttgagtgtcggcccatattttatttgtcatgtcccacgggtcaaggcaagtcatatgggcaagcagggtgggaagttgca

SEQ ID NO: 6843667 - DNA, 93 bp, Homo sapiens
caatgtagcacagtagttagcagctctagtctttgggtaatacaaatcttgatttgaatcctggctctgctacttaccagctgtgtaacattg

SEQ ID NO: 6843668 - DNA, 72 bp, Homo sapiens
gggcggggtttggggaggttcgggaatcttgtggcatctgccctcaacacaggttccatctccaccttgccc

SEQ ID NO: 6843669 - DNA, 74 bp, Homo sapiens
taaagtgtgcgatttagtggcccttggtacacacacaatggtgtgcaaccatcaccactgactccagaacttta

SEQ ID NO: 6843670 - DNA, 58 bp, Homo sapiens
tgtgtcagtgtctcctccccatcacgagcatcgggggtggtggtgagtcacgggctca

SEQ ID NO: 6843671 - DNA, 59 bp, Homo sapiens
ccaccctgggcaggctgggaagagcttctcctctaggggaactgcctgcccagaggtgg

SEQ ID NO: 6843672 - DNA, 129 bp, Homo sapiens
atatcgtttgttgcatatcttcttaaatccatcttccttgtaagggctttagaactaaaacttacttatattgtttttccttaacagagggagaaaaatagtggattattatttctaaaataaaaggat

SEQ ID NO: 6843673 - DNA, 74 bp, Homo sapiens
gcctcccaaagtgctgggattacaggcatgagccaccactgctcctgacctggtccttgtactttgaaaagggc

SEQ ID NO: 6843674 - DNA, 130 bp, Homo sapiens
gcagaagggcagctcggtcaaacagctggagctgggagccggtcagttgccaggccctgccgctgctacgtcacggagggcggggcggtgggcgattggcggtgcactgcagctcgggctgctctgcagc

SEQ ID NO: 6843675 - DNA, 62 bp, Homo sapiens
agaagatggatatctcaaatttgctctctgctctctgagacctgcaaatttggtcctcttct

SEQ ID NO: 6843676 - DNA, 75 bp, Homo sapiens
cgttcttagttggtggagcgatttgtctggttaattccgataacgaacgagactctggcatgctaactagttacg

SEQ ID NO: 6843677 - DNA, 61 bp, Homo sapiens
tgactatggttccacgaaatgcattaatccaaaaggcaaataatgcaaggaactaatgtca

SEQ ID NO: 6843678 - DNA, 75 bp, Homo sapiens
gtccccttgctttccttagtccagccctccaggtcccaaccagcagggctgggccaatggcaatggcaatggaac

SEQ ID NO: 6843679 - DNA, 114 bp, Homo sapiens
ttgatttttctctgagaagatagcatttagaatccatgttagaagattcatgaactaattcagtaaatctctaattggcatacatggtaagctgttcacttagtggataattgg

SEQ ID NO: 6843680 - DNA, 79 bp, Homo sapiens
tgataagagctttcactgtaatttgtatctgtggaaaatattttcatttcattgtacaattgcatgtgcgtacttttta

SEQ ID NO: 6843681 - DNA, 129 bp, Homo sapiens
catgagggtctacggggagtgacaaatacagtgtacttttgaaggatccagaggaccaaatttatgcatctcaaacatggtcctggtcatctgggctggcaggtttctgggctcctggttccaaggatg

SEQ ID NO: 6843682 - DNA, 129 bp, Homo sapiens
ctgtctctgacactgcagtagccacagtcgagcttgagctggctggtccagcaggggctgctccgcagccctggggctcagaccagagcaatgctgtgagagtcctggtactggccagtgcagagactg

SEQ ID NO: 6843683 - DNA, 67 bp, Homo sapiens
gtaacagagctaagaaacagaattgctgggatattaacccaggtagttttgacttcatggcttgtgc

SEQ ID NO: 6843684 - DNA, 66 bp, Homo sapiens
tgaacaatgaacaagatgagatatgtagaaagcatgtcacatatataatgttcaataaaatgttca

SEQ ID NO: 6843685 - DNA, 78 bp, Homo sapiens
agtgaggcgaaggtgctggcgccccaggagacgcgccccctcctctccctccctgcggcgcggtgactcagcctcgct

SEQ ID NO: 6843686 - DNA, 83 bp, Homo sapiens
gaggcaggcaccttgaatctgttttcttagtactgtggggaagagatctgcctgggaaagcaaggttgtggatttccagtctc

SEQ ID NO: 6843687 - DNA, 63 bp, Homo sapiens
attttcagtgatcatagcacacaaaattaatttttgatagccttttgtgatttggctggaaat

SEQ ID NO: 6843688 - DNA, 62 bp, Homo sapiens
attgcagagctaggcagcggcaagcccactttcacacagcgccagctgcctggctctgggat

SEQ ID NO: 6843689 - DNA, 124 bp, Homo sapiens
gccaggacggcctggctgctctgtcctcagcaggccctggggtgggtccactcccaacctgaaagtgtatcaagtctgaccccccaaccagggttgctggaacagagagcgaggtctcagaggc

SEQ ID NO: 6843690 - DNA, 64 bp, Homo sapiens
caatagctaggctggtaaaggactgaacatctacaaggataccctcctttgctagttgctgttg

SEQ ID NO: 6843691 - DNA, 83 bp, Homo sapiens
ctcttctcgaagtttctctgtacctctgtcccaccctgctgaatgggtttggcaccaaaggagaagatccttcatgaggagag

SEQ ID NO: 6843692 - DNA, 57 bp, Homo sapiens
cacacaagctgcagctggtcactaaaacccatttgtgacttgtcaaagaaatgtgtg

SEQ ID NO: 6843693 - DNA, 95 bp, Homo sapiens
aactagtttgggtctaaagcggaagggaatgtctgcgtagagctctatagaggcatgtcatttcttttctgaagtgggcaattttaagattagtt

SEQ ID NO: 6843694 - DNA, 55 bp, Homo sapiens
tggcagccatcagagcaggggtggacagcccagctctcctgctccagtgctgcca

SEQ ID NO: 6843695 - DNA, 97 bp, Homo sapiens
aggtgaggatgggggtgggtgttcctgggacagagggctggggcacgggcctgtctcatacccactgtctgttcccagggcctcaagccattggcct

SEQ ID NO: 6843696 - DNA, 75 bp, Homo sapiens
gggacaggtctggtttccttcaggcacaactggattcatggatcgtaatgctgcctttgggacctggcctgtctt

SEQ ID NO: 6843697 - DNA, 89 bp, Homo sapiens
ggctgggtgtcagcagaagcaccgtggccccgctctcccgcctccccgtgcgcctgggcctccgtgtgctggtgctctcgcacacagct

SEQ ID NO: 6843698 - DNA, 88 bp, Homo sapiens
ggaggatgtcttgagcctaggagttcgaagctgcagtgagctgaaatggtgccactgcacttcaccctgggtgacaaagcaagacccc

SEQ ID NO: 6843699 - DNA, 66 bp, Homo sapiens
ggcaggtgagagctctttgaaaatgaaaacattctgctatttgaatgcaaagtgttcttctttgtc

SEQ ID NO: 6843700 - DNA, 103 bp, Homo sapiens
gaaacaagctgggaaccaggcatggcaaaaccctgtctctactaaaaatacaaatctattgtattaggagagtgggtgctaagtctagttccctgctctaatc

SEQ ID NO: 6843701 - DNA, 64 bp, Homo sapiens
ttcctgcttggtttataagtcagattgcactgtgcttgtggtcgtgcttgctgctaggtaggga

SEQ ID NO: 6843702 - DNA, 56 bp, Homo sapiens
ttggactcctctttcctcttggtctcgggaaaagagacaaagggagaggtgtttaa

SEQ ID NO: 6843703 - DNA, 75 bp, Homo sapiens
atatttgaaaatgtcacagattctaatttgaggaatttcatttgcttttataggagctgagacatctttaaatgt

SEQ ID NO: 6843704 - DNA, 60 bp, Homo sapiens
ccagatggaaaaactaaagcactgccatctttaattccgtgtttaagtactcctttctgg

SEQ ID NO: 6843705 - DNA, 58 bp, Homo sapiens
ttcctggctcacagcagtggggtcacctccccagggttcccacttagtagctgaggaa

SEQ ID NO: 6843706 - DNA, 84 bp, Homo sapiens
gctgcaattatcttagatgaggctatgggttgcttgatttctccagggagtctggtaatgtagctcaacctctcctgttgcagt

SEQ ID NO: 6843707 - DNA, 96 bp, Homo sapiens
gctaagagagtaagagtagaagatgttgtcgttagtgatgaatgcagaggaaagcagctcggctaattgttagtatcaacccttactttgctaagc

SEQ ID NO: 6843708 - DNA, 57 bp, Homo sapiens
tggctcagtggcagccgcagctaggaaggactagaaagtggctagaccgcggagcca

SEQ ID NO: 6843709 - DNA, 73 bp, Homo sapiens
gctactggtgacctgcagagaaaatttcagtgtcatagagaaggcagaaagggcttttcagagtctcagaggt

SEQ ID NO: 6843710 - DNA, 69 bp, Homo sapiens
tctaccacccaagaatcttgcagcttagactccctcccggtgcagtttatagcccagattcatggtaga

SEQ ID NO: 6843711 - DNA, 82 bp, Homo sapiens
ttgttaatcatgaaaatttcctggccttaacttgatggcaattaagtctatggtagagcctgggaatttgcatgtttaatga

SEQ ID NO: 6843712 - DNA, 55 bp, Homo sapiens
cttctgcaataagttttggtccatgcgtttattggaccctaatcatctgcaggag

SEQ ID NO: 6843713 - DNA, 72 bp, Homo sapiens
tcagtagattcctcttcggggttcagcctcaggcatgtcagaaggctgctctgagagtgggttttacactga

SEQ ID NO: 6843714 - DNA, 108 bp, Homo sapiens
aagagctatgcagcacaggttgctataatgaccagggcatcttcttctacaaggaataggaggggagcaggacataatagcaatacttgttgtttgtgcattgctctt

SEQ ID NO: 6843715 - DNA, 55 bp, Homo sapiens
cagccccagttccctggaagtctgtgaatagcaagaaatggggcaggctgggctg

SEQ ID NO: 6843716 - DNA, 74 bp, Homo sapiens
tctcccacctcagtctcttcctttcccccaacccaggtaggaaaggaagacctgggagagattgggttgggagg

SEQ ID NO: 6843717 - DNA, 116 bp, Homo sapiens
ggaggtgttgatatttgtgatgtgaattgggagagttagcaatgctgtctcctcaatgttctggacaccagccttgcttattctgacgtcctgtcttcattcacgctgttgccttc

SEQ ID NO: 6843718 - DNA, 84 bp, Homo sapiens
ccagagcttctggaggaatgggatgaggcctctgttgtgactgcatcacacacagtccattcttcctccattgaatccttctgg

SEQ ID NO: 6843719 - DNA, 61 bp, Homo sapiens
ccctaagaatctcccttgtagcacgccataaccaggaatgtacaaaaaaggaaattctggg

SEQ ID NO: 6843720 - DNA, 80 bp, Homo sapiens
gcactcacccccactatatacccaggaaaaaccatggtattggttaccattgccccctagtgtctgtggaggaggagtgt

SEQ ID NO: 6843721 - DNA, 61 bp, Homo sapiens
tcttttgtggatcttcagttacttcaggccatctggatgtatacgtgcaagtcacagggga

SEQ ID NO: 6843722 - DNA, 61 bp, Homo sapiens
ggcattagcgtctgcctcgtccacatgctgtgcaagctcagcgaggccaaggggctgggcc

SEQ ID NO: 6843723 - DNA, 71 bp, Homo sapiens
tactgccagctgggccccagtgcagggggtgagtgcccctaactctctgtgatggaggccagctggaagta

SEQ ID NO: 6843724 - DNA, 56 bp, Homo sapiens
tgccttatattagctctccgttgccccataaaatgggcttgggcatatctgaggca

SEQ ID NO: 6843725 - DNA, 69 bp, Homo sapiens
cattagggatgctgtggaagggatttgggaggatgcattaggtggctttagggttccttctaccctatg

SEQ ID NO: 6843726 - DNA, 60 bp, Homo sapiens
cgcaccttcttagtgctcagggagtggacatcctagactgggagcatgagagaggctgtg

SEQ ID NO: 6843727 - DNA, 66 bp, Homo sapiens
ttggcatggtaggggggcagcatgctctatcctgtgtatgcctcatgaccctcccagccctgccaa

SEQ ID NO: 6843728 - DNA, 86 bp, Homo sapiens
aaactactggccagggctgcagtcctaaggtgctagaggatccacttccaagctcacttaggtggctgttagcggggccccagttt

SEQ ID NO: 6843729 - DNA, 81 bp, Homo sapiens
gacgttaaaagaggaaatgattgactatatagatatggttctgacaatagtattcatttcctctgctaagaaattgatgtt

SEQ ID NO: 6843730 - DNA, 67 bp, Homo sapiens
cggggcattgaggaggaaacaatggcctgtgaagctattgaaatccctacctcagaggccagccctg

SEQ ID NO: 6843731 - DNA, 57 bp, Homo sapiens
ctcgcatggcttggagcaggatgagatgagaagttttatatgaaattagtcatggag

SEQ ID NO: 6843732 - DNA, 63 bp, Homo sapiens
tgtcagaaattctttccaaagaaaatacttccactgctttctggggaatgttcatttctgaca

SEQ ID NO: 6843733 - DNA, 71 bp, Homo sapiens
aatttagtcagtgtcattattagagttgtgctttcataaaaagaatctctcaagtgtgacaaggctaaatt

SEQ ID NO: 6843734 - DNA, 82 bp, Homo sapiens
agtgagctcccagggtagggagagactaagagttaaatattctttaaggacactagctccttccactttgggtagctccact

SEQ ID NO: 6843735 - DNA, 86 bp, Homo sapiens
gattacatagaaccaagccatttcctgatacacctacacttgagacttggggaaatgggatgtggaggatatgggtactagtaatt

SEQ ID NO: 6843736 - DNA, 67 bp, Homo sapiens
ggcatgaaggcccagcgtgacctcagtgagcatgtcctccaacttctgaatcagctggtgcctgacc

SEQ ID NO: 6843737 - DNA, 102 bp, Homo sapiens
accaggctgtgagctgtatgtccttgtgagtaaatgatggtcccatgcaagggcctcttacataaccattattaccagtaaatataggttgcacaaactggt

SEQ ID NO: 6843738 - DNA, 55 bp, Homo sapiens
gcaaaacgcgctggacaagatgcacaagcaaaaacttgtctgcagtgtttatagc

SEQ ID NO: 6843739 - DNA, 68 bp, Homo sapiens
tgcattcagaaacccattgggtctcttgaacaaaggcatttgagagaatccccaggttatctgaagca

SEQ ID NO: 6843740 - DNA, 55 bp, Homo sapiens
cccagcccacggtcctgggtgggcgtcttccgcatgggaggccgtgggcgctggg

SEQ ID NO: 6843741 - DNA, 76 bp, Homo sapiens
tgagggatttctaaggaggctgaacttgacaggtggaactgtggagttctgccaacttttagaaaagattctatca

SEQ ID NO: 6843742 - DNA, 110 bp, Homo sapiens
tctggatgacttcactggtgttggggactttgcaaagcctagccttgtccaagttggtcaacagctgatctttgatgaagcaaccatcacttgtgaaaggttatttcagg

SEQ ID NO: 6843743 - DNA, 90 bp, Homo sapiens
ctgtggggagagctatgggtgtgggttccattcttcgggggccacttcaccccccaaatgcccccacactcctgggtcctctcctcacag

SEQ ID NO: 6843744 - DNA, 56 bp, Homo sapiens
ctctccagttatagctgatttgaaacttcccaatgaatcaggagtcgcggggagag

SEQ ID NO: 6843745 - DNA, 60 bp, Homo sapiens
agccaggccaagtttctagcctttaattctacagaattgatgttactattctggtctgct

SEQ ID NO: 6843746 - DNA, 78 bp, Homo sapiens
atacacacatatatgcacattcacacaaaaatgtatgcttatatatgtgtgtgtgtgtgtgtgtatgtatgtgtgtgt

SEQ ID NO: 6843747 - DNA, 78 bp, Homo sapiens
ttcttacaggtatttcctttaaagaaactctcaaggattagaagtcttcttgattcaagggagtaaagttgtgatgaa

SEQ ID NO: 6843748 - DNA, 67 bp, Homo sapiens
caggaggaaagagggagagagggggcccatctgttcatggtgtcctgcctcttgccttcttcacctg

SEQ ID NO: 6843749 - DNA, 59 bp, Homo sapiens
gtttggtcacagaacgtgattttagtcctttaaaatcgagacttgttttatggcctagc

SEQ ID NO: 6843750 - DNA, 56 bp, Homo sapiens
cctcattgtagttatggttgaggttttcttctagtcctagaaactacatgatgagg

SEQ ID NO: 6843751 - DNA, 77 bp, Homo sapiens
agtcacaggggactgtacgtcattgaaggccatttgtaacaacctggcaaggtggcgtatggaaataccctgcgatt

SEQ ID NO: 6843752 - DNA, 68 bp, Homo sapiens
ggtgtgcatgtttagggaaacaaacattttcttcctgctgtggataagtgtcatgtttctttgtcacc

SEQ ID NO: 6843753 - DNA, 67 bp, Homo sapiens
ctgtggcacaggtagaattttagggaaacaaagagttttgatcaaagaattttcctgaaagccacag

SEQ ID NO: 6843754 - DNA, 77 bp, Homo sapiens
gataaaagttagtgtttattgaatgctaagtatatggcaaagtgcttagcttttcacttgcattatctcattttgtc

SEQ ID NO: 6843755 - DNA, 77 bp, Homo sapiens
aggagtgagggtcaggggtcatgctggtgatgtgccacccggcacatctatgtagaggcttctgtcaccactatcct

SEQ ID NO: 6843756 - DNA, 59 bp, Homo sapiens
tttcctacttgaactcaattctcctgttttagcaggaaagttctcttgcgtgtgggaaa

SEQ ID NO: 6843757 - DNA, 65 bp, Homo sapiens
gcctaacacagtgactggcacctagtatgtgcctagtaaatatttgtcaattcactgttcatggc

SEQ ID NO: 6843758 - DNA, 113 bp, Homo sapiens
aagattgttaattagatagaaaactagttaatgtactacggggaaatacaattgtggtcctgttttattgccctgtagtacaggacagaaatcattcgcaatttaccagtctt

SEQ ID NO: 6843759 - DNA, 110 bp, Homo sapiens
ggtcctgccatggcttcccaccctgctccccagccacgtccaccagccacacctgcacagggtgggtgcaggtcttgtgccagggagcatggccgtgggtggtagtgacc

SEQ ID NO: 6843760 - DNA, 68 bp, Homo sapiens
ccaactgaagttaattgaaatgtacaataaaatctgagaggatgtgtttatgtcaaaactacagttgg

SEQ ID NO: 6843761 - DNA, 78 bp, Homo sapiens
gcagcagcagcagcaattttctgtccccctggttttgtcttctggggcatcttgaccaggatttgttgctgtttctgc

SEQ ID NO: 6843762 - DNA, 65 bp, Homo sapiens
gacccttaaaggctttgcctctcttccaaatcaagttgggattgagagtacgtctttaagccgtc

SEQ ID NO: 6843763 - DNA, 63 bp, Homo sapiens
atcttcaattagatttaccaattgttagtattttgtgacatttgctgaaagttagttggagat

SEQ ID NO: 6843764 - DNA, 69 bp, Homo sapiens
ttgtcttttcccaatgagtccttgagcatttctggaatgttggtgtttactggaccagggaggggacag

SEQ ID NO: 6843765 - DNA, 100 bp, Homo sapiens
caggagcagcgtgatcaggggtcctaaggcacaagtgtctttggtttattctcagaatagtaaggaggacactgtgcctggacccctacatgagaggatg

SEQ ID NO: 6843766 - DNA, 107 bp, Homo sapiens
gctgtgaataatgaatgcctctttcctttcagatcactttcaggaaagatcaccttgaggcctgcctcctttccctgggttgtgatgtgatggcaagagaatgcagc

SEQ ID NO: 6843767 - DNA, 90 bp, Homo sapiens
acaataaaagattttgttaagtggtataaaaatttgtgaatgttgaaattcaacatgcttcatattataaccaacctgcaagaatattgt

SEQ ID NO: 6843768 - DNA, 60 bp, Homo sapiens
cgtgtgccattttgcatagcagaagcttgagcatcttcttcaaacaaaagtggcatgatg

SEQ ID NO: 6843769 - DNA, 71 bp, Homo sapiens
agggtcagtttaggtcatccttgctttgctgcacaaagacatggttgggaacacactacaaagcaggccct

SEQ ID NO: 6843770 - DNA, 63 bp, Homo sapiens
gatggctggatagttgaagctctcaccattaagattttgaatgcctcttttctccagtccatt

SEQ ID NO: 6843771 - DNA, 106 bp, Homo sapiens
caccacgttggccgggatggtcttgatctcctcaccttgtgatctccctgccttggcctcccaaagtgctgggattacaggcgtgagccaccgtgcccggccagtg

SEQ ID NO: 6843772 - DNA, 65 bp, Homo sapiens
tgaggctttatgcacagcagatggtaaatgcatgtaaaagcatgagactcggtgtataaagatca

SEQ ID NO: 6843773 - DNA, 69 bp, Homo sapiens
ccctgcctcagttgctatgacaactaatggacaagattgttccagtgtgagaagcagcatgaggagggg

SEQ ID NO: 6843774 - DNA, 77 bp, Homo sapiens
cagcctaggagagtgacaaaaatatggacagacttggattctctgtccagttttaatactcactgcctgagtggctg

SEQ ID NO: 6843775 - DNA, 117 bp, Homo sapiens
aaatgttgacaaaaacacacaaaaatatcttaatcagtggtatagtatttgatgatttctatctatactacaaatggctggtgggttgagttttttgtgtatacttttgaagcattt

SEQ ID NO: 6843776 - DNA, 125 bp, Homo sapiens
ggtgtgtgttttattttgcagtgttagttttgacctcattatgctcattatgctgttgtaaggctaagtatgtcatgggtcaaaatgaaggcaaaatagacctttctcagcattaaagcacaacc

SEQ ID NO: 6843777 - DNA, 105 bp, Homo sapiens
tcccgagaactggcccatggtcacacagtggaaatgtgggaggggaacttgcctcgctccaagccgagtgctccccactcaccactggccaaagcctccttgtga

SEQ ID NO: 6843778 - DNA, 110 bp, Homo sapiens
tatggttcttatatatgataaatattttctatactgaaactatatgttgacaaatgaacaacatgtactgttggtgaagaggctgtaagtgtcaaatactaattaccatg

SEQ ID NO: 6843779 - DNA, 103 bp, Homo sapiens
ttctaaatgccttttagcctcctgtagtatttttaggtaaggaaagtatgttgaattatttctctttgtagggatatagggttgaaatgtgaagtatttggaa

SEQ ID NO: 6843780 - DNA, 81 bp, Homo sapiens
gaagcttgggctgggctttcagtgcagtgtagggtgcttccctctgtccctgtggcactcaagaagcctccagtcagcttc

SEQ ID NO: 6843781 - DNA, 76 bp, Homo sapiens
ggggccatctcggataggtgggttgagtttggggttctggcccctgcatttagtgaccagcactagaaatggccct

SEQ ID NO: 6843782 - DNA, 61 bp, Homo sapiens
tcacagccctggccctgtggggacaggtctgtctcccccactcctggagctagggctctga

SEQ ID NO: 6843783 - DNA, 79 bp, Homo sapiens
cttgccttcggaagtttctgggcaagacaaggccaagggcacttccaagtgtcccagagatcattcatccagaggcagg

SEQ ID NO: 6843784 - DNA, 65 bp, Homo sapiens
gcacgaagcaaagctgatgagaaggcaaatgccagcttttgaaaatgaagtctatgcttctgtgt

SEQ ID NO: 6843785 - DNA, 63 bp, Homo sapiens
tcttttatctgttgtgtaacaatcatgctactgaatgttagatattacatgacatatgaagga

SEQ ID NO: 6843786 - DNA, 93 bp, Homo sapiens
tctttctcgtgtttcccttcattgctatttcatgttcctatggccgggttctccttgctgtctaccacatgaaatctgcagaagggaggaaga

SEQ ID NO: 6843787 - DNA, 78 bp, Homo sapiens
gccagggagtcttggcagagccccagccttggagccaatcagaccagggttcaaagcttggctctgccaccttctagc

SEQ ID NO: 6843788 - DNA, 75 bp, Homo sapiens
caactcctgagcatagcacagatttctcaaatgcatttcttctaatctttgagaattttttgtcatgcattgttg

SEQ ID NO: 6843789 - DNA, 76 bp, Homo sapiens
gcttactatgtgccaggcactttgaaatttggagctcaatgcttttagctccacaatctggtgtcatggtgtaagc

SEQ ID NO: 6843790 - DNA, 62 bp, Homo sapiens
tgagcaagagtgaattcatgtggcttcagggaacagaactgaggctgattgatttttgctca

SEQ ID NO: 6843791 - DNA, 110 bp, Homo sapiens
tggggccagtggactttccagtgggccttagaaggttccctctactgtaggagagtgtcagaggagctgggaggccctcgtttaatgactgagaagagattccaccccca

SEQ ID NO: 6843792 - DNA, 96 bp, Homo sapiens
gggaggtaagaagggtagggaaggccagcagtcacagggtcagatgagaaatttctgctggacatgcctggctgctccagtgtcttcgattatccc

SEQ ID NO: 6843793 - DNA, 55 bp, Homo sapiens
gggcaatgtgtgttcactatatggcctctaggctacatgcaacacacacatgctt

SEQ ID NO: 6843794 - DNA, 93 bp, Homo sapiens
atggtttttgctcaaggtgttccatgtttttggctgtggaatcgactagaacttcagcagtcgtccaggaaaagcctgcagggcaaggactgt

SEQ ID NO: 6843795 - DNA, 77 bp, Homo sapiens
atagcctgatgagggctttaattagagaattcttgttattgtagaattttagatctaggaaagcctttcacaactgt

SEQ ID NO: 6843796 - DNA, 97 bp, Homo sapiens
ttaagactttggagttcttttgggatagaatatgcaaccaggttttgaaaatttggcatagctctttgttccttgaaggccatctaagatgttttaa

SEQ ID NO: 6843797 - DNA, 86 bp, Homo sapiens
caaccattttgtttggattcaaccttttctccagtggctgagtctcaagccctggagaaaaggttgaatccatctaagaattattg

SEQ ID NO: 6843798 - DNA, 87 bp, Homo sapiens
atagtaacacacttgtgctgacagatggaagaatgtgcatggcaactgcgcctgaagcacttccatctgtcaccaggtctctgctgt

SEQ ID NO: 6843799 - DNA, 78 bp, Homo sapiens
gtgctgctcccatgaatacggatgctcggagagctcaagcttccgttttccttgggcaattatgttcacagagtgcac

SEQ ID NO: 6843800 - DNA, 95 bp, Homo sapiens
ggtggggagacgagacacgaagggttgacaccacccaaccaatatcctggtgacttccgggtgtcaagccccagctgtcacgctcagaaacaacc

SEQ ID NO: 6843801 - DNA, 62 bp, Homo sapiens
cagaagagaagagaggacatgatagatacctggctatttcagcatctcaaccttctctactg

SEQ ID NO: 6843802 - DNA, 66 bp, Homo sapiens
cctatgactattttgttgtgtcttttagccagatattgagccagcacaatagagcagttaaaaagg

SEQ ID NO: 6843803 - DNA, 63 bp, Homo sapiens
gccccagagcaacaccctttacatcgacccacactggtccatgcagccatgtgcttatggggc

SEQ ID NO: 6843804 - DNA, 60 bp, Homo sapiens
gcattgtagaaaacgtactagcagttcaagcaactgcagtcacattttctcacgatttgc

SEQ ID NO: 6843805 - DNA, 82 bp, Homo sapiens
gtgtccagaaagtgtccagcctgcacagggtgcattgcaggcagtcccagcacgctctcaggccagggcatgaactgtatac

SEQ ID NO: 6843806 - DNA, 58 bp, Homo sapiens
gtctgtggcaggggagaagtttgggcaagtcactagatgctcctttaccccacaagac

SEQ ID NO: 6843807 - DNA, 109 bp, Homo sapiens
tccagagagctcagagattgtttttggcaaaggactcaaagcaggcagatccaacccctctcgctgtctctttcttgttgccaaaacataagactcttagttttatgga

SEQ ID NO: 6843808 - DNA, 70 bp, Homo sapiens
tccggtgcctggtttggggagtgttcatgggatatgttccaaaggactgacggacctatcaggtactgga

SEQ ID NO: 6843809 - DNA, 58 bp, Homo sapiens
tgtggctgtggttttcataaatcaataaaacttgatttatgaaaacaatcagtaggca

SEQ ID NO: 6843810 - DNA, 60 bp, Homo sapiens
ggtagtgttgagcagtgcaaatatttgaagtggtgatttgtgaaatagcccagcattgcc

SEQ ID NO: 6843811 - DNA, 99 bp, Homo sapiens
gaggtgggaagattgcttgagctctggaggtggaggttgcagtgagccgtgattgtgccactgtcctccagcctggatgacagagcaaaaccctacctc

SEQ ID NO: 6843812 - DNA, 65 bp, Homo sapiens
gcattcctggcaccctggacccggcctgtgagttatgacgagctgagttgggtggtggggggtgc

SEQ ID NO: 6843813 - DNA, 57 bp, Homo sapiens
ggctgcctgccgcccacttggcgtctcccaagtgatgtgcctggcagggccacagcc

SEQ ID NO: 6843814 - DNA, 56 bp, Homo sapiens
tctacaacaagtcaattgcctgggtcttcgatcaggattcagttgaaatgtttgga

SEQ ID NO: 6843815 - DNA, 101 bp, Homo sapiens
tgaggcaggagaatcgcttgaacctgggaggcggaggttgcagtgagctgagatcgcgccactgctctccagcctcggtgacagagcgagattccgtctca

SEQ ID NO: 6843816 - DNA, 71 bp, Homo sapiens
gttgtcagcaaacagatgtctcctttagcctaaggcacactcagagctactagggcagctgttgctatgac

SEQ ID NO: 6843817 - DNA, 74 bp, Homo sapiens
tgagtcatgcgccaggcacaggcgtgggtctgacctgtcccttggcaccaggcttggtgtgtggtcagggctca

SEQ ID NO: 6843818 - DNA, 88 bp, Homo sapiens
tggagttcagaaagcttacgtgatttgcaaattgaggcagagctgataagacacagtgttgtcttggcagtgcaagtttctgacttca

SEQ ID NO: 6843819 - DNA, 59 bp, Homo sapiens
ttcctcttctggactcctataacttggatagttataggaaaagttctagaaaagtggaa

SEQ ID NO: 6843820 - DNA, 126 bp, Homo sapiens
tgtgcagtttggcgaagccgtgcagccaccgcaccctgtgcctttgtagctgtgcctgcctgtgggcaaagcgcactcccaaggccaggctgccccaggtgcaggcctctttgacctcactgggca

SEQ ID NO: 6843821 - DNA, 55 bp, Homo sapiens
taggcactagacatggttaccaaagatcacttagtggttacctgaaaagtgcctg

SEQ ID NO: 6843822 - DNA, 58 bp, Homo sapiens
ttctgctgtacagaaatgcttctctcccagaattgaagcttctatctctgcagaagga

SEQ ID NO: 6843823 - DNA, 129 bp, Homo sapiens
aatgggagggctgtgtgttattgttgattgtgttttgcagcgaaacatgagtttaatgttatagagaacataaatttataattgtttcctgttaaagagtctgagaataagaaatgagttctttccatt

SEQ ID NO: 6843824 - DNA, 55 bp, Homo sapiens
gcagctccaaggtatccaccagggtctctctgactcagtgagggccttgggctgc

SEQ ID NO: 6843825 - DNA, 63 bp, Homo sapiens
cagggaaattaagtgacgatgaacccacaatctggaaaatgacattgctgcttacttttcctg

SEQ ID NO: 6843826 - DNA, 84 bp, Homo sapiens
attgccctttgaactccagactactaatttagtgaattcttcactatttctagatgctctgataacagaggttaaggggacagt

SEQ ID NO: 6843827 - DNA, 76 bp, Homo sapiens
gcagcagcagttcagcagcaaatctagaagaggaggggaaaatcctgtgccgacatatttttctgtctgttgctgc

SEQ ID NO: 6843828 - DNA, 66 bp, Homo sapiens
ttttaaagggcattagtgtttcaagcaagtaggatggtgctcagagaaagattagtccctgtggag

SEQ ID NO: 6843829 - DNA, 70 bp, Homo sapiens
gaagagtgggcaggagcctcgactactggcaattaaatgcttctacccaagtcacttctgttcacatttc

SEQ ID NO: 6843830 - DNA, 57 bp, Homo sapiens
gagtggaggtggctagtgctgttatcagggcataaaacagcagccaaacttctattc

SEQ ID NO: 6843831 - DNA, 56 bp, Homo sapiens
ggaacactggctcaattatatctttgtggccatttgttagttgtagccactgttct

SEQ ID NO: 6843832 - DNA, 118 bp, Homo sapiens
ctccttagctattaagaaaggcagtaacatcaacaggctgagctggcccttgaaatgggagaagctcctaacagcatctggtcagcttagctgatgcaattgcaaggctggcctggag

SEQ ID NO: 6843833 - DNA, 62 bp, Homo sapiens
gttttcatcctctagtactgaagtgccctcaaggtggtaggcactgtatagcaggagaaaac

SEQ ID NO: 6843834 - DNA, 55 bp, Homo sapiens
gcttcaacattctagaactgataagtggaccttcagtgtgcaagaatggagaagc

SEQ ID NO: 6843835 - DNA, 69 bp, Homo sapiens
gccaggcactgagaggtctgcagaacacatggcggtaaggtcctgccctcagaggcctcatagtctggc

SEQ ID NO: 6843836 - DNA, 64 bp, Homo sapiens
gagtctctataatgcatgtcacctgatctcaggtgatcctgaggcagcctgcattaaagagctc

SEQ ID NO: 6843837 - DNA, 88 bp, Homo sapiens
catggcaaggaagtgagaggtgttggggaggagaaacacctagatctgttcctactcctgcccagagctctccactctccaggcaatg

SEQ ID NO: 6843838 - DNA, 110 bp, Homo sapiens
ccacgatgattttaggaggggtttctactgtggtccttgtaaccacatagtttgtactgagctggacactggccatttgagtagatgcttgttctccagttatagaatgg

SEQ ID NO: 6843839 - DNA, 78 bp, Homo sapiens
gtttattctgtgatcactgcccattttggaggtcacaagctctggagcttacaggaactgggcaggacattaaaaagc

SEQ ID NO: 6843840 - DNA, 98 bp, Homo sapiens
gtgtgtgtgcgcgcgcgcaggggtggctttggggggtggctgctgtctctgctctggtacagtctgcttgtctccatggtgcctgttgccacacacgc

SEQ ID NO: 6843841 - DNA, 101 bp, Homo sapiens
gatgacaaatacaaggaaggcaaagtattaagtattaagtttggctataaaagcttggtatagctaaatgctaaatgctatctgcccttggtgtttgcgtt

SEQ ID NO: 6843842 - DNA, 55 bp, Homo sapiens
ctgccaggattctgtgaacccctccaaaagctgtgactctatggggtcctggcag

SEQ ID NO: 6843843 - DNA, 83 bp, Homo sapiens
cccgcatggagatagacttgggtatatatgttgctacagacctgtacagacacttctgaatatgtttatcatctctatatggg

SEQ ID NO: 6843844 - DNA, 72 bp, Homo sapiens
aattgcaatggcctcccaagcagggggaaagaccaacatttgcctccttgactctcttgtgaggcctcagtt

SEQ ID NO: 6843845 - DNA, 126 bp, Homo sapiens
gacaacgaagaagggtagaaaaaacccagattatagcttaaggccagtgagtgtgggggcaaacagctctgcatggcttcaaagcctttggcaccttgattgtgtggttctatctgtagggttgtc

SEQ ID NO: 6843846 - DNA, 69 bp, Homo sapiens
agaaagggtgaattagataactatggattaggaaaaaaatccagactctttaagttcattttccttttt

SEQ ID NO: 6843847 - DNA, 67 bp, Homo sapiens
tgatacacatgactctggctacccagagatccataactctctgggtcatgcaaagttatgttattca

SEQ ID NO: 6843848 - DNA, 65 bp, Homo sapiens
cctgggttaggagtaatttgttacagcaagatgatacttgagtgacaggctgcttctggctgagg

SEQ ID NO: 6843849 - DNA, 103 bp, Homo sapiens
cccaggacggtgttttagggttaccagtcttgttgccatgtctgtgcccctgtgcagcgctgtgggaacagggctatgtctggtcaccccagcatccctaggg

SEQ ID NO: 6843850 - DNA, 71 bp, Homo sapiens
gaggagcatttgaaaggtgcctgtctgcaaacctggtccccgggagagcggactaggttgccgaggctccc

SEQ ID NO: 6843851 - DNA, 62 bp, Homo sapiens
gcagctgccagtccccttccaggccctgtcatgggatggagcagggcatcactgtgcggcgc

SEQ ID NO: 6843852 - DNA, 56 bp, Homo sapiens
tgactcattcccatccaggaggaaataattcagcctctggaggagaggaaaagtca

SEQ ID NO: 6843853 - DNA, 94 bp, Homo sapiens
ttccagctgtctgtgctccctaattggtttccacactgcagccagcaaagggtctctaagctgctgatgggtgggatacggagggaagctggga

SEQ ID NO: 6843854 - DNA, 65 bp, Homo sapiens
ctgctgagagctgaaggctgtagttcagacaaaaccaagccctaccctttcaccaccctcagcag

SEQ ID NO: 6843855 - DNA, 66 bp, Homo sapiens
gaggccggctctgccctgctgatccccgtggcccaacttttcggggggctagctagaccgagtctc

SEQ ID NO: 6843856 - DNA, 60 bp, Homo sapiens
cttatcttacttccgttgtgatgacccaccctcaccatcgcctgggaagagaaaggtaag

SEQ ID NO: 6843857 - DNA, 67 bp, Homo sapiens
gtaccagtctctgtgggcacctgggagaatcctcacaccttcctttcagcccagggggataggttgc

SEQ ID NO: 6843858 - DNA, 64 bp, Homo sapiens
ttcatgtccagaggaagttgaggggcccagattctctaccttcaaaacttcctaggcgcgtgga

SEQ ID NO: 6843859 - DNA, 59 bp, Homo sapiens
gtctagtcacatttcaagtgctcaaaagccatgtgtggctgatggctagtgtactggac

SEQ ID NO: 6843860 - DNA, 130 bp, Homo sapiens
ctcagggctatggtatggattaatcaatgttatgcacacattagcacagggtctggcaactttaacatacctacggtgctgtggtgctatatatacattcagttatacaatttaaaccacatgtgctgag

SEQ ID NO: 6843861 - DNA, 65 bp, Homo sapiens
gggaaatgaaggagaaagagcagaatggccaaatgaagggtttgcttgtcttccctttacctccc

SEQ ID NO: 6843862 - DNA, 98 bp, Homo sapiens
ggaggtaatgatgctggctgtgatggcctatgaccgctatgtggccatttgtaaccctctgctctacatggtggtggtgtctcggcggctctgcctcc

SEQ ID NO: 6843863 - DNA, 58 bp, Homo sapiens
gagagtttgaccctgctgggaatgtgcaaaaatatttggaggcaggatttcaactttc

SEQ ID NO: 6843864 - DNA, 73 bp, Homo sapiens
attctctcctgctgtgagtggttcttgcctttgctaagggtttgaatatgcattcaaagtgaaaggagtggat

SEQ ID NO: 6843865 - DNA, 85 bp, Homo sapiens
tagaagcggcacaggacatggaagtatggagtggacaggttaccatttgtacgcggtgattgtatttttaaatgtgctgtaacta

SEQ ID NO: 6843866 - DNA, 69 bp, Homo sapiens
caggcctgccctgggagtacctgtccttatgcgagaatagaggataataggtcctcagggctgggtgtg

SEQ ID NO: 6843867 - DNA, 58 bp, Homo sapiens
attacacttgttcatcatcaccatgagagacattccagggagatgaacgtggtgggat

SEQ ID NO: 6843868 - DNA, 70 bp, Homo sapiens
tgcccgctggctgggctccagcttccacttcttgaccttgaaataggggctggccccatccaggctggca

SEQ ID NO: 6843869 - DNA, 73 bp, Homo sapiens
tgcacataatccatttgcactgcagacaattttaggatgtggtttacagtaaggtggatggtaccttatggca

SEQ ID NO: 6843870 - DNA, 70 bp, Homo sapiens
gggaaatcagtttttgtttgccagatagctatgtatatctagctttggagagtcccacgaacttcttccc

SEQ ID NO: 6843871 - DNA, 82 bp, Homo sapiens
ggtactgtgtcttaggatgtggaatacagcttgttttgttgttccctaaggctgcttcttccccgtcttaagagatagttcc

SEQ ID NO: 6843872 - DNA, 78 bp, Homo sapiens
tgtggggcaagggaggcaggggagtgatgaatttgttttctttgcattgttccacttccttgtttgctgtgttgcaca

SEQ ID NO: 6843873 - DNA, 89 bp, Homo sapiens
cccaacaatcgagccttgtttatgaacctacatttattaagtgaaagtatttggaaactgatggtacattcaagcttggttgccatggg

SEQ ID NO: 6843874 - DNA, 57 bp, Homo sapiens
tctgaaggaaaagggtagatattccaaaagtggtttaaaacctttagatccttcaga

SEQ ID NO: 6843875 - DNA, 68 bp, Homo sapiens
ggtgcccaggtaccttgagccgttgctgatgagaatgctctcccgaatggtcagggtgcagtaatacc

SEQ ID NO: 6843876 - DNA, 89 bp, Homo sapiens
tctgcaaagcttaactctacactgcactttatttcccaaactaaagggagggcctggaatgcagtgggagcttaccaaatatttgttga

SEQ ID NO: 6843877 - DNA, 60 bp, Homo sapiens
gcccaggctggagtgtgcagtggcgcgatctcggctcactgtaagctccgcctcccgggt

SEQ ID NO: 6843878 - DNA, 57 bp, Homo sapiens
ccctgacttgatctttgacttggctctttactgatccagccaaagctgaagccaggg

SEQ ID NO: 6843879 - DNA, 75 bp, Homo sapiens
ggcctctgtgaagtccaggagtaaagaaacctgtttggtttgtttaacctggcatttcccaaactcatctgagcc

SEQ ID NO: 6843880 - DNA, 68 bp, Homo sapiens
aggaggcactgggtgagggtcactggctccaggtgggtggggtgtccaggcctctgcctcgtgcccct

SEQ ID NO: 6843881 - DNA, 78 bp, Homo sapiens
ttagaatgtatcttcatgttgcttattctgggttaatatccttaggtatttagcatgaattttcaatatatactctga

SEQ ID NO: 6843882 - DNA, 94 bp, Homo sapiens
cagaattaagacagggtgtgaccaagagtggcaactacactaaattcgagggtgagaactggtttctattcatgctctgcctgtactaggtctg

SEQ ID NO: 6843883 - DNA, 60 bp, Homo sapiens
tcagccctgtgtgcttgtgttccttagagctctccttcaaagagcgccgggcagggctga

SEQ ID NO: 6843884 - DNA, 58 bp, Homo sapiens
ggcccccactctccagcacaccccatttctctgaaagggccaatggagagtgtgggcc

SEQ ID NO: 6843885 - DNA, 56 bp, Homo sapiens
gggtcttatggctattttcatttctagggacatggaagaaagataattaaggaccc

SEQ ID NO: 6843886 - DNA, 72 bp, Homo sapiens
gggtcggtacggggaagttcggttggccggcaggctgcggcttcggccacggggtttcctccaattagatcc

SEQ ID NO: 6843887 - DNA, 55 bp, Homo sapiens
ggggtaggtcatagcccctctaaaccccaagtttggggaatgtgccccttacccc

SEQ ID NO: 6843888 - DNA, 56 bp, Homo sapiens
ccggacttgaatcttttgcctggccgcaacccgccagcctgcaatgtaggtaccgg

SEQ ID NO: 6843889 - DNA, 78 bp, Homo sapiens
ggtagaacttcctttgctgttcggaggttagattggggaaagtcgcaaacctacagaaaagtagaaaaagtgctgtcc

SEQ ID NO: 6843890 - DNA, 77 bp, Homo sapiens
aacagcgtcttctgcaactgcacctgcctcgcttgcctctggaaagggtgggggcaggtcagcagagccatgctgtt

SEQ ID NO: 6843891 - DNA, 85 bp, Homo sapiens
tctctgtattgcagcatgtgtgcaattagttactgaaaaggaaacacagctcagctcagttgctgcatctgctgctagtcaggga

SEQ ID NO: 6843892 - DNA, 76 bp, Homo sapiens
agcaaagggatgttagttgtgagctcagttccccaccgggcctggtgtttccaaatagcccgtcactgtccctgct

SEQ ID NO: 6843893 - DNA, 84 bp, Homo sapiens
ttatctgggcaatagggtgtgtggagaagattaactgtgttatactgtaatagttgctagataatctcacacactccccaataa

SEQ ID NO: 6843894 - DNA, 58 bp, Homo sapiens
accatgtcctgtgctttgtgccacctgtttacctttgtacatggcattcccacgtggt

SEQ ID NO: 6843895 - DNA, 77 bp, Homo sapiens
tgaactccaaatactgctgattcacagtgtctctttcacttatgaccctgacctatctatgcagaatttggggttca

SEQ ID NO: 6843896 - DNA, 107 bp, Homo sapiens
tgaacttagctgtcacggccgctgacaaatagttccctttgcttcctgatttggaactgcgcgccggcgagaagttgttagtggcttggatggtgacctttggttca

SEQ ID NO: 6843897 - DNA, 56 bp, Homo sapiens
ctgttattttataattcaagaaagggattttctttcccttgaattgcaagtaatgg

SEQ ID NO: 6843898 - DNA, 81 bp, Homo sapiens
gataggggatgcctcatcctcagggggccaacccagcctcttcctagagccagggtccggcttctggggagcatctccttc

SEQ ID NO: 6843899 - DNA, 57 bp, Homo sapiens
tatgtcctgctactctctcatgctgcatttttgctcttgggaaatgtccaggacata

SEQ ID NO: 6843900 - DNA, 56 bp, Homo sapiens
ggcaggagaaaggtctcttctttagagaagaggaagggaaagagacccatcctgtc

SEQ ID NO: 6843901 - DNA, 91 bp, Homo sapiens
tggcctgtaatccagaactggccaatcagagcatcacactttcctggccacagtaattgcttcccagtgagctcatggccaagtcaggcca

SEQ ID NO: 6843902 - DNA, 59 bp, Homo sapiens
tcggctgctggtggggctatctgggcctgtctgggaagtggaagccatcggcagtctga

SEQ ID NO: 6843903 - DNA, 76 bp, Homo sapiens
atctgaagaggattattgatgagatcattatgaagggcatgctgaaacttctaatatgaatagtccagatttagat

SEQ ID NO: 6843904 - DNA, 63 bp, Homo sapiens
acttgggcagtatgtttattagaactgcaggagtttgtagtctcagggagctgcttctcaggt

SEQ ID NO: 6843905 - DNA, 83 bp, Homo sapiens
ggagctagggcttttccgctggaaagtcgatcttggttgaagatggcttagagtcctggtgagaaagagtcattgtgagctcc

SEQ ID NO: 6843906 - DNA, 68 bp, Homo sapiens
aaaactgggcagctgtatcagggagtgtgactttgtaccatattctctttttatacctgttcattttt

SEQ ID NO: 6843907 - DNA, 74 bp, Homo sapiens
ggagagttgttgatctttcattttgtttagtttcttatttgtcaagattgagagatgacttctaagtgctttcc

SEQ ID NO: 6843908 - DNA, 55 bp, Homo sapiens
agccatgggagactgtgggagacaatgcattccctccggctcagttcccttggct

SEQ ID NO: 6843909 - DNA, 57 bp, Homo sapiens
cagtttactgagtacttgcatctgtaaagtacaagatgcgtgtgtactgtaagtctg

SEQ ID NO: 6843910 - DNA, 58 bp, Homo sapiens
cagatgctggtatgggggaggtgatgtgaagcagctaaaccctcatagatagtgtatg

SEQ ID NO: 6843911 - DNA, 62 bp, Homo sapiens
attttgttgttgttgttgttcccaggctagaatgagccagaatttagaaaacaacataaaat

SEQ ID NO: 6843912 - DNA, 71 bp, Homo sapiens
ctgcctcctgtcttctggagttgtgacctcagggtggcccaggtggatcggcttcagaggccaggaggcag

SEQ ID NO: 6843913 - DNA, 82 bp, Homo sapiens
tcaaaagattgcttggtgagtatggacacagagaaattagaatgagctgtgtgatctttatgttgatttcctcaggcattga

SEQ ID NO: 6843914 - DNA, 72 bp, Homo sapiens
tcccccccgaccccgacctcgcaaagcgcactcccgggcagggtgtggtctggaaggcggggctggcgggga

SEQ ID NO: 6843915 - DNA, 81 bp, Homo sapiens
gatacgtattatgggctgcaatgcttcagttgttgagatgcagcacttagcatttgtagagtgccagccctctgctgtatc

SEQ ID NO: 6843916 - DNA, 78 bp, Homo sapiens
gatcttttattcttgagctgaagccagttgaaatgcccccagcctgggcctttttattcagacaagaacaatgagatc

SEQ ID NO: 6843917 - DNA, 80 bp, Homo sapiens
ggagtttggaggaggacctgaggcctggagtggagctacacatcccaccagccagtctcttccctcctgccagcatctcc

SEQ ID NO: 6843918 - DNA, 61 bp, Homo sapiens
tgcaaagcacaccctcagagtttcaagagaaacttaccagactctgagagtgtgctttgca

SEQ ID NO: 6843919 - DNA, 64 bp, Homo sapiens
gagttgatccctacagagtttgttctgggcccaccctagaacttccaattcagggctgcagctc

SEQ ID NO: 6843920 - DNA, 60 bp, Homo sapiens
aacagtggtctggggagtggaggtggctagattgaatgtcctccagaaaagacctctgtt

SEQ ID NO: 6843921 - DNA, 84 bp, Homo sapiens
ttttccatggattgctggagcttgagaggacagggggtgcctcataccttctgctctcttaggattccagaatgttaaggaaga

SEQ ID NO: 6843922 - DNA, 89 bp, Homo sapiens
ggagtttcacccttgtcacccaggctggagtgcagtggcacaatcttggctcactgcaacctccaccttccgggttcaagagattctcc

SEQ ID NO: 6843923 - DNA, 86 bp, Homo sapiens
tgggactcaggaaaggagcactagctccaggctgaattgcaggctgggtggctgcatctgcctggagtagcgcctggggagttcca

SEQ ID NO: 6843924 - DNA, 63 bp, Homo sapiens
gggtataatgtttgggaaggtgctttgtaaactataaggggcaatacaaacatgtagtacacc

SEQ ID NO: 6843925 - DNA, 80 bp, Homo sapiens
gaccttattggattcttgccccaggtctgcccttaacaatgcagtgtgacccacctagggcgagctatttaatcggagtc

SEQ ID NO: 6843926 - DNA, 91 bp, Homo sapiens
atgttgcaatactttttcagagtacacagagatcttctatccccagtggaacaattgaactgtgatattctgtgccaaagtgggttgatat

SEQ ID NO: 6843927 - DNA, 102 bp, Homo sapiens
tcgctgggctggggaaagtccaggtcctcattccatccttctttagccccagcctcgggatgggaaccagcagagggcctagactatccagaaaccccctga

SEQ ID NO: 6843928 - DNA, 71 bp, Homo sapiens
tcattctgagctaatatgcttatgagcatgacttattaaggagcaccagtataggcatgttgatggaatga

SEQ ID NO: 6843929 - DNA, 81 bp, Homo sapiens
ttatcaaaagcgtggaagctgacaggatggcattattagcgtggctctgagctaatcctgttgccgatttgttgaggatga

SEQ ID NO: 6843930 - DNA, 59 bp, Homo sapiens
gctgtccctggaactatggctccagtaacacatactttagctggaatccagggatctgc

SEQ ID NO: 6843931 - DNA, 77 bp, Homo sapiens
gatttgcttgaacccaggaggtggaggctgcagtgatccgagatcacaccactgcactccagcctgggggacagatc

SEQ ID NO: 6843932 - DNA, 109 bp, Homo sapiens
acatcatttaatctgccagaaatttaacaagaataaggataagagattggcctcaaggtacaattcatctttctcctcatattccttgtaggtgcatatcaaatgatgt

SEQ ID NO: 6843933 - DNA, 78 bp, Homo sapiens
gtgccccagatggagctgatggtagaagaatgactgttctttaactcttctttcctcatcaagtacatctgagcccac

SEQ ID NO: 6843934 - DNA, 118 bp, Homo sapiens
aatatattattggtcttgcatctcagatatcaaataaaggtacctagcttgacacaaaagttggtagctgcaaggttaagctgtattagtttgatgatgggccaggaaatgatatatt

SEQ ID NO: 6843935 - DNA, 79 bp, Homo sapiens
ggctatgagctgggtggtctgcgcagcccagggtcagatcacattgcatccaggccccaagaccccgacagcccaagcc

SEQ ID NO: 6843936 - DNA, 59 bp, Homo sapiens
gcaggacagagcgattactcagtagtttctgttaaagtgatcctttgttaaacttctgc

SEQ ID NO: 6843937 - DNA, 74 bp, Homo sapiens
tgctaagtctttcaaagtttgctttggattaaaagaacaaaaagagttgtccaggagcaaatgatgagacagca

SEQ ID NO: 6843938 - DNA, 70 bp, Homo sapiens
cttggatgaccttttaggatttgagttgctggactgtgaattccaaggactaaattctagattcaacaag

SEQ ID NO: 6843939 - DNA, 57 bp, Homo sapiens
tgggagagctgatagatgagctactttggacagagtggttcacactgcattctgccg

SEQ ID NO: 6843940 - DNA, 75 bp, Homo sapiens
gagattaagacaagcctcgcatttgtaaggttaacagggaagatgcaccttttaaagtgagtttgttttgttttc

SEQ ID NO: 6843941 - DNA, 75 bp, Homo sapiens
gtttaaatgcatattcctgggacccctttctcacatcaagaagcagggtagatcccaggaatctgcatttttaac

SEQ ID NO: 6843942 - DNA, 56 bp, Homo sapiens
gatccagttctcagtgcttacagtagttatcctattgtaagtaaagaaataggatt

SEQ ID NO: 6843943 - DNA, 63 bp, Homo sapiens
gggtggagcctgtgtcccagacagatcccctaggcctatctgagacccatacaggcccacacc

SEQ ID NO: 6843944 - DNA, 67 bp, Homo sapiens
taatgaactctttactttgggactgctttccattgtatccttaagaaacaatagagagtgaacatta

SEQ ID NO: 6843945 - DNA, 102 bp, Homo sapiens
taaattatatgagagatgattaaacctcagagtctttttcattttgcaaacaggtgtttatgaagcagttactgggtgttaatcattattccacatgaatta

SEQ ID NO: 6843946 - DNA, 68 bp, Homo sapiens
ccttgtccctggaagtgtttcaagcaaaggataaatgctcctcactcaggacagattccagagaaagg

SEQ ID NO: 6843947 - DNA, 96 bp, Homo sapiens
cagtttgggaaggcaagtaggtggtagagttgggatgtgaatgcgtgcattcactataatccacagtcttagccatcaaaccagtgtcccaaaatg

SEQ ID NO: 6843948 - DNA, 59 bp, Homo sapiens
tccttcctgcaggccaagtcctaacatctcagtcaggctatcaacgcactagggaagga

SEQ ID NO: 6843949 - DNA, 112 bp, Homo sapiens
gtcacaagggtgtggggtcagtgtctgctggtgagctgtatattgttttaatattacttatattgagaccagtgcttgcttagctaccagagaaaaataaacatattgtggc

SEQ ID NO: 6843950 - DNA, 79 bp, Homo sapiens
tgaacaccaccacacactgacaccttatcttgttgcctagtagcagctacaagaatgaattcaatgtgtggtgtgtcca

SEQ ID NO: 6843951 - DNA, 56 bp, Homo sapiens
gcccagagtggagggtgcagaatgggtagcacttccattaacactgagctatgggt

SEQ ID NO: 6843952 - DNA, 92 bp, Homo sapiens
tttcctttggcattagtaaagtaaacccactttgtagtcagcacacagcatgttaaagagaaagtgtttgtcttacagtgtgttaaagggaa

SEQ ID NO: 6843953 - DNA, 93 bp, Homo sapiens
gcaccactggccatagtctacattgttatctgtaagtgtccccttgcaagaatgggagaggcatgcaaacagtctagagtaggtgccaggtgt

SEQ ID NO: 6843954 - DNA, 70 bp, Homo sapiens
gtgtccatatgtcaggtgtgaattcaagttcaaaattacagacatgatttccacatagacgaatggagat

SEQ ID NO: 6843955 - DNA, 62 bp, Homo sapiens
tcctgaaggttatacattatgagaaatgtgagatttctgtattttgtcataacctccaaggg

SEQ ID NO: 6843956 - DNA, 110 bp, Homo sapiens
gagttgttaatgtcccagaaggtttggtgtgcaggtgtcagtgcagctctctgcatgtaaaatgccagcatgtactgtacccacttctaccctttccgtaaaatcaactc

SEQ ID NO: 6843957 - DNA, 74 bp, Homo sapiens
ttcctactttgtcttcattatctggttacttttctctattgtagctaagtttccaaaaggagacagggaaggaa

SEQ ID NO: 6843958 - DNA, 62 bp, Homo sapiens
aggtgggagtccaaggtttttatagttcttctctcgaattagtgcctgcagactctacagct

SEQ ID NO: 6843959 - DNA, 92 bp, Homo sapiens
ttgttttcattgacatgatagctttttgtcatagagtcttagtgaaggaggctctcaaataagctgttaaattatgttatatgatcagacaa

SEQ ID NO: 6843960 - DNA, 130 bp, Homo sapiens
ctgtatttgtgctgacctgggcctcctggcctcgctgctgtcgccgagctgcatgctggtcctcaacgcccgcaacgacgatgcgctgcggcagctggaggccgagctgggcgccgggcggtctgacttg

SEQ ID NO: 6843961 - DNA, 86 bp, Homo sapiens
aggcagccctcatcctggacacccattccttggctgtacccaacagaccactgctttcagggagccgtgccagtgagtagctgcct

SEQ ID NO: 6843962 - DNA, 79 bp, Homo sapiens
gtgggaccgcctcctgtcgcacgtttccgcctggtcccgcgctttaggagctaggaaatgtgacagaggcggtgcctac

SEQ ID NO: 6843963 - DNA, 80 bp, Homo sapiens
tgaagactatgtgtattttactcaccacagatctctaaaatagccctgtccggtggagtgcaatgggccataggcattca

SEQ ID NO: 6843964 - DNA, 89 bp, Homo sapiens
gaggcagcttgggactgactctcaagcacaagtccaccatgtgtacaggtggcagtgcttgcgggtctacccagggagtaactgaaatc

SEQ ID NO: 6843965 - DNA, 74 bp, Homo sapiens
ctcttaacgtttttctagactcaaagaggatataaatgtttcctctgcatgagctaggttccaggaacaaggag

SEQ ID NO: 6843966 - DNA, 58 bp, Homo sapiens
ggggttatcagctgtcgctggagcccaggcagggaatatgttggcagctgaaagctct

SEQ ID NO: 6843967 - DNA, 76 bp, Homo sapiens
ggtggtacatttgtacgtgctttgtaacctgtaaagccctttactgtacacgtgtcatttacagctctgtatcacc

SEQ ID NO: 6843968 - DNA, 59 bp, Homo sapiens
cctggcttccaccatggcccctgcttcagacaacgggaagcagaggccagaagcacagg

SEQ ID NO: 6843969 - DNA, 78 bp, Homo sapiens
gccctcacagagctcatactgggaggcacacaggcaggagactttcagcaaactcctgtgtgagagctgtgctggggc

SEQ ID NO: 6843970 - DNA, 59 bp, Homo sapiens
gaaagcttggaaacgactttatcatgatgcaagaacttgatacttgttttcaggctttt

SEQ ID NO: 6843971 - DNA, 55 bp, Homo sapiens
tcttgaagtccttacatttgatccttatagatggatcacagatgaaagttcaaga

SEQ ID NO: 6843972 - DNA, 56 bp, Homo sapiens
tgagtagtcagtgggcaggaaggggagtttttaccttcctctgcaactgatgctca

SEQ ID NO: 6843973 - DNA, 72 bp, Homo sapiens
ggctgcaacattttcttaggtagaaccagatcagattgctaggagtggagaacatctgagcaagtggtagcc

SEQ ID NO: 6843974 - DNA, 56 bp, Homo sapiens
ttgaggcacagattttagtggctttgtggcaataaatagggcatggtgtgccttag

SEQ ID NO: 6843975 - DNA, 87 bp, Homo sapiens
aggctgttatgagaaggttcctttagggaaatcgtctcacccttgagagtgaatctgatttccctggaggcctcattcagatagcct

SEQ ID NO: 6843976 - DNA, 80 bp, Homo sapiens
gcccgataccagctgcaggcagaggagtccaggcagaaagtgagctgtgtgtgtgggctgctgcagctaaggtgaggtgc

SEQ ID NO: 6843977 - DNA, 100 bp, Homo sapiens
cccaggtggaggggcgggacgcagagcagcggctccacctcccgggcgggaagccccggccctctcggcctgctggctccagcgcccgcccctgaccggg

SEQ ID NO: 6843978 - DNA, 56 bp, Homo sapiens
atctagctcctgtttagggtcacaactttatgcaagatccaagaaaggatgcaggt

SEQ ID NO: 6843979 - DNA, 77 bp, Homo sapiens
gccagggagctgcgggcggcagcaggacattagcctggggacaggcagatgttctggggtgtttgtggctctcaggc

SEQ ID NO: 6843980 - DNA, 93 bp, Homo sapiens
atgtttccctagactcctgtagactgttacagcttttcagatattccttatttttgatgaccttgacggttttgaggaatgctggtcagatat

SEQ ID NO: 6843981 - DNA, 55 bp, Homo sapiens
aagggaagcactttacgatgagaccttttactatttcatcttggagtactccttt

SEQ ID NO: 6843982 - DNA, 60 bp, Homo sapiens
ctcagaatgcgcagagtggtgtgtgcatgcagcaacgtgtatacaccctgtgcatctggg

SEQ ID NO: 6843983 - DNA, 66 bp, Homo sapiens
ctcatgatggacacctcctgaggttctgcttggagcaggcctctagtgcatcctcaagaagctgag

SEQ ID NO: 6843984 - DNA, 59 bp, Homo sapiens
tttgtaagaactataaattgcttgggttcactctcttccttgtatgtagtacttataaa

SEQ ID NO: 6843985 - DNA, 60 bp, Homo sapiens
gtgcgtcatcgggctgcagatgggcacccacaaatgcaccagccagtcccgcatgaccgc

SEQ ID NO: 6843986 - DNA, 107 bp, Homo sapiens
ggcccgagccaccactgccctgcacgcctggaagagcaggcagacaatgccgaggtgctagagaaacccagccgctgggcctgcctgctgtgtgcaagttctgggcc

SEQ ID NO: 6843987 - DNA, 73 bp, Homo sapiens
ttcttagtggagtataaattattaggatcatttagttttatgcctagattatccctgatttgtccactgggag

SEQ ID NO: 6843988 - DNA, 60 bp, Homo sapiens
tggggtggggttggggggcaaccacactagatggtgacattgctgccctccctttcctca

SEQ ID NO: 6843989 - DNA, 129 bp, Homo sapiens
gggtataatttgttggatagtcacatgcttcctgaggttttaaaactattccttttgaatgggaataatcatgaaattcagtgaatggcattgcttaattaagataatccacaaacagttgaagtattc

SEQ ID NO: 6843990 - DNA, 90 bp, Homo sapiens
gctgtgcagctacgtgggagaatttcccagtctgtgctgagaatacctttcttgccaccacttttgaaatcgtcctgtagagggcacagt

SEQ ID NO: 6843991 - DNA, 89 bp, Homo sapiens
gggtggggcctgtgtctctctctcttgtcaccccatctgcctaggatactgggcagggccagtgcagagaggaagctcaggagccattt

SEQ ID NO: 6843992 - DNA, 79 bp, Homo sapiens
catgcagccaggaatacaaatctttgttctcttcaaacaccaaaaagaggcagctacttgtatttactctatgctcatg

SEQ ID NO: 6843993 - DNA, 70 bp, Homo sapiens
gtataaaagcaatcgaaagctgagggagcatttgtatttgacaacgttggtccagtttttgattaggtac

SEQ ID NO: 6843994 - DNA, 76 bp, Homo sapiens
gagaaaggaagtataatcaaagcagggctactaaaagttccctaggtaagtggcccagtatgtataatcttatctc

SEQ ID NO: 6843995 - DNA, 59 bp, Homo sapiens
ataggccctgctttgcacccaggctggctctctgagccagccggcaagggagtgcctat

SEQ ID NO: 6843996 - DNA, 93 bp, Homo sapiens
ctgggaaccttactggggagtgtggattctttgacagccaagacgccttgggctctaaagcacatatcttacaataaggccaactcttttcag

SEQ ID NO: 6843997 - DNA, 56 bp, Homo sapiens
ggggatggggggtgttagtgatggccattatatcatttgttctcattctctacttc

SEQ ID NO: 6843998 - DNA, 96 bp, Homo sapiens
ttcagttggggaaagaggtgatctggctttgagctcaccccctttgtcagaggaaagatttttctggaagaggtgggttgggagctgggtattgaa

SEQ ID NO: 6843999 - DNA, 59 bp, Homo sapiens
tctgattgatgcagaccatattggttatcctcccagcttaatgtcctctgccaatcaga

SEQ ID NO: 6844000 - DNA, 82 bp, Homo sapiens
aagaggaagaaagcataggtggggagagggaggaaagaaactatgaccttggcccctatacactctgcattcttttattctt

SEQ ID NO: 6844001 - DNA, 84 bp, Homo sapiens
aggctagtcagtgaggatatgagagctttttggagcactagcagcatcagattggagtgtgatgagaagctgctgacttagcct

SEQ ID NO: 6844002 - DNA, 68 bp, Homo sapiens
agtaaacattcttcaaatatcactctttgtggaaatgcattagagggaggcaagaatggaagtttgct

SEQ ID NO: 6844003 - DNA, 62 bp, Homo sapiens
gatttaggaaagtctcttggctgggagccacagttggtcccttctgagtgctttcctgaatt

SEQ ID NO: 6844004 - DNA, 70 bp, Homo sapiens
ctctggtcttcaaggccacctcttctctaccatttaactctgtgtaaattagggctttgaagaactggag

SEQ ID NO: 6844005 - DNA, 77 bp, Homo sapiens
aagataatctgaggctagtgattttagagacttagcagcttccagctgagtctcttaaagacagtgttgacaatttt

SEQ ID NO: 6844006 - DNA, 91 bp, Homo sapiens
ctctctgaaaacctatccacctgaaattgtcctctgtatgggataggagctcaataatggcaggataaatttataaatgatagacagggag

SEQ ID NO: 6844007 - DNA, 92 bp, Homo sapiens
ccagcctctgggaggaccactgcttagtaagattgtcttctgggctctccagcagcaatcctgaaaaattgatgtcatacccatagagctgg

SEQ ID NO: 6844008 - DNA, 73 bp, Homo sapiens
taaaaggccagttctgggcctcatgcacagagatgctaatttagtatgtctagacccaagaatatgcctttta

SEQ ID NO: 6844009 - DNA, 73 bp, Homo sapiens
tttctgctgcctgacaatttaggtttgccacatccagagactcagccggcaagccttacagctacagcaggaa

SEQ ID NO: 6844010 - DNA, 91 bp, Homo sapiens
agctggataccagattctgggggaatacagctatgagaaatgtaagaattctcaaatgcttgtcacttccccatgttggttttgtttagct

SEQ ID NO: 6844011 - DNA, 68 bp, Homo sapiens
accatgcccagccagtttatggtaatttgctgcaaccacaggcaattaatatacactgttagcatggt

SEQ ID NO: 6844012 - DNA, 126 bp, Homo sapiens
actttatactgtgtgtggaggagttcagttgtaactggtggtgcctaataattctattgcaataattaaagttcatggagagctgttaggttattagttcatagaagctgcttcagaaaacggagt

SEQ ID NO: 6844013 - DNA, 69 bp, Homo sapiens
gagatcagggtcccagcctggactgggtcttgtgagcattctcttacaggttgcaggctgtgacttctc

SEQ ID NO: 6844014 - DNA, 66 bp, Homo sapiens
gtccattgttctatggctcaaacgccctttcccaaaagattcttgtttggcctggagtcaatggac

SEQ ID NO: 6844015 - DNA, 71 bp, Homo sapiens
gaaggattcacctacaagtttcaaagagatcatggctctgctgacaccttgattttaaacttctagccttc

SEQ ID NO: 6844016 - DNA, 64 bp, Homo sapiens
atgtctggcattcacagaaaacatgatcctaatggatataattatttctatggggccagcacat

SEQ ID NO: 6844017 - DNA, 63 bp, Homo sapiens
agcaaggcatttttgttaatctttggagtgatcagaaggtttgaaagatgtcttaatcctgct

SEQ ID NO: 6844018 - DNA, 60 bp, Homo sapiens
cagaatcctgttttacttcatcaacctcaaggttatgactttttggcaaaagggattctg

SEQ ID NO: 6844019 - DNA, 85 bp, Homo sapiens
ccttattgtccagtgggtaagtggaggacaaagtaagtaatactctctattaagttccctctatcttacttgccagacacaaagg

SEQ ID NO: 6844020 - DNA, 64 bp, Homo sapiens
tgctggcatggtgtatttgttcaactccaaaaagttaaatgcagagttaccatatgacccagca

SEQ ID NO: 6844021 - DNA, 60 bp, Homo sapiens
ataatacatgcattggatggcaatagggctgcttgttacatggacaactgtatgtattgt

SEQ ID NO: 6844022 - DNA, 75 bp, Homo sapiens
tgttagagcaatagttgtccatcagcagatgaaatagaattcagctgtcagatgcgataaactagtgaatataca

SEQ ID NO: 6844023 - DNA, 57 bp, Homo sapiens
ttttatcctcatggctgcaagatgactgctaatatccaggctgctatgaggatgaaa

SEQ ID NO: 6844024 - DNA, 85 bp, Homo sapiens
caacctagaaatttctttggagtcgatgttatgttataaaactgtatgtgaattttgcatttagctttaaaatatttctgtgttg

SEQ ID NO: 6844025 - DNA, 58 bp, Homo sapiens
gcctttcaaagaacctctgaatgaaggagcaaaggtcagaagaggcttaatgaatggc

SEQ ID NO: 6844026 - DNA, 87 bp, Homo sapiens
gtgaggtcacagtttcctatgcaaatttaatgaaactatgtatatagcaaattatacgtacgatttctgtgggtacgtgaaccttac

SEQ ID NO: 6844027 - DNA, 79 bp, Homo sapiens
gctgtccatttcatccagagtcctattagcagccatctactctactgctagagtcctggctttagaagaaagggatagt

SEQ ID NO: 6844028 - DNA, 57 bp, Homo sapiens
ctgtgttctgaaggagaagagtgtcatgagatggcccatttgctcacaggacagcag

SEQ ID NO: 6844029 - DNA, 130 bp, Homo sapiens
ccatgagctcccagattcgtcagaattattccactgaggtggaggcagccgtgaaccacctgctcaatttgcacctgcaggcctcctcatctgcctctctctgggcttctacttacactgtgacgatgtg

SEQ ID NO: 6844030 - DNA, 84 bp, Homo sapiens
tgactgtccccgcttggatggggggtccagagtataggcagggctggcctgtccatccagagccccagtctagtggggaagaca

SEQ ID NO: 6844031 - DNA, 69 bp, Homo sapiens
acatgattatagtgacttgtggtttaacctgtaagcttcatctggtaatgacaggcaatgtaattgtgt

SEQ ID NO: 6844032 - DNA, 80 bp, Homo sapiens
tcagctgcatccatgttgctgcaaaggacatgatgtcattcctttttatggctttgtagtattgcatggtgatgtgctga

SEQ ID NO: 6844033 - DNA, 69 bp, Homo sapiens
gaggtaggagactttctggcagatcagccaggccaccttcacactgtccagtcagaacgtcattacctc

SEQ ID NO: 6844034 - DNA, 55 bp, Homo sapiens
tggcctaaatctcatgatcttttctcatttgtaaagatactgatgatgtaggcta

SEQ ID NO: 6844035 - DNA, 77 bp, Homo sapiens
agattctaatggtatcatggctgagattcaatcatggcaaaatctcggatttctcagtcacatgaaccaatgaattt

SEQ ID NO: 6844036 - DNA, 80 bp, Homo sapiens
tgcttggatacttctctgacagtgaaagagttcaagataaccctttgaagctcaaatttgtgagataaatgttcttagca

SEQ ID NO: 6844037 - DNA, 55 bp, Homo sapiens
cctgtcatactaacgtagtgggccagctgcctctataatatcgttaataggcagg

SEQ ID NO: 6844038 - DNA, 125 bp, Homo sapiens
gtgcgtgtgctgctccttgtggtgcctgaggagaggtggcctgtgttgcattcacagaaatcatgacacacaagacacgagcggcctctcttcagtatcagatcccacctgcatgattcctgcac

SEQ ID NO: 6844039 - DNA, 85 bp, Homo sapiens
catccccccaacctggagaagcagcttagaatctacccgccacctcttaggtgactctggggcgctactccaacttggggctgtg

SEQ ID NO: 6844040 - DNA, 69 bp, Homo sapiens
ggtaaaggactgaggacatgtgaggcatgtaaaattaatatgatcttttagtcacttagaaaaaatacc

SEQ ID NO: 6844041 - DNA, 63 bp, Homo sapiens
aaccagaagcttcctacattgttctttcctgtacaattggcttaaagaagaggttttctggtt

SEQ ID NO: 6844042 - DNA, 65 bp, Homo sapiens
tgtaggttttcttatacttttcatagtccacattttatgaaagcacgtgggaagataaatctaca

SEQ ID NO: 6844043 - DNA, 117 bp, Homo sapiens
gcggtccctgccagaagatggcctattgaacatttccagaaatagcacagccaagcccgtcaactgctttcttggaaatacattcaataaggatggcggtcctccagcagggagagc

SEQ ID NO: 6844044 - DNA, 77 bp, Homo sapiens
acagaatgagtggctttggagaagtagggagcaggtcacgaggggcacccagctcatcaggagccgcccatggatgt

SEQ ID NO: 6844045 - DNA, 129 bp, Homo sapiens
tccaagtgccaagatgattagttcagtccacaaaatttcttgggagctcagagaataaaaagatcactgtggtttgggaagcctagagaaaggtttggtggaagagcaggtactcagctaggccttgga

SEQ ID NO: 6844046 - DNA, 55 bp, Homo sapiens
ttccaggaagctctcggcctctagctgaccgcgttgctgctgagcttccctgggg

SEQ ID NO: 6844047 - DNA, 91 bp, Homo sapiens
gtgagtctttttttaaagtgttcattttcatttgttctgtttcttttgtcactcagaaaacatgatattgaggctgggcacggtggctcac

SEQ ID NO: 6844048 - DNA, 78 bp, Homo sapiens
agggttcatgaggatgactgaccccttgtcttaaaaagaaggcctagaagagggcgttcagtcagtgtctctaacctt

SEQ ID NO: 6844049 - DNA, 89 bp, Homo sapiens
tatggtggtaacaaacacaatgcctactagtactattttgtggcactgcttcaatttgtgctaaggcaccggtagtcttatccactgta

SEQ ID NO: 6844050 - DNA, 57 bp, Homo sapiens
catgaaggaatgagtatactgtttctacttgcagaaaacgtgtgatctttctttctg

SEQ ID NO: 6844051 - DNA, 66 bp, Homo sapiens
ttcttcagaaaacgattttgactagtgctgggcacagcagtagacacatttgtttttcctcaagaa

SEQ ID NO: 6844052 - DNA, 63 bp, Homo sapiens
aggttaaacttcctgcagggctttctctgaagtcacagccattagttctgcagaggcaaacct

SEQ ID NO: 6844053 - DNA, 99 bp, Homo sapiens
ccctcattaatttaagcctaaaagtgcattcgaaagtccatcctcctgtgtgattgtaaggatgatgcactggtcactttggcatctgaaccaataggg

SEQ ID NO: 6844054 - DNA, 125 bp, Homo sapiens
ctcagttaatctataaatggtatcaggccattaagatacaagttaagagaaaggaggcttaaacaccatcctgctttacttgtgcttgtgctttggtgtactcagagacttcttcctaccctgag

SEQ ID NO: 6844055 - DNA, 88 bp, Homo sapiens
gggtctgcgcttctgtgggggcaggaggggcgtcactgtgcacagcctagatgccctggcctgtccccgcagggacaagacaagaccc

SEQ ID NO: 6844056 - DNA, 64 bp, Homo sapiens
cctccatttgtgtccgtcccagttctgtgctgctacagctggaggcagttggggcagaaggagg

SEQ ID NO: 6844057 - DNA, 70 bp, Homo sapiens
tccagtacacctcacttccctttgtaagtgaaagtgaatatgaaaatgcaaagggatgaagtgtattggg

SEQ ID NO: 6844058 - DNA, 56 bp, Homo sapiens
ccagggaggagcatttcatggtgtgtgtcttgacaacatgacaatgctagtcctgg

SEQ ID NO: 6844059 - DNA, 69 bp, Homo sapiens
agatagagactataatgctctttgtgccggtaaggaaaacaagctcgaggagattaaagtctgttgttt

SEQ ID NO: 6844060 - DNA, 76 bp, Homo sapiens
ggaaaatggagagctggcacttggcacccatgaaagacccactttccctgccctaccaggtggcatttctccttcc

SEQ ID NO: 6844061 - DNA, 74 bp, Homo sapiens
atgttgtggtgtgtatttaaaggatagttggggacccaaataccactatatgcctttgaaatacaaaataatgt

SEQ ID NO: 6844062 - DNA, 59 bp, Homo sapiens
ctgactgcttttttaagagtatactgtggggtagcggcagatacaagagagcagttgag

SEQ ID NO: 6844063 - DNA, 80 bp, Homo sapiens
ccatggcagtgtcctctctgctgtgatttgctacctgtgaccttcatgaggccaaatggcacagaaagcaaatgccatgg

SEQ ID NO: 6844064 - DNA, 67 bp, Homo sapiens
agctctggggcctgtcccacattaggtgatatccagacatccccagtgggagggagcccccagtgct

SEQ ID NO: 6844065 - DNA, 57 bp, Homo sapiens
tcagcttgggggtggcttctcattcagcgctagacagggagaacacaccctaggtga

SEQ ID NO: 6844066 - DNA, 106 bp, Homo sapiens
gctcctttggaaagaatatctgccgcccgaggatgggctctgcctatggaggcaacagtgagtgtcttcagagcccatcagtggcagtggaattaatgaagaaagc

SEQ ID NO: 6844067 - DNA, 85 bp, Homo sapiens
ctgagggtgggtgggatgcctctggagaagtgcctggtcctgatgaacctccacctccccattaggtcacccactctgctttcag

SEQ ID NO: 6844068 - DNA, 110 bp, Homo sapiens
gagccagaaaagctaaggtatcatctggagctgcaggagtcggggggaaaccccctgcttttgttccacagttttgaagtgggtgatccctccagcttttgctatggttc

SEQ ID NO: 6844069 - DNA, 65 bp, Homo sapiens
agaagcttactgtaattaaaagactttgaactcagacacccagagttttgaattcagaagcttct

SEQ ID NO: 6844070 - DNA, 127 bp, Homo sapiens
tttgggttgtcgtggctgtgggaggggagggagagcttcctggcatctgtgtagagaggcgaggcttgttgctaacaccctccagtgcgcaggacagccccagccccagccccagccccagcgaaga

SEQ ID NO: 6844071 - DNA, 59 bp, Homo sapiens
ttcagagccagcaacactaggctgatttcttctcacactgctgtctctgtggctctgag

SEQ ID NO: 6844072 - DNA, 88 bp, Homo sapiens
atgaatgagtaatcacccagcaatttagtcaaagatattttctatcctttgtccctgacaagtttcctggtgatttttccatattcat

SEQ ID NO: 6844073 - DNA, 59 bp, Homo sapiens
agcatagaaaagattcccagagtcctgctctgtggaaaggaaagtcttgatattatgct

SEQ ID NO: 6844074 - DNA, 71 bp, Homo sapiens
aagccctttgcccagcactctctctctctctacctggtgtggcagagtgatggaatgtgggtgaagtgctt

SEQ ID NO: 6844075 - DNA, 87 bp, Homo sapiens
agtatcctagttttcccctggagagatcctcctgaaaaagaggactttattagtaggatacctttaaaaggaaaattctaatgtatt

SEQ ID NO: 6844076 - DNA, 64 bp, Homo sapiens
gggtccagctacatcagggtgggtacttgtgtcctcttcccatactcgcctcaatcctggaccc

SEQ ID NO: 6844077 - DNA, 107 bp, Homo sapiens
cgcctccggcagccgccccatctccgccccttccggccagccgagcctcatggcttagatggcgtccatggccgcaggggtagccgtgggctcggctgtgggacacg

SEQ ID NO: 6844078 - DNA, 59 bp, Homo sapiens
ggtgggccaaattaaacatatatgtattttcatttaatgtatgtgcagtttggtttatc

SEQ ID NO: 6844079 - DNA, 83 bp, Homo sapiens
attaggttgaaccatatggaattgacattttttgcatgtcaaagaaggtataaatttgtcaacttcatatgtttcaatctaat

SEQ ID NO: 6844080 - DNA, 85 bp, Homo sapiens
gggcccgcactgtccagccggagtcggttagagaccctcaggaggctcacaggctccagggcctggatgttaggatgtgaggcct

SEQ ID NO: 6844081 - DNA, 129 bp, Homo sapiens
agccagtggtcaaccaacttgctaagatggtaggggacattaagagtcagagttggggaacaaatctgagtcttggggtccctatttccaacacttagattatatacgagttatattacactactggtt

SEQ ID NO: 6844082 - DNA, 88 bp, Homo sapiens
cacacccctccatgggtgggtaggatcaggcatatgtaatcctaaatcatttactcgttgtgtcttggccaccttgggaagggatgtg

SEQ ID NO: 6844083 - DNA, 88 bp, Homo sapiens
gagagcagagggtaggtcagggatctgggctcagctggagggaggtcctccaagcatgtggtcaggagcccgcctctctccagctctt

SEQ ID NO: 6844084 - DNA, 103 bp, Homo sapiens
ggctttactcctgtttagtcatttcattttctcacaatcctatggggtgggaatgatcactggccccattttagagaagaggaaactgagaaacagggaggtc

SEQ ID NO: 6844085 - DNA, 70 bp, Homo sapiens
gccagcgttcacaagctgggtttctgcaccccctttctagaaggtgtgggttccctggcttgacactggt

SEQ ID NO: 6844086 - DNA, 56 bp, Homo sapiens
ctggctgggagctcgcctgcggccctggaagccgcggttctcagcatcccagccgg

SEQ ID NO: 6844087 - DNA, 77 bp, Homo sapiens
tgttctcttaccacaaaacagttagaagtcaaatcagccactacattttgcactttttgcttgtgtgagagagaata

SEQ ID NO: 6844088 - DNA, 62 bp, Homo sapiens
agcagtgaggctctgctgagcggtctgccgagccgctggccctctccatgaacctcacggct

SEQ ID NO: 6844089 - DNA, 91 bp, Homo sapiens
ggctaaaattatgaggtgctatgtgaaattccacacaaatgaacttggaaatagatattgttttacttggtgttctgcccaggattttgcc

SEQ ID NO: 6844090 - DNA, 69 bp, Homo sapiens
gagtgtgttctcatttcatgtgtttacatgggcaacaccaagttcttaattcagaaagggaataaactc

SEQ ID NO: 6844091 - DNA, 64 bp, Homo sapiens
gcctcagcatcaacattctcagctctggtcacattgtagagttgtctagtgtgatctccatggc

SEQ ID NO: 6844092 - DNA, 77 bp, Homo sapiens
gagccaaatccagcagctggcttacttgagatgcatctggcaaattccagggcaaagccagtgactcccagcggctc

SEQ ID NO: 6844093 - DNA, 72 bp, Homo sapiens
tagatgatcaggacttcacttcttttgatttatttcctgaggggagtgtctgcagtgatgtctcttcttcta

SEQ ID NO: 6844094 - DNA, 61 bp, Homo sapiens
gctgggctccagcccgggaccaggtgctctaggtgggcctgggcctgggctggggaacagt

SEQ ID NO: 6844095 - DNA, 56 bp, Homo sapiens
ttcttaagtttagcaacttgtgatgaaatatgccacataaggctttcacttaagaa

SEQ ID NO: 6844096 - DNA, 57 bp, Homo sapiens
ggtatttatatgtctgaagctgctctgagtctggccgtcctagacaatgtggatatt

SEQ ID NO: 6844097 - DNA, 71 bp, Homo sapiens
tggcacctctgtcccaggcctatggtggagatctcaggtgaaaatggtgcctgggactcaggaggagctca

SEQ ID NO: 6844098 - DNA, 71 bp, Homo sapiens
gttggtgcaaaagtaattgtggttttggccattactttcaatggccaaactgcaattatttttgcatcaat

SEQ ID NO: 6844099 - DNA, 92 bp, Homo sapiens
ttcatttctgtttaaagttctggaagctgcataactagcgtggactgactgctgtgtcattgtgctgtgcctttgaaccctggctgagtgag

SEQ ID NO: 6844100 - DNA, 78 bp, Homo sapiens
ttgtttgagctggaattaaatgtgcacagctggtaccatctgctgcaaattctttaattcttgttatctcttaaacag

SEQ ID NO: 6844101 - DNA, 60 bp, Homo sapiens
ctgacatgttgacaagaaataagcttctaatttgcaactcttctttgtacaacttgtcag

SEQ ID NO: 6844102 - DNA, 66 bp, Homo sapiens
aagactgtgtccatgtgctggattgcaccacttatgagcaatcagagcaagacatggaacagactt

SEQ ID NO: 6844103 - DNA, 81 bp, Homo sapiens
cagcacaaaccaagggcgctgggtgtcgagactcagaggggtcagctgtgtccctcggcatcagcgtctaccaaggtgctg

SEQ ID NO: 6844104 - DNA, 71 bp, Homo sapiens
ccctttaggagaggggaaatgacactggtaattataaaagttttagtgcagttcccttttggcaatttggg

SEQ ID NO: 6844105 - DNA, 80 bp, Homo sapiens
ggaaactgagggacagtgtggtgatggcacttgctccaggggtggagcaaggattggaatccactgcccccttggtttcc

SEQ ID NO: 6844106 - DNA, 88 bp, Homo sapiens
gggacactccaggcagtggcttgtcccaaggtgctggaacattctgaccagccagtgggattagagcctctataacctgggtgctccc

SEQ ID NO: 6844107 - DNA, 107 bp, Homo sapiens
gagtacgagataaaatataagattaacaggaagacgtgagtacatggtgtaaagagtcaggaaaaatggctacctttccaccaactcacttccctgttttcgtgctc

SEQ ID NO: 6844108 - DNA, 66 bp, Homo sapiens
ttttgttgcaatcttagggttctcactattttaacattagcttagaacatgtggattgcaaaggaa

SEQ ID NO: 6844109 - DNA, 61 bp, Homo sapiens
tggaagcaacaactatggaccagaatgtaaatcccatggatggttttacttgatgctttta

SEQ ID NO: 6844110 - DNA, 68 bp, Homo sapiens
ctgcctgcccctgccaggcagctgtctccaaatccagcggattccttcctccaggggcaaaatggtag

SEQ ID NO: 6844111 - DNA, 61 bp, Homo sapiens
agaaagccttatgtacagaggcctgatgtttatttgttgctgccttttccaaaggctttct

SEQ ID NO: 6844112 - DNA, 84 bp, Homo sapiens
cgctggagagagcgcggctctggaagcgcaagaaaccgaatagtccagccggtaactttcccccaagccgcggctcctcctgcg

SEQ ID NO: 6844113 - DNA, 56 bp, Homo sapiens
agtgacattattttgtgtactaggatgtcctcttgtttagacagatttgtgttact

SEQ ID NO: 6844114 - DNA, 57 bp, Homo sapiens
gggagagatgggagttcaaaccctaagtaccagggttctagggttacagtttcttcc

SEQ ID NO: 6844115 - DNA, 57 bp, Homo sapiens
aggacttccctggctcccagctgactctagtggtccccggagaagcccaggaatcct

SEQ ID NO: 6844116 - DNA, 64 bp, Homo sapiens
gttcctgaggttcaaatgcaagagatgctgcccctacaccggtctcaggcatttggaccggaat

SEQ ID NO: 6844117 - DNA, 57 bp, Homo sapiens
aggatgttgctattggcagtctagcgagtagaggccggggatgccactgaacatcct

SEQ ID NO: 6844118 - DNA, 56 bp, Homo sapiens
tctgcgtggcgtggttctgtgccttgggaagagatgaatgggaagcggccagcgga

SEQ ID NO: 6844119 - DNA, 61 bp, Homo sapiens
ggctttcagaagccggaagggcaggcaggtgttccaactccccactggctctctggttacc

SEQ ID NO: 6844120 - DNA, 63 bp, Homo sapiens
agcacagtgctgtctatctcactaagccacatgttccaggaggggtaggcagtatgttatgct

SEQ ID NO: 6844121 - DNA, 58 bp, Homo sapiens
gagctctttcggttgttttcgaaataagggaacttagtgttgaaaaaccagagaactt

SEQ ID NO: 6844122 - DNA, 100 bp, Homo sapiens
tattatgttgcattggttgattgtcactccctatatggtaacttcccccaaaaaaatgaagatgcaggtgtggttggtgtcaggacagcctgttatgatg

SEQ ID NO: 6844123 - DNA, 55 bp, Homo sapiens
tgtgttccagagcatccaggtcttcttcggaaccttcccgggctttggtgacaca

SEQ ID NO: 6844124 - DNA, 76 bp, Homo sapiens
tgcatgctctctgtcctgctcagagccagtacctggatggaggctgtgtgttctgggtggactgggggagaatgca

SEQ ID NO: 6844125 - DNA, 63 bp, Homo sapiens
tccttgctgttatccatattatctttagccaggcatggtattaggcacatggtaatataagga

SEQ ID NO: 6844126 - DNA, 59 bp, Homo sapiens
cctgtgctggctttattctcaggaagagtattcctgagtggtgaaaaagcagcttcagg

SEQ ID NO: 6844127 - DNA, 59 bp, Homo sapiens
tggtttgtcggtctgcagtgttgtaccaccctggtgctcattaggactgcaaattccca

SEQ ID NO: 6844128 - DNA, 68 bp, Homo sapiens
aaccttgtttgtcattgttagaggctctgggaagggtctcaaggaatataatgagtcgagtcaaggtt

SEQ ID NO: 6844129 - DNA, 99 bp, Homo sapiens
gaagttatgggaggaaggatgacccgagtctggggaacaagtgccgttcactaggttcccattggggatcttgggctgtttctcctccaatctgccttc

SEQ ID NO: 6844130 - DNA, 106 bp, Homo sapiens
tcaagtctctgaatctgtgtctccatgactgaaagctttgtaaataaacaggtgtccacttatcccaatgtgaattaaagtttcatggagccagagggagagttga

SEQ ID NO: 6844131 - DNA, 66 bp, Homo sapiens
agtggtgtggggataagcactctgcctctggtttgcatagatttaggttctaatcccagcactgct

SEQ ID NO: 6844132 - DNA, 55 bp, Homo sapiens
tgggcagacattgagtttgttctgctaagacaactttactacagaatgtctccca

SEQ ID NO: 6844133 - DNA, 74 bp, Homo sapiens
aatgcaggtattcctggcctcaccccaactattttaatttcaggtaatttgggtggggttcaggaatcttcatt

SEQ ID NO: 6844134 - DNA, 65 bp, Homo sapiens
ggtgaggaaggaaggaggaatgagtgactataaggatggttaccatagaaacttccttttttacc

SEQ ID NO: 6844135 - DNA, 75 bp, Homo sapiens
atttgcagtctacttaagaatctcaggaatgcatcgatcagccttacatccttgaggtctgtgtaggcagcaagt

SEQ ID NO: 6844136 - DNA, 85 bp, Homo sapiens
tcatgattccgtttatgtgtttactattgcataaatacctccaagggctttggctctagtaaatataacctgactattgatctga

SEQ ID NO: 6844137 - DNA, 77 bp, Homo sapiens
gacactgtttagacagcggctctgaaccatgctatttgcaggctgatggttagctgtttgtttctttgtttagtgtc

SEQ ID NO: 6844138 - DNA, 64 bp, Homo sapiens
cacaggagccctgaggcctccctctgtctggggcctccctctctggggggcttcagggcctgtg

SEQ ID NO: 6844139 - DNA, 61 bp, Homo sapiens
ttcactcaggttcatgtctttgttcctcttgcacatatctgaacacacacaacctggtgga

SEQ ID NO: 6844140 - DNA, 59 bp, Homo sapiens
cttggacaacttttctctggtttcactcttttcaacaccagtggagagtgaagtgcagg

SEQ ID NO: 6844141 - DNA, 98 bp, Homo sapiens
tttcctcttgtttctctttctgctccctcattaaatgtcacaattccttggacaatgatgcagatgagtaagatttctggggtagacagtgggggaaa

SEQ ID NO: 6844142 - DNA, 64 bp, Homo sapiens
tgctcttcagttcacccctaagcagccaggctcagtactaggtgctcagacaagctgaacagta

SEQ ID NO: 6844143 - DNA, 61 bp, Homo sapiens
aggcagcaaagtatgagagccactgacctaatccaaatgtactctcagtatattcctgcct

SEQ ID NO: 6844144 - DNA, 78 bp, Homo sapiens
agatagccatatgtctactgctttctgtaaggacagtcacgtttgcacagagacaggcagacagtcttgatggcatct

SEQ ID NO: 6844145 - DNA, 106 bp, Homo sapiens
tacatgatcatttgtaactcaattaggtataaagctaagacttacatgaaacttatacaagttcatgaagtttggtttatagtttatacaaacagaagtcagagta

SEQ ID NO: 6844146 - DNA, 56 bp, Homo sapiens
ggtcgtgaattgaatcagtggccaaccaaagctgctgactcccaaaatacatgact

SEQ ID NO: 6844147 - DNA, 96 bp, Homo sapiens
gtcacttttaccaggtaacacttgtttggtctcatgtttaagccaagtcttgctccttaaaagagcagcccagcatatgataagtggtagaagggc

SEQ ID NO: 6844148 - DNA, 73 bp, Homo sapiens
atgcccatcaatgcctgtggaaaggctggtgctttctggactgagagctggccttggacatgaggaagggtat

SEQ ID NO: 6844149 - DNA, 115 bp, Homo sapiens
ccctgtttcctgtccttgttcattgggcagtttccatggatctctaaatagcttgaggaccaaaggtcctaagaagcatgggtcccaagaattcgctgcaggatggggcacgggg

SEQ ID NO: 6844150 - DNA, 112 bp, Homo sapiens
gcggagcgatggacgcccgcagggccgcgcgaacccggggccttagacgcgggtgccgccagtcccagggatcctccgggtcgcgcctccctgcaggcgctcctcgcggcgc

SEQ ID NO: 6844151 - DNA, 57 bp, Homo sapiens
ccaaattcacatatacattattccttccttggggaggagtagtgaggtggaatgagg

SEQ ID NO: 6844152 - DNA, 70 bp, Homo sapiens
ggaggtatcagcatctcctcaaagatatggtgcctgtaagaccccacctgtctgcagtgtttatacttcc

SEQ ID NO: 6844153 - DNA, 71 bp, Homo sapiens
tgtggtgtattttacattgggaaatgcctctataattattttccaatagatgtgtttaatgtgacattgca

SEQ ID NO: 6844154 - DNA, 59 bp, Homo sapiens
tgaggacattaggaagtgaagggcaggaagaagcaaatcttagactgttggtgtcttca

SEQ ID NO: 6844155 - DNA, 62 bp, Homo sapiens
tgcccttgggtaacttgctgatatgtgaagcatgcttcagttcacacacgtttccaagggca

SEQ ID NO: 6844156 - DNA, 104 bp, Homo sapiens
tggatgatgaggaaagcctcttaagctttcattcagggagaatttggaccctagaaatcacagaatttcctatgagagattcctctagagattcttttaatccg

SEQ ID NO: 6844157 - DNA, 56 bp, Homo sapiens
caggtccaaatgttgagactgatgtctttgtcacagttgaagtctatttggacctg

SEQ ID NO: 6844158 - DNA, 68 bp, Homo sapiens
ccttccatttcagatgtcttattttatatgtgtcagagtcacaggtgtgaaattagtcactgggaagg

SEQ ID NO: 6844159 - DNA, 66 bp, Homo sapiens
ttccttgggaggaaatgagatgctatataagaagctgtggtatattaactagtttcttcctcggaa

SEQ ID NO: 6844160 - DNA, 69 bp, Homo sapiens
gagatgggcagatcacttgaagccaggagttcaagaccagcctggccaacatggtgaaacccccatctc

SEQ ID NO: 6844161 - DNA, 56 bp, Homo sapiens
tggcatgcatgggacagaaacatcaggcagacgtcagactgactcctttgctgcca

SEQ ID NO: 6844162 - DNA, 113 bp, Homo sapiens
aggttatagaaactcccaaatttgtagctggctgatcagaagcgtggctggcctgggggtccctcttgaagctggcatctgaagtcagggcagtcttgaggaggactgagcct

SEQ ID NO: 6844163 - DNA, 88 bp, Homo sapiens
ctgatctggcatggaactttgggtaatgcttcaatttgttaaaaataaatttaagttttgcattaaggttttcctcagtgcttttcag

SEQ ID NO: 6844164 - DNA, 55 bp, Homo sapiens
aataacttcagttcttacattagggagtaatcgtgatgttaagcatgaggttgtt

SEQ ID NO: 6844165 - DNA, 58 bp, Homo sapiens
ggagctgaggctgaggcctcactgtcaccttctgtgaggtccatgacatcctcactcc

SEQ ID NO: 6844166 - DNA, 67 bp, Homo sapiens
ctggtttaagcttatatagttgtgatttagctatcatatgcctcataacaaatacaagctttactag

SEQ ID NO: 6844167 - DNA, 96 bp, Homo sapiens
ccgcgagtccgccaatcccgcccttcggaaagcgtcgcctggtatccagctgccggagcgggtcgcgccggaggggggcggaggcggaagtggcgg

SEQ ID NO: 6844168 - DNA, 130 bp, Homo sapiens
catgtggtccacatggtttgttgcctttttcttagtatttatagtaattacagatattatacactggtacctgcttatgttgtttgtggttataataagtattattagtaacaaaaaattcgattacgtg

SEQ ID NO: 6844169 - DNA, 91 bp, Homo sapiens
gtcattttccaccaccccgtttcccactgtggcagagcctcgcatagaagattcgagggcctgggtgggagaagaggcactggggaaaggc

SEQ ID NO: 6844170 - DNA, 99 bp, Homo sapiens
catgggtacacttgttgtcagaaaacatcttgctctgattggtatttctcatggcttgaactgccgtctaggtctcaggatgtatcaataagcttcatg

SEQ ID NO: 6844171 - DNA, 129 bp, Homo sapiens
caacactcagagttatgtacaataacacatatattggtgtcagaaagagttcaccatactcgtacgtggttaatgcagattttctgggccagataaaattgtgggttttgtaaagcatctgtaatgttg

SEQ ID NO: 6844172 - DNA, 71 bp, Homo sapiens
ttccttccttgagaagcaattcctcacaccacggagaatgctcagaggaatttgctctttcacttcaggaa

SEQ ID NO: 6844173 - DNA, 62 bp, Homo sapiens
cccctgaccatcccgcactgactggatttatagctcctctagtcccggatcatgggcagggg

SEQ ID NO: 6844174 - DNA, 84 bp, Homo sapiens
gggtggcctggaccacagtctggacctgctacagagctcttacttgctctgggcctgtctcagagctggaagcctatgtcaccc

SEQ ID NO: 6844175 - DNA, 103 bp, Homo sapiens
gaggcaggagaatcacttgagccttgtgggacggaggttgcggtggtgagccgagagcgcaccactgcactccagtctgggccacagagtgagaccctgtctc

SEQ ID NO: 6844176 - DNA, 57 bp, Homo sapiens
ggccaggtgctctaattcatctgggtattccacaggatttctaggagagtacctacc

SEQ ID NO: 6844177 - DNA, 87 bp, Homo sapiens
tcagataaaccacatggttttaagcaaaagtatctctcatgcaatatatgggaaagctttgtacttgaaaacttgtggtttatctga

SEQ ID NO: 6844178 - DNA, 82 bp, Homo sapiens
tgatactggaaaagaggttaaccaggtgtgtttcgtcctcaataaagaaacagaaacccagaaaacctctcttcaggtacca

SEQ ID NO: 6844179 - DNA, 80 bp, Homo sapiens
cagtggactctgggttgagatgtaatgaccagagccagtgttcaacgtgggaaagtacctctctaaacccagggacattg

SEQ ID NO: 6844180 - DNA, 56 bp, Homo sapiens
ggtcacagggaagggctctcaactgtgacccgccgagggcgcttcgattcgtgacc

SEQ ID NO: 6844181 - DNA, 58 bp, Homo sapiens
acagatgttagcaatgatgatgatgtttaaaaacacacaggtcattgcaacatactgt

SEQ ID NO: 6844182 - DNA, 57 bp, Homo sapiens
gaggggttctgggctaggaacccggacacgtaggtccaacccagcttagcgcccctc

SEQ ID NO: 6844183 - DNA, 57 bp, Homo sapiens
gggggtggttctaagtcctatatggtcactgcatgaggctaagatgactccaccccc

SEQ ID NO: 6844184 - DNA, 60 bp, Homo sapiens
ccttccagatgtaagagctgatagtaagggattgcacatcattctccaatctggagcagg

SEQ ID NO: 6844185 - DNA, 55 bp, Homo sapiens
agagtggggaaggtgttgagaagatgtaaatattcttagataattgccttactct

SEQ ID NO: 6844186 - DNA, 63 bp, Homo sapiens
gtatgtcaggctggagacaattatcaataaaatgtacagaattattatttagcactggcatac

SEQ ID NO: 6844187 - DNA, 71 bp, Homo sapiens
acaggcaaagggtcagtagcagggcaggagtaagataagtctcaggccgggtgtggtggctcaaagcctgt

SEQ ID NO: 6844188 - DNA, 80 bp, Homo sapiens
tgagtttaacctgccagtgaatactatcttgaatgtaacacaaacacagaagagtacactgatcgtaagtatataactca

SEQ ID NO: 6844189 - DNA, 89 bp, Homo sapiens
gaaagtgccatgcagaaatatcctggcgggggaactgcccacacagctgtgccagttattcaccctcgccagattcttcatgctctttc

SEQ ID NO: 6844190 - DNA, 77 bp, Homo sapiens
gggacagtatggatctaaatcatttccatcaccatcaaaaattccactggacagtgctgatctagactgaccatccc

SEQ ID NO: 6844191 - DNA, 71 bp, Homo sapiens
acatagagatgtgtttctatacggattctaaactaatatcttccttttgggaaaaaaagcatctcctatgt

SEQ ID NO: 6844192 - DNA, 129 bp, Homo sapiens
gttttaagttgaagcactccatttcttttctgggagcagatgatggtatagctggcgaaggacctgacagtttccttccaaactcatgttcgttcccaaggaactttggagattctcagcctaaaccac

SEQ ID NO: 6844193 - DNA, 87 bp, Homo sapiens
agattgatttcaggagctgtcgctgtgtttatgacaagaagcatatagagtcatttatagaagtgggcagtaattctcctgttaact

SEQ ID NO: 6844194 - DNA, 66 bp, Homo sapiens
aaagttcatctgtgagtaaaggcacattattgtgaggtggctttcttaacagattcaggaatcttt

SEQ ID NO: 6844195 - DNA, 74 bp, Homo sapiens
gtagagatggggtcttgctatgttgcccagctttgtctcaaacttctggctacaagcaatactcccatcttggc

SEQ ID NO: 6844196 - DNA, 57 bp, Homo sapiens
agaagatataaaaatacgcagcttaactatatcttcctgcgtgtgtatttattttct

SEQ ID NO: 6844197 - DNA, 65 bp, Homo sapiens
acctctcagagattgtcactgttagcatttggtgtttccctttcagatgtgcatttgtgtgaggt

SEQ ID NO: 6844198 - DNA, 63 bp, Homo sapiens
gggccttggcgaagtgtggtggaaagaattatgaacgggccaagacctgctttgaaaaggctc

SEQ ID NO: 6844199 - DNA, 95 bp, Homo sapiens
ttctgtgttgccagcctggctttcagactgtgctctggtgatgtcgtttcgctggagagggcagagatctgagtgggcagagtgggcagatggga

SEQ ID NO: 6844200 - DNA, 59 bp, Homo sapiens
gaagtggtgctatgccagttctaggcatagcccttaactgagctggcagcttccacttc

SEQ ID NO: 6844201 - DNA, 69 bp, Homo sapiens
ggttgggagtcactgttgttgagggtggtcaaagaatttgtttccccacaaggcatgtggctttgggcc

SEQ ID NO: 6844202 - DNA, 61 bp, Homo sapiens
cccactaagtataataaatcatacatttcactgcagaaatgttaatgtgtttgcttatggg

SEQ ID NO: 6844203 - DNA, 69 bp, Homo sapiens
ggagctgggccagaccttgtggtcttgcggaatgaactgcaagggaggagttgtgagctggcctgctcc

SEQ ID NO: 6844204 - DNA, 58 bp, Homo sapiens
gtggcctttcctgaagaaatgagggatgcttttctctcacaacttcatggcaggccac

SEQ ID NO: 6844205 - DNA, 67 bp, Homo sapiens
tggaataaagagtgacttttcagctgtgactatattgttaatcatagagttgatcttactcatttca

SEQ ID NO: 6844206 - DNA, 130 bp, Homo sapiens
acctgaggactccacagaggacacagtgcttggaacctgcatctcccttcctatgccctgctctgcctgcccagggccttgggattcttggatgctccaagcccacttcagatcctgtgcaagcctctgt

SEQ ID NO: 6844207 - DNA, 76 bp, Homo sapiens
ggggcagccctaccctctggaatatacaaaatgttacacagacacagtatgtacaccggggaaggtgggccacccc

SEQ ID NO: 6844208 - DNA, 56 bp, Homo sapiens
gtggcttcacatggcatttggcccttgcccttctgccttctgccatgtgagggcat

SEQ ID NO: 6844209 - DNA, 80 bp, Homo sapiens
tgatatgtaaggaagaagggaagttacttaaggaaatctcaccatgagttatttaaaacttttcattatgggatatatca

SEQ ID NO: 6844210 - DNA, 109 bp, Homo sapiens
cagctgtgcccacatatgtctgacagggtgtgttagaatgattatgtgtgggtgtggctacatgcatctctgggacacatgtttgcatatgtgtggcacacgaaggctg

SEQ ID NO: 6844211 - DNA, 82 bp, Homo sapiens
tagtgttgtatttatgcaacaggtgagcagacagcttttgccaggatgttggctgcccgtgttgcacgaatttgattagcta

SEQ ID NO: 6844212 - DNA, 111 bp, Homo sapiens
tcatctgaagattgaactgggtatctatttccaagagctttaattgttgaccgaatttggttcgtcaagggctgttggactagagaatgccctcagttccttgtcatatga

SEQ ID NO: 6844213 - DNA, 73 bp, Homo sapiens
gcgaaaggtcagtgtccttgattcctgttgttcatgagctcccagaaccacacacaaggtatacgaccaccgc

SEQ ID NO: 6844214 - DNA, 85 bp, Homo sapiens
gacccagagagcaaaaccggagcattacagcctttggagggaaaaagccttctgctgtagttgcatctgttgttttctgtctgtc

SEQ ID NO: 6844215 - DNA, 59 bp, Homo sapiens
ttcccacccccaaatgggctctactttgcagatagtaagagcccctggtggagtgagaa

SEQ ID NO: 6844216 - DNA, 70 bp, Homo sapiens
gtggattattgtactttcaataaggttagaacatctttgattgtaggtacaatgttttacccttgtccat

SEQ ID NO: 6844217 - DNA, 74 bp, Homo sapiens
tgtggtgttcaggatcccagttctaccatcacaaagccaatctagaaggccgagttgggtgctgaacgaccata

SEQ ID NO: 6844218 - DNA, 95 bp, Homo sapiens
acagcttctgtgtttttcagtatttttttctagttctaaactaagagaatgtccttaaggagcttagaagtgtgctgagaggatacttttactgt

SEQ ID NO: 6844219 - DNA, 58 bp, Homo sapiens
aaattgcataatatggatgcatttctcagtaaatagatgtgccatgtttaagcaattt

SEQ ID NO: 6844220 - DNA, 96 bp, Homo sapiens
caagcacgttacaccaatcagttgcagctgtgacattgcgccgaggctctgaagtgggtaattgcagaccacagctaggctggaatgctgtgtttg

SEQ ID NO: 6844221 - DNA, 110 bp, Homo sapiens
gggaggaggaggaggaatggatagtagaggagataggattgttaggaaaactggaggaagagaaagctaacaaccatatcattttctaggatttccctcatctacctttc

SEQ ID NO: 6844222 - DNA, 90 bp, Homo sapiens
ggggaaaggcagccagagaatggatggttcctctgagtaggttcatttattaaatctaccatgtgctgtgcattggctgggcgtttcccc

SEQ ID NO: 6844223 - DNA, 130 bp, Homo sapiens
ctaaagaaacgaaagactggtcagggggccattacaatagcccaggacaagtgtggccatggcctgtggaagagctagatggcaatacattgtctctgatgtgaaatctctggtgtcaaagccctggtgg

SEQ ID NO: 6844224 - DNA, 130 bp, Homo sapiens
tgggacacacatcacaggctgcctttgtatttcactggttctgccactttccccttgaggactgtaaactccccaagggcagaggcagggccccggggatttcacagggcagtctggctcccttctccca

SEQ ID NO: 6844225 - DNA, 58 bp, Homo sapiens
cttggagccttattctgcctttgaccttggtatggttgtgggcagaatggcatctcag

SEQ ID NO: 6844226 - DNA, 116 bp, Homo sapiens
atcacctggaattgtgttaatcatacaaattcttgggctgcatcccagtcctactgaatcagaagctctgagagtggggcccagcaatgtttgttttaacaatattcccaggagat

SEQ ID NO: 6844227 - DNA, 80 bp, Homo sapiens
agatacttacatgaattcaagagcagttattatcaacgtgtacctgaaaaaatgtgactctgccttgatgttaagtgttt

SEQ ID NO: 6844228 - DNA, 73 bp, Homo sapiens
tgtatactacaggtaaggcaattggtacctgacaaataaccattctgtaaacaatagcattgcctgatatata

SEQ ID NO: 6844229 - DNA, 77 bp, Homo sapiens
gagaaagtactttagaagggtaacggaattacaccttggtgtttgtttctctttcttttaaaaatatttttattctc

SEQ ID NO: 6844230 - DNA, 71 bp, Homo sapiens
cagctgcccctgctgactgcccttctctcctccctctcatcccagagaaacaggtcagctgggagcttctg

SEQ ID NO: 6844231 - DNA, 76 bp, Homo sapiens
actttttaactcttcctaaaaatcaaatctccccccaacaagatggagatttggtcctgctgggggatttttaagt

SEQ ID NO: 6844232 - DNA, 77 bp, Homo sapiens
tatactttttcccactgtggatcaaagacttggggcagcaaagagcctctgtcccttggctatagcaaaaatgtata

SEQ ID NO: 6844233 - DNA, 62 bp, Homo sapiens
tgaagaggctccagtctgaaccttggggcctgatagcgccctcggtgctggcagcctcgacg

SEQ ID NO: 6844234 - DNA, 80 bp, Homo sapiens
tcagtgaggttaaagtgcagttcccaaggtcacacagctggtagaagttgagatgtgatttgaactgactgcctctaggg

SEQ ID NO: 6844235 - DNA, 65 bp, Homo sapiens
gttccagcatagctcccagggctgggcctggatacttctagcttggctgtgagctttgctgtggc

SEQ ID NO: 6844236 - DNA, 66 bp, Homo sapiens
tgaatgaatgcatgcttattttgcaaggttgccaggaagatgtaaataatgcatgtaaatcattta

SEQ ID NO: 6844237 - DNA, 56 bp, Homo sapiens
tttcttagggactgtaaaatagcatcactaaaactatttgatcaagccctgagaaa

SEQ ID NO: 6844238 - DNA, 59 bp, Homo sapiens
gggcctgccaggctttcagcatttcttgtgatttgtcacaacttgagggcttggtgtcc

SEQ ID NO: 6844239 - DNA, 102 bp, Homo sapiens
agggaggaacaaaggcagtcatgtatggagctctgcctgccccaggcctggatcagggcagtagcttcgtaggcatcagttttctttccctgttcctgccct

SEQ ID NO: 6844240 - DNA, 83 bp, Homo sapiens
tttgttcatttaacaaatatttgttgagttcttatgatgtgccaaacactgttctaggagccaagaatatagaaatgaataaa

SEQ ID NO: 6844241 - DNA, 61 bp, Homo sapiens
atcttcatcaagttcacagtgggcttgctttgtttgctttctcttgaatgcttgataagat

SEQ ID NO: 6844242 - DNA, 78 bp, Homo sapiens
attcccactatattgccagagggccagaaattcacttcgtgcactggcatatttatctttggtaaataaagtggggat

SEQ ID NO: 6844243 - DNA, 125 bp, Homo sapiens
ggccacgcccctgttctgcattctattggggccctggttacacctcctctggctcagtcacacagctgcctggtaggcaagtggaggtgttcatcagtgctccctgggatttcgctcacgtggcc

SEQ ID NO: 6844244 - DNA, 90 bp, Homo sapiens
taaattaatcttatattgttgggaccaaacaatcctgtaatttttctattgtgcagcctaatcggtctcaacagctgtgtcattagttta

SEQ ID NO: 6844245 - DNA, 59 bp, Homo sapiens
ctccctgtgtcttcacttggcctgattgccaaacccagcgccttctgagatactggggg

SEQ ID NO: 6844246 - DNA, 129 bp, Homo sapiens
ggagaacaatttctttatattagttcatatggtattggaatagttaaggaagattatattaagaatctgagtttactttaatgctatttacaaattattaagtgacagactggaaaagaaaaatacttc

SEQ ID NO: 6844247 - DNA, 68 bp, Homo sapiens
gtcagtcttgctagaggtttgtcaattttattgatcttttcaaaaaatcagatctttggttaattgat

SEQ ID NO: 6844248 - DNA, 77 bp, Homo sapiens
ctgcagttcgcatggcaggcataaggagcgctaatccagtgatgacagcatctttatgcctacctgggaagatgcag

SEQ ID NO: 6844249 - DNA, 74 bp, Homo sapiens
gagccgcccgcgccagcctctccatctcgcaagttttaattaacgctgagggggaggcggctgacgggcgggtc

SEQ ID NO: 6844250 - DNA, 60 bp, Homo sapiens
caggacagttggacagacattgtgggaacccccgcactgccctggcaccacacatgcctg

SEQ ID NO: 6844251 - DNA, 69 bp, Homo sapiens
ggggcctcagggggctgttatgataagcaagagctcagtctaaagacatgctcccaagctgaaggtttc

SEQ ID NO: 6844252 - DNA, 81 bp, Homo sapiens
gtgtgtggcagtgctgatatcctttaacctggaccgggcgtgttggtgtttcagggaggatgtgaaaagctgtgcacagac

SEQ ID NO: 6844253 - DNA, 130 bp, Homo sapiens
aaggacagtgtatctttctggaattaaaaattgcattggttaagagctttggggtgcaagaaacaaaagctttccttaggtaacttaagtaatggagttttaatactccattttaaagatcaccagaatt

SEQ ID NO: 6844254 - DNA, 59 bp, Homo sapiens
ctgcaggtggcagcggggcaccaggggctcattcctggtggcctcagtggcttctgtgg

SEQ ID NO: 6844255 - DNA, 59 bp, Homo sapiens
cacccttgtgttttcaatccccatggacagctcttcagaactcatgaagacataaggtg

SEQ ID NO: 6844256 - DNA, 62 bp, Homo sapiens
ccaggtgttggaagggcagtgggtaaggttcccaagccagcccccacacccttcccacttgg

SEQ ID NO: 6844257 - DNA, 55 bp, Homo sapiens
ctgaggctgagacaggtgaaatgatgtgatccacgtcgcctgacaccagacccag

SEQ ID NO: 6844258 - DNA, 62 bp, Homo sapiens
caaaaccagcaagattttgctttgcaggaaagatctgtctttgcaggattttgtttgtactg

SEQ ID NO: 6844259 - DNA, 58 bp, Homo sapiens
ttagcatgtctactaatttgctgtttgtgtgccagacatggtaaatgatacatgctga

SEQ ID NO: 6844260 - DNA, 56 bp, Homo sapiens
gtgactgttgtttgctacgtgctagacagtatgccaagcatgacacagtggtacac

SEQ ID NO: 6844261 - DNA, 72 bp, Homo sapiens
atttgaaaaatgttgtgcatgtattttgtaagacccacatggatgcagtacagtataatcttgctttcaagt

SEQ ID NO: 6844262 - DNA, 71 bp, Homo sapiens
gggttcgaagttggcatcgctaagcaaactagtgtggctcatatcatgtcttctgtgatgtccaagaaccc

SEQ ID NO: 6844263 - DNA, 82 bp, Homo sapiens
gagtatctgcttcacgttgtgccttgttggctgacagacatatcttagcatctcacaaaacgatgaggccatcaagaaactc

SEQ ID NO: 6844264 - DNA, 125 bp, Homo sapiens
cagtttcctggccaagacattctgggatgtctcttatacccttctctggttgcagtcttcatagggcaagattgttttgggggaagtggttctgtaaggaccttccaggtcttgctaggaaattg

SEQ ID NO: 6844265 - DNA, 55 bp, Homo sapiens
acctgctgtgattctaattggctgagaggaaacaataaaccaatcacatgtaggt

SEQ ID NO: 6844266 - DNA, 56 bp, Homo sapiens
cttgaggagccagatgtagagtttagttgtagatgtatacatccgggttacttaag

SEQ ID NO: 6844267 - DNA, 59 bp, Homo sapiens
gagccgaggcgcacagctcgggccccacgatgggccgcgagcgccgccgcctcgggctc

SEQ ID NO: 6844268 - DNA, 60 bp, Homo sapiens
gggatgggtgggttctgtgagaggggctggggagctcctctggcaccccccacctgtccc

SEQ ID NO: 6844269 - DNA, 96 bp, Homo sapiens
tcgccgcgcggctgccgccgggaaacgggttgggggggttgccgcgtccggcggggcctgactctgacccgccgccccctggcggctacgcggaga

SEQ ID NO: 6844270 - DNA, 63 bp, Homo sapiens
gggctgatgtgacagaactctccccattaacatgctgttgggtagcagtccttcacttagccc

SEQ ID NO: 6844271 - DNA, 71 bp, Homo sapiens
gcttcgggatgttgaaatccacacgcaagattgtgcagttgtcagggatttccaactcccccatgtgaagc

SEQ ID NO: 6844272 - DNA, 69 bp, Homo sapiens
ttcattccaagatcaaaggaattttttacatggttaatgctatctagtaccctttggttaattgatgaa

SEQ ID NO: 6844273 - DNA, 84 bp, Homo sapiens
aggattaatgaagctcttagcagcactctttgcatggagtaatgctcagtaaatggttgctgttattttgttgttattacccct

SEQ ID NO: 6844274 - DNA, 70 bp, Homo sapiens
tgccctgcaatgcagaggctgcctgaggaacgtctgtggcctccatttggcctctgtattgtacgaggca

SEQ ID NO: 6844275 - DNA, 97 bp, Homo sapiens
ttctgtgagagagcataaagtctcataattcacttagattgatttaatatactaggttactgaattatcaggctttgaaatagtctttcctttagaa

SEQ ID NO: 6844276 - DNA, 55 bp, Homo sapiens
agactgtagggatagaggtcttaatgtgaattaggtttttctaattctaaagtct

SEQ ID NO: 6844277 - DNA, 77 bp, Homo sapiens
tgcctctatgagttttctatgccacacctggtggctgcctgcctcaccagtgggaagtggaaaatgaaatcttggca

SEQ ID NO: 6844278 - DNA, 75 bp, Homo sapiens
atcattacagagtagatttttgaatgtaagttggttatattaccaacttggttgttggcaatttgctgtactgat

SEQ ID NO: 6844279 - DNA, 67 bp, Homo sapiens
gtttgaaatgagcaaactgtcagcttgccgattaccatgcacacagtatatgctcattaaatcatgc

SEQ ID NO: 6844280 - DNA, 92 bp, Homo sapiens
ccctggacactgggcacgagggtgacagggtgggacgccaggccctggcctcccagggtgctatccgtcctccctcctgtcctcccctgggg

SEQ ID NO: 6844281 - DNA, 77 bp, Homo sapiens
cttaatgtaaaatttctatatgaggagctaaagttttctatcccaaatatttctagtccttgtgtagtcacattagg

SEQ ID NO: 6844282 - DNA, 95 bp, Homo sapiens
agttataagaagctctggctaaagagcaagaagatggatcagctgacttctcagaccactactattgttacttttctagaatatttttatttact

SEQ ID NO: 6844283 - DNA, 67 bp, Homo sapiens
tatgaaacactggaagggacatcaagtgacaatctcattgagtccctgtctccattgtgaccacata

SEQ ID NO: 6844284 - DNA, 70 bp, Homo sapiens
cggccattaggatttgaaaaggggcagaccagaggagattgaggtttgctgtcaagtccatgagttgctg

SEQ ID NO: 6844285 - DNA, 74 bp, Homo sapiens
tggaggtggtcagtcgccaggttttatttcagtgataaaagagaagtgaatctggatctatgatcaataattca

SEQ ID NO: 6844286 - DNA, 74 bp, Homo sapiens
cctaatggttcaaggtgcaggccctggagtgagcccagcctaggtttgaattcaggtagcacctccccactagg

SEQ ID NO: 6844287 - DNA, 56 bp, Homo sapiens
gcagttgttaaatacatgagccatttcctatggcatcaagtacttttgacaagtgt

SEQ ID NO: 6844288 - DNA, 85 bp, Homo sapiens
ttagagctaaagacatggatctcagtggggtgtcaaccttgcttgaagtaatcagctgttgtcacctcacatccaagtgttttga

SEQ ID NO: 6844289 - DNA, 85 bp, Homo sapiens
tggagttgagagtcatgtaagggagggaggtgatgcttggctgtggtaccccagcaagtctcttaccctctctggctctacttta

SEQ ID NO: 6844290 - DNA, 86 bp, Homo sapiens
gaaatggtgggttggctcttaaggtccctgtgctattttgataagactctagtatctccagaccttggtagttctaccaccatttt

SEQ ID NO: 6844291 - DNA, 71 bp, Homo sapiens
taaaataagaatattagtaatacctgtctcataatgttgttgtgaggattaaatgcatagtgcttatttta

SEQ ID NO: 6844292 - DNA, 80 bp, Homo sapiens
taaggtcctcattgtgtacatgtatcaactatcgttttcaaatgaaatagacacagtgctatacagtgctttaaaccttg

SEQ ID NO: 6844293 - DNA, 64 bp, Homo sapiens
tgacactgacctaaagacctggaactaaaaataatacccacggtaatcttaaggtgagtgccca

SEQ ID NO: 6844294 - DNA, 62 bp, Homo sapiens
ggtagcacagggcactgatctctgaaagaagggaagcagatgaggttagccctgtaattgcc

SEQ ID NO: 6844295 - DNA, 61 bp, Homo sapiens
tgcagccttggccgtgactcctctctgcgttttccctgcagtagtgcatgggcgaggtgca

SEQ ID NO: 6844296 - DNA, 67 bp, Homo sapiens
cttgtattcaatattattgttgctgctcattcaaatgtgatgctgttccagttatattgtttaaaag

SEQ ID NO: 6844297 - DNA, 71 bp, Homo sapiens
ccctttcccaatctcagccttgagcctggtgtggggtggaagccccagactcctctggctggtgggcaggg

SEQ ID NO: 6844298 - DNA, 66 bp, Homo sapiens
gctatgagatttttatgttttactctgggtttgtaaatccgtttcataactgtaaagatctgtagc

SEQ ID NO: 6844299 - DNA, 78 bp, Homo sapiens
ggcatgttgtgatgaggtagataacaacagcaacaataataataatagctaccatttactaatgtcatatcgcgtgcc

SEQ ID NO: 6844300 - DNA, 64 bp, Homo sapiens
cgccccgggctgctctggaccgacagctgctccccgggctgctctggaccggcagctcgaggtg

SEQ ID NO: 6844301 - DNA, 89 bp, Homo sapiens
ggaggtggagaataaactcctcagcttccttgccctttgagagtagggtaaggagtagacagcttggaagattgttctacattgtctcc

SEQ ID NO: 6844302 - DNA, 68 bp, Homo sapiens
atgagtcatttgattttgcatatatgagccctgcttggagctaagtaactgcataattaaattttcat

SEQ ID NO: 6844303 - DNA, 72 bp, Homo sapiens
cagttcattagaaggttttaaaggaatacaatttttaccaccattgtattatttttgcttctcatgagtctg

SEQ ID NO: 6844304 - DNA, 62 bp, Homo sapiens
tggaggagtgtgagttcatccagcaggcttgaagccaggcctctgggggctcagacctgtca

SEQ ID NO: 6844305 - DNA, 81 bp, Homo sapiens
agcccagcggttagatgtgcagactccaacgcctgactgcctgggtctgtcacttactagctgtatgaccttggatgggtt

SEQ ID NO: 6844306 - DNA, 65 bp, Homo sapiens
gtcgacatggtgacgaatccatagcatcgagcccccgggctgcgggcgttcgttaccactttggc

SEQ ID NO: 6844307 - DNA, 91 bp, Homo sapiens
tgtcagtgctctccagtcaaagacctagtttgttcaattaggaacatatctgtggttgaacaagttgggtatattgctgcttgtagtgagg

SEQ ID NO: 6844308 - DNA, 74 bp, Homo sapiens
agtctctccacggggcactttgaattctgccaggcacagcctcccaagttcacgttgctttttgaggaatgact

SEQ ID NO: 6844309 - DNA, 77 bp, Homo sapiens
aggctgacctcaagtgatccacccgcctcaacctcccaaagtgctgggattacaggcatgagtcactgcaccggtct

SEQ ID NO: 6844310 - DNA, 77 bp, Homo sapiens
gggatgttttatgtgctggactggcagtgccctgcttggagactttggggaacaagtgggtcctacataaagctacc

SEQ ID NO: 6844311 - DNA, 100 bp, Homo sapiens
tcagtttcatatctatccctgatagttacaatggcggaggtctgcgttataagcccatccctgacccaaaactgtcagaaatagattgtgaatatattga

SEQ ID NO: 6844312 - DNA, 111 bp, Homo sapiens
atggttcaattcatagttaatattttgaaacagctaagtacattcaagggcttattccagttttagattcgagatttggttgtaagcaagttgttaatgaaattggagcat

SEQ ID NO: 6844313 - DNA, 65 bp, Homo sapiens
gcataaggttggtcttaactacctgttgtttattaacttcaggaagctttatgaccagctaatgt

SEQ ID NO: 6844314 - DNA, 71 bp, Homo sapiens
tgtgtgggacacatatactgtaaaggaaaaatagttcttgaccatgtatgtggtccttcaactaacataca

SEQ ID NO: 6844315 - DNA, 87 bp, Homo sapiens
cctttagcttaatgacccagcttcttgtgcctaagttacagtctgggactgctgcaggaacttaagaagcttcattagtcttttagg

SEQ ID NO: 6844316 - DNA, 75 bp, Homo sapiens
cttctctcaccctgctaggccatggagatgcaaagataatgaggtgcctccaggacctcccaggctagagagagg

SEQ ID NO: 6844317 - DNA, 91 bp, Homo sapiens
tctgccaacagattgtccgtgatgtcccctcaccaggactgcagacctgactcagctcctcatgcaggggatacatgggacaccaggcaga

SEQ ID NO: 6844318 - DNA, 77 bp, Homo sapiens
gtgtctccgcctgctcatgttggctgctatagaccccctcccagatttttcttcacagccaacatgggcacacacac

SEQ ID NO: 6844319 - DNA, 70 bp, Homo sapiens
ccccacaattctccctcatcgcctctttcattgccactctttgaagcgtaaataaatgaggcatttgggg

SEQ ID NO: 6844320 - DNA, 81 bp, Homo sapiens
tttgaattctccaggtagttatttcaagaacatccttttgcatgtttcttggaaactgattccttgttgtgtgaattcaaa

SEQ ID NO: 6844321 - DNA, 107 bp, Homo sapiens
gcacccaggcctctggctgagcttgtccagagccaggctgtcggccttacgctggggagagccacggccacccgctcatgggcactcactcagggttccctggttgc

SEQ ID NO: 6844322 - DNA, 66 bp, Homo sapiens
ggatgccagggtgctctggaaaatgtagtgttgtgcaaacacttgggtttctatgaccactgctcc

SEQ ID NO: 6844323 - DNA, 106 bp, Homo sapiens
gggttttgagggagttggggtagaaaactgtatcttcttgggacttgaatcaaatgttttaagtctgccaagccagatcatgttagaccttcacctcttagatcct

SEQ ID NO: 6844324 - DNA, 80 bp, Homo sapiens
cttttgagtggggctactgcaaagtttggtcctggtggaaacatagcaggtccctagggtttggccagagcccccaaaag

SEQ ID NO: 6844325 - DNA, 76 bp, Homo sapiens
agtaatttctcattccgctaatcatttgtgaactattatttaactgtcagagtcccatagtggagtgacaagttct

SEQ ID NO: 6844326 - DNA, 79 bp, Homo sapiens
cttggttagatgctgtgcaaaaccatcgctgctgatatgcatgttatgtaacacttgtttctatagtatgagaaccgag

SEQ ID NO: 6844327 - DNA, 83 bp, Homo sapiens
tctgtagctgtatttctgaatgttcatgtcatatgttaccagctttgatacagttcatgaaatttgaagtacagcaatacaga

SEQ ID NO: 6844328 - DNA, 63 bp, Homo sapiens
gttttattggaacacagccatgaccacttgtttacatattgtctatggctggtttcattcaac

SEQ ID NO: 6844329 - DNA, 108 bp, Homo sapiens
agaggagggagctggagtgagggagcacacttgttttcagccttcagcctggcttccaccttcctggctggctagcagagtgcatccttctatatcagctcagcctct

SEQ ID NO: 6844330 - DNA, 124 bp, Homo sapiens
gtggggattaggtgaataatagatgggaaactctgcatccagggttgagcacgggagccagaagagggctcctcctgtttctcaggcctgggtgtcagggtgcccagcagaagcgagtccttgc

SEQ ID NO: 6844331 - DNA, 66 bp, Homo sapiens
gtttctttcctgtgggttttgctcatttcacccatcttatctgtaaacttcccaggaacagggaat

SEQ ID NO: 6844332 - DNA, 66 bp, Homo sapiens
tgagatgaacagtcagcttctcgggacatttgcattagcagaggtctttgccagcgaccactctca

SEQ ID NO: 6844333 - DNA, 64 bp, Homo sapiens
gcttgcaggaggttgagccaggactgacgctccaagtctgtctgaatcctaagcttcctcaagc

SEQ ID NO: 6844334 - DNA, 56 bp, Homo sapiens
ctgaccccaaggcagtgctttcctccacagggcaaaggcactcagccttgggacag

SEQ ID NO: 6844335 - DNA, 59 bp, Homo sapiens
gcgggaggcacgaggcgcgcagtgcgtgtgtgcgcgtgtgcgcggcgcgcgtgccccgc

SEQ ID NO: 6844336 - DNA, 68 bp, Homo sapiens
ctgcagctttttgtgcttgtaaagaagtcctagtgaactaatctgccaagcatggcataaaaaggcag

SEQ ID NO: 6844337 - DNA, 64 bp, Homo sapiens
tgtcgtcagctttgtgctgcttcttgtcactttaatgcaaagagacagcatggagctgataaca

SEQ ID NO: 6844338 - DNA, 86 bp, Homo sapiens
gatactataaatgactggcatctcaaacaggcagatttaaaagcaggggagtctggctttttgatgagctttattttatcagtatt

SEQ ID NO: 6844339 - DNA, 78 bp, Homo sapiens
gttgtgtgcatatttattcatatttttgttaaatgttaaatcatttatcacagtaaatctgggtgcatagtacataat

SEQ ID NO: 6844340 - DNA, 113 bp, Homo sapiens
gaggtattgggaaacttatgtagatgacatctgctatttgtgcctgactagagcaccttctaacatcttgcagtagcagaacttaggtttttcttgtaagccccctcttcctc

SEQ ID NO: 6844341 - DNA, 80 bp, Homo sapiens
gttggttatcgtttctgtattctggttccctggtacaatatctgagccataagagtacaggagatatttcttaaattaac

SEQ ID NO: 6844342 - DNA, 67 bp, Homo sapiens
gtgaagtgatttgtacaaaatgtcgtagtgtaatttattgagtgtcatgtggtattaatcgcaacat

SEQ ID NO: 6844343 - DNA, 68 bp, Homo sapiens
ttctaatctccgtccagagaaagatgactgggcttaccacaagtcaatacctgtggacaaagatagaa

SEQ ID NO: 6844344 - DNA, 63 bp, Homo sapiens
ttaggctctccctggatttccaagtgttgctaaatttagttcattctaaccaggagaggctga

SEQ ID NO: 6844345 - DNA, 100 bp, Homo sapiens
tcgatgtgaatgactcttcaaagatattcaaagatttattagaacctaacatggtagttaataaagtatgaattggaaaaaaagtcactttttacattgg

SEQ ID NO: 6844346 - DNA, 57 bp, Homo sapiens
agtccggtcagggggctgctgtgatgatctaggtgggagctgatgctggcttggact

SEQ ID NO: 6844347 - DNA, 62 bp, Homo sapiens
tgtctctcttggagagtccatcatcactgtcccagttgagccatgggactccaagggagcca

SEQ ID NO: 6844348 - DNA, 71 bp, Homo sapiens
ccaccctcccaccacagctctgcccctcagcttcctgcctgcgagaggccatggggtgggatgcagggtgg

SEQ ID NO: 6844349 - DNA, 59 bp, Homo sapiens
gtctcagttttccaaactgtcaaactcttttttatgactgttgggaagataactgagac

SEQ ID NO: 6844350 - DNA, 83 bp, Homo sapiens
agtcaacagaatggggaaattgtgtacaggctcctaaatatttcaccaaaagagactcatgacacttcctatgatgattgact

SEQ ID NO: 6844351 - DNA, 56 bp, Homo sapiens
tcagttcttattttcatgaatagtgactgtccaccagcagcgagtttaagggctga

SEQ ID NO: 6844352 - DNA, 72 bp, Homo sapiens
tgggggcttcaccctcccctacaagcagcccttaaccaatgagtgacaggggctggtggataaatgtcccca

SEQ ID NO: 6844353 - DNA, 70 bp, Homo sapiens
ggccaaaaagatgtcctgaagtttagtgcattaatgaatgacttaagcatcagcacatctaagagaggcc

SEQ ID NO: 6844354 - DNA, 81 bp, Homo sapiens
tcccctgtctgcctcggtgtcccctgctcagggctcttgatggggcctgggagcacatcggggtccttgcaagacccggga

SEQ ID NO: 6844355 - DNA, 67 bp, Homo sapiens
ccccatggtcttgataggtagaatggctgaggtgttaggcatggtctttgcttgcaggatacagggg

SEQ ID NO: 6844356 - DNA, 104 bp, Homo sapiens
gagacacctgataatatgttaaccttttgtcattggggttatttgttaaaatctaaagagctaagaaacatgattaatggcagagggtttgcattccttgtctc

SEQ ID NO: 6844357 - DNA, 65 bp, Homo sapiens
cttgtactcaggaggccaccaggacctgtcacgcagagggcctgtcagcggtgtcctgttgcaag

SEQ ID NO: 6844358 - DNA, 56 bp, Homo sapiens
ggagctcaagatgtggcctctgaagcagagctctgccagctgctccttgaggttcc

SEQ ID NO: 6844359 - DNA, 55 bp, Homo sapiens
tgctgttggtcctctttggacctggtgaggccaccaggagccattgactgcagca

SEQ ID NO: 6844360 - DNA, 81 bp, Homo sapiens
ctgggaaagtaaacaggcttgcatttggaatagattaataaactataagtcccttctatgtcaattctgattgtttcttgg

SEQ ID NO: 6844361 - DNA, 89 bp, Homo sapiens
ctcagttaattgtgaattgcttatgccaggtgagagagaattggtgtctacccctctcacctgacataagcaactctgaattaactggg

SEQ ID NO: 6844362 - DNA, 68 bp, Homo sapiens
ggctccttctgaggctctgggttcctggacacaatcttgaatcctaattaagccgttagagaaaagct

SEQ ID NO: 6844363 - DNA, 65 bp, Homo sapiens
atggaaactgaccctttcatggttctggaggacggagtctgaagcccaggtgttagtggggtcat

SEQ ID NO: 6844364 - DNA, 70 bp, Homo sapiens
gagagacagctggggagagacatggcagggtcggagcgcggcctgcgcctctgtcactcagcatcctctt

SEQ ID NO: 6844365 - DNA, 80 bp, Homo sapiens
aggatccagtggagtttttatacccagtatgtctaagaatcatgtgggcttgggtactggactccactccagggggttct

SEQ ID NO: 6844366 - DNA, 75 bp, Homo sapiens
gggggaaaatcatcttttatcactattgtgtaccgtgccggtccagatggaggataaaacatgcatgagttgccc

SEQ ID NO: 6844367 - DNA, 60 bp, Homo sapiens
gtatgtcatgagccttgtgcgtcacctcactgtggtgcatgtgcaagggcgtgtgcacgc

SEQ ID NO: 6844368 - DNA, 56 bp, Homo sapiens
aatattggagaaaagttagtggcattgcattttatgtcaagctagtttccaaagtt

SEQ ID NO: 6844369 - DNA, 64 bp, Homo sapiens
gtggggataataattttcatttcacagggtcattgtgagaattaattgagaatatttatcccac

SEQ ID NO: 6844370 - DNA, 66 bp, Homo sapiens
taagagtatctattaagtactttgcacaatatctgatgcatattgagtacttaaaagctattgtta

SEQ ID NO: 6844371 - DNA, 58 bp, Homo sapiens
gtcttcagactccaaatgttttatgttccctgtcatgagatgggatgtctgtgagtgc

SEQ ID NO: 6844372 - DNA, 94 bp, Homo sapiens
ggtggaagcaccattctccatttccaaaactatcgggtactttgctaaacaatggaaaatgtaccttgatagtttggtctctgaagctcccact

SEQ ID NO: 6844373 - DNA, 58 bp, Homo sapiens
ccacacttcttccctggcatcgctgactgaaaggcagaatgtgaggggttgaagtggg

SEQ ID NO: 6844374 - DNA, 64 bp, Homo sapiens
gcataattaaattctgggcaagattttacagaaatgcagcttcttttttctaatttagttgtgt

SEQ ID NO: 6844375 - DNA, 71 bp, Homo sapiens
tgctctctctttagctggagagtttatctcaggtcttccaatgaaggcttgctctctaaaagggctgagca

SEQ ID NO: 6844376 - DNA, 66 bp, Homo sapiens
tgcaaataagtctttctgagtgaggacccatcagacacatggtcatctcacagcagggctagtgca

SEQ ID NO: 6844377 - DNA, 104 bp, Homo sapiens
ttctcttgataattttttttctctgccatcactcatctagatatttatgtgatcttaaagtggttatattagagagagaaagagagagagagagaaagagagaa

SEQ ID NO: 6844378 - DNA, 78 bp, Homo sapiens
ggggtcacggtggaaagtagttagttgatgcaccctcccgaacagggcgtggcagagactgcttctccacgtggcccc

SEQ ID NO: 6844379 - DNA, 55 bp, Homo sapiens
gctgcagtcactgaggcagagggtgcccatgtcctgtctctcagtgactgatagc

SEQ ID NO: 6844380 - DNA, 56 bp, Homo sapiens
ggccctctggggcacacagaggacactgtccaccagccaagtcttccctaagggcc

SEQ ID NO: 6844381 - DNA, 81 bp, Homo sapiens
ccaccaccagcaggtagagcaccagctgtaaccagggcacagctcctgagccagcgggctcacttttcaatctggttgtgg

SEQ ID NO: 6844382 - DNA, 92 bp, Homo sapiens
cttgctaatgtctgaagctaactgaactgggccagatcagagcaactgtagtcacacagggctctgtccccagaggccccggatatggtgag

SEQ ID NO: 6844383 - DNA, 76 bp, Homo sapiens
agtgaacatcgggtcccatgactgacacagcagggtcaccttctctcctgaggtcaccgtggggcccggctgcact

SEQ ID NO: 6844384 - DNA, 83 bp, Homo sapiens
gaaagatattaaatatccaagaaacaattaattccataaatgtattattattggaattgcaggggttttgtgatatatttttc

SEQ ID NO: 6844385 - DNA, 94 bp, Homo sapiens
gccagagttgccggagttttggcaacttgtgtcttccataatagagctggggcattgatggaaatggagggtgctagaaccttgtgactttggc

SEQ ID NO: 6844386 - DNA, 65 bp, Homo sapiens
gtagaagtttgggggcgaaggcagagagcatttccttctcggcttttggcgcctccacgctgcac

SEQ ID NO: 6844387 - DNA, 82 bp, Homo sapiens
aggaatttttatctggaagagtaatataaattagctttgactgccagtttccactgattattactttccaggcggaattcct

SEQ ID NO: 6844388 - DNA, 69 bp, Homo sapiens
tctggtcatgacagttttgaaatgtagtctatttttttaaatactttgcatggaaaatggtcatacaga

SEQ ID NO: 6844389 - DNA, 75 bp, Homo sapiens
tcgctctgccactgaggctggagtgcagcagcatgatctcggctcactgcagctccgcctcccgggtttaagcga

SEQ ID NO: 6844390 - DNA, 64 bp, Homo sapiens
cacagctcagcatttgtttattctgttatgaaatggaggtgaatatacacttgcccagcttgtg

SEQ ID NO: 6844391 - DNA, 73 bp, Homo sapiens
gccatgttttatgtgtgtgatgggcgccgccatcttcttcgccagggcaagtatggcggccccaaaagatggc

SEQ ID NO: 6844392 - DNA, 57 bp, Homo sapiens
ttgaggtcttgagtactggggaacattcatatagaggtgagcagttttaaggcccaa

SEQ ID NO: 6844393 - DNA, 55 bp, Homo sapiens
gatggtgtcttttaattccagggaggtttctgtgagctgaatcagagatattatt

SEQ ID NO: 6844394 - DNA, 72 bp, Homo sapiens
aaaggcactgatgcaaaaatcactcaggtctcctccctgtgacttggtgcacacctgggcatcactgtcttt

SEQ ID NO: 6844395 - DNA, 95 bp, Homo sapiens
tgactacttgttttttaaataatgaacacttagcctttctatgcgcataatggtgtaaaagttagatggttaggtgtttgacaaacagatggttg

SEQ ID NO: 6844396 - DNA, 82 bp, Homo sapiens
gttgagtttgagatgcctgctagatatccaggtgaagtaggaaactggatttatggatctgcaggtcaggagcaagattaat

SEQ ID NO: 6844397 - DNA, 70 bp, Homo sapiens
gagcagagcagacagcagcagaggggctccctagagcagctgggggccctgcctgtgccgtcgctctttc

SEQ ID NO: 6844398 - DNA, 110 bp, Homo sapiens
ggaaggctgaggactcaagggctcgttaggatgctggtatcatgggctgaagactcagagcagtccctccagccagtgccagtcatgcctgcagcttgtcccagcttctc

SEQ ID NO: 6844399 - DNA, 79 bp, Homo sapiens
tttttaactttctttctcagcattctctttggagttcaacctagcgcccatgagccaggctgaggaagctgagtgagaa

SEQ ID NO: 6844400 - DNA, 56 bp, Homo sapiens
tctactcagactaaaatgggaatgtatgggagccatacctccctagactgagaagg

SEQ ID NO: 6844401 - DNA, 59 bp, Homo sapiens
atcagcagaggtctagcaccaagaatctctaaaataggagacctggttcctcttttgat

SEQ ID NO: 6844402 - DNA, 82 bp, Homo sapiens
gatcaggcaaacaaaatggattctcacataaagaagcattttttctctgtggtactgagagtctattttcttctgtctcttc

SEQ ID NO: 6844403 - DNA, 79 bp, Homo sapiens
gtggatagccaagagctcaccggagagcatttgcagagctttctgtaaatcttccaattgggcctcttttactgttcat

SEQ ID NO: 6844404 - DNA, 119 bp, Homo sapiens
gcatgaaaatcttttatctacttaatgaaatcgaattctggtgcactttgttcctggttgtcagcactaacattaacaccgtgagtttggttttggtgcagttaaggattttatcatgc

SEQ ID NO: 6844405 - DNA, 68 bp, Homo sapiens
aaatcacgtggtcctggtgcaagtgcatttccagtttgaaaaacttcagcaccagacctcagtgattt

SEQ ID NO: 6844406 - DNA, 88 bp, Homo sapiens
cgagagctctttaacaagtatttactgagcagctaccatgtgccaccatcaggcatgggtgtaatagtgggtgagagcaatggtctcg

SEQ ID NO: 6844407 - DNA, 59 bp, Homo sapiens
ggtccccccatggtgagcactgtaggctctaggaggctgaagtcctggcctgggggacc

SEQ ID NO: 6844408 - DNA, 95 bp, Homo sapiens
gaagatatttccacatctcttacatttataaggcttctctgtgtatgatctcccaaatgcagagtaagggataaggtttgagaggaaatgttatc

SEQ ID NO: 6844409 - DNA, 95 bp, Homo sapiens
gcacacagggccagctgggggatggaggtaagagaaaaggagaatgaagtgggcaccctcccttgaccctaccccccagaaggcaaccctggtgc

SEQ ID NO: 6844410 - DNA, 67 bp, Homo sapiens
ccagtcagtgtcaacaggaagtagctggtaggacaaatgctattttttatgtctctttggtgactgg

SEQ ID NO: 6844411 - DNA, 61 bp, Homo sapiens
agtgctttgaacgaaaggctgagaggttaaggaaccacttactttttaatttcaaaccact

SEQ ID NO: 6844412 - DNA, 87 bp, Homo sapiens
ggagacatttctgatactgcaaaaatgtaggatgtgggctcctgtcccttccccaaaccttgctgattcttgtagtggaagagctct

SEQ ID NO: 6844413 - DNA, 69 bp, Homo sapiens
gcaggaggatatgattcctagattcctgaaggaaaactcttttgtttagaggaactggaatcagcctgc

SEQ ID NO: 6844414 - DNA, 56 bp, Homo sapiens
tattgcgtggaggttttttcctgattaatgtatcatgaaaaattttccatgtcatg

SEQ ID NO: 6844415 - DNA, 61 bp, Homo sapiens
cccggatcctcagtcgtgcgggagtctgggaggcctggcttcctcaggggtgaggtttggg

SEQ ID NO: 6844416 - DNA, 116 bp, Homo sapiens
gtgtgcatgggggagctgctgccaggctgccctccagtctgctcctgtggttactggctccacagcacctcagagagggcggccctggcttcagaaatgccagccatagtgctcac

SEQ ID NO: 6844417 - DNA, 56 bp, Homo sapiens
ggggatatttgagcagatgcagttgaatttgaaaactctgaacacaatatatcccc

SEQ ID NO: 6844418 - DNA, 75 bp, Homo sapiens
tcagaaaagctatggtttgtaggctattgggagcctctctcacaccgtccctaaaccatctctgactttctctga

SEQ ID NO: 6844419 - DNA, 56 bp, Homo sapiens
gtgccaccagtagatctgcaagttgagaaaagcagctcaggtgacacacgtggcac

SEQ ID NO: 6844420 - DNA, 79 bp, Homo sapiens
tccctttttatcccctggcttttagtttttcatcatcctttctacagatgacctgcagtcaagaggggaaagttgggga

SEQ ID NO: 6844421 - DNA, 91 bp, Homo sapiens
ggggttgggaacagtgacagcagcgcacactggtatggagatgtacaggtggcaagcctccaatcaggtgcattgtttttcattgggcccc

SEQ ID NO: 6844422 - DNA, 82 bp, Homo sapiens
cagccctccccatcctggcgccacacggctctacttccccttccagattggggctgtttcagtgccaggcttgggaacgctg

SEQ ID NO: 6844423 - DNA, 102 bp, Homo sapiens
gggacgtaagctccactgctttttcaagaacaacattcattcaggagcaactttgtgagccctgtttcttggttaagttggtcacggaaattacatagtccc

SEQ ID NO: 6844424 - DNA, 67 bp, Homo sapiens
ggagatagacttggtgagccactaaccaatcttcccagagtgagcatccatcgtatggttcttctcc

SEQ ID NO: 6844425 - DNA, 67 bp, Homo sapiens
ccagtggctactgtatttggacgacactgatataaaacagttctatcattgcagatggctctactgg

SEQ ID NO: 6844426 - DNA, 88 bp, Homo sapiens
ggagtctcgctctgtcgcccaggctggagtgcagtggtgctatcttggttcactgcaacctccgcctcccaggttcaagcgattctcc

SEQ ID NO: 6844427 - DNA, 55 bp, Homo sapiens
catcttttctgagccttcatttgtttacctgcaaactaagggagtagatgagatg

SEQ ID NO: 6844428 - DNA, 60 bp, Homo sapiens
ctttaacctgtgcattttatatgcttagggatttagcaatagaagcacataggttcaaag

SEQ ID NO: 6844429 - DNA, 83 bp, Homo sapiens
ggcacagccctccgagaagcggggtgttttgggtggcctgcccaggcaggcgcattgaggccctgttgctctgagagtttgtt

SEQ ID NO: 6844430 - DNA, 71 bp, Homo sapiens
aagatgaaagtggaatgttctccctttttactgcttgcgggtggagaaaataacatttggcattttctctt

SEQ ID NO: 6844431 - DNA, 63 bp, Homo sapiens
tagaccggatggcctggtactggtcttctctagactgaaggtcctccaccaggtctcctgctg

SEQ ID NO: 6844432 - DNA, 92 bp, Homo sapiens
cagcaagcttgaatttccaaacccagcgagctacacatgaatggtccctgcatgcgtgggctgtagcactgggttagaaatcacaattcctg

SEQ ID NO: 6844433 - DNA, 62 bp, Homo sapiens
gtctacaaagcatataaaagaggaagttgagcttattctaattttatgtatgttttgcagat

SEQ ID NO: 6844434 - DNA, 69 bp, Homo sapiens
gcagggctgctcaaaggctggtaaaaagccttgctttaatgcccaaggctttgatggcatcgcccttgt

SEQ ID NO: 6844435 - DNA, 68 bp, Homo sapiens
gctgcgggtctcagaggccctctggtccgttcagggtgaggacagctgagaggcctgggcccgtgagc

SEQ ID NO: 6844436 - DNA, 79 bp, Homo sapiens
tgttttatcttcatttttgatgttaagtagacaggagctgctaatactgtctgtaggacagagaaatggggtttgtgca

SEQ ID NO: 6844437 - DNA, 89 bp, Homo sapiens
taggcgtgtgacaccacacccgactaatttttgtattcccagtagagatggggtttcaccatgttggtcaggatggtctcaaacgcctg

SEQ ID NO: 6844438 - DNA, 63 bp, Homo sapiens
tttcctgcctgtgcttttggtgtcatattcaagaaatcattgccaagagcaatgctaaggaga

SEQ ID NO: 6844439 - DNA, 62 bp, Homo sapiens
tttagggatgtcagaacagggatcatcactgcagtccccatccctgtctaatatgccatgaa

SEQ ID NO: 6844440 - DNA, 78 bp, Homo sapiens
tgggatttttggagaatccatcaaaaggctggtatcttcaatcactcctccaccttattgctggcaccttcaattcca

SEQ ID NO: 6844441 - DNA, 62 bp, Homo sapiens
ttcacgaggtgactttggtttagacatttctgtctctgggcctcagttttctcagctgtgaa

SEQ ID NO: 6844442 - DNA, 84 bp, Homo sapiens
tcctgagattgtttgaagcacaggtgaaacagtcaggtggataatttcaccactgaacagcaccgtgactgtgacaattcagga

SEQ ID NO: 6844443 - DNA, 90 bp, Homo sapiens
cacacagatttctgtctacatgtactattcactgtcatctgaacttcccactcaatgcagctgataattacatgttctggaagctgtgtg

SEQ ID NO: 6844444 - DNA, 69 bp, Homo sapiens
cacaatgggatggtaccactgaggattttataaaattgggggagagacactggaaccatccacatagtg

SEQ ID NO: 6844445 - DNA, 66 bp, Homo sapiens
tctaaggtggggtcctgtcatctgattttcacaggactttcaggtgattctgatgcccaccctagg

SEQ ID NO: 6844446 - DNA, 66 bp, Homo sapiens
ctggagctggcccaggctggcctcccctgcagacaggccgcgtctagggccagctgctcatcccag

SEQ ID NO: 6844447 - DNA, 70 bp, Homo sapiens
attttgtctgactcataagatctcttgagatgctatcttttaagtaggaattgctgagtcagtataaagt

SEQ ID NO: 6844448 - DNA, 96 bp, Homo sapiens
ggctgaggcagacggattacctgaggtcaggagttcgagaccaacctggccgacatggtgaaacgctgtctctactaaaaatataaaaaattagcc

SEQ ID NO: 6844449 - DNA, 77 bp, Homo sapiens
agatagctaactccatggcagacaagctgatgctccccgttggagggaggccttagcttttctctatgttggcttct

SEQ ID NO: 6844450 - DNA, 66 bp, Homo sapiens
gatttctagtctgaattatctttgacacggtcccatttacctgtgaaacatttagggtagaatttc

SEQ ID NO: 6844451 - DNA, 62 bp, Homo sapiens
ctcccacctctttgctccaatagtaatttgtagcccctctattagagcagtaattgtggcag

SEQ ID NO: 6844452 - DNA, 55 bp, Homo sapiens
ctggttcaaattctatgaaatatgtattctcaggagtacatggaattactaccag

SEQ ID NO: 6844453 - DNA, 83 bp, Homo sapiens
aaggaagatttgtttgaagtaatgaaactgaggacccacgggtgacagacttctcaatttgattacattcataaattttcctt

SEQ ID NO: 6844454 - DNA, 57 bp, Homo sapiens
gcatgtggtgaccccactcatggtagcagacaccaggtggttcaggtcaccataggt

SEQ ID NO: 6844455 - DNA, 62 bp, Homo sapiens
ttctattttccatctgacctggatggtgcaaattccagtcgctactaacagggaaaatagaa

SEQ ID NO: 6844456 - DNA, 70 bp, Homo sapiens
gtgtgcctgacatgatggttaaaaggattaaacaaaacaatagtttgtaatttattctgtcagagcacac

SEQ ID NO: 6844457 - DNA, 61 bp, Homo sapiens
tcaggctatatccaggtatccaagaacttgcagggataaagaacacagggaatagcactga

SEQ ID NO: 6844458 - DNA, 67 bp, Homo sapiens
gacacatgtgggcagatacacagacacggatacacacgttcatatgtctgtgtgcccacacacagtt

SEQ ID NO: 6844459 - DNA, 80 bp, Homo sapiens
cccatttccagggttcgtttccacgtggctcaagatttcttcctggcagtctgggaactgggaacgtttccctttgtggg

SEQ ID NO: 6844460 - DNA, 71 bp, Homo sapiens
gtggtttactgtcctctgcaaagaatttgtctccatttaaaatggaggagtggagaggggcaggataccac

SEQ ID NO: 6844461 - DNA, 61 bp, Homo sapiens
tgggagagagaaaacgtggcgcagcaccaattgacgtctgtctgtccctccacctctccca

SEQ ID NO: 6844462 - DNA, 102 bp, Homo sapiens
tttaatttgagggatcatagtcattgtccctcaatgtctatgaccccaattaaaagggatcatagtcattgagggacaatgactatgatccctcaaattaaa

SEQ ID NO: 6844463 - DNA, 104 bp, Homo sapiens
aaagatggagagaaagagaattaccattttaatggtgctataatctaaaagtctgaagatgaaagcatttcagaaatgtgatttgctcttttgtttctgtcttt

SEQ ID NO: 6844464 - DNA, 114 bp, Homo sapiens
tggtcaacatatagtagataatttatttaatatggttttagtgaatgcttgacttaatatgagtgaagtattcataaggacatatgttttaggtgtgcacaaatatgttagcta

SEQ ID NO: 6844465 - DNA, 59 bp, Homo sapiens
ctggccagcatttttgctttagccttaggcatggcttgagtatcatcatgactggttgg

SEQ ID NO: 6844466 - DNA, 58 bp, Homo sapiens
gcccctccagaggcgacttgcatcacggagatgtcggtgatgatggcttgctggaagc

SEQ ID NO: 6844467 - DNA, 76 bp, Homo sapiens
taatatgaggtctctgcagttcttaaatggcaagttcataaatacatgccaggctgtaaacaccttcaaaatattg

SEQ ID NO: 6844468 - DNA, 128 bp, Homo sapiens
gttattaaatatttcttgtctaagctaagtcgacaaagtttcttctaacatctggaatttttaatatctgagactgttttggggaacttcattgtattcttctgccgacaagtaaaaaaaagaataat

SEQ ID NO: 6844469 - DNA, 92 bp, Homo sapiens
aattggaatagaatccatctcaatttattcctagaaacagttctgcttttctgaggcattaggaataaattgaggtggatcctgttccaatt

SEQ ID NO: 6844470 - DNA, 86 bp, Homo sapiens
gcttctttcctttgtggtgacatctgtgcaataggtattcacttagtatcctgggcaagtcaatgtcccaagcaaaggactctagc

SEQ ID NO: 6844471 - DNA, 55 bp, Homo sapiens
gacagtggattcatctagtcaaccccgtataattttgatatgtgaaaacactgtt

SEQ ID NO: 6844472 - DNA, 96 bp, Homo sapiens
ctaccagtatcctgtgtatcctgttgtggccagaaagctactgacaccattagtgctttacagggcacaaagggagctaaggaagcttaaggctag

SEQ ID NO: 6844473 - DNA, 56 bp, Homo sapiens
tccccacttcccacaccctgttttctcactcctggagtgagcatgggcagtgggga

SEQ ID NO: 6844474 - DNA, 56 bp, Homo sapiens
tttagcagcaaagagccatgctctgtaaaagagacagtggctctcagcttgctaag

SEQ ID NO: 6844475 - DNA, 72 bp, Homo sapiens
atgaggaaagaatgagagtgtagcaagatcacagagccatctttctcatgttgcttaactctatgccctcat

SEQ ID NO: 6844476 - DNA, 70 bp, Homo sapiens
atgtgtgtatatagttctatgtcattttattacatgtgttggataacatgcatagatttgtattacatgt

SEQ ID NO: 6844477 - DNA, 66 bp, Homo sapiens
tgggcccaggcatttttctaatcattggcatcacaatagtgaaccaaacaaaaatgcctgtcctca

SEQ ID NO: 6844478 - DNA, 121 bp, Homo sapiens
gcatgagagcagcatctgaaccactcaggaggctggacgtgcatttctacagtggattcctaattctgttttctggggtggagaaatatgttcagcttcttcagcagtttgtgaatcatgt

SEQ ID NO: 6844479 - DNA, 63 bp, Homo sapiens
ctctgctgcctgattgcagacctcgggtttcgagtcccagaggtgttgtgagaggcagtgaag

SEQ ID NO: 6844480 - DNA, 84 bp, Homo sapiens
caggacaagtttaagaactgagtacgttaataaataaggtccagttttcagtttggggatgtctgagttgttgataaggtcctg

SEQ ID NO: 6844481 - DNA, 68 bp, Homo sapiens
cacataagatgtgcatgggtatgcaatttttaaatgtaaaagtgctactatttgacatgttttatttg

SEQ ID NO: 6844482 - DNA, 59 bp, Homo sapiens
tccacatagagcttagaagcaaagttaagagactcatcagattctgagcttctgtggga

SEQ ID NO: 6844483 - DNA, 91 bp, Homo sapiens
cctaagagcaagtgtggtgcacaggtaatagcctaggctatagaggtgactgagtgtagtttaattcctggcctttccacttgctcttggg

SEQ ID NO: 6844484 - DNA, 65 bp, Homo sapiens
tgctgcatcgttgagcatttgctacacagagaataaccttggagcaatgttcaaaggtgatggca

SEQ ID NO: 6844485 - DNA, 66 bp, Homo sapiens
gcagctgagagaagaacagggccagttaaccaagttttgttagcattcctaactatccttagctgt

SEQ ID NO: 6844486 - DNA, 64 bp, Homo sapiens
gcttctccagaccttcatcccccgtgcacacctgtcaggaacaatgaagctctgggtatgaagc

SEQ ID NO: 6844487 - DNA, 58 bp, Homo sapiens
gtgcttcctcagaggttcccatccttcagccctgtgcctttgaggatctggggagcac

SEQ ID NO: 6844488 - DNA, 55 bp, Homo sapiens
ctttatgaacctgttcagcttgagacaatcctacaagccaaactgtttcatgggg

SEQ ID NO: 6844489 - DNA, 72 bp, Homo sapiens
gggtgtgactcacacaggcctgggcttcatgatgtctcttgggagcaggaaggtctgtgtgagtctgtgtct

SEQ ID NO: 6844490 - DNA, 70 bp, Homo sapiens
tgaggagttagggtgattcagtgttattagactgtcagggctatatatactatattaccttctcaactta

SEQ ID NO: 6844491 - DNA, 73 bp, Homo sapiens
aggctggagtgcaatggcttgatcttggctcactgcatcctccgcctgccaggttcaagcgattctcctgcct

SEQ ID NO: 6844492 - DNA, 56 bp, Homo sapiens
ctattaaacactactgtgcacttacttatgttctacatgggcagtgtgtttaatag

SEQ ID NO: 6844493 - DNA, 113 bp, Homo sapiens
tcaaatgagcacaatagtccactgtatcttttccaaagtctaaataactcagtcttcattagcacaatgttgaggataccaagtgtgatggttaattttatgtgtcagtttga

SEQ ID NO: 6844494 - DNA, 77 bp, Homo sapiens
gaggatgttggggtttattgctgtgaacagggtctgcaaggtcctcacacagtggtaaaaccctgaacacaaacctc

SEQ ID NO: 6844495 - DNA, 73 bp, Homo sapiens
tggtccctgatagatagtcacctcccttaactttttggaaaaatacagttatagtcagggctaatgtggacca

SEQ ID NO: 6844496 - DNA, 89 bp, Homo sapiens
tttatgaacaatttgtttcatggggatgtttattatgtttattaaatattgagcctttaatgttttcccagtgcagacgatatcataaa

SEQ ID NO: 6844497 - DNA, 80 bp, Homo sapiens
gggggtggtggtcaggattctcagcccttctttgatttattgggaagtaatgaactggatccaatggcaagccctcctcc

SEQ ID NO: 6844498 - DNA, 67 bp, Homo sapiens
gaagattaatgcaggagttggaaaaaatgattaatcaaatgtcattctagttttcctgtagattctc

SEQ ID NO: 6844499 - DNA, 91 bp, Homo sapiens
aggtgaaacccagacctcctcttccagcctggaccgtgactgccacaccggcagctctgtgcaggcctggggagagagaactaatttcctt

SEQ ID NO: 6844500 - DNA, 65 bp, Homo sapiens
tgggtcacagggtgggttgggctgggccaggatcaatgtcccaggctcctgactcattctactta

SEQ ID NO: 6844501 - DNA, 61 bp, Homo sapiens
cagttctctgctcctagacttttggattcacattagtcctagaagatggatcagagaaatg

SEQ ID NO: 6844502 - DNA, 63 bp, Homo sapiens
acgtgcgccaataaatgcactggaaagcaattcactttgattcaacatttattgagcgtccgt

SEQ ID NO: 6844503 - DNA, 67 bp, Homo sapiens
gtctggagggtgggccagatatgaggggctaggcatgctgggtgccctcgtctggtttccctttggc

SEQ ID NO: 6844504 - DNA, 60 bp, Homo sapiens
ttggtacaatgtgctaggtaggcacttgttcacttattcagcaagaccaccatgtaccag

SEQ ID NO: 6844505 - DNA, 57 bp, Homo sapiens
tgtttcaggcttctgggattttatgatctacctgaagtcatctgagaacttgaagca

SEQ ID NO: 6844506 - DNA, 111 bp, Homo sapiens
acagtgcttggcacaggattgttctcagtgtaggttgctgaatggatgaatgcttccacctactcatccatccacgtaacatgtattgagcagctaagtgccaggtgctgt

SEQ ID NO: 6844507 - DNA, 64 bp, Homo sapiens
gcccatgtcacagtgttgctggaagtattaaataaaagtacctaatagtgcttgtcatgtgggc

SEQ ID NO: 6844508 - DNA, 80 bp, Homo sapiens
ggtgatgcagagggcggggtgcctaccttcatggagcttgcactccacaagtgaagtacacctgccatacgagcgttatc

SEQ ID NO: 6844509 - DNA, 59 bp, Homo sapiens
aggatttttcactgttaaaatgacagggaacactcctggcaactagtggtgaagagcct

SEQ ID NO: 6844510 - DNA, 60 bp, Homo sapiens
tggtctctgctgcagcttctcaaccctgtccttgcagcatagaagtggctgcagacacta

SEQ ID NO: 6844511 - DNA, 109 bp, Homo sapiens
ggcagaggggctgggggagttgggggaaacatgagactgggtttgtagggcccctaaggaggagctcaggacccggtccaggtgggtacgagtcctaggttcctttgcc

SEQ ID NO: 6844512 - DNA, 65 bp, Homo sapiens
ctcagggattgtagtgggggaagaaggacctccctttctgcgtgtcccctcacttgtcttctgag

SEQ ID NO: 6844513 - DNA, 57 bp, Homo sapiens
gccagagaggcctaaggccatatgtagtcatatccttaatgtacaagccttttgggc

SEQ ID NO: 6844514 - DNA, 129 bp, Homo sapiens
aatgccacagacaaaagcagaattcaattgcagtgcagactgaaatgaccttcttgcaaaagagagaagtgatattcccaagtctgacaagcaattttgagtgcactatctgttaatactgtgatcatt

SEQ ID NO: 6844515 - DNA, 69 bp, Homo sapiens
aattagggagaggtagctaggtggtatggcgaggccaagacaaggacaccttatctcaagtccctgatt

SEQ ID NO: 6844516 - DNA, 130 bp, Homo sapiens
tcagccaggccctccgccttgctgccagggctgcgggctcctcaaggtctcaggaataacagggcccctgtgcctgtctcctctgcagggtgaggccctcagcccagagggtgtggactggcctggtggg

SEQ ID NO: 6844517 - DNA, 90 bp, Homo sapiens
tctaagattctggcatttttggaaagaagaactcagataaagataattattaattttttgtaaatcaagggtgcctatattatctctaga

SEQ ID NO: 6844518 - DNA, 81 bp, Homo sapiens
taaaaaccacatccctgggcctcaccacctgagaatctaatccagtcagtgtaggatggggcttagtggtctgtattttta

SEQ ID NO: 6844519 - DNA, 111 bp, Homo sapiens
agttatttagtttttctgcagtggaatgtgaatatccatgattagtaggataaagtctacaagtagcttcacattagtttggatcaaattttgccattaaattagttaact

SEQ ID NO: 6844520 - DNA, 67 bp, Homo sapiens
tttcaaactttactcttgaatcttcttttccttgtcagggaactcttcaagggtggatgtcctggaa

SEQ ID NO: 6844521 - DNA, 82 bp, Homo sapiens
gaatttggtcttcagtgatttctgttgccagcaatatcttattttttcaactaggtcatgagaaatctttgaaggttgtttc

SEQ ID NO: 6844522 - DNA, 58 bp, Homo sapiens
gtgagaacttcctggaatgttaaggttgatctttctaccagcatttggaattctacac

SEQ ID NO: 6844523 - DNA, 82 bp, Homo sapiens
agcaaataaatgacagagccagaactagaccttgtattttttaacctacagtctaatcttgtgttttgtatgcttgtttgtt

SEQ ID NO: 6844524 - DNA, 72 bp, Homo sapiens
cactgggaaaagttctatgttagagatacatcctagctccatgtggtgatgtattataatatttcccaagtg

SEQ ID NO: 6844525 - DNA, 56 bp, Homo sapiens
gggaggtgatactttttcacctgttcattgatcaattgagggagtattgatttccc

SEQ ID NO: 6844526 - DNA, 65 bp, Homo sapiens
gcttggttactgatggaaaggatgctgcctctagtgaggagagagttctgacagtaataccacgt

SEQ ID NO: 6844527 - DNA, 60 bp, Homo sapiens
ctttcacagattctgtagatgctcctcagagacaagattcaggaggcatagtctggaaag

SEQ ID NO: 6844528 - DNA, 71 bp, Homo sapiens
gggtgggggtaggccttctgaggtgacctgctaaagcactccttaggcccggggccacagcctcccttccc

SEQ ID NO: 6844529 - DNA, 55 bp, Homo sapiens
aaagagtgggtagcttccctggttcaaggccagcctctggcagctgccacttttt

SEQ ID NO: 6844530 - DNA, 82 bp, Homo sapiens
gtgattgcttccatgtgtatttgttgttgtgaacaaagtaccaatatgaacaacagcatatttcatatattgaaaaaattat

SEQ ID NO: 6844531 - DNA, 64 bp, Homo sapiens
taacttctctgggacaggaacagtttaagcttctgtttacactgtcatttctcgggcaaagtta

SEQ ID NO: 6844532 - DNA, 67 bp, Homo sapiens
agtgtccctcagtagtcatgagtaaactttttaaaaaaaagtggtttttcagactttgagagagact

SEQ ID NO: 6844533 - DNA, 56 bp, Homo sapiens
tctgtctgccagagtacttgtaagaattataagtttagtttagtgtctggcataga

SEQ ID NO: 6844534 - DNA, 70 bp, Homo sapiens
cctagaatgccatcctaattacgttgaatgttcccgtttaagtcatggagaattgtggatggatgttagg

SEQ ID NO: 6844535 - DNA, 67 bp, Homo sapiens
acatagtgcctacctaccttacggacgtaagagatttagcaactgcctggtactttaggcactttgt

SEQ ID NO: 6844536 - DNA, 75 bp, Homo sapiens
tctccaacccagtttctttatttgtttgagtgctgttacaaagtttcctgcagcaaggagaagctggggaggtgg

SEQ ID NO: 6844537 - DNA, 61 bp, Homo sapiens
gtcatgagcaccgaacccatgtggtccagcctcagggcctgatggccaacctgcttatgac

SEQ ID NO: 6844538 - DNA, 127 bp, Homo sapiens
gtcaaataattcatctgtccttcttgcctttggagaattaagagagaaggggtgtctgcttggcagagggcatcagagacaaaccttgttttatgatggagggggacggatagacgaagagaaaggc

SEQ ID NO: 6844539 - DNA, 68 bp, Homo sapiens
agagtaacctttcaggcatgtaggtttgaccctctgatcacaggcttaaaactttgaaagtgttctct

SEQ ID NO: 6844540 - DNA, 129 bp, Homo sapiens
caaagcctctctggcagcaggcctgacaataccaagggcatgagcacatagtgtctagcttggtctccttagtcatctctgtgcacgtgctgctgccttggctgctgggttttggccagagtggccatg

SEQ ID NO: 6844541 - DNA, 64 bp, Homo sapiens
aggaactctgtctccagagttgaatgttgaattcctattctcaaagccagagtcaacgtgtcct

SEQ ID NO: 6844542 - DNA, 55 bp, Homo sapiens
gtattctgtttacagtgagcaatgaaaaagatgccactgtgtccaccaggaatgc

SEQ ID NO: 6844543 - DNA, 78 bp, Homo sapiens
gcctcagggctggagccacagctgggagggctcccagatcctgaccatatcctcccagaggctgagccaggcctgggc

SEQ ID NO: 6844544 - DNA, 61 bp, Homo sapiens
ctcacgatggagtcctatggggcagccctgtgactctgcctcctccgcattctctcgtaag

SEQ ID NO: 6844545 - DNA, 70 bp, Homo sapiens
cccagcgtgtattccagaccttaacgaagcaacaaggcctgcacgtagacaactgaaatgcacagatggg

SEQ ID NO: 6844546 - DNA, 90 bp, Homo sapiens
gtctgacagcatctattcctggccatcctgtgacctgagaggccccagtgcctcctctagacagtagcatgcaccaggagggtatgtgac

SEQ ID NO: 6844547 - DNA, 77 bp, Homo sapiens
caaaatgaaaacaaaacccagccgctggtgcagagtcccttgaaagctctggatccggctgggtctgttagctgttg

SEQ ID NO: 6844548 - DNA, 60 bp, Homo sapiens
ctgaatccgggtgtttcaacttcccgaggctgcctcctggaaatctggccctggatttgg

SEQ ID NO: 6844549 - DNA, 65 bp, Homo sapiens
ttgacaaatggcctcttgcacatggtgaaaacactctttcactgtcaggctaaggttatactcaa

SEQ ID NO: 6844550 - DNA, 57 bp, Homo sapiens
ctgaccttgtgatctgcccaccttggactcccaaagtgctgaaattacaggtgtgag

SEQ ID NO: 6844551 - DNA, 129 bp, Homo sapiens
tctggggcatctgtgagaagggagctcctgggagggtgaggacaaggtgatttataggaaggagcaacttcgagtcatgttctcccattaatctcatcaactggtagctccaaaacatagctgtcaaca

SEQ ID NO: 6844552 - DNA, 126 bp, Homo sapiens
ggttgtgctcaaagtcctgtttgcatgttaagcacaatgtttttgttcaaagagtacatttatatggatgacttgggaggctgaaggacattgtgttaggaggcaagtagggtttgaagcataccc

SEQ ID NO: 6844553 - DNA, 55 bp, Homo sapiens
cttaaagttgacacagtccctgaggctgaagaagggaagggttgtccgttttagg

SEQ ID NO: 6844554 - DNA, 56 bp, Homo sapiens
cccaagtattcctcctctgccctccccgaggcaccctgagatgagagtgcttgtgg

SEQ ID NO: 6844555 - DNA, 75 bp, Homo sapiens
tgtgttccagttctcgttcggaacgcacgtggagagcggagtaaaatgtgtgtatgaacgaaagaatggatggca

SEQ ID NO: 6844556 - DNA, 56 bp, Homo sapiens
cctctccagttttaacgtgaccaataaggtgatatgcaagtgaggatttggggagg

SEQ ID NO: 6844557 - DNA, 65 bp, Homo sapiens
ggagtgtgggatggagctcaggagacacttgattctgtctatggtgagcttaccagctcttaccc

SEQ ID NO: 6844558 - DNA, 92 bp, Homo sapiens
ggcatttcacttcatttttgtcagcagctggtttgctgttatgatatatatttagcagtagtgatggcccctgagactgttggtttgatgcc

SEQ ID NO: 6844559 - DNA, 75 bp, Homo sapiens
ttcaagttgctcgctgactcaacaagcttctcatttattaggtgcctacgaggtccatggcagcgggtacttgaa

SEQ ID NO: 6844560 - DNA, 62 bp, Homo sapiens
gcagtgcagtgggacagggcgccctccattctgttctgccctgccctgtcctcttgctttgt

SEQ ID NO: 6844561 - DNA, 72 bp, Homo sapiens
gtcttttacatttgttatagaaatgaagccgtatatctaatgcatcactggctgctgacagatgataaaggc

SEQ ID NO: 6844562 - DNA, 62 bp, Homo sapiens
aattcagggggaacacagggttgccaggacacctggagtccagccctgcttccccgctagtt

SEQ ID NO: 6844563 - DNA, 55 bp, Homo sapiens
gggcggcgtcggcgaggccatcaaaggccgggggtggcggcccgccgcgttgccc

SEQ ID NO: 6844564 - DNA, 71 bp, Homo sapiens
cctgttagaaggaggactggcagtgttgatctcattaatcggcgccatatgtgccagtgtcccttccaagg

SEQ ID NO: 6844565 - DNA, 61 bp, Homo sapiens
gggcatgtctctaggctggctaggctgcagggagcccgtggccagcctgggggaggtgcct

SEQ ID NO: 6844566 - DNA, 66 bp, Homo sapiens
gaacagtgccagcacacaataagcgctcataaatattaactgcttttatgattgtcagcattgttc

SEQ ID NO: 6844567 - DNA, 67 bp, Homo sapiens
gggtggaagccagagaggtcattcagggcccggccggcttcccgggccagcctccctggctacactt

SEQ ID NO: 6844568 - DNA, 92 bp, Homo sapiens
tttttcgaagagtggccttaggattggatttctcttcctgttcctgggaagaattagagatataacctaaaggtcactattcttctgagaaa

SEQ ID NO: 6844569 - DNA, 99 bp, Homo sapiens
gggactcagtttgtcaccacatggacctctctgtagggctgcttgagtatcttatggtagttggcttcccgcagagtaagtgatgagacagagagtgcc

SEQ ID NO: 6844570 - DNA, 75 bp, Homo sapiens
tgttttgtttgtttagatgatacgctgagaaccaaatctaccctgtcagcttactcttcaagaacaagccaagca

SEQ ID NO: 6844571 - DNA, 75 bp, Homo sapiens
gctgggcatctctgctgccggcctaggatcaaggcaggaaaaggccaggaaaggagggcagaagagaagtcctgc

SEQ ID NO: 6844572 - DNA, 81 bp, Homo sapiens
tatagtacctgcccacaagttggggtctagcaaggaaagtagaataaagaggcaagactagtccagtatggcaatgctatg

SEQ ID NO: 6844573 - DNA, 67 bp, Homo sapiens
ggcagggcattttgataaactttgtactcattactccttataacaagtttatgaatcttgtcctgct

SEQ ID NO: 6844574 - DNA, 89 bp, Homo sapiens
actaataacctgtatgatttctagtatgtctttggaaggtttgtaaactttccaaagttagttattagaaaggagataacattgttagt

SEQ ID NO: 6844575 - DNA, 64 bp, Homo sapiens
cccagagagtcgatgggggacactgacaaacgaatcacaaagttggtgccgtttgctcttaggg

SEQ ID NO: 6844576 - DNA, 72 bp, Homo sapiens
ctgctacattgtgagcaactccagggctgggactgtgctcccagaatctccagtgctacagcagtgtggcag

SEQ ID NO: 6844577 - DNA, 65 bp, Homo sapiens
gcagtaactattcccttcacacagaatgagcctcccttccctcatttcctgtaaaatggtactgc

SEQ ID NO: 6844578 - DNA, 76 bp, Homo sapiens
tccgcttgtggagccttttacccacaggagctgcctttgatggacttttctgggaggagggttattcccgaatgga

SEQ ID NO: 6844579 - DNA, 112 bp, Homo sapiens
actttgcccactggatgctcagaccacctgcgatggctgtatgtgctcagtgaaccccctgcttgcactgagacctgcccaacgcagaccctatgacgcatcacgggaaggt

SEQ ID NO: 6844580 - DNA, 129 bp, Homo sapiens
cgcattaaaaagacctagagagattcagcagtactgaggcctggccccaccacagaccaatgaaagcagaatatctggggaggggtcaggcatctttattctttgaactcctcagctgattttaagagg

SEQ ID NO: 6844581 - DNA, 67 bp, Homo sapiens
ttggcaaatgtgtgtttgtgcaattagttaattaaaggaaatttctatatatagacacatatgccag

SEQ ID NO: 6844582 - DNA, 69 bp, Homo sapiens
gtgaagcttcccccccaggctttcgctgcctctcccaccttgtggggacctgcctgggagaagtttcac

SEQ ID NO: 6844583 - DNA, 92 bp, Homo sapiens
gtttattttcttaagcctctgcattatctctcacacgtcttgcttaaaaaataggttagtgagaagataagtattgcaaaagacaaagaaac

SEQ ID NO: 6844584 - DNA, 69 bp, Homo sapiens
gtcctactctgggctttgatttgttacagtgaaagaatacaaagtaaaattggctcagggcaaaggggc

SEQ ID NO: 6844585 - DNA, 82 bp, Homo sapiens
gctccccggcaccccctcccaggctcctagaggcccagagggaatctggggacttggggcctgagagagggatgagggcggc

SEQ ID NO: 6844586 - DNA, 78 bp, Homo sapiens
gcaggactgtgtttctttctggaggctctaagggataatcttttttcttgccttttccagcttccaggagctgcctgc

SEQ ID NO: 6844587 - DNA, 80 bp, Homo sapiens
cttgggaggaaacccaccgtggtagggcacacagcggctgacttgtcctggtaaatcataagcatggtgggctccgcagg

SEQ ID NO: 6844588 - DNA, 63 bp, Homo sapiens
tctgtatgcatcgactcaagtctgaagataagcaagtgcttcagaagcgaaagatggagcaga

SEQ ID NO: 6844589 - DNA, 88 bp, Homo sapiens
agtcttaaagcactgcccacatttccaaagatgccagtcactgaactccgagtggagctggcttgtggaagttgggcttgccaggact

SEQ ID NO: 6844590 - DNA, 75 bp, Homo sapiens
tgtagagtgcttttcagaaagatgagaaattacttgagccagtgaggtgttttctcttgaaaagcagtcctctca

SEQ ID NO: 6844591 - DNA, 66 bp, Homo sapiens
cattctagctcatcttcccatataaccctgtctacctgaaaagggatttagtggatgagctgagtg

SEQ ID NO: 6844592 - DNA, 59 bp, Homo sapiens
tgttgtagagaagaaattaaaattcaggttactggatttctagttcattatctattcca

SEQ ID NO: 6844593 - DNA, 83 bp, Homo sapiens
agagaaccactgtttcccgcagtgtcctgtctgtttgtcctatttaaacaatgacaacacagctgcgtaggaacacaggctct

SEQ ID NO: 6844594 - DNA, 55 bp, Homo sapiens
gaggctcagttattttagcctggggattttgcctggggaaaaatgtatgtgcctc

SEQ ID NO: 6844595 - DNA, 75 bp, Homo sapiens
gagcgagagctggctttctgcaaatctccatggaatccagctatggccctgtgctgaaagcaatcaattctcatc

SEQ ID NO: 6844596 - DNA, 83 bp, Homo sapiens
gccaaactgctccagagcagagactaggttggcttacattcaaggtaagaaagccagtctctctccctggagatgtttcaggc

SEQ ID NO: 6844597 - DNA, 97 bp, Homo sapiens
gtttgtaatttattgttcagtccacaacgctaatcatgctgccctagacacaacagatgatcaataaaaggctggctggatgaatggattaattaac

SEQ ID NO: 6844598 - DNA, 72 bp, Homo sapiens
atgttctctgtgacacataaaattatatgtatgtatatgtatccgtgtgtgtacagaatatgctatgaacat

SEQ ID NO: 6844599 - DNA, 56 bp, Homo sapiens
atctcatgttctgaaccccaaggtattctatgacagaatgcaaaggacactgagat

SEQ ID NO: 6844600 - DNA, 60 bp, Homo sapiens
aggtaaatctgcataagcacagttggatctacttccctgtgaggtttgtaaggtatactt

SEQ ID NO: 6844601 - DNA, 69 bp, Homo sapiens
ggcacacagcaggcatgaagaaatgtttttgcatgaaagaatatgccttctgctgtgctgcagtttgcc

SEQ ID NO: 6844602 - DNA, 62 bp, Homo sapiens
ggcagaggaggacccaggaattataagacgtgtcaatgtattgatctgtggcacctcttccc

SEQ ID NO: 6844603 - DNA, 67 bp, Homo sapiens
caaaatagcctgttactcttctctgatcagttatctgacaagatttagcttaaagggctttattttg

SEQ ID NO: 6844604 - DNA, 129 bp, Homo sapiens
tctataacctggttatctctacgatgattttggcaagaacgtgcagatgcatacacatatacacaaaatgctgcacatctttcagcatcatacaaattttgtagaagaatggccaatccctaaattaga

SEQ ID NO: 6844605 - DNA, 57 bp, Homo sapiens
cagtgctagaatgtaactctagtcatctcttttagctatgggaacgtgggagcactg

SEQ ID NO: 6844606 - DNA, 75 bp, Homo sapiens
gcagcaagaggaagtttatattgtaattgtatcatgaaaatgagaaccataatgtacaactgcttttaatactgc

SEQ ID NO: 6844607 - DNA, 60 bp, Homo sapiens
caatggctgttatttcagcagatgctgagagaaaattaagcatcttgaaaaataccattg

SEQ ID NO: 6844608 - DNA, 92 bp, Homo sapiens
gtttttctgaagtatacagttagttgaggagtgtttgtcagtctctcaacttcaaatctctgctactagctatgcaatactgagaaggccac

SEQ ID NO: 6844609 - DNA, 73 bp, Homo sapiens
ttagggacatttaataagtgatgatagtacctagaaaataatttcaatgtaagtgatcactgttattctctaa

SEQ ID NO: 6844610 - DNA, 97 bp, Homo sapiens
actgtgttagtttgctagggctgctgaaacgataccacaagctgagtggcttagccagcagaaacatattgtctcacagttttggaggctggaaggt

SEQ ID NO: 6844611 - DNA, 74 bp, Homo sapiens
gataaagagattttctttcatgcatgcaggaaagattcctcttttagtgtaagcataaagaacatttttggttc

SEQ ID NO: 6844612 - DNA, 73 bp, Homo sapiens
ggggagggaggcccagtggagggccatggcacatgacctggttctgccctgccagtgggctcagcccctctcc

SEQ ID NO: 6844613 - DNA, 89 bp, Homo sapiens
ggttctcaatttcctgtgcagcagcttgatcctagaaatgtgtgttacaactttttatttcttagtttgccacagaggaatagaggact

SEQ ID NO: 6844614 - DNA, 60 bp, Homo sapiens
ctttcatgtctgaattctttagtgagtaaatatgtacatagactgatttggatgtgaaag

SEQ ID NO: 6844615 - DNA, 120 bp, Homo sapiens
ctgttgcatagggaacaagtgggagtggtgctggtggctttgcagttagcctaggattgagcaattgctgcaactgttgctctctgcagcttcagcgttacttcttactggtggtgacag

SEQ ID NO: 6844616 - DNA, 70 bp, Homo sapiens
ttcccccacaggtttgtctgatgtaatgatatattcagtgttaattaacaatagagaacccatttgggaa

SEQ ID NO: 6844617 - DNA, 64 bp, Homo sapiens
atcccgttgcagcatcactgctgagtgtcaggatgatctcaatctgtgggtgctacaactcgat

SEQ ID NO: 6844618 - DNA, 56 bp, Homo sapiens
tgagctcgagagctttggtccagctctgtgtctgcagggacatagctcagagctca

SEQ ID NO: 6844619 - DNA, 67 bp, Homo sapiens
aggtcctcagccatctgaattagctttgtttttgtgtggaactgtaaaggttgagtggtaagggctt

SEQ ID NO: 6844620 - DNA, 127 bp, Homo sapiens
ttagcatatgtgctttctaaaatacaatatattatgttagtcccattatatgacttctagatatcatgtacagacaagtacataggaggggctcacctgaatagtatttttctattttatatgttaa

SEQ ID NO: 6844621 - DNA, 92 bp, Homo sapiens
ggcagattctgtgattcacctgccctttacctggtggcccatttagatgccaatggcagtgcaaggaagggacagctgagaccagaactgct

SEQ ID NO: 6844622 - DNA, 75 bp, Homo sapiens
gacctctgagacttgaattcctcggctggtctgagatcttcctctgcaggctgccgtggggtccaggcagtggtt

SEQ ID NO: 6844623 - DNA, 75 bp, Homo sapiens
acccttctgtgacctgcctgtcatcccagcccgctctccttgggctgaccctgggctgcagggaacaggatgggt

SEQ ID NO: 6844624 - DNA, 70 bp, Homo sapiens
ttctggatgagattaatggtgtggccctgggatacaaagggatacacaccttcttgttttgcctccagaa

SEQ ID NO: 6844625 - DNA, 80 bp, Homo sapiens
tgctttgcctttctgtaacatgggaggattgaggggcgtgcccccagaaacacctggattctgttaattaaggtaaagca

SEQ ID NO: 6844626 - DNA, 76 bp, Homo sapiens
cccttgtaggatatttgcttaagatagctgggggctaatttaattccagagttgcttatttgagtttctatgaggg

SEQ ID NO: 6844627 - DNA, 66 bp, Homo sapiens
tgtctgcctttgtgatcagttctttcgtttgatatttttgcagaaggaactgcatcagcacagtca

SEQ ID NO: 6844628 - DNA, 65 bp, Homo sapiens
gcagcagcaggcgcacggccgtctggatctccctggaggtgatggtcgagcgcttgttgtaatgc

SEQ ID NO: 6844629 - DNA, 107 bp, Homo sapiens
tatttggtttatgttttcacgatatgcctatatgtgtgtttataagtttgtataaacatatgcatgtaagtatatgtacttgtgtatttctataagcctataaggta

SEQ ID NO: 6844630 - DNA, 58 bp, Homo sapiens
ggggctaggcttggccagcactgtgacattgctgcacgtgggcaaaatggccttcccc

SEQ ID NO: 6844631 - DNA, 66 bp, Homo sapiens
agctgcaggccagggagaatatgaagccacagatggctcatcccacccctgccctggccgatggct

SEQ ID NO: 6844632 - DNA, 80 bp, Homo sapiens
agggtggaagaggaaaagcttcatttcaactcaggggtcttagaaggcttttaggaggaaagaagatttgacctggccct

SEQ ID NO: 6844633 - DNA, 68 bp, Homo sapiens
tggcattgtcctgcctctccatgctaactaccttttagcgcatgtactgagtgccaggcactatgcta

SEQ ID NO: 6844634 - DNA, 105 bp, Homo sapiens
ggaaggactcctcccaggcaatttctgctctgacctgaaagtgtctgtagttctacttttactgagaccaggttgagctggacgcccagggtccgggggtcttcc

SEQ ID NO: 6844635 - DNA, 73 bp, Homo sapiens
tagactaaggttacagagctagtcagtgtcagagcccggcttcaaactcaggactgcctgtctccatagtcta

SEQ ID NO: 6844636 - DNA, 61 bp, Homo sapiens
ttagttgacatcatcagcctggagtttatcttgctcactccaagtgcagaatgtccactga

SEQ ID NO: 6844637 - DNA, 68 bp, Homo sapiens
cctgtgcattgagtttgcaccctgcagagaatgaacacaggagtgtaataaagtgactcagagccagg

SEQ ID NO: 6844638 - DNA, 59 bp, Homo sapiens
tctgagagcctctagcctaagtctaaatgtaacgcttgagtcagctggaggctgtctga

SEQ ID NO: 6844639 - DNA, 77 bp, Homo sapiens
agtccctagacagtatggtcagagcatcctcctggagaggggaggcttgagccatactgccaaggtacataggggct

SEQ ID NO: 6844640 - DNA, 64 bp, Homo sapiens
ctatgcccacagagagggaaatttgtttctttcttcttcagggacaggtctgtctgtggcagag

SEQ ID NO: 6844641 - DNA, 101 bp, Homo sapiens
cactgatgaacactttcttccttgctcaggcctggaagagtggtaggcccttagcaaatgagccagattgaagagatgaatgaatttgtgtactcacagtg

SEQ ID NO: 6844642 - DNA, 60 bp, Homo sapiens
accaggctccccttggatcctgaggggtttctttggggatctcactcaggagcttttggt

SEQ ID NO: 6844643 - DNA, 68 bp, Homo sapiens
caaatgagccatcatggaatcagatcagcccaagttaaaccttcagcttcttggtgatggcttacctg

SEQ ID NO: 6844644 - DNA, 56 bp, Homo sapiens
gtgtggctcagaactacttctagttgctaagcaacccacaagcagctgtagcccac

SEQ ID NO: 6844645 - DNA, 57 bp, Homo sapiens
tgctccaggcaagctgagagttgctggggacagagacttagctggtggcctggggta

SEQ ID NO: 6844646 - DNA, 66 bp, Homo sapiens
cccaccctgttgtctgcagctttcagttcttcctcttaacttctgctgttgtgacgttagtttggg

SEQ ID NO: 6844647 - DNA, 65 bp, Homo sapiens
agactacctcactcatctggtaagtgtcagcgatgatttgttacacaggtgtgtggttagagttt

SEQ ID NO: 6844648 - DNA, 58 bp, Homo sapiens
tgtatatgtgaacagatgcacatatcaaattctgtgcagagtaacgatcacatatata

SEQ ID NO: 6844649 - DNA, 84 bp, Homo sapiens
taatcctttatattgcagaatgtttaattgtttttaaatgggaagtgaggaaatattttgttttagttgtattataaagtatta

SEQ ID NO: 6844650 - DNA, 71 bp, Homo sapiens
tgtggttgtaggattgaggtcctgctgggattgctgttggtgcctgcagaccacactcagtcctggctaca

SEQ ID NO: 6844651 - DNA, 76 bp, Homo sapiens
tataggcttttgttgcagaacacgtttcgggaaccaccatttccgatttcagaggttttggtaggaaaagctaata

SEQ ID NO: 6844652 - DNA, 95 bp, Homo sapiens
atgctttgtcttttttcagttgaggtggtctattgcgttaccgagctgtggggatgcacccacttagctgaagttctcatctaaaaacaaagtat

SEQ ID NO: 6844653 - DNA, 98 bp, Homo sapiens
ctgcaccctcctctctccctctctttcctacaccttggacagacagcctgagattccagggcgtgtgtgaaggaaagccgaggagggcagggccgcag

SEQ ID NO: 6844654 - DNA, 77 bp, Homo sapiens
gcctagaacaaatgaatactctagctgttaataattgccttgattatcagatagtagatatttagcttgatctaagt

SEQ ID NO: 6844655 - DNA, 58 bp, Homo sapiens
attttggcagtttgtgctgaggtctttgctgacactcaaactgttatattgccagagt

SEQ ID NO: 6844656 - DNA, 74 bp, Homo sapiens
tcggctcctgtgaggacacagccgccgggcccaggaggtcacgtgcaagctgtgccttctcaggatagagccga

SEQ ID NO: 6844657 - DNA, 86 bp, Homo sapiens
tcctgaaaattctgtttctctggagccactctcagtacaaaaatctattttagtcagtgttctccggagaggcacaaacaatagga

SEQ ID NO: 6844658 - DNA, 63 bp, Homo sapiens
ccagcagcagcgtccaaggagaatggcagaagctgaggtgccctgtggaggctgctcagctgg

SEQ ID NO: 6844659 - DNA, 55 bp, Homo sapiens
gaggaggtcacctggtgagcaaccaagtaagtcttcatccaggtcctgcttcttc

SEQ ID NO: 6844660 - DNA, 64 bp, Homo sapiens
tccaacagctgcaactctgtctccttaacacaagcggatgacaaaatgaatgcagctagtttga

SEQ ID NO: 6844661 - DNA, 67 bp, Homo sapiens
gcgcaggggccctgatcgcccccagaggtgctgagcgcacagggcagtggctgcagagccccggcgc

SEQ ID NO: 6844662 - DNA, 66 bp, Homo sapiens
ccaaattctcaccctgtttgattggtgtatgttatctctaccgaagttcacccagagagaattagg

SEQ ID NO: 6844663 - DNA, 78 bp, Homo sapiens
gcaaatgaatcttgtgagattgttcagagtttctactagaggagtacagctgttcatttcaccttagagaattattgc

SEQ ID NO: 6844664 - DNA, 59 bp, Homo sapiens
ggtgtgtgtctaagcccccttctcagtggtttggctgggcttctggtaaagaccacacc

SEQ ID NO: 6844665 - DNA, 55 bp, Homo sapiens
attatcttgataaaatggcagtgacacgcactctgcctgccacaattagggtgat

SEQ ID NO: 6844666 - DNA, 59 bp, Homo sapiens
ctgcgcaggggtggcgccagaatgatcaaagtcatcatggggcactcatctttgtgtgg

SEQ ID NO: 6844667 - DNA, 88 bp, Homo sapiens
ttgtctgtgggcttctataggttgttgtgacttgaacagatctgtttacgctacatttgctatggcaacgtttatctgatatggacaa

SEQ ID NO: 6844668 - DNA, 72 bp, Homo sapiens
cttccccttcccagcttctgccagatctgccttcagattcctcagtcatgaagcctccctgagaggggtgag

SEQ ID NO: 6844669 - DNA, 90 bp, Homo sapiens
ctgaccttcctgaaatgctagatctggcaggcacaaggtcaagattggcttctgtgagtgcagatgctgaggttgccaggaggaaatcag

SEQ ID NO: 6844670 - DNA, 85 bp, Homo sapiens
tgatggttggctatagtgcattaaatttgttactggccatttgccagtgatttagtacaatgtagagttagaaacctgtttatca

SEQ ID NO: 6844671 - DNA, 67 bp, Homo sapiens
tgagacaaggatggggaggagaaaagagaggagagcctcttgcattccattctcgtgccatcactca

SEQ ID NO: 6844672 - DNA, 64 bp, Homo sapiens
cagatggtatttcaaatttggcaagtgctaagaaagaacttacccaaattagagttaccagctg

SEQ ID NO: 6844673 - DNA, 80 bp, Homo sapiens
gcacgggcccgctgagccgcgcactgggcatgtacagcaccgcgtctcccaggctgatgttcagcgggtgctcgatcagc

SEQ ID NO: 6844674 - DNA, 129 bp, Homo sapiens
gggtgcctggctccacagtgctcacaggcctattctggaccaggagagcaggcgtgcagctgcagcattgagcatgggggtgcctacacctgcctgtctgcagggttgtcattagcatggagtccacct

SEQ ID NO: 6844675 - DNA, 90 bp, Homo sapiens
ttaaagtgcagttaaagtctttatacagaaatatatgccctataaacacagagtatatctttttaaggactgatgaaatagtcactttaa

SEQ ID NO: 6844676 - DNA, 69 bp, Homo sapiens
aattgttcatggttgtaagtttgaacccatttaatcattcaggttcatattcttaaccactgagcaatt

SEQ ID NO: 6844677 - DNA, 59 bp, Homo sapiens
ttccaatatttacaatgcattatgaagttatggaattcaggagtgcttaagtgttggaa

SEQ ID NO: 6844678 - DNA, 77 bp, Homo sapiens
gatggaggtaaaggatgtagaaggtggcaggtggctttaataattatatgtacatcgttgaattcaaatcctctatt

SEQ ID NO: 6844679 - DNA, 95 bp, Homo sapiens
gtcttggtgatacactttaggaagaaactttccctgcagccctcgagggtggcatgtcaggatcaggagtttgtgtcttctttgtatcccaagac

SEQ ID NO: 6844680 - DNA, 112 bp, Homo sapiens
ataaataatccaaactaaccctaaaattataccaaaaaattaatgtgattaggatgataattcacagtcacatagtgttttggaatctttgtggtgaaaataaattgtttgt

SEQ ID NO: 6844681 - DNA, 98 bp, Homo sapiens
tgagaattctggggcaagaaagtgtttacattgctataagaggtattaagaacggcttcctgtattaggtagacaactatttttccattagttttcca

SEQ ID NO: 6844682 - DNA, 55 bp, Homo sapiens
tggtggtgggagtggggagggtgtcttgtttttgcatctccaaaaccaatcacta

SEQ ID NO: 6844683 - DNA, 57 bp, Homo sapiens
tctattctcaggtaagaatgtgtaagctgtagctgccagagttacatgagggtcaga

SEQ ID NO: 6844684 - DNA, 59 bp, Homo sapiens
agaaggaatctccatttagtctgtgaaccacagcaacagacagctgggagtgtccttct

SEQ ID NO: 6844685 - DNA, 55 bp, Homo sapiens
gatggtctttgtctctgataagaagttcaccagcatcttagggataatgactgtc

SEQ ID NO: 6844686 - DNA, 76 bp, Homo sapiens
aggttggtgccaaagtaattacggttttggccattatgttcaatgacaacaaccacaattacttttgcaccaacct

SEQ ID NO: 6844687 - DNA, 112 bp, Homo sapiens
gcctcgggcccagggtgggggcattccaggggcctcctcaccctgctcaggcaggccggctgggccagcagctgtggggtggccagatgccccacccctggcgcctttaggc

SEQ ID NO: 6844688 - DNA, 95 bp, Homo sapiens
ggtatgtttggatataggtacagagttagcagaaagttggatttaaactaatgtgaaccaggattcaggttttgctaagattgtgtagatatacc

SEQ ID NO: 6844689 - DNA, 55 bp, Homo sapiens
gacaaggcagctattgtctccatagtttctattatcttaccacagctgtcttgtt

SEQ ID NO: 6844690 - DNA, 65 bp, Homo sapiens
cagttatttcactcttcggcatctctgtaactgtcccagatacaggagcacaaaagagttgactg

SEQ ID NO: 6844691 - DNA, 80 bp, Homo sapiens
tctgaatttttagatagtttaactgcactttagggggtattgtattctccagtgtacttgagaattgactaatttgcaga

SEQ ID NO: 6844692 - DNA, 71 bp, Homo sapiens
gatttaggtggcaggagacacatggcatagtaaattatattcatatgatgctgggtcttctgctgtaaatc

SEQ ID NO: 6844693 - DNA, 59 bp, Homo sapiens
gtgacactgggtaaatttgaggctgagccttaaaaggtctgcagcttcacctgtgtcat

SEQ ID NO: 6844694 - DNA, 55 bp, Homo sapiens
ggtgcagctgcagcctgggagctcatatcagagtctatcgtaaagcagctttatt

SEQ ID NO: 6844695 - DNA, 55 bp, Homo sapiens
tggctcctttccagcctggtttccagagcctctgacctgctgtggggaaggacca

SEQ ID NO: 6844696 - DNA, 67 bp, Homo sapiens
cctgctatatcttcctgagctatggatttttgcaactagtcagaactttattccagaagaaagcagg

SEQ ID NO: 6844697 - DNA, 64 bp, Homo sapiens
gtaattccagctacttgggaggctgaggcaggtgaatcgcttgaacccaggaagcggaggttgc

SEQ ID NO: 6844698 - DNA, 61 bp, Homo sapiens
ctgggccaccgctgacctggagtaggctgagactctagtggccactctgcggaggccccag

SEQ ID NO: 6844699 - DNA, 58 bp, Homo sapiens
ggcagtgccttagaatctgtggtgttgatactgtcacaggctattctgatgcatagcc

SEQ ID NO: 6844700 - DNA, 71 bp, Homo sapiens
ggataccagttagcctctttccccagccctgttctgacagaggtggctggaatagagactgactggtttcc

SEQ ID NO: 6844701 - DNA, 85 bp, Homo sapiens
ctatggctccaaggctccggccctggcgtctgggctcggtcggggacagtttccacgcgaggcggagcctagctggaggtcacag

SEQ ID NO: 6844702 - DNA, 102 bp, Homo sapiens
ctgagagaggagaattgcttaaacccggagtcggaggttgcagtgagccaagatcgcaccattgcactccagcctgggcgacagagcaagactctgtctcag

SEQ ID NO: 6844703 - DNA, 81 bp, Homo sapiens
gcagaggttggattggggtaggaggggatgagtgggctttggtttgtctatggaaaatcttgagctttatccagtttctgc

SEQ ID NO: 6844704 - DNA, 86 bp, Homo sapiens
cccttgcacgctttattggaagctacagttgtcaaaggtacccatgtctacaagtgcttaccaacatgtaggttctgtgttaaggg

SEQ ID NO: 6844705 - DNA, 77 bp, Homo sapiens
gcacctgggcaggccggacgctggggacaatggctatgctctggcgctgcagcccggcctcccgcctgcccgcctgc

SEQ ID NO: 6844706 - DNA, 125 bp, Homo sapiens
ctttcctgctgcttgttcgccgggagccctgagctggagtctgtggctcctcagcctccttgggactctgcagctccggcccaggagtgtctgtctgtggtgatggcatcttggcagcaggagag

SEQ ID NO: 6844707 - DNA, 56 bp, Homo sapiens
ctgaaccactaatattttgattgactcaagtgtcaatcaaagtagtggctggtcag

SEQ ID NO: 6844708 - DNA, 60 bp, Homo sapiens
gttgggctgaagtgtgtgcttataaatgtgtttagtttttaagctaaacattcagttaac

SEQ ID NO: 6844709 - DNA, 60 bp, Homo sapiens
agtctccaactcctgggatcaagggatcctcccacttcagcatcccaaggagctgggact

SEQ ID NO: 6844710 - DNA, 98 bp, Homo sapiens
tctgagaggggaaaattggcaggtgggtggaggtgcgttgagctgcacatggggcccagctgcagctgcctccttcccttgtacttcctctactgaga

SEQ ID NO: 6844711 - DNA, 64 bp, Homo sapiens
ggatgttttctggccacttttccagtgaaataaaatgaatgggaatttagtggcagataatacc

SEQ ID NO: 6844712 - DNA, 55 bp, Homo sapiens
actcatgttttctctagctggaagccctcctggctgccctggccctaacctgagt

SEQ ID NO: 6844713 - DNA, 121 bp, Homo sapiens
cagtttaattggatttgaggaagacagtaatttttttagtgtaagtatatcccatgcaatattagggatatgcttacactacaagatgatttgttgtttatgtgagatccaaatttaactg

SEQ ID NO: 6844714 - DNA, 69 bp, Homo sapiens
gccaaagtccacttgctttctgtacctggaaaatcatccccaccagctcagacagatgtgactgatggc

SEQ ID NO: 6844715 - DNA, 57 bp, Homo sapiens
cctgagtctctactttctcatctgtaaaatggggatgatgacagcatggaccccagg

SEQ ID NO: 6844716 - DNA, 68 bp, Homo sapiens
gacagccaacttctcccacccactccctatctaataaaggaagggatgatggaaagaagcaggccttc

SEQ ID NO: 6844717 - DNA, 112 bp, Homo sapiens
ttccttcgaaggtacttcttctagtctactctttttaagtggaggaagtatgctgcatatcatttcttctgttgaaagggtagagagatgatagagcctgtgattataggga

SEQ ID NO: 6844718 - DNA, 69 bp, Homo sapiens
tgctctgttggttatttgggatgcaaggaacagctgtatacagtctgtcagtcattctaacaacaggca

SEQ ID NO: 6844719 - DNA, 92 bp, Homo sapiens
ttgaagctcagaatggaaaacagaggtttccattgaggtttcagctaaaataaatttaaatttaagcctttctttgccagtttgtgcttcaa

SEQ ID NO: 6844720 - DNA, 69 bp, Homo sapiens
gccagaagcatttcaaggctacagaaaccttagtctaaaacatagtctagctgagcccagaagactggt

SEQ ID NO: 6844721 - DNA, 61 bp, Homo sapiens
gcagagaggagctttcccaggtgcaagccctcagaaaagcctgggagccaagcctctgtgt

SEQ ID NO: 6844722 - DNA, 75 bp, Homo sapiens
atggcacagctcacccatcacgtctgcttcccactaacaagcaagagtgccatgggatgaggtctcctaggccat

SEQ ID NO: 6844723 - DNA, 77 bp, Homo sapiens
cagagtttactcatgcagatgttctgagtcacagcacagttgtcctgtgtcttcacatttgtgtgctattaactgtg

SEQ ID NO: 6844724 - DNA, 61 bp, Homo sapiens
tgtcatgggctcaggtcctggctgtgcgctctccagcacgcaggtacccttgtccatgaca

SEQ ID NO: 6844725 - DNA, 62 bp, Homo sapiens
tgggctagagaggggaaggatgtgatgtgagcagatggttctcactcattctcctctgtcca

SEQ ID NO: 6844726 - DNA, 127 bp, Homo sapiens
ttgccttgattcagaaagataagagggtcagagctttactgagtgacctagaataagttgttacatttctccaagcttatttactaatttagaaaatgaccctctgccctccgttccctacaggcaa

SEQ ID NO: 6844727 - DNA, 65 bp, Homo sapiens
ttctggcatagagtaggtgctcagtaaataactgatgaatgaatgagcacataactctaccagaa

SEQ ID NO: 6844728 - DNA, 95 bp, Homo sapiens
gggggccgtggaccctcctggcctgaagctcactccttccccgcctcctacaggggcaggggagccagggctgcgagttctgtctgtggactctc

SEQ ID NO: 6844729 - DNA, 67 bp, Homo sapiens
ggtgtggctgtgagtttttgatttgctcaatgatataggacttcagcattttaaatacagtcatatt

SEQ ID NO: 6844730 - DNA, 71 bp, Homo sapiens
agttttatgcagtgttctgatatgttatattcattttgcttctaaaaccttctagaatcctgtataagact

SEQ ID NO: 6844731 - DNA, 73 bp, Homo sapiens
tctttcacagacagaataggtacagtcagtcactataaagccttggtgtctgtctgtacctattttttctaga

SEQ ID NO: 6844732 - DNA, 125 bp, Homo sapiens
cgctcgcttattttttgttctagtctctcttgcttcagtttttatacggcttctaaaacgcttcgcatttacaatagtgactgaggtgcccagaggtgactttaattttccattgagctgagacg

SEQ ID NO: 6844733 - DNA, 116 bp, Homo sapiens
tatcttcaaaacctaaaatatagggccttgatcataacaggcgctcaataaatgtatgtagaatgaatgagtgccttttgtatgcaggccatgtatagtattaggttctggggata

SEQ ID NO: 6844734 - DNA, 71 bp, Homo sapiens
gcaggggcggctgggtttccaggggcggcagagccaccaagagcgatggaaacccacccccgagtccctgc

SEQ ID NO: 6844735 - DNA, 126 bp, Homo sapiens
ccgttaccagtcaagcaacattcatcatgttcaccctaaggcttctggagcttgctggctggctgactggctcgccaggtacatttaagaagcctgtgcttggggatgtttcttaactgcagacgg

SEQ ID NO: 6844736 - DNA, 76 bp, Homo sapiens
gagggatagacagctggtagcacttcctgtgtttggcgatccatggagcaggacatctacccagtgtttctccctc

SEQ ID NO: 6844737 - DNA, 69 bp, Homo sapiens
ggtaatcaaggtggcatttaaattaattaagctttttgagtttaaattagaaaatgtattttggttact

SEQ ID NO: 6844738 - DNA, 83 bp, Homo sapiens
gggcaggcggggtagctctgaggccatctccggtaaaactgtgctgggatgcgtcttcccaggctttgttcccttctctgtct

SEQ ID NO: 6844739 - DNA, 87 bp, Homo sapiens
ttccagccgtggcagctacaggtggcaagactgtggggaaatgattttatttgtcttgccatttagtttctcatctgcaaaatggaa

SEQ ID NO: 6844740 - DNA, 76 bp, Homo sapiens
ggagtttccttagcaggacatgtgcagagaagctaaaggaaggctgtttgcttgtcctgttattccctggaattct

SEQ ID NO: 6844741 - DNA, 85 bp, Homo sapiens
tagttccgaaatgaatccaaatctttagaggaggatatttactccacatattctcctctaaagatttggattcatttgggaacta

SEQ ID NO: 6844742 - DNA, 130 bp, Homo sapiens
ctggtcgtcgcccactgctgctgctgcagctcccccgggccccgcagggaaagccccaggaaggtgagcccctggaaggtgagccctgccggcctctgggacctgcacggaactgtactgggggtggagg

SEQ ID NO: 6844743 - DNA, 61 bp, Homo sapiens
atgacacaagcagaggctctaaaagcacttgcttattgagaatcttccctctcttgttcat

SEQ ID NO: 6844744 - DNA, 104 bp, Homo sapiens
taatgttctctccaaacgtggttaatgtacaataagacaaagaggtgattttcagatccttttgttgttgttgttattcaaacctaatgtttgggatttcatta

SEQ ID NO: 6844745 - DNA, 63 bp, Homo sapiens
tttttctatttcctttcccttggagctgcctggtttaagacttaggaaagaggattagggaaa

SEQ ID NO: 6844746 - DNA, 78 bp, Homo sapiens
tgcagactaataaagcagatgcagctaataaagcagctagttgatttggtggctacatttgtaatattttagtgagca

SEQ ID NO: 6844747 - DNA, 87 bp, Homo sapiens
ggcgatagagacccagcaggcaggccccaggcagggggaagaggctgcccttatctggccccaggcagcctgctggggtctgtggcc

SEQ ID NO: 6844748 - DNA, 60 bp, Homo sapiens
caggagccgccaggcacgttggcagggccgaactcacccttcccggcggcggcggccttg

SEQ ID NO: 6844749 - DNA, 63 bp, Homo sapiens
gcatcacagcacacctgacatgtaggtaatatcacttcctgctattctggatgttgttgatgc

SEQ ID NO: 6844750 - DNA, 60 bp, Homo sapiens
tgcagacaagtgcatctaacccaaatcatatccagggccccagctgtacaattgtttgta

SEQ ID NO: 6844751 - DNA, 81 bp, Homo sapiens
tcatcagttcccatcgcatttgagcaatcttttcctaccagggtgggaagatgcaaaatagatgtagtgaatacgagaaga

SEQ ID NO: 6844752 - DNA, 77 bp, Homo sapiens
ctgtcctcctgccatccccttatcccaggctgagccatgtcatgagtggctctaaagggttggacaggtggggacag

SEQ ID NO: 6844753 - DNA, 76 bp, Homo sapiens
gaagtgagattactgggtcaaaaggtccttctgctagtgtgtaacctgggccagctgctcagtgtctctgtgcttc

SEQ ID NO: 6844754 - DNA, 104 bp, Homo sapiens
ttggaagtttgaagatttgggttggtgttttagttcttggcctcaaatcatttgtagaacgaagatggtctagttgaaccatatgaaccccttccagctctcaa

SEQ ID NO: 6844755 - DNA, 72 bp, Homo sapiens
gccccagacgccactcgcggcggacggcggccagttcccaggggtttggagccgggtgcgcaggcgtggggc

SEQ ID NO: 6844756 - DNA, 91 bp, Homo sapiens
ccagatacaagtgaatttaagcccacatgtattgaagctgcaagcttagtttgcaatttatgtgcaagtggttttgtatttattgatctgg

SEQ ID NO: 6844757 - DNA, 55 bp, Homo sapiens
ggtgatccacctgccttggcctcccaaagtgctgagattacaggtgtgatccacc

SEQ ID NO: 6844758 - DNA, 58 bp, Homo sapiens
caggaacctaaagagacattacaactaaacgcaatgtggtatcttggatgggatcctg

SEQ ID NO: 6844759 - DNA, 119 bp, Homo sapiens
gcaaaacactaaggaactgggaggttgaatgacttctttgacatagcacaactggttaacatttgaactagaatctatgtcaggaactcatgcctagtacgtactttctgtttccctgc

SEQ ID NO: 6844760 - DNA, 70 bp, Homo sapiens
gatagtggaggggatgcaaagcttcattgttcttattgaggcaaaggaagtattccttagattcattgtt

SEQ ID NO: 6844761 - DNA, 95 bp, Homo sapiens
gatgctagctcctggacaacatttttccacataccctaggccagaagggaaattgctgccttgtggggaaggatttagtcctggcagaattcatc

SEQ ID NO: 6844762 - DNA, 59 bp, Homo sapiens
gccagattgactaattgaagaaatggggtatatccaaatttgttcaatgtctatttggt

SEQ ID NO: 6844763 - DNA, 56 bp, Homo sapiens
gctgccccagcgccgacccttgcccgcatggcacaggatgatgggttgagggccgc

SEQ ID NO: 6844764 - DNA, 62 bp, Homo sapiens
tactttggaagagttcatacagtgatcccaaaccgtgcattgatggaacagctttgaaagtg

SEQ ID NO: 6844765 - DNA, 130 bp, Homo sapiens
agaatcacctggcagctttcaaaaaactctgatgtctgcccctcacctcctcttgccgaggtccacagaatctccaaggtggggccctggaatcagcattgttagaggttccagtgtgatgccgaagtct

SEQ ID NO: 6844766 - DNA, 76 bp, Homo sapiens
cctcagactcaggggcgggagtgtgccttagaaaaactcctttggggcagttattctgtgcccccaccctctgagg

SEQ ID NO: 6844767 - DNA, 74 bp, Homo sapiens
gttcagatgtcaacactaaagaataatctttgaggctcctagacttaaagtgttttctgatgtgttctctgaat

SEQ ID NO: 6844768 - DNA, 59 bp, Homo sapiens
gtttggtttatgtcagtggggaatcctggttaaacatagggtttggcagcaaatcagac

SEQ ID NO: 6844769 - DNA, 74 bp, Homo sapiens
ccgaagtgcgtatgtccgagcgcgtgtgcatgtgtgtgcgcgtgtgtgcgtgtgtgtatatacacaggcttcgg

SEQ ID NO: 6844770 - DNA, 77 bp, Homo sapiens
cttatctgacatctggacgtgagttctgcagtgagaagatcgcttctttagttttctaggttctattttcagataag

SEQ ID NO: 6844771 - DNA, 70 bp, Homo sapiens
tttaattatttcaggaacatttaaccacagggccagcaggctggatcctgatatgtgtttctcagttgga

SEQ ID NO: 6844772 - DNA, 63 bp, Homo sapiens
cggttgcttgtggtgagagttgcccatcattctgctctggactggcagccaccgcggcggccg

SEQ ID NO: 6844773 - DNA, 55 bp, Homo sapiens
tgagtgggtattttgtttccagctatacagaagttgcataatagctacccactca

SEQ ID NO: 6844774 - DNA, 64 bp, Homo sapiens
tctgaggcctctgttcaccagaattatgcctgcttcctaacacttctgcctccagagctttaga

SEQ ID NO: 6844775 - DNA, 70 bp, Homo sapiens
gtgactgtgttgtagaggacgatgccgggaaggcccagccttgctaatttctcctcaacacacccttcat

SEQ ID NO: 6844776 - DNA, 72 bp, Homo sapiens
gggaacctccatactgtgttccatggtggccgcaccaacttgcattcccaccagcagtgtgcaaggattcct

SEQ ID NO: 6844777 - DNA, 81 bp, Homo sapiens
acccaagacagcaggttgctgttatttttgtagatctctctgattttcaaagttgcatgacagcttatcttatccttgggt

SEQ ID NO: 6844778 - DNA, 59 bp, Homo sapiens
ggcagtgttctaaatcctcgtttattctactcaggacccaccttattaggaacattgcc

SEQ ID NO: 6844779 - DNA, 125 bp, Homo sapiens
tgacatgaaacaaagacaagcacactgaggcatttggcccaggctgcatgagtccatggaagttaattgtttggtgatttcctgtacctgaggcacaaatgcttccttttccaattatagactca

SEQ ID NO: 6844780 - DNA, 113 bp, Homo sapiens
gagtttcatgaacgtcacatgttattttagagtctttagagtcttagtgtttgctggttgaatttactaagccaatgagcattaaatttttacaaggcacgtctgtgaagctc

SEQ ID NO: 6844781 - DNA, 70 bp, Homo sapiens
ggcagatgggagccccaggggagccgattccaacagcagggagctgtgactctcctggggaccatcaacc

SEQ ID NO: 6844782 - DNA, 114 bp, Homo sapiens
ggccaaacctactgagagctaggctgggctggcatggctgttgaagtcagctccacgggggagctgaccttgacgttagcagacggagaccagtcccagttccagggggaggcc

SEQ ID NO: 6844783 - DNA, 63 bp, Homo sapiens
gctcaaggcaggcagacatgagtttccctcctcgccatactcactagtcaagtgcctttgagt

SEQ ID NO: 6844784 - DNA, 63 bp, Homo sapiens
cccagcctctgggttctgccggccaggctcgtggccccgtcctcggcaccccaggttcctggg

SEQ ID NO: 6844785 - DNA, 129 bp, Homo sapiens
gttttttaagtttaaaaaaaaatgtaagtaaccttgcagatgttatcacttagacatgctagttaagaaaaatacagaatgtaaagtgatgatagctaggatatataagaagtacttttgagatgagac

SEQ ID NO: 6844786 - DNA, 130 bp, Homo sapiens
tgtgcaagatgagggagacatcaggagtcaagattggctctgaagtttctatcttagtaaaccgggcgtctgtgatgcttcttgagatagaaacaccaattgactatctgaaagatttccataatgtgca

SEQ ID NO: 6844787 - DNA, 71 bp, Homo sapiens
agtgatcccaccttttggtgttcacatctttaatttcctgtgagtgtggcatacacatgaggtggtttgct

SEQ ID NO: 6844788 - DNA, 76 bp, Homo sapiens
gtctccaggcaccaactggcagtcccaggaagttccttcatcacagggcctgcctggctgccgagtgtgcagcgac

SEQ ID NO: 6844789 - DNA, 79 bp, Homo sapiens
tagatagtaaggcacaatatctgttcagcagtggattcaaatggaaacttccaccaaatagtatatatgcatctgtttg

SEQ ID NO: 6844790 - DNA, 75 bp, Homo sapiens
ttgctatgtgctaagcactacttgtcaatttacgtggcatcaaagattaacaagctgagagctaagcactaggaa

SEQ ID NO: 6844791 - DNA, 65 bp, Homo sapiens
ggccccaggacctccacggtcctctgaatagtgtcagtggcatgagcctagaggtcttatgggcc

SEQ ID NO: 6844792 - DNA, 75 bp, Homo sapiens
tccctaatttgtagtaaagctttatggattgagaattcttcttggagtcaaagagctctatcttcaaaactggga

SEQ ID NO: 6844793 - DNA, 75 bp, Homo sapiens
cacaagcatttagtgcaattcagagaacaatagattctttctgatgtaaaattcttggttgtcatgttgctagtg

SEQ ID NO: 6844794 - DNA, 107 bp, Homo sapiens
gctggggcaaattacttcatctccttagtacttggttttcttctctataaaatggagatattaatcgtacataaggttattgtgaggttgaaaagagatgatccagc

SEQ ID NO: 6844795 - DNA, 129 bp, Homo sapiens
gttttggtttcctcacagggttttctgatttgctgttccctcctccccactgggtgtctgttctggaggccagggtgagaggtggaggaggatggccacgcagatcagcactcggggcagccagtgtac

SEQ ID NO: 6844796 - DNA, 79 bp, Homo sapiens
tgtgggttccttggagtcatgatggaggtggactatatagtcttgtctctggcctctaatgattcacatcattcccaca

SEQ ID NO: 6844797 - DNA, 73 bp, Homo sapiens
tgcctgttttgttcactgctatgatgatgatatttataaaagtgcctggcacatagtaagtacttaataggta

SEQ ID NO: 6844798 - DNA, 77 bp, Homo sapiens
gacctgggatgcagaggcagggctggggagcaggctctgtcttcttggctgcaagtctctgtgtgacatcccaagtc

SEQ ID NO: 6844799 - DNA, 65 bp, Homo sapiens
ttctgttcctactacctggctgtcatgttaccaactgaagctattggtaaggaagtgggaaagaa

SEQ ID NO: 6844800 - DNA, 70 bp, Homo sapiens
tgtttctctagctattcattaaattcctccattatctaaactactggaatttggaatagctgtagaaata

SEQ ID NO: 6844801 - DNA, 55 bp, Homo sapiens
ggggggcccgctgtggggtgtgcacggccacgcccacctcctggcgggcatcctc

SEQ ID NO: 6844802 - DNA, 67 bp, Homo sapiens
taggttagtgtattttcaaatgtagagcattccaagttctacatgttcacatgaatgtactttctta

SEQ ID NO: 6844803 - DNA, 121 bp, Homo sapiens
gactccagtttccatcccaggcccttggggctcacatccttctccaaaactggctccctggcaaggccaggccaggccaggcaggggaaggggcagtctgggcccataactcagccaagtc

SEQ ID NO: 6844804 - DNA, 65 bp, Homo sapiens
ctgagattaagatattgggagttgatggtttctatacattttacttaaatggttctttatctcag

SEQ ID NO: 6844805 - DNA, 91 bp, Homo sapiens
ttgtggtgggggctgttgtttgcattgtaggatgttagaagaatccttcttggacttctacccactagatgccagaaacaccccaccacaa

SEQ ID NO: 6844806 - DNA, 114 bp, Homo sapiens
gaatgcggcatttttgtcattcctccaacaggctttatgtttaaagttaaattcccttaggagcttttaactgaggctgtcgatgggatagaaacaatcagttaatgccatttc

SEQ ID NO: 6844807 - DNA, 104 bp, Homo sapiens
ggaaggcacgtgcacagaggagcctcccacctcttttgaatgccatggactgtgtccgtgttccaagacagggtggaagcctcttctctgcccacaccccttcc

SEQ ID NO: 6844808 - DNA, 55 bp, Homo sapiens
ccttccctagatctcagcgccttcattttagaaatgaaaagttcgatctagaagg

SEQ ID NO: 6844809 - DNA, 55 bp, Homo sapiens
gtgatgtagccctaattctgcagacacttgaatgtagttagtagaaatgcatcat

SEQ ID NO: 6844810 - DNA, 69 bp, Homo sapiens
tttcgctagaaggaacctcctggtgggattaatcatccaaattcccattagaaaggctttctggtgaaa

SEQ ID NO: 6844811 - DNA, 64 bp, Homo sapiens
gctgggcgaggtccctgcatccaaccatcccgattcctgatgctgggttacctaagcctaaagc

SEQ ID NO: 6844812 - DNA, 56 bp, Homo sapiens
tcctgctctgatgggttctcctctgtgcttggtgagaattctccttcagggcagga

SEQ ID NO: 6844813 - DNA, 72 bp, Homo sapiens
ggtgcatggctattctaactcacatgttattaacccatagatttattagtgtgatttgaaataccatccact

SEQ ID NO: 6844814 - DNA, 65 bp, Homo sapiens
gctgaaatagcatgttaataaccagagtagctatcagcacctccttggtcaattgacatgtcagt

SEQ ID NO: 6844815 - DNA, 106 bp, Homo sapiens
gggctatatttcacataaccttgactaacttggcattgaagtttcattggtggggaactagagaaaaatgtcatgccatagaaggaaatgggaagtctgaagaccc

SEQ ID NO: 6844816 - DNA, 60 bp, Homo sapiens
gctgtttctgagtagctaggctggccagtagcaagactggagttcctggttcttaacagc

SEQ ID NO: 6844817 - DNA, 60 bp, Homo sapiens
tttgtagacagaatatcatgttccttgttcccaaggtctagctgaaaagttgtttacaag

SEQ ID NO: 6844818 - DNA, 55 bp, Homo sapiens
gcaaatcaccacctagctggatggtatgaactgctaaccactatggagtgtttgc

SEQ ID NO: 6844819 - DNA, 70 bp, Homo sapiens
gagtggatgtttttatgatgcttgagggcacttaaaaagtttgttctcataagtaatttaaacattcctc

SEQ ID NO: 6844820 - DNA, 62 bp, Homo sapiens
gagttatggtggccatggagagcactgtgatactcagttgctcacccatatctccatgactc

SEQ ID NO: 6844821 - DNA, 59 bp, Homo sapiens
ggctgctcaaggactctgatcgctagatcctttttccagcttcatgtctctgggcagct

SEQ ID NO: 6844822 - DNA, 77 bp, Homo sapiens
gggagttagcaaagaagcaggcaatatttttaacttgtatcatcgggcaggaaaaggccattgtttctctgattccc

SEQ ID NO: 6844823 - DNA, 59 bp, Homo sapiens
ttagttatataactcaggtgggctcagcagcaaggctgggacctcagttatatgggtag

SEQ ID NO: 6844824 - DNA, 55 bp, Homo sapiens
tagcaggcttgtgaatggagcctgtaaatatcaggcttttagacccaagcctctg

SEQ ID NO: 6844825 - DNA, 57 bp, Homo sapiens
aagtgaatggggcagacttcagggtatgagcctgacatgaactttctcccttcactt

SEQ ID NO: 6844826 - DNA, 70 bp, Homo sapiens
ctagttcctgatatgatgggtgattttcaattgtatcttgaaaatgtttctattatatcatgagactctg

SEQ ID NO: 6844827 - DNA, 62 bp, Homo sapiens
ggctggctgtgccctgtactctgggggtgcccgggtgggtctggtggagggtggagtgggcc

SEQ ID NO: 6844828 - DNA, 57 bp, Homo sapiens
gtggaaagccagctctggaagggatggtagaggtcatttaggccagaagttttccac

SEQ ID NO: 6844829 - DNA, 67 bp, Homo sapiens
atatgttatgtgtataggtatgcacacgtgtgtatgcaggtgtgtatatatgtgcacatgtatgtat

SEQ ID NO: 6844830 - DNA, 85 bp, Homo sapiens
ctcaggaggagcagagactctcaggaggtggtagaggccctggaacactgtggtttcttccacttgctggctgcgttttcctggg

SEQ ID NO: 6844831 - DNA, 57 bp, Homo sapiens
gccttaagtctcactccaggtattattacttccatttacagatgaggagaccaaggc

SEQ ID NO: 6844832 - DNA, 129 bp, Homo sapiens
actggaattttaattttcagtgttggtggtacagagatgtggatgagggattgttttagcataagaaattaaatgcctgtcaacatagtctgcagaattaacatagaaaaaaatcatttccagcatttt

SEQ ID NO: 6844833 - DNA, 64 bp, Homo sapiens
gcagttgaagatccgtgaggtgcccagaagatcatgcagtcatcagtcccacggagcagcccgc

SEQ ID NO: 6844834 - DNA, 73 bp, Homo sapiens
agaagccagagtttctgcctcctgggctaaggctctgggctccattcccaggaggaggaaaaagctcgtttct

SEQ ID NO: 6844835 - DNA, 74 bp, Homo sapiens
gctctctgatttatcccattcatagcaagctacatctgtgcaggcagcatagcttagctgtggaggcagggggc

SEQ ID NO: 6844836 - DNA, 91 bp, Homo sapiens
agctgggaggcagaagtgacttggaacagctgaagtcctaaaaaagagccttaggtctgatttccattcagtcgtgttggcctcccttgct

SEQ ID NO: 6844837 - DNA, 59 bp, Homo sapiens
gccctggggcgggcggaaggccgggtggtggggccggcctgagagccctagccaggcgc

SEQ ID NO: 6844838 - DNA, 68 bp, Homo sapiens
gggtacttatgcacaacatgcaggtttgtgacatatatatacatgtgccatgttggtatgccgcaccc

SEQ ID NO: 6844839 - DNA, 74 bp, Homo sapiens
ttagcatgtgtgattacagcttcagaatgcttttaatcaataaaagttggattagttgcaatagcagatgttag

SEQ ID NO: 6844840 - DNA, 72 bp, Homo sapiens
actcttttcatccatagtttggttggactatatattcatatattccttctattctctgtgggtaaggacagt

SEQ ID NO: 6844841 - DNA, 83 bp, Homo sapiens
cagcaagtctcttctgagctccctggtgtgcccacctccatgtgaacttcagtaagggggatacaaagggggaagagattctg

SEQ ID NO: 6844842 - DNA, 73 bp, Homo sapiens
ttgtttccataataactgacttgtataaaggccatttttaaaggccattacaggacagatgtttacaggacag

SEQ ID NO: 6844843 - DNA, 88 bp, Homo sapiens
tttcaaagggtttttaggaaggagacagctgatgactttgtcagtcaaacagcctcctgttctaaaagaagccaacaaaccattgaag

SEQ ID NO: 6844844 - DNA, 60 bp, Homo sapiens
agtactgggaatggagcctgggcctcggcaccatgcctagggccgccactttccagtgct

SEQ ID NO: 6844845 - DNA, 66 bp, Homo sapiens
tgttttttgggtgtatatcttctctgtaatacaggggagtggattatgtggacccaacagaagaca

SEQ ID NO: 6844846 - DNA, 126 bp, Homo sapiens
gcaaatgaggtccattacaggagcattccacatcttcttaactccaaagtgtgacacttttaggcactatggaagattttgagagataaatttggggcttgctccagtaccctttaaatcacatgc

SEQ ID NO: 6844847 - DNA, 72 bp, Homo sapiens
caccaccacacccagccatgttcagttctctagagtatatacctagaaatggaattgctgggtcatatggtg

SEQ ID NO: 6844848 - DNA, 85 bp, Homo sapiens
ccagctggtcccttctgatctcagctgcctctccctggaagatgtagatctccttgtgctgggccagcttcagtggggctactgg

SEQ ID NO: 6844849 - DNA, 87 bp, Homo sapiens
gggccctgtgctggaatctatctaagtctagctgtttaataatcactcagacagctaattagaaatagattattggatactagctcc

SEQ ID NO: 6844850 - DNA, 62 bp, Homo sapiens
gggggctgcctgttgcccacctgataaagcccaacccccagggctccatgcacatagccccc

SEQ ID NO: 6844851 - DNA, 129 bp, Homo sapiens
attaaagtttaaatgtgaattttgttactattaaagcctttgcttgatccttgaaattgtcaacattttgatacttctctgaggtaggtaaaaagttttaggacttttctttatgtatgagttttaatt

SEQ ID NO: 6844852 - DNA, 69 bp, Homo sapiens
actgcccagtgattggtggttatcaaatcatgcttcttagactagctgcttagaaatcactgagggggt

SEQ ID NO: 6844853 - DNA, 79 bp, Homo sapiens
attctgtccaagaagattaatgagaaacctgctggggctctcaggaagagtttcttcattgatttacaaaaggcatgat

SEQ ID NO: 6844854 - DNA, 73 bp, Homo sapiens
tgagcaacattgagtctaagtaccaatcaagggatagaaagcctggttcttagacttcatgtctcagagctca

SEQ ID NO: 6844855 - DNA, 68 bp, Homo sapiens
acacttctaatcagaaggtctggtcttgagctaagatatgaattttaactagctttctggagaagtgt

SEQ ID NO: 6844856 - DNA, 63 bp, Homo sapiens
gtggacctgctggatgggcaggtagtatagacagggtggatctgctagacaggcaggtagtat

SEQ ID NO: 6844857 - DNA, 65 bp, Homo sapiens
tctgattatgtttccaactttccatggatgtcatatgcattgatgggaatggctaaactttctga

SEQ ID NO: 6844858 - DNA, 62 bp, Homo sapiens
cacctcatctgtcatcctagggaatgccttaatttattcttgtaatttggagaaatgaggtg

SEQ ID NO: 6844859 - DNA, 85 bp, Homo sapiens
ctgatgggctatggttttgcttcctgctaaggctgcctggatgatctggccctggggcagggaagccccaagagccttgagtcag

SEQ ID NO: 6844860 - DNA, 73 bp, Homo sapiens
tatcaaattagtaagttactcttgggctattttaacatttaaaaagcaatgcagtggcttaaggaaaatgata

SEQ ID NO: 6844861 - DNA, 69 bp, Homo sapiens
gggctggtcagctgcgagatgcttggaggtgttgaaacaaccaggccagcgctggctggaggccagtcc

SEQ ID NO: 6844862 - DNA, 60 bp, Homo sapiens
accggagtctagaatgtgctgacccagctcaatgtgcagaggtggcaggtagactcaggt

SEQ ID NO: 6844863 - DNA, 96 bp, Homo sapiens
ctgatgacatcacttggaccctttcacagctgctggggtaaacagaccccacacaagaagtgatggaaggagccagtccaggctgattggtctcag

SEQ ID NO: 6844864 - DNA, 57 bp, Homo sapiens
aggcccacagtggctcccgcggcctgtctgccggctggccgactgccttgtgagcct

SEQ ID NO: 6844865 - DNA, 57 bp, Homo sapiens
aatttctggatgaacctggctttggaaggtactgtgctgtaggtttttccaggagtt

SEQ ID NO: 6844866 - DNA, 68 bp, Homo sapiens
tgaggtacgaaatacactgtacttaaatttcctgtcctggatgtgaatatatgtgtttttctgcttca

SEQ ID NO: 6844867 - DNA, 66 bp, Homo sapiens
ggtgggagcagttcaggtgtggctgatttgggtttgacagaagccgtacggatgctgtttctttcc

SEQ ID NO: 6844868 - DNA, 61 bp, Homo sapiens
agcttgcacatggctgctttctcgctgtgtccttatatgggattttctctgtgtgtaagct

SEQ ID NO: 6844869 - DNA, 63 bp, Homo sapiens
tgacacagaaattaagctgtcaacatcttgatcattcaaaagcggtcattgatctttgtgtca

SEQ ID NO: 6844870 - DNA, 62 bp, Homo sapiens
tgccatgaagagaggaagcagtgatgtcaggctcataggatccctgctccctccttctggca

SEQ ID NO: 6844871 - DNA, 80 bp, Homo sapiens
gacgaaagaaagattttatctttgtgtgcagtattttatcttgaaaatatgcccaaatgatgagattatatacttttgtt

SEQ ID NO: 6844872 - DNA, 72 bp, Homo sapiens
ggtgctgacaaacaaggtggtgtcagttatggcactggccatctttctgagacccttagtctttgtcatacc

SEQ ID NO: 6844873 - DNA, 79 bp, Homo sapiens
ggctgggccagggcctgtggacacgctgcctttccacatgacagctgtccacccatccacaggccctgcttcccctgcc

SEQ ID NO: 6844874 - DNA, 57 bp, Homo sapiens
gcagagcatttgggttactgcttttactctttggaagctgttatcatctgtatctgc

SEQ ID NO: 6844875 - DNA, 84 bp, Homo sapiens
caaatgtctggtaaacataacgtgtccttcatgatacattgctatctgtaaaaatggctgtgtcctgcggactatcaggctttg

SEQ ID NO: 6844876 - DNA, 63 bp, Homo sapiens
aggtggctgtggcttcccttgtttgcaagatctctagcaggggagattgcatagccctctcct

SEQ ID NO: 6844877 - DNA, 93 bp, Homo sapiens
ctaactccatttcagatttgtatactgacttttttgtaggcccattcccttgtgctttcaaaagtaatcagtattagattcccatggcattag

SEQ ID NO: 6844878 - DNA, 85 bp, Homo sapiens
gagtcttgctcatcacccaggctggagtgcagtggggtgatctcggctcactgcagcttctgtctcccgggttcaagcaattctc

SEQ ID NO: 6844879 - DNA, 57 bp, Homo sapiens
ttagtgatgaagaattactaggagttactcatgagttactatgatcttcatgactga

SEQ ID NO: 6844880 - DNA, 93 bp, Homo sapiens
tctgctgctgaaggcttttaattctttggacaataagtggtgctacactgggcacaatttggtgctaaagaaagaaagttatttgtaggcaga

SEQ ID NO: 6844881 - DNA, 75 bp, Homo sapiens
ggactgtgccaggcctcaggagtctccaccctctccagttttggggccgtcagtctcctgggcctgcaattatcc

SEQ ID NO: 6844882 - DNA, 76 bp, Homo sapiens
gggctgggccatgtgtccctcttcagggcttctagatggccacaggaatcctgaagaggagaccgcgcccacgccc

SEQ ID NO: 6844883 - DNA, 56 bp, Homo sapiens
ctatgcttcagagttccaggtgtcattgctgatgggatcaggagcggggagtgtgg

SEQ ID NO: 6844884 - DNA, 69 bp, Homo sapiens
tatcctcagagtttaagatgtcagacctgggatccagccccaactctgtcaattatgggctgtgggatg

SEQ ID NO: 6844885 - DNA, 64 bp, Homo sapiens
ggtcaggaagctgaagtgcaaggcttggcccttgttcagcccccccagttccagcttcttgacc

SEQ ID NO: 6844886 - DNA, 57 bp, Homo sapiens
gccttgggagaaattgcagagtctggcttgaaagggacatgtgagtctcccatgggc

SEQ ID NO: 6844887 - DNA, 61 bp, Homo sapiens
cagcttcctgccttgatccagagcttgcacccgtggcagggctcccttgcaaggagggctg

SEQ ID NO: 6844888 - DNA, 102 bp, Homo sapiens
gaagatagaaagcaagtgtgcttactttacgggatcatagacttcaagatagaaaaaggaatcagtgatcctataaagtgagcacacctgctttctaccttc

SEQ ID NO: 6844889 - DNA, 64 bp, Homo sapiens
tcctttgagggtgtgatcaatgccatagcgacatgaagtaaatatggctcaggccatcaatgga

SEQ ID NO: 6844890 - DNA, 72 bp, Homo sapiens
gtggccttttcaagtagggtatcatgtagtattctgcaggtttacagtcagtatcctgcaaggaaaggtgac

SEQ ID NO: 6844891 - DNA, 59 bp, Homo sapiens
ctgattctgtctctcgggcctttctctctccttctgccgggaagcctgggagggaacag

SEQ ID NO: 6844892 - DNA, 57 bp, Homo sapiens
tattaggtaagtatttgtggtgtttttttccatacaaaacaagtcacttacttagta

SEQ ID NO: 6844893 - DNA, 86 bp, Homo sapiens
gaaaatcttcccagagttggtagaccattatgtgagctttcaaagagacaaggcggaaattgggtttcctgcattgggaaattttc

SEQ ID NO: 6844894 - DNA, 57 bp, Homo sapiens
tctagaatttgcgtaggttagatgctttcagcagaaagagctatgtaaatatctaga

SEQ ID NO: 6844895 - DNA, 97 bp, Homo sapiens
cataaaagctaatgcataatcgaggaatgtaaaaaattcggcatcatagatttaaatgatattggattgagacattttagaaatgtaagattttatg

SEQ ID NO: 6844896 - DNA, 85 bp, Homo sapiens
ctttccttcagtagttaggagcaaaataagatagcagcagcatctgcagtcttaagcccctctttttattggtgttggaggaaag

SEQ ID NO: 6844897 - DNA, 65 bp, Homo sapiens
gtgtctgtaagccagatgtggcttgttaactttgttaattggtaacctctggactagacagaggc

SEQ ID NO: 6844898 - DNA, 59 bp, Homo sapiens
gattacagcctggcttcccaccagggactcctctgagtgagacaccaaaggctgttgtc

SEQ ID NO: 6844899 - DNA, 60 bp, Homo sapiens
ccgttgcttctcttaagtccagctggaagtacattcatctggcaaaaaagagaggggagg

SEQ ID NO: 6844900 - DNA, 67 bp, Homo sapiens
gaattttgggcttaccgcttatggattttggtccctcagtctccgttgacttggaagccctgaattc

SEQ ID NO: 6844901 - DNA, 96 bp, Homo sapiens
cgctgcctgcagtaaattgctgatgcctgaacttgaatatcaggatcacctgaagttctacaagcctcaggttcctcagttcagtctgcgggcacg

SEQ ID NO: 6844902 - DNA, 81 bp, Homo sapiens
attttagctgggcatattgatgtctggaacaaaagtctgtattttcctacctcttttgtgcatgggtatggccaatgagat

SEQ ID NO: 6844903 - DNA, 89 bp, Homo sapiens
cccatggccactccctcactctttctttcttggagtctgggattcctctctgtttctataaagacaagagttttcagagtgtttatggg

SEQ ID NO: 6844904 - DNA, 78 bp, Homo sapiens
ttattatctccattttacagattaaacagcgaggcatacttgtgcctcagtgtttaatctataaaatggagatagtaa

SEQ ID NO: 6844905 - DNA, 74 bp, Homo sapiens
acacagacatcatcctcagcttcccacgtgtgcaacccagcatcagtggagctaagcatgagataaaattgtgt

SEQ ID NO: 6844906 - DNA, 130 bp, Homo sapiens
gctgcacactcagggccttgttgaccacgtcctggggcggcaccagggcctggtgggtcagcacggtaggcgggccctgcagccccagcaggtcggtgctgcctgggaagagggcttggggccccgcagc

SEQ ID NO: 6844907 - DNA, 129 bp, Homo sapiens
gaagttgtggggattaaatatgataaatggaaagatacacggtcaactctcaagcattgtagagatgttagattgtattatgactgtgactgttattcctcaagtgtcagcttacttttaaacagcttt

SEQ ID NO: 6844908 - DNA, 58 bp, Homo sapiens
ggggggtgctgatcagtggagcttagaattactttacacacacatgcctacacccccc

SEQ ID NO: 6844909 - DNA, 55 bp, Homo sapiens
tcgtgctggatatagggctctagataagttcttaatgatgtcctccatagtacgg

SEQ ID NO: 6844910 - DNA, 83 bp, Homo sapiens
ctctggtccattctctccctgaagcaaagcagcccggggactcctctttcaaatgtcctttagggagtgggtgtgggcctaag

SEQ ID NO: 6844911 - DNA, 59 bp, Homo sapiens
gattcacaactgccctgaaggggtggcatcggcccctttacacgtaaggctgttgagtc

SEQ ID NO: 6844912 - DNA, 65 bp, Homo sapiens
cagtgggaacacaaaagcatattactttggatctatttattgtatgcataattgtgtattcattg

SEQ ID NO: 6844913 - DNA, 60 bp, Homo sapiens
aggggagcaaggccgtggtgtaataatctctttgagatttaccagaagtcttggtctctt

SEQ ID NO: 6844914 - DNA, 83 bp, Homo sapiens
tcctaagatagagaatgagggactatcataaaagaattattgctcagggatacttcttcaaagtccttattcctttcttgaga

SEQ ID NO: 6844915 - DNA, 93 bp, Homo sapiens
gctgagcggccagcatggcaagaccaactgcatttccagctttcttcttttctttgtggacattggcagttgggtttgaactgtggccctagc

SEQ ID NO: 6844916 - DNA, 58 bp, Homo sapiens
ttgagagaggaaacatagtctcagcagccattagtggagactgagtgtagctgctcag

SEQ ID NO: 6844917 - DNA, 69 bp, Homo sapiens
gtgttcaaagttaatgatgaagtctggctgtacaaccttgtatgcagattattattattatttgtccac

SEQ ID NO: 6844918 - DNA, 68 bp, Homo sapiens
ggtgaaagggtcaaggctacatggagacccagacccaggtgaggtctctgatgctttgaccactcacc

SEQ ID NO: 6844919 - DNA, 61 bp, Homo sapiens
atggatgttatgagcattgatataagatgttaatttacattgttcactcatagacatctat

SEQ ID NO: 6844920 - DNA, 65 bp, Homo sapiens
ctattgaagtgtgggaagtaggtggcgaggactgaaagacctgtcattttccaccatttttgtag

SEQ ID NO: 6844921 - DNA, 104 bp, Homo sapiens
ggggcacattttctcctcattgttcctcttttttcaccgtggatcttcatgaaattccactgtaagcaaatgaatctcaggaagatctctgcaggagctgctcc

SEQ ID NO: 6844922 - DNA, 71 bp, Homo sapiens
ggggtgtccagcgtggaatgagggtgtgcagggccaaggctgcagagacccagggaccccgctgacgcctc

SEQ ID NO: 6844923 - DNA, 55 bp, Homo sapiens
cagaacagaatcgtgtggtgaggccttctgcttctgccaattttgttttgttttg

SEQ ID NO: 6844924 - DNA, 78 bp, Homo sapiens
tgtcactgccctgttcctgcctccagctgttaggccatagccactgccatagttgggaagagctggaacaggttgaca

SEQ ID NO: 6844925 - DNA, 60 bp, Homo sapiens
gattttcattatagctagtttcaaagtgcttgaattgggattagttacttagtgagagtc

SEQ ID NO: 6844926 - DNA, 82 bp, Homo sapiens
gagcagccataggtcagagccacagtgaagctctggcttagtgcaaacttctgctttactgggcattagcctgaggctgctt

SEQ ID NO: 6844927 - DNA, 85 bp, Homo sapiens
gagtgttttacagatctgttgatttgtttccagggcagccagatatctgccacacagcaatcttagcagaaatgtagaatgactt

SEQ ID NO: 6844928 - DNA, 63 bp, Homo sapiens
cattcaggtctgtttccatcagtgctttgttctcaaatattagcccttgttatagaccgaatg

SEQ ID NO: 6844929 - DNA, 99 bp, Homo sapiens
tctccctattgcccctcctccttgcctccttcttaatggtgaacatcgtttttctttctacatttgaggagagtcaggcagagggctgagttctggaga

SEQ ID NO: 6844930 - DNA, 59 bp, Homo sapiens
tcatgtccctgtccctggtttcagatacaaatcactcttatcagaggatagggaagtgg

SEQ ID NO: 6844931 - DNA, 77 bp, Homo sapiens
tcagctaccgtgcttgcacagggctggaatgtccttggtataacaagacatgcaataatgtgcactcatgtagttga

SEQ ID NO: 6844932 - DNA, 61 bp, Homo sapiens
gtgacagagctgggatttgaagccaggtgtgtccagctttagagtccttgctcttattcac

SEQ ID NO: 6844933 - DNA, 83 bp, Homo sapiens
cagcacccccacacaattttccagagtgctttagcgaattgagtagaggctgctagttctctgtattgtgtaagggctgactg

SEQ ID NO: 6844934 - DNA, 94 bp, Homo sapiens
gtctcctttggcttcttctgatgctcctcttctcccactgaatgcaggaaaactcacctccatcagagtgaggagggtaaggattgcctgagat

SEQ ID NO: 6844935 - DNA, 55 bp, Homo sapiens
cccagtgctaagtcccgctggtgataaagaggacacatagtggaactgctctggg

SEQ ID NO: 6844936 - DNA, 78 bp, Homo sapiens
ttagcaaaatatgacatgtgatctcaagaggttcccaaagcagaacctttagtccatttagtgtcattcttgtgctag

SEQ ID NO: 6844937 - DNA, 92 bp, Homo sapiens
ctgtgccaccaggggcctgtccacctcagagacctctcaggtgcagctcagctgcatccacagggggtcctgagtccctaggccctgcacag

SEQ ID NO: 6844938 - DNA, 75 bp, Homo sapiens
ccttagacttgggtggattgtgactctggccagtggcaatgaccaatacacattatctctatctacactttaagg

SEQ ID NO: 6844939 - DNA, 82 bp, Homo sapiens
gcccaccctccaagctgctctggaccaagtcctgtggtgaggctgaaactcaagggctcctgtgttcaggcaggacctgggc

SEQ ID NO: 6844940 - DNA, 55 bp, Homo sapiens
ttatggttcaggtgagggtgtacaagtcaggtaaataggagtatctggatcatga

SEQ ID NO: 6844941 - DNA, 72 bp, Homo sapiens
gtgtatgtgtgtgtgtgtaatgtttctctcttctgtgcgagagaagagagaacattacataaactataacac

SEQ ID NO: 6844942 - DNA, 71 bp, Homo sapiens
gaggtgcagaaaaaagtcctttaggaggaatgactcttacaaaaataaggctttacctctttctccacctt

SEQ ID NO: 6844943 - DNA, 63 bp, Homo sapiens
agttaggaaaagatatgtagtcattggaagatatccagaatacatcaatctattttctgcact

SEQ ID NO: 6844944 - DNA, 68 bp, Homo sapiens
atatggggctaaacacgcctggccttacagtgctcctcaggctcaaggtcttgtcttatgccccatat

SEQ ID NO: 6844945 - DNA, 101 bp, Homo sapiens
atggcgaaagaaaagaacaaactttaaaaatgtcttttaaatgttgaggtgatttcattgaagattatgtctaaaagataaagtttaactttggcgtccat

SEQ ID NO: 6844946 - DNA, 64 bp, Homo sapiens
cttctgtatttcttcaggttcttctaggaaatggttcttctggttttactgaggaaatcagtcg

SEQ ID NO: 6844947 - DNA, 67 bp, Homo sapiens
tggtgtggtccagtgacatacttcaaggtcactcttcctgtggtgtgcaaaagggacagaagcacca

SEQ ID NO: 6844948 - DNA, 73 bp, Homo sapiens
tacaggatggggtctaaataagagctgctgaaactgagtattttgatagctcttgccagatcctcgatctgta

SEQ ID NO: 6844949 - DNA, 97 bp, Homo sapiens
tatcaggccccacaccagaccatttgaatcaggatctcgggggaacctgacctccaagtggctctggtgttccaaagcttcccaggggcttctgatg

SEQ ID NO: 6844950 - DNA, 62 bp, Homo sapiens
gagcggaagaagggtgttcttgggacatcaaccccaaggtatttcaaagcccacttcctctc

SEQ ID NO: 6844951 - DNA, 57 bp, Homo sapiens
agttcgtatttattgagtccctgctgtgagcccagcagatgcgtctgagtgggagct

SEQ ID NO: 6844952 - DNA, 74 bp, Homo sapiens
tgtatttctgttgctgagtttgcccacttggggagggttgacacctcctggggctgtgctgagtaggaggtgca

SEQ ID NO: 6844953 - DNA, 59 bp, Homo sapiens
ctgaagtcagatggcacaaggtcagattctattctacctcttaccagccctgacttcag

SEQ ID NO: 6844954 - DNA, 95 bp, Homo sapiens
ctattgcattcttcagcaaactatttctaggacaaagtactaggaatctgacataaagtacactgttcctgaaattgttatgatagatgctttgg

SEQ ID NO: 6844955 - DNA, 78 bp, Homo sapiens
tggctttctttagttagtagataatggcaactgaataaattaattgctttccctgcctcttgctgctactgaagacca

SEQ ID NO: 6844956 - DNA, 76 bp, Homo sapiens
gacggatcagtgttcagggaccaggtcccagggctgtgaatgtgcccataggatttgatgtttgcgcactgacgtt

SEQ ID NO: 6844957 - DNA, 63 bp, Homo sapiens
ctgctgctgcctggctctgggaggcctggaaaggccctgagcctcttgcacgctcagaggcag

SEQ ID NO: 6844958 - DNA, 85 bp, Homo sapiens
gcaacgtgagtgtacatgtttcctatacctatgccagcaatatgtttcagctgttggctatagagtcatgtttactctaatttgt

SEQ ID NO: 6844959 - DNA, 67 bp, Homo sapiens
ccccaaagtatattggattgaatgggttgttgtcaactggcaccatcagctccagtatcttctgagg

SEQ ID NO: 6844960 - DNA, 73 bp, Homo sapiens
ggcttcttctttctcaaacccccagaggcagtctccaaccattgaatccatggcctgagaagcgggagaagtc

SEQ ID NO: 6844961 - DNA, 60 bp, Homo sapiens
atttgtcccattgaccccaaggtaagtcacatgaccaagcccaagatcagtggggcagat

SEQ ID NO: 6844962 - DNA, 57 bp, Homo sapiens
ggaatgggtagagggtatttgttgtttcacagagaacagcaaactcttcccatcttc

SEQ ID NO: 6844963 - DNA, 85 bp, Homo sapiens
ggcacctttcttttctttcatattgtccagtcagcgcttttaaaatagaaaagcgggaagtaccagtagaaaaaagattagggcc

SEQ ID NO: 6844964 - DNA, 92 bp, Homo sapiens
gagcaggacgtgttattgggttgactttgtaaagattgttttactgtaactgtagtcattttgaaaagcatttgagtaactacattatgctc

SEQ ID NO: 6844965 - DNA, 70 bp, Homo sapiens
gaagaaagcatctgtgtttctagctaggaaatcgattatttcagctaaaggaaactcagatattcgtttc

SEQ ID NO: 6844966 - DNA, 81 bp, Homo sapiens
gagatgttgtagccatttttattaatgctggagaagagatggtgtattctttagaattatggaaagtgagcaaaacgtttt

SEQ ID NO: 6844967 - DNA, 83 bp, Homo sapiens
gcagggagcagacggctcggggaccctggtgagcaggcctggggagctggtgaccatggtgtgccctgtgcggggctccccgc

SEQ ID NO: 6844968 - DNA, 64 bp, Homo sapiens
atgtccatgctttgctccagaaacttttctttaacacgagaaggttttggcttaggtgggatat

SEQ ID NO: 6844969 - DNA, 73 bp, Homo sapiens
gtccttagaggccctctctgctcagtctaggtcttaaagctgagatcaaagcacaaggggcaggactagggat

SEQ ID NO: 6844970 - DNA, 62 bp, Homo sapiens
tcaggggttgtccagttgtttgaccacggcccagattcccgggccaattggggggcccttga

SEQ ID NO: 6844971 - DNA, 84 bp, Homo sapiens
gccgctggtgtttagtgcttaggaaatggggaaatggccatgtcagaggtcccacagcatgagtaactctcaaatgccagtggc

SEQ ID NO: 6844972 - DNA, 95 bp, Homo sapiens
gataattgtctgattatttatttttcaattgtaatgatagtaattttgctattaattttgggacgattgaagaatagtcttaaccaccaattttc

SEQ ID NO: 6844973 - DNA, 84 bp, Homo sapiens
actagttattttttaaagcatgttgcttaacaggcacacacattgtgaacattttttttaagttgcatactttaagggattagt

SEQ ID NO: 6844974 - DNA, 55 bp, Homo sapiens
cctgtccagaatttttgcaaccggaaagagggcaaagaacatcggagtgggcggg

SEQ ID NO: 6844975 - DNA, 62 bp, Homo sapiens
ggattcccaggttccaccatccagggattctaattcatgggataagttgggacctggcatcc

SEQ ID NO: 6844976 - DNA, 55 bp, Homo sapiens
aatgtcctttatgaaatggtgttttcaaaacacattgaatttcataggggaaatt

SEQ ID NO: 6844977 - DNA, 85 bp, Homo sapiens
ttgttaaatttgtgacaccattgacagtgttaaagttgcctggataccatcaacacatggacagtgttaaaggtgcaattgacag

SEQ ID NO: 6844978 - DNA, 56 bp, Homo sapiens
gtggccttaagaaacaaacaacaacaacaaaagtaatgtgtgtttaaagaggccat

SEQ ID NO: 6844979 - DNA, 67 bp, Homo sapiens
gctctgtgtaaatgtagggtccagattgggtttcagcaaaacactagccctgcattaacatccaggc

SEQ ID NO: 6844980 - DNA, 58 bp, Homo sapiens
ttttcatgccaatccttagctctcgtgaatacagatcatgaagctctggctaggaaaa

SEQ ID NO: 6844981 - DNA, 68 bp, Homo sapiens
aggtatattctggtggaaagagaatggggagtccttgtctatgaaatgctttttagcagggtacacct

SEQ ID NO: 6844982 - DNA, 55 bp, Homo sapiens
ctttagctctccgttttgtcatccccagttggggcgtcggtcaggagagctggag

SEQ ID NO: 6844983 - DNA, 64 bp, Homo sapiens
gcctctaaagtcacgatttgtgggtatccgagtctctctgcctctaaagtcatgatttatgggt

SEQ ID NO: 6844984 - DNA, 59 bp, Homo sapiens
tcttccatttcttgccctgtctccatggaccaaactcaactggcagcaagaagggaggg

SEQ ID NO: 6844985 - DNA, 126 bp, Homo sapiens
ccagggaagctgtggtacttggctacaagtgagagagaaggaggtagcagttgaagtaagtctctgccatcagtttttctttgccttgaatgcttattccatgagttttagcagtttaatccttgg

SEQ ID NO: 6844986 - DNA, 61 bp, Homo sapiens
gtgatgcccagaaccccctggatggaggggagaccccaggcagaggggtctggagcaggac

SEQ ID NO: 6844987 - DNA, 78 bp, Homo sapiens
ttgctgtagattgtgggatattgactgaagtaccagattctgaagtagaaaaatgaggtcaatatccttttctggcaa

SEQ ID NO: 6844988 - DNA, 57 bp, Homo sapiens
tctggcttgaacaattaggtaaatgttggtatcatttactgaatgggacaggctaga

SEQ ID NO: 6844989 - DNA, 65 bp, Homo sapiens
tgtgctttagcttcatcttcaagctgggttgtaaactctttgaaagaaggagctgtgtcttcata

SEQ ID NO: 6844990 - DNA, 109 bp, Homo sapiens
ctggatttggatgagcagagaggagtccctatcacagttcactaaattaaataaaattttggttgacatacaggtatttttttctgtcttaacatttaaaaaaatccag

SEQ ID NO: 6844991 - DNA, 70 bp, Homo sapiens
ctctaactctcctacttaagacagctttggagtttggactcaagcagctgttgctgggaggagagaagag

SEQ ID NO: 6844992 - DNA, 57 bp, Homo sapiens
aagatgcatattcccagacctcacgcccagagagtctgggcaggaatctgcattctt

SEQ ID NO: 6844993 - DNA, 97 bp, Homo sapiens
tcccagcagcctccactgtttcaggatccagccagggtggagttctgggggccagaaattccaaagggctgggtgactggaagagagagtttaggga

SEQ ID NO: 6844994 - DNA, 59 bp, Homo sapiens
cattcaaatgtgccactgtcctcattatggagctcagatggctgaggatatagtggatg

SEQ ID NO: 6844995 - DNA, 67 bp, Homo sapiens
gttgcaaagcgtcttcaatatgtgtttaatattgtacaggcaatcaaaggatgtgaggacttgcagc

SEQ ID NO: 6844996 - DNA, 92 bp, Homo sapiens
gctctaaatggttaaaaatatgtttatgttgggctatatttaaagcaatttaaagatgtgtaagaaataaacaacatggggctattttcagc

SEQ ID NO: 6844997 - DNA, 55 bp, Homo sapiens
aagctatgacctgccagctttcaggatgacatccaagaggcagtagtcaaagctt

SEQ ID NO: 6844998 - DNA, 73 bp, Homo sapiens
gcagatcccagctgtgaagaggccactgcatggctgacacaaaacacctcttggccattcacaggggccctgc

SEQ ID NO: 6844999 - DNA, 72 bp, Homo sapiens
ctgccttgatccacagctgcggtaggagacgaggaccgtgactgtctccttccagtctggggtaccaggcag

SEQ ID NO: 6845000 - DNA, 66 bp, Homo sapiens
ccctaagtcctgtgcccatatcttagcttccagatataatgtggctgtgaagtagcaggggcaggg

SEQ ID NO: 6845001 - DNA, 90 bp, Homo sapiens
tacctgtccagggaagtagaggtcattctgaatgcacaaaacgcagcaacagtagtcaggttctcacagctcttcttcctatgataggta

SEQ ID NO: 6845002 - DNA, 96 bp, Homo sapiens
caagggcaggtcactgcaggctgctcaagacttagtgaggagaccagccagtgctcactaaggactgtggcgcctgccgtttgtgcctgtcccttg

SEQ ID NO: 6845003 - DNA, 105 bp, Homo sapiens
ggtgaggcaggtgccctggggcaggcgcacagtcacctgctcaggtgtccgggacactagtgtgaagctgtaggcatgggcagcgtgcaccagggcggcctcatc

SEQ ID NO: 6845004 - DNA, 72 bp, Homo sapiens
ggcagatgccctgaaagattcaaaggctgtctgtaaatggagaatgcctttattgtttattcagtgcctgcc

SEQ ID NO: 6845005 - DNA, 87 bp, Homo sapiens
ggagttgtgtgctcaggacttcattacctcaggtggtctgagtgcagatgactgatgtaaatgaggtctgcctggcacagcctctcc

SEQ ID NO: 6845006 - DNA, 81 bp, Homo sapiens
agagtcagttaagttgaaactagaaaggcaaatgtagacccaatctattctgttgcgggcctttagttcttgacagacttt

SEQ ID NO: 6845007 - DNA, 69 bp, Homo sapiens
cctgaagtctccaatgttgtgctgagcccaagggttctctggctgtggctgacattgcagacactcagg

SEQ ID NO: 6845008 - DNA, 130 bp, Homo sapiens
cagctgctaatgggtggagaccccctcactcccaccccacttcctgcctgctgatgctgcctgagagcttcctggcagtttctcaggcaggggtatggggaaggaggggggccctactcacctttagctg

SEQ ID NO: 6845009 - DNA, 68 bp, Homo sapiens
tgagtccttggtgcaatgtatactgatgaaagaaaattaatcagctaatacattctattaagcattta

SEQ ID NO: 6845010 - DNA, 87 bp, Homo sapiens
catttctcatttctcctccctaactcatgatgagtggtaggcctgatcccatcagccatgagtggggagggctgagctgagggcatg

SEQ ID NO: 6845011 - DNA, 76 bp, Homo sapiens
ctatggatgcctttctaggaatacactttccggggttccttttttccctgagatgtgaatttcagagcttccaaag

SEQ ID NO: 6845012 - DNA, 69 bp, Homo sapiens
tagagagacacctacacacatacatatacacatgtattatgtgtatgtatataggtgtgtgtctctcta

SEQ ID NO: 6845013 - DNA, 77 bp, Homo sapiens
ctggatacttatcatgacttcaagcatccaggactctgtcctgggtatcctgagcctgagtgtgtatgtgtgtccag

SEQ ID NO: 6845014 - DNA, 126 bp, Homo sapiens
tggggtggcctgagacttcagagcacaaatcacatctctgagggcgtcctttagggtgatgactacattaaccacagagccccctcagatggctgtgttggtttgaagaagtcagagtccatgcta

SEQ ID NO: 6845015 - DNA, 57 bp, Homo sapiens
ccactgccatgggctaggcatggagcagcaatgtcttaagttggaaggtggtagtgg

SEQ ID NO: 6845016 - DNA, 79 bp, Homo sapiens
ggatcctcttgtttctctgaaggccatgctcacttgtccaagttccatcatctattcagggacagacttagaaagatcc

SEQ ID NO: 6845017 - DNA, 112 bp, Homo sapiens
ggggcctgggggagacgagggagtccccctctgtccccagtgcaggcctgggactgcactaattccgcattgggtggcagcgcaggacccccgtcccctcccccaacgcccc

SEQ ID NO: 6845018 - DNA, 113 bp, Homo sapiens
gtacaagctagatttggcaacatccagggtcatgcatgggaacctgggagccccatgccccactgcctatttgcagggccctgggtcttgggtggccctagttcagtgtgtgc

SEQ ID NO: 6845019 - DNA, 62 bp, Homo sapiens
tgaacagtgtgagggtgtgaccaaggccttcagaagcaaggctctccatcctctgctcttca

SEQ ID NO: 6845020 - DNA, 59 bp, Homo sapiens
gggccctgcgtccggaagtctgcgccctgcgcggtgggcggagaagccacgaggagtcc

SEQ ID NO: 6845021 - DNA, 66 bp, Homo sapiens
tcctctgtagtaagagaacatatggcaaacaaaggcctctctaaatatgcattcatacttagtgga

SEQ ID NO: 6845022 - DNA, 87 bp, Homo sapiens
gtttctctggaatgaagctatgtacattgatatgaaaatgagatgtaatctttatggcttgataaactgactccttttaagagaaac

SEQ ID NO: 6845023 - DNA, 73 bp, Homo sapiens
aaatgaaaggtgcgccaaaggtccatctgctgtgtgggggtagatttactggagtctttggtgttctcagttt

SEQ ID NO: 6845024 - DNA, 60 bp, Homo sapiens
tatggctcatggggctagcaagtctgttcatttaattcctagccaactccagaagtcata

SEQ ID NO: 6845025 - DNA, 67 bp, Homo sapiens
tgtgcacgtacctctgtttcctctgcccctcatttgcagacctactctggatccagaggatctgcca

SEQ ID NO: 6845026 - DNA, 130 bp, Homo sapiens
catttctttaaattctcaattttaatttgtaatatggtaaatacagatagatttaacccatgtaaataaaatttatttggggtcttctgatttattagagtataaatggatactgagaccaaaagttatg

SEQ ID NO: 6845027 - DNA, 59 bp, Homo sapiens
gttggagggtgtgtctgtgtgagggcgggttcccctgctgtcgccagagccccacctac

SEQ ID NO: 6845028 - DNA, 75 bp, Homo sapiens
tccacagcaactggaggccttatctgctactggtttttggcaggcagacaaccaggtctttcagtttactttgga

SEQ ID NO: 6845029 - DNA, 76 bp, Homo sapiens
tacatgaacctttatgtgtgataaaattgcacttagtcctggtgcaggtacacactcacacaaaagagtgcaagta

SEQ ID NO: 6845030 - DNA, 62 bp, Homo sapiens
ggatcttatttccaatccaggcacctaagagtcatatctctgagcctttggagaataagtcc

SEQ ID NO: 6845031 - DNA, 77 bp, Homo sapiens
aaagcacttttattttgaattaagggctaatagaattgtcctcttaaatgagcacttgcaagattaaaagttgcttt

SEQ ID NO: 6845032 - DNA, 70 bp, Homo sapiens
catctctctgttcattgagtcaaaacggaatatttagtgggctcctttttggttctgggatacagagatg

SEQ ID NO: 6845033 - DNA, 67 bp, Homo sapiens
tcactgaggtactggcctccattcaacaatatttgatattcaagaatgtatgttagtatcttagaga

SEQ ID NO: 6845034 - DNA, 75 bp, Homo sapiens
tctcactgctaagtgctcatgcacatttatagttccagcaggactatgtctttccatgggcacccaagtaggaga

SEQ ID NO: 6845035 - DNA, 57 bp, Homo sapiens
catatactgaggagactttatatgtagccatgcatgtttaaagatcttctgtatgtg

SEQ ID NO: 6845036 - DNA, 80 bp, Homo sapiens
tggggaagggatggtagaatggtgatgtgtggagagcctagttctgagctgtggccattcttcctactcttaattcccca

SEQ ID NO: 6845037 - DNA, 97 bp, Homo sapiens
cagggaccaataatagaatcatttctactcatcctttggagaagagccatttctcctttctgcaaactaagagtgggtcttttgtttgttggccttg

SEQ ID NO: 6845038 - DNA, 82 bp, Homo sapiens
tctcgtatagaattttgtgtgtttattcctctttcagtagctgaattgatgcaaatgataaacactaaggtcgctgaacgga

SEQ ID NO: 6845039 - DNA, 58 bp, Homo sapiens
catatgagattgcttcctttcctccttgctgaggaagtggctgagagtgtttcatatg

SEQ ID NO: 6845040 - DNA, 69 bp, Homo sapiens
gggccccagggtcttggagaggagtgccagccaaggctgggcccagctcctctgcagaccctcaggctc

SEQ ID NO: 6845041 - DNA, 75 bp, Homo sapiens
tcttctggggtctgcctgtctggatgacagatgcaaagggcataagagtctgggacaggcgaggacccaggcaga

SEQ ID NO: 6845042 - DNA, 55 bp, Homo sapiens
agcccatgcagaccttcccagagctgctcactgtgtctgtggggactgctgggtt

SEQ ID NO: 6845043 - DNA, 98 bp, Homo sapiens
taatacagtatcattttggttttgtaaattagcagacaaattggaaatatatcatacaaggctcctgtatctttacagaagagaaggatgcttaatta

SEQ ID NO: 6845044 - DNA, 59 bp, Homo sapiens
tttcaaagtggagagcctgtggttgctccctgagtccaggttttatcttccacgagaga

SEQ ID NO: 6845045 - DNA, 89 bp, Homo sapiens
acttgtcagcttcctgtatgaggatcagactggacgacttcaacctgcttagcccgtcttctgaggcctcaccctagtagttggcaagt

SEQ ID NO: 6845046 - DNA, 72 bp, Homo sapiens
tgtttatgaatgtaggtctaatatcccactgcttctaaaggaatccgtatgggaaatttatatttattagca

SEQ ID NO: 6845047 - DNA, 76 bp, Homo sapiens
agatgcattcgggatgtttactttgacagctttttaggttcattatgcttctgagtgaattccccgacatgtttct

SEQ ID NO: 6845048 - DNA, 57 bp, Homo sapiens
aactaggaagcaagagaaacagggacgggattttcttctttctgtttgcttctggtt

SEQ ID NO: 6845049 - DNA, 63 bp, Homo sapiens
ggcttacacctgtgatcccagcactttgagaggccgaggtgggtgtatcacaggtcaggagtt

SEQ ID NO: 6845050 - DNA, 82 bp, Homo sapiens
tagtcatattccacaagaccataaattaggggacctctaacaataaatctagctaagctgtgtgcttgatggaaaaagatta

SEQ ID NO: 6845051 - DNA, 89 bp, Homo sapiens
cgatagatacttgggtgcagaagtgttgagccatttgttttgacccaaccattttggctctgtggatgttctgacctgagaatcttttg

SEQ ID NO: 6845052 - DNA, 58 bp, Homo sapiens
gatgcatgcagaagagtgaatacttgctgtggtgagttttcacatttctgtagtgatt

SEQ ID NO: 6845053 - DNA, 80 bp, Homo sapiens
ctggtgagaccctggaaggagcccgggcggatcaggtccagccggttgcccgacagctccagctcctccaggcgcaccag

SEQ ID NO: 6845054 - DNA, 62 bp, Homo sapiens
accagggctgacaatctgatggcataggctgacagagccatattggttggtcagcccatggt

SEQ ID NO: 6845055 - DNA, 70 bp, Homo sapiens
tgtagcacgttagtgttagagccaagtgctaaaccccaactctgcccgaattcagcatagatgtgctgca

SEQ ID NO: 6845056 - DNA, 70 bp, Homo sapiens
gcttggcactctctgggtgaggctttgtgtcccttgatcctttagaccgcactcagggtatgtgccaggc

SEQ ID NO: 6845057 - DNA, 78 bp, Homo sapiens
taggttggcacaaaagtaattgtggttttggccattactttgaatggcaaaaattgcaattacttttgcatcaatcta

SEQ ID NO: 6845058 - DNA, 59 bp, Homo sapiens
cctgtggatttgtaagcaaagtgaattttaaaaaattgcatgctaacacagtgcacagg

SEQ ID NO: 6845059 - DNA, 65 bp, Homo sapiens
ctctcagcagagctgtgtgggaagggcctgaggcttctaggtcctccacattcctctgttgtggg

SEQ ID NO: 6845060 - DNA, 90 bp, Homo sapiens
gatagagttggaaactagtaagtggatttaaagaatctctgtgacttattcctgagactttagatacgtcttcttcttttggactaaatc

SEQ ID NO: 6845061 - DNA, 79 bp, Homo sapiens
gttgtttagcattggcatttctccagcggaatactagccagtggtccagtcatgtgtggaggaggtcatgctgattaac

SEQ ID NO: 6845062 - DNA, 63 bp, Homo sapiens
gagtgaaaagtggagtgagatagtgaactttaaaaatcctattgtctgcctgcttcttcactc

SEQ ID NO: 6845063 - DNA, 130 bp, Homo sapiens
aatttgctgagaaacatcaacaaagtaaggttttgctttatgaaggaacaatgctcccaaaaagttgggtgtaagttggatttttatgagacaatttagtattttaagtgcacaatgtgaattggttatt

SEQ ID NO: 6845064 - DNA, 129 bp, Homo sapiens
atagttatagatgtataggtagtttgatcatttgggaagaagttgcaaatttatataaccctaaaacttcagtgtatattttgggtactctttttcacaattagaataaaattatcaaaatcaatatgt

SEQ ID NO: 6845065 - DNA, 74 bp, Homo sapiens
cgcctcgggaaggcaggggcaggggcggaggggctgggccgccgccctagcccgggccacctgttctggaggcg

SEQ ID NO: 6845066 - DNA, 83 bp, Homo sapiens
atcaatgagagcaaatctccttaaaggtaaaataggtaaaatttcatttttaattttttttaggtagatttgcttttatagat

SEQ ID NO: 6845067 - DNA, 89 bp, Homo sapiens
tctaaatttttctaagaaaacttagctaggcaagttttagtactaagtgggtaagaaaatgtaaagcttgagtgtagcaaagagatgga

SEQ ID NO: 6845068 - DNA, 59 bp, Homo sapiens
gaggactgtggcacattggtagggtctgtgccgtctacagggcttatctgtcactcatc

SEQ ID NO: 6845069 - DNA, 69 bp, Homo sapiens
aggaggtcattttgcctattagaatgcctggaattaagaagctttctatgaaggtaagatgtacgtctt

SEQ ID NO: 6845070 - DNA, 130 bp, Homo sapiens
ggctgaaggatggcaattaacaatgaaacatagaaagcagatgaaattgcaacaaattgtaaagaaaaagtgtagcaaattatcgtgccttaaatgtgctgttcaactaatcactgccaccagaaatacc

SEQ ID NO: 6845071 - DNA, 98 bp, Homo sapiens
tccttaactggtatctcttccctggttctctctggtttgtcaccttctctttctcactgtatggtggccaagaggggactggatacctaaggcaagga

SEQ ID NO: 6845072 - DNA, 73 bp, Homo sapiens
cggatttgtggaagcaacaggagggccttccttccttcctaggaagcacctctatgattgctttttatgtttg

SEQ ID NO: 6845073 - DNA, 67 bp, Homo sapiens
ctgtttaatgagctggaggaggaagtggctcctgaaagcaagtccttttcttggctcaggcatgcag

SEQ ID NO: 6845074 - DNA, 110 bp, Homo sapiens
cagagcaaatgtcaccttgtccctgcatcagctccagaaaggtacacacagtgggaattactcctttgttgcatgcttttggagggggcagagggactattactgagctg

SEQ ID NO: 6845075 - DNA, 62 bp, Homo sapiens
cttgtctaattcagtgactttgggccagtgtaaaagaaattgcctcagacaagttagacagg

SEQ ID NO: 6845076 - DNA, 67 bp, Homo sapiens
tgaaagcaggacattgctgctgtgtcaagaacaaactgtgttcttatacagaagatgtttaatttca

SEQ ID NO: 6845077 - DNA, 80 bp, Homo sapiens
cactgaagattgaggcctttgttcattgtttttccgatggaaaagaaaagaaacctgaggctttgcaagatttttcagtg

SEQ ID NO: 6845078 - DNA, 78 bp, Homo sapiens
taactgatgaacagaagtataaattacgcttttggagggggattaaaaaagcgtaagttatattctgtaaaaatgtta

SEQ ID NO: 6845079 - DNA, 56 bp, Homo sapiens
ggcccctgcagaccaatgccatagagtttcctcgtgtcaattttctggtaggagcc

SEQ ID NO: 6845080 - DNA, 61 bp, Homo sapiens
ctgagagcatacatatagctacgtgactttggtcgaagagcttcatcttgctgtgtctcag

SEQ ID NO: 6845081 - DNA, 78 bp, Homo sapiens
gattacagtatagggcttatattgtatgagtcttagagaagttggattctacatagctggtggccttgtagctgtgtc

SEQ ID NO: 6845082 - DNA, 128 bp, Homo sapiens
ttccctccgcctgtccacccagccacccaccctgtcttctcctttgtttcaggggtgatgggagctggaggtctctgaaataagggagaagggaatctgggagagctcagatggacacatggatggaa

SEQ ID NO: 6845083 - DNA, 84 bp, Homo sapiens
gggcctttggcctcctgaagtttatgcttttcgggtcttaaaggatgctggaccccgagagttggactccagagctaaaggctt

SEQ ID NO: 6845084 - DNA, 81 bp, Homo sapiens
gagttttatctttttagctgttgcataaaagcatttaatttatcttgagttaatttttatgtatagtgtgtggtagaggtc

SEQ ID NO: 6845085 - DNA, 56 bp, Homo sapiens
tggcagttttgtatttgagcatttcttactggaaatgttaattacaaaatgtgcca

SEQ ID NO: 6845086 - DNA, 89 bp, Homo sapiens
tgcaaatggagggcagactgagagtgcatcaccctctcacatctcagagtctaaaaggcggcctttcagtgccttctgttcaaattgca

SEQ ID NO: 6845087 - DNA, 59 bp, Homo sapiens
gaccaggctagagtgcagtggcacgatcttggcttgctgcaccctctgcctccggggtt

SEQ ID NO: 6845088 - DNA, 56 bp, Homo sapiens
agaagccatagtatctcagggtagaaaaacccaataggtagaaaacatggccttct

SEQ ID NO: 6845089 - DNA, 76 bp, Homo sapiens
agctgtggacaatcagtttttattaatgtagctcgtgattacattagctcttttggtagacatttctcctgcagtt

SEQ ID NO: 6845090 - DNA, 60 bp, Homo sapiens
tgagaatcatccagaggcttcttaaaatatgcactatgaggcctcatcctcagattttca

SEQ ID NO: 6845091 - DNA, 84 bp, Homo sapiens
cttgtgcaaggatatttagtctagtgttattcctataataaataacaaaaattggaagccacttaaatgttcctacagcagagg

SEQ ID NO: 6845092 - DNA, 66 bp, Homo sapiens
ttattctgtagaacctagtacagtgctttatacatagtaggtgcctagtaagtgtctactgaatga

SEQ ID NO: 6845093 - DNA, 56 bp, Homo sapiens
tgcctgatagtaatagtgattgtgaaagaatcactaattcagtattacctcaggca

SEQ ID NO: 6845094 - DNA, 56 bp, Homo sapiens
cagggccggtgtccctcctgcagaaagctcaccctgtctcctgggccctggccctg

SEQ ID NO: 6845095 - DNA, 68 bp, Homo sapiens
cgatgtgaagttttagtatatgtagacattgtgaattcatttagttaagctaactaaaatatccatcg

SEQ ID NO: 6845096 - DNA, 70 bp, Homo sapiens
ggagtcagaagttctagatttgagtcctaaatttatcgttttaggtcaacttggatgacttttcagctcc

SEQ ID NO: 6845097 - DNA, 83 bp, Homo sapiens
gctctctgtccttatgatctgcctgcttgtccagagctctctgccagaagccgtggacactggggcaggcgggaggagagagc

SEQ ID NO: 6845098 - DNA, 56 bp, Homo sapiens
gccagtggtcagctacgcttagtcttggggattttaggcctgctggactacctggc

SEQ ID NO: 6845099 - DNA, 57 bp, Homo sapiens
gtatttcttggaaatccttttaggcttatcccacccactagtcattccaggaaatac

SEQ ID NO: 6845100 - DNA, 84 bp, Homo sapiens
gcaggaggaaaattgctagactatactgtaataccaatcttactaagataaatttagtgtcagcctggtaaaatatcattctgc

SEQ ID NO: 6845101 - DNA, 55 bp, Homo sapiens
cccagaacacagcctctattttccagcctcttttggagctgagtgtggtcatggg

SEQ ID NO: 6845102 - DNA, 130 bp, Homo sapiens
ggctgtgccctttctcttcctttattttttactttttgatacattctatttgtacatatttgtggggcacatgtgaaattgtgttatgtgcatagaatgtgtaatgatcaagtcaggatgttggcatacc

SEQ ID NO: 6845103 - DNA, 78 bp, Homo sapiens
tcctagtgccccaagagggctgtggtctcatttagccttggagggctgtggtctcatctagccttggggtgtgatgga

SEQ ID NO: 6845104 - DNA, 68 bp, Homo sapiens
cagaggaagacatgcgccttgtcagtgatccctgcatccctaggggtgggcagcacgtcattcctgtg

SEQ ID NO: 6845105 - DNA, 79 bp, Homo sapiens
tgtaataacgtaccttttctggaagcatcttgaggcgttcagctaaaaggaaggtctcagaaatactatgttgtcagca

SEQ ID NO: 6845106 - DNA, 66 bp, Homo sapiens
ctgtgactttagacttagtcaagttgaatggaaacaaagaaacttgaataggtcagagaattatag

SEQ ID NO: 6845107 - DNA, 79 bp, Homo sapiens
tttttctactagtatatgagctatttgggggtacggaacataactttaccaacccttcatgccgtacctggtatagaaa

SEQ ID NO: 6845108 - DNA, 78 bp, Homo sapiens
cgaggatgaagtgactgatccttcctgagagtttttatctccgtgcggggaggcttcggattaaagccttggtcctcg

SEQ ID NO: 6845109 - DNA, 69 bp, Homo sapiens
tgcagcaattttttaggcattccatatggctatcagaactattagcaaaacatgcaaaaaattgttgta

SEQ ID NO: 6845110 - DNA, 72 bp, Homo sapiens
aggactctgtggtctgtttaatgggtaagcatggggagcaccagtacaaatgaaaatagaccactgggtcct

SEQ ID NO: 6845111 - DNA, 64 bp, Homo sapiens
gactgtccaggctgaggagtttatgggaatcactgagcttttcctggcctggcacacagcagtc

SEQ ID NO: 6845112 - DNA, 112 bp, Homo sapiens
tctttgttagccgccgtccagcgattgcatatgtactgtttgctttcaaattaccttaagataattgctagagtgaagcagtatgtacttatatttggaaaatcatcaaaga

SEQ ID NO: 6845113 - DNA, 58 bp, Homo sapiens
gaagttcttcatcattaacactctgaatggcacagaggatggcagtgtgaggaaaatc

SEQ ID NO: 6845114 - DNA, 75 bp, Homo sapiens
gagcattttggattgggcatttcccactggttgatgcacacagccatgtgtggtacagtcccgtttaagatcctt

SEQ ID NO: 6845115 - DNA, 56 bp, Homo sapiens
gccaaactacaagttaaattttcagactagattgagaacttgtcttcctgtttggc

SEQ ID NO: 6845116 - DNA, 101 bp, Homo sapiens
gcatgactttcaagaagaatcattgtaaagttctgtatttggttcaaagaaaatcaacaacacaaattcacagggattcctgacttggcagcagttcatgt

SEQ ID NO: 6845117 - DNA, 78 bp, Homo sapiens
cagcgatctaaaagagcatggaaagttcaggaaacaacaaatactttttcataacttttacatgcttgggaggttctg

SEQ ID NO: 6845118 - DNA, 128 bp, Homo sapiens
catctctataataaaaaggaaaaagaggaatcccctttgtaggtttcatagtttatactgatatttctgatgtcgtctcagagaattagtcacaattataggaactcagaaggcattccgtggagatg

SEQ ID NO: 6845119 - DNA, 76 bp, Homo sapiens
cctgtgtggaaagtggtctaagcacatctgtctcatcggatgtaggctgcatttggaacatgttttccatacacgg

SEQ ID NO: 6845120 - DNA, 75 bp, Homo sapiens
gttacatatagacagttactctagtgaagcaaattaggaaagctattgtcttggtgtagcttgtttatatgtgac

SEQ ID NO: 6845121 - DNA, 93 bp, Homo sapiens
ggtgggtttaggggagctgtcctgtgcactgtagcatgtttaacagcattcctggagactacacactgagtgccataggaccctctgcccacc

SEQ ID NO: 6845122 - DNA, 96 bp, Homo sapiens
ggctgtcttcctgtggctgctcctgggtggtcaggccctgtgttcgaggcggctttgactgtgactgtcccgggtgcagccatcactaacccagcc

SEQ ID NO: 6845123 - DNA, 76 bp, Homo sapiens
cttctacaggcccagcgagtgtaacctggcactatttatcttcatggaccctacttgtgtacttgctctgtagaag

SEQ ID NO: 6845124 - DNA, 63 bp, Homo sapiens
gcagccaccatggctctgcagagcacgctgggctctgagtgtctgcagtgccacagtgggagc

SEQ ID NO: 6845125 - DNA, 69 bp, Homo sapiens
tcctagacctagtatcagactctgctgctcctcactggcataaaggcagaccctgaactgggcatgggg

SEQ ID NO: 6845126 - DNA, 65 bp, Homo sapiens
tctagttttggtatgagatgcaggcctgcaacgtgatttagccttcatttctttcttgggctggg

SEQ ID NO: 6845127 - DNA, 96 bp, Homo sapiens
catcttttctgatccttgcaactctgtgaggtgggcaggagtattgtcagaacctcatctggtttgtaaggcatttctaagtcaattagaaagatg

SEQ ID NO: 6845128 - DNA, 96 bp, Homo sapiens
ccatgacgtacatcttaaggatcatagtaaacattgatgtggaagccatttgttttgtaatctggtgtggctgtgatcctcagatctgaaatatgg

SEQ ID NO: 6845129 - DNA, 61 bp, Homo sapiens
gttactgagatcactggctccccttcatcttctgattacagagcccaggcatctcattaat

SEQ ID NO: 6845130 - DNA, 59 bp, Homo sapiens
gccctcagcatcctcagggccagtgagtgtccacctgggccagtgtggggctgaagggt

SEQ ID NO: 6845131 - DNA, 127 bp, Homo sapiens
gctgctgtgtaacagatcactccaaacttagaggcctgaaagaatgatcagtttacctgtcaccattctgcaggttgagaatttggtcagggctcagcaggggtggctcatctgtatttcatgtggt

SEQ ID NO: 6845132 - DNA, 75 bp, Homo sapiens
gtacatatttatttggagagatttaggtctcagtcattttctgatttaagcttaaaattcccagtttaagtgtac

SEQ ID NO: 6845133 - DNA, 90 bp, Homo sapiens
gtggggtttccaggcccactcggtggggctcgtttacttggacgagggcagggcagagagcaccgaccagagtgcctcaaaataactcac

SEQ ID NO: 6845134 - DNA, 69 bp, Homo sapiens
cacagtgcctgcagatttggtgtctggtgagggcccacttccttcatagatggacatctgctcactgtg

SEQ ID NO: 6845135 - DNA, 94 bp, Homo sapiens
ttaatatttcaggcagaaaaagcaccatttatcatctaggtacaatgctctgttacattattacctatgaagatggttctaaatgaatgtttaa

SEQ ID NO: 6845136 - DNA, 68 bp, Homo sapiens
ggggaaggtttgaaataggtatagaagaagctaagtgcaatattctgtttatatttcaaaccttcttt

SEQ ID NO: 6845137 - DNA, 75 bp, Homo sapiens
tgtgataattgctaatcctgccttctatgtcaggtcggacagatgtgcggggcagcacagtaattttcaacttca

SEQ ID NO: 6845138 - DNA, 58 bp, Homo sapiens
ctgggcaaattgtgccagctatgggtatcaattttatagcttatcccacagtgcccag

SEQ ID NO: 6845139 - DNA, 55 bp, Homo sapiens
gcttacaggacattttcttgggtcaatttctgtttctaaggtctgtctggtaggt

SEQ ID NO: 6845140 - DNA, 70 bp, Homo sapiens
agcacacgacttttgtggagtctgcggagcaaatagaaaaatgattccacagcttcgaggtctttttgct

SEQ ID NO: 6845141 - DNA, 84 bp, Homo sapiens
atctcagggctgagaatttagagacatagctcagaaggtaattcaatatgtgattgtctctaaataggagtcttacctagaggt

SEQ ID NO: 6845142 - DNA, 85 bp, Homo sapiens
cttctcagagtcccttgctggcagtcactgttgcgggaggttgaatttatcctgtttaatagtagttgttatattgaatgagaag

SEQ ID NO: 6845143 - DNA, 58 bp, Homo sapiens
gaagagagagttcctaggcaaaatataccctgatatttcaataggagcatctttcttt

SEQ ID NO: 6845144 - DNA, 72 bp, Homo sapiens
agcaatttaggaacttctgtctcagtgttcagtttttacttagtaccttgacactactcttagttcctggct

SEQ ID NO: 6845145 - DNA, 78 bp, Homo sapiens
tccagttctctctctgtgggtctggggcagaccagcatcagcctgatttacccgtccaggccctagtggagaaatggg

SEQ ID NO: 6845146 - DNA, 81 bp, Homo sapiens
tgctacttggaaatgaaatgagtgcctggaggtgggagaccttttcaacagtattacatttcagaaatatctaataaagca

SEQ ID NO: 6845147 - DNA, 81 bp, Homo sapiens
cagggtccgggcaggcgcctcttccaggcccgggattaatgagtctctggactgggagatggcagaggcatgtagactttg

SEQ ID NO: 6845148 - DNA, 93 bp, Homo sapiens
tgcttcaggggacaacaacgcacttctcgggggcgctgtctgatcatttaggtggactgttgcccaccaggagactgtcagtttcctggagca

SEQ ID NO: 6845149 - DNA, 94 bp, Homo sapiens
aagccttaacgatttatgtacaggatttcatgttacatttaaaatgttgtggcacatttcagatgtaatgtgatgtctatttgtatgtgggctt

SEQ ID NO: 6845150 - DNA, 65 bp, Homo sapiens
atgatctttagtagcgcatagtatttctttaattcccagtggtacacaaagctattgagtgtcat

SEQ ID NO: 6845151 - DNA, 85 bp, Homo sapiens
cactggcctgttctggttttgcattcacagaattattttcatggatttgattctacaatcatgtagatcctagtttaggtaggtg

SEQ ID NO: 6845152 - DNA, 88 bp, Homo sapiens
agcttcctaagggcagaactcttagtctgttttatttgctgttgcaccccaaagtcctagaacagtgcttgacccatgccaggtagtt

SEQ ID NO: 6845153 - DNA, 86 bp, Homo sapiens
gccagagagtggaggagcacttgacggggtcttccttggataggtaactttggaaatcagaccccaagggcatttcatattttggt

SEQ ID NO: 6845154 - DNA, 118 bp, Homo sapiens
taaggcagttctttaaaccaaccaaacccttcagcaggagtttgatgcttttatcattcaaaagtgatctaatatatgtgccttgattgggtttggtttagccttgagaataacctta

SEQ ID NO: 6845155 - DNA, 61 bp, Homo sapiens
gatctcaagactctgaagtcattgcatgagcatcccttctcggcaacatcagagtgagatc

SEQ ID NO: 6845156 - DNA, 124 bp, Homo sapiens
cacttggatatggagaatgctggacagagagaaattagttggtttgctcaagattacccaattaataattggcaggattggtttcttgtacctggttcggggttctctgtattccatcatagtg

SEQ ID NO: 6845157 - DNA, 60 bp, Homo sapiens
cactccttgggaaatcactagcactgctagaaacagagactagggatttccccagggctg

SEQ ID NO: 6845158 - DNA, 55 bp, Homo sapiens
aacatgagatgttcagttactgtggaagagcttccacagaatatacattttagtt

SEQ ID NO: 6845159 - DNA, 64 bp, Homo sapiens
acaggcagagagtggcggactcagaatcttaactctgatctccagctttcacgctcctgcctgt

SEQ ID NO: 6845160 - DNA, 77 bp, Homo sapiens
tgtgagcgtgtgtgtgtgtgtgtgtgtgtgtgtgcgcagacgttaaataagcacacaaatacatatattatgaagca

SEQ ID NO: 6845161 - DNA, 67 bp, Homo sapiens
cttttaagcttgattgtagtctagacataatatgtgttatgtttttttaaaatcaggcttgtattag

SEQ ID NO: 6845162 - DNA, 57 bp, Homo sapiens
ttttttctgttacagttagaatgaggaaacttatgttgctgcctgttatggagagaa

SEQ ID NO: 6845163 - DNA, 73 bp, Homo sapiens
ggccattaagttgaaggaccatggtgaatttctgaacacattttccaaggctgtcctcactttgtccatggcc

SEQ ID NO: 6845164 - DNA, 125 bp, Homo sapiens
gcaaaagttatttttggaaataaaaatcctatataggctgcttctaccaaaatgtatgaaagacacatcctttatccattggttagaaaatcaggcttagtatgatttctctttttaatttttgc

SEQ ID NO: 6845165 - DNA, 82 bp, Homo sapiens
gatttgtataggcttttgcctgaagctaatggtatatttgtttcaataaactcagtggtaacaggcttaagccttacttatt

SEQ ID NO: 6845166 - DNA, 62 bp, Homo sapiens
ccagccctctctcaggctgacagcctttgccctttgctcaggttggcttcagaggtggaggg

SEQ ID NO: 6845167 - DNA, 88 bp, Homo sapiens
tgtatatatttgtacatacatgtatatgtatgtgtgattatatgtagatacacatgcatgtgcatgtatgtatgcaaaaaatatgtca

SEQ ID NO: 6845168 - DNA, 61 bp, Homo sapiens
cagtgataggacagctagaactgagttccgagtgttttgaagagtatctgtcctataactg

SEQ ID NO: 6845169 - DNA, 68 bp, Homo sapiens
ttctgctttgctctttagacatagtctgaaggataggaaaatctagacactggcagagagctgcagaa

SEQ ID NO: 6845170 - DNA, 65 bp, Homo sapiens
aggtaagaacatgtttctgtcctacgagataactttgttgctcctagttacagaaactcttaact

SEQ ID NO: 6845171 - DNA, 62 bp, Homo sapiens
tttctaaggccagagactgctgttactcaatgcgttagtcagtcttttcttggcttcaggaa

SEQ ID NO: 6845172 - DNA, 57 bp, Homo sapiens
ctacagcctccacaggccaagtgaccttgccaaggccacacagctggagggtgctag

SEQ ID NO: 6845173 - DNA, 83 bp, Homo sapiens
tgagctttgcaattagaaagacctagatgtgaattctagctactccattaactagctgtgtgcatttgggtctcagaggctca

SEQ ID NO: 6845174 - DNA, 63 bp, Homo sapiens
gtttgggggctggtaagatagcaaagatttcccttgttgatgttctcttgtccaggccttaac

SEQ ID NO: 6845175 - DNA, 75 bp, Homo sapiens
cctgtgggtgcttgaatgcaggcctgagccttatgtgggaggagaggccaggaatcactgctgagtaaccacagg

SEQ ID NO: 6845176 - DNA, 128 bp, Homo sapiens
ggacagggtgcctgtgtcccacagacaggactcctatgccccatggacagggtgcctgtgtcccacggacagggctcctatgccccatggacagagtgcctgtgttccatggacagggcacccatgcc

SEQ ID NO: 6845177 - DNA, 66 bp, Homo sapiens
acccgggagctggatcgcgcgcccggagctccggtctccgagtccgagttgtgcagctctcggcgt

SEQ ID NO: 6845178 - DNA, 76 bp, Homo sapiens
acgttagggacaagtgtgtctgtgagttcctagtttgcataacctggccttgtagaattgaaatggtctcaaatgt

SEQ ID NO: 6845179 - DNA, 75 bp, Homo sapiens
ggcagggtggatctctgcaggtaagcgttcttggaccggtcatggtcctgccgtcctccggggcctccaccctct

SEQ ID NO: 6845180 - DNA, 79 bp, Homo sapiens
ggagactttgtactctgctttagaatccagtagctctatcagtgtgagctgtttccattcttgagtagaagttttctcc

SEQ ID NO: 6845181 - DNA, 60 bp, Homo sapiens
agcttgaggcagcccttaattgggacccatttctctttctcccaagctgctggctcagct

SEQ ID NO: 6845182 - DNA, 90 bp, Homo sapiens
agcagatgttaggcctgacatcatggtgatttaattgactaagaatatttcctgtcatttttatcaatgtctggctttccaatgtctgtt

SEQ ID NO: 6845183 - DNA, 129 bp, Homo sapiens
agccagatagagctcaaatttccttgtcatcagcaacgatcacaggcaaatcttcagctcaaggaatttcagctttgctgaggcagatgtctgtgactctgggactgggaccaggttgacttcttagct

SEQ ID NO: 6845184 - DNA, 80 bp, Homo sapiens
tgagattctaatagctgcctatgtatttgtgttcacaatcaggtgtacaccaaacggagggcaaatgctgttaccactca

SEQ ID NO: 6845185 - DNA, 129 bp, Homo sapiens
tactgcttaagtgtttaaagcaagggatagtataatcagatttgtgtcatgaaaaggtaactctggcagctttgtcatggacagattagatgagtgaggatccaggggcaggcagagcagttaaaagtg

SEQ ID NO: 6845186 - DNA, 81 bp, Homo sapiens
cttgatgactatgataagtcaaaggcataataattgttattatggttattagctttaaagactttgattcacattcacaag

SEQ ID NO: 6845187 - DNA, 78 bp, Homo sapiens
atttactagaattggtcattttggtttagaagcaaaaacaattacttcagtataaccaagagattattactggcaaat

SEQ ID NO: 6845188 - DNA, 77 bp, Homo sapiens
gctgggactcggccatggcgccccggccccggccccggccctggccccggccccgccgcggtccgaggtcccacagc

SEQ ID NO: 6845189 - DNA, 56 bp, Homo sapiens
ggtgaggggctcctctgcccggccgcccctactggtaagtgaggagcccctctgcc

SEQ ID NO: 6845190 - DNA, 55 bp, Homo sapiens
tttccttccaaatgcccgggagccaaccaattgcattcctggcatttgtaggaaa

SEQ ID NO: 6845191 - DNA, 66 bp, Homo sapiens
gtgagttatttggtttgcatgcagaatagttgaataaattcattgatgtaaacacaggtaatgtat

SEQ ID NO: 6845192 - DNA, 95 bp, Homo sapiens
gggggaagggggacattgttttgaacttaaggctataactcaatggagttaggaatgtttttatcaacttacatcttgtctcctgcgtttcctcc

SEQ ID NO: 6845193 - DNA, 66 bp, Homo sapiens
caagaagaaaaattacctgtgattctcctctggtcagaatcttcagatgatttgtcactctttttg

SEQ ID NO: 6845194 - DNA, 86 bp, Homo sapiens
aattttcagccttcaaagctactgtggctcttaaatggctgacttaaactgctggataccacagagactctgcaggactgaaaatt

SEQ ID NO: 6845195 - DNA, 61 bp, Homo sapiens
ttcatgtgcagtgtaagacatgctctgttttctagagacgtgctaaagctgcagttatgga

SEQ ID NO: 6845196 - DNA, 55 bp, Homo sapiens
ggcgtccccggggttttcggtgtccgctgggagctgctcagatcccggggaagtc

SEQ ID NO: 6845197 - DNA, 82 bp, Homo sapiens
ttagattctcataaggacagcgcaacctagatccctcacatgcacggttcacaacagggtgtgttctcctatgagaatctaa

SEQ ID NO: 6845198 - DNA, 80 bp, Homo sapiens
cgggtttgcgtctgttacggtctgctggtgggttgcttcctcctctgcctgtatttcttggacagttgctctaaagctcg

SEQ ID NO: 6845199 - DNA, 108 bp, Homo sapiens
ttgttttcccttctgttaacctctaagcacactgccttgctgtgcgctgacttcagaaaactacagctagagggcacgtgaacgctgagcacagcaggtaaagagcaa

SEQ ID NO: 6845200 - DNA, 56 bp, Homo sapiens
acatatatgcgtgggctcatgggaaatatatattgtgtgtcagcacgtgtgtgtgt

SEQ ID NO: 6845201 - DNA, 80 bp, Homo sapiens
ttggttaggtagtggaaccttctaaatgacgcactatgtgattcctgtgtcatatagaatgttctatgattcttagccag

SEQ ID NO: 6845202 - DNA, 76 bp, Homo sapiens
cccttagaaagcttcagtgtgagcatgtaaccttgactcagtcaattagatgcacccactggatcttttacttggg

SEQ ID NO: 6845203 - DNA, 58 bp, Homo sapiens
ctgctctggtctcttcatgtttcttgatgtcaggttcaagtgaagtgccagaagtcag

SEQ ID NO: 6845204 - DNA, 64 bp, Homo sapiens
ggagaggatgttttagtaacttggacactttggtgcattgtctgggacctggaatttctcatcc

SEQ ID NO: 6845205 - DNA, 91 bp, Homo sapiens
ggaacttgtaaaatcccttacctttgatcaattatagttacgtgtctaatgatacatagcaaggaaatgacagagaagagattcaagtttc

SEQ ID NO: 6845206 - DNA, 76 bp, Homo sapiens
gagaagtatttggctaaaagacaagctaggaaaagaattgtcaaactggtttctgttttccgcacaaatatttctt

SEQ ID NO: 6845207 - DNA, 74 bp, Homo sapiens
agtccaagagtacaaagttgcagttatgtgattatagtcagtaatactgtatactgcaaatttgtgaagagact

SEQ ID NO: 6845208 - DNA, 57 bp, Homo sapiens
tgtgggataatcaggaaggtgccaacttcataattggcacctggctgactgtctcca

SEQ ID NO: 6845209 - DNA, 69 bp, Homo sapiens
gaggccaagggagaagatctctctaaatattttcccacatgggatcaaagatgtttcccccttggcttc

SEQ ID NO: 6845210 - DNA, 78 bp, Homo sapiens
tcgcacctgcccggagccaggcgggtctttgctccttcccgcgaaaggggttagccttgcctgcgccccaggaagcga

SEQ ID NO: 6845211 - DNA, 56 bp, Homo sapiens
agtttaatttgcattctgaatattaccatgtgttcatggagaatgcaaagcaggct

SEQ ID NO: 6845212 - DNA, 116 bp, Homo sapiens
atgaatgaatggtctgcctcttgtctttgataacagtgaatatcatgctaggaaaacaggggcatgtaacttttacttatcaaactctacgagttgcactgagaatactcaatcat

SEQ ID NO: 6845213 - DNA, 79 bp, Homo sapiens
cagacaaagtgattttgaataagtgtttttaagccaaattataagagagcacagatggatgtattcattattttgtctg

SEQ ID NO: 6845214 - DNA, 75 bp, Homo sapiens
gggcaccgagtcgctgataaacgtcacgttcccatagacgtgctgcgggaaggccttgtcagcggattggctccc

SEQ ID NO: 6845215 - DNA, 68 bp, Homo sapiens
ggacatttgcacctacctcagcgtcaaaattaagatgctgattttagccaaggtaggccaagtagtcc

SEQ ID NO: 6845216 - DNA, 90 bp, Homo sapiens
gatgggatgggtggcgagccccaggctgggccgacctcacactgtgctctgtgcccctgccgtggaccaggtgagccatacgtcgccatc

SEQ ID NO: 6845217 - DNA, 120 bp, Homo sapiens
catgcatctcatttgtacctttctcctatcaagtgtatggattttcagattcttatcttttagaaggatgagctgctcaatctgtggtctgtgatggaaggcaggtagggtgagttcatg

SEQ ID NO: 6845218 - DNA, 81 bp, Homo sapiens
acagaatctggcttgactttgcgacttgctttcaccaatcaaatgcagaagaagtgaagtctggtcctcaggaggttttgt

SEQ ID NO: 6845219 - DNA, 121 bp, Homo sapiens
gggtagtgaccaaagtgcaagggtgcctttctagtcccccaagatcacttctaaaactcagtgccattttaaacagtgaagttgggaggaaggggaaggatcgcatccaatttcattcccc

SEQ ID NO: 6845220 - DNA, 76 bp, Homo sapiens
atctgcctcttcttcattgcgatcttagccttttggatttcaatttcttcatttgtaaagaggggggatggtagat

SEQ ID NO: 6845221 - DNA, 76 bp, Homo sapiens
gcaagcctttcccttgtgtaggacaccccagggcctcacattctctgaatccacacaaggtgatggatggctttgc

SEQ ID NO: 6845222 - DNA, 63 bp, Homo sapiens
gaataaatactaagacttagcctattttgaatagattgggcatgagatggtagtagcttattc

SEQ ID NO: 6845223 - DNA, 56 bp, Homo sapiens
agctgaagtttagaattgtgaaaaactcatggttgcttcacaacttgaactcagtt

SEQ ID NO: 6845224 - DNA, 82 bp, Homo sapiens
gggaggaagtatggtggggcagggattgcaggccagggcccagaacagtggcctgagctgttactctgtcctcgttcctccc

SEQ ID NO: 6845225 - DNA, 93 bp, Homo sapiens
aattttcagtttttaatctaatctgccttcctaatcttcctggtgattggaaacaggttaggaatgggaggtaatggaataaacatgaggatt

SEQ ID NO: 6845226 - DNA, 56 bp, Homo sapiens
gagccctggggctttaggtcccctctccactgctggggacaccaactccagggctt

SEQ ID NO: 6845227 - DNA, 58 bp, Homo sapiens
gggtgggatacctgggaacttcagcgtgtatcttgtccagtttcagggagtcccatct

SEQ ID NO: 6845228 - DNA, 93 bp, Homo sapiens
tgatagtcctacattatggggttgttgtcaggattcagtgagttaacaaagatatggatgctgagaacactgcctgatacattggacacatca

SEQ ID NO: 6845229 - DNA, 80 bp, Homo sapiens
tgagacttaagactttactctttttccccctttggcagaggggatgagactagagctaaagcagctatcttgtaatctta

SEQ ID NO: 6845230 - DNA, 91 bp, Homo sapiens
agacggggcttctgtgggagatgggaaggtggatgccaggagacctgcaattgagtaaaatctttcctatttgcctaaagagaccctctct

SEQ ID NO: 6845231 - DNA, 59 bp, Homo sapiens
agtcgctgttggtcgtggcactgaggcccagatcatgccacctcctctaacaagtggct

SEQ ID NO: 6845232 - DNA, 128 bp, Homo sapiens
tcaattcactctggtggattgaacacaagtattcagcacatctttgtacagctgctcgtgataaggtagcttagtcctagtgtactaaatatctgttgaattttaatccttatgaacagagaaattgg

SEQ ID NO: 6845233 - DNA, 94 bp, Homo sapiens
agagaagcaccagccctgggattctcaggtgtttccactttgtcatcagcaacaaacaaattaccatggaatttgggctgagctgggtttttct

SEQ ID NO: 6845234 - DNA, 89 bp, Homo sapiens
gcttgtcattgagtgttctttgctgttgatgtagaagattctcttgaagaaatctgcataattgcagacacaaacaatggcctttgagc

SEQ ID NO: 6845235 - DNA, 86 bp, Homo sapiens
aggtggtgcttttctgtctgcaaacctaggggccagggcccatcggaatgctctgcctcccctagtgttactgctgacacccatct

SEQ ID NO: 6845236 - DNA, 129 bp, Homo sapiens
acttagatgctaacctagcttcaataccttctagcttgggatgtccagtcactgtcaatgttccttttgcaaagtggggaggagttgctggaggtaactgggaaggtggaaggagaggaagaggagcgt

SEQ ID NO: 6845237 - DNA, 68 bp, Homo sapiens
gaaatgtcaggtattaataaatggagagtagtaatgtattccattagtgttaatatctctattatttc

SEQ ID NO: 6845238 - DNA, 80 bp, Homo sapiens
attcctccccctcattctttcctgggcccctggttcagagcagtctcagttagaaggccagaaaagaagaggataggaat

SEQ ID NO: 6845239 - DNA, 81 bp, Homo sapiens
ggcctagaagacctggggaagtatttatgtatcatctaattggaagatttacaaagctctctagtgtctttggtagaggtc

SEQ ID NO: 6845240 - DNA, 63 bp, Homo sapiens
gcacagagagaagaggctgagctaggcagaactcaggcagggcagcctctgactctgctttgc

SEQ ID NO: 6845241 - DNA, 105 bp, Homo sapiens
gtggggagctccaagcaggtgggcaggacccaggggcctggtgaccaggacagacccccactgtccatcaactttcctggccctgtcctctgctaaacttcccac

SEQ ID NO: 6845242 - DNA, 68 bp, Homo sapiens
agtatcatcttccatgttcttgacacagtggcactaaatcatgtgccagtggagcacatggtgaagct

SEQ ID NO: 6845243 - DNA, 68 bp, Homo sapiens
aagaaagctctttcacttccgttctgtgttccaggaaatagaaggccagatggacggggcttattctt

SEQ ID NO: 6845244 - DNA, 128 bp, Homo sapiens
gtgcctataggtattattgttacttttagaatgagtgttaagtgtgaagtttcaagtagtgtctggcacaacttagcaatgttttagagtcagaagttataattacactaaaaatcatatttaggcat

SEQ ID NO: 6845245 - DNA, 77 bp, Homo sapiens
tccacgagcgagcatctgttaacaaagaagacagccctgctgttgatggtgttgatgagaagagctccttttgtgga

SEQ ID NO: 6845246 - DNA, 82 bp, Homo sapiens
cacttaattaattagttaagcatgtaaacactgagataaattcctgtattattaaatatgcttgaataatgtgatgtgagtg

SEQ ID NO: 6845247 - DNA, 67 bp, Homo sapiens
tcttcctcagctccaaagtccaagactgggtgccaggcccagtgtggttctttggagaaaggctgga

SEQ ID NO: 6845248 - DNA, 69 bp, Homo sapiens
gctgtcaaaggtttttcagcagggagatgatgtaatcagatctgtgtgttggagaaaagctttggcagc

SEQ ID NO: 6845249 - DNA, 62 bp, Homo sapiens
tgcagtattatatggtacatattatatggtgtttccaccatataaacaccagatagattgta

SEQ ID NO: 6845250 - DNA, 94 bp, Homo sapiens
tcatgttacattaagtattagtgctgttctttcaggagctattatattgtgacatcaaagatttcctgacagggcagtggtaggttagcactga

SEQ ID NO: 6845251 - DNA, 69 bp, Homo sapiens
tctcatttacttccacaggctggttcatcctcaaagccctccttacgtagatctgtgggatcagtgagg

SEQ ID NO: 6845252 - DNA, 72 bp, Homo sapiens
ctggccccagcaggtattagagagcctgaaagattacctctgtttctctcccctactctaaatctgcactag

SEQ ID NO: 6845253 - DNA, 85 bp, Homo sapiens
gagagagttttaaagggaatagctctcaccactacattcaacataattttggatgttgtgtttgactgttacccaaactctcctc

SEQ ID NO: 6845254 - DNA, 106 bp, Homo sapiens
gtctgcttgttttgtagttgaggaaccagaggttgagcaactagaggccacacaggtcatcagtgtcctcaggctttgttccttaggtggcacgaggtgatcagac

SEQ ID NO: 6845255 - DNA, 67 bp, Homo sapiens
ccccaggtggaggcaggagttgacagcatggatagagacaggtaaggccactgacctacatctgggg

SEQ ID NO: 6845256 - DNA, 58 bp, Homo sapiens
gatgctctggccctttgaacgctggacaggagccagtgggaaatgggaacagggggtc

SEQ ID NO: 6845257 - DNA, 88 bp, Homo sapiens
taaactcagtggttttcaagtcatctgttatgggagtttttggtaaaaggtgccctgttcccactgcagtgatggtagccctgtttta

SEQ ID NO: 6845258 - DNA, 66 bp, Homo sapiens
tgtaaatgtactgaggcaacaggagtttaccgttatgtattttcagttgttggaagtagatgtaca

SEQ ID NO: 6845259 - DNA, 91 bp, Homo sapiens
cagtgggcatatagtattatctcattgcagttgtttgaatgtgtaattcccaggctaccagtgaggtcaatctccttttatatgtttactg

SEQ ID NO: 6845260 - DNA, 72 bp, Homo sapiens
gctgaaatagaaacagaatatgagtgagaggctgtccctaaacacctatagttaactctgttctaggtcagt

SEQ ID NO: 6845261 - DNA, 56 bp, Homo sapiens
gtggtaatgtgtgcgtgtgtgtataaatatttatacacatatatacacgtttaagc

SEQ ID NO: 6845262 - DNA, 80 bp, Homo sapiens
gctaccaatcttgttttctacatccatgagtaacaggattcaccaatgaattggattgtgagaaccaagataatgtatgc

SEQ ID NO: 6845263 - DNA, 65 bp, Homo sapiens
aatctcaccttaaactgtagctctcgtaattcccacgtgttgtgggagggactcggtgggagatt

SEQ ID NO: 6845264 - DNA, 64 bp, Homo sapiens
gcctgtgtgtgtgataccacatgtgaatgtatgtctgcatatgtgtatgtatctatgcataggt

SEQ ID NO: 6845265 - DNA, 77 bp, Homo sapiens
ctgtcatagccaagaggagcctaaagcgacatgactactaaatgtagtgtggtatcttctatggaatcctggaacag

SEQ ID NO: 6845266 - DNA, 80 bp, Homo sapiens
agagccaggagctctgctgtctgaagatgggaaaagatgggtttcccagctcaagcagagagctaatttgcccttcctct

SEQ ID NO: 6845267 - DNA, 104 bp, Homo sapiens
acgtttattagaagaaaatgcagattcctgaaacttcctgcagaccccatgagtgacaatctcagggagatggagttccagaatctgctttttttcatagatgt

SEQ ID NO: 6845268 - DNA, 74 bp, Homo sapiens
ggaaatgtagttcttattctgggcagccatatgggcagccatctgcccagctaaaaatgggaggtcctatttcc

SEQ ID NO: 6845269 - DNA, 71 bp, Homo sapiens
cgcaggcagcgctcgtggcctggccagggagagaggagagtcgtgatgctgggagtgcaggctgccttgtg

SEQ ID NO: 6845270 - DNA, 66 bp, Homo sapiens
tacatagctgtttctttaaatgtgttataactttttaccacccacaggctaaagatcagccatgta

SEQ ID NO: 6845271 - DNA, 87 bp, Homo sapiens
caggaaaagggatatttagaagagaacaatgcattcaagctttttgaaagtatttgatttctattaccacatttccctttcattctg

SEQ ID NO: 6845272 - DNA, 70 bp, Homo sapiens
gccttttctaatctttgattgtttctcttcccagttaaggagaaagggataatttgaagagcgacagggt

SEQ ID NO: 6845273 - DNA, 92 bp, Homo sapiens
tcggtgccactgcatttatggagcaaggcagtggaatatgacccttatcacactcctgatcatctccttagcctcctgtagtggtccactga

SEQ ID NO: 6845274 - DNA, 59 bp, Homo sapiens
gccaaaggttggcctgtgagttgcacgcctgcagctggaactggcagaccaactatggc

SEQ ID NO: 6845275 - DNA, 61 bp, Homo sapiens
cagagtgagggcctgcacctgccccgggtcctctgtccggaaatggtttaatccttacctg

SEQ ID NO: 6845276 - DNA, 68 bp, Homo sapiens
tggcttgctactgaggtgtcaggaaattgtacactcaagtctcaccttgacatttagtagcattgtca

SEQ ID NO: 6845277 - DNA, 86 bp, Homo sapiens
aatattttctgtgtcatattttctcctttcaagatagcatttccagggatgtatttactgagaaggaaacgatgtcaggaaatatt

SEQ ID NO: 6845278 - DNA, 72 bp, Homo sapiens
actcctaggcttttgttttgagcaattggatgggtatcatataatagcatcttctgagacaaagactggagt

SEQ ID NO: 6845279 - DNA, 79 bp, Homo sapiens
ccattcagagcttttacttacattctatgccagaaaaaaattccctttagggcctgtagcttgtaaatagtgctctggg

SEQ ID NO: 6845280 - DNA, 57 bp, Homo sapiens
caacattttcatggccagggagagattccatttcatggccagggagagagaatgttg

SEQ ID NO: 6845281 - DNA, 80 bp, Homo sapiens
cttggtcaggcagcctgtagatggagccagctaagagcaaagctctgggaagcctgtatgcagaaatggaagtggccagg

SEQ ID NO: 6845282 - DNA, 61 bp, Homo sapiens
attttgcttctcatttctctgtgcaaaacctactaagatgcacaatagatttgagcaaagt

SEQ ID NO: 6845283 - DNA, 81 bp, Homo sapiens
tccaatgttctgcgaggcctgacttgtccctgacggttttaccacattcatgacatctgttaggtttatctgcagtgtgga

SEQ ID NO: 6845284 - DNA, 60 bp, Homo sapiens
ctgggctcctgggaccctggctctgacaccaccagagtccctcttcccaggaggcagcag

SEQ ID NO: 6845285 - DNA, 58 bp, Homo sapiens
ggtttacctgatacaggtgatgattttaatgatcatacagcctttgttagtgtatccc

SEQ ID NO: 6845286 - DNA, 64 bp, Homo sapiens
tggtaggtaaatgagactggaggggaacaagtgacaaatcttacaaggtcctgaatgcctgcta

SEQ ID NO: 6845287 - DNA, 94 bp, Homo sapiens
gcaggtgggtaaaagttttaggcatgtaaaggaccccccaaatcacactgctttccttattattcaaaatgtcttcatagcttatatccagtgc

SEQ ID NO: 6845288 - DNA, 86 bp, Homo sapiens
ggagcccctctccgtctgtatttgttaatttcaggttctgtgaacatcgcctctgctctggaggtcaggtgtggtggtggggctcc

SEQ ID NO: 6845289 - DNA, 63 bp, Homo sapiens
ggagcagctgctctggtggtctctcccaggctctgggggcggacccatgggaggggctgtttt

SEQ ID NO: 6845290 - DNA, 68 bp, Homo sapiens
ccattcattgttgagtgcttcagctgtacaagccattttaatgtcagtttgagaccaacagagactgg

SEQ ID NO: 6845291 - DNA, 76 bp, Homo sapiens
tttcaaggtaagtggactcttcccagtgcttgggccagggctggaaatgggcgggacagggtgcacgggcgtgagg

SEQ ID NO: 6845292 - DNA, 59 bp, Homo sapiens
cacttcaagagcaagggtgccacaaatttagtgtattctaacacatgctctaagaagtg

SEQ ID NO: 6845293 - DNA, 58 bp, Homo sapiens
aaactgttttggctattctggggcgcttcaatgtccatatgaattttagaggcagttt

SEQ ID NO: 6845294 - DNA, 86 bp, Homo sapiens
ttcttgctggggctcatgatgtaggctggtaaaaagaacccctatttatttattagctttagcctttggatgagctctaggaagaa

SEQ ID NO: 6845295 - DNA, 59 bp, Homo sapiens
tgtgcgtggttcccggggccatgttcacaagcggacacggaggcgcacacacacgcaca

SEQ ID NO: 6845296 - DNA, 73 bp, Homo sapiens
tcttatcaggtatgtgagcttgggcaggagatttgttgctaagagcctcagtttatacacctgtaaaatagga

SEQ ID NO: 6845297 - DNA, 57 bp, Homo sapiens
ttggctgctggtctttggatatggttatggtctatgtcttgatttcagtatgtgcaa

SEQ ID NO: 6845298 - DNA, 66 bp, Homo sapiens
tcctgcatgttttctggcaggcttataaccatgcaaagcagttataccttccacaaaacagcttga

SEQ ID NO: 6845299 - DNA, 74 bp, Homo sapiens
ttcctatttaatagctttgttgtttgtgattttcataatttaagtgaattatgtgtaacgagtttattgaggaa

SEQ ID NO: 6845300 - DNA, 89 bp, Homo sapiens
ctgggacgtcatgtctctgcaggtgcaggtcgggcggcccgaggtgctgctggatggcctggaacctggcagggactatgaggtctcgg

SEQ ID NO: 6845301 - DNA, 57 bp, Homo sapiens
gtggagccctgccttgctcatgttttgttatggaggtgaagctagtggttgctccat

SEQ ID NO: 6845302 - DNA, 57 bp, Homo sapiens
actggtttcccattatctgcaggatcaagtccagacttcctgatatggtaaactagt

SEQ ID NO: 6845303 - DNA, 85 bp, Homo sapiens
atggagattccagttagtggcagcttatccggttactttagagactgattaatgagttgtcactgttttattggatatcggtcat

SEQ ID NO: 6845304 - DNA, 74 bp, Homo sapiens
gtctgtcagtgctgcccagggctgagtgtcctgagccccagattctcggtccgggcagcccccactgacatggc

SEQ ID NO: 6845305 - DNA, 61 bp, Homo sapiens
tctattgtcttcaactctacttttgagccagacctcaaaatagagcctgtgagataaaaga

SEQ ID NO: 6845306 - DNA, 80 bp, Homo sapiens
ggatgtgcttctgccggtggaggcggtggttcccatgtgttaaaatgaagtgcttctcatgcttccacctgaagcgcacc

SEQ ID NO: 6845307 - DNA, 105 bp, Homo sapiens
tcaaggtgaagagtggggagttgggagcagggatggagtacccaggataaatctgagaaacaggttactgcatcgaaatgcttttatccttcctcatccctatgg

SEQ ID NO: 6845308 - DNA, 82 bp, Homo sapiens
ccttagcttgctgccttgaaaatgaagctttagatgcagtggaaatattagggctttgctggtttcaaggcttccaaagagg

SEQ ID NO: 6845309 - DNA, 77 bp, Homo sapiens
gctactctttcttagctttgcttctgggagccaagagtaattattctgtttgtaaagagtcaagcaaagaagatagc

SEQ ID NO: 6845310 - DNA, 72 bp, Homo sapiens
ggtgtccccagtgcccagctgcccaggcactgaggggcagttctgggcagagctggagctgctggtgatgcc

SEQ ID NO: 6845311 - DNA, 129 bp, Homo sapiens
gtgcctagtcactttccagctgtcatttattgttctaagagggagttttaatggggaaaaaaattccaggaagatttattttggctttgaactttggcaagaagtgttaattcataagaggcagttctc

SEQ ID NO: 6845312 - DNA, 72 bp, Homo sapiens
gctatggagctaaattgtaatcatagctgcgacgctatttttaaaatgttgttacaattttgagttcctggc

SEQ ID NO: 6845313 - DNA, 80 bp, Homo sapiens
ggtatttgtgaggaatgaaaggtcacagtatctttccttggcccacagactgtggctaattcatttggtcaacaaatatt

SEQ ID NO: 6845314 - DNA, 56 bp, Homo sapiens
ttgatttcaacatcatccctttggctacttactctaaggggaaagggaggaatcag

SEQ ID NO: 6845315 - DNA, 67 bp, Homo sapiens
ctgagttcaaattctggcttcttgttagctgtgtaccactgaacacattacttagccagagtctcag

SEQ ID NO: 6845316 - DNA, 57 bp, Homo sapiens
atcccacccacactcctgtccctgcagtagggaggggcagcaggagatgggtggggt

SEQ ID NO: 6845317 - DNA, 55 bp, Homo sapiens
taaggtcatggtgaataataagctaatagacaaagtatatgacatcatgatctta

SEQ ID NO: 6845318 - DNA, 71 bp, Homo sapiens
tgaatcttttttcttgccaggcactactctagctgtttgttagttctgcagtcataagaagaaagatctca

SEQ ID NO: 6845319 - DNA, 114 bp, Homo sapiens
actgcattgccaaagtcactgagaatgcaggagtatctatacattaaactaatacttactgaacatagtatgtgcagtttgctcttaacattcacagacaataaaaagatgagt

SEQ ID NO: 6845320 - DNA, 57 bp, Homo sapiens
ctgtcattgacagaactcaaattgtgataggcaaattggcttcaatgtcagagacag

SEQ ID NO: 6845321 - DNA, 69 bp, Homo sapiens
gagagatgtgagaatcaagtgaccatcagctggtataaatgtttttggtcagtgtagtcacaggatctc

SEQ ID NO: 6845322 - DNA, 94 bp, Homo sapiens
cctgagtcactatttttctgatttctcttgtggatgctactttctagtttaataggaaagaagttagattgttatatggaatggttatctcagg

SEQ ID NO: 6845323 - DNA, 113 bp, Homo sapiens
ttcgaggtttgtggttatatatttaaagtgcaatcagttagaccatttgggtaaaggtcaacatggaaaaggctgatttcattataaaagcatgtgagacagagacaagtgga

SEQ ID NO: 6845324 - DNA, 55 bp, Homo sapiens
gcttgagaacttcaactcagtgtttgttcagatgctgatttgtgacctctcgggc

SEQ ID NO: 6845325 - DNA, 56 bp, Homo sapiens
tattagctatatgctatgtgccaggcacaatcctaggtactagaaatatagcaata

SEQ ID NO: 6845326 - DNA, 117 bp, Homo sapiens
gcgacaaacagaagcacttcttattctttttatgctcagcaacatatttatttcagatacacaaaaaagacaggctgaagtcagaaaagaattagggagaatggcgaagtttgaagc

SEQ ID NO: 6845327 - DNA, 56 bp, Homo sapiens
gcagggaaggggacggaaccaggcttcgccccctgtgtgtgtctctggtctcttgc

SEQ ID NO: 6845328 - DNA, 64 bp, Homo sapiens
gggaaggctggtctatacggagacgagactgacatcagtcattgctccaacaagatgctttctt

SEQ ID NO: 6845329 - DNA, 82 bp, Homo sapiens
gagtctctaacccagattctagagcagaggcctccccaaagaaccaggaatgcctcctcttgagggtcagggaatgaatctc

SEQ ID NO: 6845330 - DNA, 115 bp, Homo sapiens
gagcacaggaaaggaaatagctgtactgctgggtttgttcaaaaattataagatattgaaattagtatctcctgttttgacaaattctaaaagacagcaatcatttctcttgctc

SEQ ID NO: 6845331 - DNA, 62 bp, Homo sapiens
agcagaatgcaaactggggcaccgtttccctgaagcgtgttggccgcgtttgtcgtagtgct

SEQ ID NO: 6845332 - DNA, 55 bp, Homo sapiens
ccccgtttctcatccctaggatctcagttgaggattcaggacaggaaaaacaggg

SEQ ID NO: 6845333 - DNA, 56 bp, Homo sapiens
cctggcttaaattctgtcttaacttgaaggatctcagaagcagactctgagccagg

SEQ ID NO: 6845334 - DNA, 77 bp, Homo sapiens
gcgctcttttatgcagatttgtacagtgaaggattgaatttcattcatgctcatttaacaagctaatggaagtttgc

SEQ ID NO: 6845335 - DNA, 99 bp, Homo sapiens
gagtgtttgtgtgtgtgtgtgtgtgtgtgtatgtgtgtgtggggtgtgtgcatgcatatatgtgcaggctcacacatgttcccatgaccacagactctc

SEQ ID NO: 6845336 - DNA, 78 bp, Homo sapiens
tgcaattcttatcacaaacaatctacaaaggattgagatatgtttaaaatcatttcctggagtttgtggtgatatgca

SEQ ID NO: 6845337 - DNA, 81 bp, Homo sapiens
tctgtccagtgaggtgggctgggctctatgccaggcacaagtcatctgtcctccgtccccactcccagctcctgaggcagg

SEQ ID NO: 6845338 - DNA, 95 bp, Homo sapiens
cctggaagcacatggcacgaggacagagacagcagctggtagtccagttctaaaaccaattctgcttctactgccaaacactgcccagttccagg

SEQ ID NO: 6845339 - DNA, 71 bp, Homo sapiens
ctgtgctggaggtcacccttagaacatggtaatgacaggctatagttaccatgtcctggctaccagcgcag

SEQ ID NO: 6845340 - DNA, 64 bp, Homo sapiens
ggagagggcaggcagggccacaggagggagcagggctgtcctgatggcctctggctccagctcc

SEQ ID NO: 6845341 - DNA, 60 bp, Homo sapiens
ttcctacatgggggctgctgccagcgagcacggctttgctggtaaagtctttatcgggaa

SEQ ID NO: 6845342 - DNA, 91 bp, Homo sapiens
ctggcttcacattcctgaagagtgaatgtggcagtgtgccaccctataggctccactctaccatgccactccataggcccagtgactctag

SEQ ID NO: 6845343 - DNA, 72 bp, Homo sapiens
ctgcagggcaaggaaaatcttcgagacattttttttgaaatgtatcagtgatttgcttgcagccactgacag

SEQ ID NO: 6845344 - DNA, 56 bp, Homo sapiens
cctgagctttaaaagccatgtaccagtttgttcttttatggtttttgagcttgagg

SEQ ID NO: 6845345 - DNA, 65 bp, Homo sapiens
tagtggcaggaaaggccatatttggagcttcaaatacacagtcccagtggcagttcttgcctctg

SEQ ID NO: 6845346 - DNA, 69 bp, Homo sapiens
ggtccctgcatggcagctcctccagtgtgatggagtgtgagatctcgctgaagaagctgcacatggact

SEQ ID NO: 6845347 - DNA, 69 bp, Homo sapiens
tggctaaaaatccacactaggtgaaagctcttgaaagactgattcataacccagggtggtttttatcca

SEQ ID NO: 6845348 - DNA, 61 bp, Homo sapiens
gtggcctccctgcctggagttgggttcctatgccttccagtgactaaggaggaaattccat

SEQ ID NO: 6845349 - DNA, 57 bp, Homo sapiens
attgtcttctggtcttatcttttctattggatcaggaactataagacagaagacaat

SEQ ID NO: 6845350 - DNA, 102 bp, Homo sapiens
cgtcctcccctcccctccaggcagatctggatcgccggcgcctgggcttagggaactggggcttggagcccgcggtccacgggcgcaggggcggggcgggcg
